United States Patent 11,369,692 (MATERIALS AND METHODS FOR TREATMENT OF DUCHENNE MUSCULAR DYSTROPHY) - sequence listing, part 35

SEQ ID NO: 1157802 - DNA, 22 bp, Artificial Sequence
  chemically synthesized
ggtctcatactaattgaaaata

SEQ ID NO: 1157803 - DNA, 22 bp, Artificial Sequence
  chemically synthesized
gtctcatactaattgaaaataa

SEQ ID NO: 1157804 - DNA, 22 bp, Artificial Sequence
  chemically synthesized
gcaaaaatttcaatttattttc

SEQ ID NO: 1157805 - DNA, 22 bp, Artificial Sequence
  chemically synthesized
atactaattgaaaataaattga

SEQ ID NO: 1157806 - DNA, 22 bp, Artificial Sequence
  chemically synthesized
ctggcaaaaatttcaatttatt

SEQ ID NO: 1157807 - DNA, 22 bp, Artificial Sequence
  chemically synthesized
actactggcaaaaatttcaatt

SEQ ID NO: 1157808 - DNA, 22 bp, Artificial Sequence
  chemically synthesized
aactactggcaaaaatttcaat

SEQ ID NO: 1157809 - DNA, 22 bp, Artificial Sequence
  chemically synthesized
attgaaaataaattgaaatttt

SEQ ID NO: 1157810 - DNA, 22 bp, Artificial Sequence
  chemically synthesized
taactactggcaaaaatttcaa

SEQ ID NO: 1157811 - DNA, 22 bp, Artificial Sequence
  chemically synthesized
aaaataaattgaaatttttgcc

SEQ ID NO: 1157812 - DNA, 22 bp, Artificial Sequence
  chemically synthesized
aaattttaactactggcaaaaa

SEQ ID NO: 1157813 - DNA, 22 bp, Artificial Sequence
  chemically synthesized
atatctcaaattttaactactg

SEQ ID NO: 1157814 - DNA, 22 bp, Artificial Sequence
  chemically synthesized
aaatttttgccagtagttaaaa

SEQ ID NO: 1157815 - DNA, 22 bp, Artificial Sequence
  chemically synthesized
tagctaatatctcaaattttaa

SEQ ID NO: 1157816 - DNA, 22 bp, Artificial Sequence
  chemically synthesized
gtagctaatatctcaaatttta

SEQ ID NO: 1157817 - DNA, 22 bp, Artificial Sequence
  chemically synthesized
ttgccagtagttaaaatttgag

SEQ ID NO: 1157818 - DNA, 22 bp, Artificial Sequence
  chemically synthesized
tgccagtagttaaaatttgaga

SEQ ID NO: 1157819 - DNA, 22 bp, Artificial Sequence
  chemically synthesized
gccagtagttaaaatttgagat

SEQ ID NO: 1157820 - DNA, 22 bp, Artificial Sequence
  chemically synthesized
ccagtagttaaaatttgagata

SEQ ID NO: 1157821 - DNA, 22 bp, Artificial Sequence
  chemically synthesized
atatttgtagctaatatctcaa

SEQ ID NO: 1157822 - DNA, 22 bp, Artificial Sequence
  chemically synthesized
gatatttgtagctaatatctca

SEQ ID NO: 1157823 - DNA, 22 bp, Artificial Sequence
  chemically synthesized
aaatttgagatattagctacaa

SEQ ID NO: 1157824 - DNA, 22 bp, Artificial Sequence
  chemically synthesized
gagatattagctacaaatatca

SEQ ID NO: 1157825 - DNA, 22 bp, Artificial Sequence
  chemically synthesized
agatattagctacaaatatcaa

SEQ ID NO: 1157826 - DNA, 22 bp, Artificial Sequence
  chemically synthesized
gctacaaatatcaaatctgacc

SEQ ID NO: 1157827 - DNA, 22 bp, Artificial Sequence
  chemically synthesized
aatatgatcaagagtggtcaga

SEQ ID NO: 1157828 - DNA, 22 bp, Artificial Sequence
  chemically synthesized
caaatatcaaatctgaccactc

SEQ ID NO: 1157829 - DNA, 22 bp, Artificial Sequence
  chemically synthesized
ttaaatatgatcaagagtggtc

SEQ ID NO: 1157830 - DNA, 22 bp, Artificial Sequence
  chemically synthesized
aatcctattaaatatgatcaag

SEQ ID NO: 1157831 - DNA, 22 bp, Artificial Sequence
  chemically synthesized
ctgaatcctattaaatatgatc

SEQ ID NO: 1157832 - DNA, 22 bp, Artificial Sequence
  chemically synthesized
accactcttgatcatatttaat

SEQ ID NO: 1157833 - DNA, 22 bp, Artificial Sequence
  chemically synthesized
gggttgctgaatcctattaaat

SEQ ID NO: 1157834 - DNA, 22 bp, Artificial Sequence
  chemically synthesized
agggttgctgaatcctattaaa

SEQ ID NO: 1157835 - DNA, 22 bp, Artificial Sequence
  chemically synthesized
ttgatcatatttaataggattc

SEQ ID NO: 1157836 - DNA, 22 bp, Artificial Sequence
  chemically synthesized
gatcatatttaataggattcag

SEQ ID NO: 1157837 - DNA, 22 bp, Artificial Sequence
  chemically synthesized
atcatatttaataggattcagc

SEQ ID NO: 1157838 - DNA, 22 bp, Artificial Sequence
  chemically synthesized
aataggattcagcaaccctaaa

SEQ ID NO: 1157839 - DNA, 22 bp, Artificial Sequence
  chemically synthesized
taggaaggaaggtttagggttg

SEQ ID NO: 1157840 - DNA, 22 bp, Artificial Sequence
  chemically synthesized
ataggattcagcaaccctaaac

SEQ ID NO: 1157841 - DNA, 22 bp, Artificial Sequence
  chemically synthesized
tcctataggaaggaaggtttag

SEQ ID NO: 1157842 - DNA, 22 bp, Artificial Sequence
  chemically synthesized
gtcctataggaaggaaggttta

SEQ ID NO: 1157843 - DNA, 22 bp, Artificial Sequence
  chemically synthesized
tgtcctataggaaggaaggttt

SEQ ID NO: 1157844 - DNA, 22 bp, Artificial Sequence
  chemically synthesized
agcaaccctaaaccttccttcc

SEQ ID NO: 1157845 - DNA, 22 bp, Artificial Sequence
  chemically synthesized
aattttgtcctataggaaggaa

SEQ ID NO: 1157846 - DNA, 22 bp, Artificial Sequence
  chemically synthesized
atactcaattttgtcctatagg

SEQ ID NO: 1157847 - DNA, 22 bp, Artificial Sequence
  chemically synthesized
aaccttccttcctataggacaa

SEQ ID NO: 1157848 - DNA, 22 bp, Artificial Sequence
  chemically synthesized
ccttcctataggacaaaattga

SEQ ID NO: 1157849 - DNA, 22 bp, Artificial Sequence
  chemically synthesized
cttcctataggacaaaattgag

SEQ ID NO: 1157850 - DNA, 22 bp, Artificial Sequence
  chemically synthesized
cctataggacaaaattgagtat

SEQ ID NO: 1157851 - DNA, 22 bp, Artificial Sequence
  chemically synthesized
ctataggacaaaattgagtatc

SEQ ID NO: 1157852 - DNA, 22 bp, Artificial Sequence
  chemically synthesized
taggacaaaattgagtatcaat

SEQ ID NO: 1157853 - DNA, 22 bp, Artificial Sequence
  chemically synthesized
gatgtgaagtataattgatact

SEQ ID NO: 1157854 - DNA, 22 bp, Artificial Sequence
  chemically synthesized
agtatcaattatacttcacatc

SEQ ID NO: 1157855 - DNA, 22 bp, Artificial Sequence
  chemically synthesized
gatgcgaagtataattggatgt

SEQ ID NO: 1157856 - DNA, 22 bp, Artificial Sequence
  chemically synthesized
tacttcacatccaattatactt

SEQ ID NO: 1157857 - DNA, 22 bp, Artificial Sequence
  chemically synthesized
cacatccaattatacttcgcat

SEQ ID NO: 1157858 - DNA, 22 bp, Artificial Sequence
  chemically synthesized
acatccaattatacttcgcatc

SEQ ID NO: 1157859 - DNA, 22 bp, Artificial Sequence
  chemically synthesized
tatatgaagtataattggatgc

SEQ ID NO: 1157860 - DNA, 22 bp, Artificial Sequence
  chemically synthesized
gtatatgaagtataattggatg

SEQ ID NO: 1157861 - DNA, 22 bp, Artificial Sequence
  chemically synthesized
tgtatatgaagtataattggat

SEQ ID NO: 1157862 - DNA, 22 bp, Artificial Sequence
  chemically synthesized
tacttcgcatccaattatactt

SEQ ID NO: 1157863 - DNA, 22 bp, Artificial Sequence
  chemically synthesized
tactttgtatatgaagtataat

SEQ ID NO: 1157864 - DNA, 22 bp, Artificial Sequence
  chemically synthesized
atactttgtatatgaagtataa

SEQ ID NO: 1157865 - DNA, 22 bp, Artificial Sequence
  chemically synthesized
cgcatccaattatacttcatat

SEQ ID NO: 1157866 - DNA, 22 bp, Artificial Sequence
  chemically synthesized
gcatccaattatacttcatata

SEQ ID NO: 1157867 - DNA, 22 bp, Artificial Sequence
  chemically synthesized
gagagcttatactttgtatatg

SEQ ID NO: 1157868 - DNA, 22 bp, Artificial Sequence
  chemically synthesized
tacttcatatacaaagtataag

SEQ ID NO: 1157869 - DNA, 22 bp, Artificial Sequence
  chemically synthesized
cagcaaactggagagcttatac

SEQ ID NO: 1157870 - DNA, 22 bp, Artificial Sequence
  chemically synthesized
catatacaaagtataagctctc

SEQ ID NO: 1157871 - DNA, 22 bp, Artificial Sequence
  chemically synthesized
atatacaaagtataagctctcc

SEQ ID NO: 1157872 - DNA, 22 bp, Artificial Sequence
  chemically synthesized
tccagtttgctgtagtcctcat

SEQ ID NO: 1157873 - DNA, 22 bp, Artificial Sequence
  chemically synthesized
cagtttgctgtagtcctcatca

SEQ ID NO: 1157874 - DNA, 22 bp, Artificial Sequence
  chemically synthesized
gctgtagtcctcatcactccct

SEQ ID NO: 1157875 - DNA, 22 bp, Artificial Sequence
  chemically synthesized
ctgtagtcctcatcactcccta

SEQ ID NO: 1157876 - DNA, 22 bp, Artificial Sequence
  chemically synthesized
cgtataaaaaaggatagggagt

SEQ ID NO: 1157877 - DNA, 22 bp, Artificial Sequence
  chemically synthesized
tagtcctcatcactccctatcc

SEQ ID NO: 1157878 - DNA, 22 bp, Artificial Sequence
  chemically synthesized
atcactccctatccttttttat

SEQ ID NO: 1157879 - DNA, 22 bp, Artificial Sequence
  chemically synthesized
cctatccttttttatacgcaac

SEQ ID NO: 1157880 - DNA, 22 bp, Artificial Sequence
  chemically synthesized
tccttttttatacgcaactcat

SEQ ID NO: 1157881 - DNA, 22 bp, Artificial Sequence
  chemically synthesized
ttttatacgcaactcatctcac

SEQ ID NO: 1157882 - DNA, 22 bp, Artificial Sequence
  chemically synthesized
tttatacgcaactcatctcact

SEQ ID NO: 1157883 - DNA, 22 bp, Artificial Sequence
  chemically synthesized
ttatacgcaactcatctcactt

SEQ ID NO: 1157884 - DNA, 22 bp, Artificial Sequence
  chemically synthesized
tatacgcaactcatctcacttc

SEQ ID NO: 1157885 - DNA, 22 bp, Artificial Sequence
  chemically synthesized
atacgcaactcatctcacttcc

SEQ ID NO: 1157886 - DNA, 22 bp, Artificial Sequence
  chemically synthesized
tacgcaactcatctcacttcct

SEQ ID NO: 1157887 - DNA, 22 bp, Artificial Sequence
  chemically synthesized
atctcacttccttatgttatgt

SEQ ID NO: 1157888 - DNA, 22 bp, Artificial Sequence
  chemically synthesized
tagaagccagaaacataacata

SEQ ID NO: 1157889 - DNA, 22 bp, Artificial Sequence
  chemically synthesized
ttgtagaagccagaaacataac

SEQ ID NO: 1157890 - DNA, 22 bp, Artificial Sequence
  chemically synthesized
acttccttatgttatgtttctg

SEQ ID NO: 1157891 - DNA, 22 bp, Artificial Sequence
  chemically synthesized
ccttatgttatgtttctggctt

SEQ ID NO: 1157892 - DNA, 22 bp, Artificial Sequence
  chemically synthesized
cttatgttatgtttctggcttc

SEQ ID NO: 1157893 - DNA, 22 bp, Artificial Sequence
  chemically synthesized
atgttatgtttctggcttctac

SEQ ID NO: 1157894 - DNA, 22 bp, Artificial Sequence
  chemically synthesized
tgttatgtttctggcttctaca

SEQ ID NO: 1157895 - DNA, 22 bp, Artificial Sequence
  chemically synthesized
tgtttctggcttctacaatagg

SEQ ID NO: 1157896 - DNA, 22 bp, Artificial Sequence
  chemically synthesized
ctggcttctacaataggcattt

SEQ ID NO: 1157897 - DNA, 22 bp, Artificial Sequence
  chemically synthesized
tggcttctacaataggcatttg

SEQ ID NO: 1157898 - DNA, 22 bp, Artificial Sequence
  chemically synthesized
gcttctacaataggcatttgga

SEQ ID NO: 1157899 - DNA, 22 bp, Artificial Sequence
  chemically synthesized
ctacaataggcatttggatttg

SEQ ID NO: 1157900 - DNA, 22 bp, Artificial Sequence
  chemically synthesized
tacaataggcatttggatttgg

SEQ ID NO: 1157901 - DNA, 22 bp, Artificial Sequence
  chemically synthesized
caataggcatttggatttggtg

SEQ ID NO: 1157902 - DNA, 22 bp, Artificial Sequence
  chemically synthesized
tgatcaagaccccggggggcac

SEQ ID NO: 1157903 - DNA, 22 bp, Artificial Sequence
  chemically synthesized
ggatttggtgccccccggggtc

SEQ ID NO: 1157904 - DNA, 22 bp, Artificial Sequence
  chemically synthesized
gatttggtgccccccggggtct

SEQ ID NO: 1157905 - DNA, 22 bp, Artificial Sequence
  chemically synthesized
agaagctgtgatcaagaccccg

SEQ ID NO: 1157906 - DNA, 22 bp, Artificial Sequence
  chemically synthesized
gagaagctgtgatcaagacccc

SEQ ID NO: 1157907 - DNA, 22 bp, Artificial Sequence
  chemically synthesized
ggtgccccccggggtcttgatc

SEQ ID NO: 1157908 - DNA, 22 bp, Artificial Sequence
  chemically synthesized
gtgccccccggggtcttgatca

SEQ ID NO: 1157909 - DNA, 22 bp, Artificial Sequence
  chemically synthesized
agtttgagaagctgtgatcaag

SEQ ID NO: 1157910 - DNA, 22 bp, Artificial Sequence
  chemically synthesized
aagtttgagaagctgtgatcaa

SEQ ID NO: 1157911 - DNA, 22 bp, Artificial Sequence
  chemically synthesized
tatccatatttaagtttgagaa

SEQ ID NO: 1157912 - DNA, 22 bp, Artificial Sequence
  chemically synthesized
gatcacagcttctcaaacttaa

SEQ ID NO: 1157913 - DNA, 22 bp, Artificial Sequence
  chemically synthesized
atcacagcttctcaaacttaaa

SEQ ID NO: 1157914 - DNA, 22 bp, Artificial Sequence
  chemically synthesized
ctcaaacttaaatatggataca

SEQ ID NO: 1157915 - DNA, 22 bp, Artificial Sequence
  chemically synthesized
tcaaacttaaatatggatacag

SEQ ID NO: 1157916 - DNA, 22 bp, Artificial Sequence
  chemically synthesized
aaacttaaatatggatacagcc

SEQ ID NO: 1157917 - DNA, 22 bp, Artificial Sequence
  chemically synthesized
aaatatggatacagcccacctg

SEQ ID NO: 1157918 - DNA, 22 bp, Artificial Sequence
  chemically synthesized
aatcagaatcaccaggtgggct

SEQ ID NO: 1157919 - DNA, 22 bp, Artificial Sequence
  chemically synthesized
aatatggatacagcccacctgg

SEQ ID NO: 1157920 - DNA, 22 bp, Artificial Sequence
  chemically synthesized
aaatcagaatcaccaggtgggc

SEQ ID NO: 1157921 - DNA, 22 bp, Artificial Sequence
  chemically synthesized
gacccaaccccgtgaatttaaa

SEQ ID NO: 1157922 - DNA, 22 bp, Artificial Sequence
  chemically synthesized
cgacccaaccccgtgaatttaa

SEQ ID NO: 1157923 - DNA, 22 bp, Artificial Sequence
  chemically synthesized
gtgattctgatttaaattcacg

SEQ ID NO: 1157924 - DNA, 22 bp, Artificial Sequence
  chemically synthesized
ttcgacccaaccccgtgaattt

SEQ ID NO: 1157925 - DNA, 22 bp, Artificial Sequence
  chemically synthesized
aattcttcgacccaaccccgtg

SEQ ID NO: 1157926 - DNA, 22 bp, Artificial Sequence
  chemically synthesized
tgatttaaattcacggggttgg

SEQ ID NO: 1157927 - DNA, 22 bp, Artificial Sequence
  chemically synthesized
atttaaattcacggggttgggt

SEQ ID NO: 1157928 - DNA, 22 bp, Artificial Sequence
  chemically synthesized
gaactgaattcttcgacccaac

SEQ ID NO: 1157929 - DNA, 22 bp, Artificial Sequence
  chemically synthesized
aaattcacggggttgggtcgaa

SEQ ID NO: 1157930 - DNA, 22 bp, Artificial Sequence
  chemically synthesized
aattcacggggttgggtcgaag

SEQ ID NO: 1157931 - DNA, 22 bp, Artificial Sequence
  chemically synthesized
gttagaactgaattcttcgacc

SEQ ID NO: 1157932 - DNA, 22 bp, Artificial Sequence
  chemically synthesized
acggggttgggtcgaagaattc

SEQ ID NO: 1157933 - DNA, 22 bp, Artificial Sequence
  chemically synthesized
gaagctggttagaactgaattc

SEQ ID NO: 1157934 - DNA, 22 bp, Artificial Sequence
  chemically synthesized
ggtcgaagaattcagttctaac

SEQ ID NO: 1157935 - DNA, 22 bp, Artificial Sequence
  chemically synthesized
acctggaagctggttagaactg

SEQ ID NO: 1157936 - DNA, 22 bp, Artificial Sequence
  chemically synthesized
cacctggaagctggttagaact

SEQ ID NO: 1157937 - DNA, 22 bp, Artificial Sequence
  chemically synthesized
gtttcacctggaagctggttag

SEQ ID NO: 1157938 - DNA, 22 bp, Artificial Sequence
  chemically synthesized
agttctaaccagcttccaggtg

SEQ ID NO: 1157939 - DNA, 22 bp, Artificial Sequence
  chemically synthesized
taaccagcttccaggtgaaacc

SEQ ID NO: 1157940 - DNA, 22 bp, Artificial Sequence
  chemically synthesized
accagcttccaggtgaaaccaa

SEQ ID NO: 1157941 - DNA, 22 bp, Artificial Sequence
  chemically synthesized
ccaggtgaaaccaatgttgctg

SEQ ID NO: 1157942 - DNA, 22 bp, Artificial Sequence
  chemically synthesized
caggtgaaaccaatgttgctgg

SEQ ID NO: 1157943 - DNA, 22 bp, Artificial Sequence
  chemically synthesized
aaagtgtgatccatgacccagc

SEQ ID NO: 1157944 - DNA, 22 bp, Artificial Sequence
  chemically synthesized
tcattcaaagtgtgatccatga

SEQ ID NO: 1157945 - DNA, 22 bp, Artificial Sequence
  chemically synthesized
ctgggtcatggatcacactttg

SEQ ID NO: 1157946 - DNA, 22 bp, Artificial Sequence
  chemically synthesized
gaatgttgtcattcaaagtgtg

SEQ ID NO: 1157947 - DNA, 22 bp, Artificial Sequence
  chemically synthesized
ggtcatggatcacactttgaat

SEQ ID NO: 1157948 - DNA, 22 bp, Artificial Sequence
  chemically synthesized
cctggaatgttgtcattcaaag

SEQ ID NO: 1157949 - DNA, 22 bp, Artificial Sequence
  chemically synthesized
acctggaatgttgtcattcaaa

SEQ ID NO: 1157950 - DNA, 22 bp, Artificial Sequence
  chemically synthesized
ttacctggaatgttgtcattca

SEQ ID NO: 1157951 - DNA, 22 bp, Artificial Sequence
  chemically synthesized
tgaatgacaacattccaggtaa

SEQ ID NO: 1157952 - DNA, 22 bp, Artificial Sequence
  chemically synthesized
gaatgacaacattccaggtaag

SEQ ID NO: 1157953 - DNA, 22 bp, Artificial Sequence
  chemically synthesized
aatgacaacattccaggtaaga

SEQ ID NO: 1157954 - DNA, 22 bp, Artificial Sequence
  chemically synthesized
aaataaataatattcttacctg

SEQ ID NO: 1157955 - DNA, 22 bp, Artificial Sequence
  chemically synthesized
caaataaataatattcttacct

SEQ ID NO: 1157956 - DNA, 22 bp, Artificial Sequence
  chemically synthesized
tcaaataaataatattcttacc

SEQ ID NO: 1157957 - DNA, 22 bp, Artificial Sequence
  chemically synthesized
caggtaagaatattatttattt

SEQ ID NO: 1157958 - DNA, 22 bp, Artificial Sequence
  chemically synthesized
gcagtggttttcaaataaataa

SEQ ID NO: 1157959 - DNA, 22 bp, Artificial Sequence
  chemically synthesized
agtagactagcagtggttttca

SEQ ID NO: 1157960 - DNA, 22 bp, Artificial Sequence
  chemically synthesized
aagtagactagcagtggttttc

SEQ ID NO: 1157961 - DNA, 22 bp, Artificial Sequence
  chemically synthesized
tttatttgaaaaccactgctag

SEQ ID NO: 1157962 - DNA, 22 bp, Artificial Sequence
  chemically synthesized
atttgaaaaccactgctagtct

SEQ ID NO: 1157963 - DNA, 22 bp, Artificial Sequence
  chemically synthesized
tttgaaaaccactgctagtcta

SEQ ID NO: 1157964 - DNA, 22 bp, Artificial Sequence
  chemically synthesized
gaaaaccactgctagtctactt

SEQ ID NO: 1157965 - DNA, 22 bp, Artificial Sequence
  chemically synthesized
aaaaccactgctagtctactta

SEQ ID NO: 1157966 - DNA, 22 bp, Artificial Sequence
  chemically synthesized
atagatcgaacacataccttaa

SEQ ID NO: 1157967 - DNA, 22 bp, Artificial Sequence
  chemically synthesized
ctagtctacttaaggtatgtgt

SEQ ID NO: 1157968 - DNA, 22 bp, Artificial Sequence
  chemically synthesized
gtctacttaaggtatgtgttcg

SEQ ID NO: 1157969 - DNA, 22 bp, Artificial Sequence
  chemically synthesized
cttaaggtatgtgttcgatcta

SEQ ID NO: 1157970 - DNA, 22 bp, Artificial Sequence
  chemically synthesized
gcagtagtaactaatagatcga

SEQ ID NO: 1157971 - DNA, 22 bp, Artificial Sequence
  chemically synthesized
aaggtatgtgttcgatctatta

SEQ ID NO: 1157972 - DNA, 22 bp, Artificial Sequence
  chemically synthesized
agcagtagtaactaatagatcg

SEQ ID NO: 1157973 - DNA, 22 bp, Artificial Sequence
  chemically synthesized
aggtatgtgttcgatctattag

SEQ ID NO: 1157974 - DNA, 22 bp, Artificial Sequence
  chemically synthesized
tagcagtagtaactaatagatc

SEQ ID NO: 1157975 - DNA, 22 bp, Artificial Sequence
  chemically synthesized
agttttagcagtagtaactaat

SEQ ID NO: 1157976 - DNA, 22 bp, Artificial Sequence
  chemically synthesized
tgagttttagcagtagtaacta

SEQ ID NO: 1157977 - DNA, 22 bp, Artificial Sequence
  chemically synthesized
ctgagttttagcagtagtaact

SEQ ID NO: 1157978 - DNA, 22 bp, Artificial Sequence
  chemically synthesized
gatctattagttactactgcta

SEQ ID NO: 1157979 - DNA, 22 bp, Artificial Sequence
  chemically synthesized
tatcttctgagttttagcagta

SEQ ID NO: 1157980 - DNA, 22 bp, Artificial Sequence
  chemically synthesized
ttagttactactgctaaaactc

SEQ ID NO: 1157981 - DNA, 22 bp, Artificial Sequence
  chemically synthesized
gttactactgctaaaactcaga

SEQ ID NO: 1157982 - DNA, 22 bp, Artificial Sequence
  chemically synthesized
ctactgctaaaactcagaagat

SEQ ID NO: 1157983 - DNA, 22 bp, Artificial Sequence
  chemically synthesized
ctgctaaaactcagaagatata

SEQ ID NO: 1157984 - DNA, 22 bp, Artificial Sequence
  chemically synthesized
ctaaaactcagaagatatagat

SEQ ID NO: 1157985 - DNA, 22 bp, Artificial Sequence
  chemically synthesized
ccagtgtcacataaatctatat

SEQ ID NO: 1157986 - DNA, 22 bp, Artificial Sequence
  chemically synthesized
aaactcagaagatatagattta

SEQ ID NO: 1157987 - DNA, 22 bp, Artificial Sequence
  chemically synthesized
cctgccagtgtcacataaatct

SEQ ID NO: 1157988 - DNA, 22 bp, Artificial Sequence
  chemically synthesized
ccctgccagtgtcacataaatc

SEQ ID NO: 1157989 - DNA, 22 bp, Artificial Sequence
  chemically synthesized
agaagatatagatttatgtgac

SEQ ID NO: 1157990 - DNA, 22 bp, Artificial Sequence
  chemically synthesized
atacttccctgccagtgtcaca

SEQ ID NO: 1157991 - DNA, 22 bp, Artificial Sequence
  chemically synthesized
gatacttccctgccagtgtcac

SEQ ID NO: 1157992 - DNA, 22 bp, Artificial Sequence
  chemically synthesized
tgatacttccctgccagtgtca

SEQ ID NO: 1157993 - DNA, 22 bp, Artificial Sequence
  chemically synthesized
ataccctttgatacttccctgc

SEQ ID NO: 1157994 - DNA, 22 bp, Artificial Sequence
  chemically synthesized
atgtgacactggcagggaagta

SEQ ID NO: 1157995 - DNA, 22 bp, Artificial Sequence
  chemically synthesized
tgtgacactggcagggaagtat

SEQ ID NO: 1157996 - DNA, 22 bp, Artificial Sequence
  chemically synthesized
agtctgataccctttgatactt

SEQ ID NO: 1157997 - DNA, 22 bp, Artificial Sequence
  chemically synthesized
tgagtctgataccctttgatac

SEQ ID NO: 1157998 - DNA, 22 bp, Artificial Sequence
  chemically synthesized
gcagggaagtatcaaagggtat

SEQ ID NO: 1157999 - DNA, 22 bp, Artificial Sequence
  chemically synthesized
ggcattctgagtctgataccct

SEQ ID NO: 1158000 - DNA, 22 bp, Artificial Sequence
  chemically synthesized
gggcattctgagtctgataccc

SEQ ID NO: 1158001 - DNA, 22 bp, Artificial Sequence
  chemically synthesized
aagggcatacttgggcattctg

SEQ ID NO: 1158002 - DNA, 22 bp, Artificial Sequence
  chemically synthesized
ctgaagggcatacttgggcatt

SEQ ID NO: 1158003 - DNA, 22 bp, Artificial Sequence
  chemically synthesized
actgaagggcatacttgggcat

SEQ ID NO: 1158004 - DNA, 22 bp, Artificial Sequence
  chemically synthesized
tactgaagggcatacttgggca

SEQ ID NO: 1158005 - DNA, 22 bp, Artificial Sequence
  chemically synthesized
ctttactgaagggcatacttgg

SEQ ID NO: 1158006 - DNA, 22 bp, Artificial Sequence
  chemically synthesized
actttactgaagggcatacttg

SEQ ID NO: 1158007 - DNA, 22 bp, Artificial Sequence
  chemically synthesized
cttactttactgaagggcatac

SEQ ID NO: 1158008 - DNA, 22 bp, Artificial Sequence
  chemically synthesized
agaatgcccaagtatgcccttc

SEQ ID NO: 1158009 - DNA, 22 bp, Artificial Sequence
  chemically synthesized
ccttactttactgaagggcata

SEQ ID NO: 1158010 - DNA, 22 bp, Artificial Sequence
  chemically synthesized
taataaagcccttccttacttt

SEQ ID NO: 1158011 - DNA, 22 bp, Artificial Sequence
  chemically synthesized
cagtaaagtaaggaagggcttt

SEQ ID NO: 1158012 - DNA, 22 bp, Artificial Sequence
  chemically synthesized
agtaaagtaaggaagggcttta

SEQ ID NO: 1158013 - DNA, 22 bp, Artificial Sequence
  chemically synthesized
acatatcagtactgtaataaag

SEQ ID NO: 1158014 - DNA, 22 bp, Artificial Sequence
  chemically synthesized
cacatatcagtactgtaataaa

SEQ ID NO: 1158015 - DNA, 22 bp, Artificial Sequence
  chemically synthesized
tcacatatcagtactgtaataa

SEQ ID NO: 1158016 - DNA, 22 bp, Artificial Sequence
  chemically synthesized
ttcacatatcagtactgtaata

SEQ ID NO: 1158017 - DNA, 22 bp, Artificial Sequence
  chemically synthesized
gagtttttcacatatcagtact

SEQ ID NO: 1158018 - DNA, 22 bp, Artificial Sequence
  chemically synthesized
agagtttttcacatatcagtac

SEQ ID NO: 1158019 - DNA, 22 bp, Artificial Sequence
  chemically synthesized
tagagtttttcacatatcagta

SEQ ID NO: 1158020 - DNA, 22 bp, Artificial Sequence
  chemically synthesized
tattacagtactgatatgtgaa

SEQ ID NO: 1158021 - DNA, 22 bp, Artificial Sequence
  chemically synthesized
attacagtactgatatgtgaaa

SEQ ID NO: 1158022 - DNA, 22 bp, Artificial Sequence
  chemically synthesized
ttacagtactgatatgtgaaaa

SEQ ID NO: 1158023 - DNA, 22 bp, Artificial Sequence
  chemically synthesized
aatctttagagtttttcacata

SEQ ID NO: 1158024 - DNA, 22 bp, Artificial Sequence
  chemically synthesized
caatctttagagtttttcacat

SEQ ID NO: 1158025 - DNA, 22 bp, Artificial Sequence
  chemically synthesized
cagtactgatatgtgaaaaact

SEQ ID NO: 1158026 - DNA, 22 bp, Artificial Sequence
  chemically synthesized
tttcaatctttagagtttttca

SEQ ID NO: 1158027 - DNA, 22 bp, Artificial Sequence
  chemically synthesized
gttatttcaatctttagagttt

SEQ ID NO: 1158028 - DNA, 22 bp, Artificial Sequence
  chemically synthesized
atatgtgaaaaactctaaagat

SEQ ID NO: 1158029 - DNA, 22 bp, Artificial Sequence
  chemically synthesized
ctagttatttcaatctttagag

SEQ ID NO: 1158030 - DNA, 22 bp, Artificial Sequence
  chemically synthesized
attactagttatttcaatcttt

SEQ ID NO: 1158031 - DNA, 22 bp, Artificial Sequence
  chemically synthesized
cattactagttatttcaatctt

SEQ ID NO: 1158032 - DNA, 22 bp, Artificial Sequence
  chemically synthesized
ttcattactagttatttcaatc

SEQ ID NO: 1158033 - DNA, 22 bp, Artificial Sequence
  chemically synthesized
taaagattgaaataactagtaa

SEQ ID NO: 1158034 - DNA, 22 bp, Artificial Sequence
  chemically synthesized
aagattgaaataactagtaatg

SEQ ID NO: 1158035 - DNA, 22 bp, Artificial Sequence
  chemically synthesized
aaataactagtaatgaagagga

SEQ ID NO: 1158036 - DNA, 22 bp, Artificial Sequence
  chemically synthesized
agtgaaggaaggaagcgtcctc

SEQ ID NO: 1158037 - DNA, 22 bp, Artificial Sequence
  chemically synthesized
gtaatgaagaggacgcttcctt

SEQ ID NO: 1158038 - DNA, 22 bp, Artificial Sequence
  chemically synthesized
acaggcctcagtgaaggaagga

SEQ ID NO: 1158039 - DNA, 22 bp, Artificial Sequence
  chemically synthesized
cacaggcctcagtgaaggaagg

SEQ ID NO: 1158040 - DNA, 22 bp, Artificial Sequence
  chemically synthesized
tcacaggcctcagtgaaggaag

SEQ ID NO: 1158041 - DNA, 22 bp, Artificial Sequence
  chemically synthesized
ttcacaggcctcagtgaaggaa

SEQ ID NO: 1158042 - DNA, 22 bp, Artificial Sequence
  chemically synthesized
ttttcacaggcctcagtgaagg

SEQ ID NO: 1158043 - DNA, 22 bp, Artificial Sequence
  chemically synthesized
atgctcttttcacaggcctcag

SEQ ID NO: 1158044 - DNA, 22 bp, Artificial Sequence
  chemically synthesized
ccttccttcactgaggcctgtg

SEQ ID NO: 1158045 - DNA, 22 bp, Artificial Sequence
  chemically synthesized
cttccttcactgaggcctgtga

SEQ ID NO: 1158046 - DNA, 22 bp, Artificial Sequence
  chemically synthesized
ctgatgctcttttcacaggcct

SEQ ID NO: 1158047 - DNA, 22 bp, Artificial Sequence
  chemically synthesized
actgatgctcttttcacaggcc

SEQ ID NO: 1158048 - DNA, 22 bp, Artificial Sequence
  chemically synthesized
tactgatgctcttttcacaggc

SEQ ID NO: 1158049 - DNA, 22 bp, Artificial Sequence
  chemically synthesized
ccttcactgaggcctgtgaaaa

SEQ ID NO: 1158050 - DNA, 22 bp, Artificial Sequence
  chemically synthesized
cttcactgaggcctgtgaaaag

SEQ ID NO: 1158051 - DNA, 22 bp, Artificial Sequence
  chemically synthesized
cactgaggcctgtgaaaagagc

SEQ ID NO: 1158052 - DNA, 22 bp, Artificial Sequence
  chemically synthesized
cactttactgatgctcttttca

SEQ ID NO: 1158053 - DNA, 22 bp, Artificial Sequence
  chemically synthesized
actgaggcctgtgaaaagagca

SEQ ID NO: 1158054 - DNA, 22 bp, Artificial Sequence
  chemically synthesized
aggcctgtgaaaagagcatcag

SEQ ID NO: 1158055 - DNA, 22 bp, Artificial Sequence
  chemically synthesized
acctgcactttactgatgctct

SEQ ID NO: 1158056 - DNA, 22 bp, Artificial Sequence
  chemically synthesized
taattcacctgcactttactga

SEQ ID NO: 1158057 - DNA, 22 bp, Artificial Sequence
  chemically synthesized
tgaaaagagcatcagtaaagtg

SEQ ID NO: 1158058 - DNA, 22 bp, Artificial Sequence
  chemically synthesized
gcctataattcacctgcacttt

SEQ ID NO: 1158059 - DNA, 22 bp, Artificial Sequence
  chemically synthesized
tggcctataattcacctgcact

SEQ ID NO: 1158060 - DNA, 22 bp, Artificial Sequence
  chemically synthesized
atcacccagaaaactctggcct

SEQ ID NO: 1158061 - DNA, 22 bp, Artificial Sequence
  chemically synthesized
ctaatcacccagaaaactctgg

SEQ ID NO: 1158062 - DNA, 22 bp, Artificial Sequence
  chemically synthesized
gctaatcacccagaaaactctg

SEQ ID NO: 1158063 - DNA, 22 bp, Artificial Sequence
  chemically synthesized
cttgctaatcacccagaaaact

SEQ ID NO: 1158064 - DNA, 22 bp, Artificial Sequence
  chemically synthesized
ccttgctaatcacccagaaaac

SEQ ID NO: 1158065 - DNA, 22 bp, Artificial Sequence
  chemically synthesized
taggccagagttttctgggtga

SEQ ID NO: 1158066 - DNA, 22 bp, Artificial Sequence
  chemically synthesized
acttccttgctaatcacccaga

SEQ ID NO: 1158067 - DNA, 22 bp, Artificial Sequence
  chemically synthesized
ctcacttccttgctaatcaccc

SEQ ID NO: 1158068 - DNA, 22 bp, Artificial Sequence
  chemically synthesized
tctgggtgattagcaaggaagt

SEQ ID NO: 1158069 - DNA, 22 bp, Artificial Sequence
  chemically synthesized
ctgggtgattagcaaggaagtg

SEQ ID NO: 1158070 - DNA, 22 bp, Artificial Sequence
  chemically synthesized
tgggtgattagcaaggaagtga

SEQ ID NO: 1158071 - DNA, 22 bp, Artificial Sequence
  chemically synthesized
ggtgattagcaaggaagtgagt

SEQ ID NO: 1158072 - DNA, 22 bp, Artificial Sequence
  chemically synthesized
caatggaccactactcacttcc

SEQ ID NO: 1158073 - DNA, 22 bp, Artificial Sequence
  chemically synthesized
gcaatggaccactactcacttc

SEQ ID NO: 1158074 - DNA, 22 bp, Artificial Sequence
  chemically synthesized
agccttgcaatggaccactact

SEQ ID NO: 1158075 - DNA, 22 bp, Artificial Sequence
  chemically synthesized
gcaaggaagtgagtagtggtcc

SEQ ID NO: 1158076 - DNA, 22 bp, Artificial Sequence
  chemically synthesized
gttcagccttgcaatggaccac

SEQ ID NO: 1158077 - DNA, 22 bp, Artificial Sequence
  chemically synthesized
tggttcagccttgcaatggacc

SEQ ID NO: 1158078 - DNA, 22 bp, Artificial Sequence
  chemically synthesized
ctctggttcagccttgcaatgg

SEQ ID NO: 1158079 - DNA, 22 bp, Artificial Sequence
  chemically synthesized
cctctggttcagccttgcaatg

SEQ ID NO: 1158080 - DNA, 22 bp, Artificial Sequence
  chemically synthesized
ttcctctggttcagccttgcaa

SEQ ID NO: 1158081 - DNA, 22 bp, Artificial Sequence
  chemically synthesized
cttcctctggttcagccttgca

SEQ ID NO: 1158082 - DNA, 22 bp, Artificial Sequence
  chemically synthesized
cttcttcctctggttcagcctt

SEQ ID NO: 1158083 - DNA, 22 bp, Artificial Sequence
  chemically synthesized
gcttcttcctctggttcagcct

SEQ ID NO: 1158084 - DNA, 22 bp, Artificial Sequence
  chemically synthesized
tgcttcttcctctggttcagcc

SEQ ID NO: 1158085 - DNA, 22 bp, Artificial Sequence
  chemically synthesized
aattttgcttcttcctctggtt

SEQ ID NO: 1158086 - DNA, 22 bp, Artificial Sequence
  chemically synthesized
caattttgcttcttcctctggt

SEQ ID NO: 1158087 - DNA, 22 bp, Artificial Sequence
  chemically synthesized
caaggctgaaccagaggaagaa

SEQ ID NO: 1158088 - DNA, 22 bp, Artificial Sequence
  chemically synthesized
cttcaattttgcttcttcctct

SEQ ID NO: 1158089 - DNA, 22 bp, Artificial Sequence
  chemically synthesized
aaccagaggaagaagcaaaatt

SEQ ID NO: 1158090 - DNA, 22 bp, Artificial Sequence
  chemically synthesized
atatcagtgcctccttcaattt

SEQ ID NO: 1158091 - DNA, 22 bp, Artificial Sequence
  chemically synthesized
tgatatcagtgcctccttcaat

SEQ ID NO: 1158092 - DNA, 22 bp, Artificial Sequence
  chemically synthesized
ctgatatcagtgcctccttcaa

SEQ ID NO: 1158093 - DNA, 22 bp, Artificial Sequence
  chemically synthesized
accttctgatatcagtgcctcc

SEQ ID NO: 1158094 - DNA, 22 bp, Artificial Sequence
  chemically synthesized
aactcaccttctgatatcagtg

SEQ ID NO: 1158095 - DNA, 22 bp, Artificial Sequence
  chemically synthesized
ttaaactcaccttctgatatca

SEQ ID NO: 1158096 - DNA, 22 bp, Artificial Sequence
  chemically synthesized
aaggaggcactgatatcagaag

SEQ ID NO: 1158097 - DNA, 22 bp, Artificial Sequence
  chemically synthesized
atatcagaaggtgagtttaaca

SEQ ID NO: 1158098 - DNA, 22 bp, Artificial Sequence
  chemically synthesized
tgtcatgaaggctgttaaactc

SEQ ID NO: 1158099 - DNA, 22 bp, Artificial Sequence
  chemically synthesized
gtgtcatgaaggctgttaaact

SEQ ID NO: 1158100 - DNA, 22 bp, Artificial Sequence
  chemically synthesized
ggaaaaaggacatttgtgtcat

SEQ ID NO: 1158101 - DNA, 22 bp, Artificial Sequence
  chemically synthesized
gggaaaaaggacatttgtgtca

SEQ ID NO: 1158102 - DNA, 22 bp, Artificial Sequence
  chemically synthesized
aacagccttcatgacacaaatg

SEQ ID NO: 1158103 - DNA, 22 bp, Artificial Sequence
  chemically synthesized
tgggaaaaaggacatttgtgtc

SEQ ID NO: 1158104 - DNA, 22 bp, Artificial Sequence
  chemically synthesized
acagccttcatgacacaaatgt

SEQ ID NO: 1158105 - DNA, 22 bp, Artificial Sequence
  chemically synthesized
catgacacaaatgtcctttttc

SEQ ID NO: 1158106 - DNA, 22 bp, Artificial Sequence
  chemically synthesized
aaccatctttgggaaaaaggac

SEQ ID NO: 1158107 - DNA, 22 bp, Artificial Sequence
  chemically synthesized
atgacacaaatgtcctttttcc

SEQ ID NO: 1158108 - DNA, 22 bp, Artificial Sequence
  chemically synthesized
aaaccatctttgggaaaaagga

SEQ ID NO: 1158109 - DNA, 22 bp, Artificial Sequence
  chemically synthesized
tttaaaccatctttgggaaaaa

SEQ ID NO: 1158110 - DNA, 22 bp, Artificial Sequence
  chemically synthesized
atttaaaccatctttgggaaaa

SEQ ID NO: 1158111 - DNA, 22 bp, Artificial Sequence
  chemically synthesized
tatttaaaccatctttgggaaa

SEQ ID NO: 1158112 - DNA, 22 bp, Artificial Sequence
  chemically synthesized
tttcccaaagatggtttaaata

SEQ ID NO: 1158113 - DNA, 22 bp, Artificial Sequence
  chemically synthesized
aagtcacccctttatttaaacc

SEQ ID NO: 1158114 - DNA, 22 bp, Artificial Sequence
  chemically synthesized
ttcccaaagatggtttaaataa

SEQ ID NO: 1158115 - DNA, 22 bp, Artificial Sequence
  chemically synthesized
tcccaaagatggtttaaataaa

SEQ ID NO: 1158116 - DNA, 22 bp, Artificial Sequence
  chemically synthesized
cccaaagatggtttaaataaag

SEQ ID NO: 1158117 - DNA, 22 bp, Artificial Sequence
  chemically synthesized
ccaaagatggtttaaataaagg

SEQ ID NO: 1158118 - DNA, 22 bp, Artificial Sequence
  chemically synthesized
cctgaagtcacccctttattta

SEQ ID NO: 1158119 - DNA, 22 bp, Artificial Sequence
  chemically synthesized
cccactccctgaagtcacccct

SEQ ID NO: 1158120 - DNA, 22 bp, Artificial Sequence
  chemically synthesized
acctccccactccctgaagtca

SEQ ID NO: 1158121 - DNA, 22 bp, Artificial Sequence
  chemically synthesized
aaataaaggggtgacttcaggg

SEQ ID NO: 1158122 - DNA, 22 bp, Artificial Sequence
  chemically synthesized
aataaaggggtgacttcaggga

SEQ ID NO: 1158123 - DNA, 22 bp, Artificial Sequence
  chemically synthesized
acccagaggttaacctccccac

SEQ ID NO: 1158124 - DNA, 22 bp, Artificial Sequence
  chemically synthesized
aacccagaggttaacctcccca

SEQ ID NO: 1158125 - DNA, 22 bp, Artificial Sequence
  chemically synthesized
taacccagaggttaacctcccc

SEQ ID NO: 1158126 - DNA, 22 bp, Artificial Sequence
  chemically synthesized
cagggagtggggaggttaacct

SEQ ID NO: 1158127 - DNA, 22 bp, Artificial Sequence
  chemically synthesized
agggagtggggaggttaacctc

SEQ ID NO: 1158128 - DNA, 22 bp, Artificial Sequence
  chemically synthesized
atgacattttaacccagaggtt

SEQ ID NO: 1158129 - DNA, 22 bp, Artificial Sequence
  chemically synthesized
atattaatgacattttaaccca

SEQ ID NO: 1158130 - DNA, 22 bp, Artificial Sequence
  chemically synthesized
caactaatattaatgacatttt

SEQ ID NO: 1158131 - DNA, 22 bp, Artificial Sequence
  chemically synthesized
acctctgggttaaaatgtcatt

SEQ ID NO: 1158132 - DNA, 22 bp, Artificial Sequence
  chemically synthesized
acaactaatattaatgacattt

SEQ ID NO: 1158133 - DNA, 22 bp, Artificial Sequence
  chemically synthesized
tacaactaatattaatgacatt

SEQ ID NO: 1158134 - DNA, 22 bp, Artificial Sequence
  chemically synthesized
tgggttaaaatgtcattaatat

SEQ ID NO: 1158135 - DNA, 22 bp, Artificial Sequence
  chemically synthesized
ggttaaaatgtcattaatatta

SEQ ID NO: 1158136 - DNA, 22 bp, Artificial Sequence
  chemically synthesized
aaatgtcattaatattagttgt

SEQ ID NO: 1158137 - DNA, 22 bp, Artificial Sequence
  chemically synthesized
gccagtgtattttacaactaat

SEQ ID NO: 1158138 - DNA, 22 bp, Artificial Sequence
  chemically synthesized
atattagttgtaaaatacactg

SEQ ID NO: 1158139 - DNA, 22 bp, Artificial Sequence
  chemically synthesized
aataaatgttagccagtgtatt

SEQ ID NO: 1158140 - DNA, 22 bp, Artificial Sequence
  chemically synthesized
gttgtaaaatacactggctaac

SEQ ID NO: 1158141 - DNA, 22 bp, Artificial Sequence
  chemically synthesized
taaaatacactggctaacattt

SEQ ID NO: 1158142 - DNA, 22 bp, Artificial Sequence
  chemically synthesized
aaaaaagttgaataaatgttag

SEQ ID NO: 1158143 - DNA, 22 bp, Artificial Sequence
  chemically synthesized
tgttaaaaaaagttgaataaat

SEQ ID NO: 1158144 - DNA, 22 bp, Artificial Sequence
  chemically synthesized
gctaacatttattcaacttttt

SEQ ID NO: 1158145 - DNA, 22 bp, Artificial Sequence
  chemically synthesized
gcaaggttatgttaaaaaaagt

SEQ ID NO: 1158146 - DNA, 22 bp, Artificial Sequence
  chemically synthesized
acatttattcaactttttttaa

SEQ ID NO: 1158147 - DNA, 22 bp, Artificial Sequence
  chemically synthesized
ggcaaggttatgttaaaaaaag

SEQ ID NO: 1158148 - DNA, 22 bp, Artificial Sequence
  chemically synthesized
ccttggcaaggttatgttaaaa

SEQ ID NO: 1158149 - DNA, 22 bp, Artificial Sequence
  chemically synthesized
accttggcaaggttatgttaaa

SEQ ID NO: 1158150 - DNA, 22 bp, Artificial Sequence
  chemically synthesized
attcaactttttttaacataac

SEQ ID NO: 1158151 - DNA, 22 bp, Artificial Sequence
  chemically synthesized
taccttggcaaggttatgttaa

SEQ ID NO: 1158152 - DNA, 22 bp, Artificial Sequence
  chemically synthesized
ttcaactttttttaacataacc

SEQ ID NO: 1158153 - DNA, 22 bp, Artificial Sequence
  chemically synthesized
aactttttttaacataaccttg

SEQ ID NO: 1158154 - DNA, 22 bp, Artificial Sequence
  chemically synthesized
taaatctttaccttggcaaggt

SEQ ID NO: 1158155 - DNA, 22 bp, Artificial Sequence
  chemically synthesized
tttttaacataaccttgccaag

SEQ ID NO: 1158156 - DNA, 22 bp, Artificial Sequence
  chemically synthesized
ttttaacataaccttgccaagg

SEQ ID NO: 1158157 - DNA, 22 bp, Artificial Sequence
  chemically synthesized
tttaacataaccttgccaaggt

SEQ ID NO: 1158158 - DNA, 22 bp, Artificial Sequence
  chemically synthesized
ttaacataaccttgccaaggta

SEQ ID NO: 1158159 - DNA, 22 bp, Artificial Sequence
  chemically synthesized
taacataaccttgccaaggtaa

SEQ ID NO: 1158160 - DNA, 22 bp, Artificial Sequence
  chemically synthesized
aacataaccttgccaaggtaaa

SEQ ID NO: 1158161 - DNA, 22 bp, Artificial Sequence
  chemically synthesized
gtattataaatctttaccttgg

SEQ ID NO: 1158162 - DNA, 22 bp, Artificial Sequence
  chemically synthesized
acataaccttgccaaggtaaag

SEQ ID NO: 1158163 - DNA, 22 bp, Artificial Sequence
  chemically synthesized
gccaaggtaaagatttataata

SEQ ID NO: 1158164 - DNA, 22 bp, Artificial Sequence
  chemically synthesized
ccaaggtaaagatttataatac

SEQ ID NO: 1158165 - DNA, 22 bp, Artificial Sequence
  chemically synthesized
aaaaaaaaaaaaaaaaatacta

SEQ ID NO: 1158166 - DNA, 22 bp, Artificial Sequence
  chemically synthesized
tctcaaaaaaaaaaaaaaaaat

SEQ ID NO: 1158167 - DNA, 22 bp, Artificial Sequence
  chemically synthesized
ataatactagtatttttttttt

SEQ ID NO: 1158168 - DNA, 22 bp, Artificial Sequence
  chemically synthesized
taatactagtattttttttttt

SEQ ID NO: 1158169 - DNA, 22 bp, Artificial Sequence
  chemically synthesized
gtatttttttttttttttttga

SEQ ID NO: 1158170 - DNA, 22 bp, Artificial Sequence
  chemically synthesized
ttttttttttttttgagacagg

SEQ ID NO: 1158171 - DNA, 22 bp, Artificial Sequence
  chemically synthesized
tttttttttttttgagacaggg

SEQ ID NO: 1158172 - DNA, 22 bp, Artificial Sequence
  chemically synthesized
ttttttttttttgagacagggt

SEQ ID NO: 1158173 - DNA, 22 bp, Artificial Sequence
  chemically synthesized
tttttttttttgagacagggtc

SEQ ID NO: 1158174 - DNA, 22 bp, Artificial Sequence
  chemically synthesized
ttttttttttgagacagggtct

SEQ ID NO: 1158175 - DNA, 22 bp, Artificial Sequence
  chemically synthesized
ggtaacagaatgagaccctgtc

SEQ ID NO: 1158176 - DNA, 22 bp, Artificial Sequence
  chemically synthesized
tttttttttgagacagggtctc

SEQ ID NO: 1158177 - DNA, 22 bp, Artificial Sequence
  chemically synthesized
ttttttttgagacagggtctca

SEQ ID NO: 1158178 - DNA, 22 bp, Artificial Sequence
  chemically synthesized
tttttttgagacagggtctcat

SEQ ID NO: 1158179 - DNA, 22 bp, Artificial Sequence
  chemically synthesized
ttttttgagacagggtctcatt

SEQ ID NO: 1158180 - DNA, 22 bp, Artificial Sequence
  chemically synthesized
tttttgagacagggtctcattc

SEQ ID NO: 1158181 - DNA, 22 bp, Artificial Sequence
  chemically synthesized
ttttgagacagggtctcattct

SEQ ID NO: 1158182 - DNA, 22 bp, Artificial Sequence
  chemically synthesized
tttgagacagggtctcattctg

SEQ ID NO: 1158183 - DNA, 22 bp, Artificial Sequence
  chemically synthesized
gagcctgggtaacagaatgaga

SEQ ID NO: 1158184 - DNA, 22 bp, Artificial Sequence
  chemically synthesized
ttgagacagggtctcattctgt

SEQ ID NO: 1158185 - DNA, 22 bp, Artificial Sequence
  chemically synthesized
tgagacagggtctcattctgtt

SEQ ID NO: 1158186 - DNA, 22 bp, Artificial Sequence
  chemically synthesized
gagacagggtctcattctgtta

SEQ ID NO: 1158187 - DNA, 22 bp, Artificial Sequence
  chemically synthesized
agacagggtctcattctgttac

SEQ ID NO: 1158188 - DNA, 22 bp, Artificial Sequence
  chemically synthesized
tactcgagcctgggtaacagaa

SEQ ID NO: 1158189 - DNA, 22 bp, Artificial Sequence
  chemically synthesized
tgtcactgtactcgagcctggg

SEQ ID NO: 1158190 - DNA, 22 bp, Artificial Sequence
  chemically synthesized
attctgttacccaggctcgagt

SEQ ID NO: 1158191 - DNA, 22 bp, Artificial Sequence
  chemically synthesized
tgattgtgtcactgtactcgag

SEQ ID NO: 1158192 - DNA, 22 bp, Artificial Sequence
  chemically synthesized
tgttacccaggctcgagtacag

SEQ ID NO: 1158193 - DNA, 22 bp, Artificial Sequence
  chemically synthesized
ttacccaggctcgagtacagtg

SEQ ID NO: 1158194 - DNA, 22 bp, Artificial Sequence
  chemically synthesized
cccaggctcgagtacagtgaca

SEQ ID NO: 1158195 - DNA, 22 bp, Artificial Sequence
  chemically synthesized
agtgagttatgattgtgtcact

SEQ ID NO: 1158196 - DNA, 22 bp, Artificial Sequence
  chemically synthesized
cagtgagttatgattgtgtcac

SEQ ID NO: 1158197 - DNA, 22 bp, Artificial Sequence
  chemically synthesized
gagtacagtgacacaatcataa

SEQ ID NO: 1158198 - DNA, 22 bp, Artificial Sequence
  chemically synthesized
ggaggtcaaggcttcagtgagt

SEQ ID NO: 1158199 - DNA, 22 bp, Artificial Sequence
  chemically synthesized
ggcctgggaggtcaaggcttca

SEQ ID NO: 1158200 - DNA, 22 bp, Artificial Sequence
  chemically synthesized
gggcctgggaggtcaaggcttc

SEQ ID NO: 1158201 - DNA, 22 bp, Artificial Sequence
  chemically synthesized
actgaagccttgacctcccagg

SEQ ID NO: 1158202 - DNA, 22 bp, Artificial Sequence
  chemically synthesized
aagccttgacctcccaggccca

SEQ ID NO: 1158203 - DNA, 22 bp, Artificial Sequence
  chemically synthesized
aggcaggaggatcatttgggcc

SEQ ID NO: 1158204 - DNA, 22 bp, Artificial Sequence
  chemically synthesized
gacctcccaggcccaaatgatc

SEQ ID NO: 1158205 - DNA, 22 bp, Artificial Sequence
  chemically synthesized
acctcccaggcccaaatgatcc

SEQ ID NO: 1158206 - DNA, 22 bp, Artificial Sequence
  chemically synthesized
ccaggcccaaatgatcctcctg

SEQ ID NO: 1158207 - DNA, 22 bp, Artificial Sequence
  chemically synthesized
aggaggctgaggcaggaggatc

SEQ ID NO: 1158208 - DNA, 22 bp, Artificial Sequence
  chemically synthesized
ctcaggaggctgaggcaggagg

SEQ ID NO: 1158209 - DNA, 22 bp, Artificial Sequence
  chemically synthesized
agctactcaggaggctgaggca

SEQ ID NO: 1158210 - DNA, 22 bp, Artificial Sequence
  chemically synthesized
tagtctcagctactcaggaggc

SEQ ID NO: 1158211 - DNA, 22 bp, Artificial Sequence
  chemically synthesized
ctgcctcagcctcctgagtagc

SEQ ID NO: 1158212 - DNA, 22 bp, Artificial Sequence
  chemically synthesized
cctcagcctcctgagtagctga

SEQ ID NO: 1158213 - DNA, 22 bp, Artificial Sequence
  chemically synthesized
agcctcctgagtagctgagact

SEQ ID NO: 1158214 - DNA, 22 bp, Artificial Sequence
  chemically synthesized
ctgagtagctgagactacaggt

SEQ ID NO: 1158215 - DNA, 22 bp, Artificial Sequence
  chemically synthesized
agtagctgagactacaggtgca

SEQ ID NO: 1158216 - DNA, 22 bp, Artificial Sequence
  chemically synthesized
ccagggaaggtggtgcacctgt

SEQ ID NO: 1158217 - DNA, 22 bp, Artificial Sequence
  chemically synthesized
gccagggaaggtggtgcacctg

SEQ ID NO: 1158218 - DNA, 22 bp, Artificial Sequence
  chemically synthesized
agactacaggtgcaccaccttc

SEQ ID NO: 1158219 - DNA, 22 bp, Artificial Sequence
  chemically synthesized
aaaatttgccagggaaggtggt

SEQ ID NO: 1158220 - DNA, 22 bp, Artificial Sequence
  chemically synthesized
caggtgcaccaccttccctggc

SEQ ID NO: 1158221 - DNA, 22 bp, Artificial Sequence
  chemically synthesized
tacaaaaagagttaaaaatttg

SEQ ID NO: 1158222 - DNA, 22 bp, Artificial Sequence
  chemically synthesized
ccctggcaaatttttaactctt

SEQ ID NO: 1158223 - DNA, 22 bp, Artificial Sequence
  chemically synthesized
cctggcaaatttttaactcttt

SEQ ID NO: 1158224 - DNA, 22 bp, Artificial Sequence
  chemically synthesized
gcaaatttttaactctttttgt

SEQ ID NO: 1158225 - DNA, 22 bp, Artificial Sequence
  chemically synthesized
ttaactctttttgtatagatgt

SEQ ID NO: 1158226 - DNA, 22 bp, Artificial Sequence
  chemically synthesized
taactctttttgtatagatgtg

SEQ ID NO: 1158227 - DNA, 22 bp, Artificial Sequence
  chemically synthesized
aactctttttgtatagatgtgg

SEQ ID NO: 1158228 - DNA, 22 bp, Artificial Sequence
  chemically synthesized
actctttttgtatagatgtggt

SEQ ID NO: 1158229 - DNA, 22 bp, Artificial Sequence
  chemically synthesized
ggcaacatagggagaccacatc

SEQ ID NO: 1158230 - DNA, 22 bp, Artificial Sequence
  chemically synthesized
tttttgtatagatgtggtctcc

SEQ ID NO: 1158231 - DNA, 22 bp, Artificial Sequence
  chemically synthesized
tttgtatagatgtggtctccct

SEQ ID NO: 1158232 - DNA, 22 bp, Artificial Sequence
  chemically synthesized
ttgtatagatgtggtctcccta

SEQ ID NO: 1158233 - DNA, 22 bp, Artificial Sequence
  chemically synthesized
gcctgggcaacatagggagacc

SEQ ID NO: 1158234 - DNA, 22 bp, Artificial Sequence
  chemically synthesized
tgtatagatgtggtctccctat

SEQ ID NO: 1158235 - DNA, 22 bp, Artificial Sequence
  chemically synthesized
gtatagatgtggtctccctatg

SEQ ID NO: 1158236 - DNA, 22 bp, Artificial Sequence
  chemically synthesized
tatagatgtggtctccctatgt

SEQ ID NO: 1158237 - DNA, 22 bp, Artificial Sequence
  chemically synthesized
aagactagcctgggcaacatag

SEQ ID NO: 1158238 - DNA, 22 bp, Artificial Sequence
  chemically synthesized
cctatgttgcccaggctagtct

SEQ ID NO: 1158239 - DNA, 22 bp, Artificial Sequence
  chemically synthesized
gagaccaggagttcaagactag

SEQ ID NO: 1158240 - DNA, 22 bp, Artificial Sequence
  chemically synthesized
tgttgcccaggctagtcttgaa

SEQ ID NO: 1158241 - DNA, 22 bp, Artificial Sequence
  chemically synthesized
cccaggctagtcttgaactcct

SEQ ID NO: 1158242 - DNA, 22 bp, Artificial Sequence
  chemically synthesized
gtcttgaactcctggtctccag

SEQ ID NO: 1158243 - DNA, 22 bp, Artificial Sequence
  chemically synthesized
gaactcctggtctccagctatc

SEQ ID NO: 1158244 - DNA, 22 bp, Artificial Sequence
  chemically synthesized
aactcctggtctccagctatcc

SEQ ID NO: 1158245 - DNA, 22 bp, Artificial Sequence
  chemically synthesized
ggaggtcgaggcaggaggatag

SEQ ID NO: 1158246 - DNA, 22 bp, Artificial Sequence
  chemically synthesized
ctggtctccagctatcctcctg

SEQ ID NO: 1158247 - DNA, 22 bp, Artificial Sequence
  chemically synthesized
gggaggtcgaggcaggaggata

SEQ ID NO: 1158248 - DNA, 22 bp, Artificial Sequence
  chemically synthesized
tgggaggtcgaggcaggaggat

SEQ ID NO: 1158249 - DNA, 22 bp, Artificial Sequence
  chemically synthesized
gtctccagctatcctcctgcct

SEQ ID NO: 1158250 - DNA, 22 bp, Artificial Sequence
  chemically synthesized
cagctatcctcctgcctcgacc

SEQ ID NO: 1158251 - DNA, 22 bp, Artificial Sequence
  chemically synthesized
tcctcctgcctcgacctcccaa

SEQ ID NO: 1158252 - DNA, 22 bp, Artificial Sequence
  chemically synthesized
taatcccagaactttgggaggt

SEQ ID NO: 1158253 - DNA, 22 bp, Artificial Sequence
  chemically synthesized
ctgcctcgacctcccaaagttc

SEQ ID NO: 1158254 - DNA, 22 bp, Artificial Sequence
  chemically synthesized
cctcgacctcccaaagttctgg

SEQ ID NO: 1158255 - DNA, 22 bp, Artificial Sequence
  chemically synthesized
acgcctgtaatcccagaacttt

SEQ ID NO: 1158256 - DNA, 22 bp, Artificial Sequence
  chemically synthesized
gacctcccaaagttctgggatt

SEQ ID NO: 1158257 - DNA, 22 bp, Artificial Sequence
  chemically synthesized
ccaaagttctgggattacaggc

SEQ ID NO: 1158258 - DNA, 22 bp, Artificial Sequence
  chemically synthesized
ggtgcggtggctcacgcctgta

SEQ ID NO: 1158259 - DNA, 22 bp, Artificial Sequence
  chemically synthesized
tgggattacaggcgtgagccac

SEQ ID NO: 1158260 - DNA, 22 bp, Artificial Sequence
  chemically synthesized
ggattacaggcgtgagccaccg

SEQ ID NO: 1158261 - DNA, 22 bp, Artificial Sequence
  chemically synthesized
caggcgtgagccaccgcaccta

SEQ ID NO: 1158262 - DNA, 22 bp, Artificial Sequence
  chemically synthesized
agaaataaaataacagtagcta

SEQ ID NO: 1158263 - DNA, 22 bp, Artificial Sequence
  chemically synthesized
tcctcagaaataaaataacagt

SEQ ID NO: 1158264 - DNA, 22 bp, Artificial Sequence
  chemically synthesized
ccactatcctcagaaataaaat

SEQ ID NO: 1158265 - DNA, 22 bp, Artificial Sequence
  chemically synthesized
gctactgttattttatttctga

SEQ ID NO: 1158266 - DNA, 22 bp, Artificial Sequence
  chemically synthesized
acctaccactatcctcagaaat

SEQ ID NO: 1158267 - DNA, 22 bp, Artificial Sequence
  chemically synthesized
aacctaccactatcctcagaaa

SEQ ID NO: 1158268 - DNA, 22 bp, Artificial Sequence
  chemically synthesized
ctgttattttatttctgaggat

SEQ ID NO: 1158269 - DNA, 22 bp, Artificial Sequence
  chemically synthesized
taacctaccactatcctcagaa

SEQ ID NO: 1158270 - DNA, 22 bp, Artificial Sequence
  chemically synthesized
tttaacctaccactatcctcag

SEQ ID NO: 1158271 - DNA, 22 bp, Artificial Sequence
  chemically synthesized
ttattttatttctgaggatagt

SEQ ID NO: 1158272 - DNA, 22 bp, Artificial Sequence
  chemically synthesized
ttttatttctgaggatagtggt

SEQ ID NO: 1158273 - DNA, 22 bp, Artificial Sequence
  chemically synthesized
tatttctgaggatagtggtagg

SEQ ID NO: 1158274 - DNA, 22 bp, Artificial Sequence
  chemically synthesized
atttctgaggatagtggtaggt

SEQ ID NO: 1158275 - DNA, 22 bp, Artificial Sequence
  chemically synthesized
tttctgaggatagtggtaggtt

SEQ ID NO: 1158276 - DNA, 22 bp, Artificial Sequence
  chemically synthesized
tgccagctctttaacctaccac

SEQ ID NO: 1158277 - DNA, 22 bp, Artificial Sequence
  chemically synthesized
ctgaggatagtggtaggttaaa

SEQ ID NO: 1158278 - DNA, 22 bp, Artificial Sequence
  chemically synthesized
tgaggatagtggtaggttaaag

SEQ ID NO: 1158279 - DNA, 22 bp, Artificial Sequence
  chemically synthesized
aggatagtggtaggttaaagag

SEQ ID NO: 1158280 - DNA, 22 bp, Artificial Sequence
  chemically synthesized
acatgccactgtgccagctctt

SEQ ID NO: 1158281 - DNA, 22 bp, Artificial Sequence
  chemically synthesized
cacatgccactgtgccagctct

SEQ ID NO: 1158282 - DNA, 22 bp, Artificial Sequence
  chemically synthesized
gcttcacatgccactgtgccag

SEQ ID NO: 1158283 - DNA, 22 bp, Artificial Sequence
  chemically synthesized
tactggcttcacatgccactgt

SEQ ID NO: 1158284 - DNA, 22 bp, Artificial Sequence
  chemically synthesized
aagagctggcacagtggcatgt

SEQ ID NO: 1158285 - DNA, 22 bp, Artificial Sequence
  chemically synthesized
tatactggcttcacatgccact

SEQ ID NO: 1158286 - DNA, 22 bp, Artificial Sequence
  chemically synthesized
ctatactggcttcacatgccac

SEQ ID NO: 1158287 - DNA, 22 bp, Artificial Sequence
  chemically synthesized
tgatttctatactggcttcaca

SEQ ID NO: 1158288 - DNA, 22 bp, Artificial Sequence
  chemically synthesized
gcacagtggcatgtgaagccag

SEQ ID NO: 1158289 - DNA, 22 bp, Artificial Sequence
  chemically synthesized
gtgatttctatactggcttcac

SEQ ID NO: 1158290 - DNA, 22 bp, Artificial Sequence
  chemically synthesized
ggtcacacagggtttgtgattt

SEQ ID NO: 1158291 - DNA, 22 bp, Artificial Sequence
  chemically synthesized
gggtcacacagggtttgtgatt

SEQ ID NO: 1158292 - DNA, 22 bp, Artificial Sequence
  chemically synthesized
tgtgacccaagactgtgcacta

SEQ ID NO: 1158293 - DNA, 22 bp, Artificial Sequence
  chemically synthesized
cccatgaaaaaaataaaatagt

SEQ ID NO: 1158294 - DNA, 22 bp, Artificial Sequence
  chemically synthesized
gcccatgaaaaaaataaaatag

SEQ ID NO: 1158295 - DNA, 22 bp, Artificial Sequence
  chemically synthesized
tgcccatgaaaaaaataaaata

SEQ ID NO: 1158296 - DNA, 22 bp, Artificial Sequence
  chemically synthesized
tgcactattttatttttttcat

SEQ ID NO: 1158297 - DNA, 22 bp, Artificial Sequence
  chemically synthesized
atacaatattttgcccatgaaa

SEQ ID NO: 1158298 - DNA, 22 bp, Artificial Sequence
  chemically synthesized
ttttatttttttcatgggcaaa

SEQ ID NO: 1158299 - DNA, 22 bp, Artificial Sequence
  chemically synthesized
tatttttttcatgggcaaaata

SEQ ID NO: 1158300 - DNA, 22 bp, Artificial Sequence
  chemically synthesized
atttttttcatgggcaaaatat

SEQ ID NO: 1158301 - DNA, 22 bp, Artificial Sequence
  chemically synthesized
tttttttcatgggcaaaatatt

SEQ ID NO: 1158302 - DNA, 22 bp, Artificial Sequence
  chemically synthesized
atatgatctaatacaatatttt

SEQ ID NO: 1158303 - DNA, 22 bp, Artificial Sequence
  chemically synthesized
ttttcatgggcaaaatattgta

SEQ ID NO: 1158304 - DNA, 22 bp, Artificial Sequence
  chemically synthesized
catatgatctaatacaatattt

SEQ ID NO: 1158305 - DNA, 22 bp, Artificial Sequence
  chemically synthesized
tttcatgggcaaaatattgtat

SEQ ID NO: 1158306 - DNA, 22 bp, Artificial Sequence
  chemically synthesized
ttcatgggcaaaatattgtatt

SEQ ID NO: 1158307 - DNA, 22 bp, Artificial Sequence
  chemically synthesized
tcatgggcaaaatattgtatta

SEQ ID NO: 1158308 - DNA, 22 bp, Artificial Sequence
  chemically synthesized
catgggcaaaatattgtattag

SEQ ID NO: 1158309 - DNA, 22 bp, Artificial Sequence
  chemically synthesized
atgggcaaaatattgtattaga

SEQ ID NO: 1158310 - DNA, 22 bp, Artificial Sequence
  chemically synthesized
aaatatcagaaatttcatatga

SEQ ID NO: 1158311 - DNA, 22 bp, Artificial Sequence
  chemically synthesized
tattagatcatatgaaatttct

SEQ ID NO: 1158312 - DNA, 22 bp, Artificial Sequence
  chemically synthesized
gatcatatgaaatttctgatat

SEQ ID NO: 1158313 - DNA, 22 bp, Artificial Sequence
  chemically synthesized
atcaacaaagaaattgaaatat

SEQ ID NO: 1158314 - DNA, 22 bp, Artificial Sequence
  chemically synthesized
catcaacaaagaaattgaaata

SEQ ID NO: 1158315 - DNA, 22 bp, Artificial Sequence
  chemically synthesized
tcatcaacaaagaaattgaaat

SEQ ID NO: 1158316 - DNA, 22 bp, Artificial Sequence
  chemically synthesized
ctgatatttcaatttctttgtt

SEQ ID NO: 1158317 - DNA, 22 bp, Artificial Sequence
  chemically synthesized
tgatatttcaatttctttgttg

SEQ ID NO: 1158318 - DNA, 22 bp, Artificial Sequence
  chemically synthesized
atatttcaatttctttgttgat

SEQ ID NO: 1158319 - DNA, 22 bp, Artificial Sequence
  chemically synthesized
tatgaagccattttcatcaaca

SEQ ID NO: 1158320 - DNA, 22 bp, Artificial Sequence
  chemically synthesized
caatttctttgttgatgaaaat

SEQ ID NO: 1158321 - DNA, 22 bp, Artificial Sequence
  chemically synthesized
aatttctttgttgatgaaaatg

SEQ ID NO: 1158322 - DNA, 22 bp, Artificial Sequence
  chemically synthesized
aactatatgaagccattttcat

SEQ ID NO: 1158323 - DNA, 22 bp, Artificial Sequence
  chemically synthesized
ctttgttgatgaaaatggcttc

SEQ ID NO: 1158324 - DNA, 22 bp, Artificial Sequence
  chemically synthesized
tttgttgatgaaaatggcttca

SEQ ID NO: 1158325 - DNA, 22 bp, Artificial Sequence
  chemically synthesized
aattgaactatatgaagccatt

SEQ ID NO: 1158326 - DNA, 22 bp, Artificial Sequence
  chemically synthesized
aaattgaactatatgaagccat

SEQ ID NO: 1158327 - DNA, 22 bp, Artificial Sequence
  chemically synthesized
tgttgatgaaaatggcttcata

SEQ ID NO: 1158328 - DNA, 22 bp, Artificial Sequence
  chemically synthesized
taaattgaactatatgaagcca

SEQ ID NO: 1158329 - DNA, 22 bp, Artificial Sequence
  chemically synthesized
gttgatgaaaatggcttcatat

SEQ ID NO: 1158330 - DNA, 22 bp, Artificial Sequence
  chemically synthesized
ttgatgaaaatggcttcatata

SEQ ID NO: 1158331 - DNA, 22 bp, Artificial Sequence
  chemically synthesized
atgaaaatggcttcatatagtt

SEQ ID NO: 1158332 - DNA, 22 bp, Artificial Sequence
  chemically synthesized
atcatgttttaaattgaactat

SEQ ID NO: 1158333 - DNA, 22 bp, Artificial Sequence
  chemically synthesized
catcatgttttaaattgaacta

SEQ ID NO: 1158334 - DNA, 22 bp, Artificial Sequence
  chemically synthesized
tcatcatgttttaaattgaact

SEQ ID NO: 1158335 - DNA, 22 bp, Artificial Sequence
  chemically synthesized
attttcatcatgttttaaattg

SEQ ID NO: 1158336 - DNA, 22 bp, Artificial Sequence
  chemically synthesized
catatagttcaatttaaaacat

SEQ ID NO: 1158337 - DNA, 22 bp, Artificial Sequence
  chemically synthesized
atatagttcaatttaaaacatg

SEQ ID NO: 1158338 - DNA, 22 bp, Artificial Sequence
  chemically synthesized
tctcattttcatcatgttttaa

SEQ ID NO: 1158339 - DNA, 22 bp, Artificial Sequence
  chemically synthesized
ctgtctcattttcatcatgttt

SEQ ID NO: 1158340 - DNA, 22 bp, Artificial Sequence
  chemically synthesized
aatttaaaacatgatgaaaatg

SEQ ID NO: 1158341 - DNA, 22 bp, Artificial Sequence
  chemically synthesized
aaaacatgatgaaaatgagaca

SEQ ID NO: 1158342 - DNA, 22 bp, Artificial Sequence
  chemically synthesized
aaacatgatgaaaatgagacag

SEQ ID NO: 1158343 - DNA, 22 bp, Artificial Sequence
  chemically synthesized
gaaataagaaactcctgtctca

SEQ ID NO: 1158344 - DNA, 22 bp, Artificial Sequence
  chemically synthesized
gctggaaataagaaactcctgt

SEQ ID NO: 1158345 - DNA, 22 bp, Artificial Sequence
  chemically synthesized
gaatgttagctggaaataagaa

SEQ ID NO: 1158346 - DNA, 22 bp, Artificial Sequence
  chemically synthesized
agaatgttagctggaaataaga

SEQ ID NO: 1158347 - DNA, 22 bp, Artificial Sequence
  chemically synthesized
tagaatgttagctggaaataag

SEQ ID NO: 1158348 - DNA, 22 bp, Artificial Sequence
  chemically synthesized
catctttagaatgttagctgga

SEQ ID NO: 1158349 - DNA, 22 bp, Artificial Sequence
  chemically synthesized
acatctttagaatgttagctgg

SEQ ID NO: 1158350 - DNA, 22 bp, Artificial Sequence
  chemically synthesized
tttacatctttagaatgttagc

SEQ ID NO: 1158351 - DNA, 22 bp, Artificial Sequence
  chemically synthesized
atttacatctttagaatgttag

SEQ ID NO: 1158352 - DNA, 22 bp, Artificial Sequence
  chemically synthesized
cttatttccagctaacattcta

SEQ ID NO: 1158353 - DNA, 22 bp, Artificial Sequence
  chemically synthesized
ttatttccagctaacattctaa

SEQ ID NO: 1158354 - DNA, 22 bp, Artificial Sequence
  chemically synthesized
atttccagctaacattctaaag

SEQ ID NO: 1158355 - DNA, 22 bp, Artificial Sequence
  chemically synthesized
tttccagctaacattctaaaga

SEQ ID NO: 1158356 - DNA, 22 bp, Artificial Sequence
  chemically synthesized
caaatttatttacatctttaga

SEQ ID NO: 1158357 - DNA, 22 bp, Artificial Sequence
  chemically synthesized
ccagctaacattctaaagatgt

SEQ ID NO: 1158358 - DNA, 22 bp, Artificial Sequence
  chemically synthesized
ccaaatttatttacatctttag

SEQ ID NO: 1158359 - DNA, 22 bp, Artificial Sequence
  chemically synthesized
cagctaacattctaaagatgta

SEQ ID NO: 1158360 - DNA, 22 bp, Artificial Sequence
  chemically synthesized
tccaaatttatttacatcttta

SEQ ID NO: 1158361 - DNA, 22 bp, Artificial Sequence
  chemically synthesized
ttccaaatttatttacatcttt

SEQ ID NO: 1158362 - DNA, 22 bp, Artificial Sequence
  chemically synthesized
acattctaaagatgtaaataaa

SEQ ID NO: 1158363 - DNA, 22 bp, Artificial Sequence
  chemically synthesized
acaatttttccaaatttattta

SEQ ID NO: 1158364 - DNA, 22 bp, Artificial Sequence
  chemically synthesized
gacaatttttccaaatttattt

SEQ ID NO: 1158365 - DNA, 22 bp, Artificial Sequence
  chemically synthesized
tgacaatttttccaaatttatt

SEQ ID NO: 1158366 - DNA, 22 bp, Artificial Sequence
  chemically synthesized
taaagatgtaaataaatttgga

SEQ ID NO: 1158367 - DNA, 22 bp, Artificial Sequence
  chemically synthesized
aagatgtaaataaatttggaaa

SEQ ID NO: 1158368 - DNA, 22 bp, Artificial Sequence
  chemically synthesized
tgactttgacaatttttccaaa

SEQ ID NO: 1158369 - DNA, 22 bp, Artificial Sequence
  chemically synthesized
gtgactttgacaatttttccaa

SEQ ID NO: 1158370 - DNA, 22 bp, Artificial Sequence
  chemically synthesized
tgtgactttgacaatttttcca

SEQ ID NO: 1158371 - DNA, 22 bp, Artificial Sequence
  chemically synthesized
ttttgtgactttgacaattttt

SEQ ID NO: 1158372 - DNA, 22 bp, Artificial Sequence
  chemically synthesized
attttgtgactttgacaatttt

SEQ ID NO: 1158373 - DNA, 22 bp, Artificial Sequence
  chemically synthesized
tattttgtgactttgacaattt

SEQ ID NO: 1158374 - DNA, 22 bp, Artificial Sequence
  chemically synthesized
ttattttgtgactttgacaatt

SEQ ID NO: 1158375 - DNA, 22 bp, Artificial Sequence
  chemically synthesized
ggaaaaattgtcaaagtcacaa

SEQ ID NO: 1158376 - DNA, 22 bp, Artificial Sequence
  chemically synthesized
gaaaaattgtcaaagtcacaaa

SEQ ID NO: 1158377 - DNA, 22 bp, Artificial Sequence
  chemically synthesized
tgcatggtagatttttattttg

SEQ ID NO: 1158378 - DNA, 22 bp, Artificial Sequence
  chemically synthesized
tcaaagtcacaaaataaaaatc

SEQ ID NO: 1158379 - DNA, 22 bp, Artificial Sequence
  chemically synthesized
tctgtgcatggtagatttttat

SEQ ID NO: 1158380 - DNA, 22 bp, Artificial Sequence
  chemically synthesized
ctatctgtgcatggtagatttt

SEQ ID NO: 1158381 - DNA, 22 bp, Artificial Sequence
  chemically synthesized
cctatctgtgcatggtagattt

SEQ ID NO: 1158382 - DNA, 22 bp, Artificial Sequence
  chemically synthesized
tcctatctgtgcatggtagatt

SEQ ID NO: 1158383 - DNA, 22 bp, Artificial Sequence
  chemically synthesized
ttcctatctgtgcatggtagat

SEQ ID NO: 1158384 - DNA, 22 bp, Artificial Sequence
  chemically synthesized
tttcctatctgtgcatggtaga

SEQ ID NO: 1158385 - DNA, 22 bp, Artificial Sequence
  chemically synthesized
ccatgcacagataggaaaaaat

SEQ ID NO: 1158386 - DNA, 22 bp, Artificial Sequence
  chemically synthesized
gaaaaatgcaaacattttttcc

SEQ ID NO: 1158387 - DNA, 22 bp, Artificial Sequence
  chemically synthesized
aaggatataaaatgaaacctgg

SEQ ID NO: 1158388 - DNA, 22 bp, Artificial Sequence
  chemically synthesized
gaaggatataaaatgaaacctg

SEQ ID NO: 1158389 - DNA, 22 bp, Artificial Sequence
  chemically synthesized
gcatttttccaggtttcatttt

SEQ ID NO: 1158390 - DNA, 22 bp, Artificial Sequence
  chemically synthesized
catttttccaggtttcatttta

SEQ ID NO: 1158391 - DNA, 22 bp, Artificial Sequence
  chemically synthesized
ttccaggtttcattttatatcc

SEQ ID NO: 1158392 - DNA, 22 bp, Artificial Sequence
  chemically synthesized
tccaggtttcattttatatcct

SEQ ID NO: 1158393 - DNA, 22 bp, Artificial Sequence
  chemically synthesized
ccaggtttcattttatatcctt

SEQ ID NO: 1158394 - DNA, 22 bp, Artificial Sequence
  chemically synthesized
aatgacgacttgaaggatataa

SEQ ID NO: 1158395 - DNA, 22 bp, Artificial Sequence
  chemically synthesized
caggtttcattttatatccttc

SEQ ID NO: 1158396 - DNA, 22 bp, Artificial Sequence
  chemically synthesized
ccgtctaaatgacgacttgaag

SEQ ID NO: 1158397 - DNA, 22 bp, Artificial Sequence
  chemically synthesized
cattttatatccttcaagtcgt

SEQ ID NO: 1158398 - DNA, 22 bp, Artificial Sequence
  chemically synthesized
cccgtctaaatgacgacttgaa

SEQ ID NO: 1158399 - DNA, 22 bp, Artificial Sequence
  chemically synthesized
attttatatccttcaagtcgtc

SEQ ID NO: 1158400 - DNA, 22 bp, Artificial Sequence
  chemically synthesized
tcccgtctaaatgacgacttga

SEQ ID NO: 1158401 - DNA, 22 bp, Artificial Sequence
  chemically synthesized
ctttcccgtctaaatgacgact

SEQ ID NO: 1158402 - DNA, 22 bp, Artificial Sequence
  chemically synthesized
tatatccttcaagtcgtcattt

SEQ ID NO: 1158403 - DNA, 22 bp, Artificial Sequence
  chemically synthesized
actttcccgtctaaatgacgac

SEQ ID NO: 1158404 - DNA, 22 bp, Artificial Sequence
  chemically synthesized
atatccttcaagtcgtcattta

SEQ ID NO: 1158405 - DNA, 22 bp, Artificial Sequence
  chemically synthesized
tactttcccgtctaaatgacga

SEQ ID NO: 1158406 - DNA, 22 bp, Artificial Sequence
  chemically synthesized
tatccttcaagtcgtcatttag

SEQ ID NO: 1158407 - DNA, 22 bp, Artificial Sequence
  chemically synthesized
ttactttcccgtctaaatgacg

SEQ ID NO: 1158408 - DNA, 22 bp, Artificial Sequence
  chemically synthesized
cttttactttcccgtctaaatg

SEQ ID NO: 1158409 - DNA, 22 bp, Artificial Sequence
  chemically synthesized
gcttttactttcccgtctaaat

SEQ ID NO: 1158410 - DNA, 22 bp, Artificial Sequence
  chemically synthesized
tgcttttactttcccgtctaaa

SEQ ID NO: 1158411 - DNA, 22 bp, Artificial Sequence
  chemically synthesized
ttgcttttactttcccgtctaa

SEQ ID NO: 1158412 - DNA, 22 bp, Artificial Sequence
  chemically synthesized
caagtcgtcatttagacgggaa

SEQ ID NO: 1158413 - DNA, 22 bp, Artificial Sequence
  chemically synthesized
aagtcgtcatttagacgggaaa

SEQ ID NO: 1158414 - DNA, 22 bp, Artificial Sequence
  chemically synthesized
accttttgcttttactttcccg

SEQ ID NO: 1158415 - DNA, 22 bp, Artificial Sequence
  chemically synthesized
cattcaccttttgcttttactt

SEQ ID NO: 1158416 - DNA, 22 bp, Artificial Sequence
  chemically synthesized
agacgggaaagtaaaagcaaaa

SEQ ID NO: 1158417 - DNA, 22 bp, Artificial Sequence
  chemically synthesized
gacgggaaagtaaaagcaaaag

SEQ ID NO: 1158418 - DNA, 22 bp, Artificial Sequence
  chemically synthesized
ccagtcatatatgtatactcca

SEQ ID NO: 1158419 - DNA, 22 bp, Artificial Sequence
  chemically synthesized
ttgccagtcatatatgtatact

SEQ ID NO: 1158420 - DNA, 22 bp, Artificial Sequence
  chemically synthesized
tattgccagtcatatatgtata

SEQ ID NO: 1158421 - DNA, 22 bp, Artificial Sequence
  chemically synthesized
tctattgccagtcatatatgta

SEQ ID NO: 1158422 - DNA, 22 bp, Artificial Sequence
  chemically synthesized
ggctctctattgccagtcatat

SEQ ID NO: 1158423 - DNA, 22 bp, Artificial Sequence
  chemically synthesized
cctcggctctctattgccagtc

SEQ ID NO: 1158424 - DNA, 22 bp, Artificial Sequence
  chemically synthesized
cactccctcggctctctattgc

SEQ ID NO: 1158425 - DNA, 22 bp, Artificial Sequence
  chemically synthesized
attccactccctcggctctcta

SEQ ID NO: 1158426 - DNA, 22 bp, Artificial Sequence
  chemically synthesized
taattccactccctcggctctc

SEQ ID NO: 1158427 - DNA, 22 bp, Artificial Sequence
  chemically synthesized
ttctaattccactccctcggct

SEQ ID NO: 1158428 - DNA, 22 bp, Artificial Sequence
  chemically synthesized
attctaattccactccctcggc

SEQ ID NO: 1158429 - DNA, 22 bp, Artificial Sequence
  chemically synthesized
tattctaattccactccctcgg

SEQ ID NO: 1158430 - DNA, 22 bp, Artificial Sequence
  chemically synthesized
gcaatagagagccgagggagtg

SEQ ID NO: 1158431 - DNA, 22 bp, Artificial Sequence
  chemically synthesized
ctttattctaattccactccct

SEQ ID NO: 1158432 - DNA, 22 bp, Artificial Sequence
  chemically synthesized
tactactttattctaattccac

SEQ ID NO: 1158433 - DNA, 22 bp, Artificial Sequence
  chemically synthesized
ccctatactactttattctaat

SEQ ID NO: 1158434 - DNA, 22 bp, Artificial Sequence
  chemically synthesized
ctgccctatactactttattct

SEQ ID NO: 1158435 - DNA, 22 bp, Artificial Sequence
  chemically synthesized
gaataaagtagtatagggcagg

SEQ ID NO: 1158436 - DNA, 22 bp, Artificial Sequence
  chemically synthesized
tcaggaccaactcctgccctat

SEQ ID NO: 1158437 - DNA, 22 bp, Artificial Sequence
  chemically synthesized
ctgtcaggaccaactcctgccc

SEQ ID NO: 1158438 - DNA, 22 bp, Artificial Sequence
  chemically synthesized
tacctactgtcaggaccaactc

SEQ ID NO: 1158439 - DNA, 22 bp, Artificial Sequence
  chemically synthesized
cctatacctactgtcaggacca

SEQ ID NO: 1158440 - DNA, 22 bp, Artificial Sequence
  chemically synthesized
gcctatacctactgtcaggacc

SEQ ID NO: 1158441 - DNA, 22 bp, Artificial Sequence
  chemically synthesized
tgcctatacctactgtcaggac

SEQ ID NO: 1158442 - DNA, 22 bp, Artificial Sequence
  chemically synthesized
ttgcctatacctactgtcagga

SEQ ID NO: 1158443 - DNA, 22 bp, Artificial Sequence
  chemically synthesized
atatgcttttgcctatacctac

SEQ ID NO: 1158444 - DNA, 22 bp, Artificial Sequence
  chemically synthesized
gtcctgacagtaggtataggca

SEQ ID NO: 1158445 - DNA, 22 bp, Artificial Sequence
  chemically synthesized
acagtaggtataggcaaaagca

SEQ ID NO: 1158446 - DNA, 22 bp, Artificial Sequence
  chemically synthesized
gtatcatgtcctgatatgcttt

SEQ ID NO: 1158447 - DNA, 22 bp, Artificial Sequence
  chemically synthesized
ctagtatcatgtcctgatatgc

SEQ ID NO: 1158448 - DNA, 22 bp, Artificial Sequence
  chemically synthesized
ccgtagcagttcctagtatcat

SEQ ID NO: 1158449 - DNA, 22 bp, Artificial Sequence
  chemically synthesized
accgtagcagttcctagtatca

SEQ ID NO: 1158450 - DNA, 22 bp, Artificial Sequence
  chemically synthesized
gaagtttaccgtagcagttcct

SEQ ID NO: 1158451 - DNA, 22 bp, Artificial Sequence
  chemically synthesized
aacgattggaagtttaccgtag

SEQ ID NO: 1158452 - DNA, 22 bp, Artificial Sequence
  chemically synthesized
ggaactgctacggtaaacttcc

SEQ ID NO: 1158453 - DNA, 22 bp, Artificial Sequence
  chemically synthesized
agatgatctgaacgattggaag

SEQ ID NO: 1158454 - DNA, 22 bp, Artificial Sequence
  chemically synthesized
ctacggtaaacttccaatcgtt

SEQ ID NO: 1158455 - DNA, 22 bp, Artificial Sequence
  chemically synthesized
tcagatgatctgaacgattgga

SEQ ID NO: 1158456 - DNA, 22 bp, Artificial Sequence
  chemically synthesized
cggtaaacttccaatcgttcag

SEQ ID NO: 1158457 - DNA, 22 bp, Artificial Sequence
  chemically synthesized
ttctcagatgatctgaacgatt

SEQ ID NO: 1158458 - DNA, 22 bp, Artificial Sequence
  chemically synthesized
tattctcagatgatctgaacga

SEQ ID NO: 1158459 - DNA, 22 bp, Artificial Sequence
  chemically synthesized
tctattctcagatgatctgaac

SEQ ID NO: 1158460 - DNA, 22 bp, Artificial Sequence
  chemically synthesized
ccaatcgttcagatcatctgag

SEQ ID NO: 1158461 - DNA, 22 bp, Artificial Sequence
  chemically synthesized
caatcgttcagatcatctgaga

SEQ ID NO: 1158462 - DNA, 22 bp, Artificial Sequence
  chemically synthesized
gcccctctctattctcagatga

SEQ ID NO: 1158463 - DNA, 22 bp, Artificial Sequence
  chemically synthesized
ctagcccctctctattctcaga

SEQ ID NO: 1158464 - DNA, 22 bp, Artificial Sequence
  chemically synthesized
gctagcccctctctattctcag

SEQ ID NO: 1158465 - DNA, 22 bp, Artificial Sequence
  chemically synthesized
tgctagcccctctctattctca

SEQ ID NO: 1158466 - DNA, 22 bp, Artificial Sequence
  chemically synthesized
ttttgctagcccctctctattc

SEQ ID NO: 1158467 - DNA, 22 bp, Artificial Sequence
  chemically synthesized
agatcatctgagaatagagagg

SEQ ID NO: 1158468 - DNA, 22 bp, Artificial Sequence
  chemically synthesized
tctgttttgctagcccctctct

SEQ ID NO: 1158469 - DNA, 22 bp, Artificial Sequence
  chemically synthesized
atctgttttgctagcccctctc

SEQ ID NO: 1158470 - DNA, 22 bp, Artificial Sequence
  chemically synthesized
agaatagagaggggctagcaaa

SEQ ID NO: 1158471 - DNA, 22 bp, Artificial Sequence
  chemically synthesized
caacttatctgttttgctagcc

SEQ ID NO: 1158472 - DNA, 22 bp, Artificial Sequence
  chemically synthesized
acaacttatctgttttgctagc

SEQ ID NO: 1158473 - DNA, 22 bp, Artificial Sequence
  chemically synthesized
ttacaacttatctgttttgcta

SEQ ID NO: 1158474 - DNA, 22 bp, Artificial Sequence
  chemically synthesized
caagttcttacaacttatctgt

SEQ ID NO: 1158475 - DNA, 22 bp, Artificial Sequence
  chemically synthesized
gcaaaacagataagttgtaaga

SEQ ID NO: 1158476 - DNA, 22 bp, Artificial Sequence
  chemically synthesized
ccaaagttccaagttcttacaa

SEQ ID NO: 1158477 - DNA, 22 bp, Artificial Sequence
  chemically synthesized
tgttgccaaagttccaagttct

SEQ ID NO: 1158478 - DNA, 22 bp, Artificial Sequence
  chemically synthesized
tatgttgccaaagttccaagtt

SEQ ID NO: 1158479 - DNA, 22 bp, Artificial Sequence
  chemically synthesized
taactctatgttgccaaagttc

SEQ ID NO: 1158480 - DNA, 22 bp, Artificial Sequence
  chemically synthesized
taagaacttggaactttggcaa

SEQ ID NO: 1158481 - DNA, 22 bp, Artificial Sequence
  chemically synthesized
ggtctgtaactctatgttgcca

SEQ ID NO: 1158482 - DNA, 22 bp, Artificial Sequence
  chemically synthesized
ggaactttggcaacatagagtt

SEQ ID NO: 1158483 - DNA, 22 bp, Artificial Sequence
  chemically synthesized
gaactttggcaacatagagtta

SEQ ID NO: 1158484 - DNA, 22 bp, Artificial Sequence
  chemically synthesized
gagaccattaggtctgtaactc

SEQ ID NO: 1158485 - DNA, 22 bp, Artificial Sequence
  chemically synthesized
tggcaacatagagttacagacc

SEQ ID NO: 1158486 - DNA, 22 bp, Artificial Sequence
  chemically synthesized
ggcaacatagagttacagacct

SEQ ID NO: 1158487 - DNA, 22 bp, Artificial Sequence
  chemically synthesized
gcaacatagagttacagaccta

SEQ ID NO: 1158488 - DNA, 22 bp, Artificial Sequence
  chemically synthesized
acgctagagaccattaggtctg

SEQ ID NO: 1158489 - DNA, 22 bp, Artificial Sequence
  chemically synthesized
cagacctaatggtctctagcgt

SEQ ID NO: 1158490 - DNA, 22 bp, Artificial Sequence
  chemically synthesized
atggtctctagcgtcaacgaca

SEQ ID NO: 1158491 - DNA, 22 bp, Artificial Sequence
  chemically synthesized
acaatatatcaaaaatgtcgtt

SEQ ID NO: 1158492 - DNA, 22 bp, Artificial Sequence
  chemically synthesized
tctaacaatatatcaaaaatgt

SEQ ID NO: 1158493 - DNA, 22 bp, Artificial Sequence
  chemically synthesized
tagcgtcaacgacatttttgat

SEQ ID NO: 1158494 - DNA, 22 bp, Artificial Sequence
  chemically synthesized
gcgtcaacgacatttttgatat

SEQ ID NO: 1158495 - DNA, 22 bp, Artificial Sequence
  chemically synthesized
ttatctaacaatatatcaaaaa

SEQ ID NO: 1158496 - DNA, 22 bp, Artificial Sequence
  chemically synthesized
ttgatatattgttagataacag

SEQ ID NO: 1158497 - DNA, 22 bp, Artificial Sequence
  chemically synthesized
tgatatattgttagataacaga

SEQ ID NO: 1158498 - DNA, 22 bp, Artificial Sequence
  chemically synthesized
gatatattgttagataacagac

SEQ ID NO: 1158499 - DNA, 22 bp, Artificial Sequence
  chemically synthesized
atatattgttagataacagaca

SEQ ID NO: 1158500 - DNA, 22 bp, Artificial Sequence
  chemically synthesized
ggcacaatcataaggatgtctg

SEQ ID NO: 1158501 - DNA, 22 bp, Artificial Sequence
  chemically synthesized
ttagataacagacatccttatg

SEQ ID NO: 1158502 - DNA, 22 bp, Artificial Sequence
  chemically synthesized
gataacagacatccttatgatt

SEQ ID NO: 1158503 - DNA, 22 bp, Artificial Sequence
  chemically synthesized
agaaacactgggcacaatcata

SEQ ID NO: 1158504 - DNA, 22 bp, Artificial Sequence
  chemically synthesized
gagaaacactgggcacaatcat

SEQ ID NO: 1158505 - DNA, 22 bp, Artificial Sequence
  chemically synthesized
aagtttgagaaacactgggcac

SEQ ID NO: 1158506 - DNA, 22 bp, Artificial Sequence
  chemically synthesized
atgattgtgcccagtgtttctc

SEQ ID NO: 1158507 - DNA, 22 bp, Artificial Sequence
  chemically synthesized
tgattgtgcccagtgtttctca

SEQ ID NO: 1158508 - DNA, 22 bp, Artificial Sequence
  chemically synthesized
atatgtacattaaagtttgaga

SEQ ID NO: 1158509 - DNA, 22 bp, Artificial Sequence
  chemically synthesized
tgcccagtgtttctcaaacttt

SEQ ID NO: 1158510 - DNA, 22 bp, Artificial Sequence
  chemically synthesized
caggtgattcatatgtacatta

SEQ ID NO: 1158511 - DNA, 22 bp, Artificial Sequence
  chemically synthesized
tccaggtgattcatatgtacat

SEQ ID NO: 1158512 - DNA, 22 bp, Artificial Sequence
  chemically synthesized
ctcaaactttaatgtacatatg

SEQ ID NO: 1158513 - DNA, 22 bp, Artificial Sequence
  chemically synthesized
tcaaactttaatgtacatatga

SEQ ID NO: 1158514 - DNA, 22 bp, Artificial Sequence
  chemically synthesized
aaactttaatgtacatatgaat

SEQ ID NO: 1158515 - DNA, 22 bp, Artificial Sequence
  chemically synthesized
acactctccaggtgattcatat

SEQ ID NO: 1158516 - DNA, 22 bp, Artificial Sequence
  chemically synthesized
gacactctccaggtgattcata

SEQ ID NO: 1158517 - DNA, 22 bp, Artificial Sequence
  chemically synthesized
taatgtacatatgaatcacctg

SEQ ID NO: 1158518 - DNA, 22 bp, Artificial Sequence
  chemically synthesized
aatgtacatatgaatcacctgg

SEQ ID NO: 1158519 - DNA, 22 bp, Artificial Sequence
  chemically synthesized
atgtacatatgaatcacctgga

SEQ ID NO: 1158520 - DNA, 22 bp, Artificial Sequence
  chemically synthesized
gaatgcatagtttgacactctc

SEQ ID NO: 1158521 - DNA, 22 bp, Artificial Sequence
  chemically synthesized
agaatgcatagtttgacactct

SEQ ID NO: 1158522 - DNA, 22 bp, Artificial Sequence
  chemically synthesized
acttagaatgcatagtttgaca

SEQ ID NO: 1158523 - DNA, 22 bp, Artificial Sequence
  chemically synthesized
ctgacttagaatgcatagtttg

SEQ ID NO: 1158524 - DNA, 22 bp, Artificial Sequence
  chemically synthesized
gagagtgtcaaactatgcattc

SEQ ID NO: 1158525 - DNA, 22 bp, Artificial Sequence
  chemically synthesized
tgcattctaagtcagtaggcct

SEQ ID NO: 1158526 - DNA, 22 bp, Artificial Sequence
  chemically synthesized
aggccccaacccaggcctactg

SEQ ID NO: 1158527 - DNA, 22 bp, Artificial Sequence
  chemically synthesized
taagtcagtaggcctgggttgg

SEQ ID NO: 1158528 - DNA, 22 bp, Artificial Sequence
  chemically synthesized
agtcagtaggcctgggttgggg

SEQ ID NO: 1158529 - DNA, 22 bp, Artificial Sequence
  chemically synthesized
gaaatgcagaatctcaggcccc

SEQ ID NO: 1158530 - DNA, 22 bp, Artificial Sequence
  chemically synthesized
ttagaaatgcagaatctcaggc

SEQ ID NO: 1158531 - DNA, 22 bp, Artificial Sequence
  chemically synthesized
ggttggggcctgagattctgca

SEQ ID NO: 1158532 - DNA, 22 bp, Artificial Sequence
  chemically synthesized
ggcagttgttagaaatgcagaa

SEQ ID NO: 1158533 - DNA, 22 bp, Artificial Sequence
  chemically synthesized
gggcagttgttagaaatgcaga

SEQ ID NO: 1158534 - DNA, 22 bp, Artificial Sequence
  chemically synthesized
gggcctgagattctgcatttct

SEQ ID NO: 1158535 - DNA, 22 bp, Artificial Sequence
  chemically synthesized
agattctgcatttctaacaact

SEQ ID NO: 1158536 - DNA, 22 bp, Artificial Sequence
  chemically synthesized
atatcccttgggcagttgttag

SEQ ID NO: 1158537 - DNA, 22 bp, Artificial Sequence
  chemically synthesized
tgcatttctaacaactgcccaa

SEQ ID NO: 1158538 - DNA, 22 bp, Artificial Sequence
  chemically synthesized
catttctaacaactgcccaagg

SEQ ID NO: 1158539 - DNA, 22 bp, Artificial Sequence
  chemically synthesized
ctaacaactgcccaagggatat

SEQ ID NO: 1158540 - DNA, 22 bp, Artificial Sequence
  chemically synthesized
taacaactgcccaagggatatc

SEQ ID NO: 1158541 - DNA, 22 bp, Artificial Sequence
  chemically synthesized
acaactgcccaagggatatcaa

SEQ ID NO: 1158542 - DNA, 22 bp, Artificial Sequence
  chemically synthesized
atggatccgaagcattgatatc

SEQ ID NO: 1158543 - DNA, 22 bp, Artificial Sequence
  chemically synthesized
cccaagggatatcaatgcttcg

SEQ ID NO: 1158544 - DNA, 22 bp, Artificial Sequence
  chemically synthesized
aaatgtgattaatggatccgaa

SEQ ID NO: 1158545 - DNA, 22 bp, Artificial Sequence
  chemically synthesized
aaaatgtgattaatggatccga

SEQ ID NO: 1158546 - DNA, 22 bp, Artificial Sequence
  chemically synthesized
cttaaaatgtgattaatggatc

SEQ ID NO: 1158547 - DNA, 22 bp, Artificial Sequence
  chemically synthesized
ctccttaaaatgtgattaatgg

SEQ ID NO: 1158548 - DNA, 22 bp, Artificial Sequence
  chemically synthesized
cggatccattaatcacatttta

SEQ ID NO: 1158549 - DNA, 22 bp, Artificial Sequence
  chemically synthesized
ggatccattaatcacattttaa

SEQ ID NO: 1158550 - DNA, 22 bp, Artificial Sequence
  chemically synthesized
taccattgctccttaaaatgtg

SEQ ID NO: 1158551 - DNA, 22 bp, Artificial Sequence
  chemically synthesized
ataccattgctccttaaaatgt

SEQ ID NO: 1158552 - DNA, 22 bp, Artificial Sequence
  chemically synthesized
atcacattttaaggagcaatgg

SEQ ID NO: 1158553 - DNA, 22 bp, Artificial Sequence
  chemically synthesized
aaagtgacttataccattgctc

SEQ ID NO: 1158554 - DNA, 22 bp, Artificial Sequence
  chemically synthesized
taaggagcaatggtataagtca

SEQ ID NO: 1158555 - DNA, 22 bp, Artificial Sequence
  chemically synthesized
aaggagcaatggtataagtcac

SEQ ID NO: 1158556 - DNA, 22 bp, Artificial Sequence
  chemically synthesized
aggagcaatggtataagtcact

SEQ ID NO: 1158557 - DNA, 22 bp, Artificial Sequence
  chemically synthesized
caaatgacaaaaaggccaactc

SEQ ID NO: 1158558 - DNA, 22 bp, Artificial Sequence
  chemically synthesized
ctgcaaatgacaaaaaggccaa

SEQ ID NO: 1158559 - DNA, 22 bp, Artificial Sequence
  chemically synthesized
actgcaaatgacaaaaaggcca

SEQ ID NO: 1158560 - DNA, 22 bp, Artificial Sequence
  chemically synthesized
tgagttggcctttttgtcattt

SEQ ID NO: 1158561 - DNA, 22 bp, Artificial Sequence
  chemically synthesized
gagttggcctttttgtcatttg

SEQ ID NO: 1158562 - DNA, 22 bp, Artificial Sequence
  chemically synthesized
agttggcctttttgtcatttgc

SEQ ID NO: 1158563 - DNA, 22 bp, Artificial Sequence
  chemically synthesized
gaatgccatttactgcaaatga

SEQ ID NO: 1158564 - DNA, 22 bp, Artificial Sequence
  chemically synthesized
agaatgccatttactgcaaatg

SEQ ID NO: 1158565 - DNA, 22 bp, Artificial Sequence
  chemically synthesized
gcctttttgtcatttgcagtaa

SEQ ID NO: 1158566 - DNA, 22 bp, Artificial Sequence
  chemically synthesized
cgtcttagaatgccatttactg

SEQ ID NO: 1158567 - DNA, 22 bp, Artificial Sequence
  chemically synthesized
tttgtcatttgcagtaaatggc

SEQ ID NO: 1158568 - DNA, 22 bp, Artificial Sequence
  chemically synthesized
ttgtcatttgcagtaaatggca

SEQ ID NO: 1158569 - DNA, 22 bp, Artificial Sequence
  chemically synthesized
tgtcatttgcagtaaatggcat

SEQ ID NO: 1158570 - DNA, 22 bp, Artificial Sequence
  chemically synthesized
gtcatttgcagtaaatggcatt

SEQ ID NO: 1158571 - DNA, 22 bp, Artificial Sequence
  chemically synthesized
tcatttgcagtaaatggcattc

SEQ ID NO: 1158572 - DNA, 22 bp, Artificial Sequence
  chemically synthesized
aaaaatactacgtcttagaatg

SEQ ID NO: 1158573 - DNA, 22 bp, Artificial Sequence
  chemically synthesized
gcagtaaatggcattctaagac

SEQ ID NO: 1158574 - DNA, 22 bp, Artificial Sequence
  chemically synthesized
gaaaaatactacgtcttagaat

SEQ ID NO: 1158575 - DNA, 22 bp, Artificial Sequence
  chemically synthesized
cagtaaatggcattctaagacg

SEQ ID NO: 1158576 - DNA, 22 bp, Artificial Sequence
  chemically synthesized
gagtaaaatcatttgaaaaata

SEQ ID NO: 1158577 - DNA, 22 bp, Artificial Sequence
  chemically synthesized
taagacgtagtatttttcaaat

SEQ ID NO: 1158578 - DNA, 22 bp, Artificial Sequence
  chemically synthesized
tcgagtaaaatcatttgaaaaa

SEQ ID NO: 1158579 - DNA, 22 bp, Artificial Sequence
  chemically synthesized
agacgtagtatttttcaaatga

SEQ ID NO: 1158580 - DNA, 22 bp, Artificial Sequence
  chemically synthesized
ttcaaatgattttactcgagag

SEQ ID NO: 1158581 - DNA, 22 bp, Artificial Sequence
  chemically synthesized
tcaaatgattttactcgagagc

SEQ ID NO: 1158582 - DNA, 22 bp, Artificial Sequence
  chemically synthesized
caaatgattttactcgagagct

SEQ ID NO: 1158583 - DNA, 22 bp, Artificial Sequence
  chemically synthesized
aaatgattttactcgagagctg

SEQ ID NO: 1158584 - DNA, 22 bp, Artificial Sequence
  chemically synthesized
atgtccgggggtgggatgacag

SEQ ID NO: 1158585 - DNA, 22 bp, Artificial Sequence
  chemically synthesized
catgtccgggggtgggatgaca

SEQ ID NO: 1158586 - DNA, 22 bp, Artificial Sequence
  chemically synthesized
tactcgagagctgtcatcccac

SEQ ID NO: 1158587 - DNA, 22 bp, Artificial Sequence
  chemically synthesized
tcatgtccgggggtgggatgac

SEQ ID NO: 1158588 - DNA, 22 bp, Artificial Sequence
  chemically synthesized
actcgagagctgtcatcccacc

SEQ ID NO: 1158589 - DNA, 22 bp, Artificial Sequence
  chemically synthesized
ctcgagagctgtcatcccaccc

SEQ ID NO: 1158590 - DNA, 22 bp, Artificial Sequence
  chemically synthesized
gagagctgtcatcccacccccg

SEQ ID NO: 1158591 - DNA, 22 bp, Artificial Sequence
  chemically synthesized
tcatcccacccccggacatgaa

SEQ ID NO: 1158592 - DNA, 22 bp, Artificial Sequence
  chemically synthesized
atacagatacgttttcatgtcc

SEQ ID NO: 1158593 - DNA, 22 bp, Artificial Sequence
  chemically synthesized
tgttcatacagatacgttttca

SEQ ID NO: 1158594 - DNA, 22 bp, Artificial Sequence
  chemically synthesized
atgttcatacagatacgttttc

SEQ ID NO: 1158595 - DNA, 22 bp, Artificial Sequence
  chemically synthesized
tatgttcatacagatacgtttt

SEQ ID NO: 1158596 - DNA, 22 bp, Artificial Sequence
  chemically synthesized
ctttatgttcatacagatacgt

SEQ ID NO: 1158597 - DNA, 22 bp, Artificial Sequence
  chemically synthesized
aattcctttatgttcatacaga

SEQ ID NO: 1158598 - DNA, 22 bp, Artificial Sequence
  chemically synthesized
ccattgaattcctttatgttca

SEQ ID NO: 1158599 - DNA, 22 bp, Artificial Sequence
  chemically synthesized
gcattcccattgaattccttta

SEQ ID NO: 1158600 - DNA, 22 bp, Artificial Sequence
  chemically synthesized
tatgaacataaaggaattcaat

SEQ ID NO: 1158601 - DNA, 22 bp, Artificial Sequence
  chemically synthesized
taaagcaaagctggcattccca

SEQ ID NO: 1158602 - DNA, 22 bp, Artificial Sequence
  chemically synthesized
tgtaaagcaaagctggcattcc

SEQ ID NO: 1158603 - DNA, 22 bp, Artificial Sequence
  chemically synthesized
ctgtaaagcaaagctggcattc

SEQ ID NO: 1158604 - DNA, 22 bp, Artificial Sequence
  chemically synthesized
aatgggaatgccagctttgctt

SEQ ID NO: 1158605 - DNA, 22 bp, Artificial Sequence
  chemically synthesized
acagagtttctgtaaagcaaag

SEQ ID NO: 1158606 - DNA, 22 bp, Artificial Sequence
  chemically synthesized
taacagagtttctgtaaagcaa

SEQ ID NO: 1158607 - DNA, 22 bp, Artificial Sequence
  chemically synthesized
cattctaacagagtttctgtaa

SEQ ID NO: 1158608 - DNA, 22 bp, Artificial Sequence
  chemically synthesized
ctacattctaacagagtttctg

SEQ ID NO: 1158609 - DNA, 22 bp, Artificial Sequence
  chemically synthesized
cctacattctaacagagtttct

SEQ ID NO: 1158610 - DNA, 22 bp, Artificial Sequence
  chemically synthesized
tgctttacagaaactctgttag

SEQ ID NO: 1158611 - DNA, 22 bp, Artificial Sequence
  chemically synthesized
gctttacagaaactctgttaga

SEQ ID NO: 1158612 - DNA, 22 bp, Artificial Sequence
  chemically synthesized
ctttacagaaactctgttagaa

SEQ ID NO: 1158613 - DNA, 22 bp, Artificial Sequence
  chemically synthesized
tacagaaactctgttagaatgt

SEQ ID NO: 1158614 - DNA, 22 bp, Artificial Sequence
  chemically synthesized
acagaaactctgttagaatgta

SEQ ID NO: 1158615 - DNA, 22 bp, Artificial Sequence
  chemically synthesized
cagaaactctgttagaatgtag

SEQ ID NO: 1158616 - DNA, 22 bp, Artificial Sequence
  chemically synthesized
tgttagaatgtaggaaggcggc

SEQ ID NO: 1158617 - DNA, 22 bp, Artificial Sequence
  chemically synthesized
ttagaatgtaggaaggcggctg

SEQ ID NO: 1158618 - DNA, 22 bp, Artificial Sequence
  chemically synthesized
gaatgtaggaaggcggctgggt

SEQ ID NO: 1158619 - DNA, 22 bp, Artificial Sequence
  chemically synthesized
caggcgtgagccatcgcaccca

SEQ ID NO: 1158620 - DNA, 22 bp, Artificial Sequence
  chemically synthesized
ggtgcgatggctcacgcctgta

SEQ ID NO: 1158621 - DNA, 22 bp, Artificial Sequence
  chemically synthesized
ccaaagtgatgagattacaggc

SEQ ID NO: 1158622 - DNA, 22 bp, Artificial Sequence
  chemically synthesized
agcctcccaaagtgatgagatt

SEQ ID NO: 1158623 - DNA, 22 bp, Artificial Sequence
  chemically synthesized
acgcctgtaatctcatcacttt

SEQ ID NO: 1158624 - DNA, 22 bp, Artificial Sequence
  chemically synthesized
taatctcatcactttgggaggc

SEQ ID NO: 1158625 - DNA, 22 bp, Artificial Sequence
  chemically synthesized
tgatccgccgcctcagcctccc

SEQ ID NO: 1158626 - DNA, 22 bp, Artificial Sequence
  chemically synthesized
gtgatccgccgcctcagcctcc

SEQ ID NO: 1158627 - DNA, 22 bp, Artificial Sequence
  chemically synthesized
atcactttgggaggctgaggcg

SEQ ID NO: 1158628 - DNA, 22 bp, Artificial Sequence
  chemically synthesized
accttgtgatccgccgcctcag

SEQ ID NO: 1158629 - DNA, 22 bp, Artificial Sequence
  chemically synthesized
ctgaccttgtgatccgccgcct

SEQ ID NO: 1158630 - DNA, 22 bp, Artificial Sequence
  chemically synthesized
tgggaggctgaggcggcggatc

SEQ ID NO: 1158631 - DNA, 22 bp, Artificial Sequence
  chemically synthesized
gggaggctgaggcggcggatca

SEQ ID NO: 1158632 - DNA, 22 bp, Artificial Sequence
  chemically synthesized
ggaggctgaggcggcggatcac

SEQ ID NO: 1158633 - DNA, 22 bp, Artificial Sequence
  chemically synthesized
gaactcctgaccttgtgatccg

SEQ ID NO: 1158634 - DNA, 22 bp, Artificial Sequence
  chemically synthesized
cgaactcctgaccttgtgatcc

SEQ ID NO: 1158635 - DNA, 22 bp, Artificial Sequence
  chemically synthesized
tcgaactcctgaccttgtgatc

SEQ ID NO: 1158636 - DNA, 22 bp, Artificial Sequence
  chemically synthesized
aggcggcggatcacaaggtcag

SEQ ID NO: 1158637 - DNA, 22 bp, Artificial Sequence
  chemically synthesized
gccaggatgctttcgaactcct

SEQ ID NO: 1158638 - DNA, 22 bp, Artificial Sequence
  chemically synthesized
accatgttggccaggatgcttt

SEQ ID NO: 1158639 - DNA, 22 bp, Artificial Sequence
  chemically synthesized
caccatgttggccaggatgctt

SEQ ID NO: 1158640 - DNA, 22 bp, Artificial Sequence
  chemically synthesized
gaaagcatcctggccaacatgg

SEQ ID NO: 1158641 - DNA, 22 bp, Artificial Sequence
  chemically synthesized
gtggagatggggtttcaccatg

SEQ ID NO: 1158642 - DNA, 22 bp, Artificial Sequence
  chemically synthesized
agtggagatggggtttcaccat

SEQ ID NO: 1158643 - DNA, 22 bp, Artificial Sequence
  chemically synthesized
tagtggagatggggtttcacca

SEQ ID NO: 1158644 - DNA, 22 bp, Artificial Sequence
  chemically synthesized
ttagtggagatggggtttcacc

SEQ ID NO: 1158645 - DNA, 22 bp, Artificial Sequence
  chemically synthesized
gccaacatggtgaaaccccatc

SEQ ID NO: 1158646 - DNA, 22 bp, Artificial Sequence
  chemically synthesized
tatttttagtggagatggggtt

SEQ ID NO: 1158647 - DNA, 22 bp, Artificial Sequence
  chemically synthesized
gtatttttagtggagatggggt

SEQ ID NO: 1158648 - DNA, 22 bp, Artificial Sequence
  chemically synthesized
tgtatttttagtggagatgggg

SEQ ID NO: 1158649 - DNA, 22 bp, Artificial Sequence
  chemically synthesized
ttgtatttttagtggagatggg

SEQ ID NO: 1158650 - DNA, 22 bp, Artificial Sequence
  chemically synthesized
atttttgtatttttagtggaga

SEQ ID NO: 1158651 - DNA, 22 bp, Artificial Sequence
  chemically synthesized
ccggctaatttttgtattttta

SEQ ID NO: 1158652 - DNA, 22 bp, Artificial Sequence
  chemically synthesized
cactaaaaatacaaaaattagc

SEQ ID NO: 1158653 - DNA, 22 bp, Artificial Sequence
  chemically synthesized
aaaatacaaaaattagccggga

SEQ ID NO: 1158654 - DNA, 22 bp, Artificial Sequence
  chemically synthesized
caggcatgtgccaccactcccg

SEQ ID NO: 1158655 - DNA, 22 bp, Artificial Sequence
  chemically synthesized
ggactacaggcatgtgccacca

SEQ ID NO: 1158656 - DNA, 22 bp, Artificial Sequence
  chemically synthesized
gccgggagtggtggcacatgcc

SEQ ID NO: 1158657 - DNA, 22 bp, Artificial Sequence
  chemically synthesized
agtagctgggactacaggcatg

SEQ ID NO: 1158658 - DNA, 22 bp, Artificial Sequence
  chemically synthesized
ctgagtagctgggactacaggc

SEQ ID NO: 1158659 - DNA, 22 bp, Artificial Sequence
  chemically synthesized
agcctcctgagtagctgggact

SEQ ID NO: 1158660 - DNA, 22 bp, Artificial Sequence
  chemically synthesized
cctcagcctcctgagtagctgg

SEQ ID NO: 1158661 - DNA, 22 bp, Artificial Sequence
  chemically synthesized
tcctgcctcagcctcctgagta

SEQ ID NO: 1158662 - DNA, 22 bp, Artificial Sequence
  chemically synthesized
tagtcccagctactcaggaggc

SEQ ID NO: 1158663 - DNA, 22 bp, Artificial Sequence
  chemically synthesized
aagcaattgtcctgcctcagcc

SEQ ID NO: 1158664 - DNA, 22 bp, Artificial Sequence
  chemically synthesized
ctcaggaggctgaggcaggaca

SEQ ID NO: 1158665 - DNA, 22 bp, Artificial Sequence
  chemically synthesized
aggaggctgaggcaggacaatt

SEQ ID NO: 1158666 - DNA, 22 bp, Artificial Sequence
  chemically synthesized
ccgggttcaagcaattgtcctg

SEQ ID NO: 1158667 - DNA, 22 bp, Artificial Sequence
  chemically synthesized
cgcctcccgggttcaagcaatt

SEQ ID NO: 1158668 - DNA, 22 bp, Artificial Sequence
  chemically synthesized
aggcaggacaattgcttgaacc

SEQ ID NO: 1158669 - DNA, 22 bp, Artificial Sequence
  chemically synthesized
caacctccgcctcccgggttca

SEQ ID NO: 1158670 - DNA, 22 bp, Artificial Sequence
  chemically synthesized
actgcaacctccgcctcccggg

SEQ ID NO: 1158671 - DNA, 22 bp, Artificial Sequence
  chemically synthesized
agctcactgcaacctccgcctc

SEQ ID NO: 1158672 - DNA, 22 bp, Artificial Sequence
  chemically synthesized
cttgaacccgggaggcggaggt

SEQ ID NO: 1158673 - DNA, 22 bp, Artificial Sequence
  chemically synthesized
gaacccgggaggcggaggttgc

SEQ ID NO: 1158674 - DNA, 22 bp, Artificial Sequence
  chemically synthesized
aacccgggaggcggaggttgca

SEQ ID NO: 1158675 - DNA, 22 bp, Artificial Sequence
  chemically synthesized
atggtgcgaactcagctcactg

SEQ ID NO: 1158676 - DNA, 22 bp, Artificial Sequence
  chemically synthesized
gagtctaatggtgcgaactcag

SEQ ID NO: 1158677 - DNA, 22 bp, Artificial Sequence
  chemically synthesized
cagtgagctgagttcgcaccat

SEQ ID NO: 1158678 - DNA, 22 bp, Artificial Sequence
  chemically synthesized
aggctggagtctaatggtgcga

SEQ ID NO: 1158679 - DNA, 22 bp, Artificial Sequence
  chemically synthesized
tcactcaggctggagtctaatg

SEQ ID NO: 1158680 - DNA, 22 bp, Artificial Sequence
  chemically synthesized
tgtcactcaggctggagtctaa

SEQ ID NO: 1158681 - DNA, 22 bp, Artificial Sequence
  chemically synthesized
agttcgcaccattagactccag

SEQ ID NO: 1158682 - DNA, 22 bp, Artificial Sequence
  chemically synthesized
actctgtcactcaggctggagt

SEQ ID NO: 1158683 - DNA, 22 bp, Artificial Sequence
  chemically synthesized
cactctgtcactcaggctggag

SEQ ID NO: 1158684 - DNA, 22 bp, Artificial Sequence
  chemically synthesized
gcaccattagactccagcctga

SEQ ID NO: 1158685 - DNA, 22 bp, Artificial Sequence
  chemically synthesized
gactccagcctgagtgacagag

SEQ ID NO: 1158686 - DNA, 22 bp, Artificial Sequence
  chemically synthesized
aaacggcgtttcactctgtcac

SEQ ID NO: 1158687 - DNA, 22 bp, Artificial Sequence
  chemically synthesized
gaaacggcgtttcactctgtca

SEQ ID NO: 1158688 - DNA, 22 bp, Artificial Sequence
  chemically synthesized
tgaaacggcgtttcactctgtc

SEQ ID NO: 1158689 - DNA, 22 bp, Artificial Sequence
  chemically synthesized
ttgaaacggcgtttcactctgt

SEQ ID NO: 1158690 - DNA, 22 bp, Artificial Sequence
  chemically synthesized
cagcctgagtgacagagtgaaa

SEQ ID NO: 1158691 - DNA, 22 bp, Artificial Sequence
  chemically synthesized
tttgaaacggcgtttcactctg

SEQ ID NO: 1158692 - DNA, 22 bp, Artificial Sequence
  chemically synthesized
ttttttgaaacggcgtttcact

SEQ ID NO: 1158693 - DNA, 22 bp, Artificial Sequence
  chemically synthesized
gttttttgaaacggcgtttcac

SEQ ID NO: 1158694 - DNA, 22 bp, Artificial Sequence
  chemically synthesized
tgttttttgaaacggcgtttca

SEQ ID NO: 1158695 - DNA, 22 bp, Artificial Sequence
  chemically synthesized
ttgttttttgaaacggcgtttc

SEQ ID NO: 1158696 - DNA, 22 bp, Artificial Sequence
  chemically synthesized
agtgacagagtgaaacgccgtt

SEQ ID NO: 1158697 - DNA, 22 bp, Artificial Sequence
  chemically synthesized
tttgttttttgaaacggcgttt

SEQ ID NO: 1158698 - DNA, 22 bp, Artificial Sequence
  chemically synthesized
ttttgttttttgaaacggcgtt

SEQ ID NO: 1158699 - DNA, 22 bp, Artificial Sequence
  chemically synthesized
ttttttgttttttgaaacggcg

SEQ ID NO: 1158700 - DNA, 22 bp, Artificial Sequence
  chemically synthesized
cttttttgttttttgaaacggc

SEQ ID NO: 1158701 - DNA, 22 bp, Artificial Sequence
  chemically synthesized
tcttttttgttttttgaaacgg

SEQ ID NO: 1158702 - DNA, 22 bp, Artificial Sequence
  chemically synthesized
tttcttttttgttttttgaaac

SEQ ID NO: 1158703 - DNA, 22 bp, Artificial Sequence
  chemically synthesized
cattctttcttttttgtttttt

SEQ ID NO: 1158704 - DNA, 22 bp, Artificial Sequence
  chemically synthesized
ctacattctttcttttttgttt

SEQ ID NO: 1158705 - DNA, 22 bp, Artificial Sequence
  chemically synthesized
cctacattctttcttttttgtt

SEQ ID NO: 1158706 - DNA, 22 bp, Artificial Sequence
  chemically synthesized
ccttcctacattctttcttttt

SEQ ID NO: 1158707 - DNA, 22 bp, Artificial Sequence
  chemically synthesized
caaaaaacaaaaaagaaagaat

SEQ ID NO: 1158708 - DNA, 22 bp, Artificial Sequence
  chemically synthesized
aaaaaacaaaaaagaaagaatg

SEQ ID NO: 1158709 - DNA, 22 bp, Artificial Sequence
  chemically synthesized
aagaataattgccttcctacat

SEQ ID NO: 1158710 - DNA, 22 bp, Artificial Sequence
  chemically synthesized
gttaaagaataattgccttcct

SEQ ID NO: 1158711 - DNA, 22 bp, Artificial Sequence
  chemically synthesized
gacaacactggttaaagaataa

SEQ ID NO: 1158712 - DNA, 22 bp, Artificial Sequence
  chemically synthesized
tggacaacactggttaaagaat

SEQ ID NO: 1158713 - DNA, 22 bp, Artificial Sequence
  chemically synthesized
gtaagttctggacaacactggt

SEQ ID NO: 1158714 - DNA, 22 bp, Artificial Sequence
  chemically synthesized
agtaagttctggacaacactgg

SEQ ID NO: 1158715 - DNA, 22 bp, Artificial Sequence
  chemically synthesized
tagtaagttctggacaacactg

SEQ ID NO: 1158716 - DNA, 22 bp, Artificial Sequence
  chemically synthesized
ttctttaaccagtgttgtccag

SEQ ID NO: 1158717 - DNA, 22 bp, Artificial Sequence
  chemically synthesized
tttaaccagtgttgtccagaac

SEQ ID NO: 1158718 - DNA, 22 bp, Artificial Sequence
  chemically synthesized
taaccagtgttgtccagaactt

SEQ ID NO: 1158719 - DNA, 22 bp, Artificial Sequence
  chemically synthesized
catcattttagtaagttctgga

SEQ ID NO: 1158720 - DNA, 22 bp, Artificial Sequence
  chemically synthesized
aaccagtgttgtccagaactta

SEQ ID NO: 1158721 - DNA, 22 bp, Artificial Sequence
  chemically synthesized
acatcattttagtaagttctgg

SEQ ID NO: 1158722 - DNA, 22 bp, Artificial Sequence
  chemically synthesized
accagtgttgtccagaacttac

SEQ ID NO: 1158723 - DNA, 22 bp, Artificial Sequence
  chemically synthesized
tccagaacttactaaaatgatg

SEQ ID NO: 1158724 - DNA, 22 bp, Artificial Sequence
  chemically synthesized
actaaaatgatgtaaatattct

SEQ ID NO: 1158725 - DNA, 22 bp, Artificial Sequence
  chemically synthesized
tagtgcacacatagaatattta

SEQ ID NO: 1158726 - DNA, 22 bp, Artificial Sequence
  chemically synthesized
ctaaaatgatgtaaatattcta

SEQ ID NO: 1158727 - DNA, 22 bp, Artificial Sequence
  chemically synthesized
aaatgatgtaaatattctatgt

SEQ ID NO: 1158728 - DNA, 22 bp, Artificial Sequence
  chemically synthesized
tatatgtatacctatagtgcac

SEQ ID NO: 1158729 - DNA, 22 bp, Artificial Sequence
  chemically synthesized
tatgtgtgcactataggtatac

SEQ ID NO: 1158730 - DNA, 22 bp, Artificial Sequence
  chemically synthesized
tgtgtgcactataggtatacat

SEQ ID NO: 1158731 - DNA, 22 bp, Artificial Sequence
  chemically synthesized
gtgtccattatatatgtatacc

SEQ ID NO: 1158732 - DNA, 22 bp, Artificial Sequence
  chemically synthesized
actagtgtccattatatatgta

SEQ ID NO: 1158733 - DNA, 22 bp, Artificial Sequence
  chemically synthesized
taggtatacatatataatggac

SEQ ID NO: 1158734 - DNA, 22 bp, Artificial Sequence
  chemically synthesized
ccacctgactagtgtccattat

SEQ ID NO: 1158735 - DNA, 22 bp, Artificial Sequence
  chemically synthesized
ttcccacctgactagtgtccat

SEQ ID NO: 1158736 - DNA, 22 bp, Artificial Sequence
  chemically synthesized
attattcccacctgactagtgt

SEQ ID NO: 1158737 - DNA, 22 bp, Artificial Sequence
  chemically synthesized
aagtgttcattattcccacctg

SEQ ID NO: 1158738 - DNA, 22 bp, Artificial Sequence
  chemically synthesized
caagtgttcattattcccacct

SEQ ID NO: 1158739 - DNA, 22 bp, Artificial Sequence
  chemically synthesized
gtcaggtgggaataatgaacac

SEQ ID NO: 1158740 - DNA, 22 bp, Artificial Sequence
  chemically synthesized
gccatacatatttcaagtgttc

SEQ ID NO: 1158741 - DNA, 22 bp, Artificial Sequence
  chemically synthesized
ctagccatacatatttcaagtg

SEQ ID NO: 1158742 - DNA, 22 bp, Artificial Sequence
  chemically synthesized
actagccatacatatttcaagt

SEQ ID NO: 1158743 - DNA, 22 bp, Artificial Sequence
  chemically synthesized
agccttactagccatacatatt

SEQ ID NO: 1158744 - DNA, 22 bp, Artificial Sequence
  chemically synthesized
tgagccttactagccatacata

SEQ ID NO: 1158745 - DNA, 22 bp, Artificial Sequence
  chemically synthesized
ctgagccttactagccatacat

SEQ ID NO: 1158746 - DNA, 22 bp, Artificial Sequence
  chemically synthesized
agtttctgagccttactagcca

SEQ ID NO: 1158747 - DNA, 22 bp, Artificial Sequence
  chemically synthesized
gaaatatgtatggctagtaagg

SEQ ID NO: 1158748 - DNA, 22 bp, Artificial Sequence
  chemically synthesized
aaatatgtatggctagtaaggc

SEQ ID NO: 1158749 - DNA, 22 bp, Artificial Sequence
  chemically synthesized
aaaattcagtttctgagcctta

SEQ ID NO: 1158750 - DNA, 22 bp, Artificial Sequence
  chemically synthesized
aatatagttaaaaattcagttt

SEQ ID NO: 1158751 - DNA, 22 bp, Artificial Sequence
  chemically synthesized
gtaaggctcagaaactgaattt

SEQ ID NO: 1158752 - DNA, 22 bp, Artificial Sequence
  chemically synthesized
taattaaatatagttaaaaatt

SEQ ID NO: 1158753 - DNA, 22 bp, Artificial Sequence
  chemically synthesized
ttataattaaatatagttaaaa

SEQ ID NO: 1158754 - DNA, 22 bp, Artificial Sequence
  chemically synthesized
agaaactgaatttttaactata

SEQ ID NO: 1158755 - DNA, 22 bp, Artificial Sequence
  chemically synthesized
taattattataattaaatatag

SEQ ID NO: 1158756 - DNA, 22 bp, Artificial Sequence
  chemically synthesized
aatttttaactatatttaatta

SEQ ID NO: 1158757 - DNA, 22 bp, Artificial Sequence
  chemically synthesized
ttaactatatttaattataata

SEQ ID NO: 1158758 - DNA, 22 bp, Artificial Sequence
  chemically synthesized
taactatatttaattataataa

SEQ ID NO: 1158759 - DNA, 22 bp, Artificial Sequence
  chemically synthesized
aactatatttaattataataat

SEQ ID NO: 1158760 - DNA, 22 bp, Artificial Sequence
  chemically synthesized
actatatttaattataataatt

SEQ ID NO: 1158761 - DNA, 22 bp, Artificial Sequence
  chemically synthesized
tatttaattataataattataa

SEQ ID NO: 1158762 - DNA, 22 bp, Artificial Sequence
  chemically synthesized
tgtgtaggtaaattataattat

SEQ ID NO: 1158763 - DNA, 22 bp, Artificial Sequence
  chemically synthesized
gctatgtgtaggtaaattataa

SEQ ID NO: 1158764 - DNA, 22 bp, Artificial Sequence
  chemically synthesized
aattataataattataatttac

SEQ ID NO: 1158765 - DNA, 22 bp, Artificial Sequence
  chemically synthesized
attataataattataatttacc

SEQ ID NO: 1158766 - DNA, 22 bp, Artificial Sequence
  chemically synthesized
taataattataatttacctaca

SEQ ID NO: 1158767 - DNA, 22 bp, Artificial Sequence
  chemically synthesized
cagccgctagctatgtgtaggt

SEQ ID NO: 1158768 - DNA, 22 bp, Artificial Sequence
  chemically synthesized
taatttacctacacatagctag

SEQ ID NO: 1158769 - DNA, 22 bp, Artificial Sequence
  chemically synthesized
tccaatattgcagccgctagct

SEQ ID NO: 1158770 - DNA, 22 bp, Artificial Sequence
  chemically synthesized
acctacacatagctagcggctg

SEQ ID NO: 1158771 - DNA, 22 bp, Artificial Sequence
  chemically synthesized
cctacacatagctagcggctgc

SEQ ID NO: 1158772 - DNA, 22 bp, Artificial Sequence
  chemically synthesized
tgctgtccaatattgcagccgc

SEQ ID NO: 1158773 - DNA, 22 bp, Artificial Sequence
  chemically synthesized
cacatagctagcggctgcaata

SEQ ID NO: 1158774 - DNA, 22 bp, Artificial Sequence
  chemically synthesized
tagctgtgctgtccaatattgc

SEQ ID NO: 1158775 - DNA, 22 bp, Artificial Sequence
  chemically synthesized
atagctgtgctgtccaatattg

SEQ ID NO: 1158776 - DNA, 22 bp, Artificial Sequence
  chemically synthesized
gcggctgcaatattggacagca

SEQ ID NO: 1158777 - DNA, 22 bp, Artificial Sequence
  chemically synthesized
tcggtttatagctgtgctgtcc

SEQ ID NO: 1158778 - DNA, 22 bp, Artificial Sequence
  chemically synthesized
tctgtcggtttatagctgtgct

SEQ ID NO: 1158779 - DNA, 22 bp, Artificial Sequence
  chemically synthesized
caatattggacagcacagctat

SEQ ID NO: 1158780 - DNA, 22 bp, Artificial Sequence
  chemically synthesized
attatctgtcggtttatagctg

SEQ ID NO: 1158781 - DNA, 22 bp, Artificial Sequence
  chemically synthesized
gacagcacagctataaaccgac

SEQ ID NO: 1158782 - DNA, 22 bp, Artificial Sequence
  chemically synthesized
gtaatctaattatctgtcggtt

SEQ ID NO: 1158783 - DNA, 22 bp, Artificial Sequence
  chemically synthesized
taaaccgacagataattagatt

SEQ ID NO: 1158784 - DNA, 22 bp, Artificial Sequence
  chemically synthesized
acggatattggtaatctaatta

SEQ ID NO: 1158785 - DNA, 22 bp, Artificial Sequence
  chemically synthesized
caaataaggattcacggatatt

SEQ ID NO: 1158786 - DNA, 22 bp, Artificial Sequence
  chemically synthesized
gcaaataaggattcacggatat

SEQ ID NO: 1158787 - DNA, 22 bp, Artificial Sequence
  chemically synthesized
gattaccaatatccgtgaatcc

SEQ ID NO: 1158788 - DNA, 22 bp, Artificial Sequence
  chemically synthesized
ccaatatccgtgaatccttatt

SEQ ID NO: 1158789 - DNA, 22 bp, Artificial Sequence
  chemically synthesized
gtatggataagtacttgcaaat

SEQ ID NO: 1158790 - DNA, 22 bp, Artificial Sequence
  chemically synthesized
atttgcaagtacttatccatac

SEQ ID NO: 1158791 - DNA, 22 bp, Artificial Sequence
  chemically synthesized
tttgcaagtacttatccatacc

SEQ ID NO: 1158792 - DNA, 22 bp, Artificial Sequence
  chemically synthesized
gcaagtacttatccataccaat

SEQ ID NO: 1158793 - DNA, 22 bp, Artificial Sequence
  chemically synthesized
caagtacttatccataccaatt

SEQ ID NO: 1158794 - DNA, 22 bp, Artificial Sequence
  chemically synthesized
gaggacaaaataaattggtatg

SEQ ID NO: 1158795 - DNA, 22 bp, Artificial Sequence
  chemically synthesized
atccataccaatttattttgtc

SEQ ID NO: 1158796 - DNA, 22 bp, Artificial Sequence
  chemically synthesized
tccataccaatttattttgtcc

SEQ ID NO: 1158797 - DNA, 22 bp, Artificial Sequence
  chemically synthesized
atagacattggaggacaaaata

SEQ ID NO: 1158798 - DNA, 22 bp, Artificial Sequence
  chemically synthesized
ctcatagacattggaggacaaa

SEQ ID NO: 1158799 - DNA, 22 bp, Artificial Sequence
  chemically synthesized
attttgtcctccaatgtctatg

SEQ ID NO: 1158800 - DNA, 22 bp, Artificial Sequence
  chemically synthesized
ttttgtcctccaatgtctatga

SEQ ID NO: 1158801 - DNA, 22 bp, Artificial Sequence
  chemically synthesized
ggatgtcattcctcatagacat

SEQ ID NO: 1158802 - DNA, 22 bp, Artificial Sequence
  chemically synthesized
aggatgtcattcctcatagaca

SEQ ID NO: 1158803 - DNA, 22 bp, Artificial Sequence
  chemically synthesized
tgtcctccaatgtctatgagga

SEQ ID NO: 1158804 - DNA, 22 bp, Artificial Sequence
  chemically synthesized
gtcctccaatgtctatgaggaa

SEQ ID NO: 1158805 - DNA, 22 bp, Artificial Sequence
  chemically synthesized
tcctccaatgtctatgaggaat

SEQ ID NO: 1158806 - DNA, 22 bp, Artificial Sequence
  chemically synthesized
aacttaggatgtcattcctcat

SEQ ID NO: 1158807 - DNA, 22 bp, Artificial Sequence
  chemically synthesized
ctaaacttaggatgtcattcct

SEQ ID NO: 1158808 - DNA, 22 bp, Artificial Sequence
  chemically synthesized
caatgtctatgaggaatgacat

SEQ ID NO: 1158809 - DNA, 22 bp, Artificial Sequence
  chemically synthesized
gattgctaaacttaggatgtca

SEQ ID NO: 1158810 - DNA, 22 bp, Artificial Sequence
  chemically synthesized
ctagattgctaaacttaggatg

SEQ ID NO: 1158811 - DNA, 22 bp, Artificial Sequence
  chemically synthesized
tgaggaatgacatcctaagttt

SEQ ID NO: 1158812 - DNA, 22 bp, Artificial Sequence
  chemically synthesized
ttgctagattgctaaacttagg

SEQ ID NO: 1158813 - DNA, 22 bp, Artificial Sequence
  chemically synthesized
attgctagattgctaaacttag

SEQ ID NO: 1158814 - DNA, 22 bp, Artificial Sequence
  chemically synthesized
atgtttattgctagattgctaa

SEQ ID NO: 1158815 - DNA, 22 bp, Artificial Sequence
  chemically synthesized
ttaatgtttattgctagattgc

SEQ ID NO: 1158816 - DNA, 22 bp, Artificial Sequence
  chemically synthesized
agtttagcaatctagcaataaa

SEQ ID NO: 1158817 - DNA, 22 bp, Artificial Sequence
  chemically synthesized
aaaaatgctattaatgtttatt

SEQ ID NO: 1158818 - DNA, 22 bp, Artificial Sequence
  chemically synthesized
agcaatctagcaataaacatta

SEQ ID NO: 1158819 - DNA, 22 bp, Artificial Sequence
  chemically synthesized
aaaaaatgctattaatgtttat

SEQ ID NO: 1158820 - DNA, 22 bp, Artificial Sequence
  chemically synthesized
gcaatctagcaataaacattaa

SEQ ID NO: 1158821 - DNA, 22 bp, Artificial Sequence
  chemically synthesized
taaaaaatgctattaatgttta

SEQ ID NO: 1158822 - DNA, 22 bp, Artificial Sequence
  chemically synthesized
gcaataaacattaatagcattt

SEQ ID NO: 1158823 - DNA, 22 bp, Artificial Sequence
  chemically synthesized
tatatggaaaatgaaaatttta

SEQ ID NO: 1158824 - DNA, 22 bp, Artificial Sequence
  chemically synthesized
atagcattttttaaaattttca

SEQ ID NO: 1158825 - DNA, 22 bp, Artificial Sequence
  chemically synthesized
gtatatggaaaatgaaaatttt

SEQ ID NO: 1158826 - DNA, 22 bp, Artificial Sequence
  chemically synthesized
taaatttgtatatggaaaatga

SEQ ID NO: 1158827 - DNA, 22 bp, Artificial Sequence
  chemically synthesized
ataaatttgtatatggaaaatg

SEQ ID NO: 1158828 - DNA, 22 bp, Artificial Sequence
  chemically synthesized
tttaaaattttcattttccata

SEQ ID NO: 1158829 - DNA, 22 bp, Artificial Sequence
  chemically synthesized
ttaaaattttcattttccatat

SEQ ID NO: 1158830 - DNA, 22 bp, Artificial Sequence
  chemically synthesized
taaaattttcattttccatata

SEQ ID NO: 1158831 - DNA, 22 bp, Artificial Sequence
  chemically synthesized
aaaattttcattttccatatac

SEQ ID NO: 1158832 - DNA, 22 bp, Artificial Sequence
  chemically synthesized
aaattttcattttccatataca

SEQ ID NO: 1158833 - DNA, 22 bp, Artificial Sequence
  chemically synthesized
catttataaatttgtatatgga

SEQ ID NO: 1158834 - DNA, 22 bp, Artificial Sequence
  chemically synthesized
gcatttataaatttgtatatgg

SEQ ID NO: 1158835 - DNA, 22 bp, Artificial Sequence
  chemically synthesized
tgcatttataaatttgtatatg

SEQ ID NO: 1158836 - DNA, 22 bp, Artificial Sequence
  chemically synthesized
ttttgcatttataaatttgtat

SEQ ID NO: 1158837 - DNA, 22 bp, Artificial Sequence
  chemically synthesized
tcattttccatatacaaattta

SEQ ID NO: 1158838 - DNA, 22 bp, Artificial Sequence
  chemically synthesized
cattttccatatacaaatttat

SEQ ID NO: 1158839 - DNA, 22 bp, Artificial Sequence
  chemically synthesized
attttccatatacaaatttata

SEQ ID NO: 1158840 - DNA, 22 bp, Artificial Sequence
  chemically synthesized
tccatatacaaatttataaatg

SEQ ID NO: 1158841 - DNA, 22 bp, Artificial Sequence
  chemically synthesized
ccatatacaaatttataaatgc

SEQ ID NO: 1158842 - DNA, 22 bp, Artificial Sequence
  chemically synthesized
catatacaaatttataaatgca

SEQ ID NO: 1158843 - DNA, 22 bp, Artificial Sequence
  chemically synthesized
atgaaaacatgtactattttgc

SEQ ID NO: 1158844 - DNA, 22 bp, Artificial Sequence
  chemically synthesized
ataaatgcaaaatagtacatgt

SEQ ID NO: 1158845 - DNA, 22 bp, Artificial Sequence
  chemically synthesized
aaattaatgaaaacatgtacta

SEQ ID NO: 1158846 - DNA, 22 bp, Artificial Sequence
  chemically synthesized
taaatgcaaaatagtacatgtt

SEQ ID NO: 1158847 - DNA, 22 bp, Artificial Sequence
  chemically synthesized
ggaccatcaaatacaggctgaa

SEQ ID NO: 1158848 - DNA, 22 bp, Artificial Sequence
  chemically synthesized
ttaggaccatcaaatacaggct

SEQ ID NO: 1158849 - DNA, 22 bp, Artificial Sequence
  chemically synthesized
tcattaatttcagcctgtattt

SEQ ID NO: 1158850 - DNA, 22 bp, Artificial Sequence
  chemically synthesized
cattaatttcagcctgtatttg

SEQ ID NO: 1158851 - DNA, 22 bp, Artificial Sequence
  chemically synthesized
attaatttcagcctgtatttga

SEQ ID NO: 1158852 - DNA, 22 bp, Artificial Sequence
  chemically synthesized
atttcagcctgtatttgatggt

SEQ ID NO: 1158853 - DNA, 22 bp, Artificial Sequence
  chemically synthesized
cagcctgtatttgatggtccta

SEQ ID NO: 1158854 - DNA, 22 bp, Artificial Sequence
  chemically synthesized
agcctgtatttgatggtcctaa

SEQ ID NO: 1158855 - DNA, 22 bp, Artificial Sequence
  chemically synthesized
tatttgatggtcctaatagcat

SEQ ID NO: 1158856 - DNA, 22 bp, Artificial Sequence
  chemically synthesized
cataaagcacaaaaaatgctat

SEQ ID NO: 1158857 - DNA, 22 bp, Artificial Sequence
  chemically synthesized
ccataaagcacaaaaaatgcta

SEQ ID NO: 1158858 - DNA, 22 bp, Artificial Sequence
  chemically synthesized
gatggtcctaatagcatttttt

SEQ ID NO: 1158859 - DNA, 22 bp, Artificial Sequence
  chemically synthesized
atggtcctaatagcattttttg

SEQ ID NO: 1158860 - DNA, 22 bp, Artificial Sequence
  chemically synthesized
taatgtatttccataaagcaca

SEQ ID NO: 1158861 - DNA, 22 bp, Artificial Sequence
  chemically synthesized
atagcattttttgtgctttatg

SEQ ID NO: 1158862 - DNA, 22 bp, Artificial Sequence
  chemically synthesized
ataatgtatttccataaagcac

SEQ ID NO: 1158863 - DNA, 22 bp, Artificial Sequence
  chemically synthesized
tataatgtatttccataaagca

SEQ ID NO: 1158864 - DNA, 22 bp, Artificial Sequence
  chemically synthesized
tacattttataatgtatttcca

SEQ ID NO: 1158865 - DNA, 22 bp, Artificial Sequence
  chemically synthesized
tttgtgctttatggaaatacat

SEQ ID NO: 1158866 - DNA, 22 bp, Artificial Sequence
  chemically synthesized
atacattttataatgtatttcc

SEQ ID NO: 1158867 - DNA, 22 bp, Artificial Sequence
  chemically synthesized
ttgtgctttatggaaatacatt

SEQ ID NO: 1158868 - DNA, 22 bp, Artificial Sequence
  chemically synthesized
tgtgctttatggaaatacatta

SEQ ID NO: 1158869 - DNA, 22 bp, Artificial Sequence
  chemically synthesized
gtgctttatggaaatacattat

SEQ ID NO: 1158870 - DNA, 22 bp, Artificial Sequence
  chemically synthesized
tgctttatggaaatacattata

SEQ ID NO: 1158871 - DNA, 22 bp, Artificial Sequence
  chemically synthesized
tatggaaatacattataaaatg

SEQ ID NO: 1158872 - DNA, 22 bp, Artificial Sequence
  chemically synthesized
atggaaatacattataaaatgt

SEQ ID NO: 1158873 - DNA, 22 bp, Artificial Sequence
  chemically synthesized
tggaaatacattataaaatgta

SEQ ID NO: 1158874 - DNA, 22 bp, Artificial Sequence
  chemically synthesized
ataatatatgtttatacatttt

SEQ ID NO: 1158875 - DNA, 22 bp, Artificial Sequence
  chemically synthesized
cataatatatgtttatacattt

SEQ ID NO: 1158876 - DNA, 22 bp, Artificial Sequence
  chemically synthesized
tcataatatatgtttatacatt

SEQ ID NO: 1158877 - DNA, 22 bp, Artificial Sequence
  chemically synthesized
tgttttcataatatatgtttat

SEQ ID NO: 1158878 - DNA, 22 bp, Artificial Sequence
  chemically synthesized
taaaatgtataaacatatatta

SEQ ID NO: 1158879 - DNA, 22 bp, Artificial Sequence
  chemically synthesized
gcatatgattatgttttcataa

SEQ ID NO: 1158880 - DNA, 22 bp, Artificial Sequence
  chemically synthesized
gtgcctagcatatgattatgtt

SEQ ID NO: 1158881 - DNA, 22 bp, Artificial Sequence
  chemically synthesized
gttagtgcctagcatatgatta

SEQ ID NO: 1158882 - DNA, 22 bp, Artificial Sequence
  chemically synthesized
ttagttagtgcctagcatatga

SEQ ID NO: 1158883 - DNA, 22 bp, Artificial Sequence
  chemically synthesized
tgaaaacataatcatatgctag

SEQ ID NO: 1158884 - DNA, 22 bp, Artificial Sequence
  chemically synthesized
attagttagtgcctagcatatg

SEQ ID NO: 1158885 - DNA, 22 bp, Artificial Sequence
  chemically synthesized
tattagttagtgcctagcatat

SEQ ID NO: 1158886 - DNA, 22 bp, Artificial Sequence
  chemically synthesized
tgcctttattagttagtgccta

SEQ ID NO: 1158887 - DNA, 22 bp, Artificial Sequence
  chemically synthesized
atgcctttattagttagtgcct

SEQ ID NO: 1158888 - DNA, 22 bp, Artificial Sequence
  chemically synthesized
tccatttatgcctttattagtt

SEQ ID NO: 1158889 - DNA, 22 bp, Artificial Sequence
  chemically synthesized
ggcactaactaataaaggcata

SEQ ID NO: 1158890 - DNA, 22 bp, Artificial Sequence
  chemically synthesized
taaagtctatccatttatgcct

SEQ ID NO: 1158891 - DNA, 22 bp, Artificial Sequence
  chemically synthesized
ataaagtctatccatttatgcc

SEQ ID NO: 1158892 - DNA, 22 bp, Artificial Sequence
  chemically synthesized
tataaagtctatccatttatgc

SEQ ID NO: 1158893 - DNA, 22 bp, Artificial Sequence
  chemically synthesized
actaataaaggcataaatggat

SEQ ID NO: 1158894 - DNA, 22 bp, Artificial Sequence
  chemically synthesized
ggttttataaagtctatccatt

SEQ ID NO: 1158895 - DNA, 22 bp, Artificial Sequence
  chemically synthesized
ataaaggcataaatggatagac

SEQ ID NO: 1158896 - DNA, 22 bp, Artificial Sequence
  chemically synthesized
taggttttataaagtctatcca

SEQ ID NO: 1158897 - DNA, 22 bp, Artificial Sequence
  chemically synthesized
tagtcctctaggttttataaag

SEQ ID NO: 1158898 - DNA, 22 bp, Artificial Sequence
  chemically synthesized
attgtagtcctctaggttttat

SEQ ID NO: 1158899 - DNA, 22 bp, Artificial Sequence
  chemically synthesized
aattgtagtcctctaggtttta

SEQ ID NO: 1158900 - DNA, 22 bp, Artificial Sequence
  chemically synthesized
taattgtagtcctctaggtttt

SEQ ID NO: 1158901 - DNA, 22 bp, Artificial Sequence
  chemically synthesized
taagttttaattgtagtcctct

SEQ ID NO: 1158902 - DNA, 22 bp, Artificial Sequence
  chemically synthesized
gtaagttttaattgtagtcctc

SEQ ID NO: 1158903 - DNA, 22 bp, Artificial Sequence
  chemically synthesized
tataaaacctagaggactacaa

SEQ ID NO: 1158904 - DNA, 22 bp, Artificial Sequence
  chemically synthesized
ataaaacctagaggactacaat

SEQ ID NO: 1158905 - DNA, 22 bp, Artificial Sequence
  chemically synthesized
taaaacctagaggactacaatt

SEQ ID NO: 1158906 - DNA, 22 bp, Artificial Sequence
  chemically synthesized
gtaatttgtaagttttaattgt

SEQ ID NO: 1158907 - DNA, 22 bp, Artificial Sequence
  chemically synthesized
ggtaatttgtaagttttaattg

SEQ ID NO: 1158908 - DNA, 22 bp, Artificial Sequence
  chemically synthesized
ttggtaatttgtaagttttaat

SEQ ID NO: 1158909 - DNA, 22 bp, Artificial Sequence
  chemically synthesized
gaggactacaattaaaacttac

SEQ ID NO: 1158910 - DNA, 22 bp, Artificial Sequence
  chemically synthesized
acacctcttggtaatttgtaag

SEQ ID NO: 1158911 - DNA, 22 bp, Artificial Sequence
  chemically synthesized
caattaaaacttacaaattacc

SEQ ID NO: 1158912 - DNA, 22 bp, Artificial Sequence
  chemically synthesized
aagagctcacacctcttggtaa

SEQ ID NO: 1158913 - DNA, 22 bp, Artificial Sequence
  chemically synthesized
aaacttacaaattaccaagagg

SEQ ID NO: 1158914 - DNA, 22 bp, Artificial Sequence
  chemically synthesized
ctaaagagctcacacctcttgg

SEQ ID NO: 1158915 - DNA, 22 bp, Artificial Sequence
  chemically synthesized
cctaaagagctcacacctcttg

SEQ ID NO: 1158916 - DNA, 22 bp, Artificial Sequence
  chemically synthesized
acaaattaccaagaggtgtgag

SEQ ID NO: 1158917 - DNA, 22 bp, Artificial Sequence
  chemically synthesized
caaattaccaagaggtgtgagc

SEQ ID NO: 1158918 - DNA, 22 bp, Artificial Sequence
  chemically synthesized
tcttcctaaagagctcacacct

SEQ ID NO: 1158919 - DNA, 22 bp, Artificial Sequence
  chemically synthesized
ccaagaggtgtgagctctttag

SEQ ID NO: 1158920 - DNA, 22 bp, Artificial Sequence
  chemically synthesized
agagcctgtcttcctaaagagc

SEQ ID NO: 1158921 - DNA, 22 bp, Artificial Sequence
  chemically synthesized
ggcctgagagcctgtcttccta

SEQ ID NO: 1158922 - DNA, 22 bp, Artificial Sequence
  chemically synthesized
gggaattgggcctgagagcctg

SEQ ID NO: 1158923 - DNA, 22 bp, Artificial Sequence
  chemically synthesized
tttaggaagacaggctctcagg

SEQ ID NO: 1158924 - DNA, 22 bp, Artificial Sequence
  chemically synthesized
tagggaattgggcctgagagcc

SEQ ID NO: 1158925 - DNA, 22 bp, Artificial Sequence
  chemically synthesized
taggaagacaggctctcaggcc

SEQ ID NO: 1158926 - DNA, 22 bp, Artificial Sequence
  chemically synthesized
aggaagacaggctctcaggccc

SEQ ID NO: 1158927 - DNA, 22 bp, Artificial Sequence
  chemically synthesized
ggaagacaggctctcaggccca

SEQ ID NO: 1158928 - DNA, 22 bp, Artificial Sequence
  chemically synthesized
tgaattctagggaattgggcct

SEQ ID NO: 1158929 - DNA, 22 bp, Artificial Sequence
  chemically synthesized
tcaggcccaattccctagaatt

SEQ ID NO: 1158930 - DNA, 22 bp, Artificial Sequence
  chemically synthesized
aggcccaattccctagaattca

SEQ ID NO: 1158931 - DNA, 22 bp, Artificial Sequence
  chemically synthesized
catatatgccagtaactgtgaa

SEQ ID NO: 1158932 - DNA, 22 bp, Artificial Sequence
  chemically synthesized
cctagaattcacagttactggc

SEQ ID NO: 1158933 - DNA, 22 bp, Artificial Sequence
  chemically synthesized
aggattgcatatatgccagtaa

SEQ ID NO: 1158934 - DNA, 22 bp, Artificial Sequence
  chemically synthesized
gaattcacagttactggcatat

SEQ ID NO: 1158935 - DNA, 22 bp, Artificial Sequence
  chemically synthesized
aattgaggattgcatatatgcc

SEQ ID NO: 1158936 - DNA, 22 bp, Artificial Sequence
  chemically synthesized
aaattgaggattgcatatatgc

SEQ ID NO: 1158937 - DNA, 22 bp, Artificial Sequence
  chemically synthesized
taaattgaggattgcatatatg

SEQ ID NO: 1158938 - DNA, 22 bp, Artificial Sequence
  chemically synthesized
acagttactggcatatatgcaa

SEQ ID NO: 1158939 - DNA, 22 bp, Artificial Sequence
  chemically synthesized
ttaaattgaggattgcatatat

SEQ ID NO: 1158940 - DNA, 22 bp, Artificial Sequence
  chemically synthesized
tttaaattgaggattgcatata

SEQ ID NO: 1158941 - DNA, 22 bp, Artificial Sequence
  chemically synthesized
ttttaaattgaggattgcatat

SEQ ID NO: 1158942 - DNA, 22 bp, Artificial Sequence
  chemically synthesized
ctggcatatatgcaatcctcaa

SEQ ID NO: 1158943 - DNA, 22 bp, Artificial Sequence
  chemically synthesized
gcatatatgcaatcctcaattt

SEQ ID NO: 1158944 - DNA, 22 bp, Artificial Sequence
  chemically synthesized
ggtgtatttttttaaattgagg

SEQ ID NO: 1158945 - DNA, 22 bp, Artificial Sequence
  chemically synthesized
ttaggtgtatttttttaaattg

SEQ ID NO: 1158946 - DNA, 22 bp, Artificial Sequence
  chemically synthesized
attaggtgtatttttttaaatt

SEQ ID NO: 1158947 - DNA, 22 bp, Artificial Sequence
  chemically synthesized
tattaggtgtatttttttaaat

SEQ ID NO: 1158948 - DNA, 22 bp, Artificial Sequence
  chemically synthesized
ttattaggtgtatttttttaaa

SEQ ID NO: 1158949 - DNA, 22 bp, Artificial Sequence
  chemically synthesized
cttttattaggtgtattttttt

SEQ ID NO: 1158950 - DNA, 22 bp, Artificial Sequence
  chemically synthesized
cctccttttattaggtgtattt

SEQ ID NO: 1158951 - DNA, 22 bp, Artificial Sequence
  chemically synthesized
aatttaaaaaaatacacctaat

SEQ ID NO: 1158952 - DNA, 22 bp, Artificial Sequence
  chemically synthesized
aaaaaaatacacctaataaaag

SEQ ID NO: 1158953 - DNA, 22 bp, Artificial Sequence
  chemically synthesized
aaaaaatacacctaataaaagg

SEQ ID NO: 1158954 - DNA, 22 bp, Artificial Sequence
  chemically synthesized
taatacattacctccttttatt

SEQ ID NO: 1158955 - DNA, 22 bp, Artificial Sequence
  chemically synthesized
attataatacattacctccttt

SEQ ID NO: 1158956 - DNA, 22 bp, Artificial Sequence
  chemically synthesized
cattataatacattacctcctt

SEQ ID NO: 1158957 - DNA, 22 bp, Artificial Sequence
  chemically synthesized
tcattataatacattacctcct

SEQ ID NO: 1158958 - DNA, 22 bp, Artificial Sequence
  chemically synthesized
gactttcattataatacattac

SEQ ID NO: 1158959 - DNA, 22 bp, Artificial Sequence
  chemically synthesized
ataaaaggaggtaatgtattat

SEQ ID NO: 1158960 - DNA, 22 bp, Artificial Sequence
  chemically synthesized
atctagactttcattataatac

SEQ ID NO: 1158961 - DNA, 22 bp, Artificial Sequence
  chemically synthesized
taatctagactttcattataat

SEQ ID NO: 1158962 - DNA, 22 bp, Artificial Sequence
  chemically synthesized
ctaatctagactttcattataa

SEQ ID NO: 1158963 - DNA, 22 bp, Artificial Sequence
  chemically synthesized
tctaatctagactttcattata

SEQ ID NO: 1158964 - DNA, 22 bp, Artificial Sequence
  chemically synthesized
ttctaatctagactttcattat

SEQ ID NO: 1158965 - DNA, 22 bp, Artificial Sequence
  chemically synthesized
ttttctaatctagactttcatt

SEQ ID NO: 1158966 - DNA, 22 bp, Artificial Sequence
  chemically synthesized
gtagttcttttctaatctagac

SEQ ID NO: 1158967 - DNA, 22 bp, Artificial Sequence
  chemically synthesized
taatgaaagtctagattagaaa

SEQ ID NO: 1158968 - DNA, 22 bp, Artificial Sequence
  chemically synthesized
aacatcactggtagttcttttc

SEQ ID NO: 1158969 - DNA, 22 bp, Artificial Sequence
  chemically synthesized
gattagaaaagaactaccagtg

SEQ ID NO: 1158970 - DNA, 22 bp, Artificial Sequence
  chemically synthesized
gaaaagaactaccagtgatgtt

SEQ ID NO: 1158971 - DNA, 22 bp, Artificial Sequence
  chemically synthesized
catgtaagacatgtcaattgaa

SEQ ID NO: 1158972 - DNA, 22 bp, Artificial Sequence
  chemically synthesized
acatgtaagacatgtcaattga

SEQ ID NO: 1158973 - DNA, 22 bp, Artificial Sequence
  chemically synthesized
tacatgtaagacatgtcaattg

SEQ ID NO: 1158974 - DNA, 22 bp, Artificial Sequence
  chemically synthesized
ccagtgatgttcaattgacatg

SEQ ID NO: 1158975 - DNA, 22 bp, Artificial Sequence
  chemically synthesized
tattttacatgtaagacatgtc

SEQ ID NO: 1158976 - DNA, 22 bp, Artificial Sequence
  chemically synthesized
aattgacatgtcttacatgtaa

SEQ ID NO: 1158977 - DNA, 22 bp, Artificial Sequence
  chemically synthesized
acatgtcttacatgtaaaatac

SEQ ID NO: 1158978 - DNA, 22 bp, Artificial Sequence
  chemically synthesized
aatcatgtaattgtattttaca

SEQ ID NO: 1158979 - DNA, 22 bp, Artificial Sequence
  chemically synthesized
aaatcatgtaattgtattttac

SEQ ID NO: 1158980 - DNA, 22 bp, Artificial Sequence
  chemically synthesized
acttaaatcatgtaattgtatt

SEQ ID NO: 1158981 - DNA, 22 bp, Artificial Sequence
  chemically synthesized
tgacttaaatcatgtaattgta

SEQ ID NO: 1158982 - DNA, 22 bp, Artificial Sequence
  chemically synthesized
ctgacttaaatcatgtaattgt

SEQ ID NO: 1158983 - DNA, 22 bp, Artificial Sequence
  chemically synthesized
acatgtaaaatacaattacatg

SEQ ID NO: 1158984 - DNA, 22 bp, Artificial Sequence
  chemically synthesized
catgtaaaatacaattacatga

SEQ ID NO: 1158985 - DNA, 22 bp, Artificial Sequence
  chemically synthesized
tttctgacttaaatcatgtaat

SEQ ID NO: 1158986 - DNA, 22 bp, Artificial Sequence
  chemically synthesized
atttctgacttaaatcatgtaa

SEQ ID NO: 1158987 - DNA, 22 bp, Artificial Sequence
  chemically synthesized
tatttctgacttaaatcatgta

SEQ ID NO: 1158988 - DNA, 22 bp, Artificial Sequence
  chemically synthesized
tacaggttttatttctgactta

SEQ ID NO: 1158989 - DNA, 22 bp, Artificial Sequence
  chemically synthesized
catgatttaagtcagaaataaa

SEQ ID NO: 1158990 - DNA, 22 bp, Artificial Sequence
  chemically synthesized
aatcatattatacaggttttat

SEQ ID NO: 1158991 - DNA, 22 bp, Artificial Sequence
  chemically synthesized
aaatcatattatacaggtttta

SEQ ID NO: 1158992 - DNA, 22 bp, Artificial Sequence
  chemically synthesized
aagtcagaaataaaacctgtat

SEQ ID NO: 1158993 - DNA, 22 bp, Artificial Sequence
  chemically synthesized
agtcagaaataaaacctgtata

SEQ ID NO: 1158994 - DNA, 22 bp, Artificial Sequence
  chemically synthesized
ccttaaatcatattatacaggt

SEQ ID NO: 1158995 - DNA, 22 bp, Artificial Sequence
  chemically synthesized
cccttaaatcatattatacagg

SEQ ID NO: 1158996 - DNA, 22 bp, Artificial Sequence
  chemically synthesized
tcccttaaatcatattatacag

SEQ ID NO: 1158997 - DNA, 22 bp, Artificial Sequence
  chemically synthesized
gtatctttcccttaaatcatat

SEQ ID NO: 1158998 - DNA, 22 bp, Artificial Sequence
  chemically synthesized
tactggtatctttcccttaaat

SEQ ID NO: 1158999 - DNA, 22 bp, Artificial Sequence
  chemically synthesized
gtactggtatctttcccttaaa

SEQ ID NO: 1159000 - DNA, 22 bp, Artificial Sequence
  chemically synthesized
tataatatgatttaagggaaag

SEQ ID NO: 1159001 - DNA, 22 bp, Artificial Sequence
  chemically synthesized
atttgtactggtatctttccct

SEQ ID NO: 1159002 - DNA, 22 bp, Artificial Sequence
  chemically synthesized
taatttgtactggtatctttcc

SEQ ID NO: 1159003 - DNA, 22 bp, Artificial Sequence
  chemically synthesized
tctaatttgtactggtatcttt

SEQ ID NO: 1159004 - DNA, 22 bp, Artificial Sequence
  chemically synthesized
ctctaatttgtactggtatctt

SEQ ID NO: 1159005 - DNA, 22 bp, Artificial Sequence
  chemically synthesized
agtttctctaatttgtactggt

SEQ ID NO: 1159006 - DNA, 22 bp, Artificial Sequence
  chemically synthesized
aagggaaagataccagtacaaa

SEQ ID NO: 1159007 - DNA, 22 bp, Artificial Sequence
  chemically synthesized
agggaaagataccagtacaaat

SEQ ID NO: 1159008 - DNA, 22 bp, Artificial Sequence
  chemically synthesized
aaaattaagtttctctaatttg

SEQ ID NO: 1159009 - DNA, 22 bp, Artificial Sequence
  chemically synthesized
gagaaacttaatttttaatgca

SEQ ID NO: 1159010 - DNA, 22 bp, Artificial Sequence
  chemically synthesized
aaagtaaaaacatgcattaaaa

SEQ ID NO: 1159011 - DNA, 22 bp, Artificial Sequence
  chemically synthesized
aaaagtaaaaacatgcattaaa

SEQ ID NO: 1159012 - DNA, 22 bp, Artificial Sequence
  chemically synthesized
aatttttaatgcatgtttttac

SEQ ID NO: 1159013 - DNA, 22 bp, Artificial Sequence
  chemically synthesized
atttttaatgcatgtttttact

SEQ ID NO: 1159014 - DNA, 22 bp, Artificial Sequence
  chemically synthesized
ttaatgcatgtttttactttta

SEQ ID NO: 1159015 - DNA, 22 bp, Artificial Sequence
  chemically synthesized
taatgcatgtttttacttttaa

SEQ ID NO: 1159016 - DNA, 22 bp, Artificial Sequence
  chemically synthesized
aatggcgtgcatttaaaagtaa

SEQ ID NO: 1159017 - DNA, 22 bp, Artificial Sequence
  chemically synthesized
aatgcatgtttttacttttaaa

SEQ ID NO: 1159018 - DNA, 22 bp, Artificial Sequence
  chemically synthesized
atgcatgtttttacttttaaat

SEQ ID NO: 1159019 - DNA, 22 bp, Artificial Sequence
  chemically synthesized
taaatggcgtgcatttaaaagt

SEQ ID NO: 1159020 - DNA, 22 bp, Artificial Sequence
  chemically synthesized
ctaaatggcgtgcatttaaaag

SEQ ID NO: 1159021 - DNA, 22 bp, Artificial Sequence
  chemically synthesized
gtttctaaatggcgtgcattta

SEQ ID NO: 1159022 - DNA, 22 bp, Artificial Sequence
  chemically synthesized
agtttctaaatggcgtgcattt

SEQ ID NO: 1159023 - DNA, 22 bp, Artificial Sequence
  chemically synthesized
tagtttctaaatggcgtgcatt

SEQ ID NO: 1159024 - DNA, 22 bp, Artificial Sequence
  chemically synthesized
ttacttttaaatgcacgccatt

SEQ ID NO: 1159025 - DNA, 22 bp, Artificial Sequence
  chemically synthesized
tacttttaaatgcacgccattt

SEQ ID NO: 1159026 - DNA, 22 bp, Artificial Sequence
  chemically synthesized
acttttaaatgcacgccattta

SEQ ID NO: 1159027 - DNA, 22 bp, Artificial Sequence
  chemically synthesized
cttttaaatgcacgccatttag

SEQ ID NO: 1159028 - DNA, 22 bp, Artificial Sequence
  chemically synthesized
ttaaatgcacgccatttagaaa

SEQ ID NO: 1159029 - DNA, 22 bp, Artificial Sequence
  chemically synthesized
taaatgcacgccatttagaaac

SEQ ID NO: 1159030 - DNA, 22 bp, Artificial Sequence
  chemically synthesized
aaatgcacgccatttagaaact

SEQ ID NO: 1159031 - DNA, 22 bp, Artificial Sequence
  chemically synthesized
aatgcacgccatttagaaacta

SEQ ID NO: 1159032 - DNA, 22 bp, Artificial Sequence
  chemically synthesized
atcagtacaattttagtttcta

SEQ ID NO: 1159033 - DNA, 22 bp, Artificial Sequence
  chemically synthesized
catcagtacaattttagtttct

SEQ ID NO: 1159034 - DNA, 22 bp, Artificial Sequence
  chemically synthesized
tcatcagtacaattttagtttc

SEQ ID NO: 1159035 - DNA, 22 bp, Artificial Sequence
  chemically synthesized
caattttcatcagtacaatttt

SEQ ID NO: 1159036 - DNA, 22 bp, Artificial Sequence
  chemically synthesized
agaaactaaaattgtactgatg

SEQ ID NO: 1159037 - DNA, 22 bp, Artificial Sequence
  chemically synthesized
gaaactaaaattgtactgatga

SEQ ID NO: 1159038 - DNA, 22 bp, Artificial Sequence
  chemically synthesized
aaattgtactgatgaaaattgg

SEQ ID NO: 1159039 - DNA, 22 bp, Artificial Sequence
  chemically synthesized
tactgatgaaaattggaattga

SEQ ID NO: 1159040 - DNA, 22 bp, Artificial Sequence
  chemically synthesized
aataagtaaataaatcaattcc

SEQ ID NO: 1159041 - DNA, 22 bp, Artificial Sequence
  chemically synthesized
gaataagtaaataaatcaattc

SEQ ID NO: 1159042 - DNA, 22 bp, Artificial Sequence
  chemically synthesized
tgaataagtaaataaatcaatt

SEQ ID NO: 1159043 - DNA, 22 bp, Artificial Sequence
  chemically synthesized
atgaaaattggaattgatttat

SEQ ID NO: 1159044 - DNA, 22 bp, Artificial Sequence
  chemically synthesized
gaattgatttatttacttattc

SEQ ID NO: 1159045 - DNA, 22 bp, Artificial Sequence
  chemically synthesized
agccatcattttgaataagtaa

SEQ ID NO: 1159046 - DNA, 22 bp, Artificial Sequence
  chemically synthesized
atttatttacttattcaaaatg

SEQ ID NO: 1159047 - DNA, 22 bp, Artificial Sequence
  chemically synthesized
atttacttattcaaaatgatgg

SEQ ID NO: 1159048 - DNA, 22 bp, Artificial Sequence
  chemically synthesized
tttacttattcaaaatgatggc

SEQ ID NO: 1159049 - DNA, 22 bp, Artificial Sequence
  chemically synthesized
tgcccagcctgagccatcattt

SEQ ID NO: 1159050 - DNA, 22 bp, Artificial Sequence
  chemically synthesized
acttattcaaaatgatggctca

SEQ ID NO: 1159051 - DNA, 22 bp, Artificial Sequence
  chemically synthesized
cttattcaaaatgatggctcag

SEQ ID NO: 1159052 - DNA, 22 bp, Artificial Sequence
  chemically synthesized
attcaaaatgatggctcaggct

SEQ ID NO: 1159053 - DNA, 22 bp, Artificial Sequence
  chemically synthesized
ttcaaaatgatggctcaggctg

SEQ ID NO: 1159054 - DNA, 22 bp, Artificial Sequence
  chemically synthesized
agccactgtgcccagcctgagc

SEQ ID NO: 1159055 - DNA, 22 bp, Artificial Sequence
  chemically synthesized
aaaatgatggctcaggctgggc

SEQ ID NO: 1159056 - DNA, 22 bp, Artificial Sequence
  chemically synthesized
caggcctgagccactgtgccca

SEQ ID NO: 1159057 - DNA, 22 bp, Artificial Sequence
  chemically synthesized
ggattacaggcctgagccactg

SEQ ID NO: 1159058 - DNA, 22 bp, Artificial Sequence
  chemically synthesized
aggctgggcacagtggctcagg

SEQ ID NO: 1159059 - DNA, 22 bp, Artificial Sequence
  chemically synthesized
ggcacagtggctcaggcctgta

SEQ ID NO: 1159060 - DNA, 22 bp, Artificial Sequence
  chemically synthesized
ccaaaatgctgggattacaggc

SEQ ID NO: 1159061 - DNA, 22 bp, Artificial Sequence
  chemically synthesized
ggcctcccaaaatgctgggatt

SEQ ID NO: 1159062 - DNA, 22 bp, Artificial Sequence
  chemically synthesized
aggcctgtaatcccagcatttt

SEQ ID NO: 1159063 - DNA, 22 bp, Artificial Sequence
  chemically synthesized
taatcccagcattttgggaggc

SEQ ID NO: 1159064 - DNA, 22 bp, Artificial Sequence
  chemically synthesized
aggtgatccagccacctcggcc

SEQ ID NO: 1159065 - DNA, 22 bp, Artificial Sequence
  chemically synthesized
acctcaggtgatccagccacct

SEQ ID NO: 1159066 - DNA, 22 bp, Artificial Sequence
  chemically synthesized
tgggaggccgaggtggctggat

SEQ ID NO: 1159067 - DNA, 22 bp, Artificial Sequence
  chemically synthesized
gggaggccgaggtggctggatc

SEQ ID NO: 1159068 - DNA, 22 bp, Artificial Sequence
  chemically synthesized
ctgacctcaggtgatccagcca

SEQ ID NO: 1159069 - DNA, 22 bp, Artificial Sequence
  chemically synthesized
ggaggccgaggtggctggatca

SEQ ID NO: 1159070 - DNA, 22 bp, Artificial Sequence
  chemically synthesized
aactcctgacctcaggtgatcc

SEQ ID NO: 1159071 - DNA, 22 bp, Artificial Sequence
  chemically synthesized
gaactcctgacctcaggtgatc

SEQ ID NO: 1159072 - DNA, 22 bp, Artificial Sequence
  chemically synthesized
gtcttgaactcctgacctcagg

SEQ ID NO: 1159073 - DNA, 22 bp, Artificial Sequence
  chemically synthesized
gatcacctgaggtcaggagttc

SEQ ID NO: 1159074 - DNA, 22 bp, Artificial Sequence
  chemically synthesized
gccaggctggtcttgaactcct

SEQ ID NO: 1159075 - DNA, 22 bp, Artificial Sequence
  chemically synthesized
ttggccaggctggtcttgaact

SEQ ID NO: 1159076 - DNA, 22 bp, Artificial Sequence
  chemically synthesized
tattggccaggctggtcttgaa

SEQ ID NO: 1159077 - DNA, 22 bp, Artificial Sequence
  chemically synthesized
ctattggccaggctggtcttga

SEQ ID NO: 1159078 - DNA, 22 bp, Artificial Sequence
  chemically synthesized
aggtcaggagttcaagaccagc

SEQ ID NO: 1159079 - DNA, 22 bp, Artificial Sequence
  chemically synthesized
aagaccagcctggccaatagaa

SEQ ID NO: 1159080 - DNA, 22 bp, Artificial Sequence
  chemically synthesized
gtagagatggggtttctattgg

SEQ ID NO: 1159081 - DNA, 22 bp, Artificial Sequence
  chemically synthesized
agtagagatggggtttctattg

SEQ ID NO: 1159082 - DNA, 22 bp, Artificial Sequence
  chemically synthesized
tagtagagatggggtttctatt

SEQ ID NO: 1159083 - DNA, 22 bp, Artificial Sequence
  chemically synthesized
ttagtagagatggggtttctat

SEQ ID NO: 1159084 - DNA, 22 bp, Artificial Sequence
  chemically synthesized
tatttttagtagagatggggtt

SEQ ID NO: 1159085 - DNA, 22 bp, Artificial Sequence
  chemically synthesized
gtatttttagtagagatggggt

SEQ ID NO: 1159086 - DNA, 22 bp, Artificial Sequence
  chemically synthesized
tgtatttttagtagagatgggg

SEQ ID NO: 1159087 - DNA, 22 bp, Artificial Sequence
  chemically synthesized
gccaatagaaaccccatctcta

SEQ ID NO: 1159088 - DNA, 22 bp, Artificial Sequence
  chemically synthesized
ttgtatttttagtagagatggg

SEQ ID NO: 1159089 - DNA, 22 bp, Artificial Sequence
  chemically synthesized
atttttgtatttttagtagaga

SEQ ID NO: 1159090 - DNA, 22 bp, Artificial Sequence
  chemically synthesized
tactaaaaatacaaaaattagc

SEQ ID NO: 1159091 - DNA, 22 bp, Artificial Sequence
  chemically synthesized
ccaccacgcccagctaattttt

SEQ ID NO: 1159092 - DNA, 22 bp, Artificial Sequence
  chemically synthesized
gccaccacgcccagctaatttt

SEQ ID NO: 1159093 - DNA, 22 bp, Artificial Sequence
  chemically synthesized
ctaaaaatacaaaaattagctg

SEQ ID NO: 1159094 - DNA, 22 bp, Artificial Sequence
  chemically synthesized
aaaatacaaaaattagctgggc

SEQ ID NO: 1159095 - DNA, 22 bp, Artificial Sequence
  chemically synthesized
aaaagtgcttgccaccacgccc

SEQ ID NO: 1159096 - DNA, 22 bp, Artificial Sequence
  chemically synthesized
gctgggcgtggtggcaagcact

SEQ ID NO: 1159097 - DNA, 22 bp, Artificial Sequence
  chemically synthesized
ggcgtggtggcaagcacttttt

SEQ ID NO: 1159098 - DNA, 22 bp, Artificial Sequence
  chemically synthesized
agtagccgggattaaaaagtgc

SEQ ID NO: 1159099 - DNA, 22 bp, Artificial Sequence
  chemically synthesized
ctgagtagccgggattaaaaag

SEQ ID NO: 1159100 - DNA, 22 bp, Artificial Sequence
  chemically synthesized
agcctcctgagtagccgggatt

SEQ ID NO: 1159101 - DNA, 22 bp, Artificial Sequence
  chemically synthesized
cctcagcctcctgagtagccgg

SEQ ID NO: 1159102 - DNA, 22 bp, Artificial Sequence
  chemically synthesized
ctgcctcagcctcctgagtagc

SEQ ID NO: 1159103 - DNA, 22 bp, Artificial Sequence
  chemically synthesized
tttaatcccggctactcaggag

SEQ ID NO: 1159104 - DNA, 22 bp, Artificial Sequence
  chemically synthesized
tcctgcctcagcctcctgagta

SEQ ID NO: 1159105 - DNA, 22 bp, Artificial Sequence
  chemically synthesized
ttaatcccggctactcaggagg

SEQ ID NO: 1159106 - DNA, 22 bp, Artificial Sequence
  chemically synthesized
taatcccggctactcaggaggc

SEQ ID NO: 1159107 - DNA, 22 bp, Artificial Sequence
  chemically synthesized
aatcccggctactcaggaggct

SEQ ID NO: 1159108 - DNA, 22 bp, Artificial Sequence
  chemically synthesized
atcccggctactcaggaggctg

SEQ ID NO: 1159109 - DNA, 22 bp, Artificial Sequence
  chemically synthesized
aagtgattctcctgcctcagcc

SEQ ID NO: 1159110 - DNA, 22 bp, Artificial Sequence
  chemically synthesized
ctcaggaggctgaggcaggaga

SEQ ID NO: 1159111 - DNA, 22 bp, Artificial Sequence
  chemically synthesized
aggaggctgaggcaggagaatc

SEQ ID NO: 1159112 - DNA, 22 bp, Artificial Sequence
  chemically synthesized
tccccccgggttcaagtgattc

SEQ ID NO: 1159113 - DNA, 22 bp, Artificial Sequence
  chemically synthesized
tgtccccccgggttcaagtgat

SEQ ID NO: 1159114 - DNA, 22 bp, Artificial Sequence
  chemically synthesized
aggcaggagaatcacttgaacc

SEQ ID NO: 1159115 - DNA, 22 bp, Artificial Sequence
  chemically synthesized
caacctctgtccccccgggttc

SEQ ID NO: 1159116 - DNA, 22 bp, Artificial Sequence
  chemically synthesized
actgcaacctctgtccccccgg

SEQ ID NO: 1159117 - DNA, 22 bp, Artificial Sequence
  chemically synthesized
agctcactgcaacctctgtccc

SEQ ID NO: 1159118 - DNA, 22 bp, Artificial Sequence
  chemically synthesized
gaacccggggggacagaggttg

SEQ ID NO: 1159119 - DNA, 22 bp, Artificial Sequence
  chemically synthesized
aacccggggggacagaggttgc

SEQ ID NO: 1159120 - DNA, 22 bp, Artificial Sequence
  chemically synthesized
gagtgaagtggtgtgatctcag

SEQ ID NO: 1159121 - DNA, 22 bp, Artificial Sequence
  chemically synthesized
cagtgagctgagatcacaccac

SEQ ID NO: 1159122 - DNA, 22 bp, Artificial Sequence
  chemically synthesized
acccaggctggagtgaagtggt

SEQ ID NO: 1159123 - DNA, 22 bp, Artificial Sequence
  chemically synthesized
cacccaggctggagtgaagtgg

SEQ ID NO: 1159124 - DNA, 22 bp, Artificial Sequence
  chemically synthesized
tcacccaggctggagtgaagtg

SEQ ID NO: 1159125 - DNA, 22 bp, Artificial Sequence
  chemically synthesized
tttcacccaggctggagtgaag

SEQ ID NO: 1159126 - DNA, 22 bp, Artificial Sequence
  chemically synthesized
agatcacaccacttcactccag

SEQ ID NO: 1159127 - DNA, 22 bp, Artificial Sequence
  chemically synthesized
ttctttcacccaggctggagtg

SEQ ID NO: 1159128 - DNA, 22 bp, Artificial Sequence
  chemically synthesized
gttctttcacccaggctggagt

SEQ ID NO: 1159129 - DNA, 22 bp, Artificial Sequence
  chemically synthesized
tgttctttcacccaggctggag

SEQ ID NO: 1159130 - DNA, 22 bp, Artificial Sequence
  chemically synthesized
cactccagcctgggtgaaagaa

SEQ ID NO: 1159131 - DNA, 22 bp, Artificial Sequence
  chemically synthesized
actccagcctgggtgaaagaac

SEQ ID NO: 1159132 - DNA, 22 bp, Artificial Sequence
  chemically synthesized
agacggagttttgttctttcac

SEQ ID NO: 1159133 - DNA, 22 bp, Artificial Sequence
  chemically synthesized
aagacggagttttgttctttca

SEQ ID NO: 1159134 - DNA, 22 bp, Artificial Sequence
  chemically synthesized
taagacggagttttgttctttc

SEQ ID NO: 1159135 - DNA, 22 bp, Artificial Sequence
  chemically synthesized
ttaagacggagttttgttcttt

SEQ ID NO: 1159136 - DNA, 22 bp, Artificial Sequence
  chemically synthesized
cagcctgggtgaaagaacaaaa

SEQ ID NO: 1159137 - DNA, 22 bp, Artificial Sequence
  chemically synthesized
tttaagacggagttttgttctt

SEQ ID NO: 1159138 - DNA, 22 bp, Artificial Sequence
  chemically synthesized
ttttaagacggagttttgttct

SEQ ID NO: 1159139 - DNA, 22 bp, Artificial Sequence
  chemically synthesized
tttttttaagacggagttttgt

SEQ ID NO: 1159140 - DNA, 22 bp, Artificial Sequence
  chemically synthesized
ggtgaaagaacaaaactccgtc

SEQ ID NO: 1159141 - DNA, 22 bp, Artificial Sequence
  chemically synthesized
tctatttttttaagacggagtt

SEQ ID NO: 1159142 - DNA, 22 bp, Artificial Sequence
  chemically synthesized
atctatttttttaagacggagt

SEQ ID NO: 1159143 - DNA, 22 bp, Artificial Sequence
  chemically synthesized
tatctatttttttaagacggag

SEQ ID NO: 1159144 - DNA, 22 bp, Artificial Sequence
  chemically synthesized
ttatctatttttttaagacgga

SEQ ID NO: 1159145 - DNA, 22 bp, Artificial Sequence
  chemically synthesized
tttttatctatttttttaagac

SEQ ID NO: 1159146 - DNA, 22 bp, Artificial Sequence
  chemically synthesized
ttatttttatctatttttttaa

SEQ ID NO: 1159147 - DNA, 22 bp, Artificial Sequence
  chemically synthesized
gttatttttatctattttttta

SEQ ID NO: 1159148 - DNA, 22 bp, Artificial Sequence
  chemically synthesized
tgttatttttatctattttttt

SEQ ID NO: 1159149 - DNA, 22 bp, Artificial Sequence
  chemically synthesized
cgtcttaaaaaaatagataaaa

SEQ ID NO: 1159150 - DNA, 22 bp, Artificial Sequence
  chemically synthesized
agccatcgttttgttattttta

SEQ ID NO: 1159151 - DNA, 22 bp, Artificial Sequence
  chemically synthesized
aaaaaaatagataaaaataaca

SEQ ID NO: 1159152 - DNA, 22 bp, Artificial Sequence
  chemically synthesized
gagccatcgttttgttattttt

SEQ ID NO: 1159153 - DNA, 22 bp, Artificial Sequence
  chemically synthesized
aaaaaatagataaaaataacaa

SEQ ID NO: 1159154 - DNA, 22 bp, Artificial Sequence
  chemically synthesized
tgagccatcgttttgttatttt

SEQ ID NO: 1159155 - DNA, 22 bp, Artificial Sequence
  chemically synthesized
ttgagccatcgttttgttattt

SEQ ID NO: 1159156 - DNA, 22 bp, Artificial Sequence
  chemically synthesized
gaatttttgagccatcgttttg

SEQ ID NO: 1159157 - DNA, 22 bp, Artificial Sequence
  chemically synthesized
ctagaatttttgagccatcgtt

SEQ ID NO: 1159158 - DNA, 22 bp, Artificial Sequence
  chemically synthesized
gctagaatttttgagccatcgt

SEQ ID NO: 1159159 - DNA, 22 bp, Artificial Sequence
  chemically synthesized
taagaaccaccttgctagaatt

SEQ ID NO: 1159160 - DNA, 22 bp, Artificial Sequence
  chemically synthesized
tctataagaaccaccttgctag

SEQ ID NO: 1159161 - DNA, 22 bp, Artificial Sequence
  chemically synthesized
aaaaattctagcaaggtggttc

SEQ ID NO: 1159162 - DNA, 22 bp, Artificial Sequence
  chemically synthesized
atctatctataagaaccacctt

SEQ ID NO: 1159163 - DNA, 22 bp, Artificial Sequence
  chemically synthesized
tagcaaggtggttcttatagat

SEQ ID NO: 1159164 - DNA, 22 bp, Artificial Sequence
  chemically synthesized
gcaaggtggttcttatagatag

SEQ ID NO: 1159165 - DNA, 22 bp, Artificial Sequence
  chemically synthesized
aaaccaaaactaatctatctat

SEQ ID NO: 1159166 - DNA, 22 bp, Artificial Sequence
  chemically synthesized
agctaaaaccaaaactaatcta

SEQ ID NO: 1159167 - DNA, 22 bp, Artificial Sequence
  chemically synthesized
ttaagctaaaaccaaaactaat

SEQ ID NO: 1159168 - DNA, 22 bp, Artificial Sequence
  chemically synthesized
ttatagatagattagttttggt

SEQ ID NO: 1159169 - DNA, 22 bp, Artificial Sequence
  chemically synthesized
atagatagattagttttggttt

SEQ ID NO: 1159170 - DNA, 22 bp, Artificial Sequence
  chemically synthesized
tagatagattagttttggtttt

SEQ ID NO: 1159171 - DNA, 22 bp, Artificial Sequence
  chemically synthesized
catataaagaattgttaagcta

SEQ ID NO: 1159172 - DNA, 22 bp, Artificial Sequence
  chemically synthesized
gttttggttttagcttaacaat

SEQ ID NO: 1159173 - DNA, 22 bp, Artificial Sequence
  chemically synthesized
gttgcatataaagaattgttaa

SEQ ID NO: 1159174 - DNA, 22 bp, Artificial Sequence
  chemically synthesized
tggttttagcttaacaattctt

SEQ ID NO: 1159175 - DNA, 22 bp, Artificial Sequence
  chemically synthesized
ggttttagcttaacaattcttt

SEQ ID NO: 1159176 - DNA, 22 bp, Artificial Sequence
  chemically synthesized
gttttagcttaacaattcttta

SEQ ID NO: 1159177 - DNA, 22 bp, Artificial Sequence
  chemically synthesized
tagcttaacaattctttatatg

SEQ ID NO: 1159178 - DNA, 22 bp, Artificial Sequence
  chemically synthesized
agcttaacaattctttatatgc

SEQ ID NO: 1159179 - DNA, 22 bp, Artificial Sequence
  chemically synthesized
gcttaacaattctttatatgca

SEQ ID NO: 1159180 - DNA, 22 bp, Artificial Sequence
  chemically synthesized
gaagcatctagttgcatataaa

SEQ ID NO: 1159181 - DNA, 22 bp, Artificial Sequence
  chemically synthesized
tagaagcatctagttgcatata

SEQ ID NO: 1159182 - DNA, 22 bp, Artificial Sequence
  chemically synthesized
aacaattctttatatgcaacta

SEQ ID NO: 1159183 - DNA, 22 bp, Artificial Sequence
  chemically synthesized
acaattctttatatgcaactag

SEQ ID NO: 1159184 - DNA, 22 bp, Artificial Sequence
  chemically synthesized
tttatatgcaactagatgcttc

SEQ ID NO: 1159185 - DNA, 22 bp, Artificial Sequence
  chemically synthesized
tatatgcaactagatgcttcta

SEQ ID NO: 1159186 - DNA, 22 bp, Artificial Sequence
  chemically synthesized
atatgcaactagatgcttctag

SEQ ID NO: 1159187 - DNA, 22 bp, Artificial Sequence
  chemically synthesized
tatgcaactagatgcttctaga

SEQ ID NO: 1159188 - DNA, 22 bp, Artificial Sequence
  chemically synthesized
agcagatgacagcattctagaa

SEQ ID NO: 1159189 - DNA, 22 bp, Artificial Sequence
  chemically synthesized
aagcagatgacagcattctaga

SEQ ID NO: 1159190 - DNA, 22 bp, Artificial Sequence
  chemically synthesized
tttaagcagatgacagcattct

SEQ ID NO: 1159191 - DNA, 22 bp, Artificial Sequence
  chemically synthesized
atttaagcagatgacagcattc

SEQ ID NO: 1159192 - DNA, 22 bp, Artificial Sequence
  chemically synthesized
gatgcttctagaatgctgtcat

SEQ ID NO: 1159193 - DNA, 22 bp, Artificial Sequence
  chemically synthesized
cttatttaagcagatgacagca

SEQ ID NO: 1159194 - DNA, 22 bp, Artificial Sequence
  chemically synthesized
ctagaatgctgtcatctgctta

SEQ ID NO: 1159195 - DNA, 22 bp, Artificial Sequence
  chemically synthesized
tagaatgctgtcatctgcttaa

SEQ ID NO: 1159196 - DNA, 22 bp, Artificial Sequence
  chemically synthesized
aaaattacttatttaagcagat

SEQ ID NO: 1159197 - DNA, 22 bp, Artificial Sequence
  chemically synthesized
aaaaattacttatttaagcaga

SEQ ID NO: 1159198 - DNA, 22 bp, Artificial Sequence
  chemically synthesized
gaatgctgtcatctgcttaaat

SEQ ID NO: 1159199 - DNA, 22 bp, Artificial Sequence
  chemically synthesized
taaaaattacttatttaagcag

SEQ ID NO: 1159200 - DNA, 22 bp, Artificial Sequence
  chemically synthesized
attttaaaaattacttatttaa

SEQ ID NO: 1159201 - DNA, 22 bp, Artificial Sequence
  chemically synthesized
tcatctgcttaaataagtaatt

SEQ ID NO: 1159202 - DNA, 22 bp, Artificial Sequence
  chemically synthesized
cttaaataagtaatttttaaaa

SEQ ID NO: 1159203 - DNA, 22 bp, Artificial Sequence
  chemically synthesized
aaacaaagttgattttaaaaat

SEQ ID NO: 1159204 - DNA, 22 bp, Artificial Sequence
  chemically synthesized
aaataagtaatttttaaaatca

SEQ ID NO: 1159205 - DNA, 22 bp, Artificial Sequence
  chemically synthesized
aataagtaatttttaaaatcaa

SEQ ID NO: 1159206 - DNA, 22 bp, Artificial Sequence
  chemically synthesized
ttaaaatcaactttgtttcagc

SEQ ID NO: 1159207 - DNA, 22 bp, Artificial Sequence
  chemically synthesized
taaaatcaactttgtttcagct

SEQ ID NO: 1159208 - DNA, 22 bp, Artificial Sequence
  chemically synthesized
aaaatcaactttgtttcagctt

SEQ ID NO: 1159209 - DNA, 22 bp, Artificial Sequence
  chemically synthesized
aaatcaactttgtttcagcttt

SEQ ID NO: 1159210 - DNA, 22 bp, Artificial Sequence
  chemically synthesized
atagagaatgaaacaaaagctg

SEQ ID NO: 1159211 - DNA, 22 bp, Artificial Sequence
  chemically synthesized
aatagagaatgaaacaaaagct

SEQ ID NO: 1159212 - DNA, 22 bp, Artificial Sequence
  chemically synthesized
ttaatagagaatgaaacaaaag

SEQ ID NO: 1159213 - DNA, 22 bp, Artificial Sequence
  chemically synthesized
cttaatagagaatgaaacaaaa

SEQ ID NO: 1159214 - DNA, 22 bp, Artificial Sequence
  chemically synthesized
tcttaatagagaatgaaacaaa

SEQ ID NO: 1159215 - DNA, 22 bp, Artificial Sequence
  chemically synthesized
tgtttcagcttttgtttcattc

SEQ ID NO: 1159216 - DNA, 22 bp, Artificial Sequence
  chemically synthesized
gtttcagcttttgtttcattct

SEQ ID NO: 1159217 - DNA, 22 bp, Artificial Sequence
  chemically synthesized
tttcagcttttgtttcattctc

SEQ ID NO: 1159218 - DNA, 22 bp, Artificial Sequence
  chemically synthesized
cagcttttgtttcattctctat

SEQ ID NO: 1159219 - DNA, 22 bp, Artificial Sequence
  chemically synthesized
agcttttgtttcattctctatt

SEQ ID NO: 1159220 - DNA, 22 bp, Artificial Sequence
  chemically synthesized
ttgtttcattctctattaagaa

SEQ ID NO: 1159221 - DNA, 22 bp, Artificial Sequence
  chemically synthesized
tgtttcattctctattaagaaa

SEQ ID NO: 1159222 - DNA, 22 bp, Artificial Sequence
  chemically synthesized
gtttcattctctattaagaaag

SEQ ID NO: 1159223 - DNA, 22 bp, Artificial Sequence
  chemically synthesized
tttcattctctattaagaaagg

SEQ ID NO: 1159224 - DNA, 22 bp, Artificial Sequence
  chemically synthesized
cccagcccccaatacctttctt

SEQ ID NO: 1159225 - DNA, 22 bp, Artificial Sequence
  chemically synthesized
cattctctattaagaaaggtat

SEQ ID NO: 1159226 - DNA, 22 bp, Artificial Sequence
  chemically synthesized
ccccagcccccaatacctttct

SEQ ID NO: 1159227 - DNA, 22 bp, Artificial Sequence
  chemically synthesized
attctctattaagaaaggtatt

SEQ ID NO: 1159228 - DNA, 22 bp, Artificial Sequence
  chemically synthesized
cttccccagcccccaatacctt

SEQ ID NO: 1159229 - DNA, 22 bp, Artificial Sequence
  chemically synthesized
tctattaagaaaggtattgggg

SEQ ID NO: 1159230 - DNA, 22 bp, Artificial Sequence
  chemically synthesized
ttccttccccagcccccaatac

SEQ ID NO: 1159231 - DNA, 22 bp, Artificial Sequence
  chemically synthesized
tattaagaaaggtattgggggc

SEQ ID NO: 1159232 - DNA, 22 bp, Artificial Sequence
  chemically synthesized
ttaagaaaggtattgggggctg

SEQ ID NO: 1159233 - DNA, 22 bp, Artificial Sequence
  chemically synthesized
agaaaggtattgggggctgggg

SEQ ID NO: 1159234 - DNA, 22 bp, Artificial Sequence
  chemically synthesized
atgctattccttccccagcccc

SEQ ID NO: 1159235 - DNA, 22 bp, Artificial Sequence
  chemically synthesized
ctaatgctattccttccccagc

SEQ ID NO: 1159236 - DNA, 22 bp, Artificial Sequence
  chemically synthesized
tcctaatgctattccttcccca

SEQ ID NO: 1159237 - DNA, 22 bp, Artificial Sequence
  chemically synthesized
ctcctaatgctattccttcccc

SEQ ID NO: 1159238 - DNA, 22 bp, Artificial Sequence
  chemically synthesized
ggggctggggaaggaatagcat

SEQ ID NO: 1159239 - DNA, 22 bp, Artificial Sequence
  chemically synthesized
ggtatttctcctaatgctattc

SEQ ID NO: 1159240 - DNA, 22 bp, Artificial Sequence
  chemically synthesized
cattaggtatttctcctaatgc

SEQ ID NO: 1159241 - DNA, 22 bp, Artificial Sequence
  chemically synthesized
gggaaggaatagcattaggaga

SEQ ID NO: 1159242 - DNA, 22 bp, Artificial Sequence
  chemically synthesized
acattaggtatttctcctaatg

SEQ ID NO: 1159243 - DNA, 22 bp, Artificial Sequence
  chemically synthesized
atttacattaggtatttctcct

SEQ ID NO: 1159244 - DNA, 22 bp, Artificial Sequence
  chemically synthesized
ggagaaatacctaatgtaaatg

SEQ ID NO: 1159245 - DNA, 22 bp, Artificial Sequence
  chemically synthesized
cacccatcagctcatttacatt

SEQ ID NO: 1159246 - DNA, 22 bp, Artificial Sequence
  chemically synthesized
ctgcacccatcagctcatttac

SEQ ID NO: 1159247 - DNA, 22 bp, Artificial Sequence
  chemically synthesized
gctgcacccatcagctcattta

SEQ ID NO: 1159248 - DNA, 22 bp, Artificial Sequence
  chemically synthesized
gtttgctgcacccatcagctca

SEQ ID NO: 1159249 - DNA, 22 bp, Artificial Sequence
  chemically synthesized
atgtaaatgagctgatgggtgc

SEQ ID NO: 1159250 - DNA, 22 bp, Artificial Sequence
  chemically synthesized
atgggtgcagcaaaccaacatg

SEQ ID NO: 1159251 - DNA, 22 bp, Artificial Sequence
  chemically synthesized
atacataggtatacatgtgcca

SEQ ID NO: 1159252 - DNA, 22 bp, Artificial Sequence
  chemically synthesized
gatacataggtatacatgtgcc

SEQ ID NO: 1159253 - DNA, 22 bp, Artificial Sequence
  chemically synthesized
gcaggtttgatacataggtata

SEQ ID NO: 1159254 - DNA, 22 bp, Artificial Sequence
  chemically synthesized
ggatgcatgtgcacaactcgca

SEQ ID NO: 1159255 - DNA, 22 bp, Artificial Sequence
  chemically synthesized
tgtatcaaacctgcgagttgtg

SEQ ID NO: 1159256 - DNA, 22 bp, Artificial Sequence
  chemically synthesized
taggatgcatgtgcacaactcg

SEQ ID NO: 1159257 - DNA, 22 bp, Artificial Sequence
  chemically synthesized
ctaggatgcatgtgcacaactc

SEQ ID NO: 1159258 - DNA, 22 bp, Artificial Sequence
  chemically synthesized
atttctaggatgcatgtgcaca

SEQ ID NO: 1159259 - DNA, 22 bp, Artificial Sequence
  chemically synthesized
aatttctaggatgcatgtgcac

SEQ ID NO: 1159260 - DNA, 22 bp, Artificial Sequence
  chemically synthesized
taatttctaggatgcatgtgca

SEQ ID NO: 1159261 - DNA, 22 bp, Artificial Sequence
  chemically synthesized
cgagttgtgcacatgcatccta

SEQ ID NO: 1159262 - DNA, 22 bp, Artificial Sequence
  chemically synthesized
tactttaatttctaggatgcat

SEQ ID NO: 1159263 - DNA, 22 bp, Artificial Sequence
  chemically synthesized
ttatactttaatttctaggatg

SEQ ID NO: 1159264 - DNA, 22 bp, Artificial Sequence
  chemically synthesized
ttattatactttaatttctagg

SEQ ID NO: 1159265 - DNA, 22 bp, Artificial Sequence
  chemically synthesized
tgcacatgcatcctagaaatta

SEQ ID NO: 1159266 - DNA, 22 bp, Artificial Sequence
  chemically synthesized
ttattattatactttaatttct

SEQ ID NO: 1159267 - DNA, 22 bp, Artificial Sequence
  chemically synthesized
ttattattattatactttaatt

SEQ ID NO: 1159268 - DNA, 22 bp, Artificial Sequence
  chemically synthesized
attattattattatactttaat

SEQ ID NO: 1159269 - DNA, 22 bp, Artificial Sequence
  chemically synthesized
tattattattattatactttaa

SEQ ID NO: 1159270 - DNA, 22 bp, Artificial Sequence
  chemically synthesized
ttattattattattatacttta

SEQ ID NO: 1159271 - DNA, 22 bp, Artificial Sequence
  chemically synthesized
ttttattattattattatactt

SEQ ID NO: 1159272 - DNA, 22 bp, Artificial Sequence
  chemically synthesized
cctcttttattattattattat

SEQ ID NO: 1159273 - DNA, 22 bp, Artificial Sequence
  chemically synthesized
gaaattaaagtataataataat

SEQ ID NO: 1159274 - DNA, 22 bp, Artificial Sequence
  chemically synthesized
tccctcttttattattattatt

SEQ ID NO: 1159275 - DNA, 22 bp, Artificial Sequence
  chemically synthesized
tctccctcttttattattatta

SEQ ID NO: 1159276 - DNA, 22 bp, Artificial Sequence
  chemically synthesized
ctctccctcttttattattatt

SEQ ID NO: 1159277 - DNA, 22 bp, Artificial Sequence
  chemically synthesized
tctctccctcttttattattat

SEQ ID NO: 1159278 - DNA, 22 bp, Artificial Sequence
  chemically synthesized
ttctctccctcttttattatta

SEQ ID NO: 1159279 - DNA, 22 bp, Artificial Sequence
  chemically synthesized
aagtataataataataataaaa

SEQ ID NO: 1159280 - DNA, 22 bp, Artificial Sequence
  chemically synthesized
tttctctccctcttttattatt

SEQ ID NO: 1159281 - DNA, 22 bp, Artificial Sequence
  chemically synthesized
ttttctctccctcttttattat

SEQ ID NO: 1159282 - DNA, 22 bp, Artificial Sequence
  chemically synthesized
ttttttctctccctcttttatt

SEQ ID NO: 1159283 - DNA, 22 bp, Artificial Sequence
  chemically synthesized
cttttttctctccctcttttat

SEQ ID NO: 1159284 - DNA, 22 bp, Artificial Sequence
  chemically synthesized
tcttttttctctccctctttta

SEQ ID NO: 1159285 - DNA, 22 bp, Artificial Sequence
  chemically synthesized
ttcttttttctctccctctttt

SEQ ID NO: 1159286 - DNA, 22 bp, Artificial Sequence
  chemically synthesized
ttttcttttttctctccctctt

SEQ ID NO: 1159287 - DNA, 22 bp, Artificial Sequence
  chemically synthesized
cttttcttttttctctccctct

SEQ ID NO: 1159288 - DNA, 22 bp, Artificial Sequence
  chemically synthesized
gatttcttttcttttttctctc

SEQ ID NO: 1159289 - DNA, 22 bp, Artificial Sequence
  chemically synthesized
ggatttcttttcttttttctct

SEQ ID NO: 1159290 - DNA, 22 bp, Artificial Sequence
  chemically synthesized
tcttggatttcttttctttttt

SEQ ID NO: 1159291 - DNA, 22 bp, Artificial Sequence
  chemically synthesized
acctatcttggatttcttttct

SEQ ID NO: 1159292 - DNA, 22 bp, Artificial Sequence
  chemically synthesized
aacctatcttggatttcttttc

SEQ ID NO: 1159293 - DNA, 22 bp, Artificial Sequence
  chemically synthesized
taacctatcttggatttctttt

SEQ ID NO: 1159294 - DNA, 22 bp, Artificial Sequence
  chemically synthesized
ttaacctatcttggatttcttt

SEQ ID NO: 1159295 - DNA, 22 bp, Artificial Sequence
  chemically synthesized
tttaacctatcttggatttctt

SEQ ID NO: 1159296 - DNA, 22 bp, Artificial Sequence
  chemically synthesized
ttttttaacctatcttggattt

SEQ ID NO: 1159297 - DNA, 22 bp, Artificial Sequence
  chemically synthesized
tgttttttaacctatcttggat

SEQ ID NO: 1159298 - DNA, 22 bp, Artificial Sequence
  chemically synthesized
ctgttttttaacctatcttgga

SEQ ID NO: 1159299 - DNA, 22 bp, Artificial Sequence
  chemically synthesized
tctgttttttaacctatcttgg

SEQ ID NO: 1159300 - DNA, 22 bp, Artificial Sequence
  chemically synthesized
ataactttctgttttttaacct

SEQ ID NO: 1159301 - DNA, 22 bp, Artificial Sequence
  chemically synthesized
aattaataactttctgtttttt

SEQ ID NO: 1159302 - DNA, 22 bp, Artificial Sequence
  chemically synthesized
cctcaattaataactttctgtt

SEQ ID NO: 1159303 - DNA, 22 bp, Artificial Sequence
  chemically synthesized
aacattacctcaattaataact

SEQ ID NO: 1159304 - DNA, 22 bp, Artificial Sequence
  chemically synthesized
aaacattacctcaattaataac

SEQ ID NO: 1159305 - DNA, 22 bp, Artificial Sequence
  chemically synthesized
aaaaacagaaagttattaattg

SEQ ID NO: 1159306 - DNA, 22 bp, Artificial Sequence
  chemically synthesized
ttaattgaggtaatgtttaagt

SEQ ID NO: 1159307 - DNA, 22 bp, Artificial Sequence
  chemically synthesized
aataaaagccggacttaaacat

SEQ ID NO: 1159308 - DNA, 22 bp, Artificial Sequence
  chemically synthesized
gaataaaagccggacttaaaca

SEQ ID NO: 1159309 - DNA, 22 bp, Artificial Sequence
  chemically synthesized
attgaggtaatgtttaagtccg

SEQ ID NO: 1159310 - DNA, 22 bp, Artificial Sequence
  chemically synthesized
aggtaatgtttaagtccggctt

SEQ ID NO: 1159311 - DNA, 22 bp, Artificial Sequence
  chemically synthesized
tgatagtttgaataaaagccgg

SEQ ID NO: 1159312 - DNA, 22 bp, Artificial Sequence
  chemically synthesized
tctgtgatagtttgaataaaag

SEQ ID NO: 1159313 - DNA, 22 bp, Artificial Sequence
  chemically synthesized
aagtccggcttttattcaaact

SEQ ID NO: 1159314 - DNA, 22 bp, Artificial Sequence
  chemically synthesized
agtccggcttttattcaaacta

SEQ ID NO: 1159315 - DNA, 22 bp, Artificial Sequence
  chemically synthesized
acctatctgtgatagtttgaat

SEQ ID NO: 1159316 - DNA, 22 bp, Artificial Sequence
  chemically synthesized
attcacctatctgtgatagttt

SEQ ID NO: 1159317 - DNA, 22 bp, Artificial Sequence
  chemically synthesized
cactaattcacctatctgtgat

SEQ ID NO: 1159318 - DNA, 22 bp, Artificial Sequence
  chemically synthesized
ttattcaaactatcacagatag

SEQ ID NO: 1159319 - DNA, 22 bp, Artificial Sequence
  chemically synthesized
tattcaaactatcacagatagg

SEQ ID NO: 1159320 - DNA, 22 bp, Artificial Sequence
  chemically synthesized
attcaaactatcacagataggt

SEQ ID NO: 1159321 - DNA, 22 bp, Artificial Sequence
  chemically synthesized
ttcaaactatcacagataggtg

SEQ ID NO: 1159322 - DNA, 22 bp, Artificial Sequence
  chemically synthesized
aaactatcacagataggtgaat

SEQ ID NO: 1159323 - DNA, 22 bp, Artificial Sequence
  chemically synthesized
tataaattccactaattcacct

SEQ ID NO: 1159324 - DNA, 22 bp, Artificial Sequence
  chemically synthesized
atataaattccactaattcacc

SEQ ID NO: 1159325 - DNA, 22 bp, Artificial Sequence
  chemically synthesized
tcacagataggtgaattagtgg

SEQ ID NO: 1159326 - DNA, 22 bp, Artificial Sequence
  chemically synthesized
tttatataaattccactaattc

SEQ ID NO: 1159327 - DNA, 22 bp, Artificial Sequence
  chemically synthesized
aggcattatttatataaattcc

SEQ ID NO: 1159328 - DNA, 22 bp, Artificial Sequence
  chemically synthesized
tattaaggcattatttatataa

SEQ ID NO: 1159329 - DNA, 22 bp, Artificial Sequence
  chemically synthesized
atattaaggcattatttatata

SEQ ID NO: 1159330 - DNA, 22 bp, Artificial Sequence
  chemically synthesized
tatattaaggcattatttatat

SEQ ID NO: 1159331 - DNA, 22 bp, Artificial Sequence
  chemically synthesized
ttatattaaggcattatttata

SEQ ID NO: 1159332 - DNA, 22 bp, Artificial Sequence
  chemically synthesized
tttatattaaggcattatttat

SEQ ID NO: 1159333 - DNA, 22 bp, Artificial Sequence
  chemically synthesized
gtggaatttatataaataatgc

SEQ ID NO: 1159334 - DNA, 22 bp, Artificial Sequence
  chemically synthesized
gtacctttttatattaaggcat

SEQ ID NO: 1159335 - DNA, 22 bp, Artificial Sequence
  chemically synthesized
atataaataatgccttaatata

SEQ ID NO: 1159336 - DNA, 22 bp, Artificial Sequence
  chemically synthesized
tataaataatgccttaatataa

SEQ ID NO: 1159337 - DNA, 22 bp, Artificial Sequence
  chemically synthesized
atcaattagtacctttttatat

SEQ ID NO: 1159338 - DNA, 22 bp, Artificial Sequence
  chemically synthesized
taatcaattagtacctttttat

SEQ ID NO: 1159339 - DNA, 22 bp, Artificial Sequence
  chemically synthesized
agtgattctaatcaattagtac

SEQ ID NO: 1159340 - DNA, 22 bp, Artificial Sequence
  chemically synthesized
aatataaaaaggtactaattga

SEQ ID NO: 1159341 - DNA, 22 bp, Artificial Sequence
  chemically synthesized
atataaaaaggtactaattgat

SEQ ID NO: 1159342 - DNA, 22 bp, Artificial Sequence
  chemically synthesized
tcagtgattctaatcaattagt

SEQ ID NO: 1159343 - DNA, 22 bp, Artificial Sequence
  chemically synthesized
tctcagtgattctaatcaatta

SEQ ID NO: 1159344 - DNA, 22 bp, Artificial Sequence
  chemically synthesized
aaaagttctctcagtgattcta

SEQ ID NO: 1159345 - DNA, 22 bp, Artificial Sequence
  chemically synthesized
gaaaagttctctcagtgattct

SEQ ID NO: 1159346 - DNA, 22 bp, Artificial Sequence
  chemically synthesized
tgaaaagttctctcagtgattc

SEQ ID NO: 1159347 - DNA, 22 bp, Artificial Sequence
  chemically synthesized
attgattagaatcactgagaga

SEQ ID NO: 1159348 - DNA, 22 bp, Artificial Sequence
  chemically synthesized
attagaatcactgagagaactt

SEQ ID NO: 1159349 - DNA, 22 bp, Artificial Sequence
  chemically synthesized
ggacgtcattttgaaaagttct

SEQ ID NO: 1159350 - DNA, 22 bp, Artificial Sequence
  chemically synthesized
gaatcactgagagaacttttca

SEQ ID NO: 1159351 - DNA, 22 bp, Artificial Sequence
  chemically synthesized
agagaacttttcaaaatgacgt

SEQ ID NO: 1159352 - DNA, 22 bp, Artificial Sequence
  chemically synthesized
gggaatggggctgggacgtcat

SEQ ID NO: 1159353 - DNA, 22 bp, Artificial Sequence
  chemically synthesized
ttggggaatggggctgggacgt

SEQ ID NO: 1159354 - DNA, 22 bp, Artificial Sequence
  chemically synthesized
ttcaaaatgacgtcccagcccc

SEQ ID NO: 1159355 - DNA, 22 bp, Artificial Sequence
  chemically synthesized
tcaaaatgacgtcccagcccca

SEQ ID NO: 1159356 - DNA, 22 bp, Artificial Sequence
  chemically synthesized
caaaatgacgtcccagccccat

SEQ ID NO: 1159357 - DNA, 22 bp, Artificial Sequence
  chemically synthesized
aattgttggggaatggggctgg

SEQ ID NO: 1159358 - DNA, 22 bp, Artificial Sequence
  chemically synthesized
aaaatgacgtcccagccccatt

SEQ ID NO: 1159359 - DNA, 22 bp, Artificial Sequence
  chemically synthesized
attgaattgttggggaatgggg

SEQ ID NO: 1159360 - DNA, 22 bp, Artificial Sequence
  chemically synthesized
tgattgaattgttggggaatgg

SEQ ID NO: 1159361 - DNA, 22 bp, Artificial Sequence
  chemically synthesized
ccagatattctgattgaattgt

SEQ ID NO: 1159362 - DNA, 22 bp, Artificial Sequence
  chemically synthesized
cattcccagatattctgattga

SEQ ID NO: 1159363 - DNA, 22 bp, Artificial Sequence
  chemically synthesized
cccaacaattcaatcagaatat

SEQ ID NO: 1159364 - DNA, 22 bp, Artificial Sequence
  chemically synthesized
ggctccattcccagatattctg

SEQ ID NO: 1159365 - DNA, 22 bp, Artificial Sequence
  chemically synthesized
aatcagaatatctgggaatgga

SEQ ID NO: 1159366 - DNA, 22 bp, Artificial Sequence
  chemically synthesized
cagaaccaatacctgggctcca

SEQ ID NO: 1159367 - DNA, 22 bp, Artificial Sequence
  chemically synthesized
acagaaccaatacctgggctcc

SEQ ID NO: 1159368 - DNA, 22 bp, Artificial Sequence
  chemically synthesized
tacagaaccaatacctgggctc

SEQ ID NO: 1159369 - DNA, 22 bp, Artificial Sequence
  chemically synthesized
ttacagaaccaatacctgggct

SEQ ID NO: 1159370 - DNA, 22 bp, Artificial Sequence
  chemically synthesized
tttacagaaccaatacctgggc

SEQ ID NO: 1159371 - DNA, 22 bp, Artificial Sequence
  chemically synthesized
ggaatggagcccaggtattggt

SEQ ID NO: 1159372 - DNA, 22 bp, Artificial Sequence
  chemically synthesized
gatagttttttacagaaccaat

SEQ ID NO: 1159373 - DNA, 22 bp, Artificial Sequence
  chemically synthesized
gttggatagttttttacagaac

SEQ ID NO: 1159374 - DNA, 22 bp, Artificial Sequence
  chemically synthesized
cctggttggatagttttttaca

SEQ ID NO: 1159375 - DNA, 22 bp, Artificial Sequence
  chemically synthesized
gaattacctggttggatagttt

SEQ ID NO: 1159376 - DNA, 22 bp, Artificial Sequence
  chemically synthesized
gttctgtaaaaaactatccaac

SEQ ID NO: 1159377 - DNA, 22 bp, Artificial Sequence
  chemically synthesized
attcgaattacctggttggata

SEQ ID NO: 1159378 - DNA, 22 bp, Artificial Sequence
  chemically synthesized
tgtaaaaaactatccaaccagg

SEQ ID NO: 1159379 - DNA, 22 bp, Artificial Sequence
  chemically synthesized
taaaaaactatccaaccaggta

SEQ ID NO: 1159380 - DNA, 22 bp, Artificial Sequence
  chemically synthesized
gatgttcattcgaattacctgg

SEQ ID NO: 1159381 - DNA, 22 bp, Artificial Sequence
  chemically synthesized
tccaaccaggtaattcgaatga

SEQ ID NO: 1159382 - DNA, 22 bp, Artificial Sequence
  chemically synthesized
aaccctggatgttcattcgaat

SEQ ID NO: 1159383 - DNA, 22 bp, Artificial Sequence
  chemically synthesized
tcaaccctggatgttcattcga

SEQ ID NO: 1159384 - DNA, 22 bp, Artificial Sequence
  chemically synthesized
gaatgaacatccagggttgaga

SEQ ID NO: 1159385 - DNA, 22 bp, Artificial Sequence
  chemically synthesized
agaacgattgtgcctcttcccc

SEQ ID NO: 1159386 - DNA, 22 bp, Artificial Sequence
  chemically synthesized
gggcgggggggggggcggggaa

SEQ ID NO: 1159387 - DNA, 22 bp, Artificial Sequence
  chemically synthesized
tgcctcttccccgccccccccc

SEQ ID NO: 1159388 - DNA, 22 bp, Artificial Sequence
  chemically synthesized
tgtcctggggcggggggggggg

SEQ ID NO: 1159389 - DNA, 22 bp, Artificial Sequence
  chemically synthesized
ttccccgcccccccccccgccc

SEQ ID NO: 1159390 - DNA, 22 bp, Artificial Sequence
  chemically synthesized
tggctgtgtcctggggcggggg

SEQ ID NO: 1159391 - DNA, 22 bp, Artificial Sequence
  chemically synthesized
ccccgcccccccccccgcccca

SEQ ID NO: 1159392 - DNA, 22 bp, Artificial Sequence
  chemically synthesized
cccgcccccccccccgccccag

SEQ ID NO: 1159393 - DNA, 22 bp, Artificial Sequence
  chemically synthesized
aagtaaaaattatggctgtgtc

SEQ ID NO: 1159394 - DNA, 22 bp, Artificial Sequence
  chemically synthesized
tgaggacccaagggctaaagta

SEQ ID NO: 1159395 - DNA, 22 bp, Artificial Sequence
  chemically synthesized
gtgaggacccaagggctaaagt

SEQ ID NO: 1159396 - DNA, 22 bp, Artificial Sequence
  chemically synthesized
ccacttgtgaggacccaagggc

SEQ ID NO: 1159397 - DNA, 22 bp, Artificial Sequence
  chemically synthesized
gccacttgtgaggacccaaggg

SEQ ID NO: 1159398 - DNA, 22 bp, Artificial Sequence
  chemically synthesized
ttactttagcccttgggtcctc

SEQ ID NO: 1159399 - DNA, 22 bp, Artificial Sequence
  chemically synthesized
tactttagcccttgggtcctca

SEQ ID NO: 1159400 - DNA, 22 bp, Artificial Sequence
  chemically synthesized
actttagcccttgggtcctcac

SEQ ID NO: 1159401 - DNA, 22 bp, Artificial Sequence
  chemically synthesized
ctttagcccttgggtcctcaca

SEQ ID NO: 1159402 - DNA, 22 bp, Artificial Sequence
  chemically synthesized
tagcccttgggtcctcacaagt

SEQ ID NO: 1159403 - DNA, 22 bp, Artificial Sequence
  chemically synthesized
caggtatttgccacttgtgagg

SEQ ID NO: 1159404 - DNA, 22 bp, Artificial Sequence
  chemically synthesized
agcccttgggtcctcacaagtg

SEQ ID NO: 1159405 - DNA, 22 bp, Artificial Sequence
  chemically synthesized
ccaggtatttgccacttgtgag

SEQ ID NO: 1159406 - DNA, 22 bp, Artificial Sequence
  chemically synthesized
gcccttgggtcctcacaagtgg

SEQ ID NO: 1159407 - DNA, 22 bp, Artificial Sequence
  chemically synthesized
tccaggtatttgccacttgtga

SEQ ID NO: 1159408 - DNA, 22 bp, Artificial Sequence
  chemically synthesized
gggtcctcacaagtggcaaata

SEQ ID NO: 1159409 - DNA, 22 bp, Artificial Sequence
  chemically synthesized
ggtcctcacaagtggcaaatac

SEQ ID NO: 1159410 - DNA, 22 bp, Artificial Sequence
  chemically synthesized
gatacagctttccaggtatttg

SEQ ID NO: 1159411 - DNA, 22 bp, Artificial Sequence
  chemically synthesized
acaagtggcaaatacctggaaa

SEQ ID NO: 1159412 - DNA, 22 bp, Artificial Sequence
  chemically synthesized
tctggatacagctttccaggta

SEQ ID NO: 1159413 - DNA, 22 bp, Artificial Sequence
  chemically synthesized
acaagtcatgttgtctggatac

SEQ ID NO: 1159414 - DNA, 22 bp, Artificial Sequence
  chemically synthesized
gaaagctgtatccagacaacat

SEQ ID NO: 1159415 - DNA, 22 bp, Artificial Sequence
  chemically synthesized
accctaacaagtcatgttgtct

SEQ ID NO: 1159416 - DNA, 22 bp, Artificial Sequence
  chemically synthesized
atgttaaccctaacaagtcatg

SEQ ID NO: 1159417 - DNA, 22 bp, Artificial Sequence
  chemically synthesized
tatccagacaacatgacttgtt

SEQ ID NO: 1159418 - DNA, 22 bp, Artificial Sequence
  chemically synthesized
gttcatgttaaccctaacaagt

SEQ ID NO: 1159419 - DNA, 22 bp, Artificial Sequence
  chemically synthesized
tgcatctggttcatgttaaccc

SEQ ID NO: 1159420 - DNA, 22 bp, Artificial Sequence
  chemically synthesized
tgtgcatctggttcatgttaac

SEQ ID NO: 1159421 - DNA, 22 bp, Artificial Sequence
  chemically synthesized
cctctgtgcatctggttcatgt

SEQ ID NO: 1159422 - DNA, 22 bp, Artificial Sequence
  chemically synthesized
gttagggttaacatgaaccaga

SEQ ID NO: 1159423 - DNA, 22 bp, Artificial Sequence
  chemically synthesized
ttagggttaacatgaaccagat

SEQ ID NO: 1159424 - DNA, 22 bp, Artificial Sequence
  chemically synthesized
gggttaacatgaaccagatgca

SEQ ID NO: 1159425 - DNA, 22 bp, Artificial Sequence
  chemically synthesized
catgttacctctgtgcatctgg

SEQ ID NO: 1159426 - DNA, 22 bp, Artificial Sequence
  chemically synthesized
tctccatgttacctctgtgcat

SEQ ID NO: 1159427 - DNA, 22 bp, Artificial Sequence
  chemically synthesized
acatgaaccagatgcacagagg

SEQ ID NO: 1159428 - DNA, 22 bp, Artificial Sequence
  chemically synthesized
gtctccatgttacctctgtgca

SEQ ID NO: 1159429 - DNA, 22 bp, Artificial Sequence
  chemically synthesized
tgtctccatgttacctctgtgc

SEQ ID NO: 1159430 - DNA, 22 bp, Artificial Sequence
  chemically synthesized
atcctttgtctccatgttacct

SEQ ID NO: 1159431 - DNA, 22 bp, Artificial Sequence
  chemically synthesized
tgcatcctgatcctttgtctcc

SEQ ID NO: 1159432 - DNA, 22 bp, Artificial Sequence
  chemically synthesized
gtgcatcctgatcctttgtctc

SEQ ID NO: 1159433 - DNA, 22 bp, Artificial Sequence
  chemically synthesized
taaataagtaaacgcatgtttg

SEQ ID NO: 1159434 - DNA, 22 bp, Artificial Sequence
  chemically synthesized
ataaataagtaaacgcatgttt

SEQ ID NO: 1159435 - DNA, 22 bp, Artificial Sequence
  chemically synthesized
tggaagtcatttataaataagt

SEQ ID NO: 1159436 - DNA, 22 bp, Artificial Sequence
  chemically synthesized
gtggaagtcatttataaataag

SEQ ID NO: 1159437 - DNA, 22 bp, Artificial Sequence
  chemically synthesized
gtacttgtggaagtcatttata

SEQ ID NO: 1159438 - DNA, 22 bp, Artificial Sequence
  chemically synthesized
agtacttgtggaagtcatttat

SEQ ID NO: 1159439 - DNA, 22 bp, Artificial Sequence
  chemically synthesized
tagtacttgtggaagtcattta

SEQ ID NO: 1159440 - DNA, 22 bp, Artificial Sequence
  chemically synthesized
acttatttataaatgacttcca

SEQ ID NO: 1159441 - DNA, 22 bp, Artificial Sequence
  chemically synthesized
cttatttataaatgacttccac

SEQ ID NO: 1159442 - DNA, 22 bp, Artificial Sequence
  chemically synthesized
atttataaatgacttccacaag

SEQ ID NO: 1159443 - DNA, 22 bp, Artificial Sequence
  chemically synthesized
tttataaatgacttccacaagt

SEQ ID NO: 1159444 - DNA, 22 bp, Artificial Sequence
  chemically synthesized
ataaatgacttccacaagtact

SEQ ID NO: 1159445 - DNA, 22 bp, Artificial Sequence
  chemically synthesized
taaatgacttccacaagtacta

SEQ ID NO: 1159446 - DNA, 22 bp, Artificial Sequence
  chemically synthesized
ggggtacataatagatatttta

SEQ ID NO: 1159447 - DNA, 22 bp, Artificial Sequence
  chemically synthesized
ccacaagtactaaaatatctat

SEQ ID NO: 1159448 - DNA, 22 bp, Artificial Sequence
  chemically synthesized
tgggggtacataatagatattt

SEQ ID NO: 1159449 - DNA, 22 bp, Artificial Sequence
  chemically synthesized
cacaagtactaaaatatctatt

SEQ ID NO: 1159450 - DNA, 22 bp, Artificial Sequence
  chemically synthesized
ctgggggtacataatagatatt

SEQ ID NO: 1159451 - DNA, 22 bp, Artificial Sequence
  chemically synthesized
taatttctgggggtacataata

SEQ ID NO: 1159452 - DNA, 22 bp, Artificial Sequence
  chemically synthesized
gtaatttctgggggtacataat

SEQ ID NO: 1159453 - DNA, 22 bp, Artificial Sequence
  chemically synthesized
tttgtaatttctgggggtacat

SEQ ID NO: 1159454 - DNA, 22 bp, Artificial Sequence
  chemically synthesized
aaatatctattatgtaccccca

SEQ ID NO: 1159455 - DNA, 22 bp, Artificial Sequence
  chemically synthesized
atttgtaatttctgggggtaca

SEQ ID NO: 1159456 - DNA, 22 bp, Artificial Sequence
  chemically synthesized
tatttgtaatttctgggggtac

SEQ ID NO: 1159457 - DNA, 22 bp, Artificial Sequence
  chemically synthesized
ttatttgtaatttctgggggta

SEQ ID NO: 1159458 - DNA, 22 bp, Artificial Sequence
  chemically synthesized
tttatttgtaatttctgggggt

SEQ ID NO: 1159459 - DNA, 22 bp, Artificial Sequence
  chemically synthesized
ttttatttgtaatttctggggg

SEQ ID NO: 1159460 - DNA, 22 bp, Artificial Sequence
  chemically synthesized
ttttttatttgtaatttctggg

SEQ ID NO: 1159461 - DNA, 22 bp, Artificial Sequence
  chemically synthesized
cttttttatttgtaatttctgg

SEQ ID NO: 1159462 - DNA, 22 bp, Artificial Sequence
  chemically synthesized
ttatgtacccccagaaattaca

SEQ ID NO: 1159463 - DNA, 22 bp, Artificial Sequence
  chemically synthesized
tgtacccccagaaattacaaat

SEQ ID NO: 1159464 - DNA, 22 bp, Artificial Sequence
  chemically synthesized
gtaagtcttcttttttatttgt

SEQ ID NO: 1159465 - DNA, 22 bp, Artificial Sequence
  chemically synthesized
agtaagtcttcttttttatttg

SEQ ID NO: 1159466 - DNA, 22 bp, Artificial Sequence
  chemically synthesized
tagtaagtcttcttttttattt

SEQ ID NO: 1159467 - DNA, 22 bp, Artificial Sequence
  chemically synthesized
tttagtaagtcttcttttttat

SEQ ID NO: 1159468 - DNA, 22 bp, Artificial Sequence
  chemically synthesized
ctctttagtaagtcttcttttt

SEQ ID NO: 1159469 - DNA, 22 bp, Artificial Sequence
  chemically synthesized
caaataaaaaagaagacttact

SEQ ID NO: 1159470 - DNA, 22 bp, Artificial Sequence
  chemically synthesized
caagatcaaaattactctttag

SEQ ID NO: 1159471 - DNA, 22 bp, Artificial Sequence
  chemically synthesized
tacaagatcaaaattactcttt

SEQ ID NO: 1159472 - DNA, 22 bp, Artificial Sequence
  chemically synthesized
actaaagagtaattttgatctt

SEQ ID NO: 1159473 - DNA, 22 bp, Artificial Sequence
  chemically synthesized
ctaaagagtaattttgatcttg

SEQ ID NO: 1159474 - DNA, 22 bp, Artificial Sequence
  chemically synthesized
aagagtaattttgatcttgtag

SEQ ID NO: 1159475 - DNA, 22 bp, Artificial Sequence
  chemically synthesized
aaagccccaaattctacaagat

SEQ ID NO: 1159476 - DNA, 22 bp, Artificial Sequence
  chemically synthesized
aaaagccccaaattctacaaga

SEQ ID NO: 1159477 - DNA, 22 bp, Artificial Sequence
  chemically synthesized
tatttaaaagccccaaattcta

SEQ ID NO: 1159478 - DNA, 22 bp, Artificial Sequence
  chemically synthesized
tgatcttgtagaatttggggct

SEQ ID NO: 1159479 - DNA, 22 bp, Artificial Sequence
  chemically synthesized
gatcttgtagaatttggggctt

SEQ ID NO: 1159480 - DNA, 22 bp, Artificial Sequence
  chemically synthesized
atcttgtagaatttggggcttt

SEQ ID NO: 1159481 - DNA, 22 bp, Artificial Sequence
  chemically synthesized
aaaattatatttaaaagcccca

SEQ ID NO: 1159482 - DNA, 22 bp, Artificial Sequence
  chemically synthesized
aaaaattatatttaaaagcccc

SEQ ID NO: 1159483 - DNA, 22 bp, Artificial Sequence
  chemically synthesized
gtagaatttggggcttttaaat

SEQ ID NO: 1159484 - DNA, 22 bp, Artificial Sequence
  chemically synthesized
tagaatttggggcttttaaata

SEQ ID NO: 1159485 - DNA, 22 bp, Artificial Sequence
  chemically synthesized
tatttaaaaattatatttaaaa

SEQ ID NO: 1159486 - DNA, 22 bp, Artificial Sequence
  chemically synthesized
gtatttaaaaattatatttaaa

SEQ ID NO: 1159487 - DNA, 22 bp, Artificial Sequence
  chemically synthesized
tgtatttaaaaattatatttaa

SEQ ID NO: 1159488 - DNA, 22 bp, Artificial Sequence
  chemically synthesized
ttttgtatttaaaaattatatt

SEQ ID NO: 1159489 - DNA, 22 bp, Artificial Sequence
  chemically synthesized
ggggcttttaaatataattttt

SEQ ID NO: 1159490 - DNA, 22 bp, Artificial Sequence
  chemically synthesized
gggcttttaaatataattttta

SEQ ID NO: 1159491 - DNA, 22 bp, Artificial Sequence
  chemically synthesized
ttattttgtatttaaaaattat

SEQ ID NO: 1159492 - DNA, 22 bp, Artificial Sequence
  chemically synthesized
ttaaatataatttttaaataca

SEQ ID NO: 1159493 - DNA, 22 bp, Artificial Sequence
  chemically synthesized
taaatataatttttaaatacaa

SEQ ID NO: 1159494 - DNA, 22 bp, Artificial Sequence
  chemically synthesized
aaatataatttttaaatacaaa

SEQ ID NO: 1159495 - DNA, 22 bp, Artificial Sequence
  chemically synthesized
aatataatttttaaatacaaaa

SEQ ID NO: 1159496 - DNA, 22 bp, Artificial Sequence
  chemically synthesized
acacacaattattattttgtat

SEQ ID NO: 1159497 - DNA, 22 bp, Artificial Sequence
  chemically synthesized
tgacacacaattattattttgt

SEQ ID NO: 1159498 - DNA, 22 bp, Artificial Sequence
  chemically synthesized
ctgacacacaattattattttg

SEQ ID NO: 1159499 - DNA, 22 bp, Artificial Sequence
  chemically synthesized
tctgacacacaattattatttt

SEQ ID NO: 1159500 - DNA, 22 bp, Artificial Sequence
  chemically synthesized
ttctgacacacaattattattt

SEQ ID NO: 1159501 - DNA, 22 bp, Artificial Sequence
  chemically synthesized
tttctgacacacaattattatt

SEQ ID NO: 1159502 - DNA, 22 bp, Artificial Sequence
  chemically synthesized
ttttctgacacacaattattat

SEQ ID NO: 1159503 - DNA, 22 bp, Artificial Sequence
  chemically synthesized
ttaaatacaaaataataattgt

SEQ ID NO: 1159504 - DNA, 22 bp, Artificial Sequence
  chemically synthesized
tttttctgacacacaattatta

SEQ ID NO: 1159505 - DNA, 22 bp, Artificial Sequence
  chemically synthesized
taaatacaaaataataattgtg

SEQ ID NO: 1159506 - DNA, 22 bp, Artificial Sequence
  chemically synthesized
aaatacaaaataataattgtgt

SEQ ID NO: 1159507 - DNA, 22 bp, Artificial Sequence
  chemically synthesized
tttttttctgacacacaattat

SEQ ID NO: 1159508 - DNA, 22 bp, Artificial Sequence
  chemically synthesized
aatacaaaataataattgtgtg

SEQ ID NO: 1159509 - DNA, 22 bp, Artificial Sequence
  chemically synthesized
caataatacctctttttttctg

SEQ ID NO: 1159510 - DNA, 22 bp, Artificial Sequence
  chemically synthesized
attacaataatacctctttttt

SEQ ID NO: 1159511 - DNA, 22 bp, Artificial Sequence
  chemically synthesized
tgtgtcagaaaaaaagaggtat

SEQ ID NO: 1159512 - DNA, 22 bp, Artificial Sequence
  chemically synthesized
aatcaataggattaattacaat

SEQ ID NO: 1159513 - DNA, 22 bp, Artificial Sequence
  chemically synthesized
ctgaatcaataggattaattac

SEQ ID NO: 1159514 - DNA, 22 bp, Artificial Sequence
  chemically synthesized
ttgtaattaatcctattgattc

SEQ ID NO: 1159515 - DNA, 22 bp, Artificial Sequence
  chemically synthesized
atatcagttgctgaatcaatag

SEQ ID NO: 1159516 - DNA, 22 bp, Artificial Sequence
  chemically synthesized
taattaatcctattgattcagc

SEQ ID NO: 1159517 - DNA, 22 bp, Artificial Sequence
  chemically synthesized
gggctaatatcagttgctgaat

SEQ ID NO: 1159518 - DNA, 22 bp, Artificial Sequence
  chemically synthesized
atcctattgattcagcaactga

SEQ ID NO: 1159519 - DNA, 22 bp, Artificial Sequence
  chemically synthesized
taaattggggctaatatcagtt

SEQ ID NO: 1159520 - DNA, 22 bp, Artificial Sequence
  chemically synthesized
ttgattcagcaactgatattag

SEQ ID NO: 1159521 - DNA, 22 bp, Artificial Sequence
  chemically synthesized
attcagcaactgatattagccc

SEQ ID NO: 1159522 - DNA, 22 bp, Artificial Sequence
  chemically synthesized
cccacctgtaaattggggctaa

SEQ ID NO: 1159523 - DNA, 22 bp, Artificial Sequence
  chemically synthesized
agcaactgatattagccccaat

SEQ ID NO: 1159524 - DNA, 22 bp, Artificial Sequence
  chemically synthesized
ccccacctgtaaattggggcta

SEQ ID NO: 1159525 - DNA, 22 bp, Artificial Sequence
  chemically synthesized
tttccccacctgtaaattgggg

SEQ ID NO: 1159526 - DNA, 22 bp, Artificial Sequence
  chemically synthesized
gtttccccacctgtaaattggg

SEQ ID NO: 1159527 - DNA, 22 bp, Artificial Sequence
  chemically synthesized
tgtttccccacctgtaaattgg

SEQ ID NO: 1159528 - DNA, 22 bp, Artificial Sequence
  chemically synthesized
atattagccccaatttacaggt

SEQ ID NO: 1159529 - DNA, 22 bp, Artificial Sequence
  chemically synthesized
gccccaatttacaggtggggaa

SEQ ID NO: 1159530 - DNA, 22 bp, Artificial Sequence
  chemically synthesized
acccaagtaagcctttgtttcc

SEQ ID NO: 1159531 - DNA, 22 bp, Artificial Sequence
  chemically synthesized
gacccaagtaagcctttgtttc

SEQ ID NO: 1159532 - DNA, 22 bp, Artificial Sequence
  chemically synthesized
tgacccaagtaagcctttgttt

SEQ ID NO: 1159533 - DNA, 22 bp, Artificial Sequence
  chemically synthesized
acaggtggggaaacaaaggctt

SEQ ID NO: 1159534 - DNA, 22 bp, Artificial Sequence
  chemically synthesized
caggtggggaaacaaaggctta

SEQ ID NO: 1159535 - DNA, 22 bp, Artificial Sequence
  chemically synthesized
cgttttgacccaagtaagcctt

SEQ ID NO: 1159536 - DNA, 22 bp, Artificial Sequence
  chemically synthesized
gcgttttgacccaagtaagcct

SEQ ID NO: 1159537 - DNA, 22 bp, Artificial Sequence
  chemically synthesized
tttgcgttttgacccaagtaag

SEQ ID NO: 1159538 - DNA, 22 bp, Artificial Sequence
  chemically synthesized
gtttgcgttttgacccaagtaa

SEQ ID NO: 1159539 - DNA, 22 bp, Artificial Sequence
  chemically synthesized
ccttgtttgcgttttgacccaa

SEQ ID NO: 1159540 - DNA, 22 bp, Artificial Sequence
  chemically synthesized
cccttgtttgcgttttgaccca

SEQ ID NO: 1159541 - DNA, 22 bp, Artificial Sequence
  chemically synthesized
tcaccttcccttgtttgcgttt

SEQ ID NO: 1159542 - DNA, 22 bp, Artificial Sequence
  chemically synthesized
gtcaccttcccttgtttgcgtt

SEQ ID NO: 1159543 - DNA, 22 bp, Artificial Sequence
  chemically synthesized
acttgggtcaaaacgcaaacaa

SEQ ID NO: 1159544 - DNA, 22 bp, Artificial Sequence
  chemically synthesized
tgtcaccttcccttgtttgcgt

SEQ ID NO: 1159545 - DNA, 22 bp, Artificial Sequence
  chemically synthesized
cttgggtcaaaacgcaaacaag

SEQ ID NO: 1159546 - DNA, 22 bp, Artificial Sequence
  chemically synthesized
gggtcaaaacgcaaacaaggga

SEQ ID NO: 1159547 - DNA, 22 bp, Artificial Sequence
  chemically synthesized
ggtcaaaacgcaaacaagggaa

SEQ ID NO: 1159548 - DNA, 22 bp, Artificial Sequence
  chemically synthesized
ccactttgtcaccttcccttgt

SEQ ID NO: 1159549 - DNA, 22 bp, Artificial Sequence
  chemically synthesized
agttcccactttgtcaccttcc

SEQ ID NO: 1159550 - DNA, 22 bp, Artificial Sequence
  chemically synthesized
cctgagttcccactttgtcacc

SEQ ID NO: 1159551 - DNA, 22 bp, Artificial Sequence
  chemically synthesized
tgaagcaggccccggagccaaa

SEQ ID NO: 1159552 - DNA, 22 bp, Artificial Sequence
  chemically synthesized
aggtagtttggctccggggcct

SEQ ID NO: 1159553 - DNA, 22 bp, Artificial Sequence
  chemically synthesized
catgattgtgaagcaggccccg

SEQ ID NO: 1159554 - DNA, 22 bp, Artificial Sequence
  chemically synthesized
ggctccggggcctgcttcacaa

SEQ ID NO: 1159555 - DNA, 22 bp, Artificial Sequence
  chemically synthesized
gctccggggcctgcttcacaat

SEQ ID NO: 1159556 - DNA, 22 bp, Artificial Sequence
  chemically synthesized
aggcaatattgcatgattgtga

SEQ ID NO: 1159557 - DNA, 22 bp, Artificial Sequence
  chemically synthesized
cggggcctgcttcacaatcatg

SEQ ID NO: 1159558 - DNA, 22 bp, Artificial Sequence
  chemically synthesized
gttcaggcaatattgcatgatt

SEQ ID NO: 1159559 - DNA, 22 bp, Artificial Sequence
  chemically synthesized
agttcaggcaatattgcatgat

SEQ ID NO: 1159560 - DNA, 22 bp, Artificial Sequence
  chemically synthesized
tagttcaggcaatattgcatga

SEQ ID NO: 1159561 - DNA, 22 bp, Artificial Sequence
  chemically synthesized
cttcacaatcatgcaatattgc

SEQ ID NO: 1159562 - DNA, 22 bp, Artificial Sequence
  chemically synthesized
attttagttcaggcaatattgc

SEQ ID NO: 1159563 - DNA, 22 bp, Artificial Sequence
  chemically synthesized
cacaatcatgcaatattgcctg

SEQ ID NO: 1159564 - DNA, 22 bp, Artificial Sequence
  chemically synthesized
acaatcatgcaatattgcctga

SEQ ID NO: 1159565 - DNA, 22 bp, Artificial Sequence
  chemically synthesized
aaaagttaattttagttcaggc

SEQ ID NO: 1159566 - DNA, 22 bp, Artificial Sequence
  chemically synthesized
taaaaagttaattttagttcag

SEQ ID NO: 1159567 - DNA, 22 bp, Artificial Sequence
  chemically synthesized
atctctaaaaagttaattttag

SEQ ID NO: 1159568 - DNA, 22 bp, Artificial Sequence
  chemically synthesized
cctgaactaaaattaacttttt

SEQ ID NO: 1159569 - DNA, 22 bp, Artificial Sequence
  chemically synthesized
aactaaaattaactttttagag

SEQ ID NO: 1159570 - DNA, 22 bp, Artificial Sequence
  chemically synthesized
aaattaactttttagagattaa

SEQ ID NO: 1159571 - DNA, 22 bp, Artificial Sequence
  chemically synthesized
taatagatataaagttaatctc

SEQ ID NO: 1159572 - DNA, 22 bp, Artificial Sequence
  chemically synthesized
ataatagatataaagttaatct

SEQ ID NO: 1159573 - DNA, 22 bp, Artificial Sequence
  chemically synthesized
tataatagatataaagttaatc

SEQ ID NO: 1159574 - DNA, 22 bp, Artificial Sequence
  chemically synthesized
actttttagagattaactttat

SEQ ID NO: 1159575 - DNA, 22 bp, Artificial Sequence
  chemically synthesized
tttagagattaactttatatct

SEQ ID NO: 1159576 - DNA, 22 bp, Artificial Sequence
  chemically synthesized
ttagagattaactttatatcta

SEQ ID NO: 1159577 - DNA, 22 bp, Artificial Sequence
  chemically synthesized
tagagattaactttatatctat

SEQ ID NO: 1159578 - DNA, 22 bp, Artificial Sequence
  chemically synthesized
agagattaactttatatctatt

SEQ ID NO: 1159579 - DNA, 22 bp, Artificial Sequence
  chemically synthesized
gagattaactttatatctatta

SEQ ID NO: 1159580 - DNA, 22 bp, Artificial Sequence
  chemically synthesized
actttatatctattataaagtc

SEQ ID NO: 1159581 - DNA, 22 bp, Artificial Sequence
  chemically synthesized
tatatctattataaagtcattt

SEQ ID NO: 1159582 - DNA, 22 bp, Artificial Sequence
  chemically synthesized
atatctattataaagtcattta

SEQ ID NO: 1159583 - DNA, 22 bp, Artificial Sequence
  chemically synthesized
taatcagtgccataaatgactt

SEQ ID NO: 1159584 - DNA, 22 bp, Artificial Sequence
  chemically synthesized
tatctattataaagtcatttat

SEQ ID NO: 1159585 - DNA, 22 bp, Artificial Sequence
  chemically synthesized
ataatcagtgccataaatgact

SEQ ID NO: 1159586 - DNA, 22 bp, Artificial Sequence
  chemically synthesized
ttataaagtcatttatggcact

SEQ ID NO: 1159587 - DNA, 22 bp, Artificial Sequence
  chemically synthesized
atatttataatcagtgccataa

SEQ ID NO: 1159588 - DNA, 22 bp, Artificial Sequence
  chemically synthesized
aatatttataatcagtgccata

SEQ ID NO: 1159589 - DNA, 22 bp, Artificial Sequence
  chemically synthesized
taatatttataatcagtgccat

SEQ ID NO: 1159590 - DNA, 22 bp, Artificial Sequence
  chemically synthesized
taaagtcatttatggcactgat

SEQ ID NO: 1159591 - DNA, 22 bp, Artificial Sequence
  chemically synthesized
ttaatatttataatcagtgcca

SEQ ID NO: 1159592 - DNA, 22 bp, Artificial Sequence
  chemically synthesized
tttaatatttataatcagtgcc

SEQ ID NO: 1159593 - DNA, 22 bp, Artificial Sequence
  chemically synthesized
ttttaatatttataatcagtgc

SEQ ID NO: 1159594 - DNA, 22 bp, Artificial Sequence
  chemically synthesized
tttttttaatatttataatcag

SEQ ID NO: 1159595 - DNA, 22 bp, Artificial Sequence
  chemically synthesized
tatttttttaatatttataatc

SEQ ID NO: 1159596 - DNA, 22 bp, Artificial Sequence
  chemically synthesized
ctatttttttaatatttataat

SEQ ID NO: 1159597 - DNA, 22 bp, Artificial Sequence
  chemically synthesized
tctatttttttaatatttataa

SEQ ID NO: 1159598 - DNA, 22 bp, Artificial Sequence
  chemically synthesized
atggcactgattataaatatta

SEQ ID NO: 1159599 - DNA, 22 bp, Artificial Sequence
  chemically synthesized
tggcactgattataaatattaa

SEQ ID NO: 1159600 - DNA, 22 bp, Artificial Sequence
  chemically synthesized
ttttctatttttttaatattta

SEQ ID NO: 1159601 - DNA, 22 bp, Artificial Sequence
  chemically synthesized
tgttttctatttttttaatatt

SEQ ID NO: 1159602 - DNA, 22 bp, Artificial Sequence
  chemically synthesized
ctgttttctatttttttaatat

SEQ ID NO: 1159603 - DNA, 22 bp, Artificial Sequence
  chemically synthesized
attataaatattaaaaaaatag

SEQ ID NO: 1159604 - DNA, 22 bp, Artificial Sequence
  chemically synthesized
taaatattaaaaaaatagaaaa

SEQ ID NO: 1159605 - DNA, 22 bp, Artificial Sequence
  chemically synthesized
caccaaatgaacttctgttttc

SEQ ID NO: 1159606 - DNA, 22 bp, Artificial Sequence
  chemically synthesized
aaaaaatagaaaacagaagttc

SEQ ID NO: 1159607 - DNA, 22 bp, Artificial Sequence
  chemically synthesized
tataaaattccaccaaatgaac

SEQ ID NO: 1159608 - DNA, 22 bp, Artificial Sequence
  chemically synthesized
tgtataaaattccaccaaatga

SEQ ID NO: 1159609 - DNA, 22 bp, Artificial Sequence
  chemically synthesized
atgacaatctctgtataaaatt

SEQ ID NO: 1159610 - DNA, 22 bp, Artificial Sequence
  chemically synthesized
atttggtggaattttatacaga

SEQ ID NO: 1159611 - DNA, 22 bp, Artificial Sequence
  chemically synthesized
ttaatgacaatctctgtataaa

SEQ ID NO: 1159612 - DNA, 22 bp, Artificial Sequence
  chemically synthesized
ggtggaattttatacagagatt

SEQ ID NO: 1159613 - DNA, 22 bp, Artificial Sequence
  chemically synthesized
gtggaattttatacagagattg

SEQ ID NO: 1159614 - DNA, 22 bp, Artificial Sequence
  chemically synthesized
tatacagagattgtcattaata

SEQ ID NO: 1159615 - DNA, 22 bp, Artificial Sequence
  chemically synthesized
atacagagattgtcattaataa

SEQ ID NO: 1159616 - DNA, 22 bp, Artificial Sequence
  chemically synthesized
tacagagattgtcattaataat

SEQ ID NO: 1159617 - DNA, 22 bp, Artificial Sequence
  chemically synthesized
gtgaaaataataaaattattaa

SEQ ID NO: 1159618 - DNA, 22 bp, Artificial Sequence
  chemically synthesized
ggtgaaaataataaaattatta

SEQ ID NO: 1159619 - DNA, 22 bp, Artificial Sequence
  chemically synthesized
tggtgaaaataataaaattatt

SEQ ID NO: 1159620 - DNA, 22 bp, Artificial Sequence
  chemically synthesized
gttttggtgaaaataataaaat

SEQ ID NO: 1159621 - DNA, 22 bp, Artificial Sequence
  chemically synthesized
cgttttggtgaaaataataaaa

SEQ ID NO: 1159622 - DNA, 22 bp, Artificial Sequence
  chemically synthesized
tcgttttggtgaaaataataaa

SEQ ID NO: 1159623 - DNA, 22 bp, Artificial Sequence
  chemically synthesized
tcattaataattttattatttt

SEQ ID NO: 1159624 - DNA, 22 bp, Artificial Sequence
  chemically synthesized
taattttcgttttggtgaaaat

SEQ ID NO: 1159625 - DNA, 22 bp, Artificial Sequence
  chemically synthesized
ataattttattattttcaccaa

SEQ ID NO: 1159626 - DNA, 22 bp, Artificial Sequence
  chemically synthesized
tattattttcaccaaaacgaaa

SEQ ID NO: 1159627 - DNA, 22 bp, Artificial Sequence
  chemically synthesized
attattttcaccaaaacgaaaa

SEQ ID NO: 1159628 - DNA, 22 bp, Artificial Sequence
  chemically synthesized
ttattttcaccaaaacgaaaat

SEQ ID NO: 1159629 - DNA, 22 bp, Artificial Sequence
  chemically synthesized
ttttcaccaaaacgaaaattac

SEQ ID NO: 1159630 - DNA, 22 bp, Artificial Sequence
  chemically synthesized
aagagtaacaactgtaattttc

SEQ ID NO: 1159631 - DNA, 22 bp, Artificial Sequence
  chemically synthesized
tcaccaaaacgaaaattacagt

SEQ ID NO: 1159632 - DNA, 22 bp, Artificial Sequence
  chemically synthesized
caccaaaacgaaaattacagtt

SEQ ID NO: 1159633 - DNA, 22 bp, Artificial Sequence
  chemically synthesized
accaaaacgaaaattacagttg

SEQ ID NO: 1159634 - DNA, 22 bp, Artificial Sequence
  chemically synthesized
tctcaagagtaacaactgtaat

SEQ ID NO: 1159635 - DNA, 22 bp, Artificial Sequence
  chemically synthesized
agaacaattgtctcaagagtaa

SEQ ID NO: 1159636 - DNA, 22 bp, Artificial Sequence
  chemically synthesized
cagttgttactcttgagacaat

SEQ ID NO: 1159637 - DNA, 22 bp, Artificial Sequence
  chemically synthesized
ttactcttgagacaattgttct

SEQ ID NO: 1159638 - DNA, 22 bp, Artificial Sequence
  chemically synthesized
ctcttgagacaattgttcttag

SEQ ID NO: 1159639 - DNA, 22 bp, Artificial Sequence
  chemically synthesized
aagtaaacatcatgctaagaac

SEQ ID NO: 1159640 - DNA, 22 bp, Artificial Sequence
  chemically synthesized
ttgagacaattgttcttagcat

SEQ ID NO: 1159641 - DNA, 22 bp, Artificial Sequence
  chemically synthesized
gagacaattgttcttagcatga

SEQ ID NO: 1159642 - DNA, 22 bp, Artificial Sequence
  chemically synthesized
agacaattgttcttagcatgat

SEQ ID NO: 1159643 - DNA, 22 bp, Artificial Sequence
  chemically synthesized
tcattaaagtaaacatcatgct

SEQ ID NO: 1159644 - DNA, 22 bp, Artificial Sequence
  chemically synthesized
tatcattaaagtaaacatcatg

SEQ ID NO: 1159645 - DNA, 22 bp, Artificial Sequence
  chemically synthesized
ctatcattaaagtaaacatcat

SEQ ID NO: 1159646 - DNA, 22 bp, Artificial Sequence
  chemically synthesized
ttcttagcatgatgtttacttt

SEQ ID NO: 1159647 - DNA, 22 bp, Artificial Sequence
  chemically synthesized
tggtttctatcattaaagtaaa

SEQ ID NO: 1159648 - DNA, 22 bp, Artificial Sequence
  chemically synthesized
ttagcatgatgtttactttaat

SEQ ID NO: 1159649 - DNA, 22 bp, Artificial Sequence
  chemically synthesized
agcatgatgtttactttaatga

SEQ ID NO: 1159650 - DNA, 22 bp, Artificial Sequence
  chemically synthesized
gcatgatgtttactttaatgat

SEQ ID NO: 1159651 - DNA, 22 bp, Artificial Sequence
  chemically synthesized
actttaatgatagaaaccacaa

SEQ ID NO: 1159652 - DNA, 22 bp, Artificial Sequence
  chemically synthesized
aaaaatagggtattgtggtttc

SEQ ID NO: 1159653 - DNA, 22 bp, Artificial Sequence
  chemically synthesized
ctttaatgatagaaaccacaat

SEQ ID NO: 1159654 - DNA, 22 bp, Artificial Sequence
  chemically synthesized
aaaaaatagggtattgtggttt

SEQ ID NO: 1159655 - DNA, 22 bp, Artificial Sequence
  chemically synthesized
taatgatagaaaccacaatacc

SEQ ID NO: 1159656 - DNA, 22 bp, Artificial Sequence
  chemically synthesized
aatgatagaaaccacaataccc

SEQ ID NO: 1159657 - DNA, 22 bp, Artificial Sequence
  chemically synthesized
atgatagaaaccacaataccct

SEQ ID NO: 1159658 - DNA, 22 bp, Artificial Sequence
  chemically synthesized
tatacccaaaaaaataaaaatt

SEQ ID NO: 1159659 - DNA, 22 bp, Artificial Sequence
  chemically synthesized
ttttttaaatttttattttttt

SEQ ID NO: 1159660 - DNA, 22 bp, Artificial Sequence
  chemically synthesized
tttaaatttttatttttttggg

SEQ ID NO: 1159661 - DNA, 22 bp, Artificial Sequence
  chemically synthesized
ttaaatttttatttttttgggt

SEQ ID NO: 1159662 - DNA, 22 bp, Artificial Sequence
  chemically synthesized
taaatttttatttttttgggta

SEQ ID NO: 1159663 - DNA, 22 bp, Artificial Sequence
  chemically synthesized
aaatttttatttttttgggtat

SEQ ID NO: 1159664 - DNA, 22 bp, Artificial Sequence
  chemically synthesized
aatttttatttttttgggtata

SEQ ID NO: 1159665 - DNA, 22 bp, Artificial Sequence
  chemically synthesized
ttatttttttgggtatatagta

SEQ ID NO: 1159666 - DNA, 22 bp, Artificial Sequence
  chemically synthesized
tatttttttgggtatatagtat

SEQ ID NO: 1159667 - DNA, 22 bp, Artificial Sequence
  chemically synthesized
atttttttgggtatatagtatg

SEQ ID NO: 1159668 - DNA, 22 bp, Artificial Sequence
  chemically synthesized
tttttttgggtatatagtatgt

SEQ ID NO: 1159669 - DNA, 22 bp, Artificial Sequence
  chemically synthesized
ttttgggtatatagtatgtgtt

SEQ ID NO: 1159670 - DNA, 22 bp, Artificial Sequence
  chemically synthesized
tttgggtatatagtatgtgttt

SEQ ID NO: 1159671 - DNA, 22 bp, Artificial Sequence
  chemically synthesized
ttgggtatatagtatgtgttta

SEQ ID NO: 1159672 - DNA, 22 bp, Artificial Sequence
  chemically synthesized
tgggtatatagtatgtgtttat

SEQ ID NO: 1159673 - DNA, 22 bp, Artificial Sequence
  chemically synthesized
tatcccataaatataaacacat

SEQ ID NO: 1159674 - DNA, 22 bp, Artificial Sequence
  chemically synthesized
gggtatatagtatgtgtttata

SEQ ID NO: 1159675 - DNA, 22 bp, Artificial Sequence
  chemically synthesized
gtatcccataaatataaacaca

SEQ ID NO: 1159676 - DNA, 22 bp, Artificial Sequence
  chemically synthesized
ggtatatagtatgtgtttatat

SEQ ID NO: 1159677 - DNA, 22 bp, Artificial Sequence
  chemically synthesized
ttgtatcccataaatataaaca

SEQ ID NO: 1159678 - DNA, 22 bp, Artificial Sequence
  chemically synthesized
tatgaatatgtctcttgtatcc

SEQ ID NO: 1159679 - DNA, 22 bp, Artificial Sequence
  chemically synthesized
atatttatgggatacaagagac

SEQ ID NO: 1159680 - DNA, 22 bp, Artificial Sequence
  chemically synthesized
tatttatgggatacaagagaca

SEQ ID NO: 1159681 - DNA, 22 bp, Artificial Sequence
  chemically synthesized
tatgcctgtatgaatatgtctc

SEQ ID NO: 1159682 - DNA, 22 bp, Artificial Sequence
  chemically synthesized
atgggatacaagagacatattc

SEQ ID NO: 1159683 - DNA, 22 bp, Artificial Sequence
  chemically synthesized
tgggatacaagagacatattca

SEQ ID NO: 1159684 - DNA, 22 bp, Artificial Sequence
  chemically synthesized
tgcctgtatgcctgtatgaata

SEQ ID NO: 1159685 - DNA, 22 bp, Artificial Sequence
  chemically synthesized
atgtcatattatgcctgtatgc

SEQ ID NO: 1159686 - DNA, 22 bp, Artificial Sequence
  chemically synthesized
atacaggcatacaggcataata

SEQ ID NO: 1159687 - DNA, 22 bp, Artificial Sequence
  chemically synthesized
accctaatgtcatattatgcct

SEQ ID NO: 1159688 - DNA, 22 bp, Artificial Sequence
  chemically synthesized
ttaaccctaatgtcatattatg

SEQ ID NO: 1159689 - DNA, 22 bp, Artificial Sequence
  chemically synthesized
gaggtgatggataccctattaa

SEQ ID NO: 1159690 - DNA, 22 bp, Artificial Sequence
  chemically synthesized
gggttaatagggtatccatcac

SEQ ID NO: 1159691 - DNA, 22 bp, Artificial Sequence
  chemically synthesized
atagggtatccatcacctcgag

SEQ ID NO: 1159692 - DNA, 22 bp, Artificial Sequence
  chemically synthesized
tcacataaagaaatgataagtg

SEQ ID NO: 1159693 - DNA, 22 bp, Artificial Sequence
  chemically synthesized
gtcacataaagaaatgataagt

SEQ ID NO: 1159694 - DNA, 22 bp, Artificial Sequence
  chemically synthesized
gagcacttatcatttctttatg

SEQ ID NO: 1159695 - DNA, 22 bp, Artificial Sequence
  chemically synthesized
gaatgtttgtcacataaagaaa

SEQ ID NO: 1159696 - DNA, 22 bp, Artificial Sequence
  chemically synthesized
atcatttctttatgtgacaaac

SEQ ID NO: 1159697 - DNA, 22 bp, Artificial Sequence
  chemically synthesized
tcatttctttatgtgacaaaca

SEQ ID NO: 1159698 - DNA, 22 bp, Artificial Sequence
  chemically synthesized
ctttatgtgacaaacattccaa

SEQ ID NO: 1159699 - DNA, 22 bp, Artificial Sequence
  chemically synthesized
tttatgtgacaaacattccaat

SEQ ID NO: 1159700 - DNA, 22 bp, Artificial Sequence
  chemically synthesized
tatgtgacaaacattccaatta

SEQ ID NO: 1159701 - DNA, 22 bp, Artificial Sequence
  chemically synthesized
atgtgacaaacattccaattat

SEQ ID NO: 1159702 - DNA, 22 bp, Artificial Sequence
  chemically synthesized
tgtgacaaacattccaattata

SEQ ID NO: 1159703 - DNA, 22 bp, Artificial Sequence
  chemically synthesized
aaataacaaaaagtataattgg

SEQ ID NO: 1159704 - DNA, 22 bp, Artificial Sequence
  chemically synthesized
aaaataacaaaaagtataattg

SEQ ID NO: 1159705 - DNA, 22 bp, Artificial Sequence
  chemically synthesized
taaaataacaaaaagtataatt

SEQ ID NO: 1159706 - DNA, 22 bp, Artificial Sequence
  chemically synthesized
tacgttttaaaataacaaaaag

SEQ ID NO: 1159707 - DNA, 22 bp, Artificial Sequence
  chemically synthesized
ttgtacgttttaaaataacaaa

SEQ ID NO: 1159708 - DNA, 22 bp, Artificial Sequence
  chemically synthesized
caattatactttttgttatttt

SEQ ID NO: 1159709 - DNA, 22 bp, Artificial Sequence
  chemically synthesized
gttgtacgttttaaaataacaa

SEQ ID NO: 1159710 - DNA, 22 bp, Artificial Sequence
  chemically synthesized
tactttttgttattttaaaacg

SEQ ID NO: 1159711 - DNA, 22 bp, Artificial Sequence
  chemically synthesized
tttgttattttaaaacgtacaa

SEQ ID NO: 1159712 - DNA, 22 bp, Artificial Sequence
  chemically synthesized
ttgttattttaaaacgtacaac

SEQ ID NO: 1159713 - DNA, 22 bp, Artificial Sequence
  chemically synthesized
tgttattttaaaacgtacaaca

SEQ ID NO: 1159714 - DNA, 22 bp, Artificial Sequence
  chemically synthesized
tcaaacataatttgttgtacgt

SEQ ID NO: 1159715 - DNA, 22 bp, Artificial Sequence
  chemically synthesized
gttattttaaaacgtacaacaa

SEQ ID NO: 1159716 - DNA, 22 bp, Artificial Sequence
  chemically synthesized
ttattttaaaacgtacaacaaa

SEQ ID NO: 1159717 - DNA, 22 bp, Artificial Sequence
  chemically synthesized
ctgtcaaacataatttgttgta

SEQ ID NO: 1159718 - DNA, 22 bp, Artificial Sequence
  chemically synthesized
ttttaaaacgtacaacaaatta

SEQ ID NO: 1159719 - DNA, 22 bp, Artificial Sequence
  chemically synthesized
taaaacgtacaacaaattatgt

SEQ ID NO: 1159720 - DNA, 22 bp, Artificial Sequence
  chemically synthesized
aaaacgtacaacaaattatgtt

SEQ ID NO: 1159721 - DNA, 22 bp, Artificial Sequence
  chemically synthesized
aaacgtacaacaaattatgttt

SEQ ID NO: 1159722 - DNA, 22 bp, Artificial Sequence
  chemically synthesized
atagcacgacaggatgattact

SEQ ID NO: 1159723 - DNA, 22 bp, Artificial Sequence
  chemically synthesized
gatagcacgacaggatgattac

SEQ ID NO: 1159724 - DNA, 22 bp, Artificial Sequence
  chemically synthesized
tgtttgacagtaatcatcctgt

SEQ ID NO: 1159725 - DNA, 22 bp, Artificial Sequence
  chemically synthesized
gacagtaatcatcctgtcgtgc

SEQ ID NO: 1159726 - DNA, 22 bp, Artificial Sequence
  chemically synthesized
acagtaatcatcctgtcgtgct

SEQ ID NO: 1159727 - DNA, 22 bp, Artificial Sequence
  chemically synthesized
aatgaatgtgatgtagtatttg

SEQ ID NO: 1159728 - DNA, 22 bp, Artificial Sequence
  chemically synthesized
tcgtgctatcaaatactacatc

SEQ ID NO: 1159729 - DNA, 22 bp, Artificial Sequence
  chemically synthesized
gattgaatgaatgtgatgtagt

SEQ ID NO: 1159730 - DNA, 22 bp, Artificial Sequence
  chemically synthesized
tcaaatactacatcacattcat

SEQ ID NO: 1159731 - DNA, 22 bp, Artificial Sequence
  chemically synthesized
catcacattcattcaatctaac

SEQ ID NO: 1159732 - DNA, 22 bp, Artificial Sequence
  chemically synthesized
atgggtacaaaaatatagttag

SEQ ID NO: 1159733 - DNA, 22 bp, Artificial Sequence
  chemically synthesized
attcaatctaactatatttttg

SEQ ID NO: 1159734 - DNA, 22 bp, Artificial Sequence
  chemically synthesized
aatctaactatatttttgtacc

SEQ ID NO: 1159735 - DNA, 22 bp, Artificial Sequence
  chemically synthesized
actatatttttgtacccattaa

SEQ ID NO: 1159736 - DNA, 22 bp, Artificial Sequence
  chemically synthesized
tatttttgtacccattaatgat

SEQ ID NO: 1159737 - DNA, 22 bp, Artificial Sequence
  chemically synthesized
ttgtacccattaatgatcccca

SEQ ID NO: 1159738 - DNA, 22 bp, Artificial Sequence
  chemically synthesized
tgtacccattaatgatccccac

SEQ ID NO: 1159739 - DNA, 22 bp, Artificial Sequence
  chemically synthesized
gtacccattaatgatccccact

SEQ ID NO: 1159740 - DNA, 22 bp, Artificial Sequence
  chemically synthesized
tacccattaatgatccccactg

SEQ ID NO: 1159741 - DNA, 22 bp, Artificial Sequence
  chemically synthesized
gtgggtcgggggcagtggggat

SEQ ID NO: 1159742 - DNA, 22 bp, Artificial Sequence
  chemically synthesized
atgatccccactgcccccgacc

SEQ ID NO: 1159743 - DNA, 22 bp, Artificial Sequence
  chemically synthesized
ccagaggatgggaatgctagtg

SEQ ID NO: 1159744 - DNA, 22 bp, Artificial Sequence
  chemically synthesized
cccccgacccactagcattccc

SEQ ID NO: 1159745 - DNA, 22 bp, Artificial Sequence
  chemically synthesized
gaatgatggttaccagaggatg

SEQ ID NO: 1159746 - DNA, 22 bp, Artificial Sequence
  chemically synthesized
gcattcccatcctctggtaacc

SEQ ID NO: 1159747 - DNA, 22 bp, Artificial Sequence
  chemically synthesized
ccatcctctggtaaccatcatt

SEQ ID NO: 1159748 - DNA, 22 bp, Artificial Sequence
  chemically synthesized
atggagatagagactagaatga

SEQ ID NO: 1159749 - DNA, 22 bp, Artificial Sequence
  chemically synthesized
tggtaaccatcattctagtctc

SEQ ID NO: 1159750 - DNA, 22 bp, Artificial Sequence
  chemically synthesized
gtaaccatcattctagtctcta

SEQ ID NO: 1159751 - DNA, 22 bp, Artificial Sequence
  chemically synthesized
aactcatggagatagagactag

SEQ ID NO: 1159752 - DNA, 22 bp, Artificial Sequence
  chemically synthesized
aaacaactgaactcatggagat

SEQ ID NO: 1159753 - DNA, 22 bp, Artificial Sequence
  chemically synthesized
tagtctctatctccatgagttc

SEQ ID NO: 1159754 - DNA, 22 bp, Artificial Sequence
  chemically synthesized
gtctctatctccatgagttcag

SEQ ID NO: 1159755 - DNA, 22 bp, Artificial Sequence
  chemically synthesized
tatctccatgagttcagttgtt

SEQ ID NO: 1159756 - DNA, 22 bp, Artificial Sequence
  chemically synthesized
tctccatgagttcagttgtttt

SEQ ID NO: 1159757 - DNA, 22 bp, Artificial Sequence
  chemically synthesized
catgagttcagttgttttaatt

SEQ ID NO: 1159758 - DNA, 22 bp, Artificial Sequence
  chemically synthesized
agttgttttaattttttttttt

SEQ ID NO: 1159759 - DNA, 22 bp, Artificial Sequence
  chemically synthesized
ttttaatttttttttttttttt

SEQ ID NO: 1159760 - DNA, 22 bp, Artificial Sequence
  chemically synthesized
taattttttttttttttttttt

SEQ ID NO: 1159761 - DNA, 22 bp, Artificial Sequence
  chemically synthesized
aatttttttttttttttttttt

SEQ ID NO: 1159762 - DNA, 22 bp, Artificial Sequence
  chemically synthesized
attttttttttttttttttttt

SEQ ID NO: 1159763 - DNA, 22 bp, Artificial Sequence
  chemically synthesized
aaaaaaaaaaaaaaaaaaaaaa

SEQ ID NO: 1159764 - DNA, 22 bp, Artificial Sequence
  chemically synthesized
tttttttttttttttttttttt

SEQ ID NO: 1159765 - DNA, 22 bp, Artificial Sequence
  chemically synthesized
aaaaaaaaaaaaaaaaaaaaaa

SEQ ID NO: 1159766 - DNA, 22 bp, Artificial Sequence
  chemically synthesized
tttttttttttttttttttttt

SEQ ID NO: 1159767 - DNA, 22 bp, Artificial Sequence
  chemically synthesized
tttttttttttttttttttttt

SEQ ID NO: 1159768 - DNA, 22 bp, Artificial Sequence
  chemically synthesized
tttttttttttttttttttttt

SEQ ID NO: 1159769 - DNA, 22 bp, Artificial Sequence
  chemically synthesized
tttttttttttttttttttttt

SEQ ID NO: 1159770 - DNA, 22 bp, Artificial Sequence
  chemically synthesized
tttttttttttttttttttttt

SEQ ID NO: 1159771 - DNA, 22 bp, Artificial Sequence
  chemically synthesized
tttttttttttttttttttttt

SEQ ID NO: 1159772 - DNA, 22 bp, Artificial Sequence
  chemically synthesized
tttttttttttttttttttttt

SEQ ID NO: 1159773 - DNA, 22 bp, Artificial Sequence
  chemically synthesized
tttttttttttttttttttttt

SEQ ID NO: 1159774 - DNA, 22 bp, Artificial Sequence
  chemically synthesized
tttttttttttttttttttttt

SEQ ID NO: 1159775 - DNA, 22 bp, Artificial Sequence
  chemically synthesized
tgagagcttaaaaaaaaaaaaa

SEQ ID NO: 1159776 - DNA, 22 bp, Artificial Sequence
  chemically synthesized
tttttttttttttttttttttt

SEQ ID NO: 1159777 - DNA, 22 bp, Artificial Sequence
  chemically synthesized
gtgagagcttaaaaaaaaaaaa

SEQ ID NO: 1159778 - DNA, 22 bp, Artificial Sequence
  chemically synthesized
tttttttttttttttttttttt

SEQ ID NO: 1159779 - DNA, 22 bp, Artificial Sequence
  chemically synthesized
tttttttttttttttttttttt

SEQ ID NO: 1159780 - DNA, 22 bp, Artificial Sequence
  chemically synthesized
ttttttttttttttttttttta

SEQ ID NO: 1159781 - DNA, 22 bp, Artificial Sequence
  chemically synthesized
cttgtgagagcttaaaaaaaaa

SEQ ID NO: 1159782 - DNA, 22 bp, Artificial Sequence
  chemically synthesized
ttttttttttttttttttttaa

SEQ ID NO: 1159783 - DNA, 22 bp, Artificial Sequence
  chemically synthesized
acttgtgagagcttaaaaaaaa

SEQ ID NO: 1159784 - DNA, 22 bp, Artificial Sequence
  chemically synthesized
tttttttttttttttttttaag

SEQ ID NO: 1159785 - DNA, 22 bp, Artificial Sequence
  chemically synthesized
ttttttttttttttttttaagc

SEQ ID NO: 1159786 - DNA, 22 bp, Artificial Sequence
  chemically synthesized
tttttttttttttttttaagct

SEQ ID NO: 1159787 - DNA, 22 bp, Artificial Sequence
  chemically synthesized
ttttttttttttttttaagctc

SEQ ID NO: 1159788 - DNA, 22 bp, Artificial Sequence
  chemically synthesized
acttacttgtgagagcttaaaa

SEQ ID NO: 1159789 - DNA, 22 bp, Artificial Sequence
  chemically synthesized
tttttttttttttttaagctct

SEQ ID NO: 1159790 - DNA, 22 bp, Artificial Sequence
  chemically synthesized
ttttttttttttttaagctctc

SEQ ID NO: 1159791 - DNA, 22 bp, Artificial Sequence
  chemically synthesized
tcacttacttgtgagagcttaa

SEQ ID NO: 1159792 - DNA, 22 bp, Artificial Sequence
  chemically synthesized
tttttttttttttaagctctca

SEQ ID NO: 1159793 - DNA, 22 bp, Artificial Sequence
  chemically synthesized
ttttttttttttaagctctcac

SEQ ID NO: 1159794 - DNA, 22 bp, Artificial Sequence
  chemically synthesized
tttttttttttaagctctcaca

SEQ ID NO: 1159795 - DNA, 22 bp, Artificial Sequence
  chemically synthesized
ttttttttttaagctctcacaa

SEQ ID NO: 1159796 - DNA, 22 bp, Artificial Sequence
  chemically synthesized
tttttttttaagctctcacaag

SEQ ID NO: 1159797 - DNA, 22 bp, Artificial Sequence
  chemically synthesized
ttttttttaagctctcacaagt

SEQ ID NO: 1159798 - DNA, 22 bp, Artificial Sequence
  chemically synthesized
tttttttaagctctcacaagta

SEQ ID NO: 1159799 - DNA, 22 bp, Artificial Sequence
  chemically synthesized
catgttctcacttacttgtgag

SEQ ID NO: 1159800 - DNA, 22 bp, Artificial Sequence
  chemically synthesized
ttttttaagctctcacaagtaa

SEQ ID NO: 1159801 - DNA, 22 bp, Artificial Sequence
  chemically synthesized
gcatgttctcacttacttgtga

SEQ ID NO: 1159802 - DNA, 22 bp, Artificial Sequence
  chemically synthesized
tttttaagctctcacaagtaag

SEQ ID NO: 1159803 - DNA, 22 bp, Artificial Sequence
  chemically synthesized
tgcatgttctcacttacttgtg

SEQ ID NO: 1159804 - DNA, 22 bp, Artificial Sequence
  chemically synthesized
ttttaagctctcacaagtaagt

SEQ ID NO: 1159805 - DNA, 22 bp, Artificial Sequence
  chemically synthesized
tttaagctctcacaagtaagtg

SEQ ID NO: 1159806 - DNA, 22 bp, Artificial Sequence
  chemically synthesized
ttaagctctcacaagtaagtga

SEQ ID NO: 1159807 - DNA, 22 bp, Artificial Sequence
  chemically synthesized
taagctctcacaagtaagtgag

SEQ ID NO: 1159808 - DNA, 22 bp, Artificial Sequence
  chemically synthesized
aagctctcacaagtaagtgaga

SEQ ID NO: 1159809 - DNA, 22 bp, Artificial Sequence
  chemically synthesized
agctctcacaagtaagtgagaa

SEQ ID NO: 1159810 - DNA, 22 bp, Artificial Sequence
  chemically synthesized
tcacaagtaagtgagaacatgc

SEQ ID NO: 1159811 - DNA, 22 bp, Artificial Sequence
  chemically synthesized
acaagtaagtgagaacatgcaa

SEQ ID NO: 1159812 - DNA, 22 bp, Artificial Sequence
  chemically synthesized
aaataagcccggcacagaaaaa

SEQ ID NO: 1159813 - DNA, 22 bp, Artificial Sequence
  chemically synthesized
attaaaataagcccggcacaga

SEQ ID NO: 1159814 - DNA, 22 bp, Artificial Sequence
  chemically synthesized
tgttgattaaaataagcccggc

SEQ ID NO: 1159815 - DNA, 22 bp, Artificial Sequence
  chemically synthesized
gtttttctgtgccgggcttatt

SEQ ID NO: 1159816 - DNA, 22 bp, Artificial Sequence
  chemically synthesized
tttttctgtgccgggcttattt

SEQ ID NO: 1159817 - DNA, 22 bp, Artificial Sequence
  chemically synthesized
ttctgtgccgggcttattttaa

SEQ ID NO: 1159818 - DNA, 22 bp, Artificial Sequence
  chemically synthesized
tctgtgccgggcttattttaat

SEQ ID NO: 1159819 - DNA, 22 bp, Artificial Sequence
  chemically synthesized
ctgtgccgggcttattttaatc

SEQ ID NO: 1159820 - DNA, 22 bp, Artificial Sequence
  chemically synthesized
tgtgccgggcttattttaatca

SEQ ID NO: 1159821 - DNA, 22 bp, Artificial Sequence
  chemically synthesized
gaggacgttatgttgattaaaa

SEQ ID NO: 1159822 - DNA, 22 bp, Artificial Sequence
  chemically synthesized
tgccgggcttattttaatcaac

SEQ ID NO: 1159823 - DNA, 22 bp, Artificial Sequence
  chemically synthesized
attttaatcaacataacgtcct

SEQ ID NO: 1159824 - DNA, 22 bp, Artificial Sequence
  chemically synthesized
ttttaatcaacataacgtcctc

SEQ ID NO: 1159825 - DNA, 22 bp, Artificial Sequence
  chemically synthesized
taatcaacataacgtcctccag

SEQ ID NO: 1159826 - DNA, 22 bp, Artificial Sequence
  chemically synthesized
aatcaacataacgtcctccagt

SEQ ID NO: 1159827 - DNA, 22 bp, Artificial Sequence
  chemically synthesized
atcaacataacgtcctccagtt

SEQ ID NO: 1159828 - DNA, 22 bp, Artificial Sequence
  chemically synthesized
caacaacatggatggaactgga

SEQ ID NO: 1159829 - DNA, 22 bp, Artificial Sequence
  chemically synthesized
acaacaacatggatggaactgg

SEQ ID NO: 1159830 - DNA, 22 bp, Artificial Sequence
  chemically synthesized
cagttccatccatgttgttgta

SEQ ID NO: 1159831 - DNA, 22 bp, Artificial Sequence
  chemically synthesized
catccatgttgttgtaagtgac

SEQ ID NO: 1159832 - DNA, 22 bp, Artificial Sequence
  chemically synthesized
agaaagaatgagatccagtcac

SEQ ID NO: 1159833 - DNA, 22 bp, Artificial Sequence
  chemically synthesized
actaagaaagaatgagatccag

SEQ ID NO: 1159834 - DNA, 22 bp, Artificial Sequence
  chemically synthesized
gactaagaaagaatgagatcca

SEQ ID NO: 1159835 - DNA, 22 bp, Artificial Sequence
  chemically synthesized
ttgtaagtgactggatctcatt

SEQ ID NO: 1159836 - DNA, 22 bp, Artificial Sequence
  chemically synthesized
taagtgactggatctcattctt

SEQ ID NO: 1159837 - DNA, 22 bp, Artificial Sequence
  chemically synthesized
agcttgactaagaaagaatgag

SEQ ID NO: 1159838 - DNA, 22 bp, Artificial Sequence
  chemically synthesized
aagcttgactaagaaagaatga

SEQ ID NO: 1159839 - DNA, 22 bp, Artificial Sequence
  chemically synthesized
gatctcattctttcttagtcaa

SEQ ID NO: 1159840 - DNA, 22 bp, Artificial Sequence
  chemically synthesized
attctttcttagtcaagcttaa

SEQ ID NO: 1159841 - DNA, 22 bp, Artificial Sequence
  chemically synthesized
tttcttagtcaagcttaagact

SEQ ID NO: 1159842 - DNA, 22 bp, Artificial Sequence
  chemically synthesized
acaaaaatgacaagtcttaagc

SEQ ID NO: 1159843 - DNA, 22 bp, Artificial Sequence
  chemically synthesized
tcttagtcaagcttaagacttg

SEQ ID NO: 1159844 - DNA, 22 bp, Artificial Sequence
  chemically synthesized
cttagtcaagcttaagacttgt

SEQ ID NO: 1159845 - DNA, 22 bp, Artificial Sequence
  chemically synthesized
ttagtcaagcttaagacttgtc

SEQ ID NO: 1159846 - DNA, 22 bp, Artificial Sequence
  chemically synthesized
agtcaagcttaagacttgtcat

SEQ ID NO: 1159847 - DNA, 22 bp, Artificial Sequence
  chemically synthesized
gtcaagcttaagacttgtcatt

SEQ ID NO: 1159848 - DNA, 22 bp, Artificial Sequence
  chemically synthesized
aaagggttgacaaaaatgacaa

SEQ ID NO: 1159849 - DNA, 22 bp, Artificial Sequence
  chemically synthesized
gaaagggttgacaaaaatgaca

SEQ ID NO: 1159850 - DNA, 22 bp, Artificial Sequence
  chemically synthesized
tgaaagggttgacaaaaatgac

SEQ ID NO: 1159851 - DNA, 22 bp, Artificial Sequence
  chemically synthesized
ttgaaagggttgacaaaaatga

SEQ ID NO: 1159852 - DNA, 22 bp, Artificial Sequence
  chemically synthesized
tttgaaagggttgacaaaaatg

SEQ ID NO: 1159853 - DNA, 22 bp, Artificial Sequence
  chemically synthesized
ttttgaaagggttgacaaaaat

SEQ ID NO: 1159854 - DNA, 22 bp, Artificial Sequence
  chemically synthesized
aagacttgtcatttttgtcaac

SEQ ID NO: 1159855 - DNA, 22 bp, Artificial Sequence
  chemically synthesized
agacttgtcatttttgtcaacc

SEQ ID NO: 1159856 - DNA, 22 bp, Artificial Sequence
  chemically synthesized
gtcatttttgtcaaccctttca

SEQ ID NO: 1159857 - DNA, 22 bp, Artificial Sequence
  chemically synthesized
tcatttttgtcaaccctttcaa

SEQ ID NO: 1159858 - DNA, 22 bp, Artificial Sequence
  chemically synthesized
ttgtcaaccctttcaaaaaaac

SEQ ID NO: 1159859 - DNA, 22 bp, Artificial Sequence
  chemically synthesized
tgtcaaccctttcaaaaaaacc

SEQ ID NO: 1159860 - DNA, 22 bp, Artificial Sequence
  chemically synthesized
gtcaaccctttcaaaaaaacct

SEQ ID NO: 1159861 - DNA, 22 bp, Artificial Sequence
  chemically synthesized
tcaaccctttcaaaaaaacctt

SEQ ID NO: 1159862 - DNA, 22 bp, Artificial Sequence
  chemically synthesized
tcaaaaaaaccttctttttgtt

SEQ ID NO: 1159863 - DNA, 22 bp, Artificial Sequence
  chemically synthesized
caaaaaaaccttctttttgttt

SEQ ID NO: 1159864 - DNA, 22 bp, Artificial Sequence
  chemically synthesized
aaaaaaaccttctttttgtttt

SEQ ID NO: 1159865 - DNA, 22 bp, Artificial Sequence
  chemically synthesized
ctttttgttttgttgatctttt

SEQ ID NO: 1159866 - DNA, 22 bp, Artificial Sequence
  chemically synthesized
tttttgttttgttgatcttttg

SEQ ID NO: 1159867 - DNA, 22 bp, Artificial Sequence
  chemically synthesized
tttgttttgttgatcttttgta

SEQ ID NO: 1159868 - DNA, 22 bp, Artificial Sequence
  chemically synthesized
ttgttttgttgatcttttgtat

SEQ ID NO: 1159869 - DNA, 22 bp, Artificial Sequence
  chemically synthesized
tgttttgttgatcttttgtatc

SEQ ID NO: 1159870 - DNA, 22 bp, Artificial Sequence
  chemically synthesized
gttttgttgatcttttgtatca

SEQ ID NO: 1159871 - DNA, 22 bp, Artificial Sequence
  chemically synthesized
ttttgttgatcttttgtatcat

SEQ ID NO: 1159872 - DNA, 22 bp, Artificial Sequence
  chemically synthesized
aagtacaacaaaatgatacaaa

SEQ ID NO: 1159873 - DNA, 22 bp, Artificial Sequence
  chemically synthesized
tgttgatcttttgtatcatttt

SEQ ID NO: 1159874 - DNA, 22 bp, Artificial Sequence
  chemically synthesized
gttgatcttttgtatcattttg

SEQ ID NO: 1159875 - DNA, 22 bp, Artificial Sequence
  chemically synthesized
ttgatcttttgtatcattttgt

SEQ ID NO: 1159876 - DNA, 22 bp, Artificial Sequence
  chemically synthesized
atcttttgtatcattttgttgt

SEQ ID NO: 1159877 - DNA, 22 bp, Artificial Sequence
  chemically synthesized
aaatacattaaagtacaacaaa

SEQ ID NO: 1159878 - DNA, 22 bp, Artificial Sequence
  chemically synthesized
ttgtatcattttgttgtacttt

SEQ ID NO: 1159879 - DNA, 22 bp, Artificial Sequence
  chemically synthesized
tgtatcattttgttgtacttta

SEQ ID NO: 1159880 - DNA, 22 bp, Artificial Sequence
  chemically synthesized
gtatcattttgttgtactttaa

SEQ ID NO: 1159881 - DNA, 22 bp, Artificial Sequence
  chemically synthesized
tatcattttgttgtactttaat

SEQ ID NO: 1159882 - DNA, 22 bp, Artificial Sequence
  chemically synthesized
tgttgtactttaatgtatttca

SEQ ID NO: 1159883 - DNA, 22 bp, Artificial Sequence
  chemically synthesized
gttgtactttaatgtatttcag

SEQ ID NO: 1159884 - DNA, 22 bp, Artificial Sequence
  chemically synthesized
ttgtactttaatgtatttcagc

SEQ ID NO: 1159885 - DNA, 22 bp, Artificial Sequence
  chemically synthesized
cagtaaggaacagagctgaaat

SEQ ID NO: 1159886 - DNA, 22 bp, Artificial Sequence
  chemically synthesized
tactttaatgtatttcagctct

SEQ ID NO: 1159887 - DNA, 22 bp, Artificial Sequence
  chemically synthesized
taatgtatttcagctctgttcc

SEQ ID NO: 1159888 - DNA, 22 bp, Artificial Sequence
  chemically synthesized
aatgtatttcagctctgttcct

SEQ ID NO: 1159889 - DNA, 22 bp, Artificial Sequence
  chemically synthesized
atgtatttcagctctgttcctt

SEQ ID NO: 1159890 - DNA, 22 bp, Artificial Sequence
  chemically synthesized
cagctctgttccttactgtaat

SEQ ID NO: 1159891 - DNA, 22 bp, Artificial Sequence
  chemically synthesized
agctctgttccttactgtaata

SEQ ID NO: 1159892 - DNA, 22 bp, Artificial Sequence
  chemically synthesized
gtatgagaaaataaatattaca

SEQ ID NO: 1159893 - DNA, 22 bp, Artificial Sequence
  chemically synthesized
tgttccttactgtaatatttat

SEQ ID NO: 1159894 - DNA, 22 bp, Artificial Sequence
  chemically synthesized
ttccttactgtaatatttattt

SEQ ID NO: 1159895 - DNA, 22 bp, Artificial Sequence
  chemically synthesized
cttactgtaatatttattttct

SEQ ID NO: 1159896 - DNA, 22 bp, Artificial Sequence
  chemically synthesized
actgtaatatttattttctcat

SEQ ID NO: 1159897 - DNA, 22 bp, Artificial Sequence
  chemically synthesized
ctgtaatatttattttctcata

SEQ ID NO: 1159898 - DNA, 22 bp, Artificial Sequence
  chemically synthesized
taatatttattttctcatacta

SEQ ID NO: 1159899 - DNA, 22 bp, Artificial Sequence
  chemically synthesized
attttctcatactaattttggg

SEQ ID NO: 1159900 - DNA, 22 bp, Artificial Sequence
  chemically synthesized
ttttctcatactaattttgggt

SEQ ID NO: 1159901 - DNA, 22 bp, Artificial Sequence
  chemically synthesized
tctcatactaattttgggtttg

SEQ ID NO: 1159902 - DNA, 22 bp, Artificial Sequence
  chemically synthesized
ctcatactaattttgggtttgg

SEQ ID NO: 1159903 - DNA, 22 bp, Artificial Sequence
  chemically synthesized
tcatactaattttgggtttggt

SEQ ID NO: 1159904 - DNA, 22 bp, Artificial Sequence
  chemically synthesized
atactaattttgggtttggttt

SEQ ID NO: 1159905 - DNA, 22 bp, Artificial Sequence
  chemically synthesized
gaaaagaaggagcaaaccaaac

SEQ ID NO: 1159906 - DNA, 22 bp, Artificial Sequence
  chemically synthesized
attttgggtttggtttgctcct

SEQ ID NO: 1159907 - DNA, 22 bp, Artificial Sequence
  chemically synthesized
aagagctagaaaagaaggagca

SEQ ID NO: 1159908 - DNA, 22 bp, Artificial Sequence
  chemically synthesized
tgggtttggtttgctccttctt

SEQ ID NO: 1159909 - DNA, 22 bp, Artificial Sequence
  chemically synthesized
aaagagctagaaaagaaggagc

SEQ ID NO: 1159910 - DNA, 22 bp, Artificial Sequence
  chemically synthesized
gggtttggtttgctccttcttt

SEQ ID NO: 1159911 - DNA, 22 bp, Artificial Sequence
  chemically synthesized
ggtttggtttgctccttctttt

SEQ ID NO: 1159912 - DNA, 22 bp, Artificial Sequence
  chemically synthesized
ggtttgctccttcttttctagc

SEQ ID NO: 1159913 - DNA, 22 bp, Artificial Sequence
  chemically synthesized
gtttgctccttcttttctagct

SEQ ID NO: 1159914 - DNA, 22 bp, Artificial Sequence
  chemically synthesized
gctccttcttttctagctcttt

SEQ ID NO: 1159915 - DNA, 22 bp, Artificial Sequence
  chemically synthesized
ctccttcttttctagctcttta

SEQ ID NO: 1159916 - DNA, 22 bp, Artificial Sequence
  chemically synthesized
aatgatacaccttaaagagcta

SEQ ID NO: 1159917 - DNA, 22 bp, Artificial Sequence
  chemically synthesized
cttcttttctagctctttaagg

SEQ ID NO: 1159918 - DNA, 22 bp, Artificial Sequence
  chemically synthesized
cttttctagctctttaaggtgt

SEQ ID NO: 1159919 - DNA, 22 bp, Artificial Sequence
  chemically synthesized
ttttctagctctttaaggtgta

SEQ ID NO: 1159920 - DNA, 22 bp, Artificial Sequence
  chemically synthesized
ttctagctctttaaggtgtatc

SEQ ID NO: 1159921 - DNA, 22 bp, Artificial Sequence
  chemically synthesized
aaataattgaatgatacacctt

SEQ ID NO: 1159922 - DNA, 22 bp, Artificial Sequence
  chemically synthesized
tctagctctttaaggtgtatca

SEQ ID NO: 1159923 - DNA, 22 bp, Artificial Sequence
  chemically synthesized
caaataattgaatgatacacct

SEQ ID NO: 1159924 - DNA, 22 bp, Artificial Sequence
  chemically synthesized
ctagctctttaaggtgtatcat

SEQ ID NO: 1159925 - DNA, 22 bp, Artificial Sequence
  chemically synthesized
tcaaataattgaatgatacacc

SEQ ID NO: 1159926 - DNA, 22 bp, Artificial Sequence
  chemically synthesized
tagctctttaaggtgtatcatt

SEQ ID NO: 1159927 - DNA, 22 bp, Artificial Sequence
  chemically synthesized
gctctttaaggtgtatcattca

SEQ ID NO: 1159928 - DNA, 22 bp, Artificial Sequence
  chemically synthesized
tttaaggtgtatcattcaatta

SEQ ID NO: 1159929 - DNA, 22 bp, Artificial Sequence
  chemically synthesized
taaggtgtatcattcaattatt

SEQ ID NO: 1159930 - DNA, 22 bp, Artificial Sequence
  chemically synthesized
aaggtgtatcattcaattattt

SEQ ID NO: 1159931 - DNA, 22 bp, Artificial Sequence
  chemically synthesized
aggtgtatcattcaattatttg

SEQ ID NO: 1159932 - DNA, 22 bp, Artificial Sequence
  chemically synthesized
catcaaaaaagcagaagaactt

SEQ ID NO: 1159933 - DNA, 22 bp, Artificial Sequence
  chemically synthesized
aattatttgaaagttcttctgc

SEQ ID NO: 1159934 - DNA, 22 bp, Artificial Sequence
  chemically synthesized
tttgaaagttcttctgcttttt

SEQ ID NO: 1159935 - DNA, 22 bp, Artificial Sequence
  chemically synthesized
gaaagttcttctgcttttttga

SEQ ID NO: 1159936 - DNA, 22 bp, Artificial Sequence
  chemically synthesized
aaagttcttctgcttttttgat

SEQ ID NO: 1159937 - DNA, 22 bp, Artificial Sequence
  chemically synthesized
taggtataaatacctacatcaa

SEQ ID NO: 1159938 - DNA, 22 bp, Artificial Sequence
  chemically synthesized
ataggtataaatacctacatca

SEQ ID NO: 1159939 - DNA, 22 bp, Artificial Sequence
  chemically synthesized
ttctgcttttttgatgtaggta

SEQ ID NO: 1159940 - DNA, 22 bp, Artificial Sequence
  chemically synthesized
ctgcttttttgatgtaggtatt

SEQ ID NO: 1159941 - DNA, 22 bp, Artificial Sequence
  chemically synthesized
tgcttttttgatgtaggtattt

SEQ ID NO: 1159942 - DNA, 22 bp, Artificial Sequence
  chemically synthesized
cttttttgatgtaggtatttat

SEQ ID NO: 1159943 - DNA, 22 bp, Artificial Sequence
  chemically synthesized
ttttgatgtaggtatttatacc

SEQ ID NO: 1159944 - DNA, 22 bp, Artificial Sequence
  chemically synthesized
tttgatgtaggtatttatacct

SEQ ID NO: 1159945 - DNA, 22 bp, Artificial Sequence
  chemically synthesized
ttgatgtaggtatttataccta

SEQ ID NO: 1159946 - DNA, 22 bp, Artificial Sequence
  chemically synthesized
tgatgtaggtatttatacctat

SEQ ID NO: 1159947 - DNA, 22 bp, Artificial Sequence
  chemically synthesized
tgaggaaagtttataggtataa

SEQ ID NO: 1159948 - DNA, 22 bp, Artificial Sequence
  chemically synthesized
gatgtaggtatttatacctata

SEQ ID NO: 1159949 - DNA, 22 bp, Artificial Sequence
  chemically synthesized
atgtaggtatttatacctataa

SEQ ID NO: 1159950 - DNA, 22 bp, Artificial Sequence
  chemically synthesized
atacctataaactttcctcata

SEQ ID NO: 1159951 - DNA, 22 bp, Artificial Sequence
  chemically synthesized
tacctataaactttcctcatag

SEQ ID NO: 1159952 - DNA, 22 bp, Artificial Sequence
  chemically synthesized
taaactttcctcatagtactgc

SEQ ID NO: 1159953 - DNA, 22 bp, Artificial Sequence
  chemically synthesized
tgggaagcagtgaaagcagtac

SEQ ID NO: 1159954 - DNA, 22 bp, Artificial Sequence
  chemically synthesized
tcctcatagtactgctttcact

SEQ ID NO: 1159955 - DNA, 22 bp, Artificial Sequence
  chemically synthesized
cctcatagtactgctttcactg

SEQ ID NO: 1159956 - DNA, 22 bp, Artificial Sequence
  chemically synthesized
ctcatagtactgctttcactgc

SEQ ID NO: 1159957 - DNA, 22 bp, Artificial Sequence
  chemically synthesized
atagtactgctttcactgcttc

SEQ ID NO: 1159958 - DNA, 22 bp, Artificial Sequence
  chemically synthesized
ctttcactgcttcccataggtt

SEQ ID NO: 1159959 - DNA, 22 bp, Artificial Sequence
  chemically synthesized
tcactgcttcccataggttttg

SEQ ID NO: 1159960 - DNA, 22 bp, Artificial Sequence
  chemically synthesized
cactgcttcccataggttttgg

SEQ ID NO: 1159961 - DNA, 22 bp, Artificial Sequence
  chemically synthesized
actgcttcccataggttttggt

SEQ ID NO: 1159962 - DNA, 22 bp, Artificial Sequence
  chemically synthesized
cttcccataggttttggttaca

SEQ ID NO: 1159963 - DNA, 22 bp, Artificial Sequence
  chemically synthesized
cccataggttttggttacattg

SEQ ID NO: 1159964 - DNA, 22 bp, Artificial Sequence
  chemically synthesized
ccataggttttggttacattgc

SEQ ID NO: 1159965 - DNA, 22 bp, Artificial Sequence
  chemically synthesized
aaacgaatgaaaaaggaaacgc

SEQ ID NO: 1159966 - DNA, 22 bp, Artificial Sequence
  chemically synthesized
gaaacgaatgaaaaaggaaacg

SEQ ID NO: 1159967 - DNA, 22 bp, Artificial Sequence
  chemically synthesized
tggttacattgcgtttcctttt

SEQ ID NO: 1159968 - DNA, 22 bp, Artificial Sequence
  chemically synthesized
ggttacattgcgtttccttttt

SEQ ID NO: 1159969 - DNA, 22 bp, Artificial Sequence
  chemically synthesized
ttgaaacgaatgaaaaaggaaa

SEQ ID NO: 1159970 - DNA, 22 bp, Artificial Sequence
  chemically synthesized
gttacattgcgtttcctttttc

SEQ ID NO: 1159971 - DNA, 22 bp, Artificial Sequence
  chemically synthesized
cttgaaacgaatgaaaaaggaa

SEQ ID NO: 1159972 - DNA, 22 bp, Artificial Sequence
  chemically synthesized
cattgcgtttcctttttcattc

SEQ ID NO: 1159973 - DNA, 22 bp, Artificial Sequence
  chemically synthesized
tagaatttcttgaaacgaatga

SEQ ID NO: 1159974 - DNA, 22 bp, Artificial Sequence
  chemically synthesized
cgtttcctttttcattcgtttc

SEQ ID NO: 1159975 - DNA, 22 bp, Artificial Sequence
  chemically synthesized
cctttttcattcgtttcaagaa

SEQ ID NO: 1159976 - DNA, 22 bp, Artificial Sequence
  chemically synthesized
ctttttcattcgtttcaagaaa

SEQ ID NO: 1159977 - DNA, 22 bp, Artificial Sequence
  chemically synthesized
tttcattcgtttcaagaaattc

SEQ ID NO: 1159978 - DNA, 22 bp, Artificial Sequence
  chemically synthesized
ttcattcgtttcaagaaattct

SEQ ID NO: 1159979 - DNA, 22 bp, Artificial Sequence
  chemically synthesized
tcattcgtttcaagaaattcta

SEQ ID NO: 1159980 - DNA, 22 bp, Artificial Sequence
  chemically synthesized
agaaggaaactatagaatttct

SEQ ID NO: 1159981 - DNA, 22 bp, Artificial Sequence
  chemically synthesized
cattcgtttcaagaaattctat

SEQ ID NO: 1159982 - DNA, 22 bp, Artificial Sequence
  chemically synthesized
attcgtttcaagaaattctata

SEQ ID NO: 1159983 - DNA, 22 bp, Artificial Sequence
  chemically synthesized
gtttcaagaaattctatagttt

SEQ ID NO: 1159984 - DNA, 22 bp, Artificial Sequence
  chemically synthesized
caagaaattctatagtttcctt

SEQ ID NO: 1159985 - DNA, 22 bp, Artificial Sequence
  chemically synthesized
aagaaattctatagtttccttc

SEQ ID NO: 1159986 - DNA, 22 bp, Artificial Sequence
  chemically synthesized
tatagtttccttcttaacttct

SEQ ID NO: 1159987 - DNA, 22 bp, Artificial Sequence
  chemically synthesized
tagtttccttcttaacttcttc

SEQ ID NO: 1159988 - DNA, 22 bp, Artificial Sequence
  chemically synthesized
tcagtgggtcaaagaagaagtt

SEQ ID NO: 1159989 - DNA, 22 bp, Artificial Sequence
  chemically synthesized
ccttcttaacttcttctttgac

SEQ ID NO: 1159990 - DNA, 22 bp, Artificial Sequence
  chemically synthesized
aattatcagtgggtcaaagaag

SEQ ID NO: 1159991 - DNA, 22 bp, Artificial Sequence
  chemically synthesized
cttcttaacttcttctttgacc

SEQ ID NO: 1159992 - DNA, 22 bp, Artificial Sequence
  chemically synthesized
gaattatcagtgggtcaaagaa

SEQ ID NO: 1159993 - DNA, 22 bp, Artificial Sequence
  chemically synthesized
ttgaattatcagtgggtcaaag

SEQ ID NO: 1159994 - DNA, 22 bp, Artificial Sequence
  chemically synthesized
cttaacttcttctttgacccac

SEQ ID NO: 1159995 - DNA, 22 bp, Artificial Sequence
  chemically synthesized
ttaacttcttctttgacccact

SEQ ID NO: 1159996 - DNA, 22 bp, Artificial Sequence
  chemically synthesized
aacttcttctttgacccactga

SEQ ID NO: 1159997 - DNA, 22 bp, Artificial Sequence
  chemically synthesized
acttcttctttgacccactgat

SEQ ID NO: 1159998 - DNA, 22 bp, Artificial Sequence
  chemically synthesized
cttctttgacccactgataatt

SEQ ID NO: 1159999 - DNA, 22 bp, Artificial Sequence
  chemically synthesized
ttctttgacccactgataattc

SEQ ID NO: 1160000 - DNA, 22 bp, Artificial Sequence
  chemically synthesized
ctttgacccactgataattcaa

SEQ ID NO: 1160001 - DNA, 22 bp, Artificial Sequence
  chemically synthesized
aacaatatgctcttgaattatc

SEQ ID NO: 1160002 - DNA, 22 bp, Artificial Sequence
  chemically synthesized
tttgacccactgataattcaag

SEQ ID NO: 1160003 - DNA, 22 bp, Artificial Sequence
  chemically synthesized
tgacccactgataattcaagag

SEQ ID NO: 1160004 - DNA, 22 bp, Artificial Sequence
  chemically synthesized
gacccactgataattcaagagc

SEQ ID NO: 1160005 - DNA, 22 bp, Artificial Sequence
  chemically synthesized
acccactgataattcaagagca

SEQ ID NO: 1160006 - DNA, 22 bp, Artificial Sequence
  chemically synthesized
ataattcaagagcatattgttt

SEQ ID NO: 1160007 - DNA, 22 bp, Artificial Sequence
  chemically synthesized
tagagacacatggaaattaaac

SEQ ID NO: 1160008 - DNA, 22 bp, Artificial Sequence
  chemically synthesized
aagagcatattgtttaatttcc

SEQ ID NO: 1160009 - DNA, 22 bp, Artificial Sequence
  chemically synthesized
gaaactatagagacacatggaa

SEQ ID NO: 1160010 - DNA, 22 bp, Artificial Sequence
  chemically synthesized
ggaaactatagagacacatgga

SEQ ID NO: 1160011 - DNA, 22 bp, Artificial Sequence
  chemically synthesized
tggaaactatagagacacatgg

SEQ ID NO: 1160012 - DNA, 22 bp, Artificial Sequence
  chemically synthesized
tttaatttccatgtgtctctat

SEQ ID NO: 1160013 - DNA, 22 bp, Artificial Sequence
  chemically synthesized
aatttccatgtgtctctatagt

SEQ ID NO: 1160014 - DNA, 22 bp, Artificial Sequence
  chemically synthesized
atttccatgtgtctctatagtt

SEQ ID NO: 1160015 - DNA, 22 bp, Artificial Sequence
  chemically synthesized
ccatgtgtctctatagtttcca

SEQ ID NO: 1160016 - DNA, 22 bp, Artificial Sequence
  chemically synthesized
catgtgtctctatagtttccaa

SEQ ID NO: 1160017 - DNA, 22 bp, Artificial Sequence
  chemically synthesized
tatagtttccaaaattcttcct

SEQ ID NO: 1160018 - DNA, 22 bp, Artificial Sequence
  chemically synthesized
tagtttccaaaattcttcctac

SEQ ID NO: 1160019 - DNA, 22 bp, Artificial Sequence
  chemically synthesized
aatatatcaagatatcagtagg

SEQ ID NO: 1160020 - DNA, 22 bp, Artificial Sequence
  chemically synthesized
ccaaaattcttcctactgatat

SEQ ID NO: 1160021 - DNA, 22 bp, Artificial Sequence
  chemically synthesized
caaaattcttcctactgatatc

SEQ ID NO: 1160022 - DNA, 22 bp, Artificial Sequence
  chemically synthesized
ttcctactgatatcttgatata

SEQ ID NO: 1160023 - DNA, 22 bp, Artificial Sequence
  chemically synthesized
atcacaactgaatatatcaaga

SEQ ID NO: 1160024 - DNA, 22 bp, Artificial Sequence
  chemically synthesized
cctactgatatcttgatatatt

SEQ ID NO: 1160025 - DNA, 22 bp, Artificial Sequence
  chemically synthesized
tgatcacaactgaatatatcaa

SEQ ID NO: 1160026 - DNA, 22 bp, Artificial Sequence
  chemically synthesized
ctactgatatcttgatatattc

SEQ ID NO: 1160027 - DNA, 22 bp, Artificial Sequence
  chemically synthesized
ctgatcacaactgaatatatca

SEQ ID NO: 1160028 - DNA, 22 bp, Artificial Sequence
  chemically synthesized
tctgatcacaactgaatatatc

SEQ ID NO: 1160029 - DNA, 22 bp, Artificial Sequence
  chemically synthesized
ttctgatcacaactgaatatat

SEQ ID NO: 1160030 - DNA, 22 bp, Artificial Sequence
  chemically synthesized
ctgatatcttgatatattcagt

SEQ ID NO: 1160031 - DNA, 22 bp, Artificial Sequence
  chemically synthesized
atatcttgatatattcagttgt

SEQ ID NO: 1160032 - DNA, 22 bp, Artificial Sequence
  chemically synthesized
gcttttctgatcacaactgaat

SEQ ID NO: 1160033 - DNA, 22 bp, Artificial Sequence
  chemically synthesized
gatatattcagttgtgatcaga

SEQ ID NO: 1160034 - DNA, 22 bp, Artificial Sequence
  chemically synthesized
atatattcagttgtgatcagaa

SEQ ID NO: 1160035 - DNA, 22 bp, Artificial Sequence
  chemically synthesized
agttgtgatcagaaaagctaat

SEQ ID NO: 1160036 - DNA, 22 bp, Artificial Sequence
  chemically synthesized
tgatcagaaaagctaatttatg

SEQ ID NO: 1160037 - DNA, 22 bp, Artificial Sequence
  chemically synthesized
aaaaatcaaaataacataaatt

SEQ ID NO: 1160038 - DNA, 22 bp, Artificial Sequence
  chemically synthesized
gaaaattcaaaaatcaaaataa

SEQ ID NO: 1160039 - DNA, 22 bp, Artificial Sequence
  chemically synthesized
agaaaattcaaaaatcaaaata

SEQ ID NO: 1160040 - DNA, 22 bp, Artificial Sequence
  chemically synthesized
atttatgttattttgatttttg

SEQ ID NO: 1160041 - DNA, 22 bp, Artificial Sequence
  chemically synthesized
atgttattttgatttttgaatt

SEQ ID NO: 1160042 - DNA, 22 bp, Artificial Sequence
  chemically synthesized
tgttattttgatttttgaattt

SEQ ID NO: 1160043 - DNA, 22 bp, Artificial Sequence
  chemically synthesized
ttttgatttttgaattttctaa

SEQ ID NO: 1160044 - DNA, 22 bp, Artificial Sequence
  chemically synthesized
ccacgaaacaagtcttagaaaa

SEQ ID NO: 1160045 - DNA, 22 bp, Artificial Sequence
  chemically synthesized
tgatttttgaattttctaagac

SEQ ID NO: 1160046 - DNA, 22 bp, Artificial Sequence
  chemically synthesized
gatttttgaattttctaagact

SEQ ID NO: 1160047 - DNA, 22 bp, Artificial Sequence
  chemically synthesized
tgccacgaaacaagtcttagaa

SEQ ID NO: 1160048 - DNA, 22 bp, Artificial Sequence
  chemically synthesized
atttttgaattttctaagactt

SEQ ID NO: 1160049 - DNA, 22 bp, Artificial Sequence
  chemically synthesized
ttgaattttctaagacttgttt

SEQ ID NO: 1160050 - DNA, 22 bp, Artificial Sequence
  chemically synthesized
tgaattttctaagacttgtttc

SEQ ID NO: 1160051 - DNA, 22 bp, Artificial Sequence
  chemically synthesized
gaattttctaagacttgtttcg

SEQ ID NO: 1160052 - DNA, 22 bp, Artificial Sequence
  chemically synthesized
aattttctaagacttgtttcgt

SEQ ID NO: 1160053 - DNA, 22 bp, Artificial Sequence
  chemically synthesized
tctaagacttgtttcgtggcag

SEQ ID NO: 1160054 - DNA, 22 bp, Artificial Sequence
  chemically synthesized
ctaagacttgtttcgtggcaga

SEQ ID NO: 1160055 - DNA, 22 bp, Artificial Sequence
  chemically synthesized
taagacttgtttcgtggcagaa

SEQ ID NO: 1160056 - DNA, 22 bp, Artificial Sequence
  chemically synthesized
agacttgtttcgtggcagaaca

SEQ ID NO: 1160057 - DNA, 22 bp, Artificial Sequence
  chemically synthesized
aaggacaagccatatgttctgc

SEQ ID NO: 1160058 - DNA, 22 bp, Artificial Sequence
  chemically synthesized
caaggacaagccatatgttctg

SEQ ID NO: 1160059 - DNA, 22 bp, Artificial Sequence
  chemically synthesized
tcaaggacaagccatatgttct

SEQ ID NO: 1160060 - DNA, 22 bp, Artificial Sequence
  chemically synthesized
gtttcgtggcagaacatatggc

SEQ ID NO: 1160061 - DNA, 22 bp, Artificial Sequence
  chemically synthesized
tttcgtggcagaacatatggct

SEQ ID NO: 1160062 - DNA, 22 bp, Artificial Sequence
  chemically synthesized
cgtggcagaacatatggcttgt

SEQ ID NO: 1160063 - DNA, 22 bp, Artificial Sequence
  chemically synthesized
gtggcagaacatatggcttgtc

SEQ ID NO: 1160064 - DNA, 22 bp, Artificial Sequence
  chemically synthesized
agcacatggataattttcaagg

SEQ ID NO: 1160065 - DNA, 22 bp, Artificial Sequence
  chemically synthesized
tcagcacatggataattttcaa

SEQ ID NO: 1160066 - DNA, 22 bp, Artificial Sequence
  chemically synthesized
ctcagcacatggataattttca

SEQ ID NO: 1160067 - DNA, 22 bp, Artificial Sequence
  chemically synthesized
ttctcagcacatggataatttt

SEQ ID NO: 1160068 - DNA, 22 bp, Artificial Sequence
  chemically synthesized
cttctcagcacatggataattt

SEQ ID NO: 1160069 - DNA, 22 bp, Artificial Sequence
  chemically synthesized
ttcttctcagcacatggataat

SEQ ID NO: 1160070 - DNA, 22 bp, Artificial Sequence
  chemically synthesized
gtccttgaaaattatccatgtg

SEQ ID NO: 1160071 - DNA, 22 bp, Artificial Sequence
  chemically synthesized
tccttgaaaattatccatgtgc

SEQ ID NO: 1160072 - DNA, 22 bp, Artificial Sequence
  chemically synthesized
gaaaattatccatgtgctgaga

SEQ ID NO: 1160073 - DNA, 22 bp, Artificial Sequence
  chemically synthesized
aaaattatccatgtgctgagaa

SEQ ID NO: 1160074 - DNA, 22 bp, Artificial Sequence
  chemically synthesized
cagagtacatattcttcttctc

SEQ ID NO: 1160075 - DNA, 22 bp, Artificial Sequence
  chemically synthesized
tccatgtgctgagaagaagaat

SEQ ID NO: 1160076 - DNA, 22 bp, Artificial Sequence
  chemically synthesized
tccaacagctgcagagtacata

SEQ ID NO: 1160077 - DNA, 22 bp, Artificial Sequence
  chemically synthesized
atccaacagctgcagagtacat

SEQ ID NO: 1160078 - DNA, 22 bp, Artificial Sequence
  chemically synthesized
agaagaagaatatgtactctgc

SEQ ID NO: 1160079 - DNA, 22 bp, Artificial Sequence
  chemically synthesized
tatccaacagctgcagagtaca

SEQ ID NO: 1160080 - DNA, 22 bp, Artificial Sequence
  chemically synthesized
cagaacattttatccaacagct

SEQ ID NO: 1160081 - DNA, 22 bp, Artificial Sequence
  chemically synthesized
acagaacattttatccaacagc

SEQ ID NO: 1160082 - DNA, 22 bp, Artificial Sequence
  chemically synthesized
tgcagctgttggataaaatgtt

SEQ ID NO: 1160083 - DNA, 22 bp, Artificial Sequence
  chemically synthesized
cagctgttggataaaatgttct

SEQ ID NO: 1160084 - DNA, 22 bp, Artificial Sequence
  chemically synthesized
atagatatttacagaacatttt

SEQ ID NO: 1160085 - DNA, 22 bp, Artificial Sequence
  chemically synthesized
aactaatagatatttacagaac

SEQ ID NO: 1160086 - DNA, 22 bp, Artificial Sequence
  chemically synthesized
ttggataaaatgttctgtaaat

SEQ ID NO: 1160087 - DNA, 22 bp, Artificial Sequence
  chemically synthesized
gaactaatagatatttacagaa

SEQ ID NO: 1160088 - DNA, 22 bp, Artificial Sequence
  chemically synthesized
gataaaatgttctgtaaatatc

SEQ ID NO: 1160089 - DNA, 22 bp, Artificial Sequence
  chemically synthesized
tgtaaatatctattagttcaaa

SEQ ID NO: 1160090 - DNA, 22 bp, Artificial Sequence
  chemically synthesized
taaatatctattagttcaaatt

SEQ ID NO: 1160091 - DNA, 22 bp, Artificial Sequence
  chemically synthesized
tgcagtgtagaccaatttgaac

SEQ ID NO: 1160092 - DNA, 22 bp, Artificial Sequence
  chemically synthesized
ttatgcagtgtagaccaatttg

SEQ ID NO: 1160093 - DNA, 22 bp, Artificial Sequence
  chemically synthesized
attatgcagtgtagaccaattt

SEQ ID NO: 1160094 - DNA, 22 bp, Artificial Sequence
  chemically synthesized
ttagttcaaattggtctacact

SEQ ID NO: 1160095 - DNA, 22 bp, Artificial Sequence
  chemically synthesized
gttcaaattggtctacactgca

SEQ ID NO: 1160096 - DNA, 22 bp, Artificial Sequence
  chemically synthesized
aaattggtctacactgcataat

SEQ ID NO: 1160097 - DNA, 22 bp, Artificial Sequence
  chemically synthesized
gtctacactgcataataagtct

SEQ ID NO: 1160098 - DNA, 22 bp, Artificial Sequence
  chemically synthesized
cactgcataataagtctgatgt

SEQ ID NO: 1160099 - DNA, 22 bp, Artificial Sequence
  chemically synthesized
cataataagtctgatgtttctt

SEQ ID NO: 1160100 - DNA, 22 bp, Artificial Sequence
  chemically synthesized
atgtttctttgttgattttatg

SEQ ID NO: 1160101 - DNA, 22 bp, Artificial Sequence
  chemically synthesized
ctttgttgattttatgtctgga

SEQ ID NO: 1160102 - DNA, 22 bp, Artificial Sequence
  chemically synthesized
tttgttgattttatgtctggat

SEQ ID NO: 1160103 - DNA, 22 bp, Artificial Sequence
  chemically synthesized
tgttgattttatgtctggatga

SEQ ID NO: 1160104 - DNA, 22 bp, Artificial Sequence
  chemically synthesized
gttgattttatgtctggatgat

SEQ ID NO: 1160105 - DNA, 22 bp, Artificial Sequence
  chemically synthesized
ttgattttatgtctggatgatc

SEQ ID NO: 1160106 - DNA, 22 bp, Artificial Sequence
  chemically synthesized
attttatgtctggatgatctat

SEQ ID NO: 1160107 - DNA, 22 bp, Artificial Sequence
  chemically synthesized
agcagtggccagatagatcatc

SEQ ID NO: 1160108 - DNA, 22 bp, Artificial Sequence
  chemically synthesized
cagcagtggccagatagatcat

SEQ ID NO: 1160109 - DNA, 22 bp, Artificial Sequence
  chemically synthesized
tcagcagtggccagatagatca

SEQ ID NO: 1160110 - DNA, 22 bp, Artificial Sequence
  chemically synthesized
tatgtctggatgatctatctgg

SEQ ID NO: 1160111 - DNA, 22 bp, Artificial Sequence
  chemically synthesized
atgtctggatgatctatctggc

SEQ ID NO: 1160112 - DNA, 22 bp, Artificial Sequence
  chemically synthesized
tgtctggatgatctatctggcc

SEQ ID NO: 1160113 - DNA, 22 bp, Artificial Sequence
  chemically synthesized
cccattttcagcagtggccaga

SEQ ID NO: 1160114 - DNA, 22 bp, Artificial Sequence
  chemically synthesized
gatgatctatctggccactgct

SEQ ID NO: 1160115 - DNA, 22 bp, Artificial Sequence
  chemically synthesized
aattccccattttcagcagtgg

SEQ ID NO: 1160116 - DNA, 22 bp, Artificial Sequence
  chemically synthesized
caattccccattttcagcagtg

SEQ ID NO: 1160117 - DNA, 22 bp, Artificial Sequence
  chemically synthesized
tctggccactgctgaaaatggg

SEQ ID NO: 1160118 - DNA, 22 bp, Artificial Sequence
  chemically synthesized
gccactgctgaaaatggggaat

SEQ ID NO: 1160119 - DNA, 22 bp, Artificial Sequence
  chemically synthesized
ctgaaaatggggaattgaaatc

SEQ ID NO: 1160120 - DNA, 22 bp, Artificial Sequence
  chemically synthesized
aaaatggggaattgaaatcacc

SEQ ID NO: 1160121 - DNA, 22 bp, Artificial Sequence
  chemically synthesized
aaatcaccggctattactgttt

SEQ ID NO: 1160122 - DNA, 22 bp, Artificial Sequence
  chemically synthesized
gagagatagaccccaaaacagt

SEQ ID NO: 1160123 - DNA, 22 bp, Artificial Sequence
  chemically synthesized
gagttagagagatagaccccaa

SEQ ID NO: 1160124 - DNA, 22 bp, Artificial Sequence
  chemically synthesized
ttagagttagagagatagaccc

SEQ ID NO: 1160125 - DNA, 22 bp, Artificial Sequence
  chemically synthesized
ttactgttttggggtctatctc

SEQ ID NO: 1160126 - DNA, 22 bp, Artificial Sequence
  chemically synthesized
ctgttttggggtctatctctct

SEQ ID NO: 1160127 - DNA, 22 bp, Artificial Sequence
  chemically synthesized
ttttggggtctatctctctaac

SEQ ID NO: 1160128 - DNA, 22 bp, Artificial Sequence
  chemically synthesized
tggggtctatctctctaactct

SEQ ID NO: 1160129 - DNA, 22 bp, Artificial Sequence
  chemically synthesized
ggggtctatctctctaactcta

SEQ ID NO: 1160130 - DNA, 22 bp, Artificial Sequence
  chemically synthesized
gggtctatctctctaactctaa

SEQ ID NO: 1160131 - DNA, 22 bp, Artificial Sequence
  chemically synthesized
tctctctaactctaataatatt

SEQ ID NO: 1160132 - DNA, 22 bp, Artificial Sequence
  chemically synthesized
tctaactctaataatatttgat

SEQ ID NO: 1160133 - DNA, 22 bp, Artificial Sequence
  chemically synthesized
taactctaataatatttgattt

SEQ ID NO: 1160134 - DNA, 22 bp, Artificial Sequence
  chemically synthesized
actctaataatatttgatttat

SEQ ID NO: 1160135 - DNA, 22 bp, Artificial Sequence
  chemically synthesized
gaacacccagacgtataaatca

SEQ ID NO: 1160136 - DNA, 22 bp, Artificial Sequence
  chemically synthesized
taataatatttgatttatacgt

SEQ ID NO: 1160137 - DNA, 22 bp, Artificial Sequence
  chemically synthesized
ataatatttgatttatacgtct

SEQ ID NO: 1160138 - DNA, 22 bp, Artificial Sequence
  chemically synthesized
gatttatacgtctgggtgttcc

SEQ ID NO: 1160139 - DNA, 22 bp, Artificial Sequence
  chemically synthesized
atttatacgtctgggtgttcca

SEQ ID NO: 1160140 - DNA, 22 bp, Artificial Sequence
  chemically synthesized
atacgtctgggtgttccaatgt

SEQ ID NO: 1160141 - DNA, 22 bp, Artificial Sequence
  chemically synthesized
tacgtctgggtgttccaatgtt

SEQ ID NO: 1160142 - DNA, 22 bp, Artificial Sequence
  chemically synthesized
taaataaatatgtacccaacat

SEQ ID NO: 1160143 - DNA, 22 bp, Artificial Sequence
  chemically synthesized
ggtgttccaatgttgggtacat

SEQ ID NO: 1160144 - DNA, 22 bp, Artificial Sequence
  chemically synthesized
caatgttgggtacatatttatt

SEQ ID NO: 1160145 - DNA, 22 bp, Artificial Sequence
  chemically synthesized
ggtacatatttatttacaattg

SEQ ID NO: 1160146 - DNA, 22 bp, Artificial Sequence
  chemically synthesized
agcaagaggacataacaattgt

SEQ ID NO: 1160147 - DNA, 22 bp, Artificial Sequence
  chemically synthesized
atttacaattgttatgtcctct

SEQ ID NO: 1160148 - DNA, 22 bp, Artificial Sequence
  chemically synthesized
tttacaattgttatgtcctctt

SEQ ID NO: 1160149 - DNA, 22 bp, Artificial Sequence
  chemically synthesized
acaattgttatgtcctcttgct

SEQ ID NO: 1160150 - DNA, 22 bp, Artificial Sequence
  chemically synthesized
caattgttatgtcctcttgctg

SEQ ID NO: 1160151 - DNA, 22 bp, Artificial Sequence
  chemically synthesized
ttatgtcctcttgctgaattga

SEQ ID NO: 1160152 - DNA, 22 bp, Artificial Sequence
  chemically synthesized
tgtcctcttgctgaattgaccc

SEQ ID NO: 1160153 - DNA, 22 bp, Artificial Sequence
  chemically synthesized
tagaatgataaaggggtcaatt

SEQ ID NO: 1160154 - DNA, 22 bp, Artificial Sequence
  chemically synthesized
ttgctgaattgacccctttatc

SEQ ID NO: 1160155 - DNA, 22 bp, Artificial Sequence
  chemically synthesized
gctgaattgacccctttatcat

SEQ ID NO: 1160156 - DNA, 22 bp, Artificial Sequence
  chemically synthesized
ctgaattgacccctttatcatt

SEQ ID NO: 1160157 - DNA, 22 bp, Artificial Sequence
  chemically synthesized
aattgacccctttatcattcta

SEQ ID NO: 1160158 - DNA, 22 bp, Artificial Sequence
  chemically synthesized
acccctttatcattctacaatg

SEQ ID NO: 1160159 - DNA, 22 bp, Artificial Sequence
  chemically synthesized
tatcattctacaatgaccggcg

SEQ ID NO: 1160160 - DNA, 22 bp, Artificial Sequence
  chemically synthesized
atcattctacaatgaccggcgt

SEQ ID NO: 1160161 - DNA, 22 bp, Artificial Sequence
  chemically synthesized
taaaaagggacaacgccggtca

SEQ ID NO: 1160162 - DNA, 22 bp, Artificial Sequence
  chemically synthesized
tcattctacaatgaccggcgtt

SEQ ID NO: 1160163 - DNA, 22 bp, Artificial Sequence
  chemically synthesized
tacaatgaccggcgttgtccct

SEQ ID NO: 1160164 - DNA, 22 bp, Artificial Sequence
  chemically synthesized
caatgaccggcgttgtcccttt

SEQ ID NO: 1160165 - DNA, 22 bp, Artificial Sequence
  chemically synthesized
aagacaaaaactataaaaaggg

SEQ ID NO: 1160166 - DNA, 22 bp, Artificial Sequence
  chemically synthesized
caagacaaaaactataaaaagg

SEQ ID NO: 1160167 - DNA, 22 bp, Artificial Sequence
  chemically synthesized
tccctttttatagtttttgtct

SEQ ID NO: 1160168 - DNA, 22 bp, Artificial Sequence
  chemically synthesized
tttatagtttttgtcttgaaac

SEQ ID NO: 1160169 - DNA, 22 bp, Artificial Sequence
  chemically synthesized
ttatagtttttgtcttgaaacc

SEQ ID NO: 1160170 - DNA, 22 bp, Artificial Sequence
  chemically synthesized
tcagacaaaataggtttcaaga

SEQ ID NO: 1160171 - DNA, 22 bp, Artificial Sequence
  chemically synthesized
tatagtttttgtcttgaaacct

SEQ ID NO: 1160172 - DNA, 22 bp, Artificial Sequence
  chemically synthesized
atcagacaaaataggtttcaag

SEQ ID NO: 1160173 - DNA, 22 bp, Artificial Sequence
  chemically synthesized
atagtttttgtcttgaaaccta

SEQ ID NO: 1160174 - DNA, 22 bp, Artificial Sequence
  chemically synthesized
tatcagacaaaataggtttcaa

SEQ ID NO: 1160175 - DNA, 22 bp, Artificial Sequence
  chemically synthesized
tagtttttgtcttgaaacctat

SEQ ID NO: 1160176 - DNA, 22 bp, Artificial Sequence
  chemically synthesized
ttatcagacaaaataggtttca

SEQ ID NO: 1160177 - DNA, 22 bp, Artificial Sequence
  chemically synthesized
ttttatcagacaaaataggttt

SEQ ID NO: 1160178 - DNA, 22 bp, Artificial Sequence
  chemically synthesized
ttcttttatcagacaaaatagg

SEQ ID NO: 1160179 - DNA, 22 bp, Artificial Sequence
  chemically synthesized
ttgtcttgaaacctattttgtc

SEQ ID NO: 1160180 - DNA, 22 bp, Artificial Sequence
  chemically synthesized
tgtcttgaaacctattttgtct

SEQ ID NO: 1160181 - DNA, 22 bp, Artificial Sequence
  chemically synthesized
gtcttgaaacctattttgtctg

SEQ ID NO: 1160182 - DNA, 22 bp, Artificial Sequence
  chemically synthesized
tcttgaaacctattttgtctga

SEQ ID NO: 1160183 - DNA, 22 bp, Artificial Sequence
  chemically synthesized
gctattcttttatcagacaaaa

SEQ ID NO: 1160184 - DNA, 22 bp, Artificial Sequence
  chemically synthesized
gaaacctattttgtctgataaa

SEQ ID NO: 1160185 - DNA, 22 bp, Artificial Sequence
  chemically synthesized
aaacctattttgtctgataaaa

SEQ ID NO: 1160186 - DNA, 22 bp, Artificial Sequence
  chemically synthesized
ttttgtctgataaaagaatagc

SEQ ID NO: 1160187 - DNA, 22 bp, Artificial Sequence
  chemically synthesized
tgtctgataaaagaatagctaa

SEQ ID NO: 1160188 - DNA, 22 bp, Artificial Sequence
  chemically synthesized
gtctgataaaagaatagctaat

SEQ ID NO: 1160189 - DNA, 22 bp, Artificial Sequence
  chemically synthesized
tctgataaaagaatagctaatc

SEQ ID NO: 1160190 - DNA, 22 bp, Artificial Sequence
  chemically synthesized
ataaaagaatagctaatcctgt

SEQ ID NO: 1160191 - DNA, 22 bp, Artificial Sequence
  chemically synthesized
catgccaatcgaaaccaaaaaa

SEQ ID NO: 1160192 - DNA, 22 bp, Artificial Sequence
  chemically synthesized
atcctgttcttttttggtttcg

SEQ ID NO: 1160193 - DNA, 22 bp, Artificial Sequence
  chemically synthesized
ttcttttttggtttcgattggc

SEQ ID NO: 1160194 - DNA, 22 bp, Artificial Sequence
  chemically synthesized
ttttttggtttcgattggcatg

SEQ ID NO: 1160195 - DNA, 22 bp, Artificial Sequence
  chemically synthesized
ttttggtttcgattggcatgga

SEQ ID NO: 1160196 - DNA, 22 bp, Artificial Sequence
  chemically synthesized
tttggtttcgattggcatggaa

SEQ ID NO: 1160197 - DNA, 22 bp, Artificial Sequence
  chemically synthesized
ttggtttcgattggcatggaat

SEQ ID NO: 1160198 - DNA, 22 bp, Artificial Sequence
  chemically synthesized
tggtttcgattggcatggaata

SEQ ID NO: 1160199 - DNA, 22 bp, Artificial Sequence
  chemically synthesized
ggtttcgattggcatggaatac

SEQ ID NO: 1160200 - DNA, 22 bp, Artificial Sequence
  chemically synthesized
gtttcgattggcatggaatact

SEQ ID NO: 1160201 - DNA, 22 bp, Artificial Sequence
  chemically synthesized
cgattggcatggaatacttgtt

SEQ ID NO: 1160202 - DNA, 22 bp, Artificial Sequence
  chemically synthesized
gattggcatggaatacttgttc

SEQ ID NO: 1160203 - DNA, 22 bp, Artificial Sequence
  chemically synthesized
aaaataaagggatggaacaagt

SEQ ID NO: 1160204 - DNA, 22 bp, Artificial Sequence
  chemically synthesized
gcatggaatacttgttccatcc

SEQ ID NO: 1160205 - DNA, 22 bp, Artificial Sequence
  chemically synthesized
gttccatccctttattttcagt

SEQ ID NO: 1160206 - DNA, 22 bp, Artificial Sequence
  chemically synthesized
ttccatccctttattttcagtc

SEQ ID NO: 1160207 - DNA, 22 bp, Artificial Sequence
  chemically synthesized
catccctttattttcagtctat

SEQ ID NO: 1160208 - DNA, 22 bp, Artificial Sequence
  chemically synthesized
accaataaagataaagatagac

SEQ ID NO: 1160209 - DNA, 22 bp, Artificial Sequence
  chemically synthesized
gaccaataaagataaagataga

SEQ ID NO: 1160210 - DNA, 22 bp, Artificial Sequence
  chemically synthesized
tattttcagtctatctttatct

SEQ ID NO: 1160211 - DNA, 22 bp, Artificial Sequence
  chemically synthesized
attttcagtctatctttatctt

SEQ ID NO: 1160212 - DNA, 22 bp, Artificial Sequence
  chemically synthesized
ttttcagtctatctttatcttt

SEQ ID NO: 1160213 - DNA, 22 bp, Artificial Sequence
  chemically synthesized
tcagtctatctttatctttatt

SEQ ID NO: 1160214 - DNA, 22 bp, Artificial Sequence
  chemically synthesized
cagtctatctttatctttattg

SEQ ID NO: 1160215 - DNA, 22 bp, Artificial Sequence
  chemically synthesized
agtctatctttatctttattgg

SEQ ID NO: 1160216 - DNA, 22 bp, Artificial Sequence
  chemically synthesized
caagaaacacacttgaccaata

SEQ ID NO: 1160217 - DNA, 22 bp, Artificial Sequence
  chemically synthesized
acaagaaacacacttgaccaat

SEQ ID NO: 1160218 - DNA, 22 bp, Artificial Sequence
  chemically synthesized
tctttatctttattggtcaagt

SEQ ID NO: 1160219 - DNA, 22 bp, Artificial Sequence
  chemically synthesized
cttacaagaaacacacttgacc

SEQ ID NO: 1160220 - DNA, 22 bp, Artificial Sequence
  chemically synthesized
tatctttattggtcaagtgtgt

SEQ ID NO: 1160221 - DNA, 22 bp, Artificial Sequence
  chemically synthesized
atctttattggtcaagtgtgtt

SEQ ID NO: 1160222 - DNA, 22 bp, Artificial Sequence
  chemically synthesized
ttacttacaagaaacacacttg

SEQ ID NO: 1160223 - DNA, 22 bp, Artificial Sequence
  chemically synthesized
tctttattggtcaagtgtgttt

SEQ ID NO: 1160224 - DNA, 22 bp, Artificial Sequence
  chemically synthesized
tattggtcaagtgtgtttcttg

SEQ ID NO: 1160225 - DNA, 22 bp, Artificial Sequence
  chemically synthesized
attggtcaagtgtgtttcttgt

SEQ ID NO: 1160226 - DNA, 22 bp, Artificial Sequence
  chemically synthesized
ttggtcaagtgtgtttcttgta

SEQ ID NO: 1160227 - DNA, 22 bp, Artificial Sequence
  chemically synthesized
gtcaagtgtgtttcttgtaagt

SEQ ID NO: 1160228 - DNA, 22 bp, Artificial Sequence
  chemically synthesized
cttgtaagtaacagattattgt

SEQ ID NO: 1160229 - DNA, 22 bp, Artificial Sequence
  chemically synthesized
ttgtaagtaacagattattgtg

SEQ ID NO: 1160230 - DNA, 22 bp, Artificial Sequence
  chemically synthesized
gtaagtaacagattattgtgtc

SEQ ID NO: 1160231 - DNA, 22 bp, Artificial Sequence
  chemically synthesized
taagtaacagattattgtgtct

SEQ ID NO: 1160232 - DNA, 22 bp, Artificial Sequence
  chemically synthesized
ttgtgtcttgtatattctttta

SEQ ID NO: 1160233 - DNA, 22 bp, Artificial Sequence
  chemically synthesized
agtgacagaatggataaaagaa

SEQ ID NO: 1160234 - DNA, 22 bp, Artificial Sequence
  chemically synthesized
tgtcttgtatattcttttatcc

SEQ ID NO: 1160235 - DNA, 22 bp, Artificial Sequence
  chemically synthesized
gtatattcttttatccattctg

SEQ ID NO: 1160236 - DNA, 22 bp, Artificial Sequence
  chemically synthesized
tatattcttttatccattctgt

SEQ ID NO: 1160237 - DNA, 22 bp, Artificial Sequence
  chemically synthesized
aatacattgagtgacagaatgg

SEQ ID NO: 1160238 - DNA, 22 bp, Artificial Sequence
  chemically synthesized
ttttatccattctgtcactcaa

SEQ ID NO: 1160239 - DNA, 22 bp, Artificial Sequence
  chemically synthesized
ttatccattctgtcactcaatg

SEQ ID NO: 1160240 - DNA, 22 bp, Artificial Sequence
  chemically synthesized
tatccattctgtcactcaatgt

SEQ ID NO: 1160241 - DNA, 22 bp, Artificial Sequence
  chemically synthesized
tccaatctaaatacattgagtg

SEQ ID NO: 1160242 - DNA, 22 bp, Artificial Sequence
  chemically synthesized
atccattctgtcactcaatgta

SEQ ID NO: 1160243 - DNA, 22 bp, Artificial Sequence
  chemically synthesized
tccattctgtcactcaatgtat

SEQ ID NO: 1160244 - DNA, 22 bp, Artificial Sequence
  chemically synthesized
aactatccaatctaaatacatt

SEQ ID NO: 1160245 - DNA, 22 bp, Artificial Sequence
  chemically synthesized
tgtcactcaatgtatttagatt

SEQ ID NO: 1160246 - DNA, 22 bp, Artificial Sequence
  chemically synthesized
actaaactatccaatctaaata

SEQ ID NO: 1160247 - DNA, 22 bp, Artificial Sequence
  chemically synthesized
tcactcaatgtatttagattgg

SEQ ID NO: 1160248 - DNA, 22 bp, Artificial Sequence
  chemically synthesized
aatgtatttagattggatagtt

SEQ ID NO: 1160249 - DNA, 22 bp, Artificial Sequence
  chemically synthesized
agattggatagtttagtcaatt

SEQ ID NO: 1160250 - DNA, 22 bp, Artificial Sequence
  chemically synthesized
gattggatagtttagtcaattt

SEQ ID NO: 1160251 - DNA, 22 bp, Artificial Sequence
  chemically synthesized
gatagtttagtcaatttacatt

SEQ ID NO: 1160252 - DNA, 22 bp, Artificial Sequence
  chemically synthesized
agtcaatttacattccatgtta

SEQ ID NO: 1160253 - DNA, 22 bp, Artificial Sequence
  chemically synthesized
acgtaccaatgataacatggaa

SEQ ID NO: 1160254 - DNA, 22 bp, Artificial Sequence
  chemically synthesized
gtcaatttacattccatgttat

SEQ ID NO: 1160255 - DNA, 22 bp, Artificial Sequence
  chemically synthesized
aacgtaccaatgataacatgga

SEQ ID NO: 1160256 - DNA, 22 bp, Artificial Sequence
  chemically synthesized
agtccttaacgtaccaatgata

SEQ ID NO: 1160257 - DNA, 22 bp, Artificial Sequence
  chemically synthesized
acattccatgttatcattggta

SEQ ID NO: 1160258 - DNA, 22 bp, Artificial Sequence
  chemically synthesized
aagtccttaacgtaccaatgat

SEQ ID NO: 1160259 - DNA, 22 bp, Artificial Sequence
  chemically synthesized
cattccatgttatcattggtac

SEQ ID NO: 1160260 - DNA, 22 bp, Artificial Sequence
  chemically synthesized
catgttatcattggtacgttaa

SEQ ID NO: 1160261 - DNA, 22 bp, Artificial Sequence
  chemically synthesized
tcattggtacgttaaggactta

SEQ ID NO: 1160262 - DNA, 22 bp, Artificial Sequence
  chemically synthesized
gtacgttaaggacttaaacact

SEQ ID NO: 1160263 - DNA, 22 bp, Artificial Sequence
  chemically synthesized
aggacttaaacacttcccattt

SEQ ID NO: 1160264 - DNA, 22 bp, Artificial Sequence
  chemically synthesized
aaacacttcccattttgctatt

SEQ ID NO: 1160265 - DNA, 22 bp, Artificial Sequence
  chemically synthesized
aacacttcccattttgctattt

SEQ ID NO: 1160266 - DNA, 22 bp, Artificial Sequence
  chemically synthesized
cccattttgctatttcctttct

SEQ ID NO: 1160267 - DNA, 22 bp, Artificial Sequence
  chemically synthesized
ccattttgctatttcctttctg

SEQ ID NO: 1160268 - DNA, 22 bp, Artificial Sequence
  chemically synthesized
tgctatttcctttctggttgtt

SEQ ID NO: 1160269 - DNA, 22 bp, Artificial Sequence
  chemically synthesized
gctatttcctttctggttgttt

SEQ ID NO: 1160270 - DNA, 22 bp, Artificial Sequence
  chemically synthesized
ctatttcctttctggttgtttt

SEQ ID NO: 1160271 - DNA, 22 bp, Artificial Sequence
  chemically synthesized
tttcctttctggttgttttgtg

SEQ ID NO: 1160272 - DNA, 22 bp, Artificial Sequence
  chemically synthesized
cctttctggttgttttgtggcc

SEQ ID NO: 1160273 - DNA, 22 bp, Artificial Sequence
  chemically synthesized
ctttctggttgttttgtggcct

SEQ ID NO: 1160274 - DNA, 22 bp, Artificial Sequence
  chemically synthesized
tctggttgttttgtggccttct

SEQ ID NO: 1160275 - DNA, 22 bp, Artificial Sequence
  chemically synthesized
ctggttgttttgtggccttctc

SEQ ID NO: 1160276 - DNA, 22 bp, Artificial Sequence
  chemically synthesized
tggttgttttgtggccttctct

SEQ ID NO: 1160277 - DNA, 22 bp, Artificial Sequence
  chemically synthesized
gttgttttgtggccttctcttc

SEQ ID NO: 1160278 - DNA, 22 bp, Artificial Sequence
  chemically synthesized
ttttgtggccttctcttcattc

SEQ ID NO: 1160279 - DNA, 22 bp, Artificial Sequence
  chemically synthesized
tgtggccttctcttcattctct

SEQ ID NO: 1160280 - DNA, 22 bp, Artificial Sequence
  chemically synthesized
gtggccttctcttcattctctc

SEQ ID NO: 1160281 - DNA, 22 bp, Artificial Sequence
  chemically synthesized
tggccttctcttcattctctct

SEQ ID NO: 1160282 - DNA, 22 bp, Artificial Sequence
  chemically synthesized
ctcttcattctctctttccttc

SEQ ID NO: 1160283 - DNA, 22 bp, Artificial Sequence
  chemically synthesized
atagtaagacaggaaggaaaga

SEQ ID NO: 1160284 - DNA, 22 bp, Artificial Sequence
  chemically synthesized
tcttcattctctctttccttcc

SEQ ID NO: 1160285 - DNA, 22 bp, Artificial Sequence
  chemically synthesized
ttcattctctctttccttcctg

SEQ ID NO: 1160286 - DNA, 22 bp, Artificial Sequence
  chemically synthesized
attaatagtaagacaggaagga

SEQ ID NO: 1160287 - DNA, 22 bp, Artificial Sequence
  chemically synthesized
cattctctctttccttcctgtc

SEQ ID NO: 1160288 - DNA, 22 bp, Artificial Sequence
  chemically synthesized
cattaatagtaagacaggaagg

SEQ ID NO: 1160289 - DNA, 22 bp, Artificial Sequence
  chemically synthesized
attctctctttccttcctgtct

SEQ ID NO: 1160290 - DNA, 22 bp, Artificial Sequence
  chemically synthesized
tcattaatagtaagacaggaag

SEQ ID NO: 1160291 - DNA, 22 bp, Artificial Sequence
  chemically synthesized
ctttcattaatagtaagacagg

SEQ ID NO: 1160292 - DNA, 22 bp, Artificial Sequence
  chemically synthesized
tctctttccttcctgtcttact

SEQ ID NO: 1160293 - DNA, 22 bp, Artificial Sequence
  chemically synthesized
tctttccttcctgtcttactat

SEQ ID NO: 1160294 - DNA, 22 bp, Artificial Sequence
  chemically synthesized
tttccttcctgtcttactatta

SEQ ID NO: 1160295 - DNA, 22 bp, Artificial Sequence
  chemically synthesized
tccttcctgtcttactattaat

SEQ ID NO: 1160296 - DNA, 22 bp, Artificial Sequence
  chemically synthesized
ccttcctgtcttactattaatg

SEQ ID NO: 1160297 - DNA, 22 bp, Artificial Sequence
  chemically synthesized
cttcctgtcttactattaatga

SEQ ID NO: 1160298 - DNA, 22 bp, Artificial Sequence
  chemically synthesized
cctgtcttactattaatgaaag

SEQ ID NO: 1160299 - DNA, 22 bp, Artificial Sequence
  chemically synthesized
ctgtcttactattaatgaaagt

SEQ ID NO: 1160300 - DNA, 22 bp, Artificial Sequence
  chemically synthesized
tcttactattaatgaaagtaat

SEQ ID NO: 1160301 - DNA, 22 bp, Artificial Sequence
  chemically synthesized
actattaatgaaagtaattttc

SEQ ID NO: 1160302 - DNA, 22 bp, Artificial Sequence
  chemically synthesized
ctattaatgaaagtaattttct

SEQ ID NO: 1160303 - DNA, 22 bp, Artificial Sequence
  chemically synthesized
ttaatgaaagtaattttctctg

SEQ ID NO: 1160304 - DNA, 22 bp, Artificial Sequence
  chemically synthesized
atgaaagtaattttctctggtc

SEQ ID NO: 1160305 - DNA, 22 bp, Artificial Sequence
  chemically synthesized
ataagaatgtataacatatgac

SEQ ID NO: 1160306 - DNA, 22 bp, Artificial Sequence
  chemically synthesized
tctctggtcatatgttatacat

SEQ ID NO: 1160307 - DNA, 22 bp, Artificial Sequence
  chemically synthesized
ctctggtcatatgttatacatt

SEQ ID NO: 1160308 - DNA, 22 bp, Artificial Sequence
  chemically synthesized
tctggtcatatgttatacattc

SEQ ID NO: 1160309 - DNA, 22 bp, Artificial Sequence
  chemically synthesized
tggtcatatgttatacattctt

SEQ ID NO: 1160310 - DNA, 22 bp, Artificial Sequence
  chemically synthesized
gtcatatgttatacattcttat

SEQ ID NO: 1160311 - DNA, 22 bp, Artificial Sequence
  chemically synthesized
aggtacataaaaattaataaga

SEQ ID NO: 1160312 - DNA, 22 bp, Artificial Sequence
  chemically synthesized
tacattcttattaatttttatg

SEQ ID NO: 1160313 - DNA, 22 bp, Artificial Sequence
  chemically synthesized
ttattaatttttatgtacctga

SEQ ID NO: 1160314 - DNA, 22 bp, Artificial Sequence
  chemically synthesized
attaatttttatgtacctgagt

SEQ ID NO: 1160315 - DNA, 22 bp, Artificial Sequence
  chemically synthesized
ttaatttttatgtacctgagta

SEQ ID NO: 1160316 - DNA, 22 bp, Artificial Sequence
  chemically synthesized
atttttatgtacctgagtacat

SEQ ID NO: 1160317 - DNA, 22 bp, Artificial Sequence
  chemically synthesized
ccacaaatcaaataatgtactc

SEQ ID NO: 1160318 - DNA, 22 bp, Artificial Sequence
  chemically synthesized
ttatgtacctgagtacattatt

SEQ ID NO: 1160319 - DNA, 22 bp, Artificial Sequence
  chemically synthesized
tatgtacctgagtacattattt

SEQ ID NO: 1160320 - DNA, 22 bp, Artificial Sequence
  chemically synthesized
atgtacctgagtacattatttg

SEQ ID NO: 1160321 - DNA, 22 bp, Artificial Sequence
  chemically synthesized
tgtacctgagtacattatttga

SEQ ID NO: 1160322 - DNA, 22 bp, Artificial Sequence
  chemically synthesized
atagttaccacaaatcaaataa

SEQ ID NO: 1160323 - DNA, 22 bp, Artificial Sequence
  chemically synthesized
agtacattatttgatttgtggt

SEQ ID NO: 1160324 - DNA, 22 bp, Artificial Sequence
  chemically synthesized
caaacctcatagttaccacaaa

SEQ ID NO: 1160325 - DNA, 22 bp, Artificial Sequence
  chemically synthesized
acaaacctcatagttaccacaa

SEQ ID NO: 1160326 - DNA, 22 bp, Artificial Sequence
  chemically synthesized
tacaaacctcatagttaccaca

SEQ ID NO: 1160327 - DNA, 22 bp, Artificial Sequence
  chemically synthesized
tttacaaacctcatagttacca

SEQ ID NO: 1160328 - DNA, 22 bp, Artificial Sequence
  chemically synthesized
tttgatttgtggtaactatgag

SEQ ID NO: 1160329 - DNA, 22 bp, Artificial Sequence
  chemically synthesized
ttctttacaaacctcatagtta

SEQ ID NO: 1160330 - DNA, 22 bp, Artificial Sequence
  chemically synthesized
attctttacaaacctcatagtt

SEQ ID NO: 1160331 - DNA, 22 bp, Artificial Sequence
  chemically synthesized
gatttgtggtaactatgaggtt

SEQ ID NO: 1160332 - DNA, 22 bp, Artificial Sequence
  chemically synthesized
atttgtggtaactatgaggttt

SEQ ID NO: 1160333 - DNA, 22 bp, Artificial Sequence
  chemically synthesized
taacttattctttacaaacctc

SEQ ID NO: 1160334 - DNA, 22 bp, Artificial Sequence
  chemically synthesized
gtggtaactatgaggtttgtaa

SEQ ID NO: 1160335 - DNA, 22 bp, Artificial Sequence
  chemically synthesized
tggtaactatgaggtttgtaaa

SEQ ID NO: 1160336 - DNA, 22 bp, Artificial Sequence
  chemically synthesized
tgaggtttgtaaagaataagtt

SEQ ID NO: 1160337 - DNA, 22 bp, Artificial Sequence
  chemically synthesized
aaataatggattataacttatt

SEQ ID NO: 1160338 - DNA, 22 bp, Artificial Sequence
  chemically synthesized
caaataatggattataacttat

SEQ ID NO: 1160339 - DNA, 22 bp, Artificial Sequence
  chemically synthesized
gtaaagaataagttataatcca

SEQ ID NO: 1160340 - DNA, 22 bp, Artificial Sequence
  chemically synthesized
taaagaataagttataatccat

SEQ ID NO: 1160341 - DNA, 22 bp, Artificial Sequence
  chemically synthesized
tcatgaatttcaaataatggat

SEQ ID NO: 1160342 - DNA, 22 bp, Artificial Sequence
  chemically synthesized
taatccattatttgaaattcat

SEQ ID NO: 1160343 - DNA, 22 bp, Artificial Sequence
  chemically synthesized
tgcaaccagtgttgtcatgaat

SEQ ID NO: 1160344 - DNA, 22 bp, Artificial Sequence
  chemically synthesized
atgcaaccagtgttgtcatgaa

SEQ ID NO: 1160345 - DNA, 22 bp, Artificial Sequence
  chemically synthesized
tttatgcaaccagtgttgtcat

SEQ ID NO: 1160346 - DNA, 22 bp, Artificial Sequence
  chemically synthesized
gtttatgcaaccagtgttgtca

SEQ ID NO: 1160347 - DNA, 22 bp, Artificial Sequence
  chemically synthesized
tttgaaattcatgacaacactg

SEQ ID NO: 1160348 - DNA, 22 bp, Artificial Sequence
  chemically synthesized
tttgtttatgcaaccagtgttg

SEQ ID NO: 1160349 - DNA, 22 bp, Artificial Sequence
  chemically synthesized
gaaattcatgacaacactggtt

SEQ ID NO: 1160350 - DNA, 22 bp, Artificial Sequence
  chemically synthesized
atttgtttatgcaaccagtgtt

SEQ ID NO: 1160351 - DNA, 22 bp, Artificial Sequence
  chemically synthesized
aaattcatgacaacactggttg

SEQ ID NO: 1160352 - DNA, 22 bp, Artificial Sequence
  chemically synthesized
cttatttgtttatgcaaccagt

SEQ ID NO: 1160353 - DNA, 22 bp, Artificial Sequence
  chemically synthesized
gcttatttgtttatgcaaccag

SEQ ID NO: 1160354 - DNA, 22 bp, Artificial Sequence
  chemically synthesized
tgcttatttgtttatgcaacca

SEQ ID NO: 1160355 - DNA, 22 bp, Artificial Sequence
  chemically synthesized
atgacaacactggttgcataaa

SEQ ID NO: 1160356 - DNA, 22 bp, Artificial Sequence
  chemically synthesized
tttgcttatttgtttatgcaac

SEQ ID NO: 1160357 - DNA, 22 bp, Artificial Sequence
  chemically synthesized
tctttgcttatttgtttatgca

SEQ ID NO: 1160358 - DNA, 22 bp, Artificial Sequence
  chemically synthesized
ctctttgcttatttgtttatgc

SEQ ID NO: 1160359 - DNA, 22 bp, Artificial Sequence
  chemically synthesized
tctctttgcttatttgtttatg

SEQ ID NO: 1160360 - DNA, 22 bp, Artificial Sequence
  chemically synthesized
gttttctctttgcttatttgtt

SEQ ID NO: 1160361 - DNA, 22 bp, Artificial Sequence
  chemically synthesized
agttttctctttgcttatttgt

SEQ ID NO: 1160362 - DNA, 22 bp, Artificial Sequence
  chemically synthesized
tagttttctctttgcttatttg

SEQ ID NO: 1160363 - DNA, 22 bp, Artificial Sequence
  chemically synthesized
ttagttttctctttgcttattt

SEQ ID NO: 1160364 - DNA, 22 bp, Artificial Sequence
  chemically synthesized
gttgcataaacaaataagcaaa

SEQ ID NO: 1160365 - DNA, 22 bp, Artificial Sequence
  chemically synthesized
tttagttttctctttgcttatt

SEQ ID NO: 1160366 - DNA, 22 bp, Artificial Sequence
  chemically synthesized
ttttagttttctctttgcttat

SEQ ID NO: 1160367 - DNA, 22 bp, Artificial Sequence
  chemically synthesized
tttttagttttctctttgctta

SEQ ID NO: 1160368 - DNA, 22 bp, Artificial Sequence
  chemically synthesized
ttttttagttttctctttgctt

SEQ ID NO: 1160369 - DNA, 22 bp, Artificial Sequence
  chemically synthesized
cataaacaaataagcaaagaga

SEQ ID NO: 1160370 - DNA, 22 bp, Artificial Sequence
  chemically synthesized
tttttttagttttctctttgct

SEQ ID NO: 1160371 - DNA, 22 bp, Artificial Sequence
  chemically synthesized
ttttttttagttttctctttgc

SEQ ID NO: 1160372 - DNA, 22 bp, Artificial Sequence
  chemically synthesized
tttttttttagttttctctttg

SEQ ID NO: 1160373 - DNA, 22 bp, Artificial Sequence
  chemically synthesized
ttttttttttagttttctcttt

SEQ ID NO: 1160374 - DNA, 22 bp, Artificial Sequence
  chemically synthesized
tttttttttttagttttctctt

SEQ ID NO: 1160375 - DNA, 22 bp, Artificial Sequence
  chemically synthesized
aagtgtagcatttttttttttt

SEQ ID NO: 1160376 - DNA, 22 bp, Artificial Sequence
  chemically synthesized
aaaaaaaaaaaaatgctacact

SEQ ID NO: 1160377 - DNA, 22 bp, Artificial Sequence
  chemically synthesized
cactttaacttcatccccccac

SEQ ID NO: 1160378 - DNA, 22 bp, Artificial Sequence
  chemically synthesized
taacttcatccccccactcttt

SEQ ID NO: 1160379 - DNA, 22 bp, Artificial Sequence
  chemically synthesized
aacttcatccccccactctttt

SEQ ID NO: 1160380 - DNA, 22 bp, Artificial Sequence
  chemically synthesized
acttcatccccccactcttttt

SEQ ID NO: 1160381 - DNA, 22 bp, Artificial Sequence
  chemically synthesized
catccccccactctttttgttg

SEQ ID NO: 1160382 - DNA, 22 bp, Artificial Sequence
  chemically synthesized
atccccccactctttttgttgt

SEQ ID NO: 1160383 - DNA, 22 bp, Artificial Sequence
  chemically synthesized
taataagatataaatagaaaca

SEQ ID NO: 1160384 - DNA, 22 bp, Artificial Sequence
  chemically synthesized
tttttgttgtttctatttatat

SEQ ID NO: 1160385 - DNA, 22 bp, Artificial Sequence
  chemically synthesized
tttgttgtttctatttatatct

SEQ ID NO: 1160386 - DNA, 22 bp, Artificial Sequence
  chemically synthesized
ttgttgtttctatttatatctt

SEQ ID NO: 1160387 - DNA, 22 bp, Artificial Sequence
  chemically synthesized
tgttgtttctatttatatctta

SEQ ID NO: 1160388 - DNA, 22 bp, Artificial Sequence
  chemically synthesized
gttgtttctatttatatcttat

SEQ ID NO: 1160389 - DNA, 22 bp, Artificial Sequence
  chemically synthesized
ttgtttctatttatatcttatt

SEQ ID NO: 1160390 - DNA, 22 bp, Artificial Sequence
  chemically synthesized
tttctatttatatcttattata

SEQ ID NO: 1160391 - DNA, 22 bp, Artificial Sequence
  chemically synthesized
aagacatagacactataataag

SEQ ID NO: 1160392 - DNA, 22 bp, Artificial Sequence
  chemically synthesized
caagacatagacactataataa

SEQ ID NO: 1160393 - DNA, 22 bp, Artificial Sequence
  chemically synthesized
ctatttatatcttattatagtg

SEQ ID NO: 1160394 - DNA, 22 bp, Artificial Sequence
  chemically synthesized
tcaagacatagacactataata

SEQ ID NO: 1160395 - DNA, 22 bp, Artificial Sequence
  chemically synthesized
tatttatatcttattatagtgt

SEQ ID NO: 1160396 - DNA, 22 bp, Artificial Sequence
  chemically synthesized
ttcaagacatagacactataat

SEQ ID NO: 1160397 - DNA, 22 bp, Artificial Sequence
  chemically synthesized
tttatatcttattatagtgtct

SEQ ID NO: 1160398 - DNA, 22 bp, Artificial Sequence
  chemically synthesized
atatcttattatagtgtctatg

SEQ ID NO: 1160399 - DNA, 22 bp, Artificial Sequence
  chemically synthesized
tatcttattatagtgtctatgt

SEQ ID NO: 1160400 - DNA, 22 bp, Artificial Sequence
  chemically synthesized
caacaacttttcaagacataga

SEQ ID NO: 1160401 - DNA, 22 bp, Artificial Sequence
  chemically synthesized
attatagtgtctatgtcttgaa

SEQ ID NO: 1160402 - DNA, 22 bp, Artificial Sequence
  chemically synthesized
ttatagtgtctatgtcttgaaa

SEQ ID NO: 1160403 - DNA, 22 bp, Artificial Sequence
  chemically synthesized
tagtgtctatgtcttgaaaagt

SEQ ID NO: 1160404 - DNA, 22 bp, Artificial Sequence
  chemically synthesized
tcaaaaataactgcaacaactt

SEQ ID NO: 1160405 - DNA, 22 bp, Artificial Sequence
  chemically synthesized
tgtcttgaaaagttgttgcagt

SEQ ID NO: 1160406 - DNA, 22 bp, Artificial Sequence
  chemically synthesized
gaaaagttgttgcagttatttt

SEQ ID NO: 1160407 - DNA, 22 bp, Artificial Sequence
  chemically synthesized
aaaagttgttgcagttattttt

SEQ ID NO: 1160408 - DNA, 22 bp, Artificial Sequence
  chemically synthesized
aaagacgaacctatcaaaaata

SEQ ID NO: 1160409 - DNA, 22 bp, Artificial Sequence
  chemically synthesized
ttgcagttatttttgataggtt

SEQ ID NO: 1160410 - DNA, 22 bp, Artificial Sequence
  chemically synthesized
cagttatttttgataggttcgt

SEQ ID NO: 1160411 - DNA, 22 bp, Artificial Sequence
  chemically synthesized
agtaaaaagactaaaagacgaa

SEQ ID NO: 1160412 - DNA, 22 bp, Artificial Sequence
  chemically synthesized
tttttgataggttcgtctttta

SEQ ID NO: 1160413 - DNA, 22 bp, Artificial Sequence
  chemically synthesized
gagtaaaaagactaaaagacga

SEQ ID NO: 1160414 - DNA, 22 bp, Artificial Sequence
  chemically synthesized
ttgataggttcgtcttttagtc

SEQ ID NO: 1160415 - DNA, 22 bp, Artificial Sequence
  chemically synthesized
tgataggttcgtcttttagtct

SEQ ID NO: 1160416 - DNA, 22 bp, Artificial Sequence
  chemically synthesized
gataggttcgtcttttagtctt

SEQ ID NO: 1160417 - DNA, 22 bp, Artificial Sequence
  chemically synthesized
ataggttcgtcttttagtcttt

SEQ ID NO: 1160418 - DNA, 22 bp, Artificial Sequence
  chemically synthesized
cccatatcttgagtaaaaagac

SEQ ID NO: 1160419 - DNA, 22 bp, Artificial Sequence
  chemically synthesized
gtcttttagtctttttactcaa

SEQ ID NO: 1160420 - DNA, 22 bp, Artificial Sequence
  chemically synthesized
aactacccatatcttgagtaaa

SEQ ID NO: 1160421 - DNA, 22 bp, Artificial Sequence
  chemically synthesized
ttagtctttttactcaagatat

SEQ ID NO: 1160422 - DNA, 22 bp, Artificial Sequence
  chemically synthesized
tagtctttttactcaagatatg

SEQ ID NO: 1160423 - DNA, 22 bp, Artificial Sequence
  chemically synthesized
agtctttttactcaagatatgg

SEQ ID NO: 1160424 - DNA, 22 bp, Artificial Sequence
  chemically synthesized
gtctttttactcaagatatggg

SEQ ID NO: 1160425 - DNA, 22 bp, Artificial Sequence
  chemically synthesized
tgatgtctcaactacccatatc

SEQ ID NO: 1160426 - DNA, 22 bp, Artificial Sequence
  chemically synthesized
tttactcaagatatgggtagtt

SEQ ID NO: 1160427 - DNA, 22 bp, Artificial Sequence
  chemically synthesized
ttactcaagatatgggtagttg

SEQ ID NO: 1160428 - DNA, 22 bp, Artificial Sequence
  chemically synthesized
tactcaagatatgggtagttga

SEQ ID NO: 1160429 - DNA, 22 bp, Artificial Sequence
  chemically synthesized
actcaagatatgggtagttgag

SEQ ID NO: 1160430 - DNA, 22 bp, Artificial Sequence
  chemically synthesized
tgattatgatgtctcaactacc

SEQ ID NO: 1160431 - DNA, 22 bp, Artificial Sequence
  chemically synthesized
ctcaagatatgggtagttgaga

SEQ ID NO: 1160432 - DNA, 22 bp, Artificial Sequence
  chemically synthesized
aagatatgggtagttgagacat

SEQ ID NO: 1160433 - DNA, 22 bp, Artificial Sequence
  chemically synthesized
taacactgtgattatgatgtct

SEQ ID NO: 1160434 - DNA, 22 bp, Artificial Sequence
  chemically synthesized
agacatcataatcacagtgtta

SEQ ID NO: 1160435 - DNA, 22 bp, Artificial Sequence
  chemically synthesized
caaagagaatattataacactg

SEQ ID NO: 1160436 - DNA, 22 bp, Artificial Sequence
  chemically synthesized
ttacaaagagaatattataaca

SEQ ID NO: 1160437 - DNA, 22 bp, Artificial Sequence
  chemically synthesized
tgttacaaagagaatattataa

SEQ ID NO: 1160438 - DNA, 22 bp, Artificial Sequence
  chemically synthesized
ttctgttacaaagagaatatta

SEQ ID NO: 1160439 - DNA, 22 bp, Artificial Sequence
  chemically synthesized
ctattctgttacaaagagaata

SEQ ID NO: 1160440 - DNA, 22 bp, Artificial Sequence
  chemically synthesized
ttactattctgttacaaagaga

SEQ ID NO: 1160441 - DNA, 22 bp, Artificial Sequence
  chemically synthesized
gttactattctgttacaaagag

SEQ ID NO: 1160442 - DNA, 22 bp, Artificial Sequence
  chemically synthesized
taatattctctttgtaacagaa

SEQ ID NO: 1160443 - DNA, 22 bp, Artificial Sequence
  chemically synthesized
tctttgtaacagaatagtaaca

SEQ ID NO: 1160444 - DNA, 22 bp, Artificial Sequence
  chemically synthesized
tttgtaacagaatagtaacaaa

SEQ ID NO: 1160445 - DNA, 22 bp, Artificial Sequence
  chemically synthesized
gtgatagtaaggtttgttacta

SEQ ID NO: 1160446 - DNA, 22 bp, Artificial Sequence
  chemically synthesized
tgtaacagaatagtaacaaacc

SEQ ID NO: 1160447 - DNA, 22 bp, Artificial Sequence
  chemically synthesized
gtaacagaatagtaacaaacct

SEQ ID NO: 1160448 - DNA, 22 bp, Artificial Sequence
  chemically synthesized
taacagaatagtaacaaacctt

SEQ ID NO: 1160449 - DNA, 22 bp, Artificial Sequence
  chemically synthesized
actggtgatagtaaggtttgtt

SEQ ID NO: 1160450 - DNA, 22 bp, Artificial Sequence
  chemically synthesized
aagtaacaaaactcactggtga

SEQ ID NO: 1160451 - DNA, 22 bp, Artificial Sequence
  chemically synthesized
actatcaccagtgagttttgtt

SEQ ID NO: 1160452 - DNA, 22 bp, Artificial Sequence
  chemically synthesized
ctatcaccagtgagttttgtta

SEQ ID NO: 1160453 - DNA, 22 bp, Artificial Sequence
  chemically synthesized
tcaccagtgagttttgttactt

SEQ ID NO: 1160454 - DNA, 22 bp, Artificial Sequence
  chemically synthesized
atgagcaatgagtcatcatctg

SEQ ID NO: 1160455 - DNA, 22 bp, Artificial Sequence
  chemically synthesized
tgttacttcagatgatgactca

SEQ ID NO: 1160456 - DNA, 22 bp, Artificial Sequence
  chemically synthesized
gttacttcagatgatgactcat

SEQ ID NO: 1160457 - DNA, 22 bp, Artificial Sequence
  chemically synthesized
ttacttcagatgatgactcatt

SEQ ID NO: 1160458 - DNA, 22 bp, Artificial Sequence
  chemically synthesized
cttcagatgatgactcattgct

SEQ ID NO: 1160459 - DNA, 22 bp, Artificial Sequence
  chemically synthesized
cagatgatgactcattgctcat

SEQ ID NO: 1160460 - DNA, 22 bp, Artificial Sequence
  chemically synthesized
agatgatgactcattgctcatt

SEQ ID NO: 1160461 - DNA, 22 bp, Artificial Sequence
  chemically synthesized
aagaaaaggatgttaatgagca

SEQ ID NO: 1160462 - DNA, 22 bp, Artificial Sequence
  chemically synthesized
aaagaaaaggatgttaatgagc

SEQ ID NO: 1160463 - DNA, 22 bp, Artificial Sequence
  chemically synthesized
aatcttaaagaaaaggatgtta

SEQ ID NO: 1160464 - DNA, 22 bp, Artificial Sequence
  chemically synthesized
caatcttaaagaaaaggatgtt

SEQ ID NO: 1160465 - DNA, 22 bp, Artificial Sequence
  chemically synthesized
attgctcattaacatccttttc

SEQ ID NO: 1160466 - DNA, 22 bp, Artificial Sequence
  chemically synthesized
ttcaatcttaaagaaaaggatg

SEQ ID NO: 1160467 - DNA, 22 bp, Artificial Sequence
  chemically synthesized
ctcattaacatccttttcttta

SEQ ID NO: 1160468 - DNA, 22 bp, Artificial Sequence
  chemically synthesized
attaacatccttttctttaaga

SEQ ID NO: 1160469 - DNA, 22 bp, Artificial Sequence
  chemically synthesized
acatccttttctttaagattga

SEQ ID NO: 1160470 - DNA, 22 bp, Artificial Sequence
  chemically synthesized
ttctttaagattgaagaacgcc

SEQ ID NO: 1160471 - DNA, 22 bp, Artificial Sequence
  chemically synthesized
tctttaagattgaagaacgccc

SEQ ID NO: 1160472 - DNA, 22 bp, Artificial Sequence
  chemically synthesized
ctttaagattgaagaacgccct

SEQ ID NO: 1160473 - DNA, 22 bp, Artificial Sequence
  chemically synthesized
tttaagattgaagaacgccctt

SEQ ID NO: 1160474 - DNA, 22 bp, Artificial Sequence
  chemically synthesized
caagaaatggtaaagggcgttc

SEQ ID NO: 1160475 - DNA, 22 bp, Artificial Sequence
  chemically synthesized
taagattgaagaacgcccttta

SEQ ID NO: 1160476 - DNA, 22 bp, Artificial Sequence
  chemically synthesized
tacaagaaatggtaaagggcgt

SEQ ID NO: 1160477 - DNA, 22 bp, Artificial Sequence
  chemically synthesized
aagattgaagaacgccctttac

SEQ ID NO: 1160478 - DNA, 22 bp, Artificial Sequence
  chemically synthesized
ctacaagaaatggtaaagggcg

SEQ ID NO: 1160479 - DNA, 22 bp, Artificial Sequence
  chemically synthesized
agattgaagaacgccctttacc

SEQ ID NO: 1160480 - DNA, 22 bp, Artificial Sequence
  chemically synthesized
tctacaagaaatggtaaagggc

SEQ ID NO: 1160481 - DNA, 22 bp, Artificial Sequence
  chemically synthesized
ttctacaagaaatggtaaaggg

SEQ ID NO: 1160482 - DNA, 22 bp, Artificial Sequence
  chemically synthesized
aagaacgccctttaccatttct

SEQ ID NO: 1160483 - DNA, 22 bp, Artificial Sequence
  chemically synthesized
acaccaaaccttttctacaaga

SEQ ID NO: 1160484 - DNA, 22 bp, Artificial Sequence
  chemically synthesized
attaacaccaaaccttttctac

SEQ ID NO: 1160485 - DNA, 22 bp, Artificial Sequence
  chemically synthesized
taccatttcttgtagaaaaggt

SEQ ID NO: 1160486 - DNA, 22 bp, Artificial Sequence
  chemically synthesized
cattaacaccaaaccttttcta

SEQ ID NO: 1160487 - DNA, 22 bp, Artificial Sequence
  chemically synthesized
accatttcttgtagaaaaggtt

SEQ ID NO: 1160488 - DNA, 22 bp, Artificial Sequence
  chemically synthesized
ccatttcttgtagaaaaggttt

SEQ ID NO: 1160489 - DNA, 22 bp, Artificial Sequence
  chemically synthesized
cttgtagaaaaggtttggtgtt

SEQ ID NO: 1160490 - DNA, 22 bp, Artificial Sequence
  chemically synthesized
acagatttcattaacaccaaac

SEQ ID NO: 1160491 - DNA, 22 bp, Artificial Sequence
  chemically synthesized
ttgtagaaaaggtttggtgtta

SEQ ID NO: 1160492 - DNA, 22 bp, Artificial Sequence
  chemically synthesized
gtagaaaaggtttggtgttaat

SEQ ID NO: 1160493 - DNA, 22 bp, Artificial Sequence
  chemically synthesized
tagaaaaggtttggtgttaatg

SEQ ID NO: 1160494 - DNA, 22 bp, Artificial Sequence
  chemically synthesized
ggtgttaatgaaatctgtcagc

SEQ ID NO: 1160495 - DNA, 22 bp, Artificial Sequence
  chemically synthesized
agacaaagaaaagctgacagat

SEQ ID NO: 1160496 - DNA, 22 bp, Artificial Sequence
  chemically synthesized
gtgttaatgaaatctgtcagct

SEQ ID NO: 1160497 - DNA, 22 bp, Artificial Sequence
  chemically synthesized
taagacaaagaaaagctgacag

SEQ ID NO: 1160498 - DNA, 22 bp, Artificial Sequence
  chemically synthesized
ctaagacaaagaaaagctgaca

SEQ ID NO: 1160499 - DNA, 22 bp, Artificial Sequence
  chemically synthesized
tctaagacaaagaaaagctgac

SEQ ID NO: 1160500 - DNA, 22 bp, Artificial Sequence
  chemically synthesized
atgaaatctgtcagcttttctt

SEQ ID NO: 1160501 - DNA, 22 bp, Artificial Sequence
  chemically synthesized
tcagcttttctttgtcttagaa

SEQ ID NO: 1160502 - DNA, 22 bp, Artificial Sequence
  chemically synthesized
aaggagaaatgaagactttcta

SEQ ID NO: 1160503 - DNA, 22 bp, Artificial Sequence
  chemically synthesized
gaaggagaaatgaagactttct

SEQ ID NO: 1160504 - DNA, 22 bp, Artificial Sequence
  chemically synthesized
ttctttgtcttagaaagtcttc

SEQ ID NO: 1160505 - DNA, 22 bp, Artificial Sequence
  chemically synthesized
tctttgtcttagaaagtcttca

SEQ ID NO: 1160506 - DNA, 22 bp, Artificial Sequence
  chemically synthesized
ctttgtcttagaaagtcttcat

SEQ ID NO: 1160507 - DNA, 22 bp, Artificial Sequence
  chemically synthesized
tttgtcttagaaagtcttcatt

SEQ ID NO: 1160508 - DNA, 22 bp, Artificial Sequence
  chemically synthesized
tgtcttagaaagtcttcatttc

SEQ ID NO: 1160509 - DNA, 22 bp, Artificial Sequence
  chemically synthesized
atacttgaaggagaaatgaaga

SEQ ID NO: 1160510 - DNA, 22 bp, Artificial Sequence
  chemically synthesized
gtcttagaaagtcttcatttct

SEQ ID NO: 1160511 - DNA, 22 bp, Artificial Sequence
  chemically synthesized
catacttgaaggagaaatgaag

SEQ ID NO: 1160512 - DNA, 22 bp, Artificial Sequence
  chemically synthesized
tcttagaaagtcttcatttctc

SEQ ID NO: 1160513 - DNA, 22 bp, Artificial Sequence
  chemically synthesized
ttcatacttgaaggagaaatga

SEQ ID NO: 1160514 - DNA, 22 bp, Artificial Sequence
  chemically synthesized
agaaagtcttcatttctccttc

SEQ ID NO: 1160515 - DNA, 22 bp, Artificial Sequence
  chemically synthesized
gaaagtcttcatttctccttca

SEQ ID NO: 1160516 - DNA, 22 bp, Artificial Sequence
  chemically synthesized
tgaaaatcctcttcatacttga

SEQ ID NO: 1160517 - DNA, 22 bp, Artificial Sequence
  chemically synthesized
catttctccttcaagtatgaag

SEQ ID NO: 1160518 - DNA, 22 bp, Artificial Sequence
  chemically synthesized
atttctccttcaagtatgaaga

SEQ ID NO: 1160519 - DNA, 22 bp, Artificial Sequence
  chemically synthesized
ctccttcaagtatgaagaggat

SEQ ID NO: 1160520 - DNA, 22 bp, Artificial Sequence
  chemically synthesized
tccttcaagtatgaagaggatt

SEQ ID NO: 1160521 - DNA, 22 bp, Artificial Sequence
  chemically synthesized
cttcaagtatgaagaggatttt

SEQ ID NO: 1160522 - DNA, 22 bp, Artificial Sequence
  chemically synthesized
caagtatgaagaggattttcat

SEQ ID NO: 1160523 - DNA, 22 bp, Artificial Sequence
  chemically synthesized
aagtatgaagaggattttcata

SEQ ID NO: 1160524 - DNA, 22 bp, Artificial Sequence
  chemically synthesized
gaatagtatatctatgaaaatc

SEQ ID NO: 1160525 - DNA, 22 bp, Artificial Sequence
  chemically synthesized
tagaatagtatatctatgaaaa

SEQ ID NO: 1160526 - DNA, 22 bp, Artificial Sequence
  chemically synthesized
ttctagaatagtatatctatga

SEQ ID NO: 1160527 - DNA, 22 bp, Artificial Sequence
  chemically synthesized
attctagaatagtatatctatg

SEQ ID NO: 1160528 - DNA, 22 bp, Artificial Sequence
  chemically synthesized
tattctagaatagtatatctat

SEQ ID NO: 1160529 - DNA, 22 bp, Artificial Sequence
  chemically synthesized
ttattctagaatagtatatcta

SEQ ID NO: 1160530 - DNA, 22 bp, Artificial Sequence
  chemically synthesized
tcatagatatactattctagaa

SEQ ID NO: 1160531 - DNA, 22 bp, Artificial Sequence
  chemically synthesized
catagatatactattctagaat

SEQ ID NO: 1160532 - DNA, 22 bp, Artificial Sequence
  chemically synthesized
atagatatactattctagaata

SEQ ID NO: 1160533 - DNA, 22 bp, Artificial Sequence
  chemically synthesized
aaggaaaagacttttattctag

SEQ ID NO: 1160534 - DNA, 22 bp, Artificial Sequence
  chemically synthesized
aagtgctgaaggaaaagacttt

SEQ ID NO: 1160535 - DNA, 22 bp, Artificial Sequence
  chemically synthesized
aaagtgctgaaggaaaagactt

SEQ ID NO: 1160536 - DNA, 22 bp, Artificial Sequence
  chemically synthesized
ttctagaataaaagtcttttcc

SEQ ID NO: 1160537 - DNA, 22 bp, Artificial Sequence
  chemically synthesized
tagaataaaagtcttttccttc

SEQ ID NO: 1160538 - DNA, 22 bp, Artificial Sequence
  chemically synthesized
gaataaaagtcttttccttcag

SEQ ID NO: 1160539 - DNA, 22 bp, Artificial Sequence
  chemically synthesized
ttccttcagcactttaaatgta

SEQ ID NO: 1160540 - DNA, 22 bp, Artificial Sequence
  chemically synthesized
tccttcagcactttaaatgtat

SEQ ID NO: 1160541 - DNA, 22 bp, Artificial Sequence
  chemically synthesized
ccttcagcactttaaatgtatc

SEQ ID NO: 1160542 - DNA, 22 bp, Artificial Sequence
  chemically synthesized
cttcagcactttaaatgtatca

SEQ ID NO: 1160543 - DNA, 22 bp, Artificial Sequence
  chemically synthesized
cagcactttaaatgtatcatgc

SEQ ID NO: 1160544 - DNA, 22 bp, Artificial Sequence
  chemically synthesized
agcactttaaatgtatcatgcc

SEQ ID NO: 1160545 - DNA, 22 bp, Artificial Sequence
  chemically synthesized
caggccaggagagtggcatgat

SEQ ID NO: 1160546 - DNA, 22 bp, Artificial Sequence
  chemically synthesized
ccaggccaggagagtggcatga

SEQ ID NO: 1160547 - DNA, 22 bp, Artificial Sequence
  chemically synthesized
taaatgtatcatgccactctcc

SEQ ID NO: 1160548 - DNA, 22 bp, Artificial Sequence
  chemically synthesized
aaatgtatcatgccactctcct

SEQ ID NO: 1160549 - DNA, 22 bp, Artificial Sequence
  chemically synthesized
aatgtatcatgccactctcctg

SEQ ID NO: 1160550 - DNA, 22 bp, Artificial Sequence
  chemically synthesized
agtggaaaacttccaggccagg

SEQ ID NO: 1160551 - DNA, 22 bp, Artificial Sequence
  chemically synthesized
cagtggaaaacttccaggccag

SEQ ID NO: 1160552 - DNA, 22 bp, Artificial Sequence
  chemically synthesized
tcagtggaaaacttccaggcca

SEQ ID NO: 1160553 - DNA, 22 bp, Artificial Sequence
  chemically synthesized
tcctggcctggaagttttccac

SEQ ID NO: 1160554 - DNA, 22 bp, Artificial Sequence
  chemically synthesized
ctggcctggaagttttccactg

SEQ ID NO: 1160555 - DNA, 22 bp, Artificial Sequence
  chemically synthesized
gcagcacaattttcagtggaaa

SEQ ID NO: 1160556 - DNA, 22 bp, Artificial Sequence
  chemically synthesized
gcctggaagttttccactgaaa

SEQ ID NO: 1160557 - DNA, 22 bp, Artificial Sequence
  chemically synthesized
gaagttttccactgaaaattgt

SEQ ID NO: 1160558 - DNA, 22 bp, Artificial Sequence
  chemically synthesized
cagtatgtctggcagcacaatt

SEQ ID NO: 1160559 - DNA, 22 bp, Artificial Sequence
  chemically synthesized
tccactgaaaattgtgctgcca

SEQ ID NO: 1160560 - DNA, 22 bp, Artificial Sequence
  chemically synthesized
ccactgaaaattgtgctgccag

SEQ ID NO: 1160561 - DNA, 22 bp, Artificial Sequence
  chemically synthesized
cactgaaaattgtgctgccaga

SEQ ID NO: 1160562 - DNA, 22 bp, Artificial Sequence
  chemically synthesized
aaaattgtgctgccagacatac

SEQ ID NO: 1160563 - DNA, 22 bp, Artificial Sequence
  chemically synthesized
tgctgccagacatactggagct

SEQ ID NO: 1160564 - DNA, 22 bp, Artificial Sequence
  chemically synthesized
ccagacatactggagctatttc

SEQ ID NO: 1160565 - DNA, 22 bp, Artificial Sequence
  chemically synthesized
gagctatttctatgtgattttt

SEQ ID NO: 1160566 - DNA, 22 bp, Artificial Sequence
  chemically synthesized
tttctatgtgattttttttttt

SEQ ID NO: 1160567 - DNA, 22 bp, Artificial Sequence
  chemically synthesized
ctatgtgatttttttttttata

SEQ ID NO: 1160568 - DNA, 22 bp, Artificial Sequence
  chemically synthesized
tatgtgatttttttttttatat

SEQ ID NO: 1160569 - DNA, 22 bp, Artificial Sequence
  chemically synthesized
aaagcggtaatcatataaaaaa

SEQ ID NO: 1160570 - DNA, 22 bp, Artificial Sequence
  chemically synthesized
aaaagcggtaatcatataaaaa

SEQ ID NO: 1160571 - DNA, 22 bp, Artificial Sequence
  chemically synthesized
tgtgatttttttttttatatga

SEQ ID NO: 1160572 - DNA, 22 bp, Artificial Sequence
  chemically synthesized
ttttttttatatgattaccgct

SEQ ID NO: 1160573 - DNA, 22 bp, Artificial Sequence
  chemically synthesized
tttttttatatgattaccgctt

SEQ ID NO: 1160574 - DNA, 22 bp, Artificial Sequence
  chemically synthesized
ttttttatatgattaccgcttt

SEQ ID NO: 1160575 - DNA, 22 bp, Artificial Sequence
  chemically synthesized
tttttatatgattaccgctttt

SEQ ID NO: 1160576 - DNA, 22 bp, Artificial Sequence
  chemically synthesized
ttttatatgattaccgctttta

SEQ ID NO: 1160577 - DNA, 22 bp, Artificial Sequence
  chemically synthesized
tttatatgattaccgcttttaa

SEQ ID NO: 1160578 - DNA, 22 bp, Artificial Sequence
  chemically synthesized
ttatatgattaccgcttttaag

SEQ ID NO: 1160579 - DNA, 22 bp, Artificial Sequence
  chemically synthesized
tatatgattaccgcttttaaga

SEQ ID NO: 1160580 - DNA, 22 bp, Artificial Sequence
  chemically synthesized
atatgattaccgcttttaagat

SEQ ID NO: 1160581 - DNA, 22 bp, Artificial Sequence
  chemically synthesized
tatgattaccgcttttaagatc

SEQ ID NO: 1160582 - DNA, 22 bp, Artificial Sequence
  chemically synthesized
ccgcttttaagatcttttcttt

SEQ ID NO: 1160583 - DNA, 22 bp, Artificial Sequence
  chemically synthesized
caaaggtcaaggataaagaaaa

SEQ ID NO: 1160584 - DNA, 22 bp, Artificial Sequence
  chemically synthesized
ccaaaggtcaaggataaagaaa

SEQ ID NO: 1160585 - DNA, 22 bp, Artificial Sequence
  chemically synthesized
ttaagatcttttctttatcctt

SEQ ID NO: 1160586 - DNA, 22 bp, Artificial Sequence
  chemically synthesized
taagatcttttctttatccttg

SEQ ID NO: 1160587 - DNA, 22 bp, Artificial Sequence
  chemically synthesized
aagatcttttctttatccttga

SEQ ID NO: 1160588 - DNA, 22 bp, Artificial Sequence
  chemically synthesized
agatcttttctttatccttgac

SEQ ID NO: 1160589 - DNA, 22 bp, Artificial Sequence
  chemically synthesized
aaaatcaaacttccaaaggtca

SEQ ID NO: 1160590 - DNA, 22 bp, Artificial Sequence
  chemically synthesized
ttctttatccttgacctttgga

SEQ ID NO: 1160591 - DNA, 22 bp, Artificial Sequence
  chemically synthesized
aaaaatcaaacttccaaaggtc

SEQ ID NO: 1160592 - DNA, 22 bp, Artificial Sequence
  chemically synthesized
tctttatccttgacctttggaa

SEQ ID NO: 1160593 - DNA, 22 bp, Artificial Sequence
  chemically synthesized
ctttatccttgacctttggaag

SEQ ID NO: 1160594 - DNA, 22 bp, Artificial Sequence
  chemically synthesized
tttatccttgacctttggaagt

SEQ ID NO: 1160595 - DNA, 22 bp, Artificial Sequence
  chemically synthesized
tatccttgacctttggaagttt

SEQ ID NO: 1160596 - DNA, 22 bp, Artificial Sequence
  chemically synthesized
atccttgacctttggaagtttg

SEQ ID NO: 1160597 - DNA, 22 bp, Artificial Sequence
  chemically synthesized
tccttgacctttggaagtttga

SEQ ID NO: 1160598 - DNA, 22 bp, Artificial Sequence
  chemically synthesized
agggcatttaaaaatcaaactt

SEQ ID NO: 1160599 - DNA, 22 bp, Artificial Sequence
  chemically synthesized
gacctttggaagtttgattttt

SEQ ID NO: 1160600 - DNA, 22 bp, Artificial Sequence
  chemically synthesized
acctttggaagtttgattttta

SEQ ID NO: 1160601 - DNA, 22 bp, Artificial Sequence
  chemically synthesized
cctcagggcatttaaaaatcaa

SEQ ID NO: 1160602 - DNA, 22 bp, Artificial Sequence
  chemically synthesized
tggaagtttgatttttaaatgc

SEQ ID NO: 1160603 - DNA, 22 bp, Artificial Sequence
  chemically synthesized
ggaagtttgatttttaaatgcc

SEQ ID NO: 1160604 - DNA, 22 bp, Artificial Sequence
  chemically synthesized
gaagtttgatttttaaatgccc

SEQ ID NO: 1160605 - DNA, 22 bp, Artificial Sequence
  chemically synthesized
gatttttaaatgccctgaggta

SEQ ID NO: 1160606 - DNA, 22 bp, Artificial Sequence
  chemically synthesized
atttttaaatgccctgaggtag

SEQ ID NO: 1160607 - DNA, 22 bp, Artificial Sequence
  chemically synthesized
ttaaatgccctgaggtagtctt

SEQ ID NO: 1160608 - DNA, 22 bp, Artificial Sequence
  chemically synthesized
taaatgccctgaggtagtctta

SEQ ID NO: 1160609 - DNA, 22 bp, Artificial Sequence
  chemically synthesized
aaatgccctgaggtagtcttat

SEQ ID NO: 1160610 - DNA, 22 bp, Artificial Sequence
  chemically synthesized
aatgccctgaggtagtcttatt

SEQ ID NO: 1160611 - DNA, 22 bp, Artificial Sequence
  chemically synthesized
aggtagtcttatttatattata

SEQ ID NO: 1160612 - DNA, 22 bp, Artificial Sequence
  chemically synthesized
atttatattatatctccttggt

SEQ ID NO: 1160613 - DNA, 22 bp, Artificial Sequence
  chemically synthesized
tttatattatatctccttggtg

SEQ ID NO: 1160614 - DNA, 22 bp, Artificial Sequence
  chemically synthesized
atattatatctccttggtgttc

SEQ ID NO: 1160615 - DNA, 22 bp, Artificial Sequence
  chemically synthesized
tattatatctccttggtgttct

SEQ ID NO: 1160616 - DNA, 22 bp, Artificial Sequence
  chemically synthesized
tatctccttggtgttctattat

SEQ ID NO: 1160617 - DNA, 22 bp, Artificial Sequence
  chemically synthesized
aagtacaagaagataatagaac

SEQ ID NO: 1160618 - DNA, 22 bp, Artificial Sequence
  chemically synthesized
cttggtgttctattatcttctt

SEQ ID NO: 1160619 - DNA, 22 bp, Artificial Sequence
  chemically synthesized
aaattcaagtacaagaagataa

SEQ ID NO: 1160620 - DNA, 22 bp, Artificial Sequence
  chemically synthesized
ggtgttctattatcttcttgta

SEQ ID NO: 1160621 - DNA, 22 bp, Artificial Sequence
  chemically synthesized
gtgttctattatcttcttgtac

SEQ ID NO: 1160622 - DNA, 22 bp, Artificial Sequence
  chemically synthesized
tattatcttcttgtacttgaat

SEQ ID NO: 1160623 - DNA, 22 bp, Artificial Sequence
  chemically synthesized
ttatcttcttgtacttgaattt

SEQ ID NO: 1160624 - DNA, 22 bp, Artificial Sequence
  chemically synthesized
gagagagagattaaaattcaag

SEQ ID NO: 1160625 - DNA, 22 bp, Artificial Sequence
  chemically synthesized
tcttcttgtacttgaattttaa

SEQ ID NO: 1160626 - DNA, 22 bp, Artificial Sequence
  chemically synthesized
cttgtacttgaattttaatctc

SEQ ID NO: 1160627 - DNA, 22 bp, Artificial Sequence
  chemically synthesized
ttgtacttgaattttaatctct

SEQ ID NO: 1160628 - DNA, 22 bp, Artificial Sequence
  chemically synthesized
gtacttgaattttaatctctct

SEQ ID NO: 1160629 - DNA, 22 bp, Artificial Sequence
  chemically synthesized
ccccacctagagagagagatta

SEQ ID NO: 1160630 - DNA, 22 bp, Artificial Sequence
  chemically synthesized
tacttgaattttaatctctctc

SEQ ID NO: 1160631 - DNA, 22 bp, Artificial Sequence
  chemically synthesized
cccccacctagagagagagatt

SEQ ID NO: 1160632 - DNA, 22 bp, Artificial Sequence
  chemically synthesized
gaattttaatctctctctctag

SEQ ID NO: 1160633 - DNA, 22 bp, Artificial Sequence
  chemically synthesized
aattttaatctctctctctagg

SEQ ID NO: 1160634 - DNA, 22 bp, Artificial Sequence
  chemically synthesized
taatctctctctctaggtgggg

SEQ ID NO: 1160635 - DNA, 22 bp, Artificial Sequence
  chemically synthesized
aatctctctctctaggtggggg

SEQ ID NO: 1160636 - DNA, 22 bp, Artificial Sequence
  chemically synthesized
atctctctctctaggtggggga

SEQ ID NO: 1160637 - DNA, 22 bp, Artificial Sequence
  chemically synthesized
tctctctaggtgggggaagttc

SEQ ID NO: 1160638 - DNA, 22 bp, Artificial Sequence
  chemically synthesized
tctctaggtgggggaagttctg

SEQ ID NO: 1160639 - DNA, 22 bp, Artificial Sequence
  chemically synthesized
tctaggtgggggaagttctgtg

SEQ ID NO: 1160640 - DNA, 22 bp, Artificial Sequence
  chemically synthesized
aagagggtaataacacagaact

SEQ ID NO: 1160641 - DNA, 22 bp, Artificial Sequence
  chemically synthesized
taggtgggggaagttctgtgtt

SEQ ID NO: 1160642 - DNA, 22 bp, Artificial Sequence
  chemically synthesized
ggtgggggaagttctgtgttat

SEQ ID NO: 1160643 - DNA, 22 bp, Artificial Sequence
  chemically synthesized
ttgaagagggtaataacacaga

SEQ ID NO: 1160644 - DNA, 22 bp, Artificial Sequence
  chemically synthesized
attgaagagggtaataacacag

SEQ ID NO: 1160645 - DNA, 22 bp, Artificial Sequence
  chemically synthesized
aaaagtttattgaagagggtaa

SEQ ID NO: 1160646 - DNA, 22 bp, Artificial Sequence
  chemically synthesized
tgtgttattaccctcttcaata

SEQ ID NO: 1160647 - DNA, 22 bp, Artificial Sequence
  chemically synthesized
tgttattaccctcttcaataaa

SEQ ID NO: 1160648 - DNA, 22 bp, Artificial Sequence
  chemically synthesized
ttaccctcttcaataaactttt

SEQ ID NO: 1160649 - DNA, 22 bp, Artificial Sequence
  chemically synthesized
ccctcttcaataaactttttag

SEQ ID NO: 1160650 - DNA, 22 bp, Artificial Sequence
  chemically synthesized
ttcaataaactttttaggactt

SEQ ID NO: 1160651 - DNA, 22 bp, Artificial Sequence
  chemically synthesized
caataaactttttaggactttt

SEQ ID NO: 1160652 - DNA, 22 bp, Artificial Sequence
  chemically synthesized
aataaactttttaggacttttt

SEQ ID NO: 1160653 - DNA, 22 bp, Artificial Sequence
  chemically synthesized
tttaggacttttttgtctcctc

SEQ ID NO: 1160654 - DNA, 22 bp, Artificial Sequence
  chemically synthesized
taaatacagtcagaggagacaa

SEQ ID NO: 1160655 - DNA, 22 bp, Artificial Sequence
  chemically synthesized
ttaggacttttttgtctcctct

SEQ ID NO: 1160656 - DNA, 22 bp, Artificial Sequence
  chemically synthesized
gtaaatacagtcagaggagaca

SEQ ID NO: 1160657 - DNA, 22 bp, Artificial Sequence
  chemically synthesized
taggacttttttgtctcctctg

SEQ ID NO: 1160658 - DNA, 22 bp, Artificial Sequence
  chemically synthesized
aggacttttttgtctcctctga

SEQ ID NO: 1160659 - DNA, 22 bp, Artificial Sequence
  chemically synthesized
ggacttttttgtctcctctgac

SEQ ID NO: 1160660 - DNA, 22 bp, Artificial Sequence
  chemically synthesized
tttgtaaatacagtcagaggag

SEQ ID NO: 1160661 - DNA, 22 bp, Artificial Sequence
  chemically synthesized
ttttgtctcctctgactgtatt

SEQ ID NO: 1160662 - DNA, 22 bp, Artificial Sequence
  chemically synthesized
tttgtctcctctgactgtattt

SEQ ID NO: 1160663 - DNA, 22 bp, Artificial Sequence
  chemically synthesized
ttgtctcctctgactgtattta

SEQ ID NO: 1160664 - DNA, 22 bp, Artificial Sequence
  chemically synthesized
tgtctcctctgactgtatttac

SEQ ID NO: 1160665 - DNA, 22 bp, Artificial Sequence
  chemically synthesized
gtctcctctgactgtatttaca

SEQ ID NO: 1160666 - DNA, 22 bp, Artificial Sequence
  chemically synthesized
tctcctctgactgtatttacaa

SEQ ID NO: 1160667 - DNA, 22 bp, Artificial Sequence
  chemically synthesized
aagacaagctatttgtaaatac

SEQ ID NO: 1160668 - DNA, 22 bp, Artificial Sequence
  chemically synthesized
gaagacaagctatttgtaaata

SEQ ID NO: 1160669 - DNA, 22 bp, Artificial Sequence
  chemically synthesized
ctctgactgtatttacaaatag

SEQ ID NO: 1160670 - DNA, 22 bp, Artificial Sequence
  chemically synthesized
gcttgaagacaagctatttgta

SEQ ID NO: 1160671 - DNA, 22 bp, Artificial Sequence
  chemically synthesized
tgactgtatttacaaatagctt

SEQ ID NO: 1160672 - DNA, 22 bp, Artificial Sequence
  chemically synthesized
actgtatttacaaatagcttgt

SEQ ID NO: 1160673 - DNA, 22 bp, Artificial Sequence
  chemically synthesized
tatttacaaatagcttgtcttc

SEQ ID NO: 1160674 - DNA, 22 bp, Artificial Sequence
  chemically synthesized
acaaatagcttgtcttcaagct

SEQ ID NO: 1160675 - DNA, 22 bp, Artificial Sequence
  chemically synthesized
caaatagcttgtcttcaagcta

SEQ ID NO: 1160676 - DNA, 22 bp, Artificial Sequence
  chemically synthesized
atcaagcaggagaaagaattag

SEQ ID NO: 1160677 - DNA, 22 bp, Artificial Sequence
  chemically synthesized
gtcttcaagctaattctttctc

SEQ ID NO: 1160678 - DNA, 22 bp, Artificial Sequence
  chemically synthesized
tcttcaagctaattctttctcc

SEQ ID NO: 1160679 - DNA, 22 bp, Artificial Sequence
  chemically synthesized
caagctaattctttctcctgct

SEQ ID NO: 1160680 - DNA, 22 bp, Artificial Sequence
  chemically synthesized
aagctaattctttctcctgctt

SEQ ID NO: 1160681 - DNA, 22 bp, Artificial Sequence
  chemically synthesized
attctttctcctgcttgatcaa

SEQ ID NO: 1160682 - DNA, 22 bp, Artificial Sequence
  chemically synthesized
tttctcctgcttgatcaattct

SEQ ID NO: 1160683 - DNA, 22 bp, Artificial Sequence
  chemically synthesized
tctcctgcttgatcaattcttc

SEQ ID NO: 1160684 - DNA, 22 bp, Artificial Sequence
  chemically synthesized
ctcctgcttgatcaattcttct

SEQ ID NO: 1160685 - DNA, 22 bp, Artificial Sequence
  chemically synthesized
tcctgcttgatcaattcttctg

SEQ ID NO: 1160686 - DNA, 22 bp, Artificial Sequence
  chemically synthesized
ctgcttgatcaattcttctgtt

SEQ ID NO: 1160687 - DNA, 22 bp, Artificial Sequence
  chemically synthesized
cttgatcaattcttctgttact

SEQ ID NO: 1160688 - DNA, 22 bp, Artificial Sequence
  chemically synthesized
gatcaattcttctgttactcgt

SEQ ID NO: 1160689 - DNA, 22 bp, Artificial Sequence
  chemically synthesized
atcaattcttctgttactcgtc

SEQ ID NO: 1160690 - DNA, 22 bp, Artificial Sequence
  chemically synthesized
aagaatgcgtcagagacgagta

SEQ ID NO: 1160691 - DNA, 22 bp, Artificial Sequence
  chemically synthesized
ttctgttactcgtctctgacgc

SEQ ID NO: 1160692 - DNA, 22 bp, Artificial Sequence
  chemically synthesized
ctgttactcgtctctgacgcat

SEQ ID NO: 1160693 - DNA, 22 bp, Artificial Sequence
  chemically synthesized
acatactgaagaatgcgtcaga

SEQ ID NO: 1160694 - DNA, 22 bp, Artificial Sequence
  chemically synthesized
tgttactcgtctctgacgcatt

SEQ ID NO: 1160695 - DNA, 22 bp, Artificial Sequence
  chemically synthesized
ttactcgtctctgacgcattct

SEQ ID NO: 1160696 - DNA, 22 bp, Artificial Sequence
  chemically synthesized
actgacatactgaagaatgcgt

SEQ ID NO: 1160697 - DNA, 22 bp, Artificial Sequence
  chemically synthesized
aactgacatactgaagaatgcg

SEQ ID NO: 1160698 - DNA, 22 bp, Artificial Sequence
  chemically synthesized
ctcgtctctgacgcattcttca

SEQ ID NO: 1160699 - DNA, 22 bp, Artificial Sequence
  chemically synthesized
gtctctgacgcattcttcagta

SEQ ID NO: 1160700 - DNA, 22 bp, Artificial Sequence
  chemically synthesized
aaagatttaactgacatactga

SEQ ID NO: 1160701 - DNA, 22 bp, Artificial Sequence
  chemically synthesized
tgacgcattcttcagtatgtca

SEQ ID NO: 1160702 - DNA, 22 bp, Artificial Sequence
  chemically synthesized
acgcattcttcagtatgtcagt

SEQ ID NO: 1160703 - DNA, 22 bp, Artificial Sequence
  chemically synthesized
gagttgaaagatttaactgaca

SEQ ID NO: 1160704 - DNA, 22 bp, Artificial Sequence
  chemically synthesized
tggagttgaaagatttaactga

SEQ ID NO: 1160705 - DNA, 22 bp, Artificial Sequence
  chemically synthesized
ttcagtatgtcagttaaatctt

SEQ ID NO: 1160706 - DNA, 22 bp, Artificial Sequence
  chemically synthesized
cagtatgtcagttaaatctttc

SEQ ID NO: 1160707 - DNA, 22 bp, Artificial Sequence
  chemically synthesized
agtatgtcagttaaatctttca

SEQ ID NO: 1160708 - DNA, 22 bp, Artificial Sequence
  chemically synthesized
aatctttcaactccagaatttt

SEQ ID NO: 1160709 - DNA, 22 bp, Artificial Sequence
  chemically synthesized
tcaactccagaatttttgttcg

SEQ ID NO: 1160710 - DNA, 22 bp, Artificial Sequence
  chemically synthesized
caactccagaatttttgttcga

SEQ ID NO: 1160711 - DNA, 22 bp, Artificial Sequence
  chemically synthesized
aaataaaaagaatcgaacaaaa

SEQ ID NO: 1160712 - DNA, 22 bp, Artificial Sequence
  chemically synthesized
aactccagaatttttgttcgat

SEQ ID NO: 1160713 - DNA, 22 bp, Artificial Sequence
  chemically synthesized
cagaatttttgttcgattcttt

SEQ ID NO: 1160714 - DNA, 22 bp, Artificial Sequence
  chemically synthesized
acaaagggattgaaataaaaag

SEQ ID NO: 1160715 - DNA, 22 bp, Artificial Sequence
  chemically synthesized
aacaaagggattgaaataaaaa

SEQ ID NO: 1160716 - DNA, 22 bp, Artificial Sequence
  chemically synthesized
ttgttcgattctttttatttca

SEQ ID NO: 1160717 - DNA, 22 bp, Artificial Sequence
  chemically synthesized
tgttcgattctttttatttcaa

SEQ ID NO: 1160718 - DNA, 22 bp, Artificial Sequence
  chemically synthesized
gttcgattctttttatttcaat

SEQ ID NO: 1160719 - DNA, 22 bp, Artificial Sequence
  chemically synthesized
ttcgattctttttatttcaatc

SEQ ID NO: 1160720 - DNA, 22 bp, Artificial Sequence
  chemically synthesized
gattctttttatttcaatccct

SEQ ID NO: 1160721 - DNA, 22 bp, Artificial Sequence
  chemically synthesized
cacataaatttaacaaagggat

SEQ ID NO: 1160722 - DNA, 22 bp, Artificial Sequence
  chemically synthesized
tttttatttcaatccctttgtt

SEQ ID NO: 1160723 - DNA, 22 bp, Artificial Sequence
  chemically synthesized
tttatttcaatccctttgttaa

SEQ ID NO: 1160724 - DNA, 22 bp, Artificial Sequence
  chemically synthesized
ttatttcaatccctttgttaaa

SEQ ID NO: 1160725 - DNA, 22 bp, Artificial Sequence
  chemically synthesized
tatttcaatccctttgttaaat

SEQ ID NO: 1160726 - DNA, 22 bp, Artificial Sequence
  chemically synthesized
atttcaatccctttgttaaatt

SEQ ID NO: 1160727 - DNA, 22 bp, Artificial Sequence
  chemically synthesized
tttcaatccctttgttaaattt

SEQ ID NO: 1160728 - DNA, 22 bp, Artificial Sequence
  chemically synthesized
agaatcctacacataaatttaa

SEQ ID NO: 1160729 - DNA, 22 bp, Artificial Sequence
  chemically synthesized
caatccctttgttaaatttatg

SEQ ID NO: 1160730 - DNA, 22 bp, Artificial Sequence
  chemically synthesized
aatccctttgttaaatttatgt

SEQ ID NO: 1160731 - DNA, 22 bp, Artificial Sequence
  chemically synthesized
tgttaaatttatgtgtaggatt

SEQ ID NO: 1160732 - DNA, 22 bp, Artificial Sequence
  chemically synthesized
gttaaatttatgtgtaggattc

SEQ ID NO: 1160733 - DNA, 22 bp, Artificial Sequence
  chemically synthesized
ttaaatttatgtgtaggattct

SEQ ID NO: 1160734 - DNA, 22 bp, Artificial Sequence
  chemically synthesized
aatttatgtgtaggattctgaa

SEQ ID NO: 1160735 - DNA, 22 bp, Artificial Sequence
  chemically synthesized
atgtgtaggattctgaattcct

SEQ ID NO: 1160736 - DNA, 22 bp, Artificial Sequence
  chemically synthesized
tgtgtaggattctgaattcctt

SEQ ID NO: 1160737 - DNA, 22 bp, Artificial Sequence
  chemically synthesized
tgaattccttctctgtactatc

SEQ ID NO: 1160738 - DNA, 22 bp, Artificial Sequence
  chemically synthesized
aataaaatccaagatagtacag

SEQ ID NO: 1160739 - DNA, 22 bp, Artificial Sequence
  chemically synthesized
aattccttctctgtactatctt

SEQ ID NO: 1160740 - DNA, 22 bp, Artificial Sequence
  chemically synthesized
cttctctgtactatcttggatt

SEQ ID NO: 1160741 - DNA, 22 bp, Artificial Sequence
  chemically synthesized
aggatgctcaataaaatccaag

SEQ ID NO: 1160742 - DNA, 22 bp, Artificial Sequence
  chemically synthesized
ctctgtactatcttggatttta

SEQ ID NO: 1160743 - DNA, 22 bp, Artificial Sequence
  chemically synthesized
gaggatgctcaataaaatccaa

SEQ ID NO: 1160744 - DNA, 22 bp, Artificial Sequence
  chemically synthesized
tctgtactatcttggattttat

SEQ ID NO: 1160745 - DNA, 22 bp, Artificial Sequence
  chemically synthesized
tgtactatcttggattttattg

SEQ ID NO: 1160746 - DNA, 22 bp, Artificial Sequence
  chemically synthesized
atttgaggatgctcaataaaat

SEQ ID NO: 1160747 - DNA, 22 bp, Artificial Sequence
  chemically synthesized
tactatcttggattttattgag

SEQ ID NO: 1160748 - DNA, 22 bp, Artificial Sequence
  chemically synthesized
tcttggattttattgagcatcc

SEQ ID NO: 1160749 - DNA, 22 bp, Artificial Sequence
  chemically synthesized
ggattttattgagcatcctcaa

SEQ ID NO: 1160750 - DNA, 22 bp, Artificial Sequence
  chemically synthesized
caaatggctgatttgaggatgc

SEQ ID NO: 1160751 - DNA, 22 bp, Artificial Sequence
  chemically synthesized
gattttattgagcatcctcaaa

SEQ ID NO: 1160752 - DNA, 22 bp, Artificial Sequence
  chemically synthesized
tattgagcatcctcaaatcagc

SEQ ID NO: 1160753 - DNA, 22 bp, Artificial Sequence
  chemically synthesized
attgagcatcctcaaatcagcc

SEQ ID NO: 1160754 - DNA, 22 bp, Artificial Sequence
  chemically synthesized
ttgagcatcctcaaatcagcca

SEQ ID NO: 1160755 - DNA, 22 bp, Artificial Sequence
  chemically synthesized
agcatcctcaaatcagccattt

SEQ ID NO: 1160756 - DNA, 22 bp, Artificial Sequence
  chemically synthesized
agacagagaattccaaatggct

SEQ ID NO: 1160757 - DNA, 22 bp, Artificial Sequence
  chemically synthesized
cagacagagaattccaaatggc

SEQ ID NO: 1160758 - DNA, 22 bp, Artificial Sequence
  chemically synthesized
tcagacagagaattccaaatgg

SEQ ID NO: 1160759 - DNA, 22 bp, Artificial Sequence
  chemically synthesized
aaatcagccatttggaattctc

SEQ ID NO: 1160760 - DNA, 22 bp, Artificial Sequence
  chemically synthesized
ggaattctctgtctgaaaggtc

SEQ ID NO: 1160761 - DNA, 22 bp, Artificial Sequence
  chemically synthesized
gaattctctgtctgaaaggtca

SEQ ID NO: 1160762 - DNA, 22 bp, Artificial Sequence
  chemically synthesized
gagagacagatatgtgaccttt

SEQ ID NO: 1160763 - DNA, 22 bp, Artificial Sequence
  chemically synthesized
ggagagacagatatgtgacctt

SEQ ID NO: 1160764 - DNA, 22 bp, Artificial Sequence
  chemically synthesized
tctgtctgaaaggtcacatatc

SEQ ID NO: 1160765 - DNA, 22 bp, Artificial Sequence
  chemically synthesized
tgtctgaaaggtcacatatctg

SEQ ID NO: 1160766 - DNA, 22 bp, Artificial Sequence
  chemically synthesized
tctgaaaggtcacatatctgtc

SEQ ID NO: 1160767 - DNA, 22 bp, Artificial Sequence
  chemically synthesized
accaatcttggagagacagata

SEQ ID NO: 1160768 - DNA, 22 bp, Artificial Sequence
  chemically synthesized
aaaggtcacatatctgtctctc

SEQ ID NO: 1160769 - DNA, 22 bp, Artificial Sequence
  chemically synthesized
aataaggcatcgctgaccaatc

SEQ ID NO: 1160770 - DNA, 22 bp, Artificial Sequence
  chemically synthesized
tctctccaagattggtcagcga

SEQ ID NO: 1160771 - DNA, 22 bp, Artificial Sequence
  chemically synthesized
aactaaataaggcatcgctgac

SEQ ID NO: 1160772 - DNA, 22 bp, Artificial Sequence
  chemically synthesized
tccaagattggtcagcgatgcc

SEQ ID NO: 1160773 - DNA, 22 bp, Artificial Sequence
  chemically synthesized
caagattggtcagcgatgcctt

SEQ ID NO: 1160774 - DNA, 22 bp, Artificial Sequence
  chemically synthesized
accaactgaactaaataaggca

SEQ ID NO: 1160775 - DNA, 22 bp, Artificial Sequence
  chemically synthesized
gtcagcgatgccttatttagtt

SEQ ID NO: 1160776 - DNA, 22 bp, Artificial Sequence
  chemically synthesized
atttagttcagttggtgagatc

SEQ ID NO: 1160777 - DNA, 22 bp, Artificial Sequence
  chemically synthesized
tttagttcagttggtgagatca

SEQ ID NO: 1160778 - DNA, 22 bp, Artificial Sequence
  chemically synthesized
agttcagttggtgagatcatgt

SEQ ID NO: 1160779 - DNA, 22 bp, Artificial Sequence
  chemically synthesized
gttcagttggtgagatcatgtt

SEQ ID NO: 1160780 - DNA, 22 bp, Artificial Sequence
  chemically synthesized
agttggtgagatcatgttttct

SEQ ID NO: 1160781 - DNA, 22 bp, Artificial Sequence
  chemically synthesized
gtgagatcatgttttcttggat

SEQ ID NO: 1160782 - DNA, 22 bp, Artificial Sequence
  chemically synthesized
atgaacatccggaagcatcaag

SEQ ID NO: 1160783 - DNA, 22 bp, Artificial Sequence
  chemically synthesized
tcttggatggtcttgatgcttc

SEQ ID NO: 1160784 - DNA, 22 bp, Artificial Sequence
  chemically synthesized
cttggatggtcttgatgcttcc

SEQ ID NO: 1160785 - DNA, 22 bp, Artificial Sequence
  chemically synthesized
ttggatggtcttgatgcttccg

SEQ ID NO: 1160786 - DNA, 22 bp, Artificial Sequence
  chemically synthesized
ggatggtcttgatgcttccgga

SEQ ID NO: 1160787 - DNA, 22 bp, Artificial Sequence
  chemically synthesized
gatggtcttgatgcttccggat

SEQ ID NO: 1160788 - DNA, 22 bp, Artificial Sequence
  chemically synthesized
gatgcttccggatgttcatcaa

SEQ ID NO: 1160789 - DNA, 22 bp, Artificial Sequence
  chemically synthesized
aatgcccagacattgatgaaca

SEQ ID NO: 1160790 - DNA, 22 bp, Artificial Sequence
  chemically synthesized
atgcttccggatgttcatcaat

SEQ ID NO: 1160791 - DNA, 22 bp, Artificial Sequence
  chemically synthesized
caatgcccagacattgatgaac

SEQ ID NO: 1160792 - DNA, 22 bp, Artificial Sequence
  chemically synthesized
ccggatgttcatcaatgtctgg

SEQ ID NO: 1160793 - DNA, 22 bp, Artificial Sequence
  chemically synthesized
cggatgttcatcaatgtctggg

SEQ ID NO: 1160794 - DNA, 22 bp, Artificial Sequence
  chemically synthesized
atcaatgtctgggcattgaaga

SEQ ID NO: 1160795 - DNA, 22 bp, Artificial Sequence
  chemically synthesized
caataaataccaaagtcttcaa

SEQ ID NO: 1160796 - DNA, 22 bp, Artificial Sequence
  chemically synthesized
ggcattgaagactttggtattt

SEQ ID NO: 1160797 - DNA, 22 bp, Artificial Sequence
  chemically synthesized
caaagactacaataaataccaa

SEQ ID NO: 1160798 - DNA, 22 bp, Artificial Sequence
  chemically synthesized
aagactttggtatttattgtag

SEQ ID NO: 1160799 - DNA, 22 bp, Artificial Sequence
  chemically synthesized
tggtatttattgtagtctttgc

SEQ ID NO: 1160800 - DNA, 22 bp, Artificial Sequence
  chemically synthesized
ggtatttattgtagtctttgca

SEQ ID NO: 1160801 - DNA, 22 bp, Artificial Sequence
  chemically synthesized
gtatttattgtagtctttgcag

SEQ ID NO: 1160802 - DNA, 22 bp, Artificial Sequence
  chemically synthesized
attgtagtctttgcagtatcgg

SEQ ID NO: 1160803 - DNA, 22 bp, Artificial Sequence
  chemically synthesized
ttgtagtctttgcagtatcggc

SEQ ID NO: 1160804 - DNA, 22 bp, Artificial Sequence
  chemically synthesized
tagtctttgcagtatcggcttg

SEQ ID NO: 1160805 - DNA, 22 bp, Artificial Sequence
  chemically synthesized
agaagtatggatacaaacaagc

SEQ ID NO: 1160806 - DNA, 22 bp, Artificial Sequence
  chemically synthesized
tgcagtatcggcttgtttgtat

SEQ ID NO: 1160807 - DNA, 22 bp, Artificial Sequence
  chemically synthesized
gcagtatcggcttgtttgtatc

SEQ ID NO: 1160808 - DNA, 22 bp, Artificial Sequence
  chemically synthesized
ctgagaagtatggatacaaaca

SEQ ID NO: 1160809 - DNA, 22 bp, Artificial Sequence
  chemically synthesized
cagtatcggcttgtttgtatcc

SEQ ID NO: 1160810 - DNA, 22 bp, Artificial Sequence
  chemically synthesized
gaaagccctcctgagaagtatg

SEQ ID NO: 1160811 - DNA, 22 bp, Artificial Sequence
  chemically synthesized
gtttgtatccatacttctcagg

SEQ ID NO: 1160812 - DNA, 22 bp, Artificial Sequence
  chemically synthesized
tttgtatccatacttctcagga

SEQ ID NO: 1160813 - DNA, 22 bp, Artificial Sequence
  chemically synthesized
gtatccatacttctcaggaggg

SEQ ID NO: 1160814 - DNA, 22 bp, Artificial Sequence
  chemically synthesized
tatccatacttctcaggagggc

SEQ ID NO: 1160815 - DNA, 22 bp, Artificial Sequence
  chemically synthesized
aatacctggaaagccctcctga

SEQ ID NO: 1160816 - DNA, 22 bp, Artificial Sequence
  chemically synthesized
aaatacctggaaagccctcctg

SEQ ID NO: 1160817 - DNA, 22 bp, Artificial Sequence
  chemically synthesized
taaatacctggaaagccctcct

SEQ ID NO: 1160818 - DNA, 22 bp, Artificial Sequence
  chemically synthesized
ctcaggagggctttccaggtat

SEQ ID NO: 1160819 - DNA, 22 bp, Artificial Sequence
  chemically synthesized
tcaggagggctttccaggtatt

SEQ ID NO: 1160820 - DNA, 22 bp, Artificial Sequence
  chemically synthesized
aggagggctttccaggtattta

SEQ ID NO: 1160821 - DNA, 22 bp, Artificial Sequence
  chemically synthesized
tccaggtatttaaaggttcttg

SEQ ID NO: 1160822 - DNA, 22 bp, Artificial Sequence
  chemically synthesized
ccaggtatttaaaggttcttgg

SEQ ID NO: 1160823 - DNA, 22 bp, Artificial Sequence
  chemically synthesized
caggtatttaaaggttcttggg

SEQ ID NO: 1160824 - DNA, 22 bp, Artificial Sequence
  chemically synthesized
aaaggttcttgggtgttgtgat

SEQ ID NO: 1160825 - DNA, 22 bp, Artificial Sequence
  chemically synthesized
aaggttcttgggtgttgtgatt

SEQ ID NO: 1160826 - DNA, 22 bp, Artificial Sequence
  chemically synthesized
cagtgaccaaaggaataaatca

SEQ ID NO: 1160827 - DNA, 22 bp, Artificial Sequence
  chemically synthesized
ttgggtgttgtgatttattcct

SEQ ID NO: 1160828 - DNA, 22 bp, Artificial Sequence
  chemically synthesized
gggtgttgtgatttattccttt

SEQ ID NO: 1160829 - DNA, 22 bp, Artificial Sequence
  chemically synthesized
ggtgttgtgatttattcctttg

SEQ ID NO: 1160830 - DNA, 22 bp, Artificial Sequence
  chemically synthesized
tgatttattcctttggtcactg

SEQ ID NO: 1160831 - DNA, 22 bp, Artificial Sequence
  chemically synthesized
attcctttggtcactgcagcca

SEQ ID NO: 1160832 - DNA, 22 bp, Artificial Sequence
  chemically synthesized
ttcctttggtcactgcagccat

SEQ ID NO: 1160833 - DNA, 22 bp, Artificial Sequence
  chemically synthesized
ctttggtcactgcagccatata

SEQ ID NO: 1160834 - DNA, 22 bp, Artificial Sequence
  chemically synthesized
tggtcactgcagccatatatgc

SEQ ID NO: 1160835 - DNA, 22 bp, Artificial Sequence
  chemically synthesized
ggtcactgcagccatatatgca

SEQ ID NO: 1160836 - DNA, 22 bp, Artificial Sequence
  chemically synthesized
ggtgcaccccagtgcatatatg

SEQ ID NO: 1160837 - DNA, 22 bp, Artificial Sequence
  chemically synthesized
gtcactgcagccatatatgcac

SEQ ID NO: 1160838 - DNA, 22 bp, Artificial Sequence
  chemically synthesized
gggtgcaccccagtgcatatat

SEQ ID NO: 1160839 - DNA, 22 bp, Artificial Sequence
  chemically synthesized
ggcttgggtgcaccccagtgca

SEQ ID NO: 1160840 - DNA, 22 bp, Artificial Sequence
  chemically synthesized
cagccatatatgcactggggtg

SEQ ID NO: 1160841 - DNA, 22 bp, Artificial Sequence
  chemically synthesized
ctgggcttgggtgcaccccagt

SEQ ID NO: 1160842 - DNA, 22 bp, Artificial Sequence
  chemically synthesized
gggtgcacccaagcccagtaat

SEQ ID NO: 1160843 - DNA, 22 bp, Artificial Sequence
  chemically synthesized
caagagtcacagcattactggg

SEQ ID NO: 1160844 - DNA, 22 bp, Artificial Sequence
  chemically synthesized
acagtctgcaagagtcacagca

SEQ ID NO: 1160845 - DNA, 22 bp, Artificial Sequence
  chemically synthesized
aacagtctgcaagagtcacagc

SEQ ID NO: 1160846 - DNA, 22 bp, Artificial Sequence
  chemically synthesized
tgactcttgcagactgttaaac

SEQ ID NO: 1160847 - DNA, 22 bp, Artificial Sequence
  chemically synthesized
ttgcagactgttaaacgtactg

SEQ ID NO: 1160848 - DNA, 22 bp, Artificial Sequence
  chemically synthesized
gcagactgttaaacgtactgcc

SEQ ID NO: 1160849 - DNA, 22 bp, Artificial Sequence
  chemically synthesized
cagactgttaaacgtactgcct

SEQ ID NO: 1160850 - DNA, 22 bp, Artificial Sequence
  chemically synthesized
ccaaagatcaccaaggcagtac

SEQ ID NO: 1160851 - DNA, 22 bp, Artificial Sequence
  chemically synthesized
cccaaagatcaccaaggcagta

SEQ ID NO: 1160852 - DNA, 22 bp, Artificial Sequence
  chemically synthesized
ttaaacgtactgccttggtgat

SEQ ID NO: 1160853 - DNA, 22 bp, Artificial Sequence
  chemically synthesized
aatcttcccaaagatcaccaag

SEQ ID NO: 1160854 - DNA, 22 bp, Artificial Sequence
  chemically synthesized
aacgtactgccttggtgatctt

SEQ ID NO: 1160855 - DNA, 22 bp, Artificial Sequence
  chemically synthesized
ctgaatcttcccaaagatcacc

SEQ ID NO: 1160856 - DNA, 22 bp, Artificial Sequence
  chemically synthesized
cctgaatcttcccaaagatcac

SEQ ID NO: 1160857 - DNA, 22 bp, Artificial Sequence
  chemically synthesized
tcctgaatcttcccaaagatca

SEQ ID NO: 1160858 - DNA, 22 bp, Artificial Sequence
  chemically synthesized
ccttggtgatctttgggaagat

SEQ ID NO: 1160859 - DNA, 22 bp, Artificial Sequence
  chemically synthesized
ggtgatctttgggaagattcag

SEQ ID NO: 1160860 - DNA, 22 bp, Artificial Sequence
  chemically synthesized
gtgatctttgggaagattcagg

SEQ ID NO: 1160861 - DNA, 22 bp, Artificial Sequence
  chemically synthesized
tgggaagattcaggaaaatccc

SEQ ID NO: 1160862 - DNA, 22 bp, Artificial Sequence
  chemically synthesized
gggaagattcaggaaaatcccc

SEQ ID NO: 1160863 - DNA, 22 bp, Artificial Sequence
  chemically synthesized
ccaggtaatacaggggattttc

SEQ ID NO: 1160864 - DNA, 22 bp, Artificial Sequence
  chemically synthesized
ggaagattcaggaaaatcccct

SEQ ID NO: 1160865 - DNA, 22 bp, Artificial Sequence
  chemically synthesized
tctaccaggtaatacaggggat

SEQ ID NO: 1160866 - DNA, 22 bp, Artificial Sequence
  chemically synthesized
aggaaaatcccctgtattacct

SEQ ID NO: 1160867 - DNA, 22 bp, Artificial Sequence
  chemically synthesized
tattacctggtagataatcttt

SEQ ID NO: 1160868 - DNA, 22 bp, Artificial Sequence
  chemically synthesized
cctggtagataatctttttctc

SEQ ID NO: 1160869 - DNA, 22 bp, Artificial Sequence
  chemically synthesized
aggggaaggaaagagaaaaaga

SEQ ID NO: 1160870 - DNA, 22 bp, Artificial Sequence
  chemically synthesized
ttgaggggaaggaaagagaaaa

SEQ ID NO: 1160871 - DNA, 22 bp, Artificial Sequence
  chemically synthesized
gtagataatctttttctctttc

SEQ ID NO: 1160872 - DNA, 22 bp, Artificial Sequence
  chemically synthesized
gttgaggggaaggaaagagaaa

SEQ ID NO: 1160873 - DNA, 22 bp, Artificial Sequence
  chemically synthesized
tgttgaggggaaggaaagagaa

SEQ ID NO: 1160874 - DNA, 22 bp, Artificial Sequence
  chemically synthesized
tttgttgaggggaaggaaagag

SEQ ID NO: 1160875 - DNA, 22 bp, Artificial Sequence
  chemically synthesized
tctttgttgaggggaaggaaag

SEQ ID NO: 1160876 - DNA, 22 bp, Artificial Sequence
  chemically synthesized
tttctctttccttcccctcaac

SEQ ID NO: 1160877 - DNA, 22 bp, Artificial Sequence
  chemically synthesized
ttctctttccttcccctcaaca

SEQ ID NO: 1160878 - DNA, 22 bp, Artificial Sequence
  chemically synthesized
tctctttccttcccctcaacaa

SEQ ID NO: 1160879 - DNA, 22 bp, Artificial Sequence
  chemically synthesized
ctctttccttcccctcaacaaa

SEQ ID NO: 1160880 - DNA, 22 bp, Artificial Sequence
  chemically synthesized
tctttccttcccctcaacaaag

SEQ ID NO: 1160881 - DNA, 22 bp, Artificial Sequence
  chemically synthesized
tttccttcccctcaacaaagag

SEQ ID NO: 1160882 - DNA, 22 bp, Artificial Sequence
  chemically synthesized
tccttcccctcaacaaagagag

SEQ ID NO: 1160883 - DNA, 22 bp, Artificial Sequence
  chemically synthesized
ccttcccctcaacaaagagagt

SEQ ID NO: 1160884 - DNA, 22 bp, Artificial Sequence
  chemically synthesized
cttcccctcaacaaagagagtc

SEQ ID NO: 1160885 - DNA, 22 bp, Artificial Sequence
  chemically synthesized
atcacagagagagactctcttt

SEQ ID NO: 1160886 - DNA, 22 bp, Artificial Sequence
  chemically synthesized
cccctcaacaaagagagtctct

SEQ ID NO: 1160887 - DNA, 22 bp, Artificial Sequence
  chemically synthesized
ccctcaacaaagagagtctctc

SEQ ID NO: 1160888 - DNA, 22 bp, Artificial Sequence
  chemically synthesized
aacaaagagagtctctctctgt

SEQ ID NO: 1160889 - DNA, 22 bp, Artificial Sequence
  chemically synthesized
caggcagctcatcacagagaga

SEQ ID NO: 1160890 - DNA, 22 bp, Artificial Sequence
  chemically synthesized
gctccaggcagctcatcacaga

SEQ ID NO: 1160891 - DNA, 22 bp, Artificial Sequence
  chemically synthesized
agctccaggcagctcatcacag

SEQ ID NO: 1160892 - DNA, 22 bp, Artificial Sequence
  chemically synthesized
tagctccaggcagctcatcaca

SEQ ID NO: 1160893 - DNA, 22 bp, Artificial Sequence
  chemically synthesized
ctttagctccaggcagctcatc

SEQ ID NO: 1160894 - DNA, 22 bp, Artificial Sequence
  chemically synthesized
tcctttagctccaggcagctca

SEQ ID NO: 1160895 - DNA, 22 bp, Artificial Sequence
  chemically synthesized
tctctgtgatgagctgcctgga

SEQ ID NO: 1160896 - DNA, 22 bp, Artificial Sequence
  chemically synthesized
tctgtgatgagctgcctggagc

SEQ ID NO: 1160897 - DNA, 22 bp, Artificial Sequence
  chemically synthesized
tgtgatgagctgcctggagcta

SEQ ID NO: 1160898 - DNA, 22 bp, Artificial Sequence
  chemically synthesized
tgatgagctgcctggagctaaa

SEQ ID NO: 1160899 - DNA, 22 bp, Artificial Sequence
  chemically synthesized
tgtcacctctcctttagctcca

SEQ ID NO: 1160900 - DNA, 22 bp, Artificial Sequence
  chemically synthesized
gtgtcacctctcctttagctcc

SEQ ID NO: 1160901 - DNA, 22 bp, Artificial Sequence
  chemically synthesized
cctggagctaaaggagaggtga

SEQ ID NO: 1160902 - DNA, 22 bp, Artificial Sequence
  chemically synthesized
caggggtgcttgtgtcacctct

SEQ ID NO: 1160903 - DNA, 22 bp, Artificial Sequence
  chemically synthesized
gagctaaaggagaggtgacaca

SEQ ID NO: 1160904 - DNA, 22 bp, Artificial Sequence
  chemically synthesized
aaggagaggtgacacaagcacc

SEQ ID NO: 1160905 - DNA, 22 bp, Artificial Sequence
  chemically synthesized
gtcgtggtagctacaggggtgc

SEQ ID NO: 1160906 - DNA, 22 bp, Artificial Sequence
  chemically synthesized
tagctaccacgactaggattgt

SEQ ID NO: 1160907 - DNA, 22 bp, Artificial Sequence
  chemically synthesized
ggagtgacccaacacaatccta

SEQ ID NO: 1160908 - DNA, 22 bp, Artificial Sequence
  chemically synthesized
aggagtgacccaacacaatcct

SEQ ID NO: 1160909 - DNA, 22 bp, Artificial Sequence
  chemically synthesized
taggagtgacccaacacaatcc

SEQ ID NO: 1160910 - DNA, 22 bp, Artificial Sequence
  chemically synthesized
ccacgactaggattgtgttggg

SEQ ID NO: 1160911 - DNA, 22 bp, Artificial Sequence
  chemically synthesized
gctttaggagtgacccaacaca

SEQ ID NO: 1160912 - DNA, 22 bp, Artificial Sequence
  chemically synthesized
tactggctttaggagtgaccca

SEQ ID NO: 1160913 - DNA, 22 bp, Artificial Sequence
  chemically synthesized
ggattgtgttgggtcactccta

SEQ ID NO: 1160914 - DNA, 22 bp, Artificial Sequence
  chemically synthesized
tgttgggtcactcctaaagcca

SEQ ID NO: 1160915 - DNA, 22 bp, Artificial Sequence
  chemically synthesized
ggtcactcctaaagccagtaca

SEQ ID NO: 1160916 - DNA, 22 bp, Artificial Sequence
  chemically synthesized
atcaagacccagtgttgtactg

SEQ ID NO: 1160917 - DNA, 22 bp, Artificial Sequence
  chemically synthesized
gatcaagacccagtgttgtact

SEQ ID NO: 1160918 - DNA, 22 bp, Artificial Sequence
  chemically synthesized
ctaaagccagtacaacactggg

SEQ ID NO: 1160919 - DNA, 22 bp, Artificial Sequence
  chemically synthesized
aagccagtacaacactgggtct

SEQ ID NO: 1160920 - DNA, 22 bp, Artificial Sequence
  chemically synthesized
ggtcttgatcaaggcccacact

SEQ ID NO: 1160921 - DNA, 22 bp, Artificial Sequence
  chemically synthesized
gatcaaggcccacactgaccac

SEQ ID NO: 1160922 - DNA, 22 bp, Artificial Sequence
  chemically synthesized
atcaaggcccacactgaccact

SEQ ID NO: 1160923 - DNA, 22 bp, Artificial Sequence
  chemically synthesized
agtgaatgtaggtgatagccag

SEQ ID NO: 1160924 - DNA, 22 bp, Artificial Sequence
  chemically synthesized
accactgactggctatcaccta

SEQ ID NO: 1160925 - DNA, 22 bp, Artificial Sequence
  chemically synthesized
ggccctgagtgaatgtaggtga

SEQ ID NO: 1160926 - DNA, 22 bp, Artificial Sequence
  chemically synthesized
gggccctgagtgaatgtaggtg

SEQ ID NO: 1160927 - DNA, 22 bp, Artificial Sequence
  chemically synthesized
actggctatcacctacattcac

SEQ ID NO: 1160928 - DNA, 22 bp, Artificial Sequence
  chemically synthesized
gctatcacctacattcactcag

SEQ ID NO: 1160929 - DNA, 22 bp, Artificial Sequence
  chemically synthesized
tagagtccttgggccctgagtg

SEQ ID NO: 1160930 - DNA, 22 bp, Artificial Sequence
  chemically synthesized
tcacctacattcactcagggcc

SEQ ID NO: 1160931 - DNA, 22 bp, Artificial Sequence
  chemically synthesized
ccgattgtagagtccttgggcc

SEQ ID NO: 1160932 - DNA, 22 bp, Artificial Sequence
  chemically synthesized
cattcactcagggcccaaggac

SEQ ID NO: 1160933 - DNA, 22 bp, Artificial Sequence
  chemically synthesized
actcagggcccaaggactctac

SEQ ID NO: 1160934 - DNA, 22 bp, Artificial Sequence
  chemically synthesized
ccacctgccgattgtagagtcc

SEQ ID NO: 1160935 - DNA, 22 bp, Artificial Sequence
  chemically synthesized
gccacctgccgattgtagagtc

SEQ ID NO: 1160936 - DNA, 22 bp, Artificial Sequence
  chemically synthesized
agggcccaaggactctacaatc

SEQ ID NO: 1160937 - DNA, 22 bp, Artificial Sequence
  chemically synthesized
gatttgccacctgccgattgta

SEQ ID NO: 1160938 - DNA, 22 bp, Artificial Sequence
  chemically synthesized
attggatttgccacctgccgat

SEQ ID NO: 1160939 - DNA, 22 bp, Artificial Sequence
  chemically synthesized
cattggatttgccacctgccga

SEQ ID NO: 1160940 - DNA, 22 bp, Artificial Sequence
  chemically synthesized
tacaatcggcaggtggcaaatc

SEQ ID NO: 1160941 - DNA, 22 bp, Artificial Sequence
  chemically synthesized
caatcggcaggtggcaaatcca

SEQ ID NO: 1160942 - DNA, 22 bp, Artificial Sequence
  chemically synthesized
aagtgaaaaacacaagcttcat

SEQ ID NO: 1160943 - DNA, 22 bp, Artificial Sequence
  chemically synthesized
ccctgaagtgaaaaacacaagc

SEQ ID NO: 1160944 - DNA, 22 bp, Artificial Sequence
  chemically synthesized
ctaccctgaagtgaaaaacaca

SEQ ID NO: 1160945 - DNA, 22 bp, Artificial Sequence
  chemically synthesized
gtgtttttcacttcagggtagc

SEQ ID NO: 1160946 - DNA, 22 bp, Artificial Sequence
  chemically synthesized
tgtttttcacttcagggtagca

SEQ ID NO: 1160947 - DNA, 22 bp, Artificial Sequence
  chemically synthesized
ttcacttcagggtagcaatttt

SEQ ID NO: 1160948 - DNA, 22 bp, Artificial Sequence
  chemically synthesized
tcacttcagggtagcaattttt

SEQ ID NO: 1160949 - DNA, 22 bp, Artificial Sequence
  chemically synthesized
cacttcagggtagcaatttttc

SEQ ID NO: 1160950 - DNA, 22 bp, Artificial Sequence
  chemically synthesized
acttcagggtagcaatttttcc

SEQ ID NO: 1160951 - DNA, 22 bp, Artificial Sequence
  chemically synthesized
caaacccaccagggaaaaattg

SEQ ID NO: 1160952 - DNA, 22 bp, Artificial Sequence
  chemically synthesized
gcaaacccaccagggaaaaatt

SEQ ID NO: 1160953 - DNA, 22 bp, Artificial Sequence
  chemically synthesized
cagggtagcaatttttccctgg

SEQ ID NO: 1160954 - DNA, 22 bp, Artificial Sequence
  chemically synthesized
agggtagcaatttttccctggt

SEQ ID NO: 1160955 - DNA, 22 bp, Artificial Sequence
  chemically synthesized
catataggatcttgcaaaccca

SEQ ID NO: 1160956 - DNA, 22 bp, Artificial Sequence
  chemically synthesized
acatataggatcttgcaaaccc

SEQ ID NO: 1160957 - DNA, 22 bp, Artificial Sequence
  chemically synthesized
ttccctggtgggtttgcaagat

SEQ ID NO: 1160958 - DNA, 22 bp, Artificial Sequence
  chemically synthesized
tccctggtgggtttgcaagatc

SEQ ID NO: 1160959 - DNA, 22 bp, Artificial Sequence
  chemically synthesized
gcttacatataggatcttgcaa

SEQ ID NO: 1160960 - DNA, 22 bp, Artificial Sequence
  chemically synthesized
ccctggtgggtttgcaagatcc

SEQ ID NO: 1160961 - DNA, 22 bp, Artificial Sequence
  chemically synthesized
cctggtgggtttgcaagatcct

SEQ ID NO: 1160962 - DNA, 22 bp, Artificial Sequence
  chemically synthesized
gtgggtttgcaagatcctatat

SEQ ID NO: 1160963 - DNA, 22 bp, Artificial Sequence
  chemically synthesized
gcaagatcctatatgtaagcca

SEQ ID NO: 1160964 - DNA, 22 bp, Artificial Sequence
  chemically synthesized
caagatcctatatgtaagccag

SEQ ID NO: 1160965 - DNA, 22 bp, Artificial Sequence
  chemically synthesized
atacatgaccccaggccctggc

SEQ ID NO: 1160966 - DNA, 22 bp, Artificial Sequence
  chemically synthesized
tatgtaagccagggcctggggt

SEQ ID NO: 1160967 - DNA, 22 bp, Artificial Sequence
  chemically synthesized
tgagaatggcctaatacatgac

SEQ ID NO: 1160968 - DNA, 22 bp, Artificial Sequence
  chemically synthesized
tagcattgtgagaatggcctaa

SEQ ID NO: 1160969 - DNA, 22 bp, Artificial Sequence
  chemically synthesized
atagcattgtgagaatggccta

SEQ ID NO: 1160970 - DNA, 22 bp, Artificial Sequence
  chemically synthesized
gggtcatgtattaggccattct

SEQ ID NO: 1160971 - DNA, 22 bp, Artificial Sequence
  chemically synthesized
tatagcattgtgagaatggcct

SEQ ID NO: 1160972 - DNA, 22 bp, Artificial Sequence
  chemically synthesized
tttatagcattgtgagaatggc

SEQ ID NO: 1160973 - DNA, 22 bp, Artificial Sequence
  chemically synthesized
ctttatagcattgtgagaatgg

SEQ ID NO: 1160974 - DNA, 22 bp, Artificial Sequence
  chemically synthesized
ggccattctcacaatgctataa

SEQ ID NO: 1160975 - DNA, 22 bp, Artificial Sequence
  chemically synthesized
cccagtatcagatatttcttta

SEQ ID NO: 1160976 - DNA, 22 bp, Artificial Sequence
  chemically synthesized
tcacaatgctataaagaaatat

SEQ ID NO: 1160977 - DNA, 22 bp, Artificial Sequence
  chemically synthesized
acaatgctataaagaaatatct

SEQ ID NO: 1160978 - DNA, 22 bp, Artificial Sequence
  chemically synthesized
ataaattacccagtatcagata

SEQ ID NO: 1160979 - DNA, 22 bp, Artificial Sequence
  chemically synthesized
cataaattacccagtatcagat

SEQ ID NO: 1160980 - DNA, 22 bp, Artificial Sequence
  chemically synthesized
ttcataaattacccagtatcag

SEQ ID NO: 1160981 - DNA, 22 bp, Artificial Sequence
  chemically synthesized
taaagaaatatctgatactggg

SEQ ID NO: 1160982 - DNA, 22 bp, Artificial Sequence
  chemically synthesized
cttcataaattacccagtatca

SEQ ID NO: 1160983 - DNA, 22 bp, Artificial Sequence
  chemically synthesized
tcttcataaattacccagtatc

SEQ ID NO: 1160984 - DNA, 22 bp, Artificial Sequence
  chemically synthesized
ttcttcataaattacccagtat

SEQ ID NO: 1160985 - DNA, 22 bp, Artificial Sequence
  chemically synthesized
ttttcttcataaattacccagt

SEQ ID NO: 1160986 - DNA, 22 bp, Artificial Sequence
  chemically synthesized
agcctcttttcttcataaatta

SEQ ID NO: 1160987 - DNA, 22 bp, Artificial Sequence
  chemically synthesized
aagcctcttttcttcataaatt

SEQ ID NO: 1160988 - DNA, 22 bp, Artificial Sequence
  chemically synthesized
atactgggtaatttatgaagaa

SEQ ID NO: 1160989 - DNA, 22 bp, Artificial Sequence
  chemically synthesized
ggtaatttatgaagaaaagagg

SEQ ID NO: 1160990 - DNA, 22 bp, Artificial Sequence
  chemically synthesized
atgaagaaaagaggcttaaatg

SEQ ID NO: 1160991 - DNA, 22 bp, Artificial Sequence
  chemically synthesized
tgaagaaaagaggcttaaatgg

SEQ ID NO: 1160992 - DNA, 22 bp, Artificial Sequence
  chemically synthesized
cagaaccatgagccatttaagc

SEQ ID NO: 1160993 - DNA, 22 bp, Artificial Sequence
  chemically synthesized
agggacaacctgcagaaccatg

SEQ ID NO: 1160994 - DNA, 22 bp, Artificial Sequence
  chemically synthesized
aaatggctcatggttctgcagg

SEQ ID NO: 1160995 - DNA, 22 bp, Artificial Sequence
  chemically synthesized
aatggctcatggttctgcaggt

SEQ ID NO: 1160996 - DNA, 22 bp, Artificial Sequence
  chemically synthesized
atggttctgcaggttgtccctg

SEQ ID NO: 1160997 - DNA, 22 bp, Artificial Sequence
  chemically synthesized
tgcaggttgtccctgagacatg

SEQ ID NO: 1160998 - DNA, 22 bp, Artificial Sequence
  chemically synthesized
caggttgtccctgagacatgat

SEQ ID NO: 1160999 - DNA, 22 bp, Artificial Sequence
  chemically synthesized
tccctgagacatgatgctggca

SEQ ID NO: 1161000 - DNA, 22 bp, Artificial Sequence
  chemically synthesized
cgcagaagcagagcagatgcca

SEQ ID NO: 1161001 - DNA, 22 bp, Artificial Sequence
  chemically synthesized
agacatgatgctggcatctgct

SEQ ID NO: 1161002 - DNA, 22 bp, Artificial Sequence
  chemically synthesized
aggcctccgcagaagcagagca

SEQ ID NO: 1161003 - DNA, 22 bp, Artificial Sequence
  chemically synthesized
ctgaggcctccgcagaagcaga

SEQ ID NO: 1161004 - DNA, 22 bp, Artificial Sequence
  chemically synthesized
gcatctgctctgcttctgcgga

SEQ ID NO: 1161005 - DNA, 22 bp, Artificial Sequence
  chemically synthesized
taaatctcctgaggcctccgca

SEQ ID NO: 1161006 - DNA, 22 bp, Artificial Sequence
  chemically synthesized
ctctgcttctgcggaggcctca

SEQ ID NO: 1161007 - DNA, 22 bp, Artificial Sequence
  chemically synthesized
tgcttctgcggaggcctcagga

SEQ ID NO: 1161008 - DNA, 22 bp, Artificial Sequence
  chemically synthesized
cttctgcggaggcctcaggaga

SEQ ID NO: 1161009 - DNA, 22 bp, Artificial Sequence
  chemically synthesized
ccatgattgtaaatctcctgag

SEQ ID NO: 1161010 - DNA, 22 bp, Artificial Sequence
  chemically synthesized
gccatgattgtaaatctcctga

SEQ ID NO: 1161011 - DNA, 22 bp, Artificial Sequence
  chemically synthesized
ctgcggaggcctcaggagattt

SEQ ID NO: 1161012 - DNA, 22 bp, Artificial Sequence
  chemically synthesized
tgcggaggcctcaggagattta

SEQ ID NO: 1161013 - DNA, 22 bp, Artificial Sequence
  chemically synthesized
cggaggcctcaggagatttaca

SEQ ID NO: 1161014 - DNA, 22 bp, Artificial Sequence
  chemically synthesized
gcaatttgccatgattgtaaat

SEQ ID NO: 1161015 - DNA, 22 bp, Artificial Sequence
  chemically synthesized
cgcaatttgccatgattgtaaa

SEQ ID NO: 1161016 - DNA, 22 bp, Artificial Sequence
  chemically synthesized
cttcgcaatttgccatgattgt

SEQ ID NO: 1161017 - DNA, 22 bp, Artificial Sequence
  chemically synthesized
aggagatttacaatcatggcaa

SEQ ID NO: 1161018 - DNA, 22 bp, Artificial Sequence
  chemically synthesized
ctccttcgcaatttgccatgat

SEQ ID NO: 1161019 - DNA, 22 bp, Artificial Sequence
  chemically synthesized
ctcctccttcgcaatttgccat

SEQ ID NO: 1161020 - DNA, 22 bp, Artificial Sequence
  chemically synthesized
acaatcatggcaaattgcgaag

SEQ ID NO: 1161021 - DNA, 22 bp, Artificial Sequence
  chemically synthesized
caatcatggcaaattgcgaagg

SEQ ID NO: 1161022 - DNA, 22 bp, Artificial Sequence
  chemically synthesized
gccgtgtgacatgactgctcct

SEQ ID NO: 1161023 - DNA, 22 bp, Artificial Sequence
  chemically synthesized
cctggccgtgtgacatgactgc

SEQ ID NO: 1161024 - DNA, 22 bp, Artificial Sequence
  chemically synthesized
ccctggccgtgtgacatgactg

SEQ ID NO: 1161025 - DNA, 22 bp, Artificial Sequence
  chemically synthesized
cgaaggaggagcagtcatgtca

SEQ ID NO: 1161026 - DNA, 22 bp, Artificial Sequence
  chemically synthesized
ttccctggccgtgtgacatgac

SEQ ID NO: 1161027 - DNA, 22 bp, Artificial Sequence
  chemically synthesized
acctcttccctggccgtgtgac

SEQ ID NO: 1161028 - DNA, 22 bp, Artificial Sequence
  chemically synthesized
ccactcacctcttccctggccg

SEQ ID NO: 1161029 - DNA, 22 bp, Artificial Sequence
  chemically synthesized
aaagtgtgtggtaccctcccac

SEQ ID NO: 1161030 - DNA, 22 bp, Artificial Sequence
  chemically synthesized
gttaaaagtgtgtggtaccctc

SEQ ID NO: 1161031 - DNA, 22 bp, Artificial Sequence
  chemically synthesized
tcagatccagttggttaaaagt

SEQ ID NO: 1161032 - DNA, 22 bp, Artificial Sequence
  chemically synthesized
gtcagatccagttggttaaaag

SEQ ID NO: 1161033 - DNA, 22 bp, Artificial Sequence
  chemically synthesized
ttgtcagatccagttggttaaa

SEQ ID NO: 1161034 - DNA, 22 bp, Artificial Sequence
  chemically synthesized
ttaaccaactggatctgacaag

SEQ ID NO: 1161035 - DNA, 22 bp, Artificial Sequence
  chemically synthesized
taaccaactggatctgacaaga

SEQ ID NO: 1161036 - DNA, 22 bp, Artificial Sequence
  chemically synthesized
aaccaactggatctgacaagaa

SEQ ID NO: 1161037 - DNA, 22 bp, Artificial Sequence
  chemically synthesized
accaactggatctgacaagaat

SEQ ID NO: 1161038 - DNA, 22 bp, Artificial Sequence
  chemically synthesized
atgatagtgggtgaattcttgt

SEQ ID NO: 1161039 - DNA, 22 bp, Artificial Sequence
  chemically synthesized
catgatagtgggtgaattcttg

SEQ ID NO: 1161040 - DNA, 22 bp, Artificial Sequence
  chemically synthesized
tcatgatagtgggtgaattctt

SEQ ID NO: 1161041 - DNA, 22 bp, Artificial Sequence
  chemically synthesized
ttttcatgatagtgggtgaatt

SEQ ID NO: 1161042 - DNA, 22 bp, Artificial Sequence
  chemically synthesized
gatctgacaagaattcacccac

SEQ ID NO: 1161043 - DNA, 22 bp, Artificial Sequence
  chemically synthesized
gtgctgttttcatgatagtggg

SEQ ID NO: 1161044 - DNA, 22 bp, Artificial Sequence
  chemically synthesized
acaagaattcacccactatcat

SEQ ID NO: 1161045 - DNA, 22 bp, Artificial Sequence
  chemically synthesized
agtgctgttttcatgatagtgg

SEQ ID NO: 1161046 - DNA, 22 bp, Artificial Sequence
  chemically synthesized
ttagtgctgttttcatgatagt

SEQ ID NO: 1161047 - DNA, 22 bp, Artificial Sequence
  chemically synthesized
tcctcttagtgctgttttcatg

SEQ ID NO: 1161048 - DNA, 22 bp, Artificial Sequence
  chemically synthesized
acccactatcatgaaaacagca

SEQ ID NO: 1161049 - DNA, 22 bp, Artificial Sequence
  chemically synthesized
gcactatcctcttagtgctgtt

SEQ ID NO: 1161050 - DNA, 22 bp, Artificial Sequence
  chemically synthesized
agcactatcctcttagtgctgt

SEQ ID NO: 1161051 - DNA, 22 bp, Artificial Sequence
  chemically synthesized
tcatgaaaacagcactaagagg

SEQ ID NO: 1161052 - DNA, 22 bp, Artificial Sequence
  chemically synthesized
atgaatggtttagcactatcct

SEQ ID NO: 1161053 - DNA, 22 bp, Artificial Sequence
  chemically synthesized
tcatgaatggtttagcactatc

SEQ ID NO: 1161054 - DNA, 22 bp, Artificial Sequence
  chemically synthesized
ctcatgaatggtttagcactat

SEQ ID NO: 1161055 - DNA, 22 bp, Artificial Sequence
  chemically synthesized
aatttctcatgaatggtttagc

SEQ ID NO: 1161056 - DNA, 22 bp, Artificial Sequence
  chemically synthesized
agaggatagtgctaaaccattc

SEQ ID NO: 1161057 - DNA, 22 bp, Artificial Sequence
  chemically synthesized
aaccattcatgagaaattcaac

SEQ ID NO: 1161058 - DNA, 22 bp, Artificial Sequence
  chemically synthesized
atgagaaattcaacgccatgat

SEQ ID NO: 1161059 - DNA, 22 bp, Artificial Sequence
  chemically synthesized
ggtgggagccgaatgaatcatg

SEQ ID NO: 1161060 - DNA, 22 bp, Artificial Sequence
  chemically synthesized
aacgccatgattcattcggctc

SEQ ID NO: 1161061 - DNA, 22 bp, Artificial Sequence
  chemically synthesized
tcagaggtggggcctgggtggg

SEQ ID NO: 1161062 - DNA, 22 bp, Artificial Sequence
  chemically synthesized
attcggctcccacccaggcccc

SEQ ID NO: 1161063 - DNA, 22 bp, Artificial Sequence
  chemically synthesized
actgtcagaggtggggcctggg

SEQ ID NO: 1161064 - DNA, 22 bp, Artificial Sequence
  chemically synthesized
ggctcccacccaggccccacct

SEQ ID NO: 1161065 - DNA, 22 bp, Artificial Sequence
  chemically synthesized
caatcctcactgtcagaggtgg

SEQ ID NO: 1161066 - DNA, 22 bp, Artificial Sequence
  chemically synthesized
ccacccaggccccacctctgac

SEQ ID NO: 1161067 - DNA, 22 bp, Artificial Sequence
  chemically synthesized
aattacaatcctcactgtcaga

SEQ ID NO: 1161068 - DNA, 22 bp, Artificial Sequence
  chemically synthesized
acattgaattacaatcctcact

SEQ ID NO: 1161069 - DNA, 22 bp, Artificial Sequence
  chemically synthesized
tgacagtgaggattgtaattca

SEQ ID NO: 1161070 - DNA, 22 bp, Artificial Sequence
  chemically synthesized
acagtgaggattgtaattcaat

SEQ ID NO: 1161071 - DNA, 22 bp, Artificial Sequence
  chemically synthesized
cccagatctcacattgaattac

SEQ ID NO: 1161072 - DNA, 22 bp, Artificial Sequence
  chemically synthesized
gcccagatctcacattgaatta

SEQ ID NO: 1161073 - DNA, 22 bp, Artificial Sequence
  chemically synthesized
ttgcccagatctcacattgaat

SEQ ID NO: 1161074 - DNA, 22 bp, Artificial Sequence
  chemically synthesized
taattcaatgtgagatctgggc

SEQ ID NO: 1161075 - DNA, 22 bp, Artificial Sequence
  chemically synthesized
gatgtatgttcttgcccagatc

SEQ ID NO: 1161076 - DNA, 22 bp, Artificial Sequence
  chemically synthesized
ggatgtatgttcttgcccagat

SEQ ID NO: 1161077 - DNA, 22 bp, Artificial Sequence
  chemically synthesized
aatgtgagatctgggcaagaac

SEQ ID NO: 1161078 - DNA, 22 bp, Artificial Sequence
  chemically synthesized
ggcaagaacatacatccaaacc

SEQ ID NO: 1161079 - DNA, 22 bp, Artificial Sequence
  chemically synthesized
ggaggggccaggatggaatagt

SEQ ID NO: 1161080 - DNA, 22 bp, Artificial Sequence
  chemically synthesized
gggaggggccaggatggaatag

SEQ ID NO: 1161081 - DNA, 22 bp, Artificial Sequence
  chemically synthesized
agatttgggaggggccaggatg

SEQ ID NO: 1161082 - DNA, 22 bp, Artificial Sequence
  chemically synthesized
gagatttgggaggggccaggat

SEQ ID NO: 1161083 - DNA, 22 bp, Artificial Sequence
  chemically synthesized
ttccatcctggcccctcccaaa

SEQ ID NO: 1161084 - DNA, 22 bp, Artificial Sequence
  chemically synthesized
catcctggcccctcccaaatct

SEQ ID NO: 1161085 - DNA, 22 bp, Artificial Sequence
  chemically synthesized
aatgtgagaaggacttgagatt

SEQ ID NO: 1161086 - DNA, 22 bp, Artificial Sequence
  chemically synthesized
aaatgtgagaaggacttgagat

SEQ ID NO: 1161087 - DNA, 22 bp, Artificial Sequence
  chemically synthesized
gcccctcccaaatctcaagtcc

SEQ ID NO: 1161088 - DNA, 22 bp, Artificial Sequence
  chemically synthesized
tatgtttaaatgtgagaaggac

SEQ ID NO: 1161089 - DNA, 22 bp, Artificial Sequence
  chemically synthesized
ccaaatctcaagtccttctcac

SEQ ID NO: 1161090 - DNA, 22 bp, Artificial Sequence
  chemically synthesized
aagtccttctcacatttaaaca

SEQ ID NO: 1161091 - DNA, 22 bp, Artificial Sequence
  chemically synthesized
gaagacatgattgtatgtttaa

SEQ ID NO: 1161092 - DNA, 22 bp, Artificial Sequence
  chemically synthesized
ggaagacatgattgtatgttta

SEQ ID NO: 1161093 - DNA, 22 bp, Artificial Sequence
  chemically synthesized
tttggaagacatgattgtatgt

SEQ ID NO: 1161094 - DNA, 22 bp, Artificial Sequence
  chemically synthesized
ctcacatttaaacatacaatca

SEQ ID NO: 1161095 - DNA, 22 bp, Artificial Sequence
  chemically synthesized
tcacatttaaacatacaatcat

SEQ ID NO: 1161096 - DNA, 22 bp, Artificial Sequence
  chemically synthesized
acatttaaacatacaatcatgt

SEQ ID NO: 1161097 - DNA, 22 bp, Artificial Sequence
  chemically synthesized
ggggactgtttggaagacatga

SEQ ID NO: 1161098 - DNA, 22 bp, Artificial Sequence
  chemically synthesized
gggggactgtttggaagacatg

SEQ ID NO: 1161099 - DNA, 22 bp, Artificial Sequence
  chemically synthesized
aaacatacaatcatgtcttcca

SEQ ID NO: 1161100 - DNA, 22 bp, Artificial Sequence
  chemically synthesized
aacatacaatcatgtcttccaa

SEQ ID NO: 1161101 - DNA, 22 bp, Artificial Sequence
  chemically synthesized
gaataagtaaagaccttggggg

SEQ ID NO: 1161102 - DNA, 22 bp, Artificial Sequence
  chemically synthesized
tggaataagtaaagaccttggg

SEQ ID NO: 1161103 - DNA, 22 bp, Artificial Sequence
  chemically synthesized
ccaaacagtcccccaaggtctt

SEQ ID NO: 1161104 - DNA, 22 bp, Artificial Sequence
  chemically synthesized
caaacagtcccccaaggtcttt

SEQ ID NO: 1161105 - DNA, 22 bp, Artificial Sequence
  chemically synthesized
attctggaataagtaaagacct

SEQ ID NO: 1161106 - DNA, 22 bp, Artificial Sequence
  chemically synthesized
agttaattctggaataagtaaa

SEQ ID NO: 1161107 - DNA, 22 bp, Artificial Sequence
  chemically synthesized
gagttaattctggaataagtaa

SEQ ID NO: 1161108 - DNA, 22 bp, Artificial Sequence
  chemically synthesized
tgagttaattctggaataagta

SEQ ID NO: 1161109 - DNA, 22 bp, Artificial Sequence
  chemically synthesized
ttgagttaattctggaataagt

SEQ ID NO: 1161110 - DNA, 22 bp, Artificial Sequence
  chemically synthesized
cggacttttgagttaattctgg

SEQ ID NO: 1161111 - DNA, 22 bp, Artificial Sequence
  chemically synthesized
tacttattccagaattaactca

SEQ ID NO: 1161112 - DNA, 22 bp, Artificial Sequence
  chemically synthesized
acttattccagaattaactcaa

SEQ ID NO: 1161113 - DNA, 22 bp, Artificial Sequence
  chemically synthesized
cttattccagaattaactcaaa

SEQ ID NO: 1161114 - DNA, 22 bp, Artificial Sequence
  chemically synthesized
attccagaattaactcaaaagt

SEQ ID NO: 1161115 - DNA, 22 bp, Artificial Sequence
  chemically synthesized
ttccagaattaactcaaaagtc

SEQ ID NO: 1161116 - DNA, 22 bp, Artificial Sequence
  chemically synthesized
agatgagactccggacttttga

SEQ ID NO: 1161117 - DNA, 22 bp, Artificial Sequence
  chemically synthesized
cagaattaactcaaaagtccgg

SEQ ID NO: 1161118 - DNA, 22 bp, Artificial Sequence
  chemically synthesized
tctcagatgagactccggactt

SEQ ID NO: 1161119 - DNA, 22 bp, Artificial Sequence
  chemically synthesized
gtctcagatgagactccggact

SEQ ID NO: 1161120 - DNA, 22 bp, Artificial Sequence
  chemically synthesized
ccttgtctcagatgagactccg

SEQ ID NO: 1161121 - DNA, 22 bp, Artificial Sequence
  chemically synthesized
actcaaaagtccggagtctcat

SEQ ID NO: 1161122 - DNA, 22 bp, Artificial Sequence
  chemically synthesized
accttgtctcagatgagactcc

SEQ ID NO: 1161123 - DNA, 22 bp, Artificial Sequence
  chemically synthesized
aaaagtccggagtctcatctga

SEQ ID NO: 1161124 - DNA, 22 bp, Artificial Sequence
  chemically synthesized
ataggtagaagaaacttacctt

SEQ ID NO: 1161125 - DNA, 22 bp, Artificial Sequence
  chemically synthesized
atctgagacaaggtaagtttct

SEQ ID NO: 1161126 - DNA, 22 bp, Artificial Sequence
  chemically synthesized
cgggctcataggtagaagaaac

SEQ ID NO: 1161127 - DNA, 22 bp, Artificial Sequence
  chemically synthesized
agacaaggtaagtttcttctac

SEQ ID NO: 1161128 - DNA, 22 bp, Artificial Sequence
  chemically synthesized
acgggctcataggtagaagaaa

SEQ ID NO: 1161129 - DNA, 22 bp, Artificial Sequence
  chemically synthesized
tacgggctcataggtagaagaa

SEQ ID NO: 1161130 - DNA, 22 bp, Artificial Sequence
  chemically synthesized
attttacgggctcataggtaga

SEQ ID NO: 1161131 - DNA, 22 bp, Artificial Sequence
  chemically synthesized
gattttacgggctcataggtag

SEQ ID NO: 1161132 - DNA, 22 bp, Artificial Sequence
  chemically synthesized
tgattttacgggctcataggta

SEQ ID NO: 1161133 - DNA, 22 bp, Artificial Sequence
  chemically synthesized
ttgattttacgggctcataggt

SEQ ID NO: 1161134 - DNA, 22 bp, Artificial Sequence
  chemically synthesized
gtttttgattttacgggctcat

SEQ ID NO: 1161135 - DNA, 22 bp, Artificial Sequence
  chemically synthesized
cttctacctatgagcccgtaaa

SEQ ID NO: 1161136 - DNA, 22 bp, Artificial Sequence
  chemically synthesized
ttctacctatgagcccgtaaaa

SEQ ID NO: 1161137 - DNA, 22 bp, Artificial Sequence
  chemically synthesized
attggtttttgattttacgggc

SEQ ID NO: 1161138 - DNA, 22 bp, Artificial Sequence
  chemically synthesized
ctacctatgagcccgtaaaatc

SEQ ID NO: 1161139 - DNA, 22 bp, Artificial Sequence
  chemically synthesized
tacctatgagcccgtaaaatca

SEQ ID NO: 1161140 - DNA, 22 bp, Artificial Sequence
  chemically synthesized
cctatgagcccgtaaaatcaaa

SEQ ID NO: 1161141 - DNA, 22 bp, Artificial Sequence
  chemically synthesized
tgagcccgtaaaatcaaaaacc

SEQ ID NO: 1161142 - DNA, 22 bp, Artificial Sequence
  chemically synthesized
gaagtaactaattggtttttga

SEQ ID NO: 1161143 - DNA, 22 bp, Artificial Sequence
  chemically synthesized
ggaagtaactaattggtttttg

SEQ ID NO: 1161144 - DNA, 22 bp, Artificial Sequence
  chemically synthesized
tatcttggaagtaactaattgg

SEQ ID NO: 1161145 - DNA, 22 bp, Artificial Sequence
  chemically synthesized
taatcccattgtatcttggaag

SEQ ID NO: 1161146 - DNA, 22 bp, Artificial Sequence
  chemically synthesized
ataatcccattgtatcttggaa

SEQ ID NO: 1161147 - DNA, 22 bp, Artificial Sequence
  chemically synthesized
gttacttccaagatacaatggg

SEQ ID NO: 1161148 - DNA, 22 bp, Artificial Sequence
  chemically synthesized
aatgcttataatcccattgtat

SEQ ID NO: 1161149 - DNA, 22 bp, Artificial Sequence
  chemically synthesized
cttccaagatacaatgggatta

SEQ ID NO: 1161150 - DNA, 22 bp, Artificial Sequence
  chemically synthesized
actcaatgcttataatcccatt

SEQ ID NO: 1161151 - DNA, 22 bp, Artificial Sequence
  chemically synthesized
ccaagatacaatgggattataa

SEQ ID NO: 1161152 - DNA, 22 bp, Artificial Sequence
  chemically synthesized
caagatacaatgggattataag

SEQ ID NO: 1161153 - DNA, 22 bp, Artificial Sequence
  chemically synthesized
gaataggagtgttgactcaatg

SEQ ID NO: 1161154 - DNA, 22 bp, Artificial Sequence
  chemically synthesized
ggaataggagtgttgactcaat

SEQ ID NO: 1161155 - DNA, 22 bp, Artificial Sequence
  chemically synthesized
tggaataggagtgttgactcaa

SEQ ID NO: 1161156 - DNA, 22 bp, Artificial Sequence
  chemically synthesized
ttggaataggagtgttgactca

SEQ ID NO: 1161157 - DNA, 22 bp, Artificial Sequence
  chemically synthesized
taagcattgagtcaacactcct

SEQ ID NO: 1161158 - DNA, 22 bp, Artificial Sequence
  chemically synthesized
acccttttggaataggagtgtt

SEQ ID NO: 1161159 - DNA, 22 bp, Artificial Sequence
  chemically synthesized
cacccttttggaataggagtgt

SEQ ID NO: 1161160 - DNA, 22 bp, Artificial Sequence
  chemically synthesized
agtcaacactcctattccaaaa

SEQ ID NO: 1161161 - DNA, 22 bp, Artificial Sequence
  chemically synthesized
accaatttcacccttttggaat

SEQ ID NO: 1161162 - DNA, 22 bp, Artificial Sequence
  chemically synthesized
gaccaatttcacccttttggaa

SEQ ID NO: 1161163 - DNA, 22 bp, Artificial Sequence
  chemically synthesized
tgaccaatttcacccttttgga

SEQ ID NO: 1161164 - DNA, 22 bp, Artificial Sequence
  chemically synthesized
ttgaccaatttcacccttttgg

SEQ ID NO: 1161165 - DNA, 22 bp, Artificial Sequence
  chemically synthesized
ttttgaccaatttcaccctttt

SEQ ID NO: 1161166 - DNA, 22 bp, Artificial Sequence
  chemically synthesized
cttttgaccaatttcacccttt

SEQ ID NO: 1161167 - DNA, 22 bp, Artificial Sequence
  chemically synthesized
tcttttgaccaatttcaccctt

SEQ ID NO: 1161168 - DNA, 22 bp, Artificial Sequence
  chemically synthesized
ctattccaaaagggtgaaattg

SEQ ID NO: 1161169 - DNA, 22 bp, Artificial Sequence
  chemically synthesized
ttccaaaagggtgaaattggtc

SEQ ID NO: 1161170 - DNA, 22 bp, Artificial Sequence
  chemically synthesized
caaaagggtgaaattggtcaaa

SEQ ID NO: 1161171 - DNA, 22 bp, Artificial Sequence
  chemically synthesized
catgagacctttcttttgacca

SEQ ID NO: 1161172 - DNA, 22 bp, Artificial Sequence
  chemically synthesized
gcatgagacctttcttttgacc

SEQ ID NO: 1161173 - DNA, 22 bp, Artificial Sequence
  chemically synthesized
agacttgcatgagacctttctt

SEQ ID NO: 1161174 - DNA, 22 bp, Artificial Sequence
  chemically synthesized
cagacttgcatgagacctttct

SEQ ID NO: 1161175 - DNA, 22 bp, Artificial Sequence
  chemically synthesized
ggtttcagacttgcatgagacc

SEQ ID NO: 1161176 - DNA, 22 bp, Artificial Sequence
  chemically synthesized
gtcaaaagaaaggtctcatgca

SEQ ID NO: 1161177 - DNA, 22 bp, Artificial Sequence
  chemically synthesized
ctgggtttcagacttgcatgag

SEQ ID NO: 1161178 - DNA, 22 bp, Artificial Sequence
  chemically synthesized
ccctgctgggtttcagacttgc

SEQ ID NO: 1161179 - DNA, 22 bp, Artificial Sequence
  chemically synthesized
atgactaccctgctgggtttca

SEQ ID NO: 1161180 - DNA, 22 bp, Artificial Sequence
  chemically synthesized
aatgactaccctgctgggtttc

SEQ ID NO: 1161181 - DNA, 22 bp, Artificial Sequence
  chemically synthesized
atgcaagtctgaaacccagcag

SEQ ID NO: 1161182 - DNA, 22 bp, Artificial Sequence
  chemically synthesized
agatttaatgactaccctgctg

SEQ ID NO: 1161183 - DNA, 22 bp, Artificial Sequence
  chemically synthesized
aagatttaatgactaccctgct

SEQ ID NO: 1161184 - DNA, 22 bp, Artificial Sequence
  chemically synthesized
taagatttaatgactaccctgc

SEQ ID NO: 1161185 - DNA, 22 bp, Artificial Sequence
  chemically synthesized
aaacccagcagggtagtcatta

SEQ ID NO: 1161186 - DNA, 22 bp, Artificial Sequence
  chemically synthesized
gagttttaagatttaatgacta

SEQ ID NO: 1161187 - DNA, 22 bp, Artificial Sequence
  chemically synthesized
ggagttttaagatttaatgact

SEQ ID NO: 1161188 - DNA, 22 bp, Artificial Sequence
  chemically synthesized
tggagttttaagatttaatgac

SEQ ID NO: 1161189 - DNA, 22 bp, Artificial Sequence
  chemically synthesized
aatcttaaaactccaaaattat

SEQ ID NO: 1161190 - DNA, 22 bp, Artificial Sequence
  chemically synthesized
aaaactccaaaattatctgctt

SEQ ID NO: 1161191 - DNA, 22 bp, Artificial Sequence
  chemically synthesized
aaactccaaaattatctgcttt

SEQ ID NO: 1161192 - DNA, 22 bp, Artificial Sequence
  chemically synthesized
caaaattatctgctttgactcc

SEQ ID NO: 1161193 - DNA, 22 bp, Artificial Sequence
  chemically synthesized
gatgtaggacatggagtcaaag

SEQ ID NO: 1161194 - DNA, 22 bp, Artificial Sequence
  chemically synthesized
ccctggatgtaggacatggagt

SEQ ID NO: 1161195 - DNA, 22 bp, Artificial Sequence
  chemically synthesized
accctggatgtaggacatggag

SEQ ID NO: 1161196 - DNA, 22 bp, Artificial Sequence
  chemically synthesized
tctgctttgactccatgtccta

SEQ ID NO: 1161197 - DNA, 22 bp, Artificial Sequence
  chemically synthesized
ctttgactccatgtcctacatc

SEQ ID NO: 1161198 - DNA, 22 bp, Artificial Sequence
  chemically synthesized
tgactccatgtcctacatccag

SEQ ID NO: 1161199 - DNA, 22 bp, Artificial Sequence
  chemically synthesized
gactccatgtcctacatccagg

SEQ ID NO: 1161200 - DNA, 22 bp, Artificial Sequence
  chemically synthesized
ccaccagtttaccctggatgta

SEQ ID NO: 1161201 - DNA, 22 bp, Artificial Sequence
  chemically synthesized
actccatgtcctacatccaggg

SEQ ID NO: 1161202 - DNA, 22 bp, Artificial Sequence
  chemically synthesized
catgtcctacatccagggtaaa

SEQ ID NO: 1161203 - DNA, 22 bp, Artificial Sequence
  chemically synthesized
catccagggtaaactggtggga

SEQ ID NO: 1161204 - DNA, 22 bp, Artificial Sequence
  chemically synthesized
ggagcacaccactcccaccagt

SEQ ID NO: 1161205 - DNA, 22 bp, Artificial Sequence
  chemically synthesized
gggagcacaccactcccaccag

SEQ ID NO: 1161206 - DNA, 22 bp, Artificial Sequence
  chemically synthesized
cccaaggccttgggagcacacc

SEQ ID NO: 1161207 - DNA, 22 bp, Artificial Sequence
  chemically synthesized
gtgggagtggtgtgctcccaag

SEQ ID NO: 1161208 - DNA, 22 bp, Artificial Sequence
  chemically synthesized
gagtctgcccaaggccttggga

SEQ ID NO: 1161209 - DNA, 22 bp, Artificial Sequence
  chemically synthesized
ccaaggccttgggcagactcca

SEQ ID NO: 1161210 - DNA, 22 bp, Artificial Sequence
  chemically synthesized
gaaagccacaaagttggagtct

SEQ ID NO: 1161211 - DNA, 22 bp, Artificial Sequence
  chemically synthesized
aaccctagaaagccacaaagtt

SEQ ID NO: 1161212 - DNA, 22 bp, Artificial Sequence
  chemically synthesized
gggcagactccaactttgtggc

SEQ ID NO: 1161213 - DNA, 22 bp, Artificial Sequence
  chemically synthesized
ggcagactccaactttgtggct

SEQ ID NO: 1161214 - DNA, 22 bp, Artificial Sequence
  chemically synthesized
gaagctgaaccctagaaagcca

SEQ ID NO: 1161215 - DNA, 22 bp, Artificial Sequence
  chemically synthesized
ggaagctgaaccctagaaagcc

SEQ ID NO: 1161216 - DNA, 22 bp, Artificial Sequence
  chemically synthesized
tggaagctgaaccctagaaagc

SEQ ID NO: 1161217 - DNA, 22 bp, Artificial Sequence
  chemically synthesized
caactttgtggctttctagggt

SEQ ID NO: 1161218 - DNA, 22 bp, Artificial Sequence
  chemically synthesized
tgtggctttctagggttcagct

SEQ ID NO: 1161219 - DNA, 22 bp, Artificial Sequence
  chemically synthesized
gtggctttctagggttcagctt

SEQ ID NO: 1161220 - DNA, 22 bp, Artificial Sequence
  chemically synthesized
tggctttctagggttcagcttc

SEQ ID NO: 1161221 - DNA, 22 bp, Artificial Sequence
  chemically synthesized
tctagggttcagcttccaaagc

SEQ ID NO: 1161222 - DNA, 22 bp, Artificial Sequence
  chemically synthesized
ctagggttcagcttccaaagct

SEQ ID NO: 1161223 - DNA, 22 bp, Artificial Sequence
  chemically synthesized
tagggttcagcttccaaagctg

SEQ ID NO: 1161224 - DNA, 22 bp, Artificial Sequence
  chemically synthesized
gggttcagcttccaaagctgct

SEQ ID NO: 1161225 - DNA, 22 bp, Artificial Sequence
  chemically synthesized
agcaccagaccataagagcagc

SEQ ID NO: 1161226 - DNA, 22 bp, Artificial Sequence
  chemically synthesized
agcttccaaagctgctcttatg

SEQ ID NO: 1161227 - DNA, 22 bp, Artificial Sequence
  chemically synthesized
ccaaagctgctcttatggtctg

SEQ ID NO: 1161228 - DNA, 22 bp, Artificial Sequence
  chemically synthesized
caaagctgctcttatggtctgg

SEQ ID NO: 1161229 - DNA, 22 bp, Artificial Sequence
  chemically synthesized
ctcttatggtctggtgctgagt

SEQ ID NO: 1161230 - DNA, 22 bp, Artificial Sequence
  chemically synthesized
gaaatgaaacacacactcagca

SEQ ID NO: 1161231 - DNA, 22 bp, Artificial Sequence
  chemically synthesized
ttatggtctggtgctgagtgtg

SEQ ID NO: 1161232 - DNA, 22 bp, Artificial Sequence
  chemically synthesized
atggtctggtgctgagtgtgtg

SEQ ID NO: 1161233 - DNA, 22 bp, Artificial Sequence
  chemically synthesized
tggtctggtgctgagtgtgtgt

SEQ ID NO: 1161234 - DNA, 22 bp, Artificial Sequence
  chemically synthesized
tatctggaaatgaaacacacac

SEQ ID NO: 1161235 - DNA, 22 bp, Artificial Sequence
  chemically synthesized
gtatctggaaatgaaacacaca

SEQ ID NO: 1161236 - DNA, 22 bp, Artificial Sequence
  chemically synthesized
gtgctgagtgtgtgtttcattt

SEQ ID NO: 1161237 - DNA, 22 bp, Artificial Sequence
  chemically synthesized
acccttgtatctggaaatgaaa

SEQ ID NO: 1161238 - DNA, 22 bp, Artificial Sequence
  chemically synthesized
gacccttgtatctggaaatgaa

SEQ ID NO: 1161239 - DNA, 22 bp, Artificial Sequence
  chemically synthesized
agtgtgtgtttcatttccagat

SEQ ID NO: 1161240 - DNA, 22 bp, Artificial Sequence
  chemically synthesized
acagcttgacccttgtatctgg

SEQ ID NO: 1161241 - DNA, 22 bp, Artificial Sequence
  chemically synthesized
catttccagatacaagggtcaa

SEQ ID NO: 1161242 - DNA, 22 bp, Artificial Sequence
  chemically synthesized
atttccagatacaagggtcaag

SEQ ID NO: 1161243 - DNA, 22 bp, Artificial Sequence
  chemically synthesized
ccagatacaagggtcaagctgt

SEQ ID NO: 1161244 - DNA, 22 bp, Artificial Sequence
  chemically synthesized
cagatacaagggtcaagctgtc

SEQ ID NO: 1161245 - DNA, 22 bp, Artificial Sequence
  chemically synthesized
cagaatggtagatccactgaca

SEQ ID NO: 1161246 - DNA, 22 bp, Artificial Sequence
  chemically synthesized
cagactccagaatggtagatcc

SEQ ID NO: 1161247 - DNA, 22 bp, Artificial Sequence
  chemically synthesized
tcctccagactccagaatggta

SEQ ID NO: 1161248 - DNA, 22 bp, Artificial Sequence
  chemically synthesized
tcagtggatctaccattctgga

SEQ ID NO: 1161249 - DNA, 22 bp, Artificial Sequence
  chemically synthesized
ccattctggagtctggaggaca

SEQ ID NO: 1161250 - DNA, 22 bp, Artificial Sequence
  chemically synthesized
taagaagagggccactgtcctc

SEQ ID NO: 1161251 - DNA, 22 bp, Artificial Sequence
  chemically synthesized
tggagtctggaggacagtggcc

SEQ ID NO: 1161252 - DNA, 22 bp, Artificial Sequence
  chemically synthesized
gagtctggaggacagtggccct

SEQ ID NO: 1161253 - DNA, 22 bp, Artificial Sequence
  chemically synthesized
gtggacctgtaagaagagggcc

SEQ ID NO: 1161254 - DNA, 22 bp, Artificial Sequence
  chemically synthesized
gaggacagtggccctcttctta

SEQ ID NO: 1161255 - DNA, 22 bp, Artificial Sequence
  chemically synthesized
cctagtggacctgtaagaagag

SEQ ID NO: 1161256 - DNA, 22 bp, Artificial Sequence
  chemically synthesized
gggcattgcctagtggacctgt

SEQ ID NO: 1161257 - DNA, 22 bp, Artificial Sequence
  chemically synthesized
ttcttacaggtccactaggcaa

SEQ ID NO: 1161258 - DNA, 22 bp, Artificial Sequence
  chemically synthesized
cttacaggtccactaggcaatg

SEQ ID NO: 1161259 - DNA, 22 bp, Artificial Sequence
  chemically synthesized
ttacaggtccactaggcaatgc

SEQ ID NO: 1161260 - DNA, 22 bp, Artificial Sequence
  chemically synthesized
acaggtccactaggcaatgccc

SEQ ID NO: 1161261 - DNA, 22 bp, Artificial Sequence
  chemically synthesized
caggtccactaggcaatgcccc

SEQ ID NO: 1161262 - DNA, 22 bp, Artificial Sequence
  chemically synthesized
ggcaatgccccagtggggacta

SEQ ID NO: 1161263 - DNA, 22 bp, Artificial Sequence
  chemically synthesized
atcccccacacgtagtccccac

SEQ ID NO: 1161264 - DNA, 22 bp, Artificial Sequence
  chemically synthesized
gatcccccacacgtagtcccca

SEQ ID NO: 1161265 - DNA, 22 bp, Artificial Sequence
  chemically synthesized
tgatcccccacacgtagtcccc

SEQ ID NO: 1161266 - DNA, 22 bp, Artificial Sequence
  chemically synthesized
cgtgtgggggatcaaagcccac

SEQ ID NO: 1161267 - DNA, 22 bp, Artificial Sequence
  chemically synthesized
gggcaatgcagagggaaaatgt

SEQ ID NO: 1161268 - DNA, 22 bp, Artificial Sequence
  chemically synthesized
ctggggcaatgcagagggaaaa

SEQ ID NO: 1161269 - DNA, 22 bp, Artificial Sequence
  chemically synthesized
tcctggggcaatgcagagggaa

SEQ ID NO: 1161270 - DNA, 22 bp, Artificial Sequence
  chemically synthesized
ctcctggggcaatgcagaggga

SEQ ID NO: 1161271 - DNA, 22 bp, Artificial Sequence
  chemically synthesized
acagagaacttctcctggggca

SEQ ID NO: 1161272 - DNA, 22 bp, Artificial Sequence
  chemically synthesized
tccctctgcattgccccaggag

SEQ ID NO: 1161273 - DNA, 22 bp, Artificial Sequence
  chemically synthesized
ccctctgcattgccccaggaga

SEQ ID NO: 1161274 - DNA, 22 bp, Artificial Sequence
  chemically synthesized
cctctgcattgccccaggagaa

SEQ ID NO: 1161275 - DNA, 22 bp, Artificial Sequence
  chemically synthesized
tgcattgccccaggagaagttc

SEQ ID NO: 1161276 - DNA, 22 bp, Artificial Sequence
  chemically synthesized
cattgccccaggagaagttctc

SEQ ID NO: 1161277 - DNA, 22 bp, Artificial Sequence
  chemically synthesized
ccccaggagaagttctctgtga

SEQ ID NO: 1161278 - DNA, 22 bp, Artificial Sequence
  chemically synthesized
caggggcagaaccctcacagag

SEQ ID NO: 1161279 - DNA, 22 bp, Artificial Sequence
  chemically synthesized
ctccaggggcagaaccctcaca

SEQ ID NO: 1161280 - DNA, 22 bp, Artificial Sequence
  chemically synthesized
tctgtgagggttctgcccctgg

SEQ ID NO: 1161281 - DNA, 22 bp, Artificial Sequence
  chemically synthesized
tgtgagggttctgcccctggag

SEQ ID NO: 1161282 - DNA, 22 bp, Artificial Sequence
  chemically synthesized
tgagggttctgcccctggagca

SEQ ID NO: 1161283 - DNA, 22 bp, Artificial Sequence
  chemically synthesized
caggcagaagcctgctccaggg

SEQ ID NO: 1161284 - DNA, 22 bp, Artificial Sequence
  chemically synthesized
ccaggcagaagcctgctccagg

SEQ ID NO: 1161285 - DNA, 22 bp, Artificial Sequence
  chemically synthesized
ggtttccaggcagaagcctgct

SEQ ID NO: 1161286 - DNA, 22 bp, Artificial Sequence
  chemically synthesized
tgcccctggagcaggcttctgc

SEQ ID NO: 1161287 - DNA, 22 bp, Artificial Sequence
  chemically synthesized
cccctggagcaggcttctgcct

SEQ ID NO: 1161288 - DNA, 22 bp, Artificial Sequence
  chemically synthesized
gagcaggcttctgcctggaaac

SEQ ID NO: 1161289 - DNA, 22 bp, Artificial Sequence
  chemically synthesized
tatggaaaagcctgggtttcca

SEQ ID NO: 1161290 - DNA, 22 bp, Artificial Sequence
  chemically synthesized
ctgcctggaaacccaggctttt

SEQ ID NO: 1161291 - DNA, 22 bp, Artificial Sequence
  chemically synthesized
gaggttgtatggaaaagcctgg

SEQ ID NO: 1161292 - DNA, 22 bp, Artificial Sequence
  chemically synthesized
tgcctggaaacccaggcttttc

SEQ ID NO: 1161293 - DNA, 22 bp, Artificial Sequence
  chemically synthesized
agaggttgtatggaaaagcctg

SEQ ID NO: 1161294 - DNA, 22 bp, Artificial Sequence
  chemically synthesized
tagaggttgtatggaaaagcct

SEQ ID NO: 1161295 - DNA, 22 bp, Artificial Sequence
  chemically synthesized
cctggaaacccaggcttttcca

SEQ ID NO: 1161296 - DNA, 22 bp, Artificial Sequence
  chemically synthesized
gaaacccaggcttttccataca

SEQ ID NO: 1161297 - DNA, 22 bp, Artificial Sequence
  chemically synthesized
gattttagaggttgtatggaaa

SEQ ID NO: 1161298 - DNA, 22 bp, Artificial Sequence
  chemically synthesized
ttccatacaacctctaaaatct

SEQ ID NO: 1161299 - DNA, 22 bp, Artificial Sequence
  chemically synthesized
tccatacaacctctaaaatcta

SEQ ID NO: 1161300 - DNA, 22 bp, Artificial Sequence
  chemically synthesized
ggaacatccatctagattttag

SEQ ID NO: 1161301 - DNA, 22 bp, Artificial Sequence
  chemically synthesized
ccatacaacctctaaaatctag

SEQ ID NO: 1161302 - DNA, 22 bp, Artificial Sequence
  chemically synthesized
gggaacatccatctagatttta

SEQ ID NO: 1161303 - DNA, 22 bp, Artificial Sequence
  chemically synthesized
catacaacctctaaaatctaga

SEQ ID NO: 1161304 - DNA, 22 bp, Artificial Sequence
  chemically synthesized
aggcttgggaacatccatctag

SEQ ID NO: 1161305 - DNA, 22 bp, Artificial Sequence
  chemically synthesized
taaaatctagatggatgttccc

SEQ ID NO: 1161306 - DNA, 22 bp, Artificial Sequence
  chemically synthesized
aaatctagatggatgttcccaa

SEQ ID NO: 1161307 - DNA, 22 bp, Artificial Sequence
  chemically synthesized
gatggatgttcccaagcctcaa

SEQ ID NO: 1161308 - DNA, 22 bp, Artificial Sequence
  chemically synthesized
caggtgcacagagtgcaagagt

SEQ ID NO: 1161309 - DNA, 22 bp, Artificial Sequence
  chemically synthesized
ccaagcctcaactcttgcactc

SEQ ID NO: 1161310 - DNA, 22 bp, Artificial Sequence
  chemically synthesized
aactcttgcactctgtgcacct

SEQ ID NO: 1161311 - DNA, 22 bp, Artificial Sequence
  chemically synthesized
ttgcactctgtgcacctgcagg

SEQ ID NO: 1161312 - DNA, 22 bp, Artificial Sequence
  chemically synthesized
gcactctgtgcacctgcaggct

SEQ ID NO: 1161313 - DNA, 22 bp, Artificial Sequence
  chemically synthesized
cactctgtgcacctgcaggctt

SEQ ID NO: 1161314 - DNA, 22 bp, Artificial Sequence
  chemically synthesized
tgtgcacctgcaggcttatggc

SEQ ID NO: 1161315 - DNA, 22 bp, Artificial Sequence
  chemically synthesized
cagcgggtacaagccataagcc

SEQ ID NO: 1161316 - DNA, 22 bp, Artificial Sequence
  chemically synthesized
tgcacctgcaggcttatggctt

SEQ ID NO: 1161317 - DNA, 22 bp, Artificial Sequence
  chemically synthesized
caggcttatggcttgtacccgc

SEQ ID NO: 1161318 - DNA, 22 bp, Artificial Sequence
  chemically synthesized
ggccacagctccagcgggtaca

SEQ ID NO: 1161319 - DNA, 22 bp, Artificial Sequence
  chemically synthesized
gggccacagctccagcgggtac

SEQ ID NO: 1161320 - DNA, 22 bp, Artificial Sequence
  chemically synthesized
atggcttgtacccgctggagct

SEQ ID NO: 1161321 - DNA, 22 bp, Artificial Sequence
  chemically synthesized
tggcttgtacccgctggagctg

SEQ ID NO: 1161322 - DNA, 22 bp, Artificial Sequence
  chemically synthesized
gtacccgctggagctgtggccc

SEQ ID NO: 1161323 - DNA, 22 bp, Artificial Sequence
  chemically synthesized
tacccgctggagctgtggccca

SEQ ID NO: 1161324 - DNA, 22 bp, Artificial Sequence
  chemically synthesized
agagtggcccaagtacagcttg

SEQ ID NO: 1161325 - DNA, 22 bp, Artificial Sequence
  chemically synthesized
gagctgtggcccaagctgtact

SEQ ID NO: 1161326 - DNA, 22 bp, Artificial Sequence
  chemically synthesized
tggctcagagtggcccaagtac

SEQ ID NO: 1161327 - DNA, 22 bp, Artificial Sequence
  chemically synthesized
tggcccaagctgtacttgggcc

SEQ ID NO: 1161328 - DNA, 22 bp, Artificial Sequence
  chemically synthesized
cagctgtggctcagagtggccc

SEQ ID NO: 1161329 - DNA, 22 bp, Artificial Sequence
  chemically synthesized
tagctccagctgtggctcagag

SEQ ID NO: 1161330 - DNA, 22 bp, Artificial Sequence
  chemically synthesized
tacttgggccactctgagccac

SEQ ID NO: 1161331 - DNA, 22 bp, Artificial Sequence
  chemically synthesized
gggccactctgagccacagctg

SEQ ID NO: 1161332 - DNA, 22 bp, Artificial Sequence
  chemically synthesized
ggccactctgagccacagctgg

SEQ ID NO: 1161333 - DNA, 22 bp, Artificial Sequence
  chemically synthesized
gccactgtagctccagctgtgg

SEQ ID NO: 1161334 - DNA, 22 bp, Artificial Sequence
  chemically synthesized
tgagccacagctggagctacag

SEQ ID NO: 1161335 - DNA, 22 bp, Artificial Sequence
  chemically synthesized
agccacagctggagctacagtg

SEQ ID NO: 1161336 - DNA, 22 bp, Artificial Sequence
  chemically synthesized
gagctacagtggccaggacgct

SEQ ID NO: 1161337 - DNA, 22 bp, Artificial Sequence
  chemically synthesized
ccccccgcacccagcgtcctgg

SEQ ID NO: 1161338 - DNA, 22 bp, Artificial Sequence
  chemically synthesized
cagtggccaggacgctgggtgc

SEQ ID NO: 1161339 - DNA, 22 bp, Artificial Sequence
  chemically synthesized
tgcccccgccccaacccctccc

SEQ ID NO: 1161340 - DNA, 22 bp, Artificial Sequence
  chemically synthesized
ggtgcgggggggaggggttggg

SEQ ID NO: 1161341 - DNA, 22 bp, Artificial Sequence
  chemically synthesized
gtacactgtgcccccgccccaa

SEQ ID NO: 1161342 - DNA, 22 bp, Artificial Sequence
  chemically synthesized
aacctcgtacactgtgcccccg

SEQ ID NO: 1161343 - DNA, 22 bp, Artificial Sequence
  chemically synthesized
ttcaacctcgtacactgtgccc

SEQ ID NO: 1161344 - DNA, 22 bp, Artificial Sequence
  chemically synthesized
ccctgttcaacctcgtacactg

SEQ ID NO: 1161345 - DNA, 22 bp, Artificial Sequence
  chemically synthesized
gggcgggggcacagtgtacgag

SEQ ID NO: 1161346 - DNA, 22 bp, Artificial Sequence
  chemically synthesized
ggccaggcccagggtcccagct

SEQ ID NO: 1161347 - DNA, 22 bp, Artificial Sequence
  chemically synthesized
ctgggccaggcccagggtccca

SEQ ID NO: 1161348 - DNA, 22 bp, Artificial Sequence
  chemically synthesized
aacagggcagctgggaccctgg

SEQ ID NO: 1161349 - DNA, 22 bp, Artificial Sequence
  chemically synthesized
cctgggccaggcccagggtccc

SEQ ID NO: 1161350 - DNA, 22 bp, Artificial Sequence
  chemically synthesized
ggaccctgggcctggcccagga

SEQ ID NO: 1161351 - DNA, 22 bp, Artificial Sequence
  chemically synthesized
agaggacagaatggtttcctgg

SEQ ID NO: 1161352 - DNA, 22 bp, Artificial Sequence
  chemically synthesized
ggcctggcccaggaaaccattc

SEQ ID NO: 1161353 - DNA, 22 bp, Artificial Sequence
  chemically synthesized
gcccaggaaaccattctgtcct

SEQ ID NO: 1161354 - DNA, 22 bp, Artificial Sequence
  chemically synthesized
tagatccggaggcctaagagga

SEQ ID NO: 1161355 - DNA, 22 bp, Artificial Sequence
  chemically synthesized
ccattatagatccggaggccta

SEQ ID NO: 1161356 - DNA, 22 bp, Artificial Sequence
  chemically synthesized
tgtcctcttaggcctccggatc

SEQ ID NO: 1161357 - DNA, 22 bp, Artificial Sequence
  chemically synthesized
tcctcttaggcctccggatcta

SEQ ID NO: 1161358 - DNA, 22 bp, Artificial Sequence
  chemically synthesized
ttaggcctccggatctataatg

SEQ ID NO: 1161359 - DNA, 22 bp, Artificial Sequence
  chemically synthesized
aggcctccggatctataatggg

SEQ ID NO: 1161360 - DNA, 22 bp, Artificial Sequence
  chemically synthesized
ggcctccggatctataatggga

SEQ ID NO: 1161361 - DNA, 22 bp, Artificial Sequence
  chemically synthesized
aaaggcagcccctcccattata

SEQ ID NO: 1161362 - DNA, 22 bp, Artificial Sequence
  chemically synthesized
cggatctataatgggaggggct

SEQ ID NO: 1161363 - DNA, 22 bp, Artificial Sequence
  chemically synthesized
agagatctaaaaggcagcccct

SEQ ID NO: 1161364 - DNA, 22 bp, Artificial Sequence
  chemically synthesized
cagagatctaaaaggcagcccc

SEQ ID NO: 1161365 - DNA, 22 bp, Artificial Sequence
  chemically synthesized
taatgggaggggctgcctttta

SEQ ID NO: 1161366 - DNA, 22 bp, Artificial Sequence
  chemically synthesized
gaaggcatttcagagatctaaa

SEQ ID NO: 1161367 - DNA, 22 bp, Artificial Sequence
  chemically synthesized
ccttttagatctctgaaatgcc

SEQ ID NO: 1161368 - DNA, 22 bp, Artificial Sequence
  chemically synthesized
ttagatctctgaaatgccttcc

SEQ ID NO: 1161369 - DNA, 22 bp, Artificial Sequence
  chemically synthesized
tagatctctgaaatgccttcca

SEQ ID NO: 1161370 - DNA, 22 bp, Artificial Sequence
  chemically synthesized
agatctctgaaatgccttccag

SEQ ID NO: 1161371 - DNA, 22 bp, Artificial Sequence
  chemically synthesized
gatctctgaaatgccttccagg

SEQ ID NO: 1161372 - DNA, 22 bp, Artificial Sequence
  chemically synthesized
tgaaatgccttccaggcctttt

SEQ ID NO: 1161373 - DNA, 22 bp, Artificial Sequence
  chemically synthesized
aaatgccttccaggcctttttc

SEQ ID NO: 1161374 - DNA, 22 bp, Artificial Sequence
  chemically synthesized
atagccaagacaatggggaaaa

SEQ ID NO: 1161375 - DNA, 22 bp, Artificial Sequence
  chemically synthesized
ccaggcctttttccccattgtc

SEQ ID NO: 1161376 - DNA, 22 bp, Artificial Sequence
  chemically synthesized
caggcctttttccccattgtct

SEQ ID NO: 1161377 - DNA, 22 bp, Artificial Sequence
  chemically synthesized
tttccccattgtcttggctatc

SEQ ID NO: 1161378 - DNA, 22 bp, Artificial Sequence
  chemically synthesized
ttccccattgtcttggctatca

SEQ ID NO: 1161379 - DNA, 22 bp, Artificial Sequence
  chemically synthesized
tccccattgtcttggctatcag

SEQ ID NO: 1161380 - DNA, 22 bp, Artificial Sequence
  chemically synthesized
ccccattgtcttggctatcagc

SEQ ID NO: 1161381 - DNA, 22 bp, Artificial Sequence
  chemically synthesized
cccattgtcttggctatcagca

SEQ ID NO: 1161382 - DNA, 22 bp, Artificial Sequence
  chemically synthesized
caaagaaggcaagtgctgatag

SEQ ID NO: 1161383 - DNA, 22 bp, Artificial Sequence
  chemically synthesized
tcttggctatcagcacttgcct

SEQ ID NO: 1161384 - DNA, 22 bp, Artificial Sequence
  chemically synthesized
tatacctacaaagaaggcaagt

SEQ ID NO: 1161385 - DNA, 22 bp, Artificial Sequence
  chemically synthesized
gtatacctacaaagaaggcaag

SEQ ID NO: 1161386 - DNA, 22 bp, Artificial Sequence
  chemically synthesized
ggctatcagcacttgccttctt

SEQ ID NO: 1161387 - DNA, 22 bp, Artificial Sequence
  chemically synthesized
gctatcagcacttgccttcttt

SEQ ID NO: 1161388 - DNA, 22 bp, Artificial Sequence
  chemically synthesized
tcagcacttgccttctttgtag

SEQ ID NO: 1161389 - DNA, 22 bp, Artificial Sequence
  chemically synthesized
gaaaaatttgtatacctacaaa

SEQ ID NO: 1161390 - DNA, 22 bp, Artificial Sequence
  chemically synthesized
ctagaaaaatttgtatacctac

SEQ ID NO: 1161391 - DNA, 22 bp, Artificial Sequence
  chemically synthesized
gctagaaaaatttgtataccta

SEQ ID NO: 1161392 - DNA, 22 bp, Artificial Sequence
  chemically synthesized
gccttctttgtaggtatacaaa

SEQ ID NO: 1161393 - DNA, 22 bp, Artificial Sequence
  chemically synthesized
ccttctttgtaggtatacaaat

SEQ ID NO: 1161394 - DNA, 22 bp, Artificial Sequence
  chemically synthesized
ctttgtaggtatacaaattttt

SEQ ID NO: 1161395 - DNA, 22 bp, Artificial Sequence
  chemically synthesized
tttgtaggtatacaaatttttc

SEQ ID NO: 1161396 - DNA, 22 bp, Artificial Sequence
  chemically synthesized
tgtaggtatacaaatttttcta

SEQ ID NO: 1161397 - DNA, 22 bp, Artificial Sequence
  chemically synthesized
gtaggtatacaaatttttctag

SEQ ID NO: 1161398 - DNA, 22 bp, Artificial Sequence
  chemically synthesized
agcaaccacttgctagaaaaat

SEQ ID NO: 1161399 - DNA, 22 bp, Artificial Sequence
  chemically synthesized
taggtatacaaatttttctagc

SEQ ID NO: 1161400 - DNA, 22 bp, Artificial Sequence
  chemically synthesized
tgagcaaccacttgctagaaaa

SEQ ID NO: 1161401 - DNA, 22 bp, Artificial Sequence
  chemically synthesized
ctgagcaaccacttgctagaaa

SEQ ID NO: 1161402 - DNA, 22 bp, Artificial Sequence
  chemically synthesized
aagaaggcttctgagcaaccac

SEQ ID NO: 1161403 - DNA, 22 bp, Artificial Sequence
  chemically synthesized
ttctagcaagtggttgctcaga

SEQ ID NO: 1161404 - DNA, 22 bp, Artificial Sequence
  chemically synthesized
tctagcaagtggttgctcagaa

SEQ ID NO: 1161405 - DNA, 22 bp, Artificial Sequence
  chemically synthesized
ctagcaagtggttgctcagaag

SEQ ID NO: 1161406 - DNA, 22 bp, Artificial Sequence
  chemically synthesized
tagcaagtggttgctcagaagc

SEQ ID NO: 1161407 - DNA, 22 bp, Artificial Sequence
  chemically synthesized
gcaagtggttgctcagaagcct

SEQ ID NO: 1161408 - DNA, 22 bp, Artificial Sequence
  chemically synthesized
aggagaactcaagaaggcttct

SEQ ID NO: 1161409 - DNA, 22 bp, Artificial Sequence
  chemically synthesized
caggagaactcaagaaggcttc

SEQ ID NO: 1161410 - DNA, 22 bp, Artificial Sequence
  chemically synthesized
tcaggagaactcaagaaggctt

SEQ ID NO: 1161411 - DNA, 22 bp, Artificial Sequence
  chemically synthesized
ctcagaagccttcttgagttct

SEQ ID NO: 1161412 - DNA, 22 bp, Artificial Sequence
  chemically synthesized
agaagccttcttgagttctcct

SEQ ID NO: 1161413 - DNA, 22 bp, Artificial Sequence
  chemically synthesized
cttgagttctcctgaaaatggg

SEQ ID NO: 1161414 - DNA, 22 bp, Artificial Sequence
  chemically synthesized
ttgagttctcctgaaaatgggc

SEQ ID NO: 1161415 - DNA, 22 bp, Artificial Sequence
  chemically synthesized
gagttctcctgaaaatgggctt

SEQ ID NO: 1161416 - DNA, 22 bp, Artificial Sequence
  chemically synthesized
agttctcctgaaaatgggcttt

SEQ ID NO: 1161417 - DNA, 22 bp, Artificial Sequence
  chemically synthesized
tcctgaaaatgggcttttattt

SEQ ID NO: 1161418 - DNA, 22 bp, Artificial Sequence
  chemically synthesized
ctgaaaatgggcttttattttc

SEQ ID NO: 1161419 - DNA, 22 bp, Artificial Sequence
  chemically synthesized
aaaatgggcttttattttctac

SEQ ID NO: 1161420 - DNA, 22 bp, Artificial Sequence
  chemically synthesized
caacatggatatgtggtagaaa

SEQ ID NO: 1161421 - DNA, 22 bp, Artificial Sequence
  chemically synthesized
gcaacatggatatgtggtagaa

SEQ ID NO: 1161422 - DNA, 22 bp, Artificial Sequence
  chemically synthesized
ttattttctaccacatatccat

SEQ ID NO: 1161423 - DNA, 22 bp, Artificial Sequence
  chemically synthesized
aaaatttgcaacatggatatgt

SEQ ID NO: 1161424 - DNA, 22 bp, Artificial Sequence
  chemically synthesized
tattttctaccacatatccatg

SEQ ID NO: 1161425 - DNA, 22 bp, Artificial Sequence
  chemically synthesized
caaaatttgcaacatggatatg

SEQ ID NO: 1161426 - DNA, 22 bp, Artificial Sequence
  chemically synthesized
attttctaccacatatccatgt

SEQ ID NO: 1161427 - DNA, 22 bp, Artificial Sequence
  chemically synthesized
tcaaaatttgcaacatggatat

SEQ ID NO: 1161428 - DNA, 22 bp, Artificial Sequence
  chemically synthesized
ttttctaccacatatccatgtt

SEQ ID NO: 1161429 - DNA, 22 bp, Artificial Sequence
  chemically synthesized
tctaccacatatccatgttgca

SEQ ID NO: 1161430 - DNA, 22 bp, Artificial Sequence
  chemically synthesized
ctaccacatatccatgttgcaa

SEQ ID NO: 1161431 - DNA, 22 bp, Artificial Sequence
  chemically synthesized
taccacatatccatgttgcaaa

SEQ ID NO: 1161432 - DNA, 22 bp, Artificial Sequence
  chemically synthesized
ccacatatccatgttgcaaatt

SEQ ID NO: 1161433 - DNA, 22 bp, Artificial Sequence
  chemically synthesized
caaattttgaaaacctttatgg

SEQ ID NO: 1161434 - DNA, 22 bp, Artificial Sequence
  chemically synthesized
aaaggaaagcagaccataaagg

SEQ ID NO: 1161435 - DNA, 22 bp, Artificial Sequence
  chemically synthesized
aaaaggaaagcagaccataaag

SEQ ID NO: 1161436 - DNA, 22 bp, Artificial Sequence
  chemically synthesized
tgaaaacctttatggtctgctt

SEQ ID NO: 1161437 - DNA, 22 bp, Artificial Sequence
  chemically synthesized
gaaaacctttatggtctgcttt

SEQ ID NO: 1161438 - DNA, 22 bp, Artificial Sequence
  chemically synthesized
aaaacctttatggtctgctttc

SEQ ID NO: 1161439 - DNA, 22 bp, Artificial Sequence
  chemically synthesized
tacatgtatatttaaaaggaaa

SEQ ID NO: 1161440 - DNA, 22 bp, Artificial Sequence
  chemically synthesized
atacatgtatatttaaaaggaa

SEQ ID NO: 1161441 - DNA, 22 bp, Artificial Sequence
  chemically synthesized
tatggtctgctttccttttaaa

SEQ ID NO: 1161442 - DNA, 22 bp, Artificial Sequence
  chemically synthesized
atggtctgctttccttttaaat

SEQ ID NO: 1161443 - DNA, 22 bp, Artificial Sequence
  chemically synthesized
tggtctgctttccttttaaata

SEQ ID NO: 1161444 - DNA, 22 bp, Artificial Sequence
  chemically synthesized
catatttatacatgtatattta

SEQ ID NO: 1161445 - DNA, 22 bp, Artificial Sequence
  chemically synthesized
acatatttatacatgtatattt

SEQ ID NO: 1161446 - DNA, 22 bp, Artificial Sequence
  chemically synthesized
tacatatttatacatgtatatt

SEQ ID NO: 1161447 - DNA, 22 bp, Artificial Sequence
  chemically synthesized
ctttccttttaaatatacatgt

SEQ ID NO: 1161448 - DNA, 22 bp, Artificial Sequence
  chemically synthesized
ttacatatttatacatgtatat

SEQ ID NO: 1161449 - DNA, 22 bp, Artificial Sequence
  chemically synthesized
tttacatatttatacatgtata

SEQ ID NO: 1161450 - DNA, 22 bp, Artificial Sequence
  chemically synthesized
tccttttaaatatacatgtata

SEQ ID NO: 1161451 - DNA, 22 bp, Artificial Sequence
  chemically synthesized
ccttttaaatatacatgtataa

SEQ ID NO: 1161452 - DNA, 22 bp, Artificial Sequence
  chemically synthesized
cttttaaatatacatgtataaa

SEQ ID NO: 1161453 - DNA, 22 bp, Artificial Sequence
  chemically synthesized
ttaaatatacatgtataaatat

SEQ ID NO: 1161454 - DNA, 22 bp, Artificial Sequence
  chemically synthesized
taaatatacatgtataaatatg

SEQ ID NO: 1161455 - DNA, 22 bp, Artificial Sequence
  chemically synthesized
aaatatacatgtataaatatgt

SEQ ID NO: 1161456 - DNA, 22 bp, Artificial Sequence
  chemically synthesized
aatatacatgtataaatatgta

SEQ ID NO: 1161457 - DNA, 22 bp, Artificial Sequence
  chemically synthesized
agatacatgtgcagaacgtgca

SEQ ID NO: 1161458 - DNA, 22 bp, Artificial Sequence
  chemically synthesized
tgagatacatgtgcagaacgtg

SEQ ID NO: 1161459 - DNA, 22 bp, Artificial Sequence
  chemically synthesized
agttctgagatacatgtgcaga

SEQ ID NO: 1161460 - DNA, 22 bp, Artificial Sequence
  chemically synthesized
aagttctgagatacatgtgcag

SEQ ID NO: 1161461 - DNA, 22 bp, Artificial Sequence
  chemically synthesized
taagttctgagatacatgtgca

SEQ ID NO: 1161462 - DNA, 22 bp, Artificial Sequence
  chemically synthesized
cacgttctgcacatgtatctca

SEQ ID NO: 1161463 - DNA, 22 bp, Artificial Sequence
  chemically synthesized
tactttaagttctgagatacat

SEQ ID NO: 1161464 - DNA, 22 bp, Artificial Sequence
  chemically synthesized
ttgtactttaagttctgagata

SEQ ID NO: 1161465 - DNA, 22 bp, Artificial Sequence
  chemically synthesized
attgtactttaagttctgagat

SEQ ID NO: 1161466 - DNA, 22 bp, Artificial Sequence
  chemically synthesized
tattgtactttaagttctgaga

SEQ ID NO: 1161467 - DNA, 22 bp, Artificial Sequence
  chemically synthesized
tgcacatgtatctcagaactta

SEQ ID NO: 1161468 - DNA, 22 bp, Artificial Sequence
  chemically synthesized
ttttattgtactttaagttctg

SEQ ID NO: 1161469 - DNA, 22 bp, Artificial Sequence
  chemically synthesized
cacatgtatctcagaacttaaa

SEQ ID NO: 1161470 - DNA, 22 bp, Artificial Sequence
  chemically synthesized
attttattgtactttaagttct

SEQ ID NO: 1161471 - DNA, 22 bp, Artificial Sequence
  chemically synthesized
tattttattgtactttaagttc

SEQ ID NO: 1161472 - DNA, 22 bp, Artificial Sequence
  chemically synthesized
ttttattttattgtactttaag

SEQ ID NO: 1161473 - DNA, 22 bp, Artificial Sequence
  chemically synthesized
ttattttattttattgtacttt

SEQ ID NO: 1161474 - DNA, 22 bp, Artificial Sequence
  chemically synthesized
attattttattttattgtactt

SEQ ID NO: 1161475 - DNA, 22 bp, Artificial Sequence
  chemically synthesized
agaacttaaagtacaataaaat

SEQ ID NO: 1161476 - DNA, 22 bp, Artificial Sequence
  chemically synthesized
aaagtacaataaaataaaataa

SEQ ID NO: 1161477 - DNA, 22 bp, Artificial Sequence
  chemically synthesized
aagtacaataaaataaaataat

SEQ ID NO: 1161478 - DNA, 22 bp, Artificial Sequence
  chemically synthesized
atgcaggagcaaagaaataaga

SEQ ID NO: 1161479 - DNA, 22 bp, Artificial Sequence
  chemically synthesized
tgatgcaggagcaaagaaataa

SEQ ID NO: 1161480 - DNA, 22 bp, Artificial Sequence
  chemically synthesized
tctgatgcaggagcaaagaaat

SEQ ID NO: 1161481 - DNA, 22 bp, Artificial Sequence
  chemically synthesized
ctctctgatgcaggagcaaaga

SEQ ID NO: 1161482 - DNA, 22 bp, Artificial Sequence
  chemically synthesized
catcttatttctttgctcctgc

SEQ ID NO: 1161483 - DNA, 22 bp, Artificial Sequence
  chemically synthesized
acaacctactctctgatgcagg

SEQ ID NO: 1161484 - DNA, 22 bp, Artificial Sequence
  chemically synthesized
atttctttgctcctgcatcaga

SEQ ID NO: 1161485 - DNA, 22 bp, Artificial Sequence
  chemically synthesized
tttctttgctcctgcatcagag

SEQ ID NO: 1161486 - DNA, 22 bp, Artificial Sequence
  chemically synthesized
taacaacctactctctgatgca

SEQ ID NO: 1161487 - DNA, 22 bp, Artificial Sequence
  chemically synthesized
ctaacaacctactctctgatgc

SEQ ID NO: 1161488 - DNA, 22 bp, Artificial Sequence
  chemically synthesized
ctttgctcctgcatcagagagt

SEQ ID NO: 1161489 - DNA, 22 bp, Artificial Sequence
  chemically synthesized
tttgctcctgcatcagagagta

SEQ ID NO: 1161490 - DNA, 22 bp, Artificial Sequence
  chemically synthesized
tgctcctgcatcagagagtagg

SEQ ID NO: 1161491 - DNA, 22 bp, Artificial Sequence
  chemically synthesized
gctcctgcatcagagagtaggt

SEQ ID NO: 1161492 - DNA, 22 bp, Artificial Sequence
  chemically synthesized
ctcctgcatcagagagtaggtt

SEQ ID NO: 1161493 - DNA, 22 bp, Artificial Sequence
  chemically synthesized
ctgcatcagagagtaggttgtt

SEQ ID NO: 1161494 - DNA, 22 bp, Artificial Sequence
  chemically synthesized
tgtggccacttctaacaaccta

SEQ ID NO: 1161495 - DNA, 22 bp, Artificial Sequence
  chemically synthesized
catcagagagtaggttgttaga

SEQ ID NO: 1161496 - DNA, 22 bp, Artificial Sequence
  chemically synthesized
aagacgttgtgtggccacttct

SEQ ID NO: 1161497 - DNA, 22 bp, Artificial Sequence
  chemically synthesized
ttagaagtggccacacaacgtc

SEQ ID NO: 1161498 - DNA, 22 bp, Artificial Sequence
  chemically synthesized
gaagtggccacacaacgtcttg

SEQ ID NO: 1161499 - DNA, 22 bp, Artificial Sequence
  chemically synthesized
agcagcaaaatgttcaagacgt

SEQ ID NO: 1161500 - DNA, 22 bp, Artificial Sequence
  chemically synthesized
taagcagcaaaatgttcaagac

SEQ ID NO: 1161501 - DNA, 22 bp, Artificial Sequence
  chemically synthesized
ctaagcagcaaaatgttcaaga

SEQ ID NO: 1161502 - DNA, 22 bp, Artificial Sequence
  chemically synthesized
acggaatgaatttctaagcagc

SEQ ID NO: 1161503 - DNA, 22 bp, Artificial Sequence
  chemically synthesized
gaacattttgctgcttagaaat

SEQ ID NO: 1161504 - DNA, 22 bp, Artificial Sequence
  chemically synthesized
aacattttgctgcttagaaatt

SEQ ID NO: 1161505 - DNA, 22 bp, Artificial Sequence
  chemically synthesized
gtgtgtctgacggaatgaattt

SEQ ID NO: 1161506 - DNA, 22 bp, Artificial Sequence
  chemically synthesized
tgctgcttagaaattcattccg

SEQ ID NO: 1161507 - DNA, 22 bp, Artificial Sequence
  chemically synthesized
gctgcttagaaattcattccgt

SEQ ID NO: 1161508 - DNA, 22 bp, Artificial Sequence
  chemically synthesized
ctgcttagaaattcattccgtc

SEQ ID NO: 1161509 - DNA, 22 bp, Artificial Sequence
  chemically synthesized
cttagaaattcattccgtcaga

SEQ ID NO: 1161510 - DNA, 22 bp, Artificial Sequence
  chemically synthesized
agaaattcattccgtcagacac

SEQ ID NO: 1161511 - DNA, 22 bp, Artificial Sequence
  chemically synthesized
gaaattcattccgtcagacaca

SEQ ID NO: 1161512 - DNA, 22 bp, Artificial Sequence
  chemically synthesized
agagtgatgatctcgtgtgtct

SEQ ID NO: 1161513 - DNA, 22 bp, Artificial Sequence
  chemically synthesized
gagagtgatgatctcgtgtgtc

SEQ ID NO: 1161514 - DNA, 22 bp, Artificial Sequence
  chemically synthesized
attccgtcagacacacgagatc

SEQ ID NO: 1161515 - DNA, 22 bp, Artificial Sequence
  chemically synthesized
aacttgagagtgatgatctcgt

SEQ ID NO: 1161516 - DNA, 22 bp, Artificial Sequence
  chemically synthesized
gaacttgagagtgatgatctcg

SEQ ID NO: 1161517 - DNA, 22 bp, Artificial Sequence
  chemically synthesized
cgtcagacacacgagatcatca

SEQ ID NO: 1161518 - DNA, 22 bp, Artificial Sequence
  chemically synthesized
tgaaagtttgaacttgagagtg

SEQ ID NO: 1161519 - DNA, 22 bp, Artificial Sequence
  chemically synthesized
gatatctgtgaaagtttgaact

SEQ ID NO: 1161520 - DNA, 22 bp, Artificial Sequence
  chemically synthesized
tagatatctgtgaaagtttgaa

SEQ ID NO: 1161521 - DNA, 22 bp, Artificial Sequence
  chemically synthesized
tcaagttcaaactttcacagat

SEQ ID NO: 1161522 - DNA, 22 bp, Artificial Sequence
  chemically synthesized
aagttcaaactttcacagatat

SEQ ID NO: 1161523 - DNA, 22 bp, Artificial Sequence
  chemically synthesized
tgtccatgctctagatatctgt

SEQ ID NO: 1161524 - DNA, 22 bp, Artificial Sequence
  chemically synthesized
aaactttcacagatatctagag

SEQ ID NO: 1161525 - DNA, 22 bp, Artificial Sequence
  chemically synthesized
tattatgtccatgctctagata

SEQ ID NO: 1161526 - DNA, 22 bp, Artificial Sequence
  chemically synthesized
gctgtattatgtccatgctcta

SEQ ID NO: 1161527 - DNA, 22 bp, Artificial Sequence
  chemically synthesized
tcacagatatctagagcatgga

SEQ ID NO: 1161528 - DNA, 22 bp, Artificial Sequence
  chemically synthesized
cacagatatctagagcatggac

SEQ ID NO: 1161529 - DNA, 22 bp, Artificial Sequence
  chemically synthesized
acagatatctagagcatggaca

SEQ ID NO: 1161530 - DNA, 22 bp, Artificial Sequence
  chemically synthesized
gcaaagaagttggctgtattat

SEQ ID NO: 1161531 - DNA, 22 bp, Artificial Sequence
  chemically synthesized
agcaaagaagttggctgtatta

SEQ ID NO: 1161532 - DNA, 22 bp, Artificial Sequence
  chemically synthesized
gagcatggacataatacagcca

SEQ ID NO: 1161533 - DNA, 22 bp, Artificial Sequence
  chemically synthesized
tcccttagcaaagaagttggct

SEQ ID NO: 1161534 - DNA, 22 bp, Artificial Sequence
  chemically synthesized
ttatcccttagcaaagaagttg

SEQ ID NO: 1161535 - DNA, 22 bp, Artificial Sequence
  chemically synthesized
gttatcccttagcaaagaagtt

SEQ ID NO: 1161536 - DNA, 22 bp, Artificial Sequence
  chemically synthesized
ctttgctaagggataacaaaca

SEQ ID NO: 1161537 - DNA, 22 bp, Artificial Sequence
  chemically synthesized
gagtaaatgacatgtttgttat

SEQ ID NO: 1161538 - DNA, 22 bp, Artificial Sequence
  chemically synthesized
tttgctaagggataacaaacat

SEQ ID NO: 1161539 - DNA, 22 bp, Artificial Sequence
  chemically synthesized
tgctaagggataacaaacatgt

SEQ ID NO: 1161540 - DNA, 22 bp, Artificial Sequence
  chemically synthesized
gctaagggataacaaacatgtc

SEQ ID NO: 1161541 - DNA, 22 bp, Artificial Sequence
  chemically synthesized
ctaagggataacaaacatgtca

SEQ ID NO: 1161542 - DNA, 22 bp, Artificial Sequence
  chemically synthesized
gcaactggagtaaatgacatgt

SEQ ID NO: 1161543 - DNA, 22 bp, Artificial Sequence
  chemically synthesized
agggataacaaacatgtcattt

SEQ ID NO: 1161544 - DNA, 22 bp, Artificial Sequence
  chemically synthesized
ttggcaactggagtaaatgaca

SEQ ID NO: 1161545 - DNA, 22 bp, Artificial Sequence
  chemically synthesized
attggcaactggagtaaatgac

SEQ ID NO: 1161546 - DNA, 22 bp, Artificial Sequence
  chemically synthesized
actccagttgccaataagttca

SEQ ID NO: 1161547 - DNA, 22 bp, Artificial Sequence
  chemically synthesized
agatggaaagaatgaacttatt

SEQ ID NO: 1161548 - DNA, 22 bp, Artificial Sequence
  chemically synthesized
ctccagttgccaataagttcat

SEQ ID NO: 1161549 - DNA, 22 bp, Artificial Sequence
  chemically synthesized
cagttgccaataagttcattct

SEQ ID NO: 1161550 - DNA, 22 bp, Artificial Sequence
  chemically synthesized
ccaataagttcattctttccat

SEQ ID NO: 1161551 - DNA, 22 bp, Artificial Sequence
  chemically synthesized
tcgaggtctcagatggaaagaa

SEQ ID NO: 1161552 - DNA, 22 bp, Artificial Sequence
  chemically synthesized
attctttccatctgagacctcg

SEQ ID NO: 1161553 - DNA, 22 bp, Artificial Sequence
  chemically synthesized
tttccatctgagacctcgacag

SEQ ID NO: 1161554 - DNA, 22 bp, Artificial Sequence
  chemically synthesized
tccatctgagacctcgacagct

SEQ ID NO: 1161555 - DNA, 22 bp, Artificial Sequence
  chemically synthesized
ccatctgagacctcgacagctt

SEQ ID NO: 1161556 - DNA, 22 bp, Artificial Sequence
  chemically synthesized
catctgagacctcgacagcttg

SEQ ID NO: 1161557 - DNA, 22 bp, Artificial Sequence
  chemically synthesized
atatgcacagtgaagtccaagc

SEQ ID NO: 1161558 - DNA, 22 bp, Artificial Sequence
  chemically synthesized
agacctcgacagcttggacttc

SEQ ID NO: 1161559 - DNA, 22 bp, Artificial Sequence
  chemically synthesized
atactgatatgcacagtgaagt

SEQ ID NO: 1161560 - DNA, 22 bp, Artificial Sequence
  chemically synthesized
gacagcttggacttcactgtgc

SEQ ID NO: 1161561 - DNA, 22 bp, Artificial Sequence
  chemically synthesized
ggacttcactgtgcatatcagt

SEQ ID NO: 1161562 - DNA, 22 bp, Artificial Sequence
  chemically synthesized
gacttcactgtgcatatcagta

SEQ ID NO: 1161563 - DNA, 22 bp, Artificial Sequence
  chemically synthesized
ccaaagtgctgatactgatatg

SEQ ID NO: 1161564 - DNA, 22 bp, Artificial Sequence
  chemically synthesized
ttaccaaagtgctgatactgat

SEQ ID NO: 1161565 - DNA, 22 bp, Artificial Sequence
  chemically synthesized
cactgtgcatatcagtatcagc

SEQ ID NO: 1161566 - DNA, 22 bp, Artificial Sequence
  chemically synthesized
actgtgcatatcagtatcagca

SEQ ID NO: 1161567 - DNA, 22 bp, Artificial Sequence
  chemically synthesized
tgcatatcagtatcagcacttt

SEQ ID NO: 1161568 - DNA, 22 bp, Artificial Sequence
  chemically synthesized
aatgattgttaccaaagtgctg

SEQ ID NO: 1161569 - DNA, 22 bp, Artificial Sequence
  chemically synthesized
gttaaatgattgttaccaaagt

SEQ ID NO: 1161570 - DNA, 22 bp, Artificial Sequence
  chemically synthesized
gagactggttaaatgattgtta

SEQ ID NO: 1161571 - DNA, 22 bp, Artificial Sequence
  chemically synthesized
agagactggttaaatgattgtt

SEQ ID NO: 1161572 - DNA, 22 bp, Artificial Sequence
  chemically synthesized
tggtaacaatcatttaaccagt

SEQ ID NO: 1161573 - DNA, 22 bp, Artificial Sequence
  chemically synthesized
ggtaacaatcatttaaccagtc

SEQ ID NO: 1161574 - DNA, 22 bp, Artificial Sequence
  chemically synthesized
gaatgtcttagagactggttaa

SEQ ID NO: 1161575 - DNA, 22 bp, Artificial Sequence
  chemically synthesized
gtaacaatcatttaaccagtct

SEQ ID NO: 1161576 - DNA, 22 bp, Artificial Sequence
  chemically synthesized
ggaatgtcttagagactggtta

SEQ ID NO: 1161577 - DNA, 22 bp, Artificial Sequence
  chemically synthesized
aaccagtctctaagacattcca

SEQ ID NO: 1161578 - DNA, 22 bp, Artificial Sequence
  chemically synthesized
accagtctctaagacattccaa

SEQ ID NO: 1161579 - DNA, 22 bp, Artificial Sequence
  chemically synthesized
taagacattccaaattttccct

SEQ ID NO: 1161580 - DNA, 22 bp, Artificial Sequence
  chemically synthesized
agacattccaaattttccctca

SEQ ID NO: 1161581 - DNA, 22 bp, Artificial Sequence
  chemically synthesized
agaagaagacagatgagggaaa

SEQ ID NO: 1161582 - DNA, 22 bp, Artificial Sequence
  chemically synthesized
caaattttccctcatctgtctt

SEQ ID NO: 1161583 - DNA, 22 bp, Artificial Sequence
  chemically synthesized
gagggctcagaagaagacagat

SEQ ID NO: 1161584 - DNA, 22 bp, Artificial Sequence
  chemically synthesized
ggagggctcagaagaagacaga

SEQ ID NO: 1161585 - DNA, 22 bp, Artificial Sequence
  chemically synthesized
tccctcatctgtcttcttctga

SEQ ID NO: 1161586 - DNA, 22 bp, Artificial Sequence
  chemically synthesized
ccctcatctgtcttcttctgag

SEQ ID NO: 1161587 - DNA, 22 bp, Artificial Sequence
  chemically synthesized
cctcatctgtcttcttctgagc

SEQ ID NO: 1161588 - DNA, 22 bp, Artificial Sequence
  chemically synthesized
gatgagtttggagggctcagaa

SEQ ID NO: 1161589 - DNA, 22 bp, Artificial Sequence
  chemically synthesized
atctgtcttcttctgagccctc

SEQ ID NO: 1161590 - DNA, 22 bp, Artificial Sequence
  chemically synthesized
tcttcttctgagccctccaaac

SEQ ID NO: 1161591 - DNA, 22 bp, Artificial Sequence
  chemically synthesized
cttctgagccctccaaactcat

SEQ ID NO: 1161592 - DNA, 22 bp, Artificial Sequence
  chemically synthesized
ttctgagccctccaaactcatc

SEQ ID NO: 1161593 - DNA, 22 bp, Artificial Sequence
  chemically synthesized
ctgagccctccaaactcatcca

SEQ ID NO: 1161594 - DNA, 22 bp, Artificial Sequence
  chemically synthesized
tgagccctccaaactcatccaa

SEQ ID NO: 1161595 - DNA, 22 bp, Artificial Sequence
  chemically synthesized
agccctccaaactcatccaact

SEQ ID NO: 1161596 - DNA, 22 bp, Artificial Sequence
  chemically synthesized
ggtaacagacagaagttggatg

SEQ ID NO: 1161597 - DNA, 22 bp, Artificial Sequence
  chemically synthesized
caaactcatccaacttctgtct

SEQ ID NO: 1161598 - DNA, 22 bp, Artificial Sequence
  chemically synthesized
aaattgggtaacagacagaagt

SEQ ID NO: 1161599 - DNA, 22 bp, Artificial Sequence
  chemically synthesized
gaaattgggtaacagacagaag

SEQ ID NO: 1161600 - DNA, 22 bp, Artificial Sequence
  chemically synthesized
tgaaattgggtaacagacagaa

SEQ ID NO: 1161601 - DNA, 22 bp, Artificial Sequence
  chemically synthesized
ctttgaaattgggtaacagaca

SEQ ID NO: 1161602 - DNA, 22 bp, Artificial Sequence
  chemically synthesized
atccaacttctgtctgttaccc

SEQ ID NO: 1161603 - DNA, 22 bp, Artificial Sequence
  chemically synthesized
ctgtctgttacccaatttcaaa

SEQ ID NO: 1161604 - DNA, 22 bp, Artificial Sequence
  chemically synthesized
tgtctgttacccaatttcaaag

SEQ ID NO: 1161605 - DNA, 22 bp, Artificial Sequence
  chemically synthesized
tctgttacccaatttcaaagca

SEQ ID NO: 1161606 - DNA, 22 bp, Artificial Sequence
  chemically synthesized
aaaatgtagaagctgctttgaa

SEQ ID NO: 1161607 - DNA, 22 bp, Artificial Sequence
  chemically synthesized
gaaaatgtagaagctgctttga

SEQ ID NO: 1161608 - DNA, 22 bp, Artificial Sequence
  chemically synthesized
ttacccaatttcaaagcagctt

SEQ ID NO: 1161609 - DNA, 22 bp, Artificial Sequence
  chemically synthesized
cccaatttcaaagcagcttcta

SEQ ID NO: 1161610 - DNA, 22 bp, Artificial Sequence
  chemically synthesized
tcaagatacttgaaaatgtaga

SEQ ID NO: 1161611 - DNA, 22 bp, Artificial Sequence
  chemically synthesized
caaagcagcttctacattttca

SEQ ID NO: 1161612 - DNA, 22 bp, Artificial Sequence
  chemically synthesized
aaagcagcttctacattttcaa

SEQ ID NO: 1161613 - DNA, 22 bp, Artificial Sequence
  chemically synthesized
ctgtcaagatacttgaaaatgt

SEQ ID NO: 1161614 - DNA, 22 bp, Artificial Sequence
  chemically synthesized
gctgtcaagatacttgaaaatg

SEQ ID NO: 1161615 - DNA, 22 bp, Artificial Sequence
  chemically synthesized
tgctgtcaagatacttgaaaat

SEQ ID NO: 1161616 - DNA, 22 bp, Artificial Sequence
  chemically synthesized
ctacattttcaagtatcttgac

SEQ ID NO: 1161617 - DNA, 22 bp, Artificial Sequence
  chemically synthesized
tacattttcaagtatcttgaca

SEQ ID NO: 1161618 - DNA, 22 bp, Artificial Sequence
  chemically synthesized
cattttcaagtatcttgacagc

SEQ ID NO: 1161619 - DNA, 22 bp, Artificial Sequence
  chemically synthesized
tcaagtatcttgacagcaaagc

SEQ ID NO: 1161620 - DNA, 22 bp, Artificial Sequence
  chemically synthesized
ccaagaagtggggctttgctgt

SEQ ID NO: 1161621 - DNA, 22 bp, Artificial Sequence
  chemically synthesized
caagtatcttgacagcaaagcc

SEQ ID NO: 1161622 - DNA, 22 bp, Artificial Sequence
  chemically synthesized
aagtatcttgacagcaaagccc

SEQ ID NO: 1161623 - DNA, 22 bp, Artificial Sequence
  chemically synthesized
ttaccaagaagtggggctttgc

SEQ ID NO: 1161624 - DNA, 22 bp, Artificial Sequence
  chemically synthesized
gacagcaaagccccacttcttg

SEQ ID NO: 1161625 - DNA, 22 bp, Artificial Sequence
  chemically synthesized
acagcaaagccccacttcttgg

SEQ ID NO: 1161626 - DNA, 22 bp, Artificial Sequence
  chemically synthesized
gtacagaaaattgttaccaaga

SEQ ID NO: 1161627 - DNA, 22 bp, Artificial Sequence
  chemically synthesized
cttggtaacaattttctgtact

SEQ ID NO: 1161628 - DNA, 22 bp, Artificial Sequence
  chemically synthesized
ttggtaacaattttctgtacta

SEQ ID NO: 1161629 - DNA, 22 bp, Artificial Sequence
  chemically synthesized
ggtaacaattttctgtactagg

SEQ ID NO: 1161630 - DNA, 22 bp, Artificial Sequence
  chemically synthesized
gtaacaattttctgtactaggc

SEQ ID NO: 1161631 - DNA, 22 bp, Artificial Sequence
  chemically synthesized
atagcaatgcgagagtggccta

SEQ ID NO: 1161632 - DNA, 22 bp, Artificial Sequence
  chemically synthesized
gatagcaatgcgagagtggcct

SEQ ID NO: 1161633 - DNA, 22 bp, Artificial Sequence
  chemically synthesized
ttgatagcaatgcgagagtggc

SEQ ID NO: 1161634 - DNA, 22 bp, Artificial Sequence
  chemically synthesized
cttgatagcaatgcgagagtgg

SEQ ID NO: 1161635 - DNA, 22 bp, Artificial Sequence
  chemically synthesized
tctgtactaggccactctcgca

SEQ ID NO: 1161636 - DNA, 22 bp, Artificial Sequence
  chemically synthesized
ctgtactaggccactctcgcat

SEQ ID NO: 1161637 - DNA, 22 bp, Artificial Sequence
  chemically synthesized
tgtactaggccactctcgcatt

SEQ ID NO: 1161638 - DNA, 22 bp, Artificial Sequence
  chemically synthesized
tactaggccactctcgcattgc

SEQ ID NO: 1161639 - DNA, 22 bp, Artificial Sequence
  chemically synthesized
aggtatttcttgatagcaatgc

SEQ ID NO: 1161640 - DNA, 22 bp, Artificial Sequence
  chemically synthesized
ggccactctcgcattgctatca

SEQ ID NO: 1161641 - DNA, 22 bp, Artificial Sequence
  chemically synthesized
agtctcaggtatttcttgatag

SEQ ID NO: 1161642 - DNA, 22 bp, Artificial Sequence
  chemically synthesized
ctcagtctcaggtatttcttga

SEQ ID NO: 1161643 - DNA, 22 bp, Artificial Sequence
  chemically synthesized
tcgcattgctatcaagaaatac

SEQ ID NO: 1161644 - DNA, 22 bp, Artificial Sequence
  chemically synthesized
gcattgctatcaagaaatacct

SEQ ID NO: 1161645 - DNA, 22 bp, Artificial Sequence
  chemically synthesized
taaattactcagtctcaggtat

SEQ ID NO: 1161646 - DNA, 22 bp, Artificial Sequence
  chemically synthesized
ataaattactcagtctcaggta

SEQ ID NO: 1161647 - DNA, 22 bp, Artificial Sequence
  chemically synthesized
ctatcaagaaatacctgagact

SEQ ID NO: 1161648 - DNA, 22 bp, Artificial Sequence
  chemically synthesized
tataaattactcagtctcaggt

SEQ ID NO: 1161649 - DNA, 22 bp, Artificial Sequence
  chemically synthesized
tttataaattactcagtctcag

SEQ ID NO: 1161650 - DNA, 22 bp, Artificial Sequence
  chemically synthesized
tcaagaaatacctgagactgag

SEQ ID NO: 1161651 - DNA, 22 bp, Artificial Sequence
  chemically synthesized
ctttataaattactcagtctca

SEQ ID NO: 1161652 - DNA, 22 bp, Artificial Sequence
  chemically synthesized
tctttataaattactcagtctc

SEQ ID NO: 1161653 - DNA, 22 bp, Artificial Sequence
  chemically synthesized
ttctttataaattactcagtct

SEQ ID NO: 1161654 - DNA, 22 bp, Artificial Sequence
  chemically synthesized
agcgtcttttctttataaatta

SEQ ID NO: 1161655 - DNA, 22 bp, Artificial Sequence
  chemically synthesized
agactgagtaatttataaagaa

SEQ ID NO: 1161656 - DNA, 22 bp, Artificial Sequence
  chemically synthesized
agtaatttataaagaaaagacg

SEQ ID NO: 1161657 - DNA, 22 bp, Artificial Sequence
  chemically synthesized
tgagccaattaagcgtcttttc

SEQ ID NO: 1161658 - DNA, 22 bp, Artificial Sequence
  chemically synthesized
ataaagaaaagacgcttaattg

SEQ ID NO: 1161659 - DNA, 22 bp, Artificial Sequence
  chemically synthesized
taaagaaaagacgcttaattgg

SEQ ID NO: 1161660 - DNA, 22 bp, Artificial Sequence
  chemically synthesized
tagaactgtgagccaattaagc

SEQ ID NO: 1161661 - DNA, 22 bp, Artificial Sequence
  chemically synthesized
tacagcctgtagaactgtgagc

SEQ ID NO: 1161662 - DNA, 22 bp, Artificial Sequence
  chemically synthesized
ctgtacagcctgtagaactgtg

SEQ ID NO: 1161663 - DNA, 22 bp, Artificial Sequence
  chemically synthesized
cctgtacagcctgtagaactgt

SEQ ID NO: 1161664 - DNA, 22 bp, Artificial Sequence
  chemically synthesized
aattggctcacagttctacagg

SEQ ID NO: 1161665 - DNA, 22 bp, Artificial Sequence
  chemically synthesized
attggctcacagttctacaggc

SEQ ID NO: 1161666 - DNA, 22 bp, Artificial Sequence
  chemically synthesized
gctcacagttctacaggctgta

SEQ ID NO: 1161667 - DNA, 22 bp, Artificial Sequence
  chemically synthesized
acagttctacaggctgtacagg

SEQ ID NO: 1161668 - DNA, 22 bp, Artificial Sequence
  chemically synthesized
tacaggctgtacaggaaatatg

SEQ ID NO: 1161669 - DNA, 22 bp, Artificial Sequence
  chemically synthesized
caggctgtacaggaaatatgat

SEQ ID NO: 1161670 - DNA, 22 bp, Artificial Sequence
  chemically synthesized
agcagatgccagcatcatattt

SEQ ID NO: 1161671 - DNA, 22 bp, Artificial Sequence
  chemically synthesized
tacaggaaatatgatgctggca

SEQ ID NO: 1161672 - DNA, 22 bp, Artificial Sequence
  chemically synthesized
cccagcagctgagcagatgcca

SEQ ID NO: 1161673 - DNA, 22 bp, Artificial Sequence
  chemically synthesized
aggcctccccagcagctgagca

SEQ ID NO: 1161674 - DNA, 22 bp, Artificial Sequence
  chemically synthesized
ctgaggcctccccagcagctga

SEQ ID NO: 1161675 - DNA, 22 bp, Artificial Sequence
  chemically synthesized
cctgaggcctccccagcagctg

SEQ ID NO: 1161676 - DNA, 22 bp, Artificial Sequence
  chemically synthesized
gcatctgctcagctgctgggga

SEQ ID NO: 1161677 - DNA, 22 bp, Artificial Sequence
  chemically synthesized
taagtttcctgaggcctcccca

SEQ ID NO: 1161678 - DNA, 22 bp, Artificial Sequence
  chemically synthesized
ctcagctgctggggaggcctca

SEQ ID NO: 1161679 - DNA, 22 bp, Artificial Sequence
  chemically synthesized
agctgctggggaggcctcagga

SEQ ID NO: 1161680 - DNA, 22 bp, Artificial Sequence
  chemically synthesized
ccataattgtaagtttcctgag

SEQ ID NO: 1161681 - DNA, 22 bp, Artificial Sequence
  chemically synthesized
ctggggaggcctcaggaaactt

SEQ ID NO: 1161682 - DNA, 22 bp, Artificial Sequence
  chemically synthesized
tgccataattgtaagtttcctg

SEQ ID NO: 1161683 - DNA, 22 bp, Artificial Sequence
  chemically synthesized
ctgccataattgtaagtttcct

SEQ ID NO: 1161684 - DNA, 22 bp, Artificial Sequence
  chemically synthesized
gggaggcctcaggaaacttaca

SEQ ID NO: 1161685 - DNA, 22 bp, Artificial Sequence
  chemically synthesized
accttctgccataattgtaagt

SEQ ID NO: 1161686 - DNA, 22 bp, Artificial Sequence
  chemically synthesized
caccttctgccataattgtaag

SEQ ID NO: 1161687 - DNA, 22 bp, Artificial Sequence
  chemically synthesized
cttcaccttctgccataattgt

SEQ ID NO: 1161688 - DNA, 22 bp, Artificial Sequence
  chemically synthesized
aggaaacttacaattatggcag

SEQ ID NO: 1161689 - DNA, 22 bp, Artificial Sequence
  chemically synthesized
ctccttcaccttctgccataat

SEQ ID NO: 1161690 - DNA, 22 bp, Artificial Sequence
  chemically synthesized
ttcctccttcaccttctgccat

SEQ ID NO: 1161691 - DNA, 22 bp, Artificial Sequence
  chemically synthesized
acaattatggcagaaggtgaag

SEQ ID NO: 1161692 - DNA, 22 bp, Artificial Sequence
  chemically synthesized
caattatggcagaaggtgaagg

SEQ ID NO: 1161693 - DNA, 22 bp, Artificial Sequence
  chemically synthesized
tggcagaaggtgaaggaggaac

SEQ ID NO: 1161694 - DNA, 22 bp, Artificial Sequence
  chemically synthesized
tggccatgtgatgtacctgttc

SEQ ID NO: 1161695 - DNA, 22 bp, Artificial Sequence
  chemically synthesized
ctgtggccatgtgatgtacctg

SEQ ID NO: 1161696 - DNA, 22 bp, Artificial Sequence
  chemically synthesized
ctgctgtggccatgtgatgtac

SEQ ID NO: 1161697 - DNA, 22 bp, Artificial Sequence
  chemically synthesized
ctcctgctgtggccatgtgatg

SEQ ID NO: 1161698 - DNA, 22 bp, Artificial Sequence
  chemically synthesized
gctcctgctgtggccatgtgat

SEQ ID NO: 1161699 - DNA, 22 bp, Artificial Sequence
  chemically synthesized
ttgctcctgctgtggccatgtg

SEQ ID NO: 1161700 - DNA, 22 bp, Artificial Sequence
  chemically synthesized
actcttgctcctgctgtggcca

SEQ ID NO: 1161701 - DNA, 22 bp, Artificial Sequence
  chemically synthesized
tcactcttgctcctgctgtggc

SEQ ID NO: 1161702 - DNA, 22 bp, Artificial Sequence
  chemically synthesized
cctctcactcttgctcctgctg

SEQ ID NO: 1161703 - DNA, 22 bp, Artificial Sequence
  chemically synthesized
aaagcgtggcaccctccctctc

SEQ ID NO: 1161704 - DNA, 22 bp, Artificial Sequence
  chemically synthesized
aaaagcgtggcaccctccctct

SEQ ID NO: 1161705 - DNA, 22 bp, Artificial Sequence
  chemically synthesized
tttaaaagcgtggcaccctccc

SEQ ID NO: 1161706 - DNA, 22 bp, Artificial Sequence
  chemically synthesized
gttgtttaaaagcgtggcaccc

SEQ ID NO: 1161707 - DNA, 22 bp, Artificial Sequence
  chemically synthesized
caagatctggttgtttaaaagc

SEQ ID NO: 1161708 - DNA, 22 bp, Artificial Sequence
  chemically synthesized
gcaagatctggttgtttaaaag

SEQ ID NO: 1161709 - DNA, 22 bp, Artificial Sequence
  chemically synthesized
ttgcaagatctggttgtttaaa

SEQ ID NO: 1161710 - DNA, 22 bp, Artificial Sequence
  chemically synthesized
ttaaacaaccagatcttgcaag

SEQ ID NO: 1161711 - DNA, 22 bp, Artificial Sequence
  chemically synthesized
taaacaaccagatcttgcaaga

SEQ ID NO: 1161712 - DNA, 22 bp, Artificial Sequence
  chemically synthesized
aaacaaccagatcttgcaagaa

SEQ ID NO: 1161713 - DNA, 22 bp, Artificial Sequence
  chemically synthesized
aacaaccagatcttgcaagaat

SEQ ID NO: 1161714 - DNA, 22 bp, Artificial Sequence
  chemically synthesized
caatagtgagtaaattcttgca

SEQ ID NO: 1161715 - DNA, 22 bp, Artificial Sequence
  chemically synthesized
gcaatagtgagtaaattcttgc

SEQ ID NO: 1161716 - DNA, 22 bp, Artificial Sequence
  chemically synthesized
tccttgcaatagtgagtaaatt

SEQ ID NO: 1161717 - DNA, 22 bp, Artificial Sequence
  chemically synthesized
ctgtccttgcaatagtgagtaa

SEQ ID NO: 1161718 - DNA, 22 bp, Artificial Sequence
  chemically synthesized
ctactgtccttgcaatagtgag

SEQ ID NO: 1161719 - DNA, 22 bp, Artificial Sequence
  chemically synthesized
gcaagaatttactcactattgc

SEQ ID NO: 1161720 - DNA, 22 bp, Artificial Sequence
  chemically synthesized
caagaatttactcactattgca

SEQ ID NO: 1161721 - DNA, 22 bp, Artificial Sequence
  chemically synthesized
gttgctactgtccttgcaatag

SEQ ID NO: 1161722 - DNA, 22 bp, Artificial Sequence
  chemically synthesized
actcactattgcaaggacagta

SEQ ID NO: 1161723 - DNA, 22 bp, Artificial Sequence
  chemically synthesized
ataattggttgctactgtcctt

SEQ ID NO: 1161724 - DNA, 22 bp, Artificial Sequence
  chemically synthesized
ctcactattgcaaggacagtag

SEQ ID NO: 1161725 - DNA, 22 bp, Artificial Sequence
  chemically synthesized
cataattggttgctactgtcct

SEQ ID NO: 1161726 - DNA, 22 bp, Artificial Sequence
  chemically synthesized
tcataattggttgctactgtcc

SEQ ID NO: 1161727 - DNA, 22 bp, Artificial Sequence
  chemically synthesized
ttcataattggttgctactgtc

SEQ ID NO: 1161728 - DNA, 22 bp, Artificial Sequence
  chemically synthesized
actattgcaaggacagtagcaa

SEQ ID NO: 1161729 - DNA, 22 bp, Artificial Sequence
  chemically synthesized
ttgcaaggacagtagcaaccaa

SEQ ID NO: 1161730 - DNA, 22 bp, Artificial Sequence
  chemically synthesized
caaggacagtagcaaccaatta

SEQ ID NO: 1161731 - DNA, 22 bp, Artificial Sequence
  chemically synthesized
gatcatgggggcaaatttttca

SEQ ID NO: 1161732 - DNA, 22 bp, Artificial Sequence
  chemically synthesized
attggatcatgggggcaaattt

SEQ ID NO: 1161733 - DNA, 22 bp, Artificial Sequence
  chemically synthesized
tgaaaaatttgcccccatgatc

SEQ ID NO: 1161734 - DNA, 22 bp, Artificial Sequence
  chemically synthesized
gtgggagctcattggatcatgg

SEQ ID NO: 1161735 - DNA, 22 bp, Artificial Sequence
  chemically synthesized
gcccccatgatccaatgagctc

SEQ ID NO: 1161736 - DNA, 22 bp, Artificial Sequence
  chemically synthesized
cccccatgatccaatgagctcc

SEQ ID NO: 1161737 - DNA, 22 bp, Artificial Sequence
  chemically synthesized
aggtagggcctagtgggagctc

SEQ ID NO: 1161738 - DNA, 22 bp, Artificial Sequence
  chemically synthesized
gaggtagggcctagtgggagct

SEQ ID NO: 1161739 - DNA, 22 bp, Artificial Sequence
  chemically synthesized
cagtgtttgaggtagggcctag

SEQ ID NO: 1161740 - DNA, 22 bp, Artificial Sequence
  chemically synthesized
ccactaggccctacctcaaaca

SEQ ID NO: 1161741 - DNA, 22 bp, Artificial Sequence
  chemically synthesized
tagtaatctgcagtgtttgagg

SEQ ID NO: 1161742 - DNA, 22 bp, Artificial Sequence
  chemically synthesized
ggccctacctcaaacactgcag

SEQ ID NO: 1161743 - DNA, 22 bp, Artificial Sequence
  chemically synthesized
aattgtagtaatctgcagtgtt

SEQ ID NO: 1161744 - DNA, 22 bp, Artificial Sequence
  chemically synthesized
acgttgaattgtagtaatctgc

SEQ ID NO: 1161745 - DNA, 22 bp, Artificial Sequence
  chemically synthesized
cctcaaacactgcagattacta

SEQ ID NO: 1161746 - DNA, 22 bp, Artificial Sequence
  chemically synthesized
aaacactgcagattactacaat

SEQ ID NO: 1161747 - DNA, 22 bp, Artificial Sequence
  chemically synthesized
aaatctcacgttgaattgtagt

SEQ ID NO: 1161748 - DNA, 22 bp, Artificial Sequence
  chemically synthesized
ctcaaatctcacgttgaattgt

SEQ ID NO: 1161749 - DNA, 22 bp, Artificial Sequence
  chemically synthesized
cagattactacaattcaacgtg

SEQ ID NO: 1161750 - DNA, 22 bp, Artificial Sequence
  chemically synthesized
ctacaattcaacgtgagatttg

SEQ ID NO: 1161751 - DNA, 22 bp, Artificial Sequence
  chemically synthesized
caattcaacgtgagatttgagc

SEQ ID NO: 1161752 - DNA, 22 bp, Artificial Sequence
  chemically synthesized
gacatgtgtgcctgctcaaatc

SEQ ID NO: 1161753 - DNA, 22 bp, Artificial Sequence
  chemically synthesized
ggacatgtgtgcctgctcaaat

SEQ ID NO: 1161754 - DNA, 22 bp, Artificial Sequence
  chemically synthesized
aacgtgagatttgagcaggcac

SEQ ID NO: 1161755 - DNA, 22 bp, Artificial Sequence
  chemically synthesized
atatagtttggacatgtgtgcc

SEQ ID NO: 1161756 - DNA, 22 bp, Artificial Sequence
  chemically synthesized
agttgatatagtttggacatgt

SEQ ID NO: 1161757 - DNA, 22 bp, Artificial Sequence
  chemically synthesized
gagttgatatagtttggacatg

SEQ ID NO: 1161758 - DNA, 22 bp, Artificial Sequence
  chemically synthesized
gagcaggcacacatgtccaaac

SEQ ID NO: 1161759 - DNA, 22 bp, Artificial Sequence
  chemically synthesized
agcaggcacacatgtccaaact

SEQ ID NO: 1161760 - DNA, 22 bp, Artificial Sequence
  chemically synthesized
ttgagttgatatagtttggaca

SEQ ID NO: 1161761 - DNA, 22 bp, Artificial Sequence
  chemically synthesized
ggttcttgagttgatatagttt

SEQ ID NO: 1161762 - DNA, 22 bp, Artificial Sequence
  chemically synthesized
aggttcttgagttgatatagtt

SEQ ID NO: 1161763 - DNA, 22 bp, Artificial Sequence
  chemically synthesized
ttaggttcttgagttgatatag

SEQ ID NO: 1161764 - DNA, 22 bp, Artificial Sequence
  chemically synthesized
cttaggttcttgagttgatata

SEQ ID NO: 1161765 - DNA, 22 bp, Artificial Sequence
  chemically synthesized
tatcaactcaagaacctaagaa

SEQ ID NO: 1161766 - DNA, 22 bp, Artificial Sequence
  chemically synthesized
aagaacctaagaaatctacctg

SEQ ID NO: 1161767 - DNA, 22 bp, Artificial Sequence
  chemically synthesized
gccacagtagaatagagcacca

SEQ ID NO: 1161768 - DNA, 22 bp, Artificial Sequence
  chemically synthesized
agaaatctacctggtgctctat

SEQ ID NO: 1161769 - DNA, 22 bp, Artificial Sequence
  chemically synthesized
agccacagtagaatagagcacc

SEQ ID NO: 1161770 - DNA, 22 bp, Artificial Sequence
  chemically synthesized
cctggtgctctattctactgtg

SEQ ID NO: 1161771 - DNA, 22 bp, Artificial Sequence
  chemically synthesized
gtgctctattctactgtggcta

SEQ ID NO: 1161772 - DNA, 22 bp, Artificial Sequence
  chemically synthesized
ggtggggtgccagcttagccac

SEQ ID NO: 1161773 - DNA, 22 bp, Artificial Sequence
  chemically synthesized
gggtggggtgccagcttagcca

SEQ ID NO: 1161774 - DNA, 22 bp, Artificial Sequence
  chemically synthesized
tgggtggggtgccagcttagcc

SEQ ID NO: 1161775 - DNA, 22 bp, Artificial Sequence
  chemically synthesized
tattctactgtggctaagctgg

SEQ ID NO: 1161776 - DNA, 22 bp, Artificial Sequence
  chemically synthesized
ttgggtggggtgccagcttagc

SEQ ID NO: 1161777 - DNA, 22 bp, Artificial Sequence
  chemically synthesized
ttctactgtggctaagctggca

SEQ ID NO: 1161778 - DNA, 22 bp, Artificial Sequence
  chemically synthesized
tcttttgggtggggtgccagct

SEQ ID NO: 1161779 - DNA, 22 bp, Artificial Sequence
  chemically synthesized
tactgtggctaagctggcaccc

SEQ ID NO: 1161780 - DNA, 22 bp, Artificial Sequence
  chemically synthesized
atcttttgggtggggtgccagc

SEQ ID NO: 1161781 - DNA, 22 bp, Artificial Sequence
  chemically synthesized
tatcttttgggtggggtgccag

SEQ ID NO: 1161782 - DNA, 22 bp, Artificial Sequence
  chemically synthesized
ctgtggctaagctggcacccca

SEQ ID NO: 1161783 - DNA, 22 bp, Artificial Sequence
  chemically synthesized
tggctaagctggcaccccaccc

SEQ ID NO: 1161784 - DNA, 22 bp, Artificial Sequence
  chemically synthesized
agctggcaccccacccaaaaga

SEQ ID NO: 1161785 - DNA, 22 bp, Artificial Sequence
  chemically synthesized
gcaccccacccaaaagataaag

SEQ ID NO: 1161786 - DNA, 22 bp, Artificial Sequence
  chemically synthesized
tggaaaggggagagaagagagg

SEQ ID NO: 1161787 - DNA, 22 bp, Artificial Sequence
  chemically synthesized
gtggaaaggggagagaagagag

SEQ ID NO: 1161788 - DNA, 22 bp, Artificial Sequence
  chemically synthesized
tttgtggaaaggggagagaaga

SEQ ID NO: 1161789 - DNA, 22 bp, Artificial Sequence
  chemically synthesized
tgtttgtggaaaggggagagaa

SEQ ID NO: 1161790 - DNA, 22 bp, Artificial Sequence
  chemically synthesized
ccctctcttctctcccctttcc

SEQ ID NO: 1161791 - DNA, 22 bp, Artificial Sequence
  chemically synthesized
cctctcttctctcccctttcca

SEQ ID NO: 1161792 - DNA, 22 bp, Artificial Sequence
  chemically synthesized
tcttctctcccctttccacaaa

SEQ ID NO: 1161793 - DNA, 22 bp, Artificial Sequence
  chemically synthesized
ttctctcccctttccacaaaca

SEQ ID NO: 1161794 - DNA, 22 bp, Artificial Sequence
  chemically synthesized
ctctcccctttccacaaacaga

SEQ ID NO: 1161795 - DNA, 22 bp, Artificial Sequence
  chemically synthesized
tctcccctttccacaaacagag

SEQ ID NO: 1161796 - DNA, 22 bp, Artificial Sequence
  chemically synthesized
tcccctttccacaaacagagat

SEQ ID NO: 1161797 - DNA, 22 bp, Artificial Sequence
  chemically synthesized
ccctttccacaaacagagatgt

SEQ ID NO: 1161798 - DNA, 22 bp, Artificial Sequence
  chemically synthesized
tccacaaacagagatgtctctc

SEQ ID NO: 1161799 - DNA, 22 bp, Artificial Sequence
  chemically synthesized
ccacaaacagagatgtctctcc

SEQ ID NO: 1161800 - DNA, 22 bp, Artificial Sequence
  chemically synthesized
cacaaacagagatgtctctcct

SEQ ID NO: 1161801 - DNA, 22 bp, Artificial Sequence
  chemically synthesized
agtagtcgtcgtggccatgagg

SEQ ID NO: 1161802 - DNA, 22 bp, Artificial Sequence
  chemically synthesized
gttcagtagtcgtcgtggccat

SEQ ID NO: 1161803 - DNA, 22 bp, Artificial Sequence
  chemically synthesized
ggttcagtagtcgtcgtggcca

SEQ ID NO: 1161804 - DNA, 22 bp, Artificial Sequence
  chemically synthesized
tggttcagtagtcgtcgtggcc

SEQ ID NO: 1161805 - DNA, 22 bp, Artificial Sequence
  chemically synthesized
tttggttcagtagtcgtcgtgg

SEQ ID NO: 1161806 - DNA, 22 bp, Artificial Sequence
  chemically synthesized
tctttggttcagtagtcgtcgt

SEQ ID NO: 1161807 - DNA, 22 bp, Artificial Sequence
  chemically synthesized
tcctcatggccacgacgactac

SEQ ID NO: 1161808 - DNA, 22 bp, Artificial Sequence
  chemically synthesized
ctcatggccacgacgactactg

SEQ ID NO: 1161809 - DNA, 22 bp, Artificial Sequence
  chemically synthesized
atggccacgacgactactgaac

SEQ ID NO: 1161810 - DNA, 22 bp, Artificial Sequence
  chemically synthesized
agacagtactctctttggttca

SEQ ID NO: 1161811 - DNA, 22 bp, Artificial Sequence
  chemically synthesized
gacctcagacagtactctcttt

SEQ ID NO: 1161812 - DNA, 22 bp, Artificial Sequence
  chemically synthesized
ctgaaccaaagagagtactgtc

SEQ ID NO: 1161813 - DNA, 22 bp, Artificial Sequence
  chemically synthesized
aaccaaagagagtactgtctga

SEQ ID NO: 1161814 - DNA, 22 bp, Artificial Sequence
  chemically synthesized
agtgaacattggacctcagaca

SEQ ID NO: 1161815 - DNA, 22 bp, Artificial Sequence
  chemically synthesized
gagtgaacattggacctcagac

SEQ ID NO: 1161816 - DNA, 22 bp, Artificial Sequence
  chemically synthesized
gcccttgagtgaacattggacc

SEQ ID NO: 1161817 - DNA, 22 bp, Artificial Sequence
  chemically synthesized
ggcccttgagtgaacattggac

SEQ ID NO: 1161818 - DNA, 22 bp, Artificial Sequence
  chemically synthesized
tctgaggtccaatgttcactca

SEQ ID NO: 1161819 - DNA, 22 bp, Artificial Sequence
  chemically synthesized
aggtccaatgttcactcaaggg

SEQ ID NO: 1161820 - DNA, 22 bp, Artificial Sequence
  chemically synthesized
gccaaagtggccttggcccttg

SEQ ID NO: 1161821 - DNA, 22 bp, Artificial Sequence
  chemically synthesized
actcaagggccaaggccacttt

SEQ ID NO: 1161822 - DNA, 22 bp, Artificial Sequence
  chemically synthesized
accacaggctggccaaagtggc

SEQ ID NO: 1161823 - DNA, 22 bp, Artificial Sequence
  chemically synthesized
aagggccaaggccactttggcc

SEQ ID NO: 1161824 - DNA, 22 bp, Artificial Sequence
  chemically synthesized
acagcattcaccacaggctggc

SEQ ID NO: 1161825 - DNA, 22 bp, Artificial Sequence
  chemically synthesized
aggactgacagcattcaccaca

SEQ ID NO: 1161826 - DNA, 22 bp, Artificial Sequence
  chemically synthesized
tggccagcctgtggtgaatgct

SEQ ID NO: 1161827 - DNA, 22 bp, Artificial Sequence
  chemically synthesized
ggccagcctgtggtgaatgctg

SEQ ID NO: 1161828 - DNA, 22 bp, Artificial Sequence
  chemically synthesized
gccagcctgtggtgaatgctgt

SEQ ID NO: 1161829 - DNA, 22 bp, Artificial Sequence
  chemically synthesized
aagggagagactcaggactgac

SEQ ID NO: 1161830 - DNA, 22 bp, Artificial Sequence
  chemically synthesized
tggtgaatgctgtcagtcctga

SEQ ID NO: 1161831 - DNA, 22 bp, Artificial Sequence
  chemically synthesized
ccctgaagggagagactcagga

SEQ ID NO: 1161832 - DNA, 22 bp, Artificial Sequence
  chemically synthesized
ctgccctgaagggagagactca

SEQ ID NO: 1161833 - DNA, 22 bp, Artificial Sequence
  chemically synthesized
actgccctgaagggagagactc

SEQ ID NO: 1161834 - DNA, 22 bp, Artificial Sequence
  chemically synthesized
ttactgccctgaagggagagac

SEQ ID NO: 1161835 - DNA, 22 bp, Artificial Sequence
  chemically synthesized
cttactgccctgaagggagaga

SEQ ID NO: 1161836 - DNA, 22 bp, Artificial Sequence
  chemically synthesized
tcagtcctgagtctctcccttc

SEQ ID NO: 1161837 - DNA, 22 bp, Artificial Sequence
  chemically synthesized
tcttactgccctgaagggagag

SEQ ID NO: 1161838 - DNA, 22 bp, Artificial Sequence
  chemically synthesized
cattttcttactgccctgaagg

SEQ ID NO: 1161839 - DNA, 22 bp, Artificial Sequence
  chemically synthesized
agtctctcccttcagggcagta

SEQ ID NO: 1161840 - DNA, 22 bp, Artificial Sequence
  chemically synthesized
gattccattttcttactgccct

SEQ ID NO: 1161841 - DNA, 22 bp, Artificial Sequence
  chemically synthesized
ctggattccattttcttactgc

SEQ ID NO: 1161842 - DNA, 22 bp, Artificial Sequence
  chemically synthesized
tcccttcagggcagtaagaaaa

SEQ ID NO: 1161843 - DNA, 22 bp, Artificial Sequence
  chemically synthesized
ccttcagggcagtaagaaaatg

SEQ ID NO: 1161844 - DNA, 22 bp, Artificial Sequence
  chemically synthesized
gctcctggattccattttctta

SEQ ID NO: 1161845 - DNA, 22 bp, Artificial Sequence
  chemically synthesized
ggctcctggattccattttctt

SEQ ID NO: 1161846 - DNA, 22 bp, Artificial Sequence
  chemically synthesized
cagggcagtaagaaaatggaat

SEQ ID NO: 1161847 - DNA, 22 bp, Artificial Sequence
  chemically synthesized
agggcagtaagaaaatggaatc

SEQ ID NO: 1161848 - DNA, 22 bp, Artificial Sequence
  chemically synthesized
cagagtttggctcctggattcc

SEQ ID NO: 1161849 - DNA, 22 bp, Artificial Sequence
  chemically synthesized
attccagagtttggctcctgga

SEQ ID NO: 1161850 - DNA, 22 bp, Artificial Sequence
  chemically synthesized
gggtccctgattccagagtttg

SEQ ID NO: 1161851 - DNA, 22 bp, Artificial Sequence
  chemically synthesized
ctagggtccctgattccagagt

SEQ ID NO: 1161852 - DNA, 22 bp, Artificial Sequence
  chemically synthesized
tggaatcagggaccctaggagc

SEQ ID NO: 1161853 - DNA, 22 bp, Artificial Sequence
  chemically synthesized
gaatcagggaccctaggagccc

SEQ ID NO: 1161854 - DNA, 22 bp, Artificial Sequence
  chemically synthesized
accacagtggggcagagcatca

SEQ ID NO: 1161855 - DNA, 22 bp, Artificial Sequence
  chemically synthesized
gaccacagtggggcagagcatc

SEQ ID NO: 1161856 - DNA, 22 bp, Artificial Sequence
  chemically synthesized
ggagcccacttgatgctctgcc

SEQ ID NO: 1161857 - DNA, 22 bp, Artificial Sequence
  chemically synthesized
cagtttgaccacagtggggcag

SEQ ID NO: 1161858 - DNA, 22 bp, Artificial Sequence
  chemically synthesized
ggttccagtttgaccacagtgg

SEQ ID NO: 1161859 - DNA, 22 bp, Artificial Sequence
  chemically synthesized
gatgctctgccccactgtggtc

SEQ ID NO: 1161860 - DNA, 22 bp, Artificial Sequence
  chemically synthesized
gggttccagtttgaccacagtg

SEQ ID NO: 1161861 - DNA, 22 bp, Artificial Sequence
  chemically synthesized
atgctctgccccactgtggtca

SEQ ID NO: 1161862 - DNA, 22 bp, Artificial Sequence
  chemically synthesized
cagcttgggttccagtttgacc

SEQ ID NO: 1161863 - DNA, 22 bp, Artificial Sequence
  chemically synthesized
tgccccactgtggtcaaactgg

SEQ ID NO: 1161864 - DNA, 22 bp, Artificial Sequence
  chemically synthesized
gcagcttgggttccagtttgac

SEQ ID NO: 1161865 - DNA, 22 bp, Artificial Sequence
  chemically synthesized
ccccactgtggtcaaactggaa

SEQ ID NO: 1161866 - DNA, 22 bp, Artificial Sequence
  chemically synthesized
gcttgcagcttgggttccagtt

SEQ ID NO: 1161867 - DNA, 22 bp, Artificial Sequence
  chemically synthesized
ggcttgcagcttgggttccagt

SEQ ID NO: 1161868 - DNA, 22 bp, Artificial Sequence
  chemically synthesized
tggcttgcagcttgggttccag

SEQ ID NO: 1161869 - DNA, 22 bp, Artificial Sequence
  chemically synthesized
tggtcaaactggaacccaagct

SEQ ID NO: 1161870 - DNA, 22 bp, Artificial Sequence
  chemically synthesized
gaacccaagctgcaagccaaag

SEQ ID NO: 1161871 - DNA, 22 bp, Artificial Sequence
  chemically synthesized
caagccaaagtcccctttactc

SEQ ID NO: 1161872 - DNA, 22 bp, Artificial Sequence
  chemically synthesized
aggaaaggagaggtgagagtaa

SEQ ID NO: 1161873 - DNA, 22 bp, Artificial Sequence
  chemically synthesized
caggaaaggagaggtgagagta

SEQ ID NO: 1161874 - DNA, 22 bp, Artificial Sequence
  chemically synthesized
cttcaggaaaggagaggtgaga

SEQ ID NO: 1161875 - DNA, 22 bp, Artificial Sequence
  chemically synthesized
tgcttcaggaaaggagaggtga

SEQ ID NO: 1161876 - DNA, 22 bp, Artificial Sequence
  chemically synthesized
ctgcttcaggaaaggagaggtg

SEQ ID NO: 1161877 - DNA, 22 bp, Artificial Sequence
  chemically synthesized
tactctcacctctcctttcctg

SEQ ID NO: 1161878 - DNA, 22 bp, Artificial Sequence
  chemically synthesized
actctcacctctcctttcctga

SEQ ID NO: 1161879 - DNA, 22 bp, Artificial Sequence
  chemically synthesized
ctctcacctctcctttcctgaa

SEQ ID NO: 1161880 - DNA, 22 bp, Artificial Sequence
  chemically synthesized
tcacctctcctttcctgaagca

SEQ ID NO: 1161881 - DNA, 22 bp, Artificial Sequence
  chemically synthesized
acctctcctttcctgaagcaga

SEQ ID NO: 1161882 - DNA, 22 bp, Artificial Sequence
  chemically synthesized
cagggagagaatccttctgctt

SEQ ID NO: 1161883 - DNA, 22 bp, Artificial Sequence
  chemically synthesized
tcctttcctgaagcagaaggat

SEQ ID NO: 1161884 - DNA, 22 bp, Artificial Sequence
  chemically synthesized
ctttcctgaagcagaaggattc

SEQ ID NO: 1161885 - DNA, 22 bp, Artificial Sequence
  chemically synthesized
tcctgaagcagaaggattctct

SEQ ID NO: 1161886 - DNA, 22 bp, Artificial Sequence
  chemically synthesized
cctgaagcagaaggattctctc

SEQ ID NO: 1161887 - DNA, 22 bp, Artificial Sequence
  chemically synthesized
ctgaagcagaaggattctctcc

SEQ ID NO: 1161888 - DNA, 22 bp, Artificial Sequence
  chemically synthesized
tggtggctacagggagagaatc

SEQ ID NO: 1161889 - DNA, 22 bp, Artificial Sequence
  chemically synthesized
aagcagaaggattctctccctg

SEQ ID NO: 1161890 - DNA, 22 bp, Artificial Sequence
  chemically synthesized
ccagctgtggtggctacaggga

SEQ ID NO: 1161891 - DNA, 22 bp, Artificial Sequence
  chemically synthesized
tctccctgtagccaccacagct

SEQ ID NO: 1161892 - DNA, 22 bp, Artificial Sequence
  chemically synthesized
tccctgtagccaccacagctgg

SEQ ID NO: 1161893 - DNA, 22 bp, Artificial Sequence
  chemically synthesized
cctgtagccaccacagctggga

SEQ ID NO: 1161894 - DNA, 22 bp, Artificial Sequence
  chemically synthesized
tagccaccacagctgggaatgt

SEQ ID NO: 1161895 - DNA, 22 bp, Artificial Sequence
  chemically synthesized
aggtgtgacccagtacattccc

SEQ ID NO: 1161896 - DNA, 22 bp, Artificial Sequence
  chemically synthesized
caggtgtgacccagtacattcc

SEQ ID NO: 1161897 - DNA, 22 bp, Artificial Sequence
  chemically synthesized
tgatggtttcaggtgtgaccca

SEQ ID NO: 1161898 - DNA, 22 bp, Artificial Sequence
  chemically synthesized
ggaatgtactgggtcacacctg

SEQ ID NO: 1161899 - DNA, 22 bp, Artificial Sequence
  chemically synthesized
agagctgtgatggtttcaggtg

SEQ ID NO: 1161900 - DNA, 22 bp, Artificial Sequence
  chemically synthesized
ggtcacacctgaaaccatcaca

SEQ ID NO: 1161901 - DNA, 22 bp, Artificial Sequence
  chemically synthesized
ggtgagactcagagctgtgatg

SEQ ID NO: 1161902 - DNA, 22 bp, Artificial Sequence
  chemically synthesized
aaaccatcacagctctgagtct

SEQ ID NO: 1161903 - DNA, 22 bp, Artificial Sequence
  chemically synthesized
tgggtattgggtgagactcaga

SEQ ID NO: 1161904 - DNA, 22 bp, Artificial Sequence
  chemically synthesized
ctgtgggtattgggtgagactc

SEQ ID NO: 1161905 - DNA, 22 bp, Artificial Sequence
  chemically synthesized
gctgtgggtattgggtgagact

SEQ ID NO: 1161906 - DNA, 22 bp, Artificial Sequence
  chemically synthesized
tgagtctcacccaatacccaca

SEQ ID NO: 1161907 - DNA, 22 bp, Artificial Sequence
  chemically synthesized
agtctcacccaatacccacagc

SEQ ID NO: 1161908 - DNA, 22 bp, Artificial Sequence
  chemically synthesized
tagccaggcagtacttgctgtg

SEQ ID NO: 1161909 - DNA, 22 bp, Artificial Sequence
  chemically synthesized
acccaatacccacagcaagtac

SEQ ID NO: 1161910 - DNA, 22 bp, Artificial Sequence
  chemically synthesized
aataatcagcagctgtagccag

SEQ ID NO: 1161911 - DNA, 22 bp, Artificial Sequence
  chemically synthesized
gggccctgaataatcagcagct

SEQ ID NO: 1161912 - DNA, 22 bp, Artificial Sequence
  chemically synthesized
cctggctacagctgctgattat

SEQ ID NO: 1161913 - DNA, 22 bp, Artificial Sequence
  chemically synthesized
gctacagctgctgattattcag

SEQ ID NO: 1161914 - DNA, 22 bp, Artificial Sequence
  chemically synthesized
cagctgctgattattcagggcc

SEQ ID NO: 1161915 - DNA, 22 bp, Artificial Sequence
  chemically synthesized
accaaagggacctagggccctg

SEQ ID NO: 1161916 - DNA, 22 bp, Artificial Sequence
  chemically synthesized
ctgattattcagggccctaggt

SEQ ID NO: 1161917 - DNA, 22 bp, Artificial Sequence
  chemically synthesized
attattcagggccctaggtccc

SEQ ID NO: 1161918 - DNA, 22 bp, Artificial Sequence
  chemically synthesized
ttcagggccctaggtccctttg

SEQ ID NO: 1161919 - DNA, 22 bp, Artificial Sequence
  chemically synthesized
atgacatgctgaccaaagggac

SEQ ID NO: 1161920 - DNA, 22 bp, Artificial Sequence
  chemically synthesized
agggccctaggtccctttggtc

SEQ ID NO: 1161921 - DNA, 22 bp, Artificial Sequence
  chemically synthesized
gcagaattcatgacatgctgac

SEQ ID NO: 1161922 - DNA, 22 bp, Artificial Sequence
  chemically synthesized
ggtccctttggtcagcatgtca

SEQ ID NO: 1161923 - DNA, 22 bp, Artificial Sequence
  chemically synthesized
tggtcagcatgtcatgaattct

SEQ ID NO: 1161924 - DNA, 22 bp, Artificial Sequence
  chemically synthesized
ggtcagcatgtcatgaattctg

SEQ ID NO: 1161925 - DNA, 22 bp, Artificial Sequence
  chemically synthesized
gtcagcatgtcatgaattctgc

SEQ ID NO: 1161926 - DNA, 22 bp, Artificial Sequence
  chemically synthesized
aagagaaggaccccgtcctggc

SEQ ID NO: 1161927 - DNA, 22 bp, Artificial Sequence
  chemically synthesized
gaagagaaggaccccgtcctgg

SEQ ID NO: 1161928 - DNA, 22 bp, Artificial Sequence
  chemically synthesized
tcaccttgaagagaaggacccc

SEQ ID NO: 1161929 - DNA, 22 bp, Artificial Sequence
  chemically synthesized
tgccaggacggggtccttctct

SEQ ID NO: 1161930 - DNA, 22 bp, Artificial Sequence
  chemically synthesized
ccaggacggggtccttctcttc

SEQ ID NO: 1161931 - DNA, 22 bp, Artificial Sequence
  chemically synthesized
ggccagaagagagcctgtcacc

SEQ ID NO: 1161932 - DNA, 22 bp, Artificial Sequence
  chemically synthesized
ctcttcaaggtgacaggctctc

SEQ ID NO: 1161933 - DNA, 22 bp, Artificial Sequence
  chemically synthesized
tcttcaaggtgacaggctctct

SEQ ID NO: 1161934 - DNA, 22 bp, Artificial Sequence
  chemically synthesized
ttcaaggtgacaggctctcttc

SEQ ID NO: 1161935 - DNA, 22 bp, Artificial Sequence
  chemically synthesized
caaggtgacaggctctcttctg

SEQ ID NO: 1161936 - DNA, 22 bp, Artificial Sequence
  chemically synthesized
aaggtgacaggctctcttctgg

SEQ ID NO: 1161937 - DNA, 22 bp, Artificial Sequence
  chemically synthesized
aacacaccctgggccagaagag

SEQ ID NO: 1161938 - DNA, 22 bp, Artificial Sequence
  chemically synthesized
tgaacacaccctgggccagaag

SEQ ID NO: 1161939 - DNA, 22 bp, Artificial Sequence
  chemically synthesized
ctgaacacaccctgggccagaa

SEQ ID NO: 1161940 - DNA, 22 bp, Artificial Sequence
  chemically synthesized
tcttctggcccagggtgtgttc

SEQ ID NO: 1161941 - DNA, 22 bp, Artificial Sequence
  chemically synthesized
ttctggcccagggtgtgttcag

SEQ ID NO: 1161942 - DNA, 22 bp, Artificial Sequence
  chemically synthesized
acagataacatttctgaacaca

SEQ ID NO: 1161943 - DNA, 22 bp, Artificial Sequence
  chemically synthesized
ctggcccagggtgtgttcagaa

SEQ ID NO: 1161944 - DNA, 22 bp, Artificial Sequence
  chemically synthesized
tggcccagggtgtgttcagaaa

SEQ ID NO: 1161945 - DNA, 22 bp, Artificial Sequence
  chemically synthesized
gcccagggtgtgttcagaaatg

SEQ ID NO: 1161946 - DNA, 22 bp, Artificial Sequence
  chemically synthesized
gctcacagataacatttctgaa

SEQ ID NO: 1161947 - DNA, 22 bp, Artificial Sequence
  chemically synthesized
caggccctagctcacagataac

SEQ ID NO: 1161948 - DNA, 22 bp, Artificial Sequence
  chemically synthesized
agaaatgttatctgtgagctag

SEQ ID NO: 1161949 - DNA, 22 bp, Artificial Sequence
  chemically synthesized
aggtccccattccaggccctag

SEQ ID NO: 1161950 - DNA, 22 bp, Artificial Sequence
  chemically synthesized
gaggtccccattccaggcccta

SEQ ID NO: 1161951 - DNA, 22 bp, Artificial Sequence
  chemically synthesized
tctgtgagctagggcctggaat

SEQ ID NO: 1161952 - DNA, 22 bp, Artificial Sequence
  chemically synthesized
tgagctagggcctggaatgggg

SEQ ID NO: 1161953 - DNA, 22 bp, Artificial Sequence
  chemically synthesized
gggcctggaatggggacctcaa

SEQ ID NO: 1161954 - DNA, 22 bp, Artificial Sequence
  chemically synthesized
gaatggggacctcaagactctg

SEQ ID NO: 1161955 - DNA, 22 bp, Artificial Sequence
  chemically synthesized
aagactctgcctggtgccctat

SEQ ID NO: 1161956 - DNA, 22 bp, Artificial Sequence
  chemically synthesized
agacatacaataggatagggca

SEQ ID NO: 1161957 - DNA, 22 bp, Artificial Sequence
  chemically synthesized
tgcctggtgccctatcctattg

SEQ ID NO: 1161958 - DNA, 22 bp, Artificial Sequence
  chemically synthesized
cctggtgccctatcctattgta

SEQ ID NO: 1161959 - DNA, 22 bp, Artificial Sequence
  chemically synthesized
gtgccctatcctattgtatgtc

SEQ ID NO: 1161960 - DNA, 22 bp, Artificial Sequence
  chemically synthesized
gataccagctcagacatacaat

SEQ ID NO: 1161961 - DNA, 22 bp, Artificial Sequence
  chemically synthesized
ggataccagctcagacatacaa

SEQ ID NO: 1161962 - DNA, 22 bp, Artificial Sequence
  chemically synthesized
cttggataccagctcagacata

SEQ ID NO: 1161963 - DNA, 22 bp, Artificial Sequence
  chemically synthesized
ctgcttggataccagctcagac

SEQ ID NO: 1161964 - DNA, 22 bp, Artificial Sequence
  chemically synthesized
tcctattgtatgtctgagctgg

SEQ ID NO: 1161965 - DNA, 22 bp, Artificial Sequence
  chemically synthesized
gctgcttggataccagctcaga

SEQ ID NO: 1161966 - DNA, 22 bp, Artificial Sequence
  chemically synthesized
tcttgctgcttggataccagct

SEQ ID NO: 1161967 - DNA, 22 bp, Artificial Sequence
  chemically synthesized
ttgtatgtctgagctggtatcc

SEQ ID NO: 1161968 - DNA, 22 bp, Artificial Sequence
  chemically synthesized
gtcttgctgcttggataccagc

SEQ ID NO: 1161969 - DNA, 22 bp, Artificial Sequence
  chemically synthesized
tgtcttgctgcttggataccag

SEQ ID NO: 1161970 - DNA, 22 bp, Artificial Sequence
  chemically synthesized
tatgtctgagctggtatccaag

SEQ ID NO: 1161971 - DNA, 22 bp, Artificial Sequence
  chemically synthesized
agctggtatccaagcagcaaga

SEQ ID NO: 1161972 - DNA, 22 bp, Artificial Sequence
  chemically synthesized
gtatccaagcagcaagacaaag

SEQ ID NO: 1161973 - DNA, 22 bp, Artificial Sequence
  chemically synthesized
tgaagaagagaggagacaagaa

SEQ ID NO: 1161974 - DNA, 22 bp, Artificial Sequence
  chemically synthesized
atgaagaagagaggagacaaga

SEQ ID NO: 1161975 - DNA, 22 bp, Artificial Sequence
  chemically synthesized
cgcttatgaagaagagaggaga

SEQ ID NO: 1161976 - DNA, 22 bp, Artificial Sequence
  chemically synthesized
ccgcttatgaagaagagaggag

SEQ ID NO: 1161977 - DNA, 22 bp, Artificial Sequence
  chemically synthesized
tctttcttgtctcctctcttct

SEQ ID NO: 1161978 - DNA, 22 bp, Artificial Sequence
  chemically synthesized
cttccgcttatgaagaagagag

SEQ ID NO: 1161979 - DNA, 22 bp, Artificial Sequence
  chemically synthesized
tttcttgtctcctctcttcttc

SEQ ID NO: 1161980 - DNA, 22 bp, Artificial Sequence
  chemically synthesized
ccttccgcttatgaagaagaga

SEQ ID NO: 1161981 - DNA, 22 bp, Artificial Sequence
  chemically synthesized
tcttgtctcctctcttcttcat

SEQ ID NO: 1161982 - DNA, 22 bp, Artificial Sequence
  chemically synthesized
cttgtctcctctcttcttcata

SEQ ID NO: 1161983 - DNA, 22 bp, Artificial Sequence
  chemically synthesized
cttccttccgcttatgaagaag

SEQ ID NO: 1161984 - DNA, 22 bp, Artificial Sequence
  chemically synthesized
ttgtctcctctcttcttcataa

SEQ ID NO: 1161985 - DNA, 22 bp, Artificial Sequence
  chemically synthesized
gtctcctctcttcttcataagc

SEQ ID NO: 1161986 - DNA, 22 bp, Artificial Sequence
  chemically synthesized
tctcctctcttcttcataagcg

SEQ ID NO: 1161987 - DNA, 22 bp, Artificial Sequence
  chemically synthesized
ctctcttcttcataagcggaag

SEQ ID NO: 1161988 - DNA, 22 bp, Artificial Sequence
  chemically synthesized
tcttcttcataagcggaaggaa

SEQ ID NO: 1161989 - DNA, 22 bp, Artificial Sequence
  chemically synthesized
caggaaagactccttccttccg

SEQ ID NO: 1161990 - DNA, 22 bp, Artificial Sequence
  chemically synthesized
ttcttcataagcggaaggaagg

SEQ ID NO: 1161991 - DNA, 22 bp, Artificial Sequence
  chemically synthesized
cttcataagcggaaggaaggag

SEQ ID NO: 1161992 - DNA, 22 bp, Artificial Sequence
  chemically synthesized
ttcataagcggaaggaaggagt

SEQ ID NO: 1161993 - DNA, 22 bp, Artificial Sequence
  chemically synthesized
cataagcggaaggaaggagtct

SEQ ID NO: 1161994 - DNA, 22 bp, Artificial Sequence
  chemically synthesized
ataagcggaaggaaggagtctt

SEQ ID NO: 1161995 - DNA, 22 bp, Artificial Sequence
  chemically synthesized
acagctccaggaaagactcctt

SEQ ID NO: 1161996 - DNA, 22 bp, Artificial Sequence
  chemically synthesized
tcctggagctgtgagctgtgct

SEQ ID NO: 1161997 - DNA, 22 bp, Artificial Sequence
  chemically synthesized
cctggagctgtgagctgtgctg

SEQ ID NO: 1161998 - DNA, 22 bp, Artificial Sequence
  chemically synthesized
ctggagctgtgagctgtgctgc

SEQ ID NO: 1161999 - DNA, 22 bp, Artificial Sequence
  chemically synthesized
ccccaaccccaggcagcacagc

SEQ ID NO: 1162000 - DNA, 22 bp, Artificial Sequence
  chemically synthesized
cccccaaccccaggcagcacag

SEQ ID NO: 1162001 - DNA, 22 bp, Artificial Sequence
  chemically synthesized
gagctgtgagctgtgctgcctg

SEQ ID NO: 1162002 - DNA, 22 bp, Artificial Sequence
  chemically synthesized
ccttcccccaaccccaggcagc

SEQ ID NO: 1162003 - DNA, 22 bp, Artificial Sequence
  chemically synthesized
cccttcccccaaccccaggcag

SEQ ID NO: 1162004 - DNA, 22 bp, Artificial Sequence
  chemically synthesized
tgagctgtgctgcctggggttg

SEQ ID NO: 1162005 - DNA, 22 bp, Artificial Sequence
  chemically synthesized
tgcttcccttcccccaacccca

SEQ ID NO: 1162006 - DNA, 22 bp, Artificial Sequence
  chemically synthesized
gtgcttcccttcccccaacccc

SEQ ID NO: 1162007 - DNA, 22 bp, Artificial Sequence
  chemically synthesized
cttgtgcttcccttcccccaac

SEQ ID NO: 1162008 - DNA, 22 bp, Artificial Sequence
  chemically synthesized
tgctgcctggggttgggggaag

SEQ ID NO: 1162009 - DNA, 22 bp, Artificial Sequence
  chemically synthesized
cctggggttgggggaagggaag

SEQ ID NO: 1162010 - DNA, 22 bp, Artificial Sequence
  chemically synthesized
agggactgcttgtgcttccctt

SEQ ID NO: 1162011 - DNA, 22 bp, Artificial Sequence
  chemically synthesized
gggttgggggaagggaagcaca

SEQ ID NO: 1162012 - DNA, 22 bp, Artificial Sequence
  chemically synthesized
ggggaagggaagcacaagcagt

SEQ ID NO: 1162013 - DNA, 22 bp, Artificial Sequence
  chemically synthesized
gggcagctaagggactgcttgt

SEQ ID NO: 1162014 - DNA, 22 bp, Artificial Sequence
  chemically synthesized
gtgagacatccgctggggcagc

SEQ ID NO: 1162015 - DNA, 22 bp, Artificial Sequence
  chemically synthesized
agctgccccagcggatgtctca

SEQ ID NO: 1162016 - DNA, 22 bp, Artificial Sequence
  chemically synthesized
gctgccccagcggatgtctcac

SEQ ID NO: 1162017 - DNA, 22 bp, Artificial Sequence
  chemically synthesized
ccccagcggatgtctcactagg

SEQ ID NO: 1162018 - DNA, 22 bp, Artificial Sequence
  chemically synthesized
ggatacatacaacctagtgaga

SEQ ID NO: 1162019 - DNA, 22 bp, Artificial Sequence
  chemically synthesized
gggatacatacaacctagtgag

SEQ ID NO: 1162020 - DNA, 22 bp, Artificial Sequence
  chemically synthesized
actaggttgtatgtatcccaag

SEQ ID NO: 1162021 - DNA, 22 bp, Artificial Sequence
  chemically synthesized
agagtcagtggacttgggatac

SEQ ID NO: 1162022 - DNA, 22 bp, Artificial Sequence
  chemically synthesized
ggttgtatgtatcccaagtcca

SEQ ID NO: 1162023 - DNA, 22 bp, Artificial Sequence
  chemically synthesized
tatgtatcccaagtccactgac

SEQ ID NO: 1162024 - DNA, 22 bp, Artificial Sequence
  chemically synthesized
tgccgggctcagagtcagtgga

SEQ ID NO: 1162025 - DNA, 22 bp, Artificial Sequence
  chemically synthesized
gtgctgtgccgggctcagagtc

SEQ ID NO: 1162026 - DNA, 22 bp, Artificial Sequence
  chemically synthesized
caagtcctggtgctgtgccggg

SEQ ID NO: 1162027 - DNA, 22 bp, Artificial Sequence
  chemically synthesized
gcaagtcctggtgctgtgccgg

SEQ ID NO: 1162028 - DNA, 22 bp, Artificial Sequence
  chemically synthesized
tgcaagtcctggtgctgtgccg

SEQ ID NO: 1162029 - DNA, 22 bp, Artificial Sequence
  chemically synthesized
actctgagcccggcacagcacc

SEQ ID NO: 1162030 - DNA, 22 bp, Artificial Sequence
  chemically synthesized
ctttgcaagtcctggtgctgtg

SEQ ID NO: 1162031 - DNA, 22 bp, Artificial Sequence
  chemically synthesized
tgagcccggcacagcaccagga

SEQ ID NO: 1162032 - DNA, 22 bp, Artificial Sequence
  chemically synthesized
agcccggcacagcaccaggact

SEQ ID NO: 1162033 - DNA, 22 bp, Artificial Sequence
  chemically synthesized
cagttcctttgcaagtcctggt

SEQ ID NO: 1162034 - DNA, 22 bp, Artificial Sequence
  chemically synthesized
ggccacaaggactgcagttcct

SEQ ID NO: 1162035 - DNA, 22 bp, Artificial Sequence
  chemically synthesized
gcaaaggaactgcagtccttgt

SEQ ID NO: 1162036 - DNA, 22 bp, Artificial Sequence
  chemically synthesized
caaaggaactgcagtccttgtg

SEQ ID NO: 1162037 - DNA, 22 bp, Artificial Sequence
  chemically synthesized
aaaggtagtctaggccacaagg

SEQ ID NO: 1162038 - DNA, 22 bp, Artificial Sequence
  chemically synthesized
caaaggtagtctaggccacaag

SEQ ID NO: 1162039 - DNA, 22 bp, Artificial Sequence
  chemically synthesized
cagtccttgtggcctagactac

SEQ ID NO: 1162040 - DNA, 22 bp, Artificial Sequence
  chemically synthesized
aataaacttcaaaggtagtcta

SEQ ID NO: 1162041 - DNA, 22 bp, Artificial Sequence
  chemically synthesized
taaataaacttcaaaggtagtc

SEQ ID NO: 1162042 - DNA, 22 bp, Artificial Sequence
  chemically synthesized
gtggcctagactacctttgaag

SEQ ID NO: 1162043 - DNA, 22 bp, Artificial Sequence
  chemically synthesized
tggcctagactacctttgaagt

SEQ ID NO: 1162044 - DNA, 22 bp, Artificial Sequence
  chemically synthesized
tggttctaaataaacttcaaag

SEQ ID NO: 1162045 - DNA, 22 bp, Artificial Sequence
  chemically synthesized
tgtggttctaaataaacttcaa

SEQ ID NO: 1162046 - DNA, 22 bp, Artificial Sequence
  chemically synthesized
gactacctttgaagtttattta

SEQ ID NO: 1162047 - DNA, 22 bp, Artificial Sequence
  chemically synthesized
gagtgctctgtggttctaaata

SEQ ID NO: 1162048 - DNA, 22 bp, Artificial Sequence
  chemically synthesized
cctttgaagtttatttagaacc

SEQ ID NO: 1162049 - DNA, 22 bp, Artificial Sequence
  chemically synthesized
tgaagtttatttagaaccacag

SEQ ID NO: 1162050 - DNA, 22 bp, Artificial Sequence
  chemically synthesized
gaagtttatttagaaccacaga

SEQ ID NO: 1162051 - DNA, 22 bp, Artificial Sequence
  chemically synthesized
aagtttatttagaaccacagag

SEQ ID NO: 1162052 - DNA, 22 bp, Artificial Sequence
  chemically synthesized
atttagaaccacagagcactct

SEQ ID NO: 1162053 - DNA, 22 bp, Artificial Sequence
  chemically synthesized
tcatcatggattagagtgctct

SEQ ID NO: 1162054 - DNA, 22 bp, Artificial Sequence
  chemically synthesized
tttagaaccacagagcactcta

SEQ ID NO: 1162055 - DNA, 22 bp, Artificial Sequence
  chemically synthesized
gtcatcatggattagagtgctc

SEQ ID NO: 1162056 - DNA, 22 bp, Artificial Sequence
  chemically synthesized
agaaccacagagcactctaatc

SEQ ID NO: 1162057 - DNA, 22 bp, Artificial Sequence
  chemically synthesized
gaaccacagagcactctaatcc

SEQ ID NO: 1162058 - DNA, 22 bp, Artificial Sequence
  chemically synthesized
cggcaagccttgtcatcatgga

SEQ ID NO: 1162059 - DNA, 22 bp, Artificial Sequence
  chemically synthesized
agttccggcaagccttgtcatc

SEQ ID NO: 1162060 - DNA, 22 bp, Artificial Sequence
  chemically synthesized
taatccatgatgacaaggcttg

SEQ ID NO: 1162061 - DNA, 22 bp, Artificial Sequence
  chemically synthesized
atccatgatgacaaggcttgcc

SEQ ID NO: 1162062 - DNA, 22 bp, Artificial Sequence
  chemically synthesized
gaacctgagttccggcaagcct

SEQ ID NO: 1162063 - DNA, 22 bp, Artificial Sequence
  chemically synthesized
ggaacctgagttccggcaagcc

SEQ ID NO: 1162064 - DNA, 22 bp, Artificial Sequence
  chemically synthesized
gccggaactcaggttccaaaca

SEQ ID NO: 1162065 - DNA, 22 bp, Artificial Sequence
  chemically synthesized
ccggaactcaggttccaaacac

SEQ ID NO: 1162066 - DNA, 22 bp, Artificial Sequence
  chemically synthesized
aggttccaaacactgggatgga

SEQ ID NO: 1162067 - DNA, 22 bp, Artificial Sequence
  chemically synthesized
gacagggaagaatcatccatcc

SEQ ID NO: 1162068 - DNA, 22 bp, Artificial Sequence
  chemically synthesized
caaacactgggatggatgattc

SEQ ID NO: 1162069 - DNA, 22 bp, Artificial Sequence
  chemically synthesized
gatgaaccctagacagggaaga

SEQ ID NO: 1162070 - DNA, 22 bp, Artificial Sequence
  chemically synthesized
ggatggatgattcttccctgtc

SEQ ID NO: 1162071 - DNA, 22 bp, Artificial Sequence
  chemically synthesized
agatgaaccctagacagggaag

SEQ ID NO: 1162072 - DNA, 22 bp, Artificial Sequence
  chemically synthesized
ttccctgtctagggttcatcta

SEQ ID NO: 1162073 - DNA, 22 bp, Artificial Sequence
  chemically synthesized
ccctgtctagggttcatctaaa

SEQ ID NO: 1162074 - DNA, 22 bp, Artificial Sequence
  chemically synthesized
cctgtctagggttcatctaaat

SEQ ID NO: 1162075 - DNA, 22 bp, Artificial Sequence
  chemically synthesized
tctagggttcatctaaatgctc

SEQ ID NO: 1162076 - DNA, 22 bp, Artificial Sequence
  chemically synthesized
gggttcatctaaatgctccctc

SEQ ID NO: 1162077 - DNA, 22 bp, Artificial Sequence
  chemically synthesized
agccaaatcccgcagagggagc

SEQ ID NO: 1162078 - DNA, 22 bp, Artificial Sequence
  chemically synthesized
atctaaatgctccctctgcggg

SEQ ID NO: 1162079 - DNA, 22 bp, Artificial Sequence
  chemically synthesized
aatgctccctctgcgggatttg

SEQ ID NO: 1162080 - DNA, 22 bp, Artificial Sequence
  chemically synthesized
cctctgcgggatttggctgagt

SEQ ID NO: 1162081 - DNA, 22 bp, Artificial Sequence
  chemically synthesized
tgcgggatttggctgagttctg

SEQ ID NO: 1162082 - DNA, 22 bp, Artificial Sequence
  chemically synthesized
cgggatttggctgagttctgtt

SEQ ID NO: 1162083 - DNA, 22 bp, Artificial Sequence
  chemically synthesized
ggctgagttctgttctttgtcg

SEQ ID NO: 1162084 - DNA, 22 bp, Artificial Sequence
  chemically synthesized
gctgagttctgttctttgtcgg

SEQ ID NO: 1162085 - DNA, 22 bp, Artificial Sequence
  chemically synthesized
tcacagtggaaaccgacaaaga

SEQ ID NO: 1162086 - DNA, 22 bp, Artificial Sequence
  chemically synthesized
agttctgttctttgtcggtttc

SEQ ID NO: 1162087 - DNA, 22 bp, Artificial Sequence
  chemically synthesized
ccctgtcacagtggaaaccgac

SEQ ID NO: 1162088 - DNA, 22 bp, Artificial Sequence
  chemically synthesized
tgttctttgtcggtttccactg

SEQ ID NO: 1162089 - DNA, 22 bp, Artificial Sequence
  chemically synthesized
ttctttgtcggtttccactgtg

SEQ ID NO: 1162090 - DNA, 22 bp, Artificial Sequence
  chemically synthesized
tttgtcggtttccactgtgaca

SEQ ID NO: 1162091 - DNA, 22 bp, Artificial Sequence
  chemically synthesized
tgtcggtttccactgtgacagg

SEQ ID NO: 1162092 - DNA, 22 bp, Artificial Sequence
  chemically synthesized
gtcggtttccactgtgacaggg

SEQ ID NO: 1162093 - DNA, 22 bp, Artificial Sequence
  chemically synthesized
tcggtttccactgtgacagggc

SEQ ID NO: 1162094 - DNA, 22 bp, Artificial Sequence
  chemically synthesized
aaaatcagtgctgccctgtcac

SEQ ID NO: 1162095 - DNA, 22 bp, Artificial Sequence
  chemically synthesized
cattgaaaatcagtgctgccct

SEQ ID NO: 1162096 - DNA, 22 bp, Artificial Sequence
  chemically synthesized
gcattgaaaatcagtgctgccc

SEQ ID NO: 1162097 - DNA, 22 bp, Artificial Sequence
  chemically synthesized
ccactgtgacagggcagcactg

SEQ ID NO: 1162098 - DNA, 22 bp, Artificial Sequence
  chemically synthesized
tgcattgaaaatcagtgctgcc

SEQ ID NO: 1162099 - DNA, 22 bp, Artificial Sequence
  chemically synthesized
cactgtgacagggcagcactga

SEQ ID NO: 1162100 - DNA, 22 bp, Artificial Sequence
  chemically synthesized
tgacagggcagcactgattttc

SEQ ID NO: 1162101 - DNA, 22 bp, Artificial Sequence
  chemically synthesized
taggactttgcattgaaaatca

SEQ ID NO: 1162102 - DNA, 22 bp, Artificial Sequence
  chemically synthesized
cagtgattataggactttgcat

SEQ ID NO: 1162103 - DNA, 22 bp, Artificial Sequence
  chemically synthesized
attttcaatgcaaagtcctata

SEQ ID NO: 1162104 - DNA, 22 bp, Artificial Sequence
  chemically synthesized
tcaatgcaaagtcctataatca

SEQ ID NO: 1162105 - DNA, 22 bp, Artificial Sequence
  chemically synthesized
caatgcaaagtcctataatcac

SEQ ID NO: 1162106 - DNA, 22 bp, Artificial Sequence
  chemically synthesized
aatgcaaagtcctataatcact

SEQ ID NO: 1162107 - DNA, 22 bp, Artificial Sequence
  chemically synthesized
cagaagggagattgcagtgatt

SEQ ID NO: 1162108 - DNA, 22 bp, Artificial Sequence
  chemically synthesized
gcagaagggagattgcagtgat

SEQ ID NO: 1162109 - DNA, 22 bp, Artificial Sequence
  chemically synthesized
tgtgcttgcagaagggagattg

SEQ ID NO: 1162110 - DNA, 22 bp, Artificial Sequence
  chemically synthesized
taatcactgcaatctcccttct

SEQ ID NO: 1162111 - DNA, 22 bp, Artificial Sequence
  chemically synthesized
caatctcccttctgcaagcaca

SEQ ID NO: 1162112 - DNA, 22 bp, Artificial Sequence
  chemically synthesized
ccttctgcaagcacatagactc

SEQ ID NO: 1162113 - DNA, 22 bp, Artificial Sequence
  chemically synthesized
ctgcaagcacatagactctctc

SEQ ID NO: 1162114 - DNA, 22 bp, Artificial Sequence
  chemically synthesized
tgcaagcacatagactctctct

SEQ ID NO: 1162115 - DNA, 22 bp, Artificial Sequence
  chemically synthesized
caagcacatagactctctcttc

SEQ ID NO: 1162116 - DNA, 22 bp, Artificial Sequence
  chemically synthesized
atccatggcagcagtcacatgg

SEQ ID NO: 1162117 - DNA, 22 bp, Artificial Sequence
  chemically synthesized
tctcttcatgccatgtgactgc

SEQ ID NO: 1162118 - DNA, 22 bp, Artificial Sequence
  chemically synthesized
tcttcatgccatgtgactgctg

SEQ ID NO: 1162119 - DNA, 22 bp, Artificial Sequence
  chemically synthesized
cctcatccatggcagcagtcac

SEQ ID NO: 1162120 - DNA, 22 bp, Artificial Sequence
  chemically synthesized
ttcatgccatgtgactgctgcc

SEQ ID NO: 1162121 - DNA, 22 bp, Artificial Sequence
  chemically synthesized
tccctcatccatggcagcagtc

SEQ ID NO: 1162122 - DNA, 22 bp, Artificial Sequence
  chemically synthesized
catgccatgtgactgctgccat

SEQ ID NO: 1162123 - DNA, 22 bp, Artificial Sequence
  chemically synthesized
atgccatgtgactgctgccatg

SEQ ID NO: 1162124 - DNA, 22 bp, Artificial Sequence
  chemically synthesized
taccagctctccctcatccatg

SEQ ID NO: 1162125 - DNA, 22 bp, Artificial Sequence
  chemically synthesized
tcacctataccagctctccctc

SEQ ID NO: 1162126 - DNA, 22 bp, Artificial Sequence
  chemically synthesized
ctgccatggatgagggagagct

SEQ ID NO: 1162127 - DNA, 22 bp, Artificial Sequence
  chemically synthesized
tatcacctataccagctctccc

SEQ ID NO: 1162128 - DNA, 22 bp, Artificial Sequence
  chemically synthesized
ccatggatgagggagagctggt

SEQ ID NO: 1162129 - DNA, 22 bp, Artificial Sequence
  chemically synthesized
gtataggtgatagaatattgcc

SEQ ID NO: 1162130 - DNA, 22 bp, Artificial Sequence
  chemically synthesized
cctttactaccctcttctgtgc

SEQ ID NO: 1162131 - DNA, 22 bp, Artificial Sequence
  chemically synthesized
tatcacagaaagaggcacagaa

SEQ ID NO: 1162132 - DNA, 22 bp, Artificial Sequence
  chemically synthesized
tactaccctcttctgtgcctct

SEQ ID NO: 1162133 - DNA, 22 bp, Artificial Sequence
  chemically synthesized
actaccctcttctgtgcctctt

SEQ ID NO: 1162134 - DNA, 22 bp, Artificial Sequence
  chemically synthesized
ctaccctcttctgtgcctcttt

SEQ ID NO: 1162135 - DNA, 22 bp, Artificial Sequence
  chemically synthesized
ggttgtatcacagaaagaggca

SEQ ID NO: 1162136 - DNA, 22 bp, Artificial Sequence
  chemically synthesized
gggttgtatcacagaaagaggc

SEQ ID NO: 1162137 - DNA, 22 bp, Artificial Sequence
  chemically synthesized
ccctcttctgtgcctctttctg

SEQ ID NO: 1162138 - DNA, 22 bp, Artificial Sequence
  chemically synthesized
tgggttgtatcacagaaagagg

SEQ ID NO: 1162139 - DNA, 22 bp, Artificial Sequence
  chemically synthesized
ttgggttgtatcacagaaagag

SEQ ID NO: 1162140 - DNA, 22 bp, Artificial Sequence
  chemically synthesized
ttctgtgcctctttctgtgata

SEQ ID NO: 1162141 - DNA, 22 bp, Artificial Sequence
  chemically synthesized
gtttttgggttgtatcacagaa

SEQ ID NO: 1162142 - DNA, 22 bp, Artificial Sequence
  chemically synthesized
ctgtgcctctttctgtgataca

SEQ ID NO: 1162143 - DNA, 22 bp, Artificial Sequence
  chemically synthesized
tgtgcctctttctgtgatacaa

SEQ ID NO: 1162144 - DNA, 22 bp, Artificial Sequence
  chemically synthesized
tgcctctttctgtgatacaacc

SEQ ID NO: 1162145 - DNA, 22 bp, Artificial Sequence
  chemically synthesized
tttctgtgatacaacccaaaaa

SEQ ID NO: 1162146 - DNA, 22 bp, Artificial Sequence
  chemically synthesized
tctgtgatacaacccaaaaacc

SEQ ID NO: 1162147 - DNA, 22 bp, Artificial Sequence
  chemically synthesized
ctgtgatacaacccaaaaacca

SEQ ID NO: 1162148 - DNA, 22 bp, Artificial Sequence
  chemically synthesized
tgtgatacaacccaaaaaccag

SEQ ID NO: 1162149 - DNA, 22 bp, Artificial Sequence
  chemically synthesized
tgatacaacccaaaaaccaggt

SEQ ID NO: 1162150 - DNA, 22 bp, Artificial Sequence
  chemically synthesized
ggtgcatgatcgtagtacctgg

SEQ ID NO: 1162151 - DNA, 22 bp, Artificial Sequence
  chemically synthesized
ataagagtgaaaaattaggtgc

SEQ ID NO: 1162152 - DNA, 22 bp, Artificial Sequence
  chemically synthesized
cataagagtgaaaaattaggtg

SEQ ID NO: 1162153 - DNA, 22 bp, Artificial Sequence
  chemically synthesized
cgatcatgcacctaatttttca

SEQ ID NO: 1162154 - DNA, 22 bp, Artificial Sequence
  chemically synthesized
gaaaagcaccttcataagagtg

SEQ ID NO: 1162155 - DNA, 22 bp, Artificial Sequence
  chemically synthesized
atttttcactcttatgaaggtg

SEQ ID NO: 1162156 - DNA, 22 bp, Artificial Sequence
  chemically synthesized
tccacactagaaaagcaccttc

SEQ ID NO: 1162157 - DNA, 22 bp, Artificial Sequence
  chemically synthesized
ttcactcttatgaaggtgcttt

SEQ ID NO: 1162158 - DNA, 22 bp, Artificial Sequence
  chemically synthesized
tcactcttatgaaggtgctttt

SEQ ID NO: 1162159 - DNA, 22 bp, Artificial Sequence
  chemically synthesized
cactcttatgaaggtgcttttc

SEQ ID NO: 1162160 - DNA, 22 bp, Artificial Sequence
  chemically synthesized
actcttatgaaggtgcttttct

SEQ ID NO: 1162161 - DNA, 22 bp, Artificial Sequence
  chemically synthesized
ttatgaaggtgcttttctagtg

SEQ ID NO: 1162162 - DNA, 22 bp, Artificial Sequence
  chemically synthesized
aacaactgtccacactagaaaa

SEQ ID NO: 1162163 - DNA, 22 bp, Artificial Sequence
  chemically synthesized
atgaaggtgcttttctagtgtg

SEQ ID NO: 1162164 - DNA, 22 bp, Artificial Sequence
  chemically synthesized
tgaaggtgcttttctagtgtgg

SEQ ID NO: 1162165 - DNA, 22 bp, Artificial Sequence
  chemically synthesized
ttctagtgtggacagttgttca

SEQ ID NO: 1162166 - DNA, 22 bp, Artificial Sequence
  chemically synthesized
tctagtgtggacagttgttcaa

SEQ ID NO: 1162167 - DNA, 22 bp, Artificial Sequence
  chemically synthesized
ctagtgtggacagttgttcaat

SEQ ID NO: 1162168 - DNA, 22 bp, Artificial Sequence
  chemically synthesized
caggaacatcaaattgaacaac

SEQ ID NO: 1162169 - DNA, 22 bp, Artificial Sequence
  chemically synthesized
tagtgtggacagttgttcaatt

SEQ ID NO: 1162170 - DNA, 22 bp, Artificial Sequence
  chemically synthesized
gtgtggacagttgttcaatttg

SEQ ID NO: 1162171 - DNA, 22 bp, Artificial Sequence
  chemically synthesized
ttgcaggaacatcaaattgaac

SEQ ID NO: 1162172 - DNA, 22 bp, Artificial Sequence
  chemically synthesized
tccctgttgcaggaacatcaaa

SEQ ID NO: 1162173 - DNA, 22 bp, Artificial Sequence
  chemically synthesized
ttcaatttgatgttcctgcaac

SEQ ID NO: 1162174 - DNA, 22 bp, Artificial Sequence
  chemically synthesized
cagtaattatccctgttgcagg

SEQ ID NO: 1162175 - DNA, 22 bp, Artificial Sequence
  chemically synthesized
aatttgatgttcctgcaacagg

SEQ ID NO: 1162176 - DNA, 22 bp, Artificial Sequence
  chemically synthesized
gatgttcctgcaacagggataa

SEQ ID NO: 1162177 - DNA, 22 bp, Artificial Sequence
  chemically synthesized
atgttcctgcaacagggataat

SEQ ID NO: 1162178 - DNA, 22 bp, Artificial Sequence
  chemically synthesized
ctgcaacagggataattactgg

SEQ ID NO: 1162179 - DNA, 22 bp, Artificial Sequence
  chemically synthesized
caacagggataattactggagg

SEQ ID NO: 1162180 - DNA, 22 bp, Artificial Sequence
  chemically synthesized
ctggaggcttctgtttggcgat

SEQ ID NO: 1162181 - DNA, 22 bp, Artificial Sequence
  chemically synthesized
gaggcttctgtttggcgatttt

SEQ ID NO: 1162182 - DNA, 22 bp, Artificial Sequence
  chemically synthesized
tggaggaggtggagaaaaatcg

SEQ ID NO: 1162183 - DNA, 22 bp, Artificial Sequence
  chemically synthesized
ttgtggaggaggtggagaaaaa

SEQ ID NO: 1162184 - DNA, 22 bp, Artificial Sequence
  chemically synthesized
ctgtttggcgatttttctccac

SEQ ID NO: 1162185 - DNA, 22 bp, Artificial Sequence
  chemically synthesized
attgtggaggaggtggagaaaa

SEQ ID NO: 1162186 - DNA, 22 bp, Artificial Sequence
  chemically synthesized
tgtttggcgatttttctccacc

SEQ ID NO: 1162187 - DNA, 22 bp, Artificial Sequence
  chemically synthesized
tttggcgatttttctccacctc

SEQ ID NO: 1162188 - DNA, 22 bp, Artificial Sequence
  chemically synthesized
ggcgatttttctccacctcctc

SEQ ID NO: 1162189 - DNA, 22 bp, Artificial Sequence
  chemically synthesized
gcgatttttctccacctcctcc

SEQ ID NO: 1162190 - DNA, 22 bp, Artificial Sequence
  chemically synthesized
gaagtttattgtggaggaggtg

SEQ ID NO: 1162191 - DNA, 22 bp, Artificial Sequence
  chemically synthesized
ttctccacctcctccacaataa

SEQ ID NO: 1162192 - DNA, 22 bp, Artificial Sequence
  chemically synthesized
tctccacctcctccacaataaa

SEQ ID NO: 1162193 - DNA, 22 bp, Artificial Sequence
  chemically synthesized
ctccacctcctccacaataaac

SEQ ID NO: 1162194 - DNA, 22 bp, Artificial Sequence
  chemically synthesized
tccacctcctccacaataaact

SEQ ID NO: 1162195 - DNA, 22 bp, Artificial Sequence
  chemically synthesized
cacctcctccacaataaacttc

SEQ ID NO: 1162196 - DNA, 22 bp, Artificial Sequence
  chemically synthesized
agggaaaatgagtctcgaagtt

SEQ ID NO: 1162197 - DNA, 22 bp, Artificial Sequence
  chemically synthesized
gagggaaaatgagtctcgaagt

SEQ ID NO: 1162198 - DNA, 22 bp, Artificial Sequence
  chemically synthesized
ctccacaataaacttcgagact

SEQ ID NO: 1162199 - DNA, 22 bp, Artificial Sequence
  chemically synthesized
cacaataaacttcgagactcat

SEQ ID NO: 1162200 - DNA, 22 bp, Artificial Sequence
  chemically synthesized
cgagactcattttccctcaaat

SEQ ID NO: 1162201 - DNA, 22 bp, Artificial Sequence
  chemically synthesized
gagactcattttccctcaaata

SEQ ID NO: 1162202 - DNA, 22 bp, Artificial Sequence
  chemically synthesized
tatggtcaccatatatttgagg

SEQ ID NO: 1162203 - DNA, 22 bp, Artificial Sequence
  chemically synthesized
atatggtcaccatatatttgag

SEQ ID NO: 1162204 - DNA, 22 bp, Artificial Sequence
  chemically synthesized
tatatggtcaccatatatttga

SEQ ID NO: 1162205 - DNA, 22 bp, Artificial Sequence
  chemically synthesized
attttccctcaaatatatggtg

SEQ ID NO: 1162206 - DNA, 22 bp, Artificial Sequence
  chemically synthesized
gtcattttatatggtcaccata

SEQ ID NO: 1162207 - DNA, 22 bp, Artificial Sequence
  chemically synthesized
tccctcaaatatatggtgacca

SEQ ID NO: 1162208 - DNA, 22 bp, Artificial Sequence
  chemically synthesized
ccctcaaatatatggtgaccat

SEQ ID NO: 1162209 - DNA, 22 bp, Artificial Sequence
  chemically synthesized
cctcaaatatatggtgaccata

SEQ ID NO: 1162210 - DNA, 22 bp, Artificial Sequence
  chemically synthesized
aaatatatggtgaccatataaa

SEQ ID NO: 1162211 - DNA, 22 bp, Artificial Sequence
  chemically synthesized
aaaatatctagtcattttatat

SEQ ID NO: 1162212 - DNA, 22 bp, Artificial Sequence
  chemically synthesized
aaaaatatctagtcattttata

SEQ ID NO: 1162213 - DNA, 22 bp, Artificial Sequence
  chemically synthesized
taaaaatatctagtcattttat

SEQ ID NO: 1162214 - DNA, 22 bp, Artificial Sequence
  chemically synthesized
atgatacaccatacattttaaa

SEQ ID NO: 1162215 - DNA, 22 bp, Artificial Sequence
  chemically synthesized
aatgatacaccatacattttaa

SEQ ID NO: 1162216 - DNA, 22 bp, Artificial Sequence
  chemically synthesized
gatatttttaaaatgtatggtg

SEQ ID NO: 1162217 - DNA, 22 bp, Artificial Sequence
  chemically synthesized
tatttaatgatacaccatacat

SEQ ID NO: 1162218 - DNA, 22 bp, Artificial Sequence
  chemically synthesized
ctatatttaatgatacaccata

SEQ ID NO: 1162219 - DNA, 22 bp, Artificial Sequence
  chemically synthesized
ttaaaatgtatggtgtatcatt

SEQ ID NO: 1162220 - DNA, 22 bp, Artificial Sequence
  chemically synthesized
attcctatatttaatgatacac

SEQ ID NO: 1162221 - DNA, 22 bp, Artificial Sequence
  chemically synthesized
taaaatgtatggtgtatcatta

SEQ ID NO: 1162222 - DNA, 22 bp, Artificial Sequence
  chemically synthesized
aaaatgtatggtgtatcattaa

SEQ ID NO: 1162223 - DNA, 22 bp, Artificial Sequence
  chemically synthesized
tgattcctatatttaatgatac

SEQ ID NO: 1162224 - DNA, 22 bp, Artificial Sequence
  chemically synthesized
aaatgtatggtgtatcattaaa

SEQ ID NO: 1162225 - DNA, 22 bp, Artificial Sequence
  chemically synthesized
ctgattcctatatttaatgata

SEQ ID NO: 1162226 - DNA, 22 bp, Artificial Sequence
  chemically synthesized
taatatatcatgatttctgatt

SEQ ID NO: 1162227 - DNA, 22 bp, Artificial Sequence
  chemically synthesized
aatataggaatcagaaatcatg

SEQ ID NO: 1162228 - DNA, 22 bp, Artificial Sequence
  chemically synthesized
gattataatatatcatgatttc

SEQ ID NO: 1162229 - DNA, 22 bp, Artificial Sequence
  chemically synthesized
ggattataatatatcatgattt

SEQ ID NO: 1162230 - DNA, 22 bp, Artificial Sequence
  chemically synthesized
ttggattataatatatcatgat

SEQ ID NO: 1162231 - DNA, 22 bp, Artificial Sequence
  chemically synthesized
cttggattataatatatcatga

SEQ ID NO: 1162232 - DNA, 22 bp, Artificial Sequence
  chemically synthesized
ccatttcttggattataatata

SEQ ID NO: 1162233 - DNA, 22 bp, Artificial Sequence
  chemically synthesized
gccatttcttggattataatat

SEQ ID NO: 1162234 - DNA, 22 bp, Artificial Sequence
  chemically synthesized
aaacatgtttgccatttcttgg

SEQ ID NO: 1162235 - DNA, 22 bp, Artificial Sequence
  chemically synthesized
tattaaaacatgtttgccattt

SEQ ID NO: 1162236 - DNA, 22 bp, Artificial Sequence
  chemically synthesized
tatattaaaacatgtttgccat

SEQ ID NO: 1162237 - DNA, 22 bp, Artificial Sequence
  chemically synthesized
taatccaagaaatggcaaacat

SEQ ID NO: 1162238 - DNA, 22 bp, Artificial Sequence
  chemically synthesized
ctatattaaaacatgtttgcca

SEQ ID NO: 1162239 - DNA, 22 bp, Artificial Sequence
  chemically synthesized
tctatattaaaacatgtttgcc

SEQ ID NO: 1162240 - DNA, 22 bp, Artificial Sequence
  chemically synthesized
ttctatattaaaacatgtttgc

SEQ ID NO: 1162241 - DNA, 22 bp, Artificial Sequence
  chemically synthesized
cttttctatattaaaacatgtt

SEQ ID NO: 1162242 - DNA, 22 bp, Artificial Sequence
  chemically synthesized
aatgaatgttgcttttctatat

SEQ ID NO: 1162243 - DNA, 22 bp, Artificial Sequence
  chemically synthesized
aaatgaatgttgcttttctata

SEQ ID NO: 1162244 - DNA, 22 bp, Artificial Sequence
  chemically synthesized
taaatgaatgttgcttttctat

SEQ ID NO: 1162245 - DNA, 22 bp, Artificial Sequence
  chemically synthesized
ttaaatgaatgttgcttttcta

SEQ ID NO: 1162246 - DNA, 22 bp, Artificial Sequence
  chemically synthesized
ttttaaatgaatgttgcttttc

SEQ ID NO: 1162247 - DNA, 22 bp, Artificial Sequence
  chemically synthesized
cttttaaatgaatgttgctttt

SEQ ID NO: 1162248 - DNA, 22 bp, Artificial Sequence
  chemically synthesized
tcttttaaatgaatgttgcttt

SEQ ID NO: 1162249 - DNA, 22 bp, Artificial Sequence
  chemically synthesized
ttcttttaaatgaatgttgctt

SEQ ID NO: 1162250 - DNA, 22 bp, Artificial Sequence
  chemically synthesized
taatatagaaaagcaacattca

SEQ ID NO: 1162251 - DNA, 22 bp, Artificial Sequence
  chemically synthesized
aatatagaaaagcaacattcat

SEQ ID NO: 1162252 - DNA, 22 bp, Artificial Sequence
  chemically synthesized
atatagaaaagcaacattcatt

SEQ ID NO: 1162253 - DNA, 22 bp, Artificial Sequence
  chemically synthesized
aagcttttcttttaaatgaatg

SEQ ID NO: 1162254 - DNA, 22 bp, Artificial Sequence
  chemically synthesized
ctcaagcttttcttttaaatga

SEQ ID NO: 1162255 - DNA, 22 bp, Artificial Sequence
  chemically synthesized
tacatgcactactcaagctttt

SEQ ID NO: 1162256 - DNA, 22 bp, Artificial Sequence
  chemically synthesized
gtacatgcactactcaagcttt

SEQ ID NO: 1162257 - DNA, 22 bp, Artificial Sequence
  chemically synthesized
atttaaaagaaaagcttgagta

SEQ ID NO: 1162258 - DNA, 22 bp, Artificial Sequence
  chemically synthesized
aaaagaaaagcttgagtagtgc

SEQ ID NO: 1162259 - DNA, 22 bp, Artificial Sequence
  chemically synthesized
aaagaaaagcttgagtagtgca

SEQ ID NO: 1162260 - DNA, 22 bp, Artificial Sequence
  chemically synthesized
tgtgcatatgtttgtacatgca

SEQ ID NO: 1162261 - DNA, 22 bp, Artificial Sequence
  chemically synthesized
gagtagtgcatgtacaaacata

SEQ ID NO: 1162262 - DNA, 22 bp, Artificial Sequence
  chemically synthesized
agtagtgcatgtacaaacatat

SEQ ID NO: 1162263 - DNA, 22 bp, Artificial Sequence
  chemically synthesized
ccatgcaacaacaacaaaaaac

SEQ ID NO: 1162264 - DNA, 22 bp, Artificial Sequence
  chemically synthesized
ttgccatgcaacaacaacaaaa

SEQ ID NO: 1162265 - DNA, 22 bp, Artificial Sequence
  chemically synthesized
attattgccatgcaacaacaac

SEQ ID NO: 1162266 - DNA, 22 bp, Artificial Sequence
  chemically synthesized
tttgttgttgttgcatggcaat

SEQ ID NO: 1162267 - DNA, 22 bp, Artificial Sequence
  chemically synthesized
ttgttgttgttgcatggcaata

SEQ ID NO: 1162268 - DNA, 22 bp, Artificial Sequence
  chemically synthesized
tggaccattcattattgccatg

SEQ ID NO: 1162269 - DNA, 22 bp, Artificial Sequence
  chemically synthesized
tgttgttgttgcatggcaataa

SEQ ID NO: 1162270 - DNA, 22 bp, Artificial Sequence
  chemically synthesized
gttgttgttgcatggcaataat

SEQ ID NO: 1162271 - DNA, 22 bp, Artificial Sequence
  chemically synthesized
ttgttgttgcatggcaataatg

SEQ ID NO: 1162272 - DNA, 22 bp, Artificial Sequence
  chemically synthesized
ctatggaccattcattattgcc

SEQ ID NO: 1162273 - DNA, 22 bp, Artificial Sequence
  chemically synthesized
cctatggaccattcattattgc

SEQ ID NO: 1162274 - DNA, 22 bp, Artificial Sequence
  chemically synthesized
ttgttgcatggcaataatgaat

SEQ ID NO: 1162275 - DNA, 22 bp, Artificial Sequence
  chemically synthesized
ttgcatggcaataatgaatggt

SEQ ID NO: 1162276 - DNA, 22 bp, Artificial Sequence
  chemically synthesized
catggcaataatgaatggtcca

SEQ ID NO: 1162277 - DNA, 22 bp, Artificial Sequence
  chemically synthesized
atatgcttcctatggaccattc

SEQ ID NO: 1162278 - DNA, 22 bp, Artificial Sequence
  chemically synthesized
aaaaatactaatatgcttccta

SEQ ID NO: 1162279 - DNA, 22 bp, Artificial Sequence
  chemically synthesized
ggagttgaaaaatactaatatg

SEQ ID NO: 1162280 - DNA, 22 bp, Artificial Sequence
  chemically synthesized
gggagttgaaaaatactaatat

SEQ ID NO: 1162281 - DNA, 22 bp, Artificial Sequence
  chemically synthesized
taaatcttgggagttgaaaaat

SEQ ID NO: 1162282 - DNA, 22 bp, Artificial Sequence
  chemically synthesized
gtatttttcaactcccaagatt

SEQ ID NO: 1162283 - DNA, 22 bp, Artificial Sequence
  chemically synthesized
ataaacgttataaatcttggga

SEQ ID NO: 1162284 - DNA, 22 bp, Artificial Sequence
  chemically synthesized
gataaacgttataaatcttggg

SEQ ID NO: 1162285 - DNA, 22 bp, Artificial Sequence
  chemically synthesized
tgataaacgttataaatcttgg

SEQ ID NO: 1162286 - DNA, 22 bp, Artificial Sequence
  chemically synthesized
ttcaactcccaagatttataac

SEQ ID NO: 1162287 - DNA, 22 bp, Artificial Sequence
  chemically synthesized
tcaactcccaagatttataacg

SEQ ID NO: 1162288 - DNA, 22 bp, Artificial Sequence
  chemically synthesized
aactttgataaacgttataaat

SEQ ID NO: 1162289 - DNA, 22 bp, Artificial Sequence
  chemically synthesized
caactcccaagatttataacgt

SEQ ID NO: 1162290 - DNA, 22 bp, Artificial Sequence
  chemically synthesized
aactcccaagatttataacgtt

SEQ ID NO: 1162291 - DNA, 22 bp, Artificial Sequence
  chemically synthesized
ttgaactttgataaacgttata

SEQ ID NO: 1162292 - DNA, 22 bp, Artificial Sequence
  chemically synthesized
attgaactttgataaacgttat

SEQ ID NO: 1162293 - DNA, 22 bp, Artificial Sequence
  chemically synthesized
ccaagatttataacgtttatca

SEQ ID NO: 1162294 - DNA, 22 bp, Artificial Sequence
  chemically synthesized
acaggccacttattgaactttg

SEQ ID NO: 1162295 - DNA, 22 bp, Artificial Sequence
  chemically synthesized
ataacgtttatcaaagttcaat

SEQ ID NO: 1162296 - DNA, 22 bp, Artificial Sequence
  chemically synthesized
cacaggccacttattgaacttt

SEQ ID NO: 1162297 - DNA, 22 bp, Artificial Sequence
  chemically synthesized
taacgtttatcaaagttcaata

SEQ ID NO: 1162298 - DNA, 22 bp, Artificial Sequence
  chemically synthesized
tatttcacaggccacttattga

SEQ ID NO: 1162299 - DNA, 22 bp, Artificial Sequence
  chemically synthesized
atatttcacaggccacttattg

SEQ ID NO: 1162300 - DNA, 22 bp, Artificial Sequence
  chemically synthesized
atcaaagttcaataagtggcct

SEQ ID NO: 1162301 - DNA, 22 bp, Artificial Sequence
  chemically synthesized
tcaaagttcaataagtggcctg

SEQ ID NO: 1162302 - DNA, 22 bp, Artificial Sequence
  chemically synthesized
aagcttatatttcacaggccac

SEQ ID NO: 1162303 - DNA, 22 bp, Artificial Sequence
  chemically synthesized
aaagcttatatttcacaggcca

SEQ ID NO: 1162304 - DNA, 22 bp, Artificial Sequence
  chemically synthesized
taaagcttatatttcacaggcc

SEQ ID NO: 1162305 - DNA, 22 bp, Artificial Sequence
  chemically synthesized
gctttaaagcttatatttcaca

SEQ ID NO: 1162306 - DNA, 22 bp, Artificial Sequence
  chemically synthesized
aataagtggcctgtgaaatata

SEQ ID NO: 1162307 - DNA, 22 bp, Artificial Sequence
  chemically synthesized
tggctttaaagcttatatttca

SEQ ID NO: 1162308 - DNA, 22 bp, Artificial Sequence
  chemically synthesized
gattctggctttaaagcttata

SEQ ID NO: 1162309 - DNA, 22 bp, Artificial Sequence
  chemically synthesized
ggattctggctttaaagcttat

SEQ ID NO: 1162310 - DNA, 22 bp, Artificial Sequence
  chemically synthesized
tttggattctggctttaaagct

SEQ ID NO: 1162311 - DNA, 22 bp, Artificial Sequence
  chemically synthesized
tgtttggattctggctttaaag

SEQ ID NO: 1162312 - DNA, 22 bp, Artificial Sequence
  chemically synthesized
tgaaatataagctttaaagcca

SEQ ID NO: 1162313 - DNA, 22 bp, Artificial Sequence
  chemically synthesized
gttctgtttggattctggcttt

SEQ ID NO: 1162314 - DNA, 22 bp, Artificial Sequence
  chemically synthesized
taaagccagaatccaaacagaa

SEQ ID NO: 1162315 - DNA, 22 bp, Artificial Sequence
  chemically synthesized
aaagccagaatccaaacagaac

SEQ ID NO: 1162316 - DNA, 22 bp, Artificial Sequence
  chemically synthesized
agggggtaattggttctgtttg

SEQ ID NO: 1162317 - DNA, 22 bp, Artificial Sequence
  chemically synthesized
aagccagaatccaaacagaacc

SEQ ID NO: 1162318 - DNA, 22 bp, Artificial Sequence
  chemically synthesized
gagggggtaattggttctgttt

SEQ ID NO: 1162319 - DNA, 22 bp, Artificial Sequence
  chemically synthesized
cacatttgagggggtaattggt

SEQ ID NO: 1162320 - DNA, 22 bp, Artificial Sequence
  chemically synthesized
acacatttgagggggtaattgg

SEQ ID NO: 1162321 - DNA, 22 bp, Artificial Sequence
  chemically synthesized
aagtcttacacatttgaggggg

SEQ ID NO: 1162322 - DNA, 22 bp, Artificial Sequence
  chemically synthesized
ccccctcaaatgtgtaagactt

SEQ ID NO: 1162323 - DNA, 22 bp, Artificial Sequence
  chemically synthesized
aaatgtgtaagacttcagctgt

SEQ ID NO: 1162324 - DNA, 22 bp, Artificial Sequence
  chemically synthesized
cagctgtcactgttttcactat

SEQ ID NO: 1162325 - DNA, 22 bp, Artificial Sequence
  chemically synthesized
agctgtcactgttttcactatc

SEQ ID NO: 1162326 - DNA, 22 bp, Artificial Sequence
  chemically synthesized
tggtaaaggtgatgagatagtg

SEQ ID NO: 1162327 - DNA, 22 bp, Artificial Sequence
  chemically synthesized
gtggtaaaggtgatgagatagt

SEQ ID NO: 1162328 - DNA, 22 bp, Artificial Sequence
  chemically synthesized
tcactgttttcactatctcatc

SEQ ID NO: 1162329 - DNA, 22 bp, Artificial Sequence
  chemically synthesized
ttttcactatctcatcaccttt

SEQ ID NO: 1162330 - DNA, 22 bp, Artificial Sequence
  chemically synthesized
tcactatctcatcacctttacc

SEQ ID NO: 1162331 - DNA, 22 bp, Artificial Sequence
  chemically synthesized
cactatctcatcacctttacca

SEQ ID NO: 1162332 - DNA, 22 bp, Artificial Sequence
  chemically synthesized
actatctcatcacctttaccac

SEQ ID NO: 1162333 - DNA, 22 bp, Artificial Sequence
  chemically synthesized
tctcatcacctttaccacaagt

SEQ ID NO: 1162334 - DNA, 22 bp, Artificial Sequence
  chemically synthesized
atcacctttaccacaagtacat

SEQ ID NO: 1162335 - DNA, 22 bp, Artificial Sequence
  chemically synthesized
gaggacaatagcgatggatgta

SEQ ID NO: 1162336 - DNA, 22 bp, Artificial Sequence
  chemically synthesized
taccacaagtacatccatcgct

SEQ ID NO: 1162337 - DNA, 22 bp, Artificial Sequence
  chemically synthesized
accacaagtacatccatcgcta

SEQ ID NO: 1162338 - DNA, 22 bp, Artificial Sequence
  chemically synthesized
ccacaagtacatccatcgctat

SEQ ID NO: 1162339 - DNA, 22 bp, Artificial Sequence
  chemically synthesized
gcatgagaactagaggacaata

SEQ ID NO: 1162340 - DNA, 22 bp, Artificial Sequence
  chemically synthesized
agaaagttagcatgagaactag

SEQ ID NO: 1162341 - DNA, 22 bp, Artificial Sequence
  chemically synthesized
ttgtcctctagttctcatgcta

SEQ ID NO: 1162342 - DNA, 22 bp, Artificial Sequence
  chemically synthesized
tcctctagttctcatgctaact

SEQ ID NO: 1162343 - DNA, 22 bp, Artificial Sequence
  chemically synthesized
tagttctcatgctaactttctg

SEQ ID NO: 1162344 - DNA, 22 bp, Artificial Sequence
  chemically synthesized
agggtacccattcagaaagtta

SEQ ID NO: 1162345 - DNA, 22 bp, Artificial Sequence
  chemically synthesized
gttctcatgctaactttctgaa

SEQ ID NO: 1162346 - DNA, 22 bp, Artificial Sequence
  chemically synthesized
tcatgctaactttctgaatggg

SEQ ID NO: 1162347 - DNA, 22 bp, Artificial Sequence
  chemically synthesized
atgctaactttctgaatgggta

SEQ ID NO: 1162348 - DNA, 22 bp, Artificial Sequence
  chemically synthesized
acagatgctgagggtacccatt

SEQ ID NO: 1162349 - DNA, 22 bp, Artificial Sequence
  chemically synthesized
cacagatgctgagggtacccat

SEQ ID NO: 1162350 - DNA, 22 bp, Artificial Sequence
  chemically synthesized
actttctgaatgggtaccctca

SEQ ID NO: 1162351 - DNA, 22 bp, Artificial Sequence
  chemically synthesized
cagcttcacagatgctgagggt

SEQ ID NO: 1162352 - DNA, 22 bp, Artificial Sequence
  chemically synthesized
tctgaatgggtaccctcagcat

SEQ ID NO: 1162353 - DNA, 22 bp, Artificial Sequence
  chemically synthesized
ctgaatgggtaccctcagcatc

SEQ ID NO: 1162354 - DNA, 22 bp, Artificial Sequence
  chemically synthesized
tacagcttcacagatgctgagg

SEQ ID NO: 1162355 - DNA, 22 bp, Artificial Sequence
  chemically synthesized
tgaatgggtaccctcagcatct

SEQ ID NO: 1162356 - DNA, 22 bp, Artificial Sequence
  chemically synthesized
ctacagcttcacagatgctgag

SEQ ID NO: 1162357 - DNA, 22 bp, Artificial Sequence
  chemically synthesized
aatgggtaccctcagcatctgt

SEQ ID NO: 1162358 - DNA, 22 bp, Artificial Sequence
  chemically synthesized
ggccagtagggtttctacagct

SEQ ID NO: 1162359 - DNA, 22 bp, Artificial Sequence
  chemically synthesized
agcatctgtgaagctgtagaaa

SEQ ID NO: 1162360 - DNA, 22 bp, Artificial Sequence
  chemically synthesized
tgaagctgtagaaaccctactg

SEQ ID NO: 1162361 - DNA, 22 bp, Artificial Sequence
  chemically synthesized
tagaaaccctactggcctagtt

SEQ ID NO: 1162362 - DNA, 22 bp, Artificial Sequence
  chemically synthesized
aggcaagtaggtaaactaggcc

SEQ ID NO: 1162363 - DNA, 22 bp, Artificial Sequence
  chemically synthesized
ctgaggcaagtaggtaaactag

SEQ ID NO: 1162364 - DNA, 22 bp, Artificial Sequence
  chemically synthesized
gttactgaggcaagtaggtaaa

SEQ ID NO: 1162365 - DNA, 22 bp, Artificial Sequence
  chemically synthesized
ctggcctagtttacctacttgc

SEQ ID NO: 1162366 - DNA, 22 bp, Artificial Sequence
  chemically synthesized
gcctagtttacctacttgcctc

SEQ ID NO: 1162367 - DNA, 22 bp, Artificial Sequence
  chemically synthesized
gtttacctacttgcctcagtaa

SEQ ID NO: 1162368 - DNA, 22 bp, Artificial Sequence
  chemically synthesized
acctacttgcctcagtaactag

SEQ ID NO: 1162369 - DNA, 22 bp, Artificial Sequence
  chemically synthesized
cctacttgcctcagtaactaga

SEQ ID NO: 1162370 - DNA, 22 bp, Artificial Sequence
  chemically synthesized
gaggaaagcagatctagttact

SEQ ID NO: 1162371 - DNA, 22 bp, Artificial Sequence
  chemically synthesized
ggaggaaagcagatctagttac

SEQ ID NO: 1162372 - DNA, 22 bp, Artificial Sequence
  chemically synthesized
cttgcctcagtaactagatctg

SEQ ID NO: 1162373 - DNA, 22 bp, Artificial Sequence
  chemically synthesized
gcctcagtaactagatctgctt

SEQ ID NO: 1162374 - DNA, 22 bp, Artificial Sequence
  chemically synthesized
cctcagtaactagatctgcttt

SEQ ID NO: 1162375 - DNA, 22 bp, Artificial Sequence
  chemically synthesized
agtaactagatctgctttcctc

SEQ ID NO: 1162376 - DNA, 22 bp, Artificial Sequence
  chemically synthesized
gatctgctttcctccaaattct

SEQ ID NO: 1162377 - DNA, 22 bp, Artificial Sequence
  chemically synthesized
gtaaggaataccagaatttgga

SEQ ID NO: 1162378 - DNA, 22 bp, Artificial Sequence
  chemically synthesized
ctttcctccaaattctggtatt

SEQ ID NO: 1162379 - DNA, 22 bp, Artificial Sequence
  chemically synthesized
agtctagtaaggaataccagaa

SEQ ID NO: 1162380 - DNA, 22 bp, Artificial Sequence
  chemically synthesized
tcctccaaattctggtattcct

SEQ ID NO: 1162381 - DNA, 22 bp, Artificial Sequence
  chemically synthesized
cctccaaattctggtattcctt

SEQ ID NO: 1162382 - DNA, 22 bp, Artificial Sequence
  chemically synthesized
ctccaaattctggtattcctta

SEQ ID NO: 1162383 - DNA, 22 bp, Artificial Sequence
  chemically synthesized
cagctgagtctagtaaggaata

SEQ ID NO: 1162384 - DNA, 22 bp, Artificial Sequence
  chemically synthesized
gcagctgagtctagtaaggaat

SEQ ID NO: 1162385 - DNA, 22 bp, Artificial Sequence
  chemically synthesized
caaattctggtattccttacta

SEQ ID NO: 1162386 - DNA, 22 bp, Artificial Sequence
  chemically synthesized
tgcagctgagtctagtaaggaa

SEQ ID NO: 1162387 - DNA, 22 bp, Artificial Sequence
  chemically synthesized
tggtattccttactagactcag

SEQ ID NO: 1162388 - DNA, 22 bp, Artificial Sequence
  chemically synthesized
gtattccttactagactcagct

SEQ ID NO: 1162389 - DNA, 22 bp, Artificial Sequence
  chemically synthesized
cttactagactcagctgcaaag

SEQ ID NO: 1162390 - DNA, 22 bp, Artificial Sequence
  chemically synthesized
actagactcagctgcaaagcct

SEQ ID NO: 1162391 - DNA, 22 bp, Artificial Sequence
  chemically synthesized
ctagactcagctgcaaagcctg

SEQ ID NO: 1162392 - DNA, 22 bp, Artificial Sequence
  chemically synthesized
gactcagctgcaaagcctgaca

SEQ ID NO: 1162393 - DNA, 22 bp, Artificial Sequence
  chemically synthesized
agctgcaaagcctgacactgca

SEQ ID NO: 1162394 - DNA, 22 bp, Artificial Sequence
  chemically synthesized
caaagcctgacactgcatggtg

SEQ ID NO: 1162395 - DNA, 22 bp, Artificial Sequence
  chemically synthesized
tacacaccgtgacaccatgcag

SEQ ID NO: 1162396 - DNA, 22 bp, Artificial Sequence
  chemically synthesized
atacacaccgtgacaccatgca

SEQ ID NO: 1162397 - DNA, 22 bp, Artificial Sequence
  chemically synthesized
agatttatacacaccgtgacac

SEQ ID NO: 1162398 - DNA, 22 bp, Artificial Sequence
  chemically synthesized
acactgcatggtgtcacggtgt

SEQ ID NO: 1162399 - DNA, 22 bp, Artificial Sequence
  chemically synthesized
gtgcctaagatttatacacacc

SEQ ID NO: 1162400 - DNA, 22 bp, Artificial Sequence
  chemically synthesized
catggtgtcacggtgtgtataa

SEQ ID NO: 1162401 - DNA, 22 bp, Artificial Sequence
  chemically synthesized
tattagtgcctaagatttatac

SEQ ID NO: 1162402 - DNA, 22 bp, Artificial Sequence
  chemically synthesized
ctatattagtgcctaagattta

SEQ ID NO: 1162403 - DNA, 22 bp, Artificial Sequence
  chemically synthesized
caatggaaactactatattagt

SEQ ID NO: 1162404 - DNA, 22 bp, Artificial Sequence
  chemically synthesized
tccaatggaaactactatatta

SEQ ID NO: 1162405 - DNA, 22 bp, Artificial Sequence
  chemically synthesized
attctccaatggaaactactat

SEQ ID NO: 1162406 - DNA, 22 bp, Artificial Sequence
  chemically synthesized
cattctccaatggaaactacta

SEQ ID NO: 1162407 - DNA, 22 bp, Artificial Sequence
  chemically synthesized
aggcactaatatagtagtttcc

SEQ ID NO: 1162408 - DNA, 22 bp, Artificial Sequence
  chemically synthesized
ggcactaatatagtagtttcca

SEQ ID NO: 1162409 - DNA, 22 bp, Artificial Sequence
  chemically synthesized
acttcattctccaatggaaact

SEQ ID NO: 1162410 - DNA, 22 bp, Artificial Sequence
  chemically synthesized
cctcacttcattctccaatgga

SEQ ID NO: 1162411 - DNA, 22 bp, Artificial Sequence
  chemically synthesized
atatagtagtttccattggaga

SEQ ID NO: 1162412 - DNA, 22 bp, Artificial Sequence
  chemically synthesized
gcctcacttcattctccaatgg

SEQ ID NO: 1162413 - DNA, 22 bp, Artificial Sequence
  chemically synthesized
tcagaccttgcctcacttcatt

SEQ ID NO: 1162414 - DNA, 22 bp, Artificial Sequence
  chemically synthesized
gtcagaccttgcctcacttcat

SEQ ID NO: 1162415 - DNA, 22 bp, Artificial Sequence
  chemically synthesized
tgtcagaccttgcctcacttca

SEQ ID NO: 1162416 - DNA, 22 bp, Artificial Sequence
  chemically synthesized
ccattggagaatgaagtgaggc

SEQ ID NO: 1162417 - DNA, 22 bp, Artificial Sequence
  chemically synthesized
cattggagaatgaagtgaggca

SEQ ID NO: 1162418 - DNA, 22 bp, Artificial Sequence
  chemically synthesized
gagaatgaagtgaggcaaggtc

SEQ ID NO: 1162419 - DNA, 22 bp, Artificial Sequence
  chemically synthesized
tataattttgtcagaccttgcc

SEQ ID NO: 1162420 - DNA, 22 bp, Artificial Sequence
  chemically synthesized
gggggataaaaactgtataatt

SEQ ID NO: 1162421 - DNA, 22 bp, Artificial Sequence
  chemically synthesized
agggggataaaaactgtataat

SEQ ID NO: 1162422 - DNA, 22 bp, Artificial Sequence
  chemically synthesized
tagggggataaaaactgtataa

SEQ ID NO: 1162423 - DNA, 22 bp, Artificial Sequence
  chemically synthesized
gttttagggggataaaaactgt

SEQ ID NO: 1162424 - DNA, 22 bp, Artificial Sequence
  chemically synthesized
acaaaattatacagtttttatc

SEQ ID NO: 1162425 - DNA, 22 bp, Artificial Sequence
  chemically synthesized
tacagtttttatccccctaaaa

SEQ ID NO: 1162426 - DNA, 22 bp, Artificial Sequence
  chemically synthesized
ttatccccctaaaactaatgtg

SEQ ID NO: 1162427 - DNA, 22 bp, Artificial Sequence
  chemically synthesized
tatccccctaaaactaatgtgt

SEQ ID NO: 1162428 - DNA, 22 bp, Artificial Sequence
  chemically synthesized
atccccctaaaactaatgtgtt

SEQ ID NO: 1162429 - DNA, 22 bp, Artificial Sequence
  chemically synthesized
tccccctaaaactaatgtgttc

SEQ ID NO: 1162430 - DNA, 22 bp, Artificial Sequence
  chemically synthesized
taaagaggagaatgaacacatt

SEQ ID NO: 1162431 - DNA, 22 bp, Artificial Sequence
  chemically synthesized
aaactaatgtgttcattctcct

SEQ ID NO: 1162432 - DNA, 22 bp, Artificial Sequence
  chemically synthesized
atgtgttcattctcctctttac

SEQ ID NO: 1162433 - DNA, 22 bp, Artificial Sequence
  chemically synthesized
ggaaagaaggtgctgtaaagag

SEQ ID NO: 1162434 - DNA, 22 bp, Artificial Sequence
  chemically synthesized
attctcctctttacagcacctt

SEQ ID NO: 1162435 - DNA, 22 bp, Artificial Sequence
  chemically synthesized
gtgttgggaaagaaggtgctgt

SEQ ID NO: 1162436 - DNA, 22 bp, Artificial Sequence
  chemically synthesized
cgtgttgggaaagaaggtgctg

SEQ ID NO: 1162437 - DNA, 22 bp, Artificial Sequence
  chemically synthesized
tcctctttacagcaccttcttt

SEQ ID NO: 1162438 - DNA, 22 bp, Artificial Sequence
  chemically synthesized
ctctttacagcaccttctttcc

SEQ ID NO: 1162439 - DNA, 22 bp, Artificial Sequence
  chemically synthesized
tttacagcaccttctttcccaa

SEQ ID NO: 1162440 - DNA, 22 bp, Artificial Sequence
  chemically synthesized
tacagcaccttctttcccaaca

SEQ ID NO: 1162441 - DNA, 22 bp, Artificial Sequence
  chemically synthesized
acagcaccttctttcccaacac

SEQ ID NO: 1162442 - DNA, 22 bp, Artificial Sequence
  chemically synthesized
cagcaccttctttcccaacacg

SEQ ID NO: 1162443 - DNA, 22 bp, Artificial Sequence
  chemically synthesized
ctttcccaacacgaagtatgct

SEQ ID NO: 1162444 - DNA, 22 bp, Artificial Sequence
  chemically synthesized
gcccaagatgtcagcatacttc

SEQ ID NO: 1162445 - DNA, 22 bp, Artificial Sequence
  chemically synthesized
tttcccaacacgaagtatgctg

SEQ ID NO: 1162446 - DNA, 22 bp, Artificial Sequence
  chemically synthesized
tcccaacacgaagtatgctgac

SEQ ID NO: 1162447 - DNA, 22 bp, Artificial Sequence
  chemically synthesized
ctagcccaagatgtcagcatac

SEQ ID NO: 1162448 - DNA, 22 bp, Artificial Sequence
  chemically synthesized
cccaacacgaagtatgctgaca

SEQ ID NO: 1162449 - DNA, 22 bp, Artificial Sequence
  chemically synthesized
cctagcccaagatgtcagcata

SEQ ID NO: 1162450 - DNA, 22 bp, Artificial Sequence
  chemically synthesized
ccaacacgaagtatgctgacat

SEQ ID NO: 1162451 - DNA, 22 bp, Artificial Sequence
  chemically synthesized
tcctagcccaagatgtcagcat

SEQ ID NO: 1162452 - DNA, 22 bp, Artificial Sequence
  chemically synthesized
tttcctagcccaagatgtcagc

SEQ ID NO: 1162453 - DNA, 22 bp, Artificial Sequence
  chemically synthesized
ctttcctagcccaagatgtcag

SEQ ID NO: 1162454 - DNA, 22 bp, Artificial Sequence
  chemically synthesized
gcttctttcctagcccaagatg

SEQ ID NO: 1162455 - DNA, 22 bp, Artificial Sequence
  chemically synthesized
ggcttctttcctagcccaagat

SEQ ID NO: 1162456 - DNA, 22 bp, Artificial Sequence
  chemically synthesized
cttggcttctttcctagcccaa

SEQ ID NO: 1162457 - DNA, 22 bp, Artificial Sequence
  chemically synthesized
tccttggcttctttcctagccc

SEQ ID NO: 1162458 - DNA, 22 bp, Artificial Sequence
  chemically synthesized
acatcttgggctaggaaagaag

SEQ ID NO: 1162459 - DNA, 22 bp, Artificial Sequence
  chemically synthesized
gggctaggaaagaagccaagga

SEQ ID NO: 1162460 - DNA, 22 bp, Artificial Sequence
  chemically synthesized
ggctaggaaagaagccaaggag

SEQ ID NO: 1162461 - DNA, 22 bp, Artificial Sequence
  chemically synthesized
ggaaagaagccaaggagagcat

SEQ ID NO: 1162462 - DNA, 22 bp, Artificial Sequence
  chemically synthesized
aaaatgatacatgacatgctct

SEQ ID NO: 1162463 - DNA, 22 bp, Artificial Sequence
  chemically synthesized
gaaaatgatacatgacatgctc

SEQ ID NO: 1162464 - DNA, 22 bp, Artificial Sequence
  chemically synthesized
tgaaaatgatacatgacatgct

SEQ ID NO: 1162465 - DNA, 22 bp, Artificial Sequence
  chemically synthesized
ttgaaaatgatacatgacatgc

SEQ ID NO: 1162466 - DNA, 22 bp, Artificial Sequence
  chemically synthesized
gtgggaatttttgaaaatgata

SEQ ID NO: 1162467 - DNA, 22 bp, Artificial Sequence
  chemically synthesized
tggcaattagtgggaatttttg

SEQ ID NO: 1162468 - DNA, 22 bp, Artificial Sequence
  chemically synthesized
tcaaaaattcccactaattgcc

SEQ ID NO: 1162469 - DNA, 22 bp, Artificial Sequence
  chemically synthesized
caaaaattcccactaattgcca

SEQ ID NO: 1162470 - DNA, 22 bp, Artificial Sequence
  chemically synthesized
aaaaattcccactaattgccat

SEQ ID NO: 1162471 - DNA, 22 bp, Artificial Sequence
  chemically synthesized
ccactaattgccatagttatta

SEQ ID NO: 1162472 - DNA, 22 bp, Artificial Sequence
  chemically synthesized
cagggtgcagtataataactat

SEQ ID NO: 1162473 - DNA, 22 bp, Artificial Sequence
  chemically synthesized
attgccatagttattatactgc

SEQ ID NO: 1162474 - DNA, 22 bp, Artificial Sequence
  chemically synthesized
ccatagttattatactgcaccc

SEQ ID NO: 1162475 - DNA, 22 bp, Artificial Sequence
  chemically synthesized
caagatcaggttgcagggtgca

SEQ ID NO: 1162476 - DNA, 22 bp, Artificial Sequence
  chemically synthesized
acctccaagatcaggttgcagg

SEQ ID NO: 1162477 - DNA, 22 bp, Artificial Sequence
  chemically synthesized
ttatactgcaccctgcaacctg

SEQ ID NO: 1162478 - DNA, 22 bp, Artificial Sequence
  chemically synthesized
gacctccaagatcaggttgcag

SEQ ID NO: 1162479 - DNA, 22 bp, Artificial Sequence
  chemically synthesized
tactgcaccctgcaacctgatc

SEQ ID NO: 1162480 - DNA, 22 bp, Artificial Sequence
  chemically synthesized
aagtttgacctccaagatcagg

SEQ ID NO: 1162481 - DNA, 22 bp, Artificial Sequence
  chemically synthesized
aaagtttgacctccaagatcag

SEQ ID NO: 1162482 - DNA, 22 bp, Artificial Sequence
  chemically synthesized
caccctgcaacctgatcttgga

SEQ ID NO: 1162483 - DNA, 22 bp, Artificial Sequence
  chemically synthesized
taatttaaagtttgacctccaa

SEQ ID NO: 1162484 - DNA, 22 bp, Artificial Sequence
  chemically synthesized
caacctgatcttggaggtcaaa

SEQ ID NO: 1162485 - DNA, 22 bp, Artificial Sequence
  chemically synthesized
tgaggttgtaatttaaagtttg

SEQ ID NO: 1162486 - DNA, 22 bp, Artificial Sequence
  chemically synthesized
atcttggaggtcaaactttaaa

SEQ ID NO: 1162487 - DNA, 22 bp, Artificial Sequence
  chemically synthesized
ctgtgaggttgtaatttaaagt

SEQ ID NO: 1162488 - DNA, 22 bp, Artificial Sequence
  chemically synthesized
actgtgaggttgtaatttaaag

SEQ ID NO: 1162489 - DNA, 22 bp, Artificial Sequence
  chemically synthesized
ggaggtcaaactttaaattaca

SEQ ID NO: 1162490 - DNA, 22 bp, Artificial Sequence
  chemically synthesized
gaggtcaaactttaaattacaa

SEQ ID NO: 1162491 - DNA, 22 bp, Artificial Sequence
  chemically synthesized
tttactgtgaggttgtaattta

SEQ ID NO: 1162492 - DNA, 22 bp, Artificial Sequence
  chemically synthesized
aactatttactgtgaggttgta

SEQ ID NO: 1162493 - DNA, 22 bp, Artificial Sequence
  chemically synthesized
tgaactatttactgtgaggttg

SEQ ID NO: 1162494 - DNA, 22 bp, Artificial Sequence
  chemically synthesized
ctgaactatttactgtgaggtt

SEQ ID NO: 1162495 - DNA, 22 bp, Artificial Sequence
  chemically synthesized
tctgaactatttactgtgaggt

SEQ ID NO: 1162496 - DNA, 22 bp, Artificial Sequence
  chemically synthesized
tttctgaactatttactgtgag

SEQ ID NO: 1162497 - DNA, 22 bp, Artificial Sequence
  chemically synthesized
taaattacaacctcacagtaaa

SEQ ID NO: 1162498 - DNA, 22 bp, Artificial Sequence
  chemically synthesized
aaattacaacctcacagtaaat

SEQ ID NO: 1162499 - DNA, 22 bp, Artificial Sequence
  chemically synthesized
aattacaacctcacagtaaata

SEQ ID NO: 1162500 - DNA, 22 bp, Artificial Sequence
  chemically synthesized
ggttctttctgaactatttact

SEQ ID NO: 1162501 - DNA, 22 bp, Artificial Sequence
  chemically synthesized
caacctcacagtaaatagttca

SEQ ID NO: 1162502 - DNA, 22 bp, Artificial Sequence
  chemically synthesized
tattaggttctttctgaactat

SEQ ID NO: 1162503 - DNA, 22 bp, Artificial Sequence
  chemically synthesized
atattaggttctttctgaacta

SEQ ID NO: 1162504 - DNA, 22 bp, Artificial Sequence
  chemically synthesized
tatattaggttctttctgaact

SEQ ID NO: 1162505 - DNA, 22 bp, Artificial Sequence
  chemically synthesized
acagtaaatagttcagaaagaa

SEQ ID NO: 1162506 - DNA, 22 bp, Artificial Sequence
  chemically synthesized
gatggggaactttatattaggt

SEQ ID NO: 1162507 - DNA, 22 bp, Artificial Sequence
  chemically synthesized
ttggatggggaactttatatta

SEQ ID NO: 1162508 - DNA, 22 bp, Artificial Sequence
  chemically synthesized
agaaagaacctaatataaagtt

SEQ ID NO: 1162509 - DNA, 22 bp, Artificial Sequence
  chemically synthesized
gttgttggatggggaactttat

SEQ ID NO: 1162510 - DNA, 22 bp, Artificial Sequence
  chemically synthesized
tagttgttggatggggaacttt

SEQ ID NO: 1162511 - DNA, 22 bp, Artificial Sequence
  chemically synthesized
ctagttgttggatggggaactt

SEQ ID NO: 1162512 - DNA, 22 bp, Artificial Sequence
  chemically synthesized
atttctagttgttggatgggga

SEQ ID NO: 1162513 - DNA, 22 bp, Artificial Sequence
  chemically synthesized
catttctagttgttggatgggg

SEQ ID NO: 1162514 - DNA, 22 bp, Artificial Sequence
  chemically synthesized
atataaagttccccatccaaca

SEQ ID NO: 1162515 - DNA, 22 bp, Artificial Sequence
  chemically synthesized
cttcatttctagttgttggatg

SEQ ID NO: 1162516 - DNA, 22 bp, Artificial Sequence
  chemically synthesized
ccttcatttctagttgttggat

SEQ ID NO: 1162517 - DNA, 22 bp, Artificial Sequence
  chemically synthesized
tccttcatttctagttgttgga

SEQ ID NO: 1162518 - DNA, 22 bp, Artificial Sequence
  chemically synthesized
cccatccaacaactagaaatga

SEQ ID NO: 1162519 - DNA, 22 bp, Artificial Sequence
  chemically synthesized
gaacattttccttcatttctag

SEQ ID NO: 1162520 - DNA, 22 bp, Artificial Sequence
  chemically synthesized
tgaaaaactggaacattttcct

SEQ ID NO: 1162521 - DNA, 22 bp, Artificial Sequence
  chemically synthesized
gtgaaaaactggaacattttcc

SEQ ID NO: 1162522 - DNA, 22 bp, Artificial Sequence
  chemically synthesized
tgtgaaaaactggaacattttc

SEQ ID NO: 1162523 - DNA, 22 bp, Artificial Sequence
  chemically synthesized
gaaatgaaggaaaatgttccag

SEQ ID NO: 1162524 - DNA, 22 bp, Artificial Sequence
  chemically synthesized
attttgtgaaaaactggaacat

SEQ ID NO: 1162525 - DNA, 22 bp, Artificial Sequence
  chemically synthesized
aattttgtgaaaaactggaaca

SEQ ID NO: 1162526 - DNA, 22 bp, Artificial Sequence
  chemically synthesized
gtgcatgtttaattttgtgaaa

SEQ ID NO: 1162527 - DNA, 22 bp, Artificial Sequence
  chemically synthesized
cagtttttcacaaaattaaaca

SEQ ID NO: 1162528 - DNA, 22 bp, Artificial Sequence
  chemically synthesized
ttcacaaaattaaacatgcact

SEQ ID NO: 1162529 - DNA, 22 bp, Artificial Sequence
  chemically synthesized
tcacaaaattaaacatgcacta

SEQ ID NO: 1162530 - DNA, 22 bp, Artificial Sequence
  chemically synthesized
cacaaaattaaacatgcactaa

SEQ ID NO: 1162531 - DNA, 22 bp, Artificial Sequence
  chemically synthesized
acaaaattaaacatgcactaac

SEQ ID NO: 1162532 - DNA, 22 bp, Artificial Sequence
  chemically synthesized
agtaggaaaataaatgttagtg

SEQ ID NO: 1162533 - DNA, 22 bp, Artificial Sequence
  chemically synthesized
cattaagtaggaaaataaatgt

SEQ ID NO: 1162534 - DNA, 22 bp, Artificial Sequence
  chemically synthesized
aacatgcactaacatttatttt

SEQ ID NO: 1162535 - DNA, 22 bp, Artificial Sequence
  chemically synthesized
acattccattaagtaggaaaat

SEQ ID NO: 1162536 - DNA, 22 bp, Artificial Sequence
  chemically synthesized
tcacattccattaagtaggaaa

SEQ ID NO: 1162537 - DNA, 22 bp, Artificial Sequence
  chemically synthesized
ctcacattccattaagtaggaa

SEQ ID NO: 1162538 - DNA, 22 bp, Artificial Sequence
  chemically synthesized
acatttattttcctacttaatg

SEQ ID NO: 1162539 - DNA, 22 bp, Artificial Sequence
  chemically synthesized
tttctcacattccattaagtag

SEQ ID NO: 1162540 - DNA, 22 bp, Artificial Sequence
  chemically synthesized
attttcctacttaatggaatgt

SEQ ID NO: 1162541 - DNA, 22 bp, Artificial Sequence
  chemically synthesized
ttttcctacttaatggaatgtg

SEQ ID NO: 1162542 - DNA, 22 bp, Artificial Sequence
  chemically synthesized
tcctacttaatggaatgtgaga

SEQ ID NO: 1162543 - DNA, 22 bp, Artificial Sequence
  chemically synthesized
cctacttaatggaatgtgagaa

SEQ ID NO: 1162544 - DNA, 22 bp, Artificial Sequence
  chemically synthesized
ctacttaatggaatgtgagaaa

SEQ ID NO: 1162545 - DNA, 22 bp, Artificial Sequence
  chemically synthesized
cttaatggaatgtgagaaatag

SEQ ID NO: 1162546 - DNA, 22 bp, Artificial Sequence
  chemically synthesized
aatggaatgtgagaaatagtat

SEQ ID NO: 1162547 - DNA, 22 bp, Artificial Sequence
  chemically synthesized
agtataaaaacaatactatttc

SEQ ID NO: 1162548 - DNA, 22 bp, Artificial Sequence
  chemically synthesized
atggaatgtgagaaatagtatt

SEQ ID NO: 1162549 - DNA, 22 bp, Artificial Sequence
  chemically synthesized
atagaattcagtataaaaacaa

SEQ ID NO: 1162550 - DNA, 22 bp, Artificial Sequence
  chemically synthesized
tcatagaattcagtataaaaac

SEQ ID NO: 1162551 - DNA, 22 bp, Artificial Sequence
  chemically synthesized
ctcatagaattcagtataaaaa

SEQ ID NO: 1162552 - DNA, 22 bp, Artificial Sequence
  chemically synthesized
tctcatagaattcagtataaaa

SEQ ID NO: 1162553 - DNA, 22 bp, Artificial Sequence
  chemically synthesized
gattttctcatagaattcagta

SEQ ID NO: 1162554 - DNA, 22 bp, Artificial Sequence
  chemically synthesized
cgattttctcatagaattcagt

SEQ ID NO: 1162555 - DNA, 22 bp, Artificial Sequence
  chemically synthesized
tcgattttctcatagaattcag

SEQ ID NO: 1162556 - DNA, 22 bp, Artificial Sequence
  chemically synthesized
tttttatactgaattctatgag

SEQ ID NO: 1162557 - DNA, 22 bp, Artificial Sequence
  chemically synthesized
ttatactgaattctatgagaaa

SEQ ID NO: 1162558 - DNA, 22 bp, Artificial Sequence
  chemically synthesized
tatactgaattctatgagaaaa

SEQ ID NO: 1162559 - DNA, 22 bp, Artificial Sequence
  chemically synthesized
atactgaattctatgagaaaat

SEQ ID NO: 1162560 - DNA, 22 bp, Artificial Sequence
  chemically synthesized
tactgaattctatgagaaaatc

SEQ ID NO: 1162561 - DNA, 22 bp, Artificial Sequence
  chemically synthesized
aattctatgagaaaatcgaaaa

SEQ ID NO: 1162562 - DNA, 22 bp, Artificial Sequence
  chemically synthesized
aaaacaatgacacattttcgat

SEQ ID NO: 1162563 - DNA, 22 bp, Artificial Sequence
  chemically synthesized
gaaaacaatgacacattttcga

SEQ ID NO: 1162564 - DNA, 22 bp, Artificial Sequence
  chemically synthesized
tatgagaaaatcgaaaatgtgt

SEQ ID NO: 1162565 - DNA, 22 bp, Artificial Sequence
  chemically synthesized
tgagaaaatcgaaaatgtgtca

SEQ ID NO: 1162566 - DNA, 22 bp, Artificial Sequence
  chemically synthesized
ttttcaaatcctgatccatttt

SEQ ID NO: 1162567 - DNA, 22 bp, Artificial Sequence
  chemically synthesized
tcaaatcctgatccatttttgt

SEQ ID NO: 1162568 - DNA, 22 bp, Artificial Sequence
  chemically synthesized
tatggatggaggacaaaaatgg

SEQ ID NO: 1162569 - DNA, 22 bp, Artificial Sequence
  chemically synthesized
caaatcctgatccatttttgtc

SEQ ID NO: 1162570 - DNA, 22 bp, Artificial Sequence
  chemically synthesized
aaatcctgatccatttttgtcc

SEQ ID NO: 1162571 - DNA, 22 bp, Artificial Sequence
  chemically synthesized
agctatatggatggaggacaaa

SEQ ID NO: 1162572 - DNA, 22 bp, Artificial Sequence
  chemically synthesized
ttcagctatatggatggaggac

SEQ ID NO: 1162573 - DNA, 22 bp, Artificial Sequence
  chemically synthesized
atccatttttgtcctccatcca

SEQ ID NO: 1162574 - DNA, 22 bp, Artificial Sequence
  chemically synthesized
aactgttcagctatatggatgg

SEQ ID NO: 1162575 - DNA, 22 bp, Artificial Sequence
  chemically synthesized
ttgtcctccatccatatagctg

SEQ ID NO: 1162576 - DNA, 22 bp, Artificial Sequence
  chemically synthesized
tgtcctccatccatatagctga

SEQ ID NO: 1162577 - DNA, 22 bp, Artificial Sequence
  chemically synthesized
gtcctccatccatatagctgaa

SEQ ID NO: 1162578 - DNA, 22 bp, Artificial Sequence
  chemically synthesized
ataattaaactgttcagctata

SEQ ID NO: 1162579 - DNA, 22 bp, Artificial Sequence
  chemically synthesized
tcctccatccatatagctgaac

SEQ ID NO: 1162580 - DNA, 22 bp, Artificial Sequence
  chemically synthesized
catccatatagctgaacagttt

SEQ ID NO: 1162581 - DNA, 22 bp, Artificial Sequence
  chemically synthesized
aaaaatattaataattaaactg

SEQ ID NO: 1162582 - DNA, 22 bp, Artificial Sequence
  chemically synthesized
ggatagttgaaaaatattaata

SEQ ID NO: 1162583 - DNA, 22 bp, Artificial Sequence
  chemically synthesized
aacagtttaattattaatattt

SEQ ID NO: 1162584 - DNA, 22 bp, Artificial Sequence
  chemically synthesized
cctcggatagttgaaaaatatt

SEQ ID NO: 1162585 - DNA, 22 bp, Artificial Sequence
  chemically synthesized
aattattaatatttttcaacta

SEQ ID NO: 1162586 - DNA, 22 bp, Artificial Sequence
  chemically synthesized
attattaatatttttcaactat

SEQ ID NO: 1162587 - DNA, 22 bp, Artificial Sequence
  chemically synthesized
atgttgcctcggatagttgaaa

SEQ ID NO: 1162588 - DNA, 22 bp, Artificial Sequence
  chemically synthesized
aatgttgcctcggatagttgaa

SEQ ID NO: 1162589 - DNA, 22 bp, Artificial Sequence
  chemically synthesized
taatgttgcctcggatagttga

SEQ ID NO: 1162590 - DNA, 22 bp, Artificial Sequence
  chemically synthesized
ttaatatttttcaactatccga

SEQ ID NO: 1162591 - DNA, 22 bp, Artificial Sequence
  chemically synthesized
atatttttcaactatccgaggc

SEQ ID NO: 1162592 - DNA, 22 bp, Artificial Sequence
  chemically synthesized
aactttaatgttgcctcggata

SEQ ID NO: 1162593 - DNA, 22 bp, Artificial Sequence
  chemically synthesized
gaactttaatgttgcctcggat

SEQ ID NO: 1162594 - DNA, 22 bp, Artificial Sequence
  chemically synthesized
ttcaactatccgaggcaacatt

SEQ ID NO: 1162595 - DNA, 22 bp, Artificial Sequence
  chemically synthesized
catttgaactttaatgttgcct

SEQ ID NO: 1162596 - DNA, 22 bp, Artificial Sequence
  chemically synthesized
tcaactatccgaggcaacatta

SEQ ID NO: 1162597 - DNA, 22 bp, Artificial Sequence
  chemically synthesized
gcatttgaactttaatgttgcc

SEQ ID NO: 1162598 - DNA, 22 bp, Artificial Sequence
  chemically synthesized
caactatccgaggcaacattaa

SEQ ID NO: 1162599 - DNA, 22 bp, Artificial Sequence
  chemically synthesized
aactatccgaggcaacattaaa

SEQ ID NO: 1162600 - DNA, 22 bp, Artificial Sequence
  chemically synthesized
tccgaggcaacattaaagttca

SEQ ID NO: 1162601 - DNA, 22 bp, Artificial Sequence
  chemically synthesized
aaaatgaaaataaatgtgtttg

SEQ ID NO: 1162602 - DNA, 22 bp, Artificial Sequence
  chemically synthesized
aagttcaaatgcaaacacattt

SEQ ID NO: 1162603 - DNA, 22 bp, Artificial Sequence
  chemically synthesized
caaaatgaaaataaatgtgttt

SEQ ID NO: 1162604 - DNA, 22 bp, Artificial Sequence
  chemically synthesized
tcaaaatgaaaataaatgtgtt

SEQ ID NO: 1162605 - DNA, 22 bp, Artificial Sequence
  chemically synthesized
aaatgcaaacacatttattttc

SEQ ID NO: 1162606 - DNA, 22 bp, Artificial Sequence
  chemically synthesized
tgttttcaaaatgaaaataaat

SEQ ID NO: 1162607 - DNA, 22 bp, Artificial Sequence
  chemically synthesized
atgttttcaaaatgaaaataaa

SEQ ID NO: 1162608 - DNA, 22 bp, Artificial Sequence
  chemically synthesized
aatttatgttttcaaaatgaaa

SEQ ID NO: 1162609 - DNA, 22 bp, Artificial Sequence
  chemically synthesized
aactgaatttatgttttcaaaa

SEQ ID NO: 1162610 - DNA, 22 bp, Artificial Sequence
  chemically synthesized
ctaaactgaatttatgttttca

SEQ ID NO: 1162611 - DNA, 22 bp, Artificial Sequence
  chemically synthesized
attttcattttgaaaacataaa

SEQ ID NO: 1162612 - DNA, 22 bp, Artificial Sequence
  chemically synthesized
ttttcattttgaaaacataaat

SEQ ID NO: 1162613 - DNA, 22 bp, Artificial Sequence
  chemically synthesized
ttactaaactgaatttatgttt

SEQ ID NO: 1162614 - DNA, 22 bp, Artificial Sequence
  chemically synthesized
tcattttgaaaacataaattca

SEQ ID NO: 1162615 - DNA, 22 bp, Artificial Sequence
  chemically synthesized
ttgttactaaactgaatttatg

SEQ ID NO: 1162616 - DNA, 22 bp, Artificial Sequence
  chemically synthesized
cattttgaaaacataaattcag

SEQ ID NO: 1162617 - DNA, 22 bp, Artificial Sequence
  chemically synthesized
attttgaaaacataaattcagt

SEQ ID NO: 1162618 - DNA, 22 bp, Artificial Sequence
  chemically synthesized
tgttattgttactaaactgaat

SEQ ID NO: 1162619 - DNA, 22 bp, Artificial Sequence
  chemically synthesized
tgaaaacataaattcagtttag

SEQ ID NO: 1162620 - DNA, 22 bp, Artificial Sequence
  chemically synthesized
atgttattgttactaaactgaa

SEQ ID NO: 1162621 - DNA, 22 bp, Artificial Sequence
  chemically synthesized
gaaaacataaattcagtttagt

SEQ ID NO: 1162622 - DNA, 22 bp, Artificial Sequence
  chemically synthesized
tatgttattgttactaaactga

SEQ ID NO: 1162623 - DNA, 22 bp, Artificial Sequence
  chemically synthesized
aaaacataaattcagtttagta

SEQ ID NO: 1162624 - DNA, 22 bp, Artificial Sequence
  chemically synthesized
tttatgttattgttactaaact

SEQ ID NO: 1162625 - DNA, 22 bp, Artificial Sequence
  chemically synthesized
ctttatgttattgttactaaac

SEQ ID NO: 1162626 - DNA, 22 bp, Artificial Sequence
  chemically synthesized
agtttagtaacaataacataaa

SEQ ID NO: 1162627 - DNA, 22 bp, Artificial Sequence
  chemically synthesized
agtaacaataacataaagaagc

SEQ ID NO: 1162628 - DNA, 22 bp, Artificial Sequence
  chemically synthesized
gtaacaataacataaagaagct

SEQ ID NO: 1162629 - DNA, 22 bp, Artificial Sequence
  chemically synthesized
catccagccacgcagcttcttt

SEQ ID NO: 1162630 - DNA, 22 bp, Artificial Sequence
  chemically synthesized
gcatccagccacgcagcttctt

SEQ ID NO: 1162631 - DNA, 22 bp, Artificial Sequence
  chemically synthesized
tgcatccagccacgcagcttct

SEQ ID NO: 1162632 - DNA, 22 bp, Artificial Sequence
  chemically synthesized
ttgcatccagccacgcagcttc

SEQ ID NO: 1162633 - DNA, 22 bp, Artificial Sequence
  chemically synthesized
gccaagaatcttttgcatccag

SEQ ID NO: 1162634 - DNA, 22 bp, Artificial Sequence
  chemically synthesized
cgtggctggatgcaaaagattc

SEQ ID NO: 1162635 - DNA, 22 bp, Artificial Sequence
  chemically synthesized
gatgcaaaagattcttggccag

SEQ ID NO: 1162636 - DNA, 22 bp, Artificial Sequence
  chemically synthesized
caggcatgagccaccacgcctg

SEQ ID NO: 1162637 - DNA, 22 bp, Artificial Sequence
  chemically synthesized
ggattacaggcatgagccacca

SEQ ID NO: 1162638 - DNA, 22 bp, Artificial Sequence
  chemically synthesized
ttggccaggcgtggtggctcat

SEQ ID NO: 1162639 - DNA, 22 bp, Artificial Sequence
  chemically synthesized
ggccaggcgtggtggctcatgc

SEQ ID NO: 1162640 - DNA, 22 bp, Artificial Sequence
  chemically synthesized
gccaggcgtggtggctcatgcc

SEQ ID NO: 1162641 - DNA, 22 bp, Artificial Sequence
  chemically synthesized
agtgctgggattacaggcatga

SEQ ID NO: 1162642 - DNA, 22 bp, Artificial Sequence
  chemically synthesized
agcctcagtgctgggattacag

SEQ ID NO: 1162643 - DNA, 22 bp, Artificial Sequence
  chemically synthesized
ctcagcctcagtgctgggatta

SEQ ID NO: 1162644 - DNA, 22 bp, Artificial Sequence
  chemically synthesized
atgcctgtaatcccagcactga

SEQ ID NO: 1162645 - DNA, 22 bp, Artificial Sequence
  chemically synthesized
gcctcctcagcctcagtgctgg

SEQ ID NO: 1162646 - DNA, 22 bp, Artificial Sequence
  chemically synthesized
agcctcctcagcctcagtgctg

SEQ ID NO: 1162647 - DNA, 22 bp, Artificial Sequence
  chemically synthesized
ccttagcctcctcagcctcagt

SEQ ID NO: 1162648 - DNA, 22 bp, Artificial Sequence
  chemically synthesized
taatcccagcactgaggctgag

SEQ ID NO: 1162649 - DNA, 22 bp, Artificial Sequence
  chemically synthesized
gtgatccacctgccttagcctc

SEQ ID NO: 1162650 - DNA, 22 bp, Artificial Sequence
  chemically synthesized
aggctgaggaggctaaggcagg

SEQ ID NO: 1162651 - DNA, 22 bp, Artificial Sequence
  chemically synthesized
acctcgtgatccacctgcctta

SEQ ID NO: 1162652 - DNA, 22 bp, Artificial Sequence
  chemically synthesized
ctgacctcgtgatccacctgcc

SEQ ID NO: 1162653 - DNA, 22 bp, Artificial Sequence
  chemically synthesized
aggaggctaaggcaggtggatc

SEQ ID NO: 1162654 - DNA, 22 bp, Artificial Sequence
  chemically synthesized
gacctcctgacctcgtgatcca

SEQ ID NO: 1162655 - DNA, 22 bp, Artificial Sequence
  chemically synthesized
aggcaggtggatcacgaggtca

SEQ ID NO: 1162656 - DNA, 22 bp, Artificial Sequence
  chemically synthesized
aggatggtctcgacctcctgac

SEQ ID NO: 1162657 - DNA, 22 bp, Artificial Sequence
  chemically synthesized
ttcaggatggtctcgacctcct

SEQ ID NO: 1162658 - DNA, 22 bp, Artificial Sequence
  chemically synthesized
accatgttattcaggatggtct

SEQ ID NO: 1162659 - DNA, 22 bp, Artificial Sequence
  chemically synthesized
caccatgttattcaggatggtc

SEQ ID NO: 1162660 - DNA, 22 bp, Artificial Sequence
  chemically synthesized
gtagagacggggtttcaccatg

SEQ ID NO: 1162661 - DNA, 22 bp, Artificial Sequence
  chemically synthesized
agtagagacggggtttcaccat

SEQ ID NO: 1162662 - DNA, 22 bp, Artificial Sequence
  chemically synthesized
tagtagagacggggtttcacca

SEQ ID NO: 1162663 - DNA, 22 bp, Artificial Sequence
  chemically synthesized
ttagtagagacggggtttcacc

SEQ ID NO: 1162664 - DNA, 22 bp, Artificial Sequence
  chemically synthesized
aataacatggtgaaaccccgtc

SEQ ID NO: 1162665 - DNA, 22 bp, Artificial Sequence
  chemically synthesized
tatttttagtagagacggggtt

SEQ ID NO: 1162666 - DNA, 22 bp, Artificial Sequence
  chemically synthesized
gtatttttagtagagacggggt

SEQ ID NO: 1162667 - DNA, 22 bp, Artificial Sequence
  chemically synthesized
tgtatttttagtagagacgggg

SEQ ID NO: 1162668 - DNA, 22 bp, Artificial Sequence
  chemically synthesized
ttgtatttttagtagagacggg

SEQ ID NO: 1162669 - DNA, 22 bp, Artificial Sequence
  chemically synthesized
tttgtatttttagtagagacgg

SEQ ID NO: 1162670 - DNA, 22 bp, Artificial Sequence
  chemically synthesized
actttttgtatttttagtagag

SEQ ID NO: 1162671 - DNA, 22 bp, Artificial Sequence
  chemically synthesized
ggctaactttttgtatttttag

SEQ ID NO: 1162672 - DNA, 22 bp, Artificial Sequence
  chemically synthesized
tactaaaaatacaaaaagttag

SEQ ID NO: 1162673 - DNA, 22 bp, Artificial Sequence
  chemically synthesized
ctaaaaatacaaaaagttagcc

SEQ ID NO: 1162674 - DNA, 22 bp, Artificial Sequence
  chemically synthesized
aaaatacaaaaagttagccgag

SEQ ID NO: 1162675 - DNA, 22 bp, Artificial Sequence
  chemically synthesized
caggtgcccgccaccacgctcg

SEQ ID NO: 1162676 - DNA, 22 bp, Artificial Sequence
  chemically synthesized
ggactacaggtgcccgccacca

SEQ ID NO: 1162677 - DNA, 22 bp, Artificial Sequence
  chemically synthesized
gccgagcgtggtggcgggcacc

SEQ ID NO: 1162678 - DNA, 22 bp, Artificial Sequence
  chemically synthesized
cccagtagttgggactacaggt

SEQ ID NO: 1162679 - DNA, 22 bp, Artificial Sequence
  chemically synthesized
agcctccccagtagttgggact

SEQ ID NO: 1162680 - DNA, 22 bp, Artificial Sequence
  chemically synthesized
gttcagcctccccagtagttgg

SEQ ID NO: 1162681 - DNA, 22 bp, Artificial Sequence
  chemically synthesized
ctggttcagcctccccagtagt

SEQ ID NO: 1162682 - DNA, 22 bp, Artificial Sequence
  chemically synthesized
tcctggttcagcctccccagta

SEQ ID NO: 1162683 - DNA, 22 bp, Artificial Sequence
  chemically synthesized
tagtcccaactactggggaggc

SEQ ID NO: 1162684 - DNA, 22 bp, Artificial Sequence
  chemically synthesized
acgccattctcctggttcagcc

SEQ ID NO: 1162685 - DNA, 22 bp, Artificial Sequence
  chemically synthesized
ctggggaggctgaaccaggaga

SEQ ID NO: 1162686 - DNA, 22 bp, Artificial Sequence
  chemically synthesized
gggaggctgaaccaggagaatg

SEQ ID NO: 1162687 - DNA, 22 bp, Artificial Sequence
  chemically synthesized
cgccccccgggttcacgccatt

SEQ ID NO: 1162688 - DNA, 22 bp, Artificial Sequence
  chemically synthesized
aaccaggagaatggcgtgaacc

SEQ ID NO: 1162689 - DNA, 22 bp, Artificial Sequence
  chemically synthesized
caagctccgccccccgggttca

SEQ ID NO: 1162690 - DNA, 22 bp, Artificial Sequence
  chemically synthesized
actgcaagctccgccccccggg

SEQ ID NO: 1162691 - DNA, 22 bp, Artificial Sequence
  chemically synthesized
ggctcactgcaagctccgcccc

SEQ ID NO: 1162692 - DNA, 22 bp, Artificial Sequence
  chemically synthesized
tctcggctcactgcaagctccg

SEQ ID NO: 1162693 - DNA, 22 bp, Artificial Sequence
  chemically synthesized
gagtgcagtggcgctatctcgg

SEQ ID NO: 1162694 - DNA, 22 bp, Artificial Sequence
  chemically synthesized
gcagtgagccgagatagcgcca

SEQ ID NO: 1162695 - DNA, 22 bp, Artificial Sequence
  chemically synthesized
cagtgagccgagatagcgccac

SEQ ID NO: 1162696 - DNA, 22 bp, Artificial Sequence
  chemically synthesized
ccaggctggagtgcagtggcgc

SEQ ID NO: 1162697 - DNA, 22 bp, Artificial Sequence
  chemically synthesized
tctcccaggctggagtgcagtg

SEQ ID NO: 1162698 - DNA, 22 bp, Artificial Sequence
  chemically synthesized
cctgtctcccaggctggagtgc

SEQ ID NO: 1162699 - DNA, 22 bp, Artificial Sequence
  chemically synthesized
agacagagtctccctgtctccc

SEQ ID NO: 1162700 - DNA, 22 bp, Artificial Sequence
  chemically synthesized
cactccagcctgggagacaggg

SEQ ID NO: 1162701 - DNA, 22 bp, Artificial Sequence
  chemically synthesized
gagacagagtctccctgtctcc

SEQ ID NO: 1162702 - DNA, 22 bp, Artificial Sequence
  chemically synthesized
tgagacagagtctccctgtctc

SEQ ID NO: 1162703 - DNA, 22 bp, Artificial Sequence
  chemically synthesized
ttgagacagagtctccctgtct

SEQ ID NO: 1162704 - DNA, 22 bp, Artificial Sequence
  chemically synthesized
tttgagacagagtctccctgtc

SEQ ID NO: 1162705 - DNA, 22 bp, Artificial Sequence
  chemically synthesized
ttttgagacagagtctccctgt

SEQ ID NO: 1162706 - DNA, 22 bp, Artificial Sequence
  chemically synthesized
cagcctgggagacagggagact

SEQ ID NO: 1162707 - DNA, 22 bp, Artificial Sequence
  chemically synthesized
tttttgagacagagtctccctg

SEQ ID NO: 1162708 - DNA, 22 bp, Artificial Sequence
  chemically synthesized
ttttttgagacagagtctccct

SEQ ID NO: 1162709 - DNA, 22 bp, Artificial Sequence
  chemically synthesized
tttttttgagacagagtctccc

SEQ ID NO: 1162710 - DNA, 22 bp, Artificial Sequence
  chemically synthesized
ttttttttgagacagagtctcc

SEQ ID NO: 1162711 - DNA, 22 bp, Artificial Sequence
  chemically synthesized
ttttttttttgagacagagtct

SEQ ID NO: 1162712 - DNA, 22 bp, Artificial Sequence
  chemically synthesized
cttttttttttgagacagagtc

SEQ ID NO: 1162713 - DNA, 22 bp, Artificial Sequence
  chemically synthesized
ggagacagggagactctgtctc

SEQ ID NO: 1162714 - DNA, 22 bp, Artificial Sequence
  chemically synthesized
tcttttttttttgagacagagt

SEQ ID NO: 1162715 - DNA, 22 bp, Artificial Sequence
  chemically synthesized
ttcttttttttttgagacagag

SEQ ID NO: 1162716 - DNA, 22 bp, Artificial Sequence
  chemically synthesized
tttcttttttttttgagacaga

SEQ ID NO: 1162717 - DNA, 22 bp, Artificial Sequence
  chemically synthesized
tttttcttttttttttgagaca

SEQ ID NO: 1162718 - DNA, 22 bp, Artificial Sequence
  chemically synthesized
ctttttcttttttttttgagac

SEQ ID NO: 1162719 - DNA, 22 bp, Artificial Sequence
  chemically synthesized
tctttttcttttttttttgaga

SEQ ID NO: 1162720 - DNA, 22 bp, Artificial Sequence
  chemically synthesized
ttctttttcttttttttttgag

SEQ ID NO: 1162721 - DNA, 22 bp, Artificial Sequence
  chemically synthesized
tttctttttcttttttttttga

SEQ ID NO: 1162722 - DNA, 22 bp, Artificial Sequence
  chemically synthesized
tttttctttttctttttttttt

SEQ ID NO: 1162723 - DNA, 22 bp, Artificial Sequence
  chemically synthesized
ctttttctttttcttttttttt

SEQ ID NO: 1162724 - DNA, 22 bp, Artificial Sequence
  chemically synthesized
tctttttctttttctttttttt

SEQ ID NO: 1162725 - DNA, 22 bp, Artificial Sequence
  chemically synthesized
ttctttttctttttcttttttt

SEQ ID NO: 1162726 - DNA, 22 bp, Artificial Sequence
  chemically synthesized
tttctttttctttttctttttt

SEQ ID NO: 1162727 - DNA, 22 bp, Artificial Sequence
  chemically synthesized
tgtctcaaaaaaaaaagaaaaa

SEQ ID NO: 1162728 - DNA, 22 bp, Artificial Sequence
  chemically synthesized
tctcaaaaaaaaaagaaaaaga

SEQ ID NO: 1162729 - DNA, 22 bp, Artificial Sequence
  chemically synthesized
aaaaaaaaaagaaaaagaaaaa

SEQ ID NO: 1162730 - DNA, 22 bp, Artificial Sequence
  chemically synthesized
ccacaagaatctttttcttttt

SEQ ID NO: 1162731 - DNA, 22 bp, Artificial Sequence
  chemically synthesized
gccacaagaatctttttctttt

SEQ ID NO: 1162732 - DNA, 22 bp, Artificial Sequence
  chemically synthesized
ccataatgtatttgccacaaga

SEQ ID NO: 1162733 - DNA, 22 bp, Artificial Sequence
  chemically synthesized
agggttgccataatgtatttgc

SEQ ID NO: 1162734 - DNA, 22 bp, Artificial Sequence
  chemically synthesized
gagggttgccataatgtatttg

SEQ ID NO: 1162735 - DNA, 22 bp, Artificial Sequence
  chemically synthesized
atttgagggttgccataatgta

SEQ ID NO: 1162736 - DNA, 22 bp, Artificial Sequence
  chemically synthesized
ttgtggcaaatacattatggca

SEQ ID NO: 1162737 - DNA, 22 bp, Artificial Sequence
  chemically synthesized
gtggcaaatacattatggcaac

SEQ ID NO: 1162738 - DNA, 22 bp, Artificial Sequence
  chemically synthesized
tggcaaatacattatggcaacc

SEQ ID NO: 1162739 - DNA, 22 bp, Artificial Sequence
  chemically synthesized
atcaggaagattgatttgaggg

SEQ ID NO: 1162740 - DNA, 22 bp, Artificial Sequence
  chemically synthesized
aatcaggaagattgatttgagg

SEQ ID NO: 1162741 - DNA, 22 bp, Artificial Sequence
  chemically synthesized
tggcaaccctcaaatcaatctt

SEQ ID NO: 1162742 - DNA, 22 bp, Artificial Sequence
  chemically synthesized
aaagcatttaatcaggaagatt

SEQ ID NO: 1162743 - DNA, 22 bp, Artificial Sequence
  chemically synthesized
aaaagcatttaatcaggaagat

SEQ ID NO: 1162744 - DNA, 22 bp, Artificial Sequence
  chemically synthesized
taaaagcatttaatcaggaaga

SEQ ID NO: 1162745 - DNA, 22 bp, Artificial Sequence
  chemically synthesized
tttaaaagcatttaatcaggaa

SEQ ID NO: 1162746 - DNA, 22 bp, Artificial Sequence
  chemically synthesized
ctttaaaagcatttaatcagga

SEQ ID NO: 1162747 - DNA, 22 bp, Artificial Sequence
  chemically synthesized
tctttaaaagcatttaatcagg

SEQ ID NO: 1162748 - DNA, 22 bp, Artificial Sequence
  chemically synthesized
aaatcaatcttcctgattaaat

SEQ ID NO: 1162749 - DNA, 22 bp, Artificial Sequence
  chemically synthesized
ttttctttaaaagcatttaatc

SEQ ID NO: 1162750 - DNA, 22 bp, Artificial Sequence
  chemically synthesized
attttctttaaaagcatttaat

SEQ ID NO: 1162751 - DNA, 22 bp, Artificial Sequence
  chemically synthesized
tattttctttaaaagcatttaa

SEQ ID NO: 1162752 - DNA, 22 bp, Artificial Sequence
  chemically synthesized
tttattttctttaaaagcattt

SEQ ID NO: 1162753 - DNA, 22 bp, Artificial Sequence
  chemically synthesized
ctttattttctttaaaagcatt

SEQ ID NO: 1162754 - DNA, 22 bp, Artificial Sequence
  chemically synthesized
cctgattaaatgcttttaaaga

SEQ ID NO: 1162755 - DNA, 22 bp, Artificial Sequence
  chemically synthesized
ctgattaaatgcttttaaagaa

SEQ ID NO: 1162756 - DNA, 22 bp, Artificial Sequence
  chemically synthesized
ccaatttctttattttctttaa

SEQ ID NO: 1162757 - DNA, 22 bp, Artificial Sequence
  chemically synthesized
attaaatgcttttaaagaaaat

SEQ ID NO: 1162758 - DNA, 22 bp, Artificial Sequence
  chemically synthesized
aatgcttttaaagaaaataaag

SEQ ID NO: 1162759 - DNA, 22 bp, Artificial Sequence
  chemically synthesized
atgacatctgccaatttcttta

SEQ ID NO: 1162760 - DNA, 22 bp, Artificial Sequence
  chemically synthesized
ttaaagaaaataaagaaattgg

SEQ ID NO: 1162761 - DNA, 22 bp, Artificial Sequence
  chemically synthesized
taaagaaaataaagaaattggc

SEQ ID NO: 1162762 - DNA, 22 bp, Artificial Sequence
  chemically synthesized
ctgatgacatctgccaatttct

SEQ ID NO: 1162763 - DNA, 22 bp, Artificial Sequence
  chemically synthesized
aaagaaaataaagaaattggca

SEQ ID NO: 1162764 - DNA, 22 bp, Artificial Sequence
  chemically synthesized
aagaaaataaagaaattggcag

SEQ ID NO: 1162765 - DNA, 22 bp, Artificial Sequence
  chemically synthesized
gctcctgatgacatctgccaat

SEQ ID NO: 1162766 - DNA, 22 bp, Artificial Sequence
  chemically synthesized
ggctcctgatgacatctgccaa

SEQ ID NO: 1162767 - DNA, 22 bp, Artificial Sequence
  chemically synthesized
tccttggctcctgatgacatct

SEQ ID NO: 1162768 - DNA, 22 bp, Artificial Sequence
  chemically synthesized
gtccttggctcctgatgacatc

SEQ ID NO: 1162769 - DNA, 22 bp, Artificial Sequence
  chemically synthesized
atatttgtccttggctcctgat

SEQ ID NO: 1162770 - DNA, 22 bp, Artificial Sequence
  chemically synthesized
gcagatgtcatcaggagccaag

SEQ ID NO: 1162771 - DNA, 22 bp, Artificial Sequence
  chemically synthesized
caaacgtgatatattcatattt

SEQ ID NO: 1162772 - DNA, 22 bp, Artificial Sequence
  chemically synthesized
ccaaacgtgatatattcatatt

SEQ ID NO: 1162773 - DNA, 22 bp, Artificial Sequence
  chemically synthesized
aacagtcttccaaacgtgatat

SEQ ID NO: 1162774 - DNA, 22 bp, Artificial Sequence
  chemically synthesized
aaacagtcttccaaacgtgata

SEQ ID NO: 1162775 - DNA, 22 bp, Artificial Sequence
  chemically synthesized
gagataatttaaacagtcttcc

SEQ ID NO: 1162776 - DNA, 22 bp, Artificial Sequence
  chemically synthesized
ctagagataatttaaacagtct

SEQ ID NO: 1162777 - DNA, 22 bp, Artificial Sequence
  chemically synthesized
actagagataatttaaacagtc

SEQ ID NO: 1162778 - DNA, 22 bp, Artificial Sequence
  chemically synthesized
ttactagagataatttaaacag

SEQ ID NO: 1162779 - DNA, 22 bp, Artificial Sequence
  chemically synthesized
ttcttactagagataatttaaa

SEQ ID NO: 1162780 - DNA, 22 bp, Artificial Sequence
  chemically synthesized
ggaagactgtttaaattatctc

SEQ ID NO: 1162781 - DNA, 22 bp, Artificial Sequence
  chemically synthesized
gaagactgtttaaattatctct

SEQ ID NO: 1162782 - DNA, 22 bp, Artificial Sequence
  chemically synthesized
cctattcttactagagataatt

SEQ ID NO: 1162783 - DNA, 22 bp, Artificial Sequence
  chemically synthesized
tttaaattatctctagtaagaa

SEQ ID NO: 1162784 - DNA, 22 bp, Artificial Sequence
  chemically synthesized
aaattatctctagtaagaatag

SEQ ID NO: 1162785 - DNA, 22 bp, Artificial Sequence
  chemically synthesized
aattatctctagtaagaatagg

SEQ ID NO: 1162786 - DNA, 22 bp, Artificial Sequence
  chemically synthesized
agagtgtcaacattacctattc

SEQ ID NO: 1162787 - DNA, 22 bp, Artificial Sequence
  chemically synthesized
cagagtgtcaacattacctatt

SEQ ID NO: 1162788 - DNA, 22 bp, Artificial Sequence
  chemically synthesized
tctctagtaagaataggtaatg

SEQ ID NO: 1162789 - DNA, 22 bp, Artificial Sequence
  chemically synthesized
tagtaagaataggtaatgttga

SEQ ID NO: 1162790 - DNA, 22 bp, Artificial Sequence
  chemically synthesized
gtaagaataggtaatgttgaca

SEQ ID NO: 1162791 - DNA, 22 bp, Artificial Sequence
  chemically synthesized
cacataaatgaatagaatttca

SEQ ID NO: 1162792 - DNA, 22 bp, Artificial Sequence
  chemically synthesized
ccacataaatgaatagaatttc

SEQ ID NO: 1162793 - DNA, 22 bp, Artificial Sequence
  chemically synthesized
tttccacataaatgaatagaat

SEQ ID NO: 1162794 - DNA, 22 bp, Artificial Sequence
  chemically synthesized
acactctgaaattctattcatt

SEQ ID NO: 1162795 - DNA, 22 bp, Artificial Sequence
  chemically synthesized
tatttccacataaatgaataga

SEQ ID NO: 1162796 - DNA, 22 bp, Artificial Sequence
  chemically synthesized
ctatttccacataaatgaatag

SEQ ID NO: 1162797 - DNA, 22 bp, Artificial Sequence
  chemically synthesized
tgaaattctattcatttatgtg

SEQ ID NO: 1162798 - DNA, 22 bp, Artificial Sequence
  chemically synthesized
aaattctattcatttatgtgga

SEQ ID NO: 1162799 - DNA, 22 bp, Artificial Sequence
  chemically synthesized
agagtgagcttctatttccaca

SEQ ID NO: 1162800 - DNA, 22 bp, Artificial Sequence
  chemically synthesized
tattcatttatgtggaaataga

SEQ ID NO: 1162801 - DNA, 22 bp, Artificial Sequence
  chemically synthesized
ttcatttatgtggaaatagaag

SEQ ID NO: 1162802 - DNA, 22 bp, Artificial Sequence
  chemically synthesized
aagttgagagtgagcttctatt

SEQ ID NO: 1162803 - DNA, 22 bp, Artificial Sequence
  chemically synthesized
atttatgtggaaatagaagctc

SEQ ID NO: 1162804 - DNA, 22 bp, Artificial Sequence
  chemically synthesized
gaagttgagagtgagcttctat

SEQ ID NO: 1162805 - DNA, 22 bp, Artificial Sequence
  chemically synthesized
tgaagttgagagtgagcttcta

SEQ ID NO: 1162806 - DNA, 22 bp, Artificial Sequence
  chemically synthesized
ttgaagttgagagtgagcttct

SEQ ID NO: 1162807 - DNA, 22 bp, Artificial Sequence
  chemically synthesized
atgtggaaatagaagctcactc

SEQ ID NO: 1162808 - DNA, 22 bp, Artificial Sequence
  chemically synthesized
tgtggaaatagaagctcactct

SEQ ID NO: 1162809 - DNA, 22 bp, Artificial Sequence
  chemically synthesized
tgtagtggcaaaatttttgaag

SEQ ID NO: 1162810 - DNA, 22 bp, Artificial Sequence
  chemically synthesized
actctcaacttcaaaaattttg

SEQ ID NO: 1162811 - DNA, 22 bp, Artificial Sequence
  chemically synthesized
tcaacttcaaaaattttgccac

SEQ ID NO: 1162812 - DNA, 22 bp, Artificial Sequence
  chemically synthesized
aacttcaaaaattttgccacta

SEQ ID NO: 1162813 - DNA, 22 bp, Artificial Sequence
  chemically synthesized
tgccagatgctatgtagtggca

SEQ ID NO: 1162814 - DNA, 22 bp, Artificial Sequence
  chemically synthesized
caaaaattttgccactacatag

SEQ ID NO: 1162815 - DNA, 22 bp, Artificial Sequence
  chemically synthesized
aaaaattttgccactacatagc

SEQ ID NO: 1162816 - DNA, 22 bp, Artificial Sequence
  chemically synthesized
tgccactacatagcatctggca

SEQ ID NO: 1162817 - DNA, 22 bp, Artificial Sequence
  chemically synthesized
gccactacatagcatctggcac

SEQ ID NO: 1162818 - DNA, 22 bp, Artificial Sequence
  chemically synthesized
ccactacatagcatctggcaca

SEQ ID NO: 1162819 - DNA, 22 bp, Artificial Sequence
  chemically synthesized
catagcatctggcacagtgcct

SEQ ID NO: 1162820 - DNA, 22 bp, Artificial Sequence
  chemically synthesized
agtgtgtagtatgtgccaggca

SEQ ID NO: 1162821 - DNA, 22 bp, Artificial Sequence
  chemically synthesized
ttgagtgtgtagtatgtgccag

SEQ ID NO: 1162822 - DNA, 22 bp, Artificial Sequence
  chemically synthesized
attgagtgtgtagtatgtgcca

SEQ ID NO: 1162823 - DNA, 22 bp, Artificial Sequence
  chemically synthesized
gcacagtgcctggcacatacta

SEQ ID NO: 1162824 - DNA, 22 bp, Artificial Sequence
  chemically synthesized
aagaaatatttattgagtgtgt

SEQ ID NO: 1162825 - DNA, 22 bp, Artificial Sequence
  chemically synthesized
gcacatactacacactcaataa

SEQ ID NO: 1162826 - DNA, 22 bp, Artificial Sequence
  chemically synthesized
tacattgaagaaatatttattg

SEQ ID NO: 1162827 - DNA, 22 bp, Artificial Sequence
  chemically synthesized
atacattgaagaaatatttatt

SEQ ID NO: 1162828 - DNA, 22 bp, Artificial Sequence
  chemically synthesized
cttatacattgaagaaatattt

SEQ ID NO: 1162829 - DNA, 22 bp, Artificial Sequence
  chemically synthesized
cacactcaataaatatttcttc

SEQ ID NO: 1162830 - DNA, 22 bp, Artificial Sequence
  chemically synthesized
tactacttatacattgaagaaa

SEQ ID NO: 1162831 - DNA, 22 bp, Artificial Sequence
  chemically synthesized
aataaatatttcttcaatgtat

SEQ ID NO: 1162832 - DNA, 22 bp, Artificial Sequence
  chemically synthesized
agttatactacttatacattga

SEQ ID NO: 1162833 - DNA, 22 bp, Artificial Sequence
  chemically synthesized
ataattaagttatactacttat

SEQ ID NO: 1162834 - DNA, 22 bp, Artificial Sequence
  chemically synthesized
cttcaatgtataagtagtataa

SEQ ID NO: 1162835 - DNA, 22 bp, Artificial Sequence
  chemically synthesized
ttcataattaagttatactact

SEQ ID NO: 1162836 - DNA, 22 bp, Artificial Sequence
  chemically synthesized
ttcaatgtataagtagtataac

SEQ ID NO: 1162837 - DNA, 22 bp, Artificial Sequence
  chemically synthesized
gttcataattaagttatactac

SEQ ID NO: 1162838 - DNA, 22 bp, Artificial Sequence
  chemically synthesized
caatgtataagtagtataactt

SEQ ID NO: 1162839 - DNA, 22 bp, Artificial Sequence
  chemically synthesized
aatgtataagtagtataactta

SEQ ID NO: 1162840 - DNA, 22 bp, Artificial Sequence
  chemically synthesized
tgtcttgttcataattaagtta

SEQ ID NO: 1162841 - DNA, 22 bp, Artificial Sequence
  chemically synthesized
aattatgaacaagacatagttt

SEQ ID NO: 1162842 - DNA, 22 bp, Artificial Sequence
  chemically synthesized
attatgaacaagacatagtttt

SEQ ID NO: 1162843 - DNA, 22 bp, Artificial Sequence
  chemically synthesized
ccaatcagaaatatcaaaacta

SEQ ID NO: 1162844 - DNA, 22 bp, Artificial Sequence
  chemically synthesized
tgaacaagacatagttttgata

SEQ ID NO: 1162845 - DNA, 22 bp, Artificial Sequence
  chemically synthesized
gtacaaaaattcccaatcagaa

SEQ ID NO: 1162846 - DNA, 22 bp, Artificial Sequence
  chemically synthesized
agtacaaaaattcccaatcaga

SEQ ID NO: 1162847 - DNA, 22 bp, Artificial Sequence
  chemically synthesized
tgatatttctgattgggaattt

SEQ ID NO: 1162848 - DNA, 22 bp, Artificial Sequence
  chemically synthesized
atcttagtacaaaaattcccaa

SEQ ID NO: 1162849 - DNA, 22 bp, Artificial Sequence
  chemically synthesized
gatatttctgattgggaatttt

SEQ ID NO: 1162850 - DNA, 22 bp, Artificial Sequence
  chemically synthesized
aatcttagtacaaaaattccca

SEQ ID NO: 1162851 - DNA, 22 bp, Artificial Sequence
  chemically synthesized
atatttctgattgggaattttt

SEQ ID NO: 1162852 - DNA, 22 bp, Artificial Sequence
  chemically synthesized
taatcttagtacaaaaattccc

SEQ ID NO: 1162853 - DNA, 22 bp, Artificial Sequence
  chemically synthesized
ctgattgggaatttttgtacta

SEQ ID NO: 1162854 - DNA, 22 bp, Artificial Sequence
  chemically synthesized
acattttaatcttagtacaaaa

SEQ ID NO: 1162855 - DNA, 22 bp, Artificial Sequence
  chemically synthesized
tgattgggaatttttgtactaa

SEQ ID NO: 1162856 - DNA, 22 bp, Artificial Sequence
  chemically synthesized
attgggaatttttgtactaaga

SEQ ID NO: 1162857 - DNA, 22 bp, Artificial Sequence
  chemically synthesized
ggaatttttgtactaagattaa

SEQ ID NO: 1162858 - DNA, 22 bp, Artificial Sequence
  chemically synthesized
atagaagttgacattttaatct

SEQ ID NO: 1162859 - DNA, 22 bp, Artificial Sequence
  chemically synthesized
aatagaagttgacattttaatc

SEQ ID NO: 1162860 - DNA, 22 bp, Artificial Sequence
  chemically synthesized
ttgtactaagattaaaatgtca

SEQ ID NO: 1162861 - DNA, 22 bp, Artificial Sequence
  chemically synthesized
tgtactaagattaaaatgtcaa

SEQ ID NO: 1162862 - DNA, 22 bp, Artificial Sequence
  chemically synthesized
gtactaagattaaaatgtcaac

SEQ ID NO: 1162863 - DNA, 22 bp, Artificial Sequence
  chemically synthesized
tactaagattaaaatgtcaact

SEQ ID NO: 1162864 - DNA, 22 bp, Artificial Sequence
  chemically synthesized
agattaaaatgtcaacttctat

SEQ ID NO: 1162865 - DNA, 22 bp, Artificial Sequence
  chemically synthesized
agagagcagatttaatagaagt

SEQ ID NO: 1162866 - DNA, 22 bp, Artificial Sequence
  chemically synthesized
aaatgtcaacttctattaaatc

SEQ ID NO: 1162867 - DNA, 22 bp, Artificial Sequence
  chemically synthesized
tctcagagagcagatttaatag

SEQ ID NO: 1162868 - DNA, 22 bp, Artificial Sequence
  chemically synthesized
atagactatctcagagagcaga

SEQ ID NO: 1162869 - DNA, 22 bp, Artificial Sequence
  chemically synthesized
ctattaaatctgctctctgaga

SEQ ID NO: 1162870 - DNA, 22 bp, Artificial Sequence
  chemically synthesized
tattaaatctgctctctgagat

SEQ ID NO: 1162871 - DNA, 22 bp, Artificial Sequence
  chemically synthesized
aactaatagactatctcagaga

SEQ ID NO: 1162872 - DNA, 22 bp, Artificial Sequence
  chemically synthesized
ttaaatctgctctctgagatag

SEQ ID NO: 1162873 - DNA, 22 bp, Artificial Sequence
  chemically synthesized
aatctgctctctgagatagtct

SEQ ID NO: 1162874 - DNA, 22 bp, Artificial Sequence
  chemically synthesized
aaattaaactaatagactatct

SEQ ID NO: 1162875 - DNA, 22 bp, Artificial Sequence
  chemically synthesized
ctctctgagatagtctattagt

SEQ ID NO: 1162876 - DNA, 22 bp, Artificial Sequence
  chemically synthesized
tctgagatagtctattagttta

SEQ ID NO: 1162877 - DNA, 22 bp, Artificial Sequence
  chemically synthesized
gaacaattcaaattaaactaat

SEQ ID NO: 1162878 - DNA, 22 bp, Artificial Sequence
  chemically synthesized
tgagatagtctattagtttaat

SEQ ID NO: 1162879 - DNA, 22 bp, Artificial Sequence
  chemically synthesized
agatagtctattagtttaattt

SEQ ID NO: 1162880 - DNA, 22 bp, Artificial Sequence
  chemically synthesized
ttagtttaatttgaattgttcc

SEQ ID NO: 1162881 - DNA, 22 bp, Artificial Sequence
  chemically synthesized
gtttaatttgaattgttccaac

SEQ ID NO: 1162882 - DNA, 22 bp, Artificial Sequence
  chemically synthesized
ggtaacagccaggggttggaac

SEQ ID NO: 1162883 - DNA, 22 bp, Artificial Sequence
  chemically synthesized
aatttgaattgttccaacccct

SEQ ID NO: 1162884 - DNA, 22 bp, Artificial Sequence
  chemically synthesized
atttgaattgttccaacccctg

SEQ ID NO: 1162885 - DNA, 22 bp, Artificial Sequence
  chemically synthesized
gaactgggtaacagccaggggt

SEQ ID NO: 1162886 - DNA, 22 bp, Artificial Sequence
  chemically synthesized
gaattgttccaacccctggctg

SEQ ID NO: 1162887 - DNA, 22 bp, Artificial Sequence
  chemically synthesized
ggaactgggtaacagccagggg

SEQ ID NO: 1162888 - DNA, 22 bp, Artificial Sequence
  chemically synthesized
aattgttccaacccctggctgt

SEQ ID NO: 1162889 - DNA, 22 bp, Artificial Sequence
  chemically synthesized
tggaactgggtaacagccaggg

SEQ ID NO: 1162890 - DNA, 22 bp, Artificial Sequence
  chemically synthesized
ttccaacccctggctgttaccc

SEQ ID NO: 1162891 - DNA, 22 bp, Artificial Sequence
  chemically synthesized
caacccctggctgttacccagt

SEQ ID NO: 1162892 - DNA, 22 bp, Artificial Sequence
  chemically synthesized
gctgttacccagttccaaagtc

SEQ ID NO: 1162893 - DNA, 22 bp, Artificial Sequence
  chemically synthesized
ttacccagttccaaagtcactt

SEQ ID NO: 1162894 - DNA, 22 bp, Artificial Sequence
  chemically synthesized
cccagttccaaagtcacttcca

SEQ ID NO: 1162895 - DNA, 22 bp, Artificial Sequence
  chemically synthesized
taaagatacccgaacacgtgga

SEQ ID NO: 1162896 - DNA, 22 bp, Artificial Sequence
  chemically synthesized
caaagtcacttccacgtgttcg

SEQ ID NO: 1162897 - DNA, 22 bp, Artificial Sequence
  chemically synthesized
ctataaagatacccgaacacgt

SEQ ID NO: 1162898 - DNA, 22 bp, Artificial Sequence
  chemically synthesized
ccacgtgttcgggtatctttat

SEQ ID NO: 1162899 - DNA, 22 bp, Artificial Sequence
  chemically synthesized
cacgtgttcgggtatctttata

SEQ ID NO: 1162900 - DNA, 22 bp, Artificial Sequence
  chemically synthesized
gggtatctttatagcagcaccc

SEQ ID NO: 1162901 - DNA, 22 bp, Artificial Sequence
  chemically synthesized
gtaccgcagagagtggggtgct

SEQ ID NO: 1162902 - DNA, 22 bp, Artificial Sequence
  chemically synthesized
tatagcagcaccccactctctg

SEQ ID NO: 1162903 - DNA, 22 bp, Artificial Sequence
  chemically synthesized
atagcagcaccccactctctgc

SEQ ID NO: 1162904 - DNA, 22 bp, Artificial Sequence
  chemically synthesized
tagcagcaccccactctctgcg

SEQ ID NO: 1162905 - DNA, 22 bp, Artificial Sequence
  chemically synthesized
gtacagtacattggtaccgcag

SEQ ID NO: 1162906 - DNA, 22 bp, Artificial Sequence
  chemically synthesized
tctgcggtaccaatgtactgta

SEQ ID NO: 1162907 - DNA, 22 bp, Artificial Sequence
  chemically synthesized
tgcggtaccaatgtactgtact

SEQ ID NO: 1162908 - DNA, 22 bp, Artificial Sequence
  chemically synthesized
cggtaccaatgtactgtactag

SEQ ID NO: 1162909 - DNA, 22 bp, Artificial Sequence
  chemically synthesized
gcagcgtgagaacagactagta

SEQ ID NO: 1162910 - DNA, 22 bp, Artificial Sequence
  chemically synthesized
attagcagcgtgagaacagact

SEQ ID NO: 1162911 - DNA, 22 bp, Artificial Sequence
  chemically synthesized
aattagcagcgtgagaacagac

SEQ ID NO: 1162912 - DNA, 22 bp, Artificial Sequence
  chemically synthesized
taattagcagcgtgagaacaga

SEQ ID NO: 1162913 - DNA, 22 bp, Artificial Sequence
  chemically synthesized
tactagtctgttctcacgctgc

SEQ ID NO: 1162914 - DNA, 22 bp, Artificial Sequence
  chemically synthesized
tgtctttaattagcagcgtgag

SEQ ID NO: 1162915 - DNA, 22 bp, Artificial Sequence
  chemically synthesized
ttatgtctttaattagcagcgt

SEQ ID NO: 1162916 - DNA, 22 bp, Artificial Sequence
  chemically synthesized
gtctgttctcacgctgctaatt

SEQ ID NO: 1162917 - DNA, 22 bp, Artificial Sequence
  chemically synthesized
tattatgtctttaattagcagc

SEQ ID NO: 1162918 - DNA, 22 bp, Artificial Sequence
  chemically synthesized
ttctcacgctgctaattaaaga

SEQ ID NO: 1162919 - DNA, 22 bp, Artificial Sequence
  chemically synthesized
tcacgctgctaattaaagacat

SEQ ID NO: 1162920 - DNA, 22 bp, Artificial Sequence
  chemically synthesized
tccagtctctattatgtcttta

SEQ ID NO: 1162921 - DNA, 22 bp, Artificial Sequence
  chemically synthesized
acgctgctaattaaagacataa

SEQ ID NO: 1162922 - DNA, 22 bp, Artificial Sequence
  chemically synthesized
ctaattaaagacataatagaga

SEQ ID NO: 1162923 - DNA, 22 bp, Artificial Sequence
  chemically synthesized
taaattatccagtctctattat

SEQ ID NO: 1162924 - DNA, 22 bp, Artificial Sequence
  chemically synthesized
ataaattatccagtctctatta

SEQ ID NO: 1162925 - DNA, 22 bp, Artificial Sequence
  chemically synthesized
tataaattatccagtctctatt

SEQ ID NO: 1162926 - DNA, 22 bp, Artificial Sequence
  chemically synthesized
attaaagacataatagagactg

SEQ ID NO: 1162927 - DNA, 22 bp, Artificial Sequence
  chemically synthesized
tttataaattatccagtctcta

SEQ ID NO: 1162928 - DNA, 22 bp, Artificial Sequence
  chemically synthesized
ctttataaattatccagtctct

SEQ ID NO: 1162929 - DNA, 22 bp, Artificial Sequence
  chemically synthesized
tctttataaattatccagtctc

SEQ ID NO: 1162930 - DNA, 22 bp, Artificial Sequence
  chemically synthesized
aagacataatagagactggata

SEQ ID NO: 1162931 - DNA, 22 bp, Artificial Sequence
  chemically synthesized
ttttctttataaattatccagt

SEQ ID NO: 1162932 - DNA, 22 bp, Artificial Sequence
  chemically synthesized
gttttctttataaattatccag

SEQ ID NO: 1162933 - DNA, 22 bp, Artificial Sequence
  chemically synthesized
aacttgttttctttataaatta

SEQ ID NO: 1162934 - DNA, 22 bp, Artificial Sequence
  chemically synthesized
gataatttataaagaaaacaag

SEQ ID NO: 1162935 - DNA, 22 bp, Artificial Sequence
  chemically synthesized
tgagtcaattaaacttgttttc

SEQ ID NO: 1162936 - DNA, 22 bp, Artificial Sequence
  chemically synthesized
ataaagaaaacaagtttaattg

SEQ ID NO: 1162937 - DNA, 22 bp, Artificial Sequence
  chemically synthesized
taaagaaaacaagtttaattga

SEQ ID NO: 1162938 - DNA, 22 bp, Artificial Sequence
  chemically synthesized
cccagccatgccgaactgtgag

SEQ ID NO: 1162939 - DNA, 22 bp, Artificial Sequence
  chemically synthesized
aattgactcacagttcggcatg

SEQ ID NO: 1162940 - DNA, 22 bp, Artificial Sequence
  chemically synthesized
attgactcacagttcggcatgg

SEQ ID NO: 1162941 - DNA, 22 bp, Artificial Sequence
  chemically synthesized
aggcctccccagccatgccgaa

SEQ ID NO: 1162942 - DNA, 22 bp, Artificial Sequence
  chemically synthesized
tgaggcctccccagccatgccg

SEQ ID NO: 1162943 - DNA, 22 bp, Artificial Sequence
  chemically synthesized
ctgaggcctccccagccatgcc

SEQ ID NO: 1162944 - DNA, 22 bp, Artificial Sequence
  chemically synthesized
actcacagttcggcatggctgg

SEQ ID NO: 1162945 - DNA, 22 bp, Artificial Sequence
  chemically synthesized
tctgaggcctccccagccatgc

SEQ ID NO: 1162946 - DNA, 22 bp, Artificial Sequence
  chemically synthesized
ttctgaggcctccccagccatg

SEQ ID NO: 1162947 - DNA, 22 bp, Artificial Sequence
  chemically synthesized
tttctgaggcctccccagccat

SEQ ID NO: 1162948 - DNA, 22 bp, Artificial Sequence
  chemically synthesized
acagttcggcatggctggggag

SEQ ID NO: 1162949 - DNA, 22 bp, Artificial Sequence
  chemically synthesized
ggcatggctggggaggcctcag

SEQ ID NO: 1162950 - DNA, 22 bp, Artificial Sequence
  chemically synthesized
catcatgattttttctgaggcc

SEQ ID NO: 1162951 - DNA, 22 bp, Artificial Sequence
  chemically synthesized
ccatcatgattttttctgaggc

SEQ ID NO: 1162952 - DNA, 22 bp, Artificial Sequence
  chemically synthesized
cccttccatcatgattttttct

SEQ ID NO: 1162953 - DNA, 22 bp, Artificial Sequence
  chemically synthesized
ccccttccatcatgattttttc

SEQ ID NO: 1162954 - DNA, 22 bp, Artificial Sequence
  chemically synthesized
gggaggcctcagaaaaaatcat

SEQ ID NO: 1162955 - DNA, 22 bp, Artificial Sequence
  chemically synthesized
cttccccttccatcatgatttt

SEQ ID NO: 1162956 - DNA, 22 bp, Artificial Sequence
  chemically synthesized
gcttccccttccatcatgattt

SEQ ID NO: 1162957 - DNA, 22 bp, Artificial Sequence
  chemically synthesized
agaaaaaatcatgatggaaggg

SEQ ID NO: 1162958 - DNA, 22 bp, Artificial Sequence
  chemically synthesized
ccatgtgaagaaggacatgttt

SEQ ID NO: 1162959 - DNA, 22 bp, Artificial Sequence
  chemically synthesized
ctgccatgtgaagaaggacatg

SEQ ID NO: 1162960 - DNA, 22 bp, Artificial Sequence
  chemically synthesized
ctgctgccatgtgaagaaggac

SEQ ID NO: 1162961 - DNA, 22 bp, Artificial Sequence
  chemically synthesized
cctgctgccatgtgaagaagga

SEQ ID NO: 1162962 - DNA, 22 bp, Artificial Sequence
  chemically synthesized
ttcctgctgccatgtgaagaag

SEQ ID NO: 1162963 - DNA, 22 bp, Artificial Sequence
  chemically synthesized
cttcctgctgccatgtgaagaa

SEQ ID NO: 1162964 - DNA, 22 bp, Artificial Sequence
  chemically synthesized
gcccttcttcctgctgccatgt

SEQ ID NO: 1162965 - DNA, 22 bp, Artificial Sequence
  chemically synthesized
ggcccttcttcctgctgccatg

SEQ ID NO: 1162966 - DNA, 22 bp, Artificial Sequence
  chemically synthesized
cttggcccttcttcctgctgcc

SEQ ID NO: 1162967 - DNA, 22 bp, Artificial Sequence
  chemically synthesized
gcttggcccttcttcctgctgc

SEQ ID NO: 1162968 - DNA, 22 bp, Artificial Sequence
  chemically synthesized
tgcttggcccttcttcctgctg

SEQ ID NO: 1162969 - DNA, 22 bp, Artificial Sequence
  chemically synthesized
ttgcttggcccttcttcctgct

SEQ ID NO: 1162970 - DNA, 22 bp, Artificial Sequence
  chemically synthesized
cttcacatggcagcaggaagaa

SEQ ID NO: 1162971 - DNA, 22 bp, Artificial Sequence
  chemically synthesized
ttcacatggcagcaggaagaag

SEQ ID NO: 1162972 - DNA, 22 bp, Artificial Sequence
  chemically synthesized
cacatggcagcaggaagaaggg

SEQ ID NO: 1162973 - DNA, 22 bp, Artificial Sequence
  chemically synthesized
acatggcagcaggaagaagggc

SEQ ID NO: 1162974 - DNA, 22 bp, Artificial Sequence
  chemically synthesized
cccttttgcttggcccttcttc

SEQ ID NO: 1162975 - DNA, 22 bp, Artificial Sequence
  chemically synthesized
ccccttttgcttggcccttctt

SEQ ID NO: 1162976 - DNA, 22 bp, Artificial Sequence
  chemically synthesized
tccccttttgcttggcccttct

SEQ ID NO: 1162977 - DNA, 22 bp, Artificial Sequence
  chemically synthesized
taaggggcctttccccttttgc

SEQ ID NO: 1162978 - DNA, 22 bp, Artificial Sequence
  chemically synthesized
ataaggggcctttccccttttg

SEQ ID NO: 1162979 - DNA, 22 bp, Artificial Sequence
  chemically synthesized
tataaggggcctttcccctttt

SEQ ID NO: 1162980 - DNA, 22 bp, Artificial Sequence
  chemically synthesized
atggttttataaggggcctttc

SEQ ID NO: 1162981 - DNA, 22 bp, Artificial Sequence
  chemically synthesized
acaagatctgatggttttataa

SEQ ID NO: 1162982 - DNA, 22 bp, Artificial Sequence
  chemically synthesized
tcacaagatctgatggttttat

SEQ ID NO: 1162983 - DNA, 22 bp, Artificial Sequence
  chemically synthesized
ataaaaccatcagatcttgtga

SEQ ID NO: 1162984 - DNA, 22 bp, Artificial Sequence
  chemically synthesized
taaaaccatcagatcttgtgag

SEQ ID NO: 1162985 - DNA, 22 bp, Artificial Sequence
  chemically synthesized
atgatagtgagtgagttctcac

SEQ ID NO: 1162986 - DNA, 22 bp, Artificial Sequence
  chemically synthesized
tcatgatagtgagtgagttctc

SEQ ID NO: 1162987 - DNA, 22 bp, Artificial Sequence
  chemically synthesized
ttctcatgatagtgagtgagtt

SEQ ID NO: 1162988 - DNA, 22 bp, Artificial Sequence
  chemically synthesized
atgctgttctcatgatagtgag

SEQ ID NO: 1162989 - DNA, 22 bp, Artificial Sequence
  chemically synthesized
gtgagaactcactcactatcat

SEQ ID NO: 1162990 - DNA, 22 bp, Artificial Sequence
  chemically synthesized
tgagaactcactcactatcatg

SEQ ID NO: 1162991 - DNA, 22 bp, Artificial Sequence
  chemically synthesized
actcactatcatgagaacagca

SEQ ID NO: 1162992 - DNA, 22 bp, Artificial Sequence
  chemically synthesized
actatcatgagaacagcatgag

SEQ ID NO: 1162993 - DNA, 22 bp, Artificial Sequence
  chemically synthesized
tcatgagaacagcatgagggtt

SEQ ID NO: 1162994 - DNA, 22 bp, Artificial Sequence
  chemically synthesized
aatcatgggagtgtaaccctca

SEQ ID NO: 1162995 - DNA, 22 bp, Artificial Sequence
  chemically synthesized
gtggaaggtaattgaatcatgg

SEQ ID NO: 1162996 - DNA, 22 bp, Artificial Sequence
  chemically synthesized
cactcccatgattcaattacct

SEQ ID NO: 1162997 - DNA, 22 bp, Artificial Sequence
  chemically synthesized
ccatgattcaattaccttccac

SEQ ID NO: 1162998 - DNA, 22 bp, Artificial Sequence
  chemically synthesized
tgggagggacctggtggaaggt

SEQ ID NO: 1162999 - DNA, 22 bp, Artificial Sequence
  chemically synthesized
aattaccttccaccaggtccct

SEQ ID NO: 1163000 - DNA, 22 bp, Artificial Sequence
  chemically synthesized
ccttccaccaggtccctcccac

SEQ ID NO: 1163001 - DNA, 22 bp, Artificial Sequence
  chemically synthesized
ccaccaggtccctcccacaaca

SEQ ID NO: 1163002 - DNA, 22 bp, Artificial Sequence
  chemically synthesized
ataatccccatgtgttgtggga

SEQ ID NO: 1163003 - DNA, 22 bp, Artificial Sequence
  chemically synthesized
caccaggtccctcccacaacac

SEQ ID NO: 1163004 - DNA, 22 bp, Artificial Sequence
  chemically synthesized
tcataatccccatgtgttgtgg

SEQ ID NO: 1163005 - DNA, 22 bp, Artificial Sequence
  chemically synthesized
tagttctcataatccccatgtg

SEQ ID NO: 1163006 - DNA, 22 bp, Artificial Sequence
  chemically synthesized
aattgtagttctcataatcccc

SEQ ID NO: 1163007 - DNA, 22 bp, Artificial Sequence
  chemically synthesized
ccacaacacatggggattatga

SEQ ID NO: 1163008 - DNA, 22 bp, Artificial Sequence
  chemically synthesized
gaattgtagttctcataatccc

SEQ ID NO: 1163009 - DNA, 22 bp, Artificial Sequence
  chemically synthesized
atcttgaattgtagttctcata

SEQ ID NO: 1163010 - DNA, 22 bp, Artificial Sequence
  chemically synthesized
gctcatcttgaattgtagttct

SEQ ID NO: 1163011 - DNA, 22 bp, Artificial Sequence
  chemically synthesized
ggctcatcttgaattgtagttc

SEQ ID NO: 1163012 - DNA, 22 bp, Artificial Sequence
  chemically synthesized
tgagaactacaattcaagatga

SEQ ID NO: 1163013 - DNA, 22 bp, Artificial Sequence
  chemically synthesized
atatggtttggctcatcttgaa

SEQ ID NO: 1163014 - DNA, 22 bp, Artificial Sequence
  chemically synthesized
caattcaagatgagccaaacca

SEQ ID NO: 1163015 - DNA, 22 bp, Artificial Sequence
  chemically synthesized
aagatgagccaaaccatatcag

SEQ ID NO: 1163016 - DNA, 22 bp, Artificial Sequence
  chemically synthesized
acaaagataaataatgctgata

SEQ ID NO: 1163017 - DNA, 22 bp, Artificial Sequence
  chemically synthesized
tcacaaagataaataatgctga

SEQ ID NO: 1163018 - DNA, 22 bp, Artificial Sequence
  chemically synthesized
ctcacaaagataaataatgctg

SEQ ID NO: 1163019 - DNA, 22 bp, Artificial Sequence
  chemically synthesized
tctcacaaagataaataatgct

SEQ ID NO: 1163020 - DNA, 22 bp, Artificial Sequence
  chemically synthesized
aaaaacaatgctttctcacaaa

SEQ ID NO: 1163021 - DNA, 22 bp, Artificial Sequence
  chemically synthesized
caaaaacaatgctttctcacaa

SEQ ID NO: 1163022 - DNA, 22 bp, Artificial Sequence
  chemically synthesized
tttatctttgtgagaaagcatt

SEQ ID NO: 1163023 - DNA, 22 bp, Artificial Sequence
  chemically synthesized
atctttgtgagaaagcattgtt

SEQ ID NO: 1163024 - DNA, 22 bp, Artificial Sequence
  chemically synthesized
tctttgtgagaaagcattgttt

SEQ ID NO: 1163025 - DNA, 22 bp, Artificial Sequence
  chemically synthesized
tgtgagaaagcattgtttttga

SEQ ID NO: 1163026 - DNA, 22 bp, Artificial Sequence
  chemically synthesized
gtgagaaagcattgtttttgaa

SEQ ID NO: 1163027 - DNA, 22 bp, Artificial Sequence
  chemically synthesized
tgagaaagcattgtttttgaag

SEQ ID NO: 1163028 - DNA, 22 bp, Artificial Sequence
  chemically synthesized
acagaaatgagagagccgtatc

SEQ ID NO: 1163029 - DNA, 22 bp, Artificial Sequence
  chemically synthesized
tttttgaagatacggctctctc

SEQ ID NO: 1163030 - DNA, 22 bp, Artificial Sequence
  chemically synthesized
gaattcacagaaatgagagagc

SEQ ID NO: 1163031 - DNA, 22 bp, Artificial Sequence
  chemically synthesized
ttgaagatacggctctctcatt

SEQ ID NO: 1163032 - DNA, 22 bp, Artificial Sequence
  chemically synthesized
tgaagatacggctctctcattt

SEQ ID NO: 1163033 - DNA, 22 bp, Artificial Sequence
  chemically synthesized
tggaattcacagaaatgagaga

SEQ ID NO: 1163034 - DNA, 22 bp, Artificial Sequence
  chemically synthesized
gaagatacggctctctcatttc

SEQ ID NO: 1163035 - DNA, 22 bp, Artificial Sequence
  chemically synthesized
ctggaattcacagaaatgagag

SEQ ID NO: 1163036 - DNA, 22 bp, Artificial Sequence
  chemically synthesized
aagatacggctctctcatttct

SEQ ID NO: 1163037 - DNA, 22 bp, Artificial Sequence
  chemically synthesized
aatttctggaattcacagaaat

SEQ ID NO: 1163038 - DNA, 22 bp, Artificial Sequence
  chemically synthesized
tctcatttctgtgaattccaga

SEQ ID NO: 1163039 - DNA, 22 bp, Artificial Sequence
  chemically synthesized
tcatttctgtgaattccagaaa

SEQ ID NO: 1163040 - DNA, 22 bp, Artificial Sequence
  chemically synthesized
caggaaagctaaatttctggaa

SEQ ID NO: 1163041 - DNA, 22 bp, Artificial Sequence
  chemically synthesized
atttctgtgaattccagaaatt

SEQ ID NO: 1163042 - DNA, 22 bp, Artificial Sequence
  chemically synthesized
ctgtgaattccagaaatttagc

SEQ ID NO: 1163043 - DNA, 22 bp, Artificial Sequence
  chemically synthesized
aattacaggaaagctaaatttc

SEQ ID NO: 1163044 - DNA, 22 bp, Artificial Sequence
  chemically synthesized
tgtgaattccagaaatttagct

SEQ ID NO: 1163045 - DNA, 22 bp, Artificial Sequence
  chemically synthesized
aaattacaggaaagctaaattt

SEQ ID NO: 1163046 - DNA, 22 bp, Artificial Sequence
  chemically synthesized
tgaattccagaaatttagcttt

SEQ ID NO: 1163047 - DNA, 22 bp, Artificial Sequence
  chemically synthesized
atagtttaaattacaggaaagc

SEQ ID NO: 1163048 - DNA, 22 bp, Artificial Sequence
  chemically synthesized
cagaaatttagctttcctgtaa

SEQ ID NO: 1163049 - DNA, 22 bp, Artificial Sequence
  chemically synthesized
agctttcctgtaatttaaacta

SEQ ID NO: 1163050 - DNA, 22 bp, Artificial Sequence
  chemically synthesized
gctttcctgtaatttaaactat

SEQ ID NO: 1163051 - DNA, 22 bp, Artificial Sequence
  chemically synthesized
tcctgtaatttaaactatgagt

SEQ ID NO: 1163052 - DNA, 22 bp, Artificial Sequence
  chemically synthesized
cctgtaatttaaactatgagtc

SEQ ID NO: 1163053 - DNA, 22 bp, Artificial Sequence
  chemically synthesized
ctgtaatttaaactatgagtca

SEQ ID NO: 1163054 - DNA, 22 bp, Artificial Sequence
  chemically synthesized
taatttaaactatgagtcacat

SEQ ID NO: 1163055 - DNA, 22 bp, Artificial Sequence
  chemically synthesized
ataatacaatgcatgtgactca

SEQ ID NO: 1163056 - DNA, 22 bp, Artificial Sequence
  chemically synthesized
tactaataatacaatgcatgtg

SEQ ID NO: 1163057 - DNA, 22 bp, Artificial Sequence
  chemically synthesized
aaactatgagtcacatgcattg

SEQ ID NO: 1163058 - DNA, 22 bp, Artificial Sequence
  chemically synthesized
gtactaataatacaatgcatgt

SEQ ID NO: 1163059 - DNA, 22 bp, Artificial Sequence
  chemically synthesized
aactatgagtcacatgcattgt

SEQ ID NO: 1163060 - DNA, 22 bp, Artificial Sequence
  chemically synthesized
ttgtactaataatacaatgcat

SEQ ID NO: 1163061 - DNA, 22 bp, Artificial Sequence
  chemically synthesized
tgagtcacatgcattgtattat

SEQ ID NO: 1163062 - DNA, 22 bp, Artificial Sequence
  chemically synthesized
aatgtggacatctcttgtacta

SEQ ID NO: 1163063 - DNA, 22 bp, Artificial Sequence
  chemically synthesized
tattattagtacaagagatgtc

SEQ ID NO: 1163064 - DNA, 22 bp, Artificial Sequence
  chemically synthesized
ttagtacaagagatgtccacat

SEQ ID NO: 1163065 - DNA, 22 bp, Artificial Sequence
  chemically synthesized
gtacaagagatgtccacattta

SEQ ID NO: 1163066 - DNA, 22 bp, Artificial Sequence
  chemically synthesized
aaaatgtgataatgcagctaaa

SEQ ID NO: 1163067 - DNA, 22 bp, Artificial Sequence
  chemically synthesized
tcaataattaaaaatgtgataa

SEQ ID NO: 1163068 - DNA, 22 bp, Artificial Sequence
  chemically synthesized
tgtcaataattaaaaatgtgat

SEQ ID NO: 1163069 - DNA, 22 bp, Artificial Sequence
  chemically synthesized
ctgtcaataattaaaaatgtga

SEQ ID NO: 1163070 - DNA, 22 bp, Artificial Sequence
  chemically synthesized
tctgtcaataattaaaaatgtg

SEQ ID NO: 1163071 - DNA, 22 bp, Artificial Sequence
  chemically synthesized
agctgcattatcacatttttaa

SEQ ID NO: 1163072 - DNA, 22 bp, Artificial Sequence
  chemically synthesized
ttctgtcaataattaaaaatgt

SEQ ID NO: 1163073 - DNA, 22 bp, Artificial Sequence
  chemically synthesized
gctgcattatcacatttttaat

SEQ ID NO: 1163074 - DNA, 22 bp, Artificial Sequence
  chemically synthesized
cattatcacatttttaattatt

SEQ ID NO: 1163075 - DNA, 22 bp, Artificial Sequence
  chemically synthesized
tcacatttttaattattgacag

SEQ ID NO: 1163076 - DNA, 22 bp, Artificial Sequence
  chemically synthesized
tggtcataataatttttctgtc

SEQ ID NO: 1163077 - DNA, 22 bp, Artificial Sequence
  chemically synthesized
ttaattattgacagaaaaatta

SEQ ID NO: 1163078 - DNA, 22 bp, Artificial Sequence
  chemically synthesized
taattattgacagaaaaattat

SEQ ID NO: 1163079 - DNA, 22 bp, Artificial Sequence
  chemically synthesized
aattattgacagaaaaattatt

SEQ ID NO: 1163080 - DNA, 22 bp, Artificial Sequence
  chemically synthesized
attattgacagaaaaattatta

SEQ ID NO: 1163081 - DNA, 22 bp, Artificial Sequence
  chemically synthesized
ttgacagaaaaattattatgac

SEQ ID NO: 1163082 - DNA, 22 bp, Artificial Sequence
  chemically synthesized
cacatggattatggtcataata

SEQ ID NO: 1163083 - DNA, 22 bp, Artificial Sequence
  chemically synthesized
acagaaaaattattatgaccat

SEQ ID NO: 1163084 - DNA, 22 bp, Artificial Sequence
  chemically synthesized
ggttgcacatggattatggtca

SEQ ID NO: 1163085 - DNA, 22 bp, Artificial Sequence
  chemically synthesized
ggttaggttgcacatggattat

SEQ ID NO: 1163086 - DNA, 22 bp, Artificial Sequence
  chemically synthesized
ttatgaccataatccatgtgca

SEQ ID NO: 1163087 - DNA, 22 bp, Artificial Sequence
  chemically synthesized
tgaccataatccatgtgcaacc

SEQ ID NO: 1163088 - DNA, 22 bp, Artificial Sequence
  chemically synthesized
tagatgataacgtgacattcgg

SEQ ID NO: 1163089 - DNA, 22 bp, Artificial Sequence
  chemically synthesized
atagatgataacgtgacattcg

SEQ ID NO: 1163090 - DNA, 22 bp, Artificial Sequence
  chemically synthesized
tttatagatgataacgtgacat

SEQ ID NO: 1163091 - DNA, 22 bp, Artificial Sequence
  chemically synthesized
accgaatgtcacgttatcatct

SEQ ID NO: 1163092 - DNA, 22 bp, Artificial Sequence
  chemically synthesized
ataagaagtaggaattatttat

SEQ ID NO: 1163093 - DNA, 22 bp, Artificial Sequence
  chemically synthesized
gactaataagaagtaggaatta

SEQ ID NO: 1163094 - DNA, 22 bp, Artificial Sequence
  chemically synthesized
tcatctataaataattcctact

SEQ ID NO: 1163095 - DNA, 22 bp, Artificial Sequence
  chemically synthesized
ttggactaataagaagtaggaa

SEQ ID NO: 1163096 - DNA, 22 bp, Artificial Sequence
  chemically synthesized
taaataattcctacttcttatt

SEQ ID NO: 1163097 - DNA, 22 bp, Artificial Sequence
  chemically synthesized
agctattggactaataagaagt

SEQ ID NO: 1163098 - DNA, 22 bp, Artificial Sequence
  chemically synthesized
ataattaagctattggactaat

SEQ ID NO: 1163099 - DNA, 22 bp, Artificial Sequence
  chemically synthesized
ctacttcttattagtccaatag

SEQ ID NO: 1163100 - DNA, 22 bp, Artificial Sequence
  chemically synthesized
cttcttattagtccaatagctt

SEQ ID NO: 1163101 - DNA, 22 bp, Artificial Sequence
  chemically synthesized
cttattagtccaatagcttaat

SEQ ID NO: 1163102 - DNA, 22 bp, Artificial Sequence
  chemically synthesized
ttattagtccaatagcttaatt

SEQ ID NO: 1163103 - DNA, 22 bp, Artificial Sequence
  chemically synthesized
atgagtattgataattaagcta

SEQ ID NO: 1163104 - DNA, 22 bp, Artificial Sequence
  chemically synthesized
attagtccaatagcttaattat

SEQ ID NO: 1163105 - DNA, 22 bp, Artificial Sequence
  chemically synthesized
ttagtccaatagcttaattatc

SEQ ID NO: 1163106 - DNA, 22 bp, Artificial Sequence
  chemically synthesized
gtccaatagcttaattatcaat

SEQ ID NO: 1163107 - DNA, 22 bp, Artificial Sequence
  chemically synthesized
aattatcaatactcatcaacac

SEQ ID NO: 1163108 - DNA, 22 bp, Artificial Sequence
  chemically synthesized
attatcaatactcatcaacact

SEQ ID NO: 1163109 - DNA, 22 bp, Artificial Sequence
  chemically synthesized
tcaatactcatcaacactcata

SEQ ID NO: 1163110 - DNA, 22 bp, Artificial Sequence
  chemically synthesized
atcaacactcatatattgtctg

SEQ ID NO: 1163111 - DNA, 22 bp, Artificial Sequence
  chemically synthesized
gtgcaataatatataacagaca

SEQ ID NO: 1163112 - DNA, 22 bp, Artificial Sequence
  chemically synthesized
tggtgcaataatatataacaga

SEQ ID NO: 1163113 - DNA, 22 bp, Artificial Sequence
  chemically synthesized
atatattgtctgttatatatta

SEQ ID NO: 1163114 - DNA, 22 bp, Artificial Sequence
  chemically synthesized
tctgttatatattattgcacca

SEQ ID NO: 1163115 - DNA, 22 bp, Artificial Sequence
  chemically synthesized
ttatatattattgcaccagaat

SEQ ID NO: 1163116 - DNA, 22 bp, Artificial Sequence
  chemically synthesized
agcagtagcaagattctggtgc

SEQ ID NO: 1163117 - DNA, 22 bp, Artificial Sequence
  chemically synthesized
tatattattgcaccagaatctt

SEQ ID NO: 1163118 - DNA, 22 bp, Artificial Sequence
  chemically synthesized
ttgcaccagaatcttgctactg

SEQ ID NO: 1163119 - DNA, 22 bp, Artificial Sequence
  chemically synthesized
caccagaatcttgctactgctt

SEQ ID NO: 1163120 - DNA, 22 bp, Artificial Sequence
  chemically synthesized
atatcataccccatgggtgatt

SEQ ID NO: 1163121 - DNA, 22 bp, Artificial Sequence
  chemically synthesized
gctactgcttaatcacccatgg

SEQ ID NO: 1163122 - DNA, 22 bp, Artificial Sequence
  chemically synthesized
ctactgcttaatcacccatggg

SEQ ID NO: 1163123 - DNA, 22 bp, Artificial Sequence
  chemically synthesized
ctgcttaatcacccatggggta

SEQ ID NO: 1163124 - DNA, 22 bp, Artificial Sequence
  chemically synthesized
atatgttgatatcataccccat

SEQ ID NO: 1163125 - DNA, 22 bp, Artificial Sequence
  chemically synthesized
cttaatcacccatggggtatga

SEQ ID NO: 1163126 - DNA, 22 bp, Artificial Sequence
  chemically synthesized
aatcacccatggggtatgatat

SEQ ID NO: 1163127 - DNA, 22 bp, Artificial Sequence
  chemically synthesized
atcacccatggggtatgatatc

SEQ ID NO: 1163128 - DNA, 22 bp, Artificial Sequence
  chemically synthesized
agtcctcatatgttgatatcat

SEQ ID NO: 1163129 - DNA, 22 bp, Artificial Sequence
  chemically synthesized
attcagtcctcatatgttgata

SEQ ID NO: 1163130 - DNA, 22 bp, Artificial Sequence
  chemically synthesized
cattcagtcctcatatgttgat

SEQ ID NO: 1163131 - DNA, 22 bp, Artificial Sequence
  chemically synthesized
atatttcattcagtcctcatat

SEQ ID NO: 1163132 - DNA, 22 bp, Artificial Sequence
  chemically synthesized
aaaatggtgctgatatttcatt

SEQ ID NO: 1163133 - DNA, 22 bp, Artificial Sequence
  chemically synthesized
taaaaatggtgctgatatttca

SEQ ID NO: 1163134 - DNA, 22 bp, Artificial Sequence
  chemically synthesized
aggagctctaaaaatggtgctg

SEQ ID NO: 1163135 - DNA, 22 bp, Artificial Sequence
  chemically synthesized
aatgaaatatcagcaccatttt

SEQ ID NO: 1163136 - DNA, 22 bp, Artificial Sequence
  chemically synthesized
tcaggagctctaaaaatggtgc

SEQ ID NO: 1163137 - DNA, 22 bp, Artificial Sequence
  chemically synthesized
ctcaggagctctaaaaatggtg

SEQ ID NO: 1163138 - DNA, 22 bp, Artificial Sequence
  chemically synthesized
tctcaggagctctaaaaatggt

SEQ ID NO: 1163139 - DNA, 22 bp, Artificial Sequence
  chemically synthesized
ctttctcaggagctctaaaaat

SEQ ID NO: 1163140 - DNA, 22 bp, Artificial Sequence
  chemically synthesized
attactttctcaggagctctaa

SEQ ID NO: 1163141 - DNA, 22 bp, Artificial Sequence
  chemically synthesized
aattactttctcaggagctcta

SEQ ID NO: 1163142 - DNA, 22 bp, Artificial Sequence
  chemically synthesized
taattactttctcaggagctct

SEQ ID NO: 1163143 - DNA, 22 bp, Artificial Sequence
  chemically synthesized
ttagagctcctgagaaagtaat

SEQ ID NO: 1163144 - DNA, 22 bp, Artificial Sequence
  chemically synthesized
tagagctcctgagaaagtaatt

SEQ ID NO: 1163145 - DNA, 22 bp, Artificial Sequence
  chemically synthesized
agagctcctgagaaagtaatta

SEQ ID NO: 1163146 - DNA, 22 bp, Artificial Sequence
  chemically synthesized
gagctcctgagaaagtaattaa

SEQ ID NO: 1163147 - DNA, 22 bp, Artificial Sequence
  chemically synthesized
ctgagaaagtaattaaaatatt

SEQ ID NO: 1163148 - DNA, 22 bp, Artificial Sequence
  chemically synthesized
agaaagtaattaaaatatttgg

SEQ ID NO: 1163149 - DNA, 22 bp, Artificial Sequence
  chemically synthesized
tcaagtgacgtgggccaaatat

SEQ ID NO: 1163150 - DNA, 22 bp, Artificial Sequence
  chemically synthesized
tatcaagtgacgtgggccaaat

SEQ ID NO: 1163151 - DNA, 22 bp, Artificial Sequence
  chemically synthesized
ctatcaagtgacgtgggccaaa

SEQ ID NO: 1163152 - DNA, 22 bp, Artificial Sequence
  chemically synthesized
tctatcaagtgacgtgggccaa

SEQ ID NO: 1163153 - DNA, 22 bp, Artificial Sequence
  chemically synthesized
ttctatcaagtgacgtgggcca

SEQ ID NO: 1163154 - DNA, 22 bp, Artificial Sequence
  chemically synthesized
tttttctatcaagtgacgtggg

SEQ ID NO: 1163155 - DNA, 22 bp, Artificial Sequence
  chemically synthesized
aaatatttggcccacgtcactt

SEQ ID NO: 1163156 - DNA, 22 bp, Artificial Sequence
  chemically synthesized
ctatttttctatcaagtgacgt

SEQ ID NO: 1163157 - DNA, 22 bp, Artificial Sequence
  chemically synthesized
ttcctatttttctatcaagtga

SEQ ID NO: 1163158 - DNA, 22 bp, Artificial Sequence
  chemically synthesized
tgttcctatttttctatcaagt

SEQ ID NO: 1163159 - DNA, 22 bp, Artificial Sequence
  chemically synthesized
ctgttcctatttttctatcaag

SEQ ID NO: 1163160 - DNA, 22 bp, Artificial Sequence
  chemically synthesized
ggcccacgtcacttgatagaaa

SEQ ID NO: 1163161 - DNA, 22 bp, Artificial Sequence
  chemically synthesized
gcccacgtcacttgatagaaaa

SEQ ID NO: 1163162 - DNA, 22 bp, Artificial Sequence
  chemically synthesized
gatatcttctgttcctattttt

SEQ ID NO: 1163163 - DNA, 22 bp, Artificial Sequence
  chemically synthesized
agatatcttctgttcctatttt

SEQ ID NO: 1163164 - DNA, 22 bp, Artificial Sequence
  chemically synthesized
cttagatatcttctgttcctat

SEQ ID NO: 1163165 - DNA, 22 bp, Artificial Sequence
  chemically synthesized
tacttagatatcttctgttcct

SEQ ID NO: 1163166 - DNA, 22 bp, Artificial Sequence
  chemically synthesized
gatagaaaaataggaacagaag

SEQ ID NO: 1163167 - DNA, 22 bp, Artificial Sequence
  chemically synthesized
atagaaaaataggaacagaaga

SEQ ID NO: 1163168 - DNA, 22 bp, Artificial Sequence
  chemically synthesized
taaacctctacttagatatctt

SEQ ID NO: 1163169 - DNA, 22 bp, Artificial Sequence
  chemically synthesized
gtaaacctctacttagatatct

SEQ ID NO: 1163170 - DNA, 22 bp, Artificial Sequence
  chemically synthesized
tgtaaacctctacttagatatc

SEQ ID NO: 1163171 - DNA, 22 bp, Artificial Sequence
  chemically synthesized
tttgtaaacctctacttagata

SEQ ID NO: 1163172 - DNA, 22 bp, Artificial Sequence
  chemically synthesized
ctttgtaaacctctacttagat

SEQ ID NO: 1163173 - DNA, 22 bp, Artificial Sequence
  chemically synthesized
aacttctttgtaaacctctact

SEQ ID NO: 1163174 - DNA, 22 bp, Artificial Sequence
  chemically synthesized
agtagaggtttacaaagaagtt

SEQ ID NO: 1163175 - DNA, 22 bp, Artificial Sequence
  chemically synthesized
agacagagtagaaatctcaact

SEQ ID NO: 1163176 - DNA, 22 bp, Artificial Sequence
  chemically synthesized
acaaagaagttgagatttctac

SEQ ID NO: 1163177 - DNA, 22 bp, Artificial Sequence
  chemically synthesized
caaagaagttgagatttctact

SEQ ID NO: 1163178 - DNA, 22 bp, Artificial Sequence
  chemically synthesized
aaattaagacagagtagaaatc

SEQ ID NO: 1163179 - DNA, 22 bp, Artificial Sequence
  chemically synthesized
actgaaattaagacagagtaga

SEQ ID NO: 1163180 - DNA, 22 bp, Artificial Sequence
  chemically synthesized
atctaactgaaattaagacaga

SEQ ID NO: 1163181 - DNA, 22 bp, Artificial Sequence
  chemically synthesized
agatttctactctgtcttaatt

SEQ ID NO: 1163182 - DNA, 22 bp, Artificial Sequence
  chemically synthesized
ctactctgtcttaatttcagtt

SEQ ID NO: 1163183 - DNA, 22 bp, Artificial Sequence
  chemically synthesized
tactctgtcttaatttcagtta

SEQ ID NO: 1163184 - DNA, 22 bp, Artificial Sequence
  chemically synthesized
agaagcactgatctaactgaaa

SEQ ID NO: 1163185 - DNA, 22 bp, Artificial Sequence
  chemically synthesized
ctctgtcttaatttcagttaga

SEQ ID NO: 1163186 - DNA, 22 bp, Artificial Sequence
  chemically synthesized
gagaagcactgatctaactgaa

SEQ ID NO: 1163187 - DNA, 22 bp, Artificial Sequence
  chemically synthesized
tgtcttaatttcagttagatca

SEQ ID NO: 1163188 - DNA, 22 bp, Artificial Sequence
  chemically synthesized
tcttaatttcagttagatcagt

SEQ ID NO: 1163189 - DNA, 22 bp, Artificial Sequence
  chemically synthesized
agtttgagaagcactgatctaa

SEQ ID NO: 1163190 - DNA, 22 bp, Artificial Sequence
  chemically synthesized
aagtttgagaagcactgatcta

SEQ ID NO: 1163191 - DNA, 22 bp, Artificial Sequence
  chemically synthesized
aatttcagttagatcagtgctt

SEQ ID NO: 1163192 - DNA, 22 bp, Artificial Sequence
  chemically synthesized
atttcagttagatcagtgcttc

SEQ ID NO: 1163193 - DNA, 22 bp, Artificial Sequence
  chemically synthesized
cagttagatcagtgcttctcaa

SEQ ID NO: 1163194 - DNA, 22 bp, Artificial Sequence
  chemically synthesized
atcagtttaagtttgagaagca

SEQ ID NO: 1163195 - DNA, 22 bp, Artificial Sequence
  chemically synthesized
agttagatcagtgcttctcaaa

SEQ ID NO: 1163196 - DNA, 22 bp, Artificial Sequence
  chemically synthesized
gatcagtgcttctcaaacttaa

SEQ ID NO: 1163197 - DNA, 22 bp, Artificial Sequence
  chemically synthesized
ctcaaacttaaactgatcaggg

SEQ ID NO: 1163198 - DNA, 22 bp, Artificial Sequence
  chemically synthesized
tcaaacttaaactgatcaggga

SEQ ID NO: 1163199 - DNA, 22 bp, Artificial Sequence
  chemically synthesized
aaacttaaactgatcagggatc

SEQ ID NO: 1163200 - DNA, 22 bp, Artificial Sequence
  chemically synthesized
gcaatatcccaggtgatccctg

SEQ ID NO: 1163201 - DNA, 22 bp, Artificial Sequence
  chemically synthesized
agcaatatcccaggtgatccct

SEQ ID NO: 1163202 - DNA, 22 bp, Artificial Sequence
  chemically synthesized
aaactgatcagggatcacctgg

SEQ ID NO: 1163203 - DNA, 22 bp, Artificial Sequence
  chemically synthesized
aactgatcagggatcacctggg

SEQ ID NO: 1163204 - DNA, 22 bp, Artificial Sequence
  chemically synthesized
tgcagtttagcaatatcccagg

SEQ ID NO: 1163205 - DNA, 22 bp, Artificial Sequence
  chemically synthesized
atcagggatcacctgggatatt

SEQ ID NO: 1163206 - DNA, 22 bp, Artificial Sequence
  chemically synthesized
ggatattgctaaactgcacaat

SEQ ID NO: 1163207 - DNA, 22 bp, Artificial Sequence
  chemically synthesized
atatatacagaatcagaattgt

SEQ ID NO: 1163208 - DNA, 22 bp, Artificial Sequence
  chemically synthesized
tgatatatacagaatcagaatt

SEQ ID NO: 1163209 - DNA, 22 bp, Artificial Sequence
  chemically synthesized
ctaaactgcacaattctgattc

SEQ ID NO: 1163210 - DNA, 22 bp, Artificial Sequence
  chemically synthesized
aactgcacaattctgattctgt

SEQ ID NO: 1163211 - DNA, 22 bp, Artificial Sequence
  chemically synthesized
attctgatatatacagaatcag

SEQ ID NO: 1163212 - DNA, 22 bp, Artificial Sequence
  chemically synthesized
tcattctgatatatacagaatc

SEQ ID NO: 1163213 - DNA, 22 bp, Artificial Sequence
  chemically synthesized
cacaattctgattctgtatata

SEQ ID NO: 1163214 - DNA, 22 bp, Artificial Sequence
  chemically synthesized
agctctcattctgatatataca

SEQ ID NO: 1163215 - DNA, 22 bp, Artificial Sequence
  chemically synthesized
tcagctctcattctgatatata

SEQ ID NO: 1163216 - DNA, 22 bp, Artificial Sequence
  chemically synthesized
tgattctgtatatatcagaatg

SEQ ID NO: 1163217 - DNA, 22 bp, Artificial Sequence
  chemically synthesized
attctgtatatatcagaatgag

SEQ ID NO: 1163218 - DNA, 22 bp, Artificial Sequence
  chemically synthesized
tgtatatatcagaatgagagct

SEQ ID NO: 1163219 - DNA, 22 bp, Artificial Sequence
  chemically synthesized
tatatatcagaatgagagctga

SEQ ID NO: 1163220 - DNA, 22 bp, Artificial Sequence
  chemically synthesized
aaaatgcagactctcagctctc

SEQ ID NO: 1163221 - DNA, 22 bp, Artificial Sequence
  chemically synthesized
ttaaaaatgcagactctcagct

SEQ ID NO: 1163222 - DNA, 22 bp, Artificial Sequence
  chemically synthesized
gttaaaaatgcagactctcagc

SEQ ID NO: 1163223 - DNA, 22 bp, Artificial Sequence
  chemically synthesized
agaacttgttaaaaatgcagac

SEQ ID NO: 1163224 - DNA, 22 bp, Artificial Sequence
  chemically synthesized
agagtctgcatttttaacaagt

SEQ ID NO: 1163225 - DNA, 22 bp, Artificial Sequence
  chemically synthesized
catttttaacaagttctcaggt

SEQ ID NO: 1163226 - DNA, 22 bp, Artificial Sequence
  chemically synthesized
ttaacaagttctcaggtgacgc

SEQ ID NO: 1163227 - DNA, 22 bp, Artificial Sequence
  chemically synthesized
taacaagttctcaggtgacgct

SEQ ID NO: 1163228 - DNA, 22 bp, Artificial Sequence
  chemically synthesized
aacaagttctcaggtgacgctg

SEQ ID NO: 1163229 - DNA, 22 bp, Artificial Sequence
  chemically synthesized
acaagttctcaggtgacgctga

SEQ ID NO: 1163230 - DNA, 22 bp, Artificial Sequence
  chemically synthesized
tcaggtgacgctgatgctactg

SEQ ID NO: 1163231 - DNA, 22 bp, Artificial Sequence
  chemically synthesized
aggtgacgctgatgctactggt

SEQ ID NO: 1163232 - DNA, 22 bp, Artificial Sequence
  chemically synthesized
cagatcaaggtggtgtaggacc

SEQ ID NO: 1163233 - DNA, 22 bp, Artificial Sequence
  chemically synthesized
gcagatcaaggtggtgtaggac

SEQ ID NO: 1163234 - DNA, 22 bp, Artificial Sequence
  chemically synthesized
atgctactggtcctacaccacc

SEQ ID NO: 1163235 - DNA, 22 bp, Artificial Sequence
  chemically synthesized
ctggtcctacaccaccttgatc

SEQ ID NO: 1163236 - DNA, 22 bp, Artificial Sequence
  chemically synthesized
gtcctacaccaccttgatctgc

SEQ ID NO: 1163237 - DNA, 22 bp, Artificial Sequence
  chemically synthesized
agcaatagtaacttgcagatca

SEQ ID NO: 1163238 - DNA, 22 bp, Artificial Sequence
  chemically synthesized
caccaccttgatctgcaagtta

SEQ ID NO: 1163239 - DNA, 22 bp, Artificial Sequence
  chemically synthesized
cagtaatgttaagcaatagtaa

SEQ ID NO: 1163240 - DNA, 22 bp, Artificial Sequence
  chemically synthesized
ccagtaatgttaagcaatagta

SEQ ID NO: 1163241 - DNA, 22 bp, Artificial Sequence
  chemically synthesized
gatctgcaagttactattgctt

SEQ ID NO: 1163242 - DNA, 22 bp, Artificial Sequence
  chemically synthesized
atctgcaagttactattgctta

SEQ ID NO: 1163243 - DNA, 22 bp, Artificial Sequence
  chemically synthesized
ttccagtaatgttaagcaatag

SEQ ID NO: 1163244 - DNA, 22 bp, Artificial Sequence
  chemically synthesized
cttccagtaatgttaagcaata

SEQ ID NO: 1163245 - DNA, 22 bp, Artificial Sequence
  chemically synthesized
cttcttccagtaatgttaagca

SEQ ID NO: 1163246 - DNA, 22 bp, Artificial Sequence
  chemically synthesized
caagttactattgcttaacatt

SEQ ID NO: 1163247 - DNA, 22 bp, Artificial Sequence
  chemically synthesized
acttcttccagtaatgttaagc

SEQ ID NO: 1163248 - DNA, 22 bp, Artificial Sequence
  chemically synthesized
tacttcttccagtaatgttaag

SEQ ID NO: 1163249 - DNA, 22 bp, Artificial Sequence
  chemically synthesized
ttttacttcttccagtaatgtt

SEQ ID NO: 1163250 - DNA, 22 bp, Artificial Sequence
  chemically synthesized
tgttttacttcttccagtaatg

SEQ ID NO: 1163251 - DNA, 22 bp, Artificial Sequence
  chemically synthesized
ctattgcttaacattactggaa

SEQ ID NO: 1163252 - DNA, 22 bp, Artificial Sequence
  chemically synthesized
ctgttttacttcttccagtaat

SEQ ID NO: 1163253 - DNA, 22 bp, Artificial Sequence
  chemically synthesized
tctgttttacttcttccagtaa

SEQ ID NO: 1163254 - DNA, 22 bp, Artificial Sequence
  chemically synthesized
ttctgttttacttcttccagta

SEQ ID NO: 1163255 - DNA, 22 bp, Artificial Sequence
  chemically synthesized
ttgcttaacattactggaagaa

SEQ ID NO: 1163256 - DNA, 22 bp, Artificial Sequence
  chemically synthesized
cttaacattactggaagaagta

SEQ ID NO: 1163257 - DNA, 22 bp, Artificial Sequence
  chemically synthesized
atttttctgttttacttcttcc

SEQ ID NO: 1163258 - DNA, 22 bp, Artificial Sequence
  chemically synthesized
aacattactggaagaagtaaaa

SEQ ID NO: 1163259 - DNA, 22 bp, Artificial Sequence
  chemically synthesized
acattactggaagaagtaaaac

SEQ ID NO: 1163260 - DNA, 22 bp, Artificial Sequence
  chemically synthesized
attgatttttctgttttacttc

SEQ ID NO: 1163261 - DNA, 22 bp, Artificial Sequence
  chemically synthesized
ctggaagaagtaaaacagaaaa

SEQ ID NO: 1163262 - DNA, 22 bp, Artificial Sequence
  chemically synthesized
gtaagttcattgatttttctgt

SEQ ID NO: 1163263 - DNA, 22 bp, Artificial Sequence
  chemically synthesized
gaagaagtaaaacagaaaaatc

SEQ ID NO: 1163264 - DNA, 22 bp, Artificial Sequence
  chemically synthesized
ggtaagttcattgatttttctg

SEQ ID NO: 1163265 - DNA, 22 bp, Artificial Sequence
  chemically synthesized
acaatttggtaagttcattgat

SEQ ID NO: 1163266 - DNA, 22 bp, Artificial Sequence
  chemically synthesized
cacaatttggtaagttcattga

SEQ ID NO: 1163267 - DNA, 22 bp, Artificial Sequence
  chemically synthesized
tttcacaatttggtaagttcat

SEQ ID NO: 1163268 - DNA, 22 bp, Artificial Sequence
  chemically synthesized
atttcacaatttggtaagttca

SEQ ID NO: 1163269 - DNA, 22 bp, Artificial Sequence
  chemically synthesized
tatttcacaatttggtaagttc

SEQ ID NO: 1163270 - DNA, 22 bp, Artificial Sequence
  chemically synthesized
tgattttatttcacaatttggt

SEQ ID NO: 1163271 - DNA, 22 bp, Artificial Sequence
  chemically synthesized
attgtgattttatttcacaatt

SEQ ID NO: 1163272 - DNA, 22 bp, Artificial Sequence
  chemically synthesized
ctaattgtgattttatttcaca

SEQ ID NO: 1163273 - DNA, 22 bp, Artificial Sequence
  chemically synthesized
accaaattgtgaaataaaatca

SEQ ID NO: 1163274 - DNA, 22 bp, Artificial Sequence
  chemically synthesized
ccaaattgtgaaataaaatcac

SEQ ID NO: 1163275 - DNA, 22 bp, Artificial Sequence
  chemically synthesized
aaactcctaattgtgattttat

SEQ ID NO: 1163276 - DNA, 22 bp, Artificial Sequence
  chemically synthesized
tgaaataaaatcacaattagga

SEQ ID NO: 1163277 - DNA, 22 bp, Artificial Sequence
  chemically synthesized
gaggtgcacaatctcaaactcc

SEQ ID NO: 1163278 - DNA, 22 bp, Artificial Sequence
  chemically synthesized
ggaggtgcacaatctcaaactc

SEQ ID NO: 1163279 - DNA, 22 bp, Artificial Sequence
  chemically synthesized
tggaggtgcacaatctcaaact

SEQ ID NO: 1163280 - DNA, 22 bp, Artificial Sequence
  chemically synthesized
ggagtttgagattgtgcacctc

SEQ ID NO: 1163281 - DNA, 22 bp, Artificial Sequence
  chemically synthesized
cagtaaatactttggaggtgca

SEQ ID NO: 1163282 - DNA, 22 bp, Artificial Sequence
  chemically synthesized
gttgcagtaaatactttggagg

SEQ ID NO: 1163283 - DNA, 22 bp, Artificial Sequence
  chemically synthesized
gagattgtgcacctccaaagta

SEQ ID NO: 1163284 - DNA, 22 bp, Artificial Sequence
  chemically synthesized
agattgtgcacctccaaagtat

SEQ ID NO: 1163285 - DNA, 22 bp, Artificial Sequence
  chemically synthesized
aattcgttgcagtaaatacttt

SEQ ID NO: 1163286 - DNA, 22 bp, Artificial Sequence
  chemically synthesized
tgcacctccaaagtatttactg

SEQ ID NO: 1163287 - DNA, 22 bp, Artificial Sequence
  chemically synthesized
gaattgaattcgttgcagtaaa

SEQ ID NO: 1163288 - DNA, 22 bp, Artificial Sequence
  chemically synthesized
ggaattgaattcgttgcagtaa

SEQ ID NO: 1163289 - DNA, 22 bp, Artificial Sequence
  chemically synthesized
caaagtatttactgcaacgaat

SEQ ID NO: 1163290 - DNA, 22 bp, Artificial Sequence
  chemically synthesized
caatcttggaattgaattcgtt

SEQ ID NO: 1163291 - DNA, 22 bp, Artificial Sequence
  chemically synthesized
actgcaacgaattcaattccaa

SEQ ID NO: 1163292 - DNA, 22 bp, Artificial Sequence
  chemically synthesized
ctgcaacgaattcaattccaag

SEQ ID NO: 1163293 - DNA, 22 bp, Artificial Sequence
  chemically synthesized
aggtaattccaatcttggaatt

SEQ ID NO: 1163294 - DNA, 22 bp, Artificial Sequence
  chemically synthesized
caacgaattcaattccaagatt

SEQ ID NO: 1163295 - DNA, 22 bp, Artificial Sequence
  chemically synthesized
ttcaggtaattccaatcttgga

SEQ ID NO: 1163296 - DNA, 22 bp, Artificial Sequence
  chemically synthesized
agttattcaggtaattccaatc

SEQ ID NO: 1163297 - DNA, 22 bp, Artificial Sequence
  chemically synthesized
aattccaagattggaattacct

SEQ ID NO: 1163298 - DNA, 22 bp, Artificial Sequence
  chemically synthesized
aattaagttattcaggtaattc

SEQ ID NO: 1163299 - DNA, 22 bp, Artificial Sequence
  chemically synthesized
caagattggaattacctgaata

SEQ ID NO: 1163300 - DNA, 22 bp, Artificial Sequence
  chemically synthesized
gaattacctgaataacttaatt

SEQ ID NO: 1163301 - DNA, 22 bp, Artificial Sequence
  chemically synthesized
cctgaataacttaatttagttg

SEQ ID NO: 1163302 - DNA, 22 bp, Artificial Sequence
  chemically synthesized
aataacttaatttagttgttca

SEQ ID NO: 1163303 - DNA, 22 bp, Artificial Sequence
  chemically synthesized
aatttagttgttcatctattca

SEQ ID NO: 1163304 - DNA, 22 bp, Artificial Sequence
  chemically synthesized
atttagttgttcatctattcat

SEQ ID NO: 1163305 - DNA, 22 bp, Artificial Sequence
  chemically synthesized
agttgttcatctattcattcat

SEQ ID NO: 1163306 - DNA, 22 bp, Artificial Sequence
  chemically synthesized
gttgttcatctattcattcata

SEQ ID NO: 1163307 - DNA, 22 bp, Artificial Sequence
  chemically synthesized
cgtatgtgaatatatgaatgaa

SEQ ID NO: 1163308 - DNA, 22 bp, Artificial Sequence
  chemically synthesized
gcgtatgtgaatatatgaatga

SEQ ID NO: 1163309 - DNA, 22 bp, Artificial Sequence
  chemically synthesized
ttcatctattcattcatatatt

SEQ ID NO: 1163310 - DNA, 22 bp, Artificial Sequence
  chemically synthesized
atctattcattcatatattcac

SEQ ID NO: 1163311 - DNA, 22 bp, Artificial Sequence
  chemically synthesized
ttcattcatatattcacatacg

SEQ ID NO: 1163312 - DNA, 22 bp, Artificial Sequence
  chemically synthesized
attcatatattcacatacgcaa

SEQ ID NO: 1163313 - DNA, 22 bp, Artificial Sequence
  chemically synthesized
atatattcacatacgcaaactt

SEQ ID NO: 1163314 - DNA, 22 bp, Artificial Sequence
  chemically synthesized
ccaagtgcagtgaagtttgcgt

SEQ ID NO: 1163315 - DNA, 22 bp, Artificial Sequence
  chemically synthesized
tcccaagtgcagtgaagtttgc

SEQ ID NO: 1163316 - DNA, 22 bp, Artificial Sequence
  chemically synthesized
ctcccaagtgcagtgaagtttg

SEQ ID NO: 1163317 - DNA, 22 bp, Artificial Sequence
  chemically synthesized
tctcccaagtgcagtgaagttt

SEQ ID NO: 1163318 - DNA, 22 bp, Artificial Sequence
  chemically synthesized
ttttctcccaagtgcagtgaag

SEQ ID NO: 1163319 - DNA, 22 bp, Artificial Sequence
  chemically synthesized
acatacgcaaacttcactgcac

SEQ ID NO: 1163320 - DNA, 22 bp, Artificial Sequence
  chemically synthesized
cactgcacttgggagaaaataa

SEQ ID NO: 1163321 - DNA, 22 bp, Artificial Sequence
  chemically synthesized
actgcacttgggagaaaataac

SEQ ID NO: 1163322 - DNA, 22 bp, Artificial Sequence
  chemically synthesized
aacaaatgagtgggttattttc

SEQ ID NO: 1163323 - DNA, 22 bp, Artificial Sequence
  chemically synthesized
cacttgggagaaaataacccac

SEQ ID NO: 1163324 - DNA, 22 bp, Artificial Sequence
  chemically synthesized
gggagaaaataacccactcatt

SEQ ID NO: 1163325 - DNA, 22 bp, Artificial Sequence
  chemically synthesized
ggagaaaataacccactcattt

SEQ ID NO: 1163326 - DNA, 22 bp, Artificial Sequence
  chemically synthesized
atttgttcagcacctccttttc

SEQ ID NO: 1163327 - DNA, 22 bp, Artificial Sequence
  chemically synthesized
gttcagcacctccttttctcta

SEQ ID NO: 1163328 - DNA, 22 bp, Artificial Sequence
  chemically synthesized
ttcagcacctccttttctctat

SEQ ID NO: 1163329 - DNA, 22 bp, Artificial Sequence
  chemically synthesized
agcacctccttttctctatcca

SEQ ID NO: 1163330 - DNA, 22 bp, Artificial Sequence
  chemically synthesized
cttttctctatccactctcaca

SEQ ID NO: 1163331 - DNA, 22 bp, Artificial Sequence
  chemically synthesized
ttctctatccactctcacatat

SEQ ID NO: 1163332 - DNA, 22 bp, Artificial Sequence
  chemically synthesized
tctctatccactctcacatatg

SEQ ID NO: 1163333 - DNA, 22 bp, Artificial Sequence
  chemically synthesized
gaaataagatggcatatgtgag

SEQ ID NO: 1163334 - DNA, 22 bp, Artificial Sequence
  chemically synthesized
ctctatccactctcacatatgc

SEQ ID NO: 1163335 - DNA, 22 bp, Artificial Sequence
  chemically synthesized
tctatccactctcacatatgcc

SEQ ID NO: 1163336 - DNA, 22 bp, Artificial Sequence
  chemically synthesized
tggaaataagatggcatatgtg

SEQ ID NO: 1163337 - DNA, 22 bp, Artificial Sequence
  chemically synthesized
tatccactctcacatatgccat

SEQ ID NO: 1163338 - DNA, 22 bp, Artificial Sequence
  chemically synthesized
tccactctcacatatgccatct

SEQ ID NO: 1163339 - DNA, 22 bp, Artificial Sequence
  chemically synthesized
actctggaaataagatggcata

SEQ ID NO: 1163340 - DNA, 22 bp, Artificial Sequence
  chemically synthesized
gactctggaaataagatggcat

SEQ ID NO: 1163341 - DNA, 22 bp, Artificial Sequence
  chemically synthesized
tttgactctggaaataagatgg

SEQ ID NO: 1163342 - DNA, 22 bp, Artificial Sequence
  chemically synthesized
tcacatatgccatcttatttcc

SEQ ID NO: 1163343 - DNA, 22 bp, Artificial Sequence
  chemically synthesized
acatatgccatcttatttccag

SEQ ID NO: 1163344 - DNA, 22 bp, Artificial Sequence
  chemically synthesized
ccccaagtgtctatttgactct

SEQ ID NO: 1163345 - DNA, 22 bp, Artificial Sequence
  chemically synthesized
cccccaagtgtctatttgactc

SEQ ID NO: 1163346 - DNA, 22 bp, Artificial Sequence
  chemically synthesized
tcccccaagtgtctatttgact

SEQ ID NO: 1163347 - DNA, 22 bp, Artificial Sequence
  chemically synthesized
ttcccccaagtgtctatttgac

SEQ ID NO: 1163348 - DNA, 22 bp, Artificial Sequence
  chemically synthesized
tttcccccaagtgtctatttga

SEQ ID NO: 1163349 - DNA, 22 bp, Artificial Sequence
  chemically synthesized
ttttcccccaagtgtctatttg

SEQ ID NO: 1163350 - DNA, 22 bp, Artificial Sequence
  chemically synthesized
atttccagagtcaaatagacac

SEQ ID NO: 1163351 - DNA, 22 bp, Artificial Sequence
  chemically synthesized
tttttcccccaagtgtctattt

SEQ ID NO: 1163352 - DNA, 22 bp, Artificial Sequence
  chemically synthesized
tttccagagtcaaatagacact

SEQ ID NO: 1163353 - DNA, 22 bp, Artificial Sequence
  chemically synthesized
ttttttcccccaagtgtctatt

SEQ ID NO: 1163354 - DNA, 22 bp, Artificial Sequence
  chemically synthesized
tttttttcccccaagtgtctat

SEQ ID NO: 1163355 - DNA, 22 bp, Artificial Sequence
  chemically synthesized
ccagagtcaaatagacacttgg

SEQ ID NO: 1163356 - DNA, 22 bp, Artificial Sequence
  chemically synthesized
tttttttttcccccaagtgtct

SEQ ID NO: 1163357 - DNA, 22 bp, Artificial Sequence
  chemically synthesized
cagagtcaaatagacacttggg

SEQ ID NO: 1163358 - DNA, 22 bp, Artificial Sequence
  chemically synthesized
atctctttttttttcccccaag

SEQ ID NO: 1163359 - DNA, 22 bp, Artificial Sequence
  chemically synthesized
acaaatatggctcatctctttt

SEQ ID NO: 1163360 - DNA, 22 bp, Artificial Sequence
  chemically synthesized
gggggaaaaaaaaagagatgag

SEQ ID NO: 1163361 - DNA, 22 bp, Artificial Sequence
  chemically synthesized
ggggaaaaaaaaagagatgagc

SEQ ID NO: 1163362 - DNA, 22 bp, Artificial Sequence
  chemically synthesized
gacagaaaaatacatctaacaa

SEQ ID NO: 1163363 - DNA, 22 bp, Artificial Sequence
  chemically synthesized
actggacagaaaaatacatcta

SEQ ID NO: 1163364 - DNA, 22 bp, Artificial Sequence
  chemically synthesized
gactggacagaaaaatacatct

SEQ ID NO: 1163365 - DNA, 22 bp, Artificial Sequence
  chemically synthesized
tgactggacagaaaaatacatc

SEQ ID NO: 1163366 - DNA, 22 bp, Artificial Sequence
  chemically synthesized
gttagatgtatttttctgtcca

SEQ ID NO: 1163367 - DNA, 22 bp, Artificial Sequence
  chemically synthesized
ttagatgtatttttctgtccag

SEQ ID NO: 1163368 - DNA, 22 bp, Artificial Sequence
  chemically synthesized
gatgtatttttctgtccagtca

SEQ ID NO: 1163369 - DNA, 22 bp, Artificial Sequence
  chemically synthesized
tgaatcaccatcaatgctttga

SEQ ID NO: 1163370 - DNA, 22 bp, Artificial Sequence
  chemically synthesized
ttctgtccagtcaaagcattga

SEQ ID NO: 1163371 - DNA, 22 bp, Artificial Sequence
  chemically synthesized
tctgtccagtcaaagcattgat

SEQ ID NO: 1163372 - DNA, 22 bp, Artificial Sequence
  chemically synthesized
ctgtccagtcaaagcattgatg

SEQ ID NO: 1163373 - DNA, 22 bp, Artificial Sequence
  chemically synthesized
tgtccagtcaaagcattgatgg

SEQ ID NO: 1163374 - DNA, 22 bp, Artificial Sequence
  chemically synthesized
tccagtcaaagcattgatggtg

SEQ ID NO: 1163375 - DNA, 22 bp, Artificial Sequence
  chemically synthesized
atggtgattcacaattattttc

SEQ ID NO: 1163376 - DNA, 22 bp, Artificial Sequence
  chemically synthesized
acaattattttccatattatgg

SEQ ID NO: 1163377 - DNA, 22 bp, Artificial Sequence
  chemically synthesized
ggtagatacacaagccataata

SEQ ID NO: 1163378 - DNA, 22 bp, Artificial Sequence
  chemically synthesized
ttttccatattatggcttgtgt

SEQ ID NO: 1163379 - DNA, 22 bp, Artificial Sequence
  chemically synthesized
tccatattatggcttgtgtatc

SEQ ID NO: 1163380 - DNA, 22 bp, Artificial Sequence
  chemically synthesized
ccatattatggcttgtgtatct

SEQ ID NO: 1163381 - DNA, 22 bp, Artificial Sequence
  chemically synthesized
catattatggcttgtgtatcta

SEQ ID NO: 1163382 - DNA, 22 bp, Artificial Sequence
  chemically synthesized
tggcttgtgtatctacccagat

SEQ ID NO: 1163383 - DNA, 22 bp, Artificial Sequence
  chemically synthesized
gtgtatctacccagatactatt

SEQ ID NO: 1163384 - DNA, 22 bp, Artificial Sequence
  chemically synthesized
tgtatctacccagatactattc

SEQ ID NO: 1163385 - DNA, 22 bp, Artificial Sequence
  chemically synthesized
cccagatactattcatatctct

SEQ ID NO: 1163386 - DNA, 22 bp, Artificial Sequence
  chemically synthesized
tatcagcaggaggagagatatg

SEQ ID NO: 1163387 - DNA, 22 bp, Artificial Sequence
  chemically synthesized
atatcagcaggaggagagatat

SEQ ID NO: 1163388 - DNA, 22 bp, Artificial Sequence
  chemically synthesized
gtttatatcagcaggaggagag

SEQ ID NO: 1163389 - DNA, 22 bp, Artificial Sequence
  chemically synthesized
ggtttatatcagcaggaggaga

SEQ ID NO: 1163390 - DNA, 22 bp, Artificial Sequence
  chemically synthesized
tggtttatatcagcaggaggag

SEQ ID NO: 1163391 - DNA, 22 bp, Artificial Sequence
  chemically synthesized
ttggtttatatcagcaggagga

SEQ ID NO: 1163392 - DNA, 22 bp, Artificial Sequence
  chemically synthesized
tttggtttatatcagcaggagg

SEQ ID NO: 1163393 - DNA, 22 bp, Artificial Sequence
  chemically synthesized
ttcatatctctcctcctgctga

SEQ ID NO: 1163394 - DNA, 22 bp, Artificial Sequence
  chemically synthesized
atatctctcctcctgctgatat

SEQ ID NO: 1163395 - DNA, 22 bp, Artificial Sequence
  chemically synthesized
tgttttttggtttatatcagca

SEQ ID NO: 1163396 - DNA, 22 bp, Artificial Sequence
  chemically synthesized
tcctcctgctgatataaaccaa

SEQ ID NO: 1163397 - DNA, 22 bp, Artificial Sequence
  chemically synthesized
ctcctgctgatataaaccaaaa

SEQ ID NO: 1163398 - DNA, 22 bp, Artificial Sequence
  chemically synthesized
ctgctgatataaaccaaaaaac

SEQ ID NO: 1163399 - DNA, 22 bp, Artificial Sequence
  chemically synthesized
ctgatataaaccaaaaaacaca

SEQ ID NO: 1163400 - DNA, 22 bp, Artificial Sequence
  chemically synthesized
atataaaccaaaaaacacaact

SEQ ID NO: 1163401 - DNA, 22 bp, Artificial Sequence
  chemically synthesized
cacttggcctcctgacttgctt

SEQ ID NO: 1163402 - DNA, 22 bp, Artificial Sequence
  chemically synthesized
acttggcctcctgacttgcttt

SEQ ID NO: 1163403 - DNA, 22 bp, Artificial Sequence
  chemically synthesized
ggcctcctgacttgctttcatt

SEQ ID NO: 1163404 - DNA, 22 bp, Artificial Sequence
  chemically synthesized
gcctcctgacttgctttcattt

SEQ ID NO: 1163405 - DNA, 22 bp, Artificial Sequence
  chemically synthesized
tgacggtaagggaaaaaaatga

SEQ ID NO: 1163406 - DNA, 22 bp, Artificial Sequence
  chemically synthesized
ctgacttgctttcatttttttc

SEQ ID NO: 1163407 - DNA, 22 bp, Artificial Sequence
  chemically synthesized
tgtgacggtaagggaaaaaaat

SEQ ID NO: 1163408 - DNA, 22 bp, Artificial Sequence
  chemically synthesized
ctgtgacggtaagggaaaaaaa

SEQ ID NO: 1163409 - DNA, 22 bp, Artificial Sequence
  chemically synthesized
acttgctttcatttttttccct

SEQ ID NO: 1163410 - DNA, 22 bp, Artificial Sequence
  chemically synthesized
gctttcatttttttcccttacc

SEQ ID NO: 1163411 - DNA, 22 bp, Artificial Sequence
  chemically synthesized
ctttcatttttttcccttaccg

SEQ ID NO: 1163412 - DNA, 22 bp, Artificial Sequence
  chemically synthesized
aaacttctgtgacggtaaggga

SEQ ID NO: 1163413 - DNA, 22 bp, Artificial Sequence
  chemically synthesized
tcatttttttcccttaccgtca

SEQ ID NO: 1163414 - DNA, 22 bp, Artificial Sequence
  chemically synthesized
catttttttcccttaccgtcac

SEQ ID NO: 1163415 - DNA, 22 bp, Artificial Sequence
  chemically synthesized
atttttttcccttaccgtcaca

SEQ ID NO: 1163416 - DNA, 22 bp, Artificial Sequence
  chemically synthesized
ttttcccttaccgtcacagaag

SEQ ID NO: 1163417 - DNA, 22 bp, Artificial Sequence
  chemically synthesized
tttcccttaccgtcacagaagt

SEQ ID NO: 1163418 - DNA, 22 bp, Artificial Sequence
  chemically synthesized
ttcccttaccgtcacagaagtt

SEQ ID NO: 1163419 - DNA, 22 bp, Artificial Sequence
  chemically synthesized
tcccttaccgtcacagaagttt

SEQ ID NO: 1163420 - DNA, 22 bp, Artificial Sequence
  chemically synthesized
cccttaccgtcacagaagtttt

SEQ ID NO: 1163421 - DNA, 22 bp, Artificial Sequence
  chemically synthesized
ccttaccgtcacagaagtttta

SEQ ID NO: 1163422 - DNA, 22 bp, Artificial Sequence
  chemically synthesized
accgtcacagaagttttagttt

SEQ ID NO: 1163423 - DNA, 22 bp, Artificial Sequence
  chemically synthesized
ccgtcacagaagttttagtttc

SEQ ID NO: 1163424 - DNA, 22 bp, Artificial Sequence
  chemically synthesized
ggacatgcaggcagaaactaaa

SEQ ID NO: 1163425 - DNA, 22 bp, Artificial Sequence
  chemically synthesized
tagttaggacatgcaggcagaa

SEQ ID NO: 1163426 - DNA, 22 bp, Artificial Sequence
  chemically synthesized
ataattgtagttaggacatgca

SEQ ID NO: 1163427 - DNA, 22 bp, Artificial Sequence
  chemically synthesized
tagtttctgcctgcatgtccta

SEQ ID NO: 1163428 - DNA, 22 bp, Artificial Sequence
  chemically synthesized
agtttctgcctgcatgtcctaa

SEQ ID NO: 1163429 - DNA, 22 bp, Artificial Sequence
  chemically synthesized
tgataattgtagttaggacatg

SEQ ID NO: 1163430 - DNA, 22 bp, Artificial Sequence
  chemically synthesized
gtttctgcctgcatgtcctaac

SEQ ID NO: 1163431 - DNA, 22 bp, Artificial Sequence
  chemically synthesized
ctgataattgtagttaggacat

SEQ ID NO: 1163432 - DNA, 22 bp, Artificial Sequence
  chemically synthesized
tctgataattgtagttaggaca

SEQ ID NO: 1163433 - DNA, 22 bp, Artificial Sequence
  chemically synthesized
ttctgataattgtagttaggac

SEQ ID NO: 1163434 - DNA, 22 bp, Artificial Sequence
  chemically synthesized
ctgcctgcatgtcctaactaca

SEQ ID NO: 1163435 - DNA, 22 bp, Artificial Sequence
  chemically synthesized
tgcctgcatgtcctaactacaa

SEQ ID NO: 1163436 - DNA, 22 bp, Artificial Sequence
  chemically synthesized
cctgcatgtcctaactacaatt

SEQ ID NO: 1163437 - DNA, 22 bp, Artificial Sequence
  chemically synthesized
catgtcctaactacaattatca

SEQ ID NO: 1163438 - DNA, 22 bp, Artificial Sequence
  chemically synthesized
catcaacttttctgataattgt

SEQ ID NO: 1163439 - DNA, 22 bp, Artificial Sequence
  chemically synthesized
actacaattatcagaaaagttg

SEQ ID NO: 1163440 - DNA, 22 bp, Artificial Sequence
  chemically synthesized
caattatcagaaaagttgatgg

SEQ ID NO: 1163441 - DNA, 22 bp, Artificial Sequence
  chemically synthesized
agcacagcaagttccatcaact

SEQ ID NO: 1163442 - DNA, 22 bp, Artificial Sequence
  chemically synthesized
tcagaaaagttgatggaacttg

SEQ ID NO: 1163443 - DNA, 22 bp, Artificial Sequence
  chemically synthesized
aaagttaagcacagcaagttcc

SEQ ID NO: 1163444 - DNA, 22 bp, Artificial Sequence
  chemically synthesized
taaggactcaaagttaagcaca

SEQ ID NO: 1163445 - DNA, 22 bp, Artificial Sequence
  chemically synthesized
atggaacttgctgtgcttaact

SEQ ID NO: 1163446 - DNA, 22 bp, Artificial Sequence
  chemically synthesized
ataaggactcaaagttaagcac

SEQ ID NO: 1163447 - DNA, 22 bp, Artificial Sequence
  chemically synthesized
tataaggactcaaagttaagca

SEQ ID NO: 1163448 - DNA, 22 bp, Artificial Sequence
  chemically synthesized
ttataaggactcaaagttaagc

SEQ ID NO: 1163449 - DNA, 22 bp, Artificial Sequence
  chemically synthesized
acatttttataaggactcaaag

SEQ ID NO: 1163450 - DNA, 22 bp, Artificial Sequence
  chemically synthesized
gctgtgcttaactttgagtcct

SEQ ID NO: 1163451 - DNA, 22 bp, Artificial Sequence
  chemically synthesized
ctgtgcttaactttgagtcctt

SEQ ID NO: 1163452 - DNA, 22 bp, Artificial Sequence
  chemically synthesized
ctgacatttttataaggactca

SEQ ID NO: 1163453 - DNA, 22 bp, Artificial Sequence
  chemically synthesized
actgacatttttataaggactc

SEQ ID NO: 1163454 - DNA, 22 bp, Artificial Sequence
  chemically synthesized
tgcttaactttgagtccttata

SEQ ID NO: 1163455 - DNA, 22 bp, Artificial Sequence
  chemically synthesized
aactttgagtccttataaaaat

SEQ ID NO: 1163456 - DNA, 22 bp, Artificial Sequence
  chemically synthesized
actttgagtccttataaaaatg

SEQ ID NO: 1163457 - DNA, 22 bp, Artificial Sequence
  chemically synthesized
tgagtccttataaaaatgtcag

SEQ ID NO: 1163458 - DNA, 22 bp, Artificial Sequence
  chemically synthesized
gagtccttataaaaatgtcagt

SEQ ID NO: 1163459 - DNA, 22 bp, Artificial Sequence
  chemically synthesized
agtccttataaaaatgtcagta

SEQ ID NO: 1163460 - DNA, 22 bp, Artificial Sequence
  chemically synthesized
cagagagcaaaaaagatttact

SEQ ID NO: 1163461 - DNA, 22 bp, Artificial Sequence
  chemically synthesized
ataaaaatgtcagtaaatcttt

SEQ ID NO: 1163462 - DNA, 22 bp, Artificial Sequence
  chemically synthesized
taaaaatgtcagtaaatctttt

SEQ ID NO: 1163463 - DNA, 22 bp, Artificial Sequence
  chemically synthesized
aaaaatgcaacctgcagagagc

SEQ ID NO: 1163464 - DNA, 22 bp, Artificial Sequence
  chemically synthesized
attgaaaaatgcaacctgcaga

SEQ ID NO: 1163465 - DNA, 22 bp, Artificial Sequence
  chemically synthesized
gattgaaaaatgcaacctgcag

SEQ ID NO: 1163466 - DNA, 22 bp, Artificial Sequence
  chemically synthesized
ttttgctctctgcaggttgcat

SEQ ID NO: 1163467 - DNA, 22 bp, Artificial Sequence
  chemically synthesized
tttgctctctgcaggttgcatt

SEQ ID NO: 1163468 - DNA, 22 bp, Artificial Sequence
  chemically synthesized
atttgattgaaaaatgcaacct

SEQ ID NO: 1163469 - DNA, 22 bp, Artificial Sequence
  chemically synthesized
ttgctctctgcaggttgcattt

SEQ ID NO: 1163470 - DNA, 22 bp, Artificial Sequence
  chemically synthesized
tgctctctgcaggttgcatttt

SEQ ID NO: 1163471 - DNA, 22 bp, Artificial Sequence
  chemically synthesized
gctctctgcaggttgcattttt

SEQ ID NO: 1163472 - DNA, 22 bp, Artificial Sequence
  chemically synthesized
ctctctgcaggttgcatttttc

SEQ ID NO: 1163473 - DNA, 22 bp, Artificial Sequence
  chemically synthesized
attaatttgattgaaaaatgca

SEQ ID NO: 1163474 - DNA, 22 bp, Artificial Sequence
  chemically synthesized
tctgcaggttgcatttttcaat

SEQ ID NO: 1163475 - DNA, 22 bp, Artificial Sequence
  chemically synthesized
tgcaggttgcatttttcaatca

SEQ ID NO: 1163476 - DNA, 22 bp, Artificial Sequence
  chemically synthesized
caggttgcatttttcaatcaaa

SEQ ID NO: 1163477 - DNA, 22 bp, Artificial Sequence
  chemically synthesized
tgaataaactaattaatttgat

SEQ ID NO: 1163478 - DNA, 22 bp, Artificial Sequence
  chemically synthesized
tatgaataaactaattaatttg

SEQ ID NO: 1163479 - DNA, 22 bp, Artificial Sequence
  chemically synthesized
catttttcaatcaaattaatta

SEQ ID NO: 1163480 - DNA, 22 bp, Artificial Sequence
  chemically synthesized
tctatgaataaactaattaatt

SEQ ID NO: 1163481 - DNA, 22 bp, Artificial Sequence
  chemically synthesized
ctctatgaataaactaattaat

SEQ ID NO: 1163482 - DNA, 22 bp, Artificial Sequence
  chemically synthesized
ttctctatgaataaactaatta

SEQ ID NO: 1163483 - DNA, 22 bp, Artificial Sequence
  chemically synthesized
ttcaatcaaattaattagttta

SEQ ID NO: 1163484 - DNA, 22 bp, Artificial Sequence
  chemically synthesized
cttctctatgaataaactaatt

SEQ ID NO: 1163485 - DNA, 22 bp, Artificial Sequence
  chemically synthesized
tcaatcaaattaattagtttat

SEQ ID NO: 1163486 - DNA, 22 bp, Artificial Sequence
  chemically synthesized
tcttctctatgaataaactaat

SEQ ID NO: 1163487 - DNA, 22 bp, Artificial Sequence
  chemically synthesized
caatcaaattaattagtttatt

SEQ ID NO: 1163488 - DNA, 22 bp, Artificial Sequence
  chemically synthesized
aatcaaattaattagtttattc

SEQ ID NO: 1163489 - DNA, 22 bp, Artificial Sequence
  chemically synthesized
attagtttattcatagagaaga

SEQ ID NO: 1163490 - DNA, 22 bp, Artificial Sequence
  chemically synthesized
gtttattcatagagaagaaaat

SEQ ID NO: 1163491 - DNA, 22 bp, Artificial Sequence
  chemically synthesized
attcatagagaagaaaatcttc

SEQ ID NO: 1163492 - DNA, 22 bp, Artificial Sequence
  chemically synthesized
ttcatagagaagaaaatcttct

SEQ ID NO: 1163493 - DNA, 22 bp, Artificial Sequence
  chemically synthesized
gcacagggaaaacagaagattt

SEQ ID NO: 1163494 - DNA, 22 bp, Artificial Sequence
  chemically synthesized
atagagaagaaaatcttctgtt

SEQ ID NO: 1163495 - DNA, 22 bp, Artificial Sequence
  chemically synthesized
ctgttttccctgtgccagttgt

SEQ ID NO: 1163496 - DNA, 22 bp, Artificial Sequence
  chemically synthesized
tgttttccctgtgccagttgtc

SEQ ID NO: 1163497 - DNA, 22 bp, Artificial Sequence
  chemically synthesized
ttttccctgtgccagttgtctt

SEQ ID NO: 1163498 - DNA, 22 bp, Artificial Sequence
  chemically synthesized
tggaagtgcaagaagacaactg

SEQ ID NO: 1163499 - DNA, 22 bp, Artificial Sequence
  chemically synthesized
tccctgtgccagttgtcttctt

SEQ ID NO: 1163500 - DNA, 22 bp, Artificial Sequence
  chemically synthesized
ccctgtgccagttgtcttcttg

SEQ ID NO: 1163501 - DNA, 22 bp, Artificial Sequence
  chemically synthesized
cctgtgccagttgtcttcttgc

SEQ ID NO: 1163502 - DNA, 22 bp, Artificial Sequence
  chemically synthesized
caactgtggaagtgcaagaaga

SEQ ID NO: 1163503 - DNA, 22 bp, Artificial Sequence
  chemically synthesized
ccaactgtggaagtgcaagaag

SEQ ID NO: 1163504 - DNA, 22 bp, Artificial Sequence
  chemically synthesized
tgccagttgtcttcttgcactt

SEQ ID NO: 1163505 - DNA, 22 bp, Artificial Sequence
  chemically synthesized
tcttcttgcacttccacagttg

SEQ ID NO: 1163506 - DNA, 22 bp, Artificial Sequence
  chemically synthesized
cttgcacttccacagttggaag

SEQ ID NO: 1163507 - DNA, 22 bp, Artificial Sequence
  chemically synthesized
ttgcacttccacagttggaagt

SEQ ID NO: 1163508 - DNA, 22 bp, Artificial Sequence
  chemically synthesized
gcacttccacagttggaagttg

SEQ ID NO: 1163509 - DNA, 22 bp, Artificial Sequence
  chemically synthesized
cacttccacagttggaagttgt

SEQ ID NO: 1163510 - DNA, 22 bp, Artificial Sequence
  chemically synthesized
ggaagaaaaacacacaacttcc

SEQ ID NO: 1163511 - DNA, 22 bp, Artificial Sequence
  chemically synthesized
ccacagttggaagttgtgtgtt

SEQ ID NO: 1163512 - DNA, 22 bp, Artificial Sequence
  chemically synthesized
cacagttggaagttgtgtgttt

SEQ ID NO: 1163513 - DNA, 22 bp, Artificial Sequence
  chemically synthesized
gaagttgtgtgtttttcttccg

SEQ ID NO: 1163514 - DNA, 22 bp, Artificial Sequence
  chemically synthesized
tgtgtttttcttccgaattcct

SEQ ID NO: 1163515 - DNA, 22 bp, Artificial Sequence
  chemically synthesized
ggatggtaggaggtaaggaatt

SEQ ID NO: 1163516 - DNA, 22 bp, Artificial Sequence
  chemically synthesized
gggatggtaggaggtaaggaat

SEQ ID NO: 1163517 - DNA, 22 bp, Artificial Sequence
  chemically synthesized
ttcttccgaattccttacctcc

SEQ ID NO: 1163518 - DNA, 22 bp, Artificial Sequence
  chemically synthesized
tcttccgaattccttacctcct

SEQ ID NO: 1163519 - DNA, 22 bp, Artificial Sequence
  chemically synthesized
cttccgaattccttacctccta

SEQ ID NO: 1163520 - DNA, 22 bp, Artificial Sequence
  chemically synthesized
ttccgaattccttacctcctac

SEQ ID NO: 1163521 - DNA, 22 bp, Artificial Sequence
  chemically synthesized
ccgaattccttacctcctacca

SEQ ID NO: 1163522 - DNA, 22 bp, Artificial Sequence
  chemically synthesized
cgaattccttacctcctaccat

SEQ ID NO: 1163523 - DNA, 22 bp, Artificial Sequence
  chemically synthesized
tggaatacacttgggatggtag

SEQ ID NO: 1163524 - DNA, 22 bp, Artificial Sequence
  chemically synthesized
cttacctcctaccatcccaagt

SEQ ID NO: 1163525 - DNA, 22 bp, Artificial Sequence
  chemically synthesized
atgctgtggaatacacttggga

SEQ ID NO: 1163526 - DNA, 22 bp, Artificial Sequence
  chemically synthesized
acctcctaccatcccaagtgta

SEQ ID NO: 1163527 - DNA, 22 bp, Artificial Sequence
  chemically synthesized
aatgctgtggaatacacttggg

SEQ ID NO: 1163528 - DNA, 22 bp, Artificial Sequence
  chemically synthesized
cctcctaccatcccaagtgtat

SEQ ID NO: 1163529 - DNA, 22 bp, Artificial Sequence
  chemically synthesized
taatgctgtggaatacacttgg

SEQ ID NO: 1163530 - DNA, 22 bp, Artificial Sequence
  chemically synthesized
ttaatgctgtggaatacacttg

SEQ ID NO: 1163531 - DNA, 22 bp, Artificial Sequence
  chemically synthesized
tttaatgctgtggaatacactt

SEQ ID NO: 1163532 - DNA, 22 bp, Artificial Sequence
  chemically synthesized
ttttaatgctgtggaatacact

SEQ ID NO: 1163533 - DNA, 22 bp, Artificial Sequence
  chemically synthesized
ctaccatcccaagtgtattcca

SEQ ID NO: 1163534 - DNA, 22 bp, Artificial Sequence
  chemically synthesized
tttttaatgctgtggaatacac

SEQ ID NO: 1163535 - DNA, 22 bp, Artificial Sequence
  chemically synthesized
ttttttaatgctgtggaataca

SEQ ID NO: 1163536 - DNA, 22 bp, Artificial Sequence
  chemically synthesized
tttttttaatgctgtggaatac

SEQ ID NO: 1163537 - DNA, 22 bp, Artificial Sequence
  chemically synthesized
ccatcccaagtgtattccacag

SEQ ID NO: 1163538 - DNA, 22 bp, Artificial Sequence
  chemically synthesized
cacagcattaaaaaaaaaatca

SEQ ID NO: 1163539 - DNA, 22 bp, Artificial Sequence
  chemically synthesized
agaggagtaagccaatgatttt

SEQ ID NO: 1163540 - DNA, 22 bp, Artificial Sequence
  chemically synthesized
aagaggagtaagccaatgattt

SEQ ID NO: 1163541 - DNA, 22 bp, Artificial Sequence
  chemically synthesized
aaaaaaaaatcattggcttact

SEQ ID NO: 1163542 - DNA, 22 bp, Artificial Sequence
  chemically synthesized
gaaccccttaagaggagtaagc

SEQ ID NO: 1163543 - DNA, 22 bp, Artificial Sequence
  chemically synthesized
ttagaaccccttaagaggagta

SEQ ID NO: 1163544 - DNA, 22 bp, Artificial Sequence
  chemically synthesized
gttagaaccccttaagaggagt

SEQ ID NO: 1163545 - DNA, 22 bp, Artificial Sequence
  chemically synthesized
tgttagaaccccttaagaggag

SEQ ID NO: 1163546 - DNA, 22 bp, Artificial Sequence
  chemically synthesized
gcttactcctcttaaggggttc

SEQ ID NO: 1163547 - DNA, 22 bp, Artificial Sequence
  chemically synthesized
atgtggttttgttagaacccct

SEQ ID NO: 1163548 - DNA, 22 bp, Artificial Sequence
  chemically synthesized
actcctcttaaggggttctaac

SEQ ID NO: 1163549 - DNA, 22 bp, Artificial Sequence
  chemically synthesized
ctcctcttaaggggttctaaca

SEQ ID NO: 1163550 - DNA, 22 bp, Artificial Sequence
  chemically synthesized
ctcttaaggggttctaacaaaa

SEQ ID NO: 1163551 - DNA, 22 bp, Artificial Sequence
  chemically synthesized
ttaaggggttctaacaaaacca

SEQ ID NO: 1163552 - DNA, 22 bp, Artificial Sequence
  chemically synthesized
aaggggttctaacaaaaccaca

SEQ ID NO: 1163553 - DNA, 22 bp, Artificial Sequence
  chemically synthesized
aggggttctaacaaaaccacat

SEQ ID NO: 1163554 - DNA, 22 bp, Artificial Sequence
  chemically synthesized
aaacaagagaatattgatgtgg

SEQ ID NO: 1163555 - DNA, 22 bp, Artificial Sequence
  chemically synthesized
aaaacaagagaatattgatgtg

SEQ ID NO: 1163556 - DNA, 22 bp, Artificial Sequence
  chemically synthesized
taacaaaaccacatcaatattc

SEQ ID NO: 1163557 - DNA, 22 bp, Artificial Sequence
  chemically synthesized
acaaaaccacatcaatattctc

SEQ ID NO: 1163558 - DNA, 22 bp, Artificial Sequence
  chemically synthesized
ataatgtagtgtttaaaacaag

SEQ ID NO: 1163559 - DNA, 22 bp, Artificial Sequence
  chemically synthesized
cataatgtagtgtttaaaacaa

SEQ ID NO: 1163560 - DNA, 22 bp, Artificial Sequence
  chemically synthesized
tcataatgtagtgtttaaaaca

SEQ ID NO: 1163561 - DNA, 22 bp, Artificial Sequence
  chemically synthesized
ctttcataatgtagtgtttaaa

SEQ ID NO: 1163562 - DNA, 22 bp, Artificial Sequence
  chemically synthesized
tcttgttttaaacactacatta

SEQ ID NO: 1163563 - DNA, 22 bp, Artificial Sequence
  chemically synthesized
ttgttttaaacactacattatg

SEQ ID NO: 1163564 - DNA, 22 bp, Artificial Sequence
  chemically synthesized
gttttaaacactacattatgaa

SEQ ID NO: 1163565 - DNA, 22 bp, Artificial Sequence
  chemically synthesized
agtgccattcctttcataatgt

SEQ ID NO: 1163566 - DNA, 22 bp, Artificial Sequence
  chemically synthesized
ttttaaacactacattatgaaa

SEQ ID NO: 1163567 - DNA, 22 bp, Artificial Sequence
  chemically synthesized
taaacactacattatgaaagga

SEQ ID NO: 1163568 - DNA, 22 bp, Artificial Sequence
  chemically synthesized
aaacactacattatgaaaggaa

SEQ ID NO: 1163569 - DNA, 22 bp, Artificial Sequence
  chemically synthesized
aacactacattatgaaaggaat

SEQ ID NO: 1163570 - DNA, 22 bp, Artificial Sequence
  chemically synthesized
cattatgaaaggaatggcactt

SEQ ID NO: 1163571 - DNA, 22 bp, Artificial Sequence
  chemically synthesized
aatgagaaaactaagtgccatt

SEQ ID NO: 1163572 - DNA, 22 bp, Artificial Sequence
  chemically synthesized
aaatgagaaaactaagtgccat

SEQ ID NO: 1163573 - DNA, 22 bp, Artificial Sequence
  chemically synthesized
tgaaaggaatggcacttagttt

SEQ ID NO: 1163574 - DNA, 22 bp, Artificial Sequence
  chemically synthesized
tatgatttaaatgagaaaacta

SEQ ID NO: 1163575 - DNA, 22 bp, Artificial Sequence
  chemically synthesized
atatgatttaaatgagaaaact

SEQ ID NO: 1163576 - DNA, 22 bp, Artificial Sequence
  chemically synthesized
ccaatgtttatatgatttaaat

SEQ ID NO: 1163577 - DNA, 22 bp, Artificial Sequence
  chemically synthesized
accaatgtttatatgatttaaa

SEQ ID NO: 1163578 - DNA, 22 bp, Artificial Sequence
  chemically synthesized
taccaatgtttatatgatttaa

SEQ ID NO: 1163579 - DNA, 22 bp, Artificial Sequence
  chemically synthesized
agttttctcatttaaatcatat

SEQ ID NO: 1163580 - DNA, 22 bp, Artificial Sequence
  chemically synthesized
gttttctcatttaaatcatata

SEQ ID NO: 1163581 - DNA, 22 bp, Artificial Sequence
  chemically synthesized
tctcatttaaatcatataaaca

SEQ ID NO: 1163582 - DNA, 22 bp, Artificial Sequence
  chemically synthesized
ctcatttaaatcatataaacat

SEQ ID NO: 1163583 - DNA, 22 bp, Artificial Sequence
  chemically synthesized
tcatttaaatcatataaacatt

SEQ ID NO: 1163584 - DNA, 22 bp, Artificial Sequence
  chemically synthesized
caaaactttaccaatgtttata

SEQ ID NO: 1163585 - DNA, 22 bp, Artificial Sequence
  chemically synthesized
atttaaatcatataaacattgg

SEQ ID NO: 1163586 - DNA, 22 bp, Artificial Sequence
  chemically synthesized
aaatcatataaacattggtaaa

SEQ ID NO: 1163587 - DNA, 22 bp, Artificial Sequence
  chemically synthesized
aatcatataaacattggtaaag

SEQ ID NO: 1163588 - DNA, 22 bp, Artificial Sequence
  chemically synthesized
gtcaattacaaaactttaccaa

SEQ ID NO: 1163589 - DNA, 22 bp, Artificial Sequence
  chemically synthesized
gtaaagttttgtaattgaccag

SEQ ID NO: 1163590 - DNA, 22 bp, Artificial Sequence
  chemically synthesized
gcacgtgccgatactggtcaat

SEQ ID NO: 1163591 - DNA, 22 bp, Artificial Sequence
  chemically synthesized
ggcacgtgccgatactggtcaa

SEQ ID NO: 1163592 - DNA, 22 bp, Artificial Sequence
  chemically synthesized
tgtaattgaccagtatcggcac

SEQ ID NO: 1163593 - DNA, 22 bp, Artificial Sequence
  chemically synthesized
gtaattgaccagtatcggcacg

SEQ ID NO: 1163594 - DNA, 22 bp, Artificial Sequence
  chemically synthesized
taattgaccagtatcggcacgt

SEQ ID NO: 1163595 - DNA, 22 bp, Artificial Sequence
  chemically synthesized
accagtatcggcacgtgccaaa

SEQ ID NO: 1163596 - DNA, 22 bp, Artificial Sequence
  chemically synthesized
cagtcacaaatgagtttggcac

SEQ ID NO: 1163597 - DNA, 22 bp, Artificial Sequence
  chemically synthesized
acacatctccagtcacaaatga

SEQ ID NO: 1163598 - DNA, 22 bp, Artificial Sequence
  chemically synthesized
ttaacacatctccagtcacaaa

SEQ ID NO: 1163599 - DNA, 22 bp, Artificial Sequence
  chemically synthesized
attaacacatctccagtcacaa

SEQ ID NO: 1163600 - DNA, 22 bp, Artificial Sequence
  chemically synthesized
atttgtgactggagatgtgtta

SEQ ID NO: 1163601 - DNA, 22 bp, Artificial Sequence
  chemically synthesized
gtgactggagatgtgttaataa

SEQ ID NO: 1163602 - DNA, 22 bp, Artificial Sequence
  chemically synthesized
tgactggagatgtgttaataaa

SEQ ID NO: 1163603 - DNA, 22 bp, Artificial Sequence
  chemically synthesized
atacaataaagaagtttattaa

SEQ ID NO: 1163604 - DNA, 22 bp, Artificial Sequence
  chemically synthesized
gagatgtgttaataaacttctt

SEQ ID NO: 1163605 - DNA, 22 bp, Artificial Sequence
  chemically synthesized
ataaacttctttattgtattag

SEQ ID NO: 1163606 - DNA, 22 bp, Artificial Sequence
  chemically synthesized
atgaggtaaaagctaatacaat

SEQ ID NO: 1163607 - DNA, 22 bp, Artificial Sequence
  chemically synthesized
tgatgaggtaaaagctaataca

SEQ ID NO: 1163608 - DNA, 22 bp, Artificial Sequence
  chemically synthesized
ctgatgaggtaaaagctaatac

SEQ ID NO: 1163609 - DNA, 22 bp, Artificial Sequence
  chemically synthesized
ctttattgtattagcttttacc

SEQ ID NO: 1163610 - DNA, 22 bp, Artificial Sequence
  chemically synthesized
tttattgtattagcttttacct

SEQ ID NO: 1163611 - DNA, 22 bp, Artificial Sequence
  chemically synthesized
tattgtattagcttttacctca

SEQ ID NO: 1163612 - DNA, 22 bp, Artificial Sequence
  chemically synthesized
attgtattagcttttacctcat

SEQ ID NO: 1163613 - DNA, 22 bp, Artificial Sequence
  chemically synthesized
ttgtattagcttttacctcatc

SEQ ID NO: 1163614 - DNA, 22 bp, Artificial Sequence
  chemically synthesized
tattagcttttacctcatcaga

SEQ ID NO: 1163615 - DNA, 22 bp, Artificial Sequence
  chemically synthesized
tggacataaatttctgatgagg

SEQ ID NO: 1163616 - DNA, 22 bp, Artificial Sequence
  chemically synthesized
atggacataaatttctgatgag

SEQ ID NO: 1163617 - DNA, 22 bp, Artificial Sequence
  chemically synthesized
tatggacataaatttctgatga

SEQ ID NO: 1163618 - DNA, 22 bp, Artificial Sequence
  chemically synthesized
ttatggacataaatttctgatg

SEQ ID NO: 1163619 - DNA, 22 bp, Artificial Sequence
  chemically synthesized
gcttttacctcatcagaaattt

SEQ ID NO: 1163620 - DNA, 22 bp, Artificial Sequence
  chemically synthesized
cttttatggacataaatttctg

SEQ ID NO: 1163621 - DNA, 22 bp, Artificial Sequence
  chemically synthesized
ttacctcatcagaaatttatgt

SEQ ID NO: 1163622 - DNA, 22 bp, Artificial Sequence
  chemically synthesized
ttgcttttatggacataaattt

SEQ ID NO: 1163623 - DNA, 22 bp, Artificial Sequence
  chemically synthesized
tacctcatcagaaatttatgtc

SEQ ID NO: 1163624 - DNA, 22 bp, Artificial Sequence
  chemically synthesized
acctcatcagaaatttatgtcc

SEQ ID NO: 1163625 - DNA, 22 bp, Artificial Sequence
  chemically synthesized
tgttgcttttatggacataaat

SEQ ID NO: 1163626 - DNA, 22 bp, Artificial Sequence
  chemically synthesized
cctcatcagaaatttatgtcca

SEQ ID NO: 1163627 - DNA, 22 bp, Artificial Sequence
  chemically synthesized
atcagaaatttatgtccataaa

SEQ ID NO: 1163628 - DNA, 22 bp, Artificial Sequence
  chemically synthesized
caattctgttgcttttatggac

SEQ ID NO: 1163629 - DNA, 22 bp, Artificial Sequence
  chemically synthesized
cctccaattctgttgcttttat

SEQ ID NO: 1163630 - DNA, 22 bp, Artificial Sequence
  chemically synthesized
ccctccaattctgttgctttta

SEQ ID NO: 1163631 - DNA, 22 bp, Artificial Sequence
  chemically synthesized
tccctccaattctgttgctttt

SEQ ID NO: 1163632 - DNA, 22 bp, Artificial Sequence
  chemically synthesized
atgtccataaaagcaacagaat

SEQ ID NO: 1163633 - DNA, 22 bp, Artificial Sequence
  chemically synthesized
tgtccataaaagcaacagaatt

SEQ ID NO: 1163634 - DNA, 22 bp, Artificial Sequence
  chemically synthesized
tattttccctccaattctgttg

SEQ ID NO: 1163635 - DNA, 22 bp, Artificial Sequence
  chemically synthesized
ttgtattttccctccaattctg

SEQ ID NO: 1163636 - DNA, 22 bp, Artificial Sequence
  chemically synthesized
ctattgtattttccctccaatt

SEQ ID NO: 1163637 - DNA, 22 bp, Artificial Sequence
  chemically synthesized
gctattgtattttccctccaat

SEQ ID NO: 1163638 - DNA, 22 bp, Artificial Sequence
  chemically synthesized
cttgctattgtattttccctcc

SEQ ID NO: 1163639 - DNA, 22 bp, Artificial Sequence
  chemically synthesized
ccttgctattgtattttccctc

SEQ ID NO: 1163640 - DNA, 22 bp, Artificial Sequence
  chemically synthesized
tccttgctattgtattttccct

SEQ ID NO: 1163641 - DNA, 22 bp, Artificial Sequence
  chemically synthesized
tttccttgctattgtattttcc

SEQ ID NO: 1163642 - DNA, 22 bp, Artificial Sequence
  chemically synthesized
attctttccttgctattgtatt

SEQ ID NO: 1163643 - DNA, 22 bp, Artificial Sequence
  chemically synthesized
gattctttccttgctattgtat

SEQ ID NO: 1163644 - DNA, 22 bp, Artificial Sequence
  chemically synthesized
gagggaaaatacaatagcaagg

SEQ ID NO: 1163645 - DNA, 22 bp, Artificial Sequence
  chemically synthesized
atttgattctttccttgctatt

SEQ ID NO: 1163646 - DNA, 22 bp, Artificial Sequence
  chemically synthesized
tcatttgattctttccttgcta

SEQ ID NO: 1163647 - DNA, 22 bp, Artificial Sequence
  chemically synthesized
ataaccacactctcatttgatt

SEQ ID NO: 1163648 - DNA, 22 bp, Artificial Sequence
  chemically synthesized
cataaccacactctcatttgat

SEQ ID NO: 1163649 - DNA, 22 bp, Artificial Sequence
  chemically synthesized
cttcataaccacactctcattt

SEQ ID NO: 1163650 - DNA, 22 bp, Artificial Sequence
  chemically synthesized
tccttcataaccacactctcat

SEQ ID NO: 1163651 - DNA, 22 bp, Artificial Sequence
  chemically synthesized
ctccttcataaccacactctca

SEQ ID NO: 1163652 - DNA, 22 bp, Artificial Sequence
  chemically synthesized
tctccttcataaccacactctc

SEQ ID NO: 1163653 - DNA, 22 bp, Artificial Sequence
  chemically synthesized
tttctccttcataaccacactc

SEQ ID NO: 1163654 - DNA, 22 bp, Artificial Sequence
  chemically synthesized
ctttctccttcataaccacact

SEQ ID NO: 1163655 - DNA, 22 bp, Artificial Sequence
  chemically synthesized
tctttctccttcataaccacac

SEQ ID NO: 1163656 - DNA, 22 bp, Artificial Sequence
  chemically synthesized
ctttctttctccttcataacca

SEQ ID NO: 1163657 - DNA, 22 bp, Artificial Sequence
  chemically synthesized
ctcctttctttctccttcataa

SEQ ID NO: 1163658 - DNA, 22 bp, Artificial Sequence
  chemically synthesized
cctcctttctttctccttcata

SEQ ID NO: 1163659 - DNA, 22 bp, Artificial Sequence
  chemically synthesized
tgaaggagaaagaaaggaggaa

SEQ ID NO: 1163660 - DNA, 22 bp, Artificial Sequence
  chemically synthesized
caaaggaatgtcaggaaagata

SEQ ID NO: 1163661 - DNA, 22 bp, Artificial Sequence
  chemically synthesized
acaaaggaatgtcaggaaagat

SEQ ID NO: 1163662 - DNA, 22 bp, Artificial Sequence
  chemically synthesized
tatggttatctttcctgacatt

SEQ ID NO: 1163663 - DNA, 22 bp, Artificial Sequence
  chemically synthesized
aaaatatgcttacaaaggaatg

SEQ ID NO: 1163664 - DNA, 22 bp, Artificial Sequence
  chemically synthesized
aaaaatatgcttacaaaggaat

SEQ ID NO: 1163665 - DNA, 22 bp, Artificial Sequence
  chemically synthesized
tctttcctgacattcctttgta

SEQ ID NO: 1163666 - DNA, 22 bp, Artificial Sequence
  chemically synthesized
tcctgacattcctttgtaagca

SEQ ID NO: 1163667 - DNA, 22 bp, Artificial Sequence
  chemically synthesized
cctgacattcctttgtaagcat

SEQ ID NO: 1163668 - DNA, 22 bp, Artificial Sequence
  chemically synthesized
ctgacattcctttgtaagcata

SEQ ID NO: 1163669 - DNA, 22 bp, Artificial Sequence
  chemically synthesized
acattcctttgtaagcatattt

SEQ ID NO: 1163670 - DNA, 22 bp, Artificial Sequence
  chemically synthesized
acaatggcaacatttaaaaata

SEQ ID NO: 1163671 - DNA, 22 bp, Artificial Sequence
  chemically synthesized
ctttgtaagcatatttttaaat

SEQ ID NO: 1163672 - DNA, 22 bp, Artificial Sequence
  chemically synthesized
cacaatggcaacatttaaaaat

SEQ ID NO: 1163673 - DNA, 22 bp, Artificial Sequence
  chemically synthesized
tcacaatggcaacatttaaaaa

SEQ ID NO: 1163674 - DNA, 22 bp, Artificial Sequence
  chemically synthesized
ttcacaatggcaacatttaaaa

SEQ ID NO: 1163675 - DNA, 22 bp, Artificial Sequence
  chemically synthesized
tgtaagcatatttttaaatgtt

SEQ ID NO: 1163676 - DNA, 22 bp, Artificial Sequence
  chemically synthesized
tttcacaatggcaacatttaaa

SEQ ID NO: 1163677 - DNA, 22 bp, Artificial Sequence
  chemically synthesized
gtaagcatatttttaaatgttg

SEQ ID NO: 1163678 - DNA, 22 bp, Artificial Sequence
  chemically synthesized
taagcatatttttaaatgttgc

SEQ ID NO: 1163679 - DNA, 22 bp, Artificial Sequence
  chemically synthesized
ttttttcacaatggcaacattt

SEQ ID NO: 1163680 - DNA, 22 bp, Artificial Sequence
  chemically synthesized
cagttattttttcacaatggca

SEQ ID NO: 1163681 - DNA, 22 bp, Artificial Sequence
  chemically synthesized
gcagttattttttcacaatggc

SEQ ID NO: 1163682 - DNA, 22 bp, Artificial Sequence
  chemically synthesized
ttaaatgttgccattgtgaaaa

SEQ ID NO: 1163683 - DNA, 22 bp, Artificial Sequence
  chemically synthesized
taaatgttgccattgtgaaaaa

SEQ ID NO: 1163684 - DNA, 22 bp, Artificial Sequence
  chemically synthesized
aaatgttgccattgtgaaaaaa

SEQ ID NO: 1163685 - DNA, 22 bp, Artificial Sequence
  chemically synthesized
aatgttgccattgtgaaaaaat

SEQ ID NO: 1163686 - DNA, 22 bp, Artificial Sequence
  chemically synthesized
gaaatacatttgcagttatttt

SEQ ID NO: 1163687 - DNA, 22 bp, Artificial Sequence
  chemically synthesized
ccattgtgaaaaaataactgca

SEQ ID NO: 1163688 - DNA, 22 bp, Artificial Sequence
  chemically synthesized
tgaaaaaataactgcaaatgta

SEQ ID NO: 1163689 - DNA, 22 bp, Artificial Sequence
  chemically synthesized
caaatgtatttctaatcatcct

SEQ ID NO: 1163690 - DNA, 22 bp, Artificial Sequence
  chemically synthesized
ctaatcatcctgctcatgctcc

SEQ ID NO: 1163691 - DNA, 22 bp, Artificial Sequence
  chemically synthesized
tatggggataagggagcatgag

SEQ ID NO: 1163692 - DNA, 22 bp, Artificial Sequence
  chemically synthesized
taatcatcctgctcatgctccc

SEQ ID NO: 1163693 - DNA, 22 bp, Artificial Sequence
  chemically synthesized
gtatggggataagggagcatga

SEQ ID NO: 1163694 - DNA, 22 bp, Artificial Sequence
  chemically synthesized
tgtatggggataagggagcatg

SEQ ID NO: 1163695 - DNA, 22 bp, Artificial Sequence
  chemically synthesized
atcatcctgctcatgctccctt

SEQ ID NO: 1163696 - DNA, 22 bp, Artificial Sequence
  chemically synthesized
ttttgtatggggataagggagc

SEQ ID NO: 1163697 - DNA, 22 bp, Artificial Sequence
  chemically synthesized
tggttattttgtatggggataa

SEQ ID NO: 1163698 - DNA, 22 bp, Artificial Sequence
  chemically synthesized
ctcatgctcccttatccccata

SEQ ID NO: 1163699 - DNA, 22 bp, Artificial Sequence
  chemically synthesized
atgctcccttatccccatacaa

SEQ ID NO: 1163700 - DNA, 22 bp, Artificial Sequence
  chemically synthesized
ccttatccccatacaaaataac

SEQ ID NO: 1163701 - DNA, 22 bp, Artificial Sequence
  chemically synthesized
atccccatacaaaataaccaca

SEQ ID NO: 1163702 - DNA, 22 bp, Artificial Sequence
  chemically synthesized
tccccatacaaaataaccacag

SEQ ID NO: 1163703 - DNA, 22 bp, Artificial Sequence
  chemically synthesized
ccaaagagtatagctgtggtta

SEQ ID NO: 1163704 - DNA, 22 bp, Artificial Sequence
  chemically synthesized
cccaaagagtatagctgtggtt

SEQ ID NO: 1163705 - DNA, 22 bp, Artificial Sequence
  chemically synthesized
tcccaaagagtatagctgtggt

SEQ ID NO: 1163706 - DNA, 22 bp, Artificial Sequence
  chemically synthesized
ttcccaaagagtatagctgtgg

SEQ ID NO: 1163707 - DNA, 22 bp, Artificial Sequence
  chemically synthesized
tttcccaaagagtatagctgtg

SEQ ID NO: 1163708 - DNA, 22 bp, Artificial Sequence
  chemically synthesized
ttttcccaaagagtatagctgt

SEQ ID NO: 1163709 - DNA, 22 bp, Artificial Sequence
  chemically synthesized
tttttcccaaagagtatagctg

SEQ ID NO: 1163710 - DNA, 22 bp, Artificial Sequence
  chemically synthesized
ttttttcccaaagagtatagct

SEQ ID NO: 1163711 - DNA, 22 bp, Artificial Sequence
  chemically synthesized
agtcatttttttttcccaaaga

SEQ ID NO: 1163712 - DNA, 22 bp, Artificial Sequence
  chemically synthesized
cctcagtcatttttttttccca

SEQ ID NO: 1163713 - DNA, 22 bp, Artificial Sequence
  chemically synthesized
attgcctcagtcattttttttt

SEQ ID NO: 1163714 - DNA, 22 bp, Artificial Sequence
  chemically synthesized
tactctttgggaaaaaaaaatg

SEQ ID NO: 1163715 - DNA, 22 bp, Artificial Sequence
  chemically synthesized
taattgcctcagtcattttttt

SEQ ID NO: 1163716 - DNA, 22 bp, Artificial Sequence
  chemically synthesized
ctaattgcctcagtcatttttt

SEQ ID NO: 1163717 - DNA, 22 bp, Artificial Sequence
  chemically synthesized
tctaattgcctcagtcattttt

SEQ ID NO: 1163718 - DNA, 22 bp, Artificial Sequence
  chemically synthesized
ttctaattgcctcagtcatttt

SEQ ID NO: 1163719 - DNA, 22 bp, Artificial Sequence
  chemically synthesized
tttgggaaaaaaaaatgactga

SEQ ID NO: 1163720 - DNA, 22 bp, Artificial Sequence
  chemically synthesized
tgggaaaaaaaaatgactgagg

SEQ ID NO: 1163721 - DNA, 22 bp, Artificial Sequence
  chemically synthesized
gggaaaaaaaaatgactgaggc

SEQ ID NO: 1163722 - DNA, 22 bp, Artificial Sequence
  chemically synthesized
ggaaaaaaaaatgactgaggca

SEQ ID NO: 1163723 - DNA, 22 bp, Artificial Sequence
  chemically synthesized
cagccttttctaattgcctcag

SEQ ID NO: 1163724 - DNA, 22 bp, Artificial Sequence
  chemically synthesized
tccagccttttctaattgcctc

SEQ ID NO: 1163725 - DNA, 22 bp, Artificial Sequence
  chemically synthesized
ctccagccttttctaattgcct

SEQ ID NO: 1163726 - DNA, 22 bp, Artificial Sequence
  chemically synthesized
tctccagccttttctaattgcc

SEQ ID NO: 1163727 - DNA, 22 bp, Artificial Sequence
  chemically synthesized
ttctccagccttttctaattgc

SEQ ID NO: 1163728 - DNA, 22 bp, Artificial Sequence
  chemically synthesized
tttctccagccttttctaattg

SEQ ID NO: 1163729 - DNA, 22 bp, Artificial Sequence
  chemically synthesized
ttttctccagccttttctaatt

SEQ ID NO: 1163730 - DNA, 22 bp, Artificial Sequence
  chemically synthesized
tttttctccagccttttctaat

SEQ ID NO: 1163731 - DNA, 22 bp, Artificial Sequence
  chemically synthesized
ctttttttctccagccttttct

SEQ ID NO: 1163732 - DNA, 22 bp, Artificial Sequence
  chemically synthesized
actttttttctccagccttttc

SEQ ID NO: 1163733 - DNA, 22 bp, Artificial Sequence
  chemically synthesized
tactttttttctccagcctttt

SEQ ID NO: 1163734 - DNA, 22 bp, Artificial Sequence
  chemically synthesized
ttactttttttctccagccttt

SEQ ID NO: 1163735 - DNA, 22 bp, Artificial Sequence
  chemically synthesized
aggcaattagaaaaggctggag

SEQ ID NO: 1163736 - DNA, 22 bp, Artificial Sequence
  chemically synthesized
tttactttttttctccagcctt

SEQ ID NO: 1163737 - DNA, 22 bp, Artificial Sequence
  chemically synthesized
gaaaaggctggagaaaaaaagt

SEQ ID NO: 1163738 - DNA, 22 bp, Artificial Sequence
  chemically synthesized
atagatgttttttacttttttt

SEQ ID NO: 1163739 - DNA, 22 bp, Artificial Sequence
  chemically synthesized
accctcatagatgttttttact

SEQ ID NO: 1163740 - DNA, 22 bp, Artificial Sequence
  chemically synthesized
gagaaaaaaagtaaaaaacatc

SEQ ID NO: 1163741 - DNA, 22 bp, Artificial Sequence
  chemically synthesized
ccaaacctgaccctcatagatg

SEQ ID NO: 1163742 - DNA, 22 bp, Artificial Sequence
  chemically synthesized
agctaccaaacctgaccctcat

SEQ ID NO: 1163743 - DNA, 22 bp, Artificial Sequence
  chemically synthesized
cagacctgagctaccaaacctg

SEQ ID NO: 1163744 - DNA, 22 bp, Artificial Sequence
  chemically synthesized
tgagggtcaggtttggtagctc

SEQ ID NO: 1163745 - DNA, 22 bp, Artificial Sequence
  chemically synthesized
gtattacagacctgagctacca

SEQ ID NO: 1163746 - DNA, 22 bp, Artificial Sequence
  chemically synthesized
ccaaagtactagtattacagac

SEQ ID NO: 1163747 - DNA, 22 bp, Artificial Sequence
  chemically synthesized
ggtagctcaggtctgtaatact

SEQ ID NO: 1163748 - DNA, 22 bp, Artificial Sequence
  chemically synthesized
gtagctcaggtctgtaatacta

SEQ ID NO: 1163749 - DNA, 22 bp, Artificial Sequence
  chemically synthesized
gcctcccaaagtactagtatta

SEQ ID NO: 1163750 - DNA, 22 bp, Artificial Sequence
  chemically synthesized
ggcctcccaaagtactagtatt

SEQ ID NO: 1163751 - DNA, 22 bp, Artificial Sequence
  chemically synthesized
aggtctgtaatactagtacttt

SEQ ID NO: 1163752 - DNA, 22 bp, Artificial Sequence
  chemically synthesized
ccaccttggcctcccaaagtac

SEQ ID NO: 1163753 - DNA, 22 bp, Artificial Sequence
  chemically synthesized
tcccaccttggcctcccaaagt

SEQ ID NO: 1163754 - DNA, 22 bp, Artificial Sequence
  chemically synthesized
taatactagtactttgggaggc

SEQ ID NO: 1163755 - DNA, 22 bp, Artificial Sequence
  chemically synthesized
gtactttgggaggccaaggtgg

SEQ ID NO: 1163756 - DNA, 22 bp, Artificial Sequence
  chemically synthesized
aagtgatcctctcccaccttgg

SEQ ID NO: 1163757 - DNA, 22 bp, Artificial Sequence
  chemically synthesized
tgggaggccaaggtgggagagg

SEQ ID NO: 1163758 - DNA, 22 bp, Artificial Sequence
  chemically synthesized
gcctcaagtgatcctctcccac

SEQ ID NO: 1163759 - DNA, 22 bp, Artificial Sequence
  chemically synthesized
gggaggccaaggtgggagagga

SEQ ID NO: 1163760 - DNA, 22 bp, Artificial Sequence
  chemically synthesized
ggaggccaaggtgggagaggat

SEQ ID NO: 1163761 - DNA, 22 bp, Artificial Sequence
  chemically synthesized
ctggcctcaagtgatcctctcc

SEQ ID NO: 1163762 - DNA, 22 bp, Artificial Sequence
  chemically synthesized
aagctcctggcctcaagtgatc

SEQ ID NO: 1163763 - DNA, 22 bp, Artificial Sequence
  chemically synthesized
gtctcaagctcctggcctcaag

SEQ ID NO: 1163764 - DNA, 22 bp, Artificial Sequence
  chemically synthesized
ccaggctagtctcaagctcctg

SEQ ID NO: 1163765 - DNA, 22 bp, Artificial Sequence
  chemically synthesized
cccaggctagtctcaagctcct

SEQ ID NO: 1163766 - DNA, 22 bp, Artificial Sequence
  chemically synthesized
tgtttcccaggctagtctcaag

SEQ ID NO: 1163767 - DNA, 22 bp, Artificial Sequence
  chemically synthesized
gaggccaggagcttgagactag

SEQ ID NO: 1163768 - DNA, 22 bp, Artificial Sequence
  chemically synthesized
aggccaggagcttgagactagc

SEQ ID NO: 1163769 - DNA, 22 bp, Artificial Sequence
  chemically synthesized
ttatgtttcccaggctagtctc

SEQ ID NO: 1163770 - DNA, 22 bp, Artificial Sequence
  chemically synthesized
gttatgtttcccaggctagtct

SEQ ID NO: 1163771 - DNA, 22 bp, Artificial Sequence
  chemically synthesized
gagactagcctgggaaacataa

SEQ ID NO: 1163772 - DNA, 22 bp, Artificial Sequence
  chemically synthesized
agactagcctgggaaacataac

SEQ ID NO: 1163773 - DNA, 22 bp, Artificial Sequence
  chemically synthesized
cagggaatgaggtcttgttatg

SEQ ID NO: 1163774 - DNA, 22 bp, Artificial Sequence
  chemically synthesized
gcagggaatgaggtcttgttat

SEQ ID NO: 1163775 - DNA, 22 bp, Artificial Sequence
  chemically synthesized
gcctgggaaacataacaagacc

SEQ ID NO: 1163776 - DNA, 22 bp, Artificial Sequence
  chemically synthesized
tgcagggaatgaggtcttgtta

SEQ ID NO: 1163777 - DNA, 22 bp, Artificial Sequence
  chemically synthesized
ggaaacataacaagacctcatt

SEQ ID NO: 1163778 - DNA, 22 bp, Artificial Sequence
  chemically synthesized
aaaaaattttgcagggaatgag

SEQ ID NO: 1163779 - DNA, 22 bp, Artificial Sequence
  chemically synthesized
aaaaaaattttgcagggaatga

SEQ ID NO: 1163780 - DNA, 22 bp, Artificial Sequence
  chemically synthesized
taaaaaaattttgcagggaatg

SEQ ID NO: 1163781 - DNA, 22 bp, Artificial Sequence
  chemically synthesized
ttaaaaaaattttgcagggaat

SEQ ID NO: 1163782 - DNA, 22 bp, Artificial Sequence
  chemically synthesized
acttttaaaaaaattttgcagg

SEQ ID NO: 1163783 - DNA, 22 bp, Artificial Sequence
  chemically synthesized
aacttttaaaaaaattttgcag

SEQ ID NO: 1163784 - DNA, 22 bp, Artificial Sequence
  chemically synthesized
taacttttaaaaaaattttgca

SEQ ID NO: 1163785 - DNA, 22 bp, Artificial Sequence
  chemically synthesized
ttaacttttaaaaaaattttgc

SEQ ID NO: 1163786 - DNA, 22 bp, Artificial Sequence
  chemically synthesized
tttaacttttaaaaaaattttg

SEQ ID NO: 1163787 - DNA, 22 bp, Artificial Sequence
  chemically synthesized
attccctgcaaaatttttttaa

SEQ ID NO: 1163788 - DNA, 22 bp, Artificial Sequence
  chemically synthesized
cctgcaaaatttttttaaaagt

SEQ ID NO: 1163789 - DNA, 22 bp, Artificial Sequence
  chemically synthesized
tatataattttttaacttttaa

SEQ ID NO: 1163790 - DNA, 22 bp, Artificial Sequence
  chemically synthesized
atatataattttttaactttta

SEQ ID NO: 1163791 - DNA, 22 bp, Artificial Sequence
  chemically synthesized
caaaatttttttaaaagttaaa

SEQ ID NO: 1163792 - DNA, 22 bp, Artificial Sequence
  chemically synthesized
ttttaaaagttaaaaaattata

SEQ ID NO: 1163793 - DNA, 22 bp, Artificial Sequence
  chemically synthesized
tttaaaagttaaaaaattatat

SEQ ID NO: 1163794 - DNA, 22 bp, Artificial Sequence
  chemically synthesized
ttaaaagttaaaaaattatata

SEQ ID NO: 1163795 - DNA, 22 bp, Artificial Sequence
  chemically synthesized
tataataacttatatataattt

SEQ ID NO: 1163796 - DNA, 22 bp, Artificial Sequence
  chemically synthesized
taaaagttaaaaaattatatat

SEQ ID NO: 1163797 - DNA, 22 bp, Artificial Sequence
  chemically synthesized
gtataataacttatatataatt

SEQ ID NO: 1163798 - DNA, 22 bp, Artificial Sequence
  chemically synthesized
aaaagttaaaaaattatatata

SEQ ID NO: 1163799 - DNA, 22 bp, Artificial Sequence
  chemically synthesized
tgtataataacttatatataat

SEQ ID NO: 1163800 - DNA, 22 bp, Artificial Sequence
  chemically synthesized
aaagttaaaaaattatatataa

SEQ ID NO: 1163801 - DNA, 22 bp, Artificial Sequence
  chemically synthesized
aaaaattatatataagttatta

SEQ ID NO: 1163802 - DNA, 22 bp, Artificial Sequence
  chemically synthesized
atatattttgtataataactta

SEQ ID NO: 1163803 - DNA, 22 bp, Artificial Sequence
  chemically synthesized
catatattttgtataataactt

SEQ ID NO: 1163804 - DNA, 22 bp, Artificial Sequence
  chemically synthesized
tatttcatatattttgtataat

SEQ ID NO: 1163805 - DNA, 22 bp, Artificial Sequence
  chemically synthesized
tatataagttattatacaaaat

SEQ ID NO: 1163806 - DNA, 22 bp, Artificial Sequence
  chemically synthesized
tatataattatatttcatatat

SEQ ID NO: 1163807 - DNA, 22 bp, Artificial Sequence
  chemically synthesized
atatataattatatttcatata

SEQ ID NO: 1163808 - DNA, 22 bp, Artificial Sequence
  chemically synthesized
tatatataattatatttcatat

SEQ ID NO: 1163809 - DNA, 22 bp, Artificial Sequence
  chemically synthesized
ttatacaaaatatatgaaatat

SEQ ID NO: 1163810 - DNA, 22 bp, Artificial Sequence
  chemically synthesized
tacaaaatatatgaaatataat

SEQ ID NO: 1163811 - DNA, 22 bp, Artificial Sequence
  chemically synthesized
tataattttatatataattata

SEQ ID NO: 1163812 - DNA, 22 bp, Artificial Sequence
  chemically synthesized
tatgaagtattatataatttta

SEQ ID NO: 1163813 - DNA, 22 bp, Artificial Sequence
  chemically synthesized
tatatgaagtattatataattt

SEQ ID NO: 1163814 - DNA, 22 bp, Artificial Sequence
  chemically synthesized
ctatatgaagtattatataatt

SEQ ID NO: 1163815 - DNA, 22 bp, Artificial Sequence
  chemically synthesized
tctatatgaagtattatataat

SEQ ID NO: 1163816 - DNA, 22 bp, Artificial Sequence
  chemically synthesized
tatataaaattatataatactt

SEQ ID NO: 1163817 - DNA, 22 bp, Artificial Sequence
  chemically synthesized
atattttctatatgaagtatta

SEQ ID NO: 1163818 - DNA, 22 bp, Artificial Sequence
  chemically synthesized
gatattttctatatgaagtatt

SEQ ID NO: 1163819 - DNA, 22 bp, Artificial Sequence
  chemically synthesized
tataatacttcatatagaaaat

SEQ ID NO: 1163820 - DNA, 22 bp, Artificial Sequence
  chemically synthesized
tatgtaatttgatattttctat

SEQ ID NO: 1163821 - DNA, 22 bp, Artificial Sequence
  chemically synthesized
atatgtaatttgatattttcta

SEQ ID NO: 1163822 - DNA, 22 bp, Artificial Sequence
  chemically synthesized
tatatgtaatttgatattttct

SEQ ID NO: 1163823 - DNA, 22 bp, Artificial Sequence
  chemically synthesized
ttatatgtaatttgatattttc

SEQ ID NO: 1163824 - DNA, 22 bp, Artificial Sequence
  chemically synthesized
tttatatgtaatttgatatttt

SEQ ID NO: 1163825 - DNA, 22 bp, Artificial Sequence
  chemically synthesized
catatagaaaatatcaaattac

SEQ ID NO: 1163826 - DNA, 22 bp, Artificial Sequence
  chemically synthesized
atatagaaaatatcaaattaca

SEQ ID NO: 1163827 - DNA, 22 bp, Artificial Sequence
  chemically synthesized
ccataccatgtcactttttata

SEQ ID NO: 1163828 - DNA, 22 bp, Artificial Sequence
  chemically synthesized
accataccatgtcactttttat

SEQ ID NO: 1163829 - DNA, 22 bp, Artificial Sequence
  chemically synthesized
taccataccatgtcacttttta

SEQ ID NO: 1163830 - DNA, 22 bp, Artificial Sequence
  chemically synthesized
ttttaccataccatgtcacttt

SEQ ID NO: 1163831 - DNA, 22 bp, Artificial Sequence
  chemically synthesized
actattttaccataccatgtca

SEQ ID NO: 1163832 - DNA, 22 bp, Artificial Sequence
  chemically synthesized
catataaaaagtgacatggtat

SEQ ID NO: 1163833 - DNA, 22 bp, Artificial Sequence
  chemically synthesized
tcagttaactattttaccatac

SEQ ID NO: 1163834 - DNA, 22 bp, Artificial Sequence
  chemically synthesized
tgataaataagatgatgagctg

SEQ ID NO: 1163835 - DNA, 22 bp, Artificial Sequence
  chemically synthesized
actgacagctcatcatcttatt

SEQ ID NO: 1163836 - DNA, 22 bp, Artificial Sequence
  chemically synthesized
acagctcatcatcttatttatc

SEQ ID NO: 1163837 - DNA, 22 bp, Artificial Sequence
  chemically synthesized
atcatcttatttatcacagtta

SEQ ID NO: 1163838 - DNA, 22 bp, Artificial Sequence
  chemically synthesized
taaaatgtgaagaaagataact

SEQ ID NO: 1163839 - DNA, 22 bp, Artificial Sequence
  chemically synthesized
atttatcacagttatctttctt

SEQ ID NO: 1163840 - DNA, 22 bp, Artificial Sequence
  chemically synthesized
ttataaaatgtgaagaaagata

SEQ ID NO: 1163841 - DNA, 22 bp, Artificial Sequence
  chemically synthesized
tttatcacagttatctttcttc

SEQ ID NO: 1163842 - DNA, 22 bp, Artificial Sequence
  chemically synthesized
atcacagttatctttcttcaca

SEQ ID NO: 1163843 - DNA, 22 bp, Artificial Sequence
  chemically synthesized
tcacagttatctttcttcacat

SEQ ID NO: 1163844 - DNA, 22 bp, Artificial Sequence
  chemically synthesized
tctttcttcacattttataata

SEQ ID NO: 1163845 - DNA, 22 bp, Artificial Sequence
  chemically synthesized
tgaatgcaaaattattataaaa

SEQ ID NO: 1163846 - DNA, 22 bp, Artificial Sequence
  chemically synthesized
gtgaatgcaaaattattataaa

SEQ ID NO: 1163847 - DNA, 22 bp, Artificial Sequence
  chemically synthesized
tcttcacattttataataattt

SEQ ID NO: 1163848 - DNA, 22 bp, Artificial Sequence
  chemically synthesized
cttcacattttataataatttt

SEQ ID NO: 1163849 - DNA, 22 bp, Artificial Sequence
  chemically synthesized
gtttgtgaatgcaaaattatta

SEQ ID NO: 1163850 - DNA, 22 bp, Artificial Sequence
  chemically synthesized
ttcacattttataataattttg

SEQ ID NO: 1163851 - DNA, 22 bp, Artificial Sequence
  chemically synthesized
cacattttataataattttgca

SEQ ID NO: 1163852 - DNA, 22 bp, Artificial Sequence
  chemically synthesized
acattttataataattttgcat

SEQ ID NO: 1163853 - DNA, 22 bp, Artificial Sequence
  chemically synthesized
tataataattttgcattcacaa

SEQ ID NO: 1163854 - DNA, 22 bp, Artificial Sequence
  chemically synthesized
ataataattttgcattcacaaa

SEQ ID NO: 1163855 - DNA, 22 bp, Artificial Sequence
  chemically synthesized
taataattttgcattcacaaac

SEQ ID NO: 1163856 - DNA, 22 bp, Artificial Sequence
  chemically synthesized
tgcattcacaaactaacttttt

SEQ ID NO: 1163857 - DNA, 22 bp, Artificial Sequence
  chemically synthesized
gcattcacaaactaacttttta

SEQ ID NO: 1163858 - DNA, 22 bp, Artificial Sequence
  chemically synthesized
cattcacaaactaactttttat

SEQ ID NO: 1163859 - DNA, 22 bp, Artificial Sequence
  chemically synthesized
gatgagatagggtataaaaagt

SEQ ID NO: 1163860 - DNA, 22 bp, Artificial Sequence
  chemically synthesized
acaaactaactttttataccct

SEQ ID NO: 1163861 - DNA, 22 bp, Artificial Sequence
  chemically synthesized
aaagatactagatgagataggg

SEQ ID NO: 1163862 - DNA, 22 bp, Artificial Sequence
  chemically synthesized
actttttataccctatctcatc

SEQ ID NO: 1163863 - DNA, 22 bp, Artificial Sequence
  chemically synthesized
tgaaagatactagatgagatag

SEQ ID NO: 1163864 - DNA, 22 bp, Artificial Sequence
  chemically synthesized
tttataccctatctcatctagt

SEQ ID NO: 1163865 - DNA, 22 bp, Artificial Sequence
  chemically synthesized
ttataccctatctcatctagta

SEQ ID NO: 1163866 - DNA, 22 bp, Artificial Sequence
  chemically synthesized
tataccctatctcatctagtat

SEQ ID NO: 1163867 - DNA, 22 bp, Artificial Sequence
  chemically synthesized
ataccctatctcatctagtatc

SEQ ID NO: 1163868 - DNA, 22 bp, Artificial Sequence
  chemically synthesized
taccctatctcatctagtatct

SEQ ID NO: 1163869 - DNA, 22 bp, Artificial Sequence
  chemically synthesized
acatacctctgaaagatactag

SEQ ID NO: 1163870 - DNA, 22 bp, Artificial Sequence
  chemically synthesized
tctcatctagtatctttcagag

SEQ ID NO: 1163871 - DNA, 22 bp, Artificial Sequence
  chemically synthesized
atctagtatctttcagaggtat

SEQ ID NO: 1163872 - DNA, 22 bp, Artificial Sequence
  chemically synthesized
gtatctttcagaggtatgtcag

SEQ ID NO: 1163873 - DNA, 22 bp, Artificial Sequence
  chemically synthesized
tcagaggtatgtcagcctcatg

SEQ ID NO: 1163874 - DNA, 22 bp, Artificial Sequence
  chemically synthesized
cagaggtatgtcagcctcatga

SEQ ID NO: 1163875 - DNA, 22 bp, Artificial Sequence
  chemically synthesized
agaggtatgtcagcctcatgac

SEQ ID NO: 1163876 - DNA, 22 bp, Artificial Sequence
  chemically synthesized
taaaacagcaatagtgtcatga

SEQ ID NO: 1163877 - DNA, 22 bp, Artificial Sequence
  chemically synthesized
gtaaaacagcaatagtgtcatg

SEQ ID NO: 1163878 - DNA, 22 bp, Artificial Sequence
  chemically synthesized
tgtaaaacagcaatagtgtcat

SEQ ID NO: 1163879 - DNA, 22 bp, Artificial Sequence
  chemically synthesized
tagttttgtaaaacagcaatag

SEQ ID NO: 1163880 - DNA, 22 bp, Artificial Sequence
  chemically synthesized
atagttttgtaaaacagcaata

SEQ ID NO: 1163881 - DNA, 22 bp, Artificial Sequence
  chemically synthesized
tatagttttgtaaaacagcaat

SEQ ID NO: 1163882 - DNA, 22 bp, Artificial Sequence
  chemically synthesized
ctttatagttttgtaaaacagc

SEQ ID NO: 1163883 - DNA, 22 bp, Artificial Sequence
  chemically synthesized
atgacactattgctgttttaca

SEQ ID NO: 1163884 - DNA, 22 bp, Artificial Sequence
  chemically synthesized
tactttatagttttgtaaaaca

SEQ ID NO: 1163885 - DNA, 22 bp, Artificial Sequence
  chemically synthesized
tctactttatagttttgtaaaa

SEQ ID NO: 1163886 - DNA, 22 bp, Artificial Sequence
  chemically synthesized
ttctctactttatagttttgta

SEQ ID NO: 1163887 - DNA, 22 bp, Artificial Sequence
  chemically synthesized
tgttctctactttatagttttg

SEQ ID NO: 1163888 - DNA, 22 bp, Artificial Sequence
  chemically synthesized
ttgctgttttacaaaactataa

SEQ ID NO: 1163889 - DNA, 22 bp, Artificial Sequence
  chemically synthesized
ctgttctctactttatagtttt

SEQ ID NO: 1163890 - DNA, 22 bp, Artificial Sequence
  chemically synthesized
tctgttctctactttatagttt

SEQ ID NO: 1163891 - DNA, 22 bp, Artificial Sequence
  chemically synthesized
ttctgttctctactttatagtt

SEQ ID NO: 1163892 - DNA, 22 bp, Artificial Sequence
  chemically synthesized
ctgttttacaaaactataaagt

SEQ ID NO: 1163893 - DNA, 22 bp, Artificial Sequence
  chemically synthesized
ttttctgttctctactttatag

SEQ ID NO: 1163894 - DNA, 22 bp, Artificial Sequence
  chemically synthesized
cttttctgttctctactttata

SEQ ID NO: 1163895 - DNA, 22 bp, Artificial Sequence
  chemically synthesized
ttttacaaaactataaagtaga

SEQ ID NO: 1163896 - DNA, 22 bp, Artificial Sequence
  chemically synthesized
tcttttctgttctctactttat

SEQ ID NO: 1163897 - DNA, 22 bp, Artificial Sequence
  chemically synthesized
ttcttttctgttctctacttta

SEQ ID NO: 1163898 - DNA, 22 bp, Artificial Sequence
  chemically synthesized
tacaaaactataaagtagagaa

SEQ ID NO: 1163899 - DNA, 22 bp, Artificial Sequence
  chemically synthesized
acaaaactataaagtagagaac

SEQ ID NO: 1163900 - DNA, 22 bp, Artificial Sequence
  chemically synthesized
caaaactataaagtagagaaca

SEQ ID NO: 1163901 - DNA, 22 bp, Artificial Sequence
  chemically synthesized
taaagtagagaacagaaaagaa

SEQ ID NO: 1163902 - DNA, 22 bp, Artificial Sequence
  chemically synthesized
gggcaatatacttttcttttct

SEQ ID NO: 1163903 - DNA, 22 bp, Artificial Sequence
  chemically synthesized
tgtgaactggggcaatatactt

SEQ ID NO: 1163904 - DNA, 22 bp, Artificial Sequence
  chemically synthesized
atgtgaactggggcaatatact

SEQ ID NO: 1163905 - DNA, 22 bp, Artificial Sequence
  chemically synthesized
tttatgtgaactggggcaatat

SEQ ID NO: 1163906 - DNA, 22 bp, Artificial Sequence
  chemically synthesized
atttatgtgaactggggcaata

SEQ ID NO: 1163907 - DNA, 22 bp, Artificial Sequence
  chemically synthesized
aaacacttatttatgtgaactg

SEQ ID NO: 1163908 - DNA, 22 bp, Artificial Sequence
  chemically synthesized
tcaaacacttatttatgtgaac

SEQ ID NO: 1163909 - DNA, 22 bp, Artificial Sequence
  chemically synthesized
ctcaaacacttatttatgtgaa

SEQ ID NO: 1163910 - DNA, 22 bp, Artificial Sequence
  chemically synthesized
tctcaaacacttatttatgtga

SEQ ID NO: 1163911 - DNA, 22 bp, Artificial Sequence
  chemically synthesized
ctttctcaaacacttatttatg

SEQ ID NO: 1163912 - DNA, 22 bp, Artificial Sequence
  chemically synthesized
gctttctcaaacacttatttat

SEQ ID NO: 1163913 - DNA, 22 bp, Artificial Sequence
  chemically synthesized
ccccagttcacataaataagtg

SEQ ID NO: 1163914 - DNA, 22 bp, Artificial Sequence
  chemically synthesized
acataaataagtgtttgagaaa

SEQ ID NO: 1163915 - DNA, 22 bp, Artificial Sequence
  chemically synthesized
aggaataagggcttgctttctc

SEQ ID NO: 1163916 - DNA, 22 bp, Artificial Sequence
  chemically synthesized
cctaaggaataagggcttgctt

SEQ ID NO: 1163917 - DNA, 22 bp, Artificial Sequence
  chemically synthesized
gcctaaggaataagggcttgct

SEQ ID NO: 1163918 - DNA, 22 bp, Artificial Sequence
  chemically synthesized
cagtttgcctaaggaataaggg

SEQ ID NO: 1163919 - DNA, 22 bp, Artificial Sequence
  chemically synthesized
gagaaagcaagcccttattcct

SEQ ID NO: 1163920 - DNA, 22 bp, Artificial Sequence
  chemically synthesized
agaaagcaagcccttattcctt

SEQ ID NO: 1163921 - DNA, 22 bp, Artificial Sequence
  chemically synthesized
tccagtttgcctaaggaataag

SEQ ID NO: 1163922 - DNA, 22 bp, Artificial Sequence
  chemically synthesized
cataaaatcctctccagtttgc

SEQ ID NO: 1163923 - DNA, 22 bp, Artificial Sequence
  chemically synthesized
acataaaatcctctccagtttg

SEQ ID NO: 1163924 - DNA, 22 bp, Artificial Sequence
  chemically synthesized
attccttaggcaaactggagag

SEQ ID NO: 1163925 - DNA, 22 bp, Artificial Sequence
  chemically synthesized
ttccttaggcaaactggagagg

SEQ ID NO: 1163926 - DNA, 22 bp, Artificial Sequence
  chemically synthesized
ccttacataaaatcctctccag

SEQ ID NO: 1163927 - DNA, 22 bp, Artificial Sequence
  chemically synthesized
cttaggcaaactggagaggatt

SEQ ID NO: 1163928 - DNA, 22 bp, Artificial Sequence
  chemically synthesized
tgccttacataaaatcctctcc

SEQ ID NO: 1163929 - DNA, 22 bp, Artificial Sequence
  chemically synthesized
ctgccttacataaaatcctctc

SEQ ID NO: 1163930 - DNA, 22 bp, Artificial Sequence
  chemically synthesized
aggcaaactggagaggatttta

SEQ ID NO: 1163931 - DNA, 22 bp, Artificial Sequence
  chemically synthesized
ggcaaactggagaggattttat

SEQ ID NO: 1163932 - DNA, 22 bp, Artificial Sequence
  chemically synthesized
atttctgccttacataaaatcc

SEQ ID NO: 1163933 - DNA, 22 bp, Artificial Sequence
  chemically synthesized
gagaggattttatgtaaggcag

SEQ ID NO: 1163934 - DNA, 22 bp, Artificial Sequence
  chemically synthesized
tatgtaaggcagaaatcagggc

SEQ ID NO: 1163935 - DNA, 22 bp, Artificial Sequence
  chemically synthesized
atgtaaggcagaaatcagggca

SEQ ID NO: 1163936 - DNA, 22 bp, Artificial Sequence
  chemically synthesized
tgtaaggcagaaatcagggcac

SEQ ID NO: 1163937 - DNA, 22 bp, Artificial Sequence
  chemically synthesized
aaaatacaaagataatagcgtg

SEQ ID NO: 1163938 - DNA, 22 bp, Artificial Sequence
  chemically synthesized
ttatctttgtatttttaatatt

SEQ ID NO: 1163939 - DNA, 22 bp, Artificial Sequence
  chemically synthesized
tgcaaaacaagaaatattaaaa

SEQ ID NO: 1163940 - DNA, 22 bp, Artificial Sequence
  chemically synthesized
tctttgtatttttaatatttct

SEQ ID NO: 1163941 - DNA, 22 bp, Artificial Sequence
  chemically synthesized
tgtatttttaatatttcttgtt

SEQ ID NO: 1163942 - DNA, 22 bp, Artificial Sequence
  chemically synthesized
gtatttttaatatttcttgttt

SEQ ID NO: 1163943 - DNA, 22 bp, Artificial Sequence
  chemically synthesized
tatttttaatatttcttgtttt

SEQ ID NO: 1163944 - DNA, 22 bp, Artificial Sequence
  chemically synthesized
ttaatatttcttgttttgcata

SEQ ID NO: 1163945 - DNA, 22 bp, Artificial Sequence
  chemically synthesized
taatatttcttgttttgcataa

SEQ ID NO: 1163946 - DNA, 22 bp, Artificial Sequence
  chemically synthesized
aatatttcttgttttgcataat

SEQ ID NO: 1163947 - DNA, 22 bp, Artificial Sequence
  chemically synthesized
atatttcttgttttgcataatt

SEQ ID NO: 1163948 - DNA, 22 bp, Artificial Sequence
  chemically synthesized
tcccataaaccatcaacaatta

SEQ ID NO: 1163949 - DNA, 22 bp, Artificial Sequence
  chemically synthesized
cttgttttgcataattgttgat

SEQ ID NO: 1163950 - DNA, 22 bp, Artificial Sequence
  chemically synthesized
atcccataaaccatcaacaatt

SEQ ID NO: 1163951 - DNA, 22 bp, Artificial Sequence
  chemically synthesized
ttgttttgcataattgttgatg

SEQ ID NO: 1163952 - DNA, 22 bp, Artificial Sequence
  chemically synthesized
gttttgcataattgttgatggt

SEQ ID NO: 1163953 - DNA, 22 bp, Artificial Sequence
  chemically synthesized
ttttgcataattgttgatggtt

SEQ ID NO: 1163954 - DNA, 22 bp, Artificial Sequence
  chemically synthesized
tgcataattgttgatggtttat

SEQ ID NO: 1163955 - DNA, 22 bp, Artificial Sequence
  chemically synthesized
gcataattgttgatggtttatg

SEQ ID NO: 1163956 - DNA, 22 bp, Artificial Sequence
  chemically synthesized
cataattgttgatggtttatgg

SEQ ID NO: 1163957 - DNA, 22 bp, Artificial Sequence
  chemically synthesized
ggaaataatatttatcccataa

SEQ ID NO: 1163958 - DNA, 22 bp, Artificial Sequence
  chemically synthesized
ttgatggtttatgggataaata

SEQ ID NO: 1163959 - DNA, 22 bp, Artificial Sequence
  chemically synthesized
catctaggaaataatatttatc

SEQ ID NO: 1163960 - DNA, 22 bp, Artificial Sequence
  chemically synthesized
atggtttatgggataaatatta

SEQ ID NO: 1163961 - DNA, 22 bp, Artificial Sequence
  chemically synthesized
aagttgcatctaggaaataata

SEQ ID NO: 1163962 - DNA, 22 bp, Artificial Sequence
  chemically synthesized
atgggataaatattatttccta

SEQ ID NO: 1163963 - DNA, 22 bp, Artificial Sequence
  chemically synthesized
tgggataaatattatttcctag

SEQ ID NO: 1163964 - DNA, 22 bp, Artificial Sequence
  chemically synthesized
ttcaagttgcatctaggaaata

SEQ ID NO: 1163965 - DNA, 22 bp, Artificial Sequence
  chemically synthesized
ttattcaagttgcatctaggaa

SEQ ID NO: 1163966 - DNA, 22 bp, Artificial Sequence
  chemically synthesized
ctattattcaagttgcatctag

SEQ ID NO: 1163967 - DNA, 22 bp, Artificial Sequence
  chemically synthesized
tttcctagatgcaacttgaata

SEQ ID NO: 1163968 - DNA, 22 bp, Artificial Sequence
  chemically synthesized
cctagatgcaacttgaataata

SEQ ID NO: 1163969 - DNA, 22 bp, Artificial Sequence
  chemically synthesized
ctagatgcaacttgaataatag

SEQ ID NO: 1163970 - DNA, 22 bp, Artificial Sequence
  chemically synthesized
tgcccacagttactattattca

SEQ ID NO: 1163971 - DNA, 22 bp, Artificial Sequence
  chemically synthesized
gtgcccacagttactattattc

SEQ ID NO: 1163972 - DNA, 22 bp, Artificial Sequence
  chemically synthesized
gatgcaacttgaataatagtaa

SEQ ID NO: 1163973 - DNA, 22 bp, Artificial Sequence
  chemically synthesized
aatttgtgcccacagttactat

SEQ ID NO: 1163974 - DNA, 22 bp, Artificial Sequence
  chemically synthesized
caatttgtgcccacagttacta

SEQ ID NO: 1163975 - DNA, 22 bp, Artificial Sequence
  chemically synthesized
cttcaatttgtgcccacagtta

SEQ ID NO: 1163976 - DNA, 22 bp, Artificial Sequence
  chemically synthesized
gaataatagtaactgtgggcac

SEQ ID NO: 1163977 - DNA, 22 bp, Artificial Sequence
  chemically synthesized
aataatagtaactgtgggcaca

SEQ ID NO: 1163978 - DNA, 22 bp, Artificial Sequence
  chemically synthesized
gaaatagactgcttcaatttgt

SEQ ID NO: 1163979 - DNA, 22 bp, Artificial Sequence
  chemically synthesized
ggaaatagactgcttcaatttg

SEQ ID NO: 1163980 - DNA, 22 bp, Artificial Sequence
  chemically synthesized
tggaaatagactgcttcaattt

SEQ ID NO: 1163981 - DNA, 22 bp, Artificial Sequence
  chemically synthesized
ctttggaaatagactgcttcaa

SEQ ID NO: 1163982 - DNA, 22 bp, Artificial Sequence
  chemically synthesized
cctttggaaatagactgcttca

SEQ ID NO: 1163983 - DNA, 22 bp, Artificial Sequence
  chemically synthesized
tgggcacaaattgaagcagtct

SEQ ID NO: 1163984 - DNA, 22 bp, Artificial Sequence
  chemically synthesized
tcctttggaaatagactgcttc

SEQ ID NO: 1163985 - DNA, 22 bp, Artificial Sequence
  chemically synthesized
ttcctttggaaatagactgctt

SEQ ID NO: 1163986 - DNA, 22 bp, Artificial Sequence
  chemically synthesized
tttcctttggaaatagactgct

SEQ ID NO: 1163987 - DNA, 22 bp, Artificial Sequence
  chemically synthesized
aagcagtctatttccaaaggaa

SEQ ID NO: 1163988 - DNA, 22 bp, Artificial Sequence
  chemically synthesized
acagtaaaagtgctttttcctt

SEQ ID NO: 1163989 - DNA, 22 bp, Artificial Sequence
  chemically synthesized
gacagtaaaagtgctttttcct

SEQ ID NO: 1163990 - DNA, 22 bp, Artificial Sequence
  chemically synthesized
tgacagtaaaagtgctttttcc

SEQ ID NO: 1163991 - DNA, 22 bp, Artificial Sequence
  chemically synthesized
ttgacagtaaaagtgctttttc

SEQ ID NO: 1163992 - DNA, 22 bp, Artificial Sequence
  chemically synthesized
tttccaaaggaaaaagcacttt

SEQ ID NO: 1163993 - DNA, 22 bp, Artificial Sequence
  chemically synthesized
cttttgacagtaaaagtgcttt

SEQ ID NO: 1163994 - DNA, 22 bp, Artificial Sequence
  chemically synthesized
ccttttgacagtaaaagtgctt

SEQ ID NO: 1163995 - DNA, 22 bp, Artificial Sequence
  chemically synthesized
tccttttgacagtaaaagtgct

SEQ ID NO: 1163996 - DNA, 22 bp, Artificial Sequence
  chemically synthesized
ccaaaggaaaaagcacttttac

SEQ ID NO: 1163997 - DNA, 22 bp, Artificial Sequence
  chemically synthesized
ttccttttgacagtaaaagtgc

SEQ ID NO: 1163998 - DNA, 22 bp, Artificial Sequence
  chemically synthesized
caaaggaaaaagcacttttact

SEQ ID NO: 1163999 - DNA, 22 bp, Artificial Sequence
  chemically synthesized
tttccttttgacagtaaaagtg

SEQ ID NO: 1164000 - DNA, 22 bp, Artificial Sequence
  chemically synthesized
ttttccttttgacagtaaaagt

SEQ ID NO: 1164001 - DNA, 22 bp, Artificial Sequence
  chemically synthesized
tttttccttttgacagtaaaag

SEQ ID NO: 1164002 - DNA, 22 bp, Artificial Sequence
  chemically synthesized
ttttttccttttgacagtaaaa

SEQ ID NO: 1164003 - DNA, 22 bp, Artificial Sequence
  chemically synthesized
tttttttttccttttgacagta

SEQ ID NO: 1164004 - DNA, 22 bp, Artificial Sequence
  chemically synthesized
ctatttttttttccttttgaca

SEQ ID NO: 1164005 - DNA, 22 bp, Artificial Sequence
  chemically synthesized
gttcctatttttttttcctttt

SEQ ID NO: 1164006 - DNA, 22 bp, Artificial Sequence
  chemically synthesized
agttcctatttttttttccttt

SEQ ID NO: 1164007 - DNA, 22 bp, Artificial Sequence
  chemically synthesized
tagttcctatttttttttcctt

SEQ ID NO: 1164008 - DNA, 22 bp, Artificial Sequence
  chemically synthesized
ttactgtcaaaaggaaaaaaaa

SEQ ID NO: 1164009 - DNA, 22 bp, Artificial Sequence
  chemically synthesized
tactgtcaaaaggaaaaaaaaa

SEQ ID NO: 1164010 - DNA, 22 bp, Artificial Sequence
  chemically synthesized
actgtcaaaaggaaaaaaaaat

SEQ ID NO: 1164011 - DNA, 22 bp, Artificial Sequence
  chemically synthesized
gttttagttcctattttttttt

SEQ ID NO: 1164012 - DNA, 22 bp, Artificial Sequence
  chemically synthesized
ctgtcaaaaggaaaaaaaaata

SEQ ID NO: 1164013 - DNA, 22 bp, Artificial Sequence
  chemically synthesized
agttttagttcctatttttttt

SEQ ID NO: 1164014 - DNA, 22 bp, Artificial Sequence
  chemically synthesized
tcaaaaggaaaaaaaaatagga

SEQ ID NO: 1164015 - DNA, 22 bp, Artificial Sequence
  chemically synthesized
tttagttttagttcctattttt

SEQ ID NO: 1164016 - DNA, 22 bp, Artificial Sequence
  chemically synthesized
tgtttagttttagttcctattt

SEQ ID NO: 1164017 - DNA, 22 bp, Artificial Sequence
  chemically synthesized
tctgtttagttttagttcctat

SEQ ID NO: 1164018 - DNA, 22 bp, Artificial Sequence
  chemically synthesized
ctctgtttagttttagttccta

SEQ ID NO: 1164019 - DNA, 22 bp, Artificial Sequence
  chemically synthesized
aaaaccacttctctgtttagtt

SEQ ID NO: 1164020 - DNA, 22 bp, Artificial Sequence
  chemically synthesized
aaaaaccacttctctgtttagt

SEQ ID NO: 1164021 - DNA, 22 bp, Artificial Sequence
  chemically synthesized
taaaaaccacttctctgtttag

SEQ ID NO: 1164022 - DNA, 22 bp, Artificial Sequence
  chemically synthesized
ttttaaaaaccacttctctgtt

SEQ ID NO: 1164023 - DNA, 22 bp, Artificial Sequence
  chemically synthesized
gttattttaaaaaccacttctc

SEQ ID NO: 1164024 - DNA, 22 bp, Artificial Sequence
  chemically synthesized
agttattttaaaaaccacttct

SEQ ID NO: 1164025 - DNA, 22 bp, Artificial Sequence
  chemically synthesized
aaactaaacagagaagtggttt

SEQ ID NO: 1164026 - DNA, 22 bp, Artificial Sequence
  chemically synthesized
aacagagaagtggtttttaaaa

SEQ ID NO: 1164027 - DNA, 22 bp, Artificial Sequence
  chemically synthesized
gccatttagttattttaaaaac

SEQ ID NO: 1164028 - DNA, 22 bp, Artificial Sequence
  chemically synthesized
agccatttagttattttaaaaa

SEQ ID NO: 1164029 - DNA, 22 bp, Artificial Sequence
  chemically synthesized
tcttagccatttagttatttta

SEQ ID NO: 1164030 - DNA, 22 bp, Artificial Sequence
  chemically synthesized
ctatcttagccatttagttatt

SEQ ID NO: 1164031 - DNA, 22 bp, Artificial Sequence
  chemically synthesized
actatcttagccatttagttat

SEQ ID NO: 1164032 - DNA, 22 bp, Artificial Sequence
  chemically synthesized
tactatcttagccatttagtta

SEQ ID NO: 1164033 - DNA, 22 bp, Artificial Sequence
  chemically synthesized
ttaaaataactaaatggctaag

SEQ ID NO: 1164034 - DNA, 22 bp, Artificial Sequence
  chemically synthesized
taaaataactaaatggctaaga

SEQ ID NO: 1164035 - DNA, 22 bp, Artificial Sequence
  chemically synthesized
aaaataactaaatggctaagat

SEQ ID NO: 1164036 - DNA, 22 bp, Artificial Sequence
  chemically synthesized
aaataactaaatggctaagata

SEQ ID NO: 1164037 - DNA, 22 bp, Artificial Sequence
  chemically synthesized
tgataaaagtatactttactat

SEQ ID NO: 1164038 - DNA, 22 bp, Artificial Sequence
  chemically synthesized
aatggctaagatagtaaagtat

SEQ ID NO: 1164039 - DNA, 22 bp, Artificial Sequence
  chemically synthesized
gtagttgtgataaaagtatact

SEQ ID NO: 1164040 - DNA, 22 bp, Artificial Sequence
  chemically synthesized
agatagtaaagtatacttttat

SEQ ID NO: 1164041 - DNA, 22 bp, Artificial Sequence
  chemically synthesized
gaccagctggtagttgtgataa

SEQ ID NO: 1164042 - DNA, 22 bp, Artificial Sequence
  chemically synthesized
agaccagctggtagttgtgata

SEQ ID NO: 1164043 - DNA, 22 bp, Artificial Sequence
  chemically synthesized
ttatcacaactaccagctggtc

SEQ ID NO: 1164044 - DNA, 22 bp, Artificial Sequence
  chemically synthesized
tatcacaactaccagctggtct

SEQ ID NO: 1164045 - DNA, 22 bp, Artificial Sequence
  chemically synthesized
atcacaactaccagctggtcta

SEQ ID NO: 1164046 - DNA, 22 bp, Artificial Sequence
  chemically synthesized
tcacaactaccagctggtctaa

SEQ ID NO: 1164047 - DNA, 22 bp, Artificial Sequence
  chemically synthesized
agacacagtagtgtcttagacc

SEQ ID NO: 1164048 - DNA, 22 bp, Artificial Sequence
  chemically synthesized
ccagctggtctaagacactact

SEQ ID NO: 1164049 - DNA, 22 bp, Artificial Sequence
  chemically synthesized
gccagttaagacacagtagtgt

SEQ ID NO: 1164050 - DNA, 22 bp, Artificial Sequence
  chemically synthesized
gtctaagacactactgtgtctt

SEQ ID NO: 1164051 - DNA, 22 bp, Artificial Sequence
  chemically synthesized
agacactactgtgtcttaactg

SEQ ID NO: 1164052 - DNA, 22 bp, Artificial Sequence
  chemically synthesized
ggccagtgaagttggccagtta

SEQ ID NO: 1164053 - DNA, 22 bp, Artificial Sequence
  chemically synthesized
ttaggccagtgaagttggccag

SEQ ID NO: 1164054 - DNA, 22 bp, Artificial Sequence
  chemically synthesized
ctgtgtcttaactggccaactt

SEQ ID NO: 1164055 - DNA, 22 bp, Artificial Sequence
  chemically synthesized
tgtcttaactggccaacttcac

SEQ ID NO: 1164056 - DNA, 22 bp, Artificial Sequence
  chemically synthesized
aactggccaacttcactggcct

SEQ ID NO: 1164057 - DNA, 22 bp, Artificial Sequence
  chemically synthesized
actggccaacttcactggccta

SEQ ID NO: 1164058 - DNA, 22 bp, Artificial Sequence
  chemically synthesized
gccaacttcactggcctaataa

SEQ ID NO: 1164059 - DNA, 22 bp, Artificial Sequence
  chemically synthesized
gaggaagagaggacagttatta

SEQ ID NO: 1164060 - DNA, 22 bp, Artificial Sequence
  chemically synthesized
cactggcctaataactgtcctc

SEQ ID NO: 1164061 - DNA, 22 bp, Artificial Sequence
  chemically synthesized
actggcctaataactgtcctct

SEQ ID NO: 1164062 - DNA, 22 bp, Artificial Sequence
  chemically synthesized
gcctaataactgtcctctcttc

SEQ ID NO: 1164063 - DNA, 22 bp, Artificial Sequence
  chemically synthesized
ataactgtcctctcttcctcca

SEQ ID NO: 1164064 - DNA, 22 bp, Artificial Sequence
  chemically synthesized
tcaggaaggccactggaggaag

SEQ ID NO: 1164065 - DNA, 22 bp, Artificial Sequence
  chemically synthesized
tcctctcttcctccagtggcct

SEQ ID NO: 1164066 - DNA, 22 bp, Artificial Sequence
  chemically synthesized
tcttcctccagtggccttcctg

SEQ ID NO: 1164067 - DNA, 22 bp, Artificial Sequence
  chemically synthesized
ttcctccagtggccttcctgat

SEQ ID NO: 1164068 - DNA, 22 bp, Artificial Sequence
  chemically synthesized
cctccagtggccttcctgatag

SEQ ID NO: 1164069 - DNA, 22 bp, Artificial Sequence
  chemically synthesized
ctccagtggccttcctgatagg

SEQ ID NO: 1164070 - DNA, 22 bp, Artificial Sequence
  chemically synthesized
cagtggccttcctgataggttt

SEQ ID NO: 1164071 - DNA, 22 bp, Artificial Sequence
  chemically synthesized
cctgataggttttcttgaccta

SEQ ID NO: 1164072 - DNA, 22 bp, Artificial Sequence
  chemically synthesized
ctgataggttttcttgacctat

SEQ ID NO: 1164073 - DNA, 22 bp, Artificial Sequence
  chemically synthesized
tgtaggtgagagataggtcaag

SEQ ID NO: 1164074 - DNA, 22 bp, Artificial Sequence
  chemically synthesized
atgtaggtgagagataggtcaa

SEQ ID NO: 1164075 - DNA, 22 bp, Artificial Sequence
  chemically synthesized
tatgtaggtgagagataggtca

SEQ ID NO: 1164076 - DNA, 22 bp, Artificial Sequence
  chemically synthesized
ataggttttcttgacctatctc

SEQ ID NO: 1164077 - DNA, 22 bp, Artificial Sequence
  chemically synthesized
tcttgacctatctctcacctac

SEQ ID NO: 1164078 - DNA, 22 bp, Artificial Sequence
  chemically synthesized
cttgacctatctctcacctaca

SEQ ID NO: 1164079 - DNA, 22 bp, Artificial Sequence
  chemically synthesized
ttgacctatctctcacctacat

SEQ ID NO: 1164080 - DNA, 22 bp, Artificial Sequence
  chemically synthesized
gacctatctctcacctacataa

SEQ ID NO: 1164081 - DNA, 22 bp, Artificial Sequence
  chemically synthesized
acctatctctcacctacataaa

SEQ ID NO: 1164082 - DNA, 22 bp, Artificial Sequence
  chemically synthesized
tctctcacctacataaaatctg

SEQ ID NO: 1164083 - DNA, 22 bp, Artificial Sequence
  chemically synthesized
tcacctacataaaatctgatgg

SEQ ID NO: 1164084 - DNA, 22 bp, Artificial Sequence
  chemically synthesized
acctacataaaatctgatggct

SEQ ID NO: 1164085 - DNA, 22 bp, Artificial Sequence
  chemically synthesized
agtgcaagacaaagccatcaga

SEQ ID NO: 1164086 - DNA, 22 bp, Artificial Sequence
  chemically synthesized
cataaaatctgatggctttgtc

SEQ ID NO: 1164087 - DNA, 22 bp, Artificial Sequence
  chemically synthesized
gactaagtgcaagacaaagcca

SEQ ID NO: 1164088 - DNA, 22 bp, Artificial Sequence
  chemically synthesized
tagactaagtgcaagacaaagc

SEQ ID NO: 1164089 - DNA, 22 bp, Artificial Sequence
  chemically synthesized
aattctagactaagtgcaagac

SEQ ID NO: 1164090 - DNA, 22 bp, Artificial Sequence
  chemically synthesized
gaattctagactaagtgcaaga

SEQ ID NO: 1164091 - DNA, 22 bp, Artificial Sequence
  chemically synthesized
tgaattctagactaagtgcaag

SEQ ID NO: 1164092 - DNA, 22 bp, Artificial Sequence
  chemically synthesized
atggctttgtcttgcacttagt

SEQ ID NO: 1164093 - DNA, 22 bp, Artificial Sequence
  chemically synthesized
tgtcttgcacttagtctagaat

SEQ ID NO: 1164094 - DNA, 22 bp, Artificial Sequence
  chemically synthesized
gtcttgcacttagtctagaatt

SEQ ID NO: 1164095 - DNA, 22 bp, Artificial Sequence
  chemically synthesized
tcttgcacttagtctagaattc

SEQ ID NO: 1164096 - DNA, 22 bp, Artificial Sequence
  chemically synthesized
aataagggctttgaattctaga

SEQ ID NO: 1164097 - DNA, 22 bp, Artificial Sequence
  chemically synthesized
gaataagggctttgaattctag

SEQ ID NO: 1164098 - DNA, 22 bp, Artificial Sequence
  chemically synthesized
tgaataagggctttgaattcta

SEQ ID NO: 1164099 - DNA, 22 bp, Artificial Sequence
  chemically synthesized
gcacttagtctagaattcaaag

SEQ ID NO: 1164100 - DNA, 22 bp, Artificial Sequence
  chemically synthesized
cacttagtctagaattcaaagc

SEQ ID NO: 1164101 - DNA, 22 bp, Artificial Sequence
  chemically synthesized
agtctagaattcaaagccctta

SEQ ID NO: 1164102 - DNA, 22 bp, Artificial Sequence
  chemically synthesized
gtctagaattcaaagcccttat

SEQ ID NO: 1164103 - DNA, 22 bp, Artificial Sequence
  chemically synthesized
gaattcaaagcccttattcaaa

SEQ ID NO: 1164104 - DNA, 22 bp, Artificial Sequence
  chemically synthesized
tagtgtcagtcagggctttgaa

SEQ ID NO: 1164105 - DNA, 22 bp, Artificial Sequence
  chemically synthesized
aaagcccttattcaaagccctg

SEQ ID NO: 1164106 - DNA, 22 bp, Artificial Sequence
  chemically synthesized
catattgtagtgtcagtcaggg

SEQ ID NO: 1164107 - DNA, 22 bp, Artificial Sequence
  chemically synthesized
attcaaagccctgactgacact

SEQ ID NO: 1164108 - DNA, 22 bp, Artificial Sequence
  chemically synthesized
attacatattgtagtgtcagtc

SEQ ID NO: 1164109 - DNA, 22 bp, Artificial Sequence
  chemically synthesized
ttcaaagccctgactgacacta

SEQ ID NO: 1164110 - DNA, 22 bp, Artificial Sequence
  chemically synthesized
aaagccctgactgacactacaa

SEQ ID NO: 1164111 - DNA, 22 bp, Artificial Sequence
  chemically synthesized
actgacactacaatatgtaatc

SEQ ID NO: 1164112 - DNA, 22 bp, Artificial Sequence
  chemically synthesized
acactacaatatgtaatcagtc

SEQ ID NO: 1164113 - DNA, 22 bp, Artificial Sequence
  chemically synthesized
aaatataggtaggagactgatt

SEQ ID NO: 1164114 - DNA, 22 bp, Artificial Sequence
  chemically synthesized
caatatgtaatcagtctcctac

SEQ ID NO: 1164115 - DNA, 22 bp, Artificial Sequence
  chemically synthesized
agatggggttgaaatataggta

SEQ ID NO: 1164116 - DNA, 22 bp, Artificial Sequence
  chemically synthesized
aggtctgagatggggttgaaat

SEQ ID NO: 1164117 - DNA, 22 bp, Artificial Sequence
  chemically synthesized
ctacctatatttcaaccccatc

SEQ ID NO: 1164118 - DNA, 22 bp, Artificial Sequence
  chemically synthesized
cctatatttcaaccccatctca

SEQ ID NO: 1164119 - DNA, 22 bp, Artificial Sequence
  chemically synthesized
gatggctgaggtctgagatggg

SEQ ID NO: 1164120 - DNA, 22 bp, Artificial Sequence
  chemically synthesized
tatttcaaccccatctcagacc

SEQ ID NO: 1164121 - DNA, 22 bp, Artificial Sequence
  chemically synthesized
caaccccatctcagacctcagc

SEQ ID NO: 1164122 - DNA, 22 bp, Artificial Sequence
  chemically synthesized
aaccccatctcagacctcagcc

SEQ ID NO: 1164123 - DNA, 22 bp, Artificial Sequence
  chemically synthesized
cagggtggtaagttagatggct

SEQ ID NO: 1164124 - DNA, 22 bp, Artificial Sequence
  chemically synthesized
agacctcagccatctaacttac

SEQ ID NO: 1164125 - DNA, 22 bp, Artificial Sequence
  chemically synthesized
tagagttgcagggtggtaagtt

SEQ ID NO: 1164126 - DNA, 22 bp, Artificial Sequence
  chemically synthesized
agccatctaacttaccaccctg

SEQ ID NO: 1164127 - DNA, 22 bp, Artificial Sequence
  chemically synthesized
acttaccaccctgcaactctac

SEQ ID NO: 1164128 - DNA, 22 bp, Artificial Sequence
  chemically synthesized
accaccctgcaactctacagtc

SEQ ID NO: 1164129 - DNA, 22 bp, Artificial Sequence
  chemically synthesized
ccaccctgcaactctacagtcc

SEQ ID NO: 1164130 - DNA, 22 bp, Artificial Sequence
  chemically synthesized
caactctacagtccccctggcc

SEQ ID NO: 1164131 - DNA, 22 bp, Artificial Sequence
  chemically synthesized
gaggaaccaaaaggccaggggg

SEQ ID NO: 1164132 - DNA, 22 bp, Artificial Sequence
  chemically synthesized
ctggaggaaccaaaaggccagg

SEQ ID NO: 1164133 - DNA, 22 bp, Artificial Sequence
  chemically synthesized
gctggaggaaccaaaaggccag

SEQ ID NO: 1164134 - DNA, 22 bp, Artificial Sequence
  chemically synthesized
tacagtccccctggccttttgg

SEQ ID NO: 1164135 - DNA, 22 bp, Artificial Sequence
  chemically synthesized
cagtccccctggccttttggtt

SEQ ID NO: 1164136 - DNA, 22 bp, Artificial Sequence
  chemically synthesized
gcttgctggaggaaccaaaagg

SEQ ID NO: 1164137 - DNA, 22 bp, Artificial Sequence
  chemically synthesized
ggcttgctggaggaaccaaaag

SEQ ID NO: 1164138 - DNA, 22 bp, Artificial Sequence
  chemically synthesized
gccttttggttcctccagcaag

SEQ ID NO: 1164139 - DNA, 22 bp, Artificial Sequence
  chemically synthesized
ttggttcctccagcaagccaaa

SEQ ID NO: 1164140 - DNA, 22 bp, Artificial Sequence
  chemically synthesized
tggttcctccagcaagccaaac

SEQ ID NO: 1164141 - DNA, 22 bp, Artificial Sequence
  chemically synthesized
ggttcctccagcaagccaaact

SEQ ID NO: 1164142 - DNA, 22 bp, Artificial Sequence
  chemically synthesized
gttcctccagcaagccaaactg

SEQ ID NO: 1164143 - DNA, 22 bp, Artificial Sequence
  chemically synthesized
ctccagcaagccaaactgtccc

SEQ ID NO: 1164144 - DNA, 22 bp, Artificial Sequence
  chemically synthesized
cagcaagccaaactgtccctat

SEQ ID NO: 1164145 - DNA, 22 bp, Artificial Sequence
  chemically synthesized
atgcaaaggcccaaaaataggg

SEQ ID NO: 1164146 - DNA, 22 bp, Artificial Sequence
  chemically synthesized
ggaacagctaatgcaaaggccc

SEQ ID NO: 1164147 - DNA, 22 bp, Artificial Sequence
  chemically synthesized
tccctatttttgggcctttgca

SEQ ID NO: 1164148 - DNA, 22 bp, Artificial Sequence
  chemically synthesized
tttttgggcctttgcattagct

SEQ ID NO: 1164149 - DNA, 22 bp, Artificial Sequence
  chemically synthesized
acggattaggaacagctaatgc

SEQ ID NO: 1164150 - DNA, 22 bp, Artificial Sequence
  chemically synthesized
ttgggcctttgcattagctgtt

SEQ ID NO: 1164151 - DNA, 22 bp, Artificial Sequence
  chemically synthesized
tgggcctttgcattagctgttc

SEQ ID NO: 1164152 - DNA, 22 bp, Artificial Sequence
  chemically synthesized
gggcctttgcattagctgttcc

SEQ ID NO: 1164153 - DNA, 22 bp, Artificial Sequence
  chemically synthesized
ggcctttgcattagctgttcct

SEQ ID NO: 1164154 - DNA, 22 bp, Artificial Sequence
  chemically synthesized
tgcattagctgttcctaatccg

SEQ ID NO: 1164155 - DNA, 22 bp, Artificial Sequence
  chemically synthesized
gcattagctgttcctaatccgt

SEQ ID NO: 1164156 - DNA, 22 bp, Artificial Sequence
  chemically synthesized
cattagctgttcctaatccgtg

SEQ ID NO: 1164157 - DNA, 22 bp, Artificial Sequence
  chemically synthesized
gctgttcctaatccgtgaacca

SEQ ID NO: 1164158 - DNA, 22 bp, Artificial Sequence
  chemically synthesized
ttcctaatccgtgaaccacact

SEQ ID NO: 1164159 - DNA, 22 bp, Artificial Sequence
  chemically synthesized
cagatcacaaggaagtgtggtt

SEQ ID NO: 1164160 - DNA, 22 bp, Artificial Sequence
  chemically synthesized
gcagatcacaaggaagtgtggt

SEQ ID NO: 1164161 - DNA, 22 bp, Artificial Sequence
  chemically synthesized
ctaatccgtgaaccacacttcc

SEQ ID NO: 1164162 - DNA, 22 bp, Artificial Sequence
  chemically synthesized
tttgcagatcacaaggaagtgt

SEQ ID NO: 1164163 - DNA, 22 bp, Artificial Sequence
  chemically synthesized
atccgtgaaccacacttccttg

SEQ ID NO: 1164164 - DNA, 22 bp, Artificial Sequence
  chemically synthesized
ccttgtgatctgcaaatagtgg

SEQ ID NO: 1164165 - DNA, 22 bp, Artificial Sequence
  chemically synthesized
cttgtgatctgcaaatagtggt

SEQ ID NO: 1164166 - DNA, 22 bp, Artificial Sequence
  chemically synthesized
aatgacaagaaggtaccactat

SEQ ID NO: 1164167 - DNA, 22 bp, Artificial Sequence
  chemically synthesized
gtgatctgcaaatagtggtacc

SEQ ID NO: 1164168 - DNA, 22 bp, Artificial Sequence
  chemically synthesized
gaatgacaagaaggtaccacta

SEQ ID NO: 1164169 - DNA, 22 bp, Artificial Sequence
  chemically synthesized
tgatctgcaaatagtggtacct

SEQ ID NO: 1164170 - DNA, 22 bp, Artificial Sequence
  chemically synthesized
agatttgaatgacaagaaggta

SEQ ID NO: 1164171 - DNA, 22 bp, Artificial Sequence
  chemically synthesized
gagatttgaatgacaagaaggt

SEQ ID NO: 1164172 - DNA, 22 bp, Artificial Sequence
  chemically synthesized
caaatagtggtaccttcttgtc

SEQ ID NO: 1164173 - DNA, 22 bp, Artificial Sequence
  chemically synthesized
gtttgagatttgaatgacaaga

SEQ ID NO: 1164174 - DNA, 22 bp, Artificial Sequence
  chemically synthesized
agtttgagatttgaatgacaag

SEQ ID NO: 1164175 - DNA, 22 bp, Artificial Sequence
  chemically synthesized
gtaccatttagtttgagatttg

SEQ ID NO: 1164176 - DNA, 22 bp, Artificial Sequence
  chemically synthesized
cttgtcattcaaatctcaaact

SEQ ID NO: 1164177 - DNA, 22 bp, Artificial Sequence
  chemically synthesized
ttgtcattcaaatctcaaacta

SEQ ID NO: 1164178 - DNA, 22 bp, Artificial Sequence
  chemically synthesized
gtcattcaaatctcaaactaaa

SEQ ID NO: 1164179 - DNA, 22 bp, Artificial Sequence
  chemically synthesized
tcattcaaatctcaaactaaat

SEQ ID NO: 1164180 - DNA, 22 bp, Artificial Sequence
  chemically synthesized
aaggttggtaccatttagtttg

SEQ ID NO: 1164181 - DNA, 22 bp, Artificial Sequence
  chemically synthesized
gaaggttggtaccatttagttt

SEQ ID NO: 1164182 - DNA, 22 bp, Artificial Sequence
  chemically synthesized
tgaaggttggtaccatttagtt

SEQ ID NO: 1164183 - DNA, 22 bp, Artificial Sequence
  chemically synthesized
aaatctcaaactaaatggtacc

SEQ ID NO: 1164184 - DNA, 22 bp, Artificial Sequence
  chemically synthesized
aaactaaatggtaccaaccttc

SEQ ID NO: 1164185 - DNA, 22 bp, Artificial Sequence
  chemically synthesized
aatggtaccaaccttcaaagtc

SEQ ID NO: 1164186 - DNA, 22 bp, Artificial Sequence
  chemically synthesized
tgatccaggtaagactttgaag

SEQ ID NO: 1164187 - DNA, 22 bp, Artificial Sequence
  chemically synthesized
gtgatccaggtaagactttgaa

SEQ ID NO: 1164188 - DNA, 22 bp, Artificial Sequence
  chemically synthesized
tgtgatccaggtaagactttga

SEQ ID NO: 1164189 - DNA, 22 bp, Artificial Sequence
  chemically synthesized
gactttgtgatccaggtaagac

SEQ ID NO: 1164190 - DNA, 22 bp, Artificial Sequence
  chemically synthesized
agactttgtgatccaggtaaga

SEQ ID NO: 1164191 - DNA, 22 bp, Artificial Sequence
  chemically synthesized
tagactttgtgatccaggtaag

SEQ ID NO: 1164192 - DNA, 22 bp, Artificial Sequence
  chemically synthesized
ctttagactttgtgatccaggt

SEQ ID NO: 1164193 - DNA, 22 bp, Artificial Sequence
  chemically synthesized
caaagtcttacctggatcacaa

SEQ ID NO: 1164194 - DNA, 22 bp, Artificial Sequence
  chemically synthesized
aaagtcttacctggatcacaaa

SEQ ID NO: 1164195 - DNA, 22 bp, Artificial Sequence
  chemically synthesized
aggggaggctactttagacttt

SEQ ID NO: 1164196 - DNA, 22 bp, Artificial Sequence
  chemically synthesized
acctggatcacaaagtctaaag

SEQ ID NO: 1164197 - DNA, 22 bp, Artificial Sequence
  chemically synthesized
cctggatcacaaagtctaaagt

SEQ ID NO: 1164198 - DNA, 22 bp, Artificial Sequence
  chemically synthesized
gatcacaaagtctaaagtagcc

SEQ ID NO: 1164199 - DNA, 22 bp, Artificial Sequence
  chemically synthesized
aagtagcctcccctcaaccatt

SEQ ID NO: 1164200 - DNA, 22 bp, Artificial Sequence
  chemically synthesized
aaatgtaatgtgatagagaatg

SEQ ID NO: 1164201 - DNA, 22 bp, Artificial Sequence
  chemically synthesized
ccctcaaccattctctatcaca

SEQ ID NO: 1164202 - DNA, 22 bp, Artificial Sequence
  chemically synthesized
aaccattctctatcacattaca

SEQ ID NO: 1164203 - DNA, 22 bp, Artificial Sequence
  chemically synthesized
aagagattaaaatgtaatgtga

SEQ ID NO: 1164204 - DNA, 22 bp, Artificial Sequence
  chemically synthesized
gaagagattaaaatgtaatgtg

SEQ ID NO: 1164205 - DNA, 22 bp, Artificial Sequence
  chemically synthesized
tgaagagattaaaatgtaatgt

SEQ ID NO: 1164206 - DNA, 22 bp, Artificial Sequence
  chemically synthesized
ttgaagagattaaaatgtaatg

SEQ ID NO: 1164207 - DNA, 22 bp, Artificial Sequence
  chemically synthesized
tctatcacattacattttaatc

SEQ ID NO: 1164208 - DNA, 22 bp, Artificial Sequence
  chemically synthesized
tatcacattacattttaatctc

SEQ ID NO: 1164209 - DNA, 22 bp, Artificial Sequence
  chemically synthesized
tcacattacattttaatctctt

SEQ ID NO: 1164210 - DNA, 22 bp, Artificial Sequence
  chemically synthesized
cattttaatctcttcaaaaact

SEQ ID NO: 1164211 - DNA, 22 bp, Artificial Sequence
  chemically synthesized
taatctcttcaaaaactatatt

SEQ ID NO: 1164212 - DNA, 22 bp, Artificial Sequence
  chemically synthesized
aatctcttcaaaaactatattc

SEQ ID NO: 1164213 - DNA, 22 bp, Artificial Sequence
  chemically synthesized
atctcttcaaaaactatattcc

SEQ ID NO: 1164214 - DNA, 22 bp, Artificial Sequence
  chemically synthesized
ttcaaaaactatattcctatcc

SEQ ID NO: 1164215 - DNA, 22 bp, Artificial Sequence
  chemically synthesized
caaaaactatattcctatccgg

SEQ ID NO: 1164216 - DNA, 22 bp, Artificial Sequence
  chemically synthesized
aaaaactatattcctatccggt

SEQ ID NO: 1164217 - DNA, 22 bp, Artificial Sequence
  chemically synthesized
tattcctatccggtatttttct

SEQ ID NO: 1164218 - DNA, 22 bp, Artificial Sequence
  chemically synthesized
ctatccggtatttttcttgtgt

SEQ ID NO: 1164219 - DNA, 22 bp, Artificial Sequence
  chemically synthesized
tccggtatttttcttgtgttct

SEQ ID NO: 1164220 - DNA, 22 bp, Artificial Sequence
  chemically synthesized
gcagccaagaaaaaaaagaaca

SEQ ID NO: 1164221 - DNA, 22 bp, Artificial Sequence
  chemically synthesized
ttcttgtgttcttttttttctt

SEQ ID NO: 1164222 - DNA, 22 bp, Artificial Sequence
  chemically synthesized
tcttgtgttcttttttttcttg

SEQ ID NO: 1164223 - DNA, 22 bp, Artificial Sequence
  chemically synthesized
cttgtgttcttttttttcttgg

SEQ ID NO: 1164224 - DNA, 22 bp, Artificial Sequence
  chemically synthesized
ttgtgttcttttttttcttggc

SEQ ID NO: 1164225 - DNA, 22 bp, Artificial Sequence
  chemically synthesized
tagaggctggcagccaagaaaa

SEQ ID NO: 1164226 - DNA, 22 bp, Artificial Sequence
  chemically synthesized
gtgttcttttttttcttggctg

SEQ ID NO: 1164227 - DNA, 22 bp, Artificial Sequence
  chemically synthesized
tgtagaggctggcagccaagaa

SEQ ID NO: 1164228 - DNA, 22 bp, Artificial Sequence
  chemically synthesized
tgttcttttttttcttggctgc

SEQ ID NO: 1164229 - DNA, 22 bp, Artificial Sequence
  chemically synthesized
ttttttttcttggctgccagcc

SEQ ID NO: 1164230 - DNA, 22 bp, Artificial Sequence
  chemically synthesized
ttttttcttggctgccagcctc

SEQ ID NO: 1164231 - DNA, 22 bp, Artificial Sequence
  chemically synthesized
tttttcttggctgccagcctct

SEQ ID NO: 1164232 - DNA, 22 bp, Artificial Sequence
  chemically synthesized
ttttcttggctgccagcctcta

SEQ ID NO: 1164233 - DNA, 22 bp, Artificial Sequence
  chemically synthesized
tttcttggctgccagcctctac

SEQ ID NO: 1164234 - DNA, 22 bp, Artificial Sequence
  chemically synthesized
ttcttggctgccagcctctaca

SEQ ID NO: 1164235 - DNA, 22 bp, Artificial Sequence
  chemically synthesized
tcttggctgccagcctctacag

SEQ ID NO: 1164236 - DNA, 22 bp, Artificial Sequence
  chemically synthesized
atgaaacatattctgtagaggc

SEQ ID NO: 1164237 - DNA, 22 bp, Artificial Sequence
  chemically synthesized
cttggctgccagcctctacaga

SEQ ID NO: 1164238 - DNA, 22 bp, Artificial Sequence
  chemically synthesized
ttggctgccagcctctacagaa

SEQ ID NO: 1164239 - DNA, 22 bp, Artificial Sequence
  chemically synthesized
ggctgccagcctctacagaata

SEQ ID NO: 1164240 - DNA, 22 bp, Artificial Sequence
  chemically synthesized
gctgccagcctctacagaatat

SEQ ID NO: 1164241 - DNA, 22 bp, Artificial Sequence
  chemically synthesized
ccagcctctacagaatatgttt

SEQ ID NO: 1164242 - DNA, 22 bp, Artificial Sequence
  chemically synthesized
gccccagatctcatgaaacata

SEQ ID NO: 1164243 - DNA, 22 bp, Artificial Sequence
  chemically synthesized
tacagaatatgtttcatgagat

SEQ ID NO: 1164244 - DNA, 22 bp, Artificial Sequence
  chemically synthesized
cagaatatgtttcatgagatct

SEQ ID NO: 1164245 - DNA, 22 bp, Artificial Sequence
  chemically synthesized
catgagatctggggccagacct

SEQ ID NO: 1164246 - DNA, 22 bp, Artificial Sequence
  chemically synthesized
atgagatctggggccagacctt

SEQ ID NO: 1164247 - DNA, 22 bp, Artificial Sequence
  chemically synthesized
aataatgatcatacaaggtctg

SEQ ID NO: 1164248 - DNA, 22 bp, Artificial Sequence
  chemically synthesized
gagactcaataatgatcataca

SEQ ID NO: 1164249 - DNA, 22 bp, Artificial Sequence
  chemically synthesized
gggccagaccttgtatgatcat

SEQ ID NO: 1164250 - DNA, 22 bp, Artificial Sequence
  chemically synthesized
atggcactggagactcaataat

SEQ ID NO: 1164251 - DNA, 22 bp, Artificial Sequence
  chemically synthesized
gtatgatcattattgagtctcc

SEQ ID NO: 1164252 - DNA, 22 bp, Artificial Sequence
  chemically synthesized
tatgatcattattgagtctcca

SEQ ID NO: 1164253 - DNA, 22 bp, Artificial Sequence
  chemically synthesized
tcaaaaacaattaatggcactg

SEQ ID NO: 1164254 - DNA, 22 bp, Artificial Sequence
  chemically synthesized
ttgagtctccagtgccattaat

SEQ ID NO: 1164255 - DNA, 22 bp, Artificial Sequence
  chemically synthesized
agtctccagtgccattaattgt

SEQ ID NO: 1164256 - DNA, 22 bp, Artificial Sequence
  chemically synthesized
cagtgccattaattgtttttga

SEQ ID NO: 1164257 - DNA, 22 bp, Artificial Sequence
  chemically synthesized
atggaatacattatcaaaaaca

SEQ ID NO: 1164258 - DNA, 22 bp, Artificial Sequence
  chemically synthesized
attgtttttgataatgtattcc

SEQ ID NO: 1164259 - DNA, 22 bp, Artificial Sequence
  chemically synthesized
tttttgataatgtattccatta

SEQ ID NO: 1164260 - DNA, 22 bp, Artificial Sequence
  chemically synthesized
tatgaacaaatattaatggaat

SEQ ID NO: 1164261 - DNA, 22 bp, Artificial Sequence
  chemically synthesized
ttgataatgtattccattaata

SEQ ID NO: 1164262 - DNA, 22 bp, Artificial Sequence
  chemically synthesized
tatatgaacaaatattaatgga

SEQ ID NO: 1164263 - DNA, 22 bp, Artificial Sequence
  chemically synthesized
tgataatgtattccattaatat

SEQ ID NO: 1164264 - DNA, 22 bp, Artificial Sequence
  chemically synthesized
gataatgtattccattaatatt

SEQ ID NO: 1164265 - DNA, 22 bp, Artificial Sequence
  chemically synthesized
tctatatgaacaaatattaatg

SEQ ID NO: 1164266 - DNA, 22 bp, Artificial Sequence
  chemically synthesized
ataatgtattccattaatattt

SEQ ID NO: 1164267 - DNA, 22 bp, Artificial Sequence
  chemically synthesized
cattaatatttgttcatataga

SEQ ID NO: 1164268 - DNA, 22 bp, Artificial Sequence
  chemically synthesized
atatttgttcatatagagagat

SEQ ID NO: 1164269 - DNA, 22 bp, Artificial Sequence
  chemically synthesized
gttcatatagagagatatatgt

SEQ ID NO: 1164270 - DNA, 22 bp, Artificial Sequence
  chemically synthesized
ttcatatagagagatatatgtg

SEQ ID NO: 1164271 - DNA, 22 bp, Artificial Sequence
  chemically synthesized
atatagagagatatatgtgtat

SEQ ID NO: 1164272 - DNA, 22 bp, Artificial Sequence
  chemically synthesized
tatacgtatatatatatatata

SEQ ID NO: 1164273 - DNA, 22 bp, Artificial Sequence
  chemically synthesized
atacgtatatatatatatatat

SEQ ID NO: 1164274 - DNA, 22 bp, Artificial Sequence
  chemically synthesized
tacgtatatatatatatatata

SEQ ID NO: 1164275 - DNA, 22 bp, Artificial Sequence
  chemically synthesized
tgagatatatatatatatatat

SEQ ID NO: 1164276 - DNA, 22 bp, Artificial Sequence
  chemically synthesized
atatatagtcattgtgagatat

SEQ ID NO: 1164277 - DNA, 22 bp, Artificial Sequence
  chemically synthesized
gatatatagtcattgtgagata

SEQ ID NO: 1164278 - DNA, 22 bp, Artificial Sequence
  chemically synthesized
tatttgatatatagtcattgtg

SEQ ID NO: 1164279 - DNA, 22 bp, Artificial Sequence
  chemically synthesized
acaatgactatatatcaaatat

SEQ ID NO: 1164280 - DNA, 22 bp, Artificial Sequence
  chemically synthesized
atagcaacatcaaattatattt

SEQ ID NO: 1164281 - DNA, 22 bp, Artificial Sequence
  chemically synthesized
tatatcaaatataatttgatgt

SEQ ID NO: 1164282 - DNA, 22 bp, Artificial Sequence
  chemically synthesized
taccaacctaatagcaacatca

SEQ ID NO: 1164283 - DNA, 22 bp, Artificial Sequence
  chemically synthesized
gtaccaacctaatagcaacatc

SEQ ID NO: 1164284 - DNA, 22 bp, Artificial Sequence
  chemically synthesized
tgtaccaacctaatagcaacat

SEQ ID NO: 1164285 - DNA, 22 bp, Artificial Sequence
  chemically synthesized
ttgtaccaacctaatagcaaca

SEQ ID NO: 1164286 - DNA, 22 bp, Artificial Sequence
  chemically synthesized
cttttgtaccaacctaatagca

SEQ ID NO: 1164287 - DNA, 22 bp, Artificial Sequence
  chemically synthesized
taattacttttgtaccaaccta

SEQ ID NO: 1164288 - DNA, 22 bp, Artificial Sequence
  chemically synthesized
gatgttgctattaggttggtac

SEQ ID NO: 1164289 - DNA, 22 bp, Artificial Sequence
  chemically synthesized
atgttgctattaggttggtaca

SEQ ID NO: 1164290 - DNA, 22 bp, Artificial Sequence
  chemically synthesized
ctattaggttggtacaaaagta

SEQ ID NO: 1164291 - DNA, 22 bp, Artificial Sequence
  chemically synthesized
ttaggttggtacaaaagtaatt

SEQ ID NO: 1164292 - DNA, 22 bp, Artificial Sequence
  chemically synthesized
ggttggtacaaaagtaattaca

SEQ ID NO: 1164293 - DNA, 22 bp, Artificial Sequence
  chemically synthesized
gtacaaaagtaattacagtttt

SEQ ID NO: 1164294 - DNA, 22 bp, Artificial Sequence
  chemically synthesized
taagtaatgggaaaaactgtaa

SEQ ID NO: 1164295 - DNA, 22 bp, Artificial Sequence
  chemically synthesized
cattgtaagtaatgggaaaaac

SEQ ID NO: 1164296 - DNA, 22 bp, Artificial Sequence
  chemically synthesized
ccattgtaagtaatgggaaaaa

SEQ ID NO: 1164297 - DNA, 22 bp, Artificial Sequence
  chemically synthesized
tccattgtaagtaatgggaaaa

SEQ ID NO: 1164298 - DNA, 22 bp, Artificial Sequence
  chemically synthesized
ttccattgtaagtaatgggaaa

SEQ ID NO: 1164299 - DNA, 22 bp, Artificial Sequence
  chemically synthesized
tttccattgtaagtaatgggaa

SEQ ID NO: 1164300 - DNA, 22 bp, Artificial Sequence
  chemically synthesized
ttttccattgtaagtaatggga

SEQ ID NO: 1164301 - DNA, 22 bp, Artificial Sequence
  chemically synthesized
cagtttttcccattacttacaa

SEQ ID NO: 1164302 - DNA, 22 bp, Artificial Sequence
  chemically synthesized
ttcccattacttacaatggaaa

SEQ ID NO: 1164303 - DNA, 22 bp, Artificial Sequence
  chemically synthesized
tcccattacttacaatggaaaa

SEQ ID NO: 1164304 - DNA, 22 bp, Artificial Sequence
  chemically synthesized
cccattacttacaatggaaaaa

SEQ ID NO: 1164305 - DNA, 22 bp, Artificial Sequence
  chemically synthesized
ccattacttacaatggaaaaaa

SEQ ID NO: 1164306 - DNA, 22 bp, Artificial Sequence
  chemically synthesized
caaaagtaatcatgtttttttc

SEQ ID NO: 1164307 - DNA, 22 bp, Artificial Sequence
  chemically synthesized
cttacaatggaaaaaaacatga

SEQ ID NO: 1164308 - DNA, 22 bp, Artificial Sequence
  chemically synthesized
ctgcaaaagtaatcatgttttt

SEQ ID NO: 1164309 - DNA, 22 bp, Artificial Sequence
  chemically synthesized
acaatggaaaaaaacatgatta

SEQ ID NO: 1164310 - DNA, 22 bp, Artificial Sequence
  chemically synthesized
caatggaaaaaaacatgattac

SEQ ID NO: 1164311 - DNA, 22 bp, Artificial Sequence
  chemically synthesized
ggttgctgcaaaagtaatcatg

SEQ ID NO: 1164312 - DNA, 22 bp, Artificial Sequence
  chemically synthesized
ttaggttgctgcaaaagtaatc

SEQ ID NO: 1164313 - DNA, 22 bp, Artificial Sequence
  chemically synthesized
ctattaggttgctgcaaaagta

SEQ ID NO: 1164314 - DNA, 22 bp, Artificial Sequence
  chemically synthesized
actattaggttgctgcaaaagt

SEQ ID NO: 1164315 - DNA, 22 bp, Artificial Sequence
  chemically synthesized
ccaacatacttactattaggtt

SEQ ID NO: 1164316 - DNA, 22 bp, Artificial Sequence
  chemically synthesized
cttttgcagcaacctaatagta

SEQ ID NO: 1164317 - DNA, 22 bp, Artificial Sequence
  chemically synthesized
tctaccaacatacttactatta

SEQ ID NO: 1164318 - DNA, 22 bp, Artificial Sequence
  chemically synthesized
ttgcagcaacctaatagtaagt

SEQ ID NO: 1164319 - DNA, 22 bp, Artificial Sequence
  chemically synthesized
tgcagcaacctaatagtaagta

SEQ ID NO: 1164320 - DNA, 22 bp, Artificial Sequence
  chemically synthesized
gcagcaacctaatagtaagtat

SEQ ID NO: 1164321 - DNA, 22 bp, Artificial Sequence
  chemically synthesized
cagcaacctaatagtaagtatg

SEQ ID NO: 1164322 - DNA, 22 bp, Artificial Sequence
  chemically synthesized
atcctatctaccaacatactta

SEQ ID NO: 1164323 - DNA, 22 bp, Artificial Sequence
  chemically synthesized
ttaatcctatctaccaacatac

SEQ ID NO: 1164324 - DNA, 22 bp, Artificial Sequence
  chemically synthesized
atagtaagtatgttggtagata

SEQ ID NO: 1164325 - DNA, 22 bp, Artificial Sequence
  chemically synthesized
gcaattattaatcctatctacc

SEQ ID NO: 1164326 - DNA, 22 bp, Artificial Sequence
  chemically synthesized
agcaattattaatcctatctac

SEQ ID NO: 1164327 - DNA, 22 bp, Artificial Sequence
  chemically synthesized
cacttagcaattattaatccta

SEQ ID NO: 1164328 - DNA, 22 bp, Artificial Sequence
  chemically synthesized
acacttagcaattattaatcct

SEQ ID NO: 1164329 - DNA, 22 bp, Artificial Sequence
  chemically synthesized
gtagataggattaataattgct

SEQ ID NO: 1164330 - DNA, 22 bp, Artificial Sequence
  chemically synthesized
tgaacatttacacttagcaatt

SEQ ID NO: 1164331 - DNA, 22 bp, Artificial Sequence
  chemically synthesized
aaatctatgaacatttacactt

SEQ ID NO: 1164332 - DNA, 22 bp, Artificial Sequence
  chemically synthesized
ataattgctaagtgtaaatgtt

SEQ ID NO: 1164333 - DNA, 22 bp, Artificial Sequence
  chemically synthesized
tcactaaaatctatgaacattt

SEQ ID NO: 1164334 - DNA, 22 bp, Artificial Sequence
  chemically synthesized
atcactaaaatctatgaacatt

SEQ ID NO: 1164335 - DNA, 22 bp, Artificial Sequence
  chemically synthesized
ctaagtgtaaatgttcatagat

SEQ ID NO: 1164336 - DNA, 22 bp, Artificial Sequence
  chemically synthesized
agtgtaaatgttcatagatttt

SEQ ID NO: 1164337 - DNA, 22 bp, Artificial Sequence
  chemically synthesized
taaatacagataagcttatcac

SEQ ID NO: 1164338 - DNA, 22 bp, Artificial Sequence
  chemically synthesized
gtaaatacagataagcttatca

SEQ ID NO: 1164339 - DNA, 22 bp, Artificial Sequence
  chemically synthesized
atagattttagtgataagctta

SEQ ID NO: 1164340 - DNA, 22 bp, Artificial Sequence
  chemically synthesized
ttgtaaatacagataagcttat

SEQ ID NO: 1164341 - DNA, 22 bp, Artificial Sequence
  chemically synthesized
cttgtaaatacagataagctta

SEQ ID NO: 1164342 - DNA, 22 bp, Artificial Sequence
  chemically synthesized
tagtgataagcttatctgtatt

SEQ ID NO: 1164343 - DNA, 22 bp, Artificial Sequence
  chemically synthesized
agtgataagcttatctgtattt

SEQ ID NO: 1164344 - DNA, 22 bp, Artificial Sequence
  chemically synthesized
aaaacttcttgtaaatacagat

SEQ ID NO: 1164345 - DNA, 22 bp, Artificial Sequence
  chemically synthesized
gtgataagcttatctgtattta

SEQ ID NO: 1164346 - DNA, 22 bp, Artificial Sequence
  chemically synthesized
atctgtatttacaagaagtttt

SEQ ID NO: 1164347 - DNA, 22 bp, Artificial Sequence
  chemically synthesized
tctgtatttacaagaagttttt

SEQ ID NO: 1164348 - DNA, 22 bp, Artificial Sequence
  chemically synthesized
atataacaaaagttaaaaactt

SEQ ID NO: 1164349 - DNA, 22 bp, Artificial Sequence
  chemically synthesized
tatttacaagaagtttttaact

SEQ ID NO: 1164350 - DNA, 22 bp, Artificial Sequence
  chemically synthesized
agttgatataacaaaagttaaa

SEQ ID NO: 1164351 - DNA, 22 bp, Artificial Sequence
  chemically synthesized
acaagaagtttttaacttttgt

SEQ ID NO: 1164352 - DNA, 22 bp, Artificial Sequence
  chemically synthesized
taagttgatataacaaaagtta

SEQ ID NO: 1164353 - DNA, 22 bp, Artificial Sequence
  chemically synthesized
caagaagtttttaacttttgtt

SEQ ID NO: 1164354 - DNA, 22 bp, Artificial Sequence
  chemically synthesized
ctaagttgatataacaaaagtt

SEQ ID NO: 1164355 - DNA, 22 bp, Artificial Sequence
  chemically synthesized
taatttctaagttgatataaca

SEQ ID NO: 1164356 - DNA, 22 bp, Artificial Sequence
  chemically synthesized
ttaacttttgttatatcaactt

SEQ ID NO: 1164357 - DNA, 22 bp, Artificial Sequence
  chemically synthesized
taacttttgttatatcaactta

SEQ ID NO: 1164358 - DNA, 22 bp, Artificial Sequence
  chemically synthesized
tgctataatttctaagttgata

SEQ ID NO: 1164359 - DNA, 22 bp, Artificial Sequence
  chemically synthesized
aacttttgttatatcaacttag

SEQ ID NO: 1164360 - DNA, 22 bp, Artificial Sequence
  chemically synthesized
acttttgttatatcaacttaga

SEQ ID NO: 1164361 - DNA, 22 bp, Artificial Sequence
  chemically synthesized
ttgttatatcaacttagaaatt

SEQ ID NO: 1164362 - DNA, 22 bp, Artificial Sequence
  chemically synthesized
tgttatatcaacttagaaatta

SEQ ID NO: 1164363 - DNA, 22 bp, Artificial Sequence
  chemically synthesized
gttatatcaacttagaaattat

SEQ ID NO: 1164364 - DNA, 22 bp, Artificial Sequence
  chemically synthesized
ttatatcaacttagaaattata

SEQ ID NO: 1164365 - DNA, 22 bp, Artificial Sequence
  chemically synthesized
tatcaacttagaaattatagca

SEQ ID NO: 1164366 - DNA, 22 bp, Artificial Sequence
  chemically synthesized
agtatatccaaagctatgctat

SEQ ID NO: 1164367 - DNA, 22 bp, Artificial Sequence
  chemically synthesized
agaaattatagcatagctttgg

SEQ ID NO: 1164368 - DNA, 22 bp, Artificial Sequence
  chemically synthesized
gaaattatagcatagctttgga

SEQ ID NO: 1164369 - DNA, 22 bp, Artificial Sequence
  chemically synthesized
gtcatattaagtatatccaaag

SEQ ID NO: 1164370 - DNA, 22 bp, Artificial Sequence
  chemically synthesized
tagcatagctttggatatactt

SEQ ID NO: 1164371 - DNA, 22 bp, Artificial Sequence
  chemically synthesized
tctagtcatattaagtatatcc

SEQ ID NO: 1164372 - DNA, 22 bp, Artificial Sequence
  chemically synthesized
gtctagtcatattaagtatatc

SEQ ID NO: 1164373 - DNA, 22 bp, Artificial Sequence
  chemically synthesized
acatttgtctagtcatattaag

SEQ ID NO: 1164374 - DNA, 22 bp, Artificial Sequence
  chemically synthesized
tggatatacttaatatgactag

SEQ ID NO: 1164375 - DNA, 22 bp, Artificial Sequence
  chemically synthesized
ggatatacttaatatgactaga

SEQ ID NO: 1164376 - DNA, 22 bp, Artificial Sequence
  chemically synthesized
gatatacttaatatgactagac

SEQ ID NO: 1164377 - DNA, 22 bp, Artificial Sequence
  chemically synthesized
aatatgactagacaaatgttaa

SEQ ID NO: 1164378 - DNA, 22 bp, Artificial Sequence
  chemically synthesized
gagaaatgataattaacatttg

SEQ ID NO: 1164379 - DNA, 22 bp, Artificial Sequence
  chemically synthesized
atatgactagacaaatgttaat

SEQ ID NO: 1164380 - DNA, 22 bp, Artificial Sequence
  chemically synthesized
gcgattagagaaatgataatta

SEQ ID NO: 1164381 - DNA, 22 bp, Artificial Sequence
  chemically synthesized
agcgattagagaaatgataatt

SEQ ID NO: 1164382 - DNA, 22 bp, Artificial Sequence
  chemically synthesized
gacaaatgttaattatcatttc

SEQ ID NO: 1164383 - DNA, 22 bp, Artificial Sequence
  chemically synthesized
gtttagcgattagagaaatgat

SEQ ID NO: 1164384 - DNA, 22 bp, Artificial Sequence
  chemically synthesized
ggtttagcgattagagaaatga

SEQ ID NO: 1164385 - DNA, 22 bp, Artificial Sequence
  chemically synthesized
agccttggtttagcgattagag

SEQ ID NO: 1164386 - DNA, 22 bp, Artificial Sequence
  chemically synthesized
attatcatttctctaatcgcta

SEQ ID NO: 1164387 - DNA, 22 bp, Artificial Sequence
  chemically synthesized
cctaagccttggtttagcgatt

SEQ ID NO: 1164388 - DNA, 22 bp, Artificial Sequence
  chemically synthesized
tcatttctctaatcgctaaacc

SEQ ID NO: 1164389 - DNA, 22 bp, Artificial Sequence
  chemically synthesized
ctgcctaagccttggtttagcg

SEQ ID NO: 1164390 - DNA, 22 bp, Artificial Sequence
  chemically synthesized
cctgcctaagccttggtttagc

SEQ ID NO: 1164391 - DNA, 22 bp, Artificial Sequence
  chemically synthesized
tttcctgcctaagccttggttt

SEQ ID NO: 1164392 - DNA, 22 bp, Artificial Sequence
  chemically synthesized
ctctaatcgctaaaccaaggct

SEQ ID NO: 1164393 - DNA, 22 bp, Artificial Sequence
  chemically synthesized
tctaatcgctaaaccaaggctt

SEQ ID NO: 1164394 - DNA, 22 bp, Artificial Sequence
  chemically synthesized
taatcgctaaaccaaggcttag

SEQ ID NO: 1164395 - DNA, 22 bp, Artificial Sequence
  chemically synthesized
atcgctaaaccaaggcttaggc

SEQ ID NO: 1164396 - DNA, 22 bp, Artificial Sequence
  chemically synthesized
aaccaaggcttaggcaggaaat

SEQ ID NO: 1164397 - DNA, 22 bp, Artificial Sequence
  chemically synthesized
aggcaggaaataatggcttccg

SEQ ID NO: 1164398 - DNA, 22 bp, Artificial Sequence
  chemically synthesized
gatagatccagtcggaagccat

SEQ ID NO: 1164399 - DNA, 22 bp, Artificial Sequence
  chemically synthesized
ggcaggaaataatggcttccga

SEQ ID NO: 1164400 - DNA, 22 bp, Artificial Sequence
  chemically synthesized
ggatagatccagtcggaagcca

SEQ ID NO: 1164401 - DNA, 22 bp, Artificial Sequence
  chemically synthesized
agacagggtttggatagatcca

SEQ ID NO: 1164402 - DNA, 22 bp, Artificial Sequence
  chemically synthesized
cctaagacagggtttggataga

SEQ ID NO: 1164403 - DNA, 22 bp, Artificial Sequence
  chemically synthesized
tacctaagacagggtttggata

SEQ ID NO: 1164404 - DNA, 22 bp, Artificial Sequence
  chemically synthesized
ccgactggatctatccaaaccc

SEQ ID NO: 1164405 - DNA, 22 bp, Artificial Sequence
  chemically synthesized
cgactggatctatccaaaccct

SEQ ID NO: 1164406 - DNA, 22 bp, Artificial Sequence
  chemically synthesized
tctacctaagacagggtttgga

SEQ ID NO: 1164407 - DNA, 22 bp, Artificial Sequence
  chemically synthesized
tctctacctaagacagggtttg

SEQ ID NO: 1164408 - DNA, 22 bp, Artificial Sequence
  chemically synthesized
tctctctacctaagacagggtt

SEQ ID NO: 1164409 - DNA, 22 bp, Artificial Sequence
  chemically synthesized
ctctctctacctaagacagggt

SEQ ID NO: 1164410 - DNA, 22 bp, Artificial Sequence
  chemically synthesized
gatctatccaaaccctgtctta

SEQ ID NO: 1164411 - DNA, 22 bp, Artificial Sequence
  chemically synthesized
tctctctctacctaagacaggg

SEQ ID NO: 1164412 - DNA, 22 bp, Artificial Sequence
  chemically synthesized
ttctctctctacctaagacagg

SEQ ID NO: 1164413 - DNA, 22 bp, Artificial Sequence
  chemically synthesized
ttttctctctctacctaagaca

SEQ ID NO: 1164414 - DNA, 22 bp, Artificial Sequence
  chemically synthesized
cttttctctctctacctaagac

SEQ ID NO: 1164415 - DNA, 22 bp, Artificial Sequence
  chemically synthesized
tccaaaccctgtcttaggtaga

SEQ ID NO: 1164416 - DNA, 22 bp, Artificial Sequence
  chemically synthesized
atcgatacttcttttctctctc

SEQ ID NO: 1164417 - DNA, 22 bp, Artificial Sequence
  chemically synthesized
tcttaggtagagagagaaaaga

SEQ ID NO: 1164418 - DNA, 22 bp, Artificial Sequence
  chemically synthesized
aggtagagagagaaaagaagta

SEQ ID NO: 1164419 - DNA, 22 bp, Artificial Sequence
  chemically synthesized
ggtagagagagaaaagaagtat

SEQ ID NO: 1164420 - DNA, 22 bp, Artificial Sequence
  chemically synthesized
gtaaacaaaaatggattcatcg

SEQ ID NO: 1164421 - DNA, 22 bp, Artificial Sequence
  chemically synthesized
ctagtaaacaaaaatggattca

SEQ ID NO: 1164422 - DNA, 22 bp, Artificial Sequence
  chemically synthesized
agagtagaagattactagtaaa

SEQ ID NO: 1164423 - DNA, 22 bp, Artificial Sequence
  chemically synthesized
cagagtagaagattactagtaa

SEQ ID NO: 1164424 - DNA, 22 bp, Artificial Sequence
  chemically synthesized
cttcagagtagaagattactag

SEQ ID NO: 1164425 - DNA, 22 bp, Artificial Sequence
  chemically synthesized
ttgtttactagtaatcttctac

SEQ ID NO: 1164426 - DNA, 22 bp, Artificial Sequence
  chemically synthesized
tgtttactagtaatcttctact

SEQ ID NO: 1164427 - DNA, 22 bp, Artificial Sequence
  chemically synthesized
gtttactagtaatcttctactc

SEQ ID NO: 1164428 - DNA, 22 bp, Artificial Sequence
  chemically synthesized
tttactagtaatcttctactct

SEQ ID NO: 1164429 - DNA, 22 bp, Artificial Sequence
  chemically synthesized
actagtaatcttctactctgaa

SEQ ID NO: 1164430 - DNA, 22 bp, Artificial Sequence
  chemically synthesized
ctagtaatcttctactctgaag

SEQ ID NO: 1164431 - DNA, 22 bp, Artificial Sequence
  chemically synthesized
aatatatgattacttcagagta

SEQ ID NO: 1164432 - DNA, 22 bp, Artificial Sequence
  chemically synthesized
taaatatatgattacttcagag

SEQ ID NO: 1164433 - DNA, 22 bp, Artificial Sequence
  chemically synthesized
gtaatcttctactctgaagtaa

SEQ ID NO: 1164434 - DNA, 22 bp, Artificial Sequence
  chemically synthesized
ctaaatatatgattacttcaga

SEQ ID NO: 1164435 - DNA, 22 bp, Artificial Sequence
  chemically synthesized
tctaaatatatgattacttcag

SEQ ID NO: 1164436 - DNA, 22 bp, Artificial Sequence
  chemically synthesized
ttctaaatatatgattacttca

SEQ ID NO: 1164437 - DNA, 22 bp, Artificial Sequence
  chemically synthesized
tttctaaatatatgattacttc

SEQ ID NO: 1164438 - DNA, 22 bp, Artificial Sequence
  chemically synthesized
ttttctaaatatatgattactt

SEQ ID NO: 1164439 - DNA, 22 bp, Artificial Sequence
  chemically synthesized
tttttctaaatatatgattact

SEQ ID NO: 1164440 - DNA, 22 bp, Artificial Sequence
  chemically synthesized
ctactctgaagtaatcatatat

SEQ ID NO: 1164441 - DNA, 22 bp, Artificial Sequence
  chemically synthesized
ttttttttctaaatatatgatt

SEQ ID NO: 1164442 - DNA, 22 bp, Artificial Sequence
  chemically synthesized
tactctgaagtaatcatatatt

SEQ ID NO: 1164443 - DNA, 22 bp, Artificial Sequence
  chemically synthesized
ctctgaagtaatcatatattta

SEQ ID NO: 1164444 - DNA, 22 bp, Artificial Sequence
  chemically synthesized
cctattttttttctaaatatat

SEQ ID NO: 1164445 - DNA, 22 bp, Artificial Sequence
  chemically synthesized
tgaagtaatcatatatttagaa

SEQ ID NO: 1164446 - DNA, 22 bp, Artificial Sequence
  chemically synthesized
aagtaatcatatatttagaaaa

SEQ ID NO: 1164447 - DNA, 22 bp, Artificial Sequence
  chemically synthesized
gagcattacctattttttttct

SEQ ID NO: 1164448 - DNA, 22 bp, Artificial Sequence
  chemically synthesized
ggagcattacctattttttttc

SEQ ID NO: 1164449 - DNA, 22 bp, Artificial Sequence
  chemically synthesized
aacttggagcattacctatttt

SEQ ID NO: 1164450 - DNA, 22 bp, Artificial Sequence
  chemically synthesized
caacttggagcattacctattt

SEQ ID NO: 1164451 - DNA, 22 bp, Artificial Sequence
  chemically synthesized
gcttcaacttggagcattacct

SEQ ID NO: 1164452 - DNA, 22 bp, Artificial Sequence
  chemically synthesized
agaaaaaaaataggtaatgctc

SEQ ID NO: 1164453 - DNA, 22 bp, Artificial Sequence
  chemically synthesized
gaaaaaaaataggtaatgctcc

SEQ ID NO: 1164454 - DNA, 22 bp, Artificial Sequence
  chemically synthesized
caatgattagcttcaacttgga

SEQ ID NO: 1164455 - DNA, 22 bp, Artificial Sequence
  chemically synthesized
tctccaatgattagcttcaact

SEQ ID NO: 1164456 - DNA, 22 bp, Artificial Sequence
  chemically synthesized
caagttgaagctaatcattgga

SEQ ID NO: 1164457 - DNA, 22 bp, Artificial Sequence
  chemically synthesized
aagctaatcattggagataatc

SEQ ID NO: 1164458 - DNA, 22 bp, Artificial Sequence
  chemically synthesized
tcatggtcatgagaatggatta

SEQ ID NO: 1164459 - DNA, 22 bp, Artificial Sequence
  chemically synthesized
atcattggagataatccattct

SEQ ID NO: 1164460 - DNA, 22 bp, Artificial Sequence
  chemically synthesized
cattatcatggtcatgagaatg

SEQ ID NO: 1164461 - DNA, 22 bp, Artificial Sequence
  chemically synthesized
ccattatcatggtcatgagaat

SEQ ID NO: 1164462 - DNA, 22 bp, Artificial Sequence
  chemically synthesized
gagataatccattctcatgacc

SEQ ID NO: 1164463 - DNA, 22 bp, Artificial Sequence
  chemically synthesized
agtttccattatcatggtcatg

SEQ ID NO: 1164464 - DNA, 22 bp, Artificial Sequence
  chemically synthesized
ttcagtttccattatcatggtc

SEQ ID NO: 1164465 - DNA, 22 bp, Artificial Sequence
  chemically synthesized
taacctgttcagtttccattat

SEQ ID NO: 1164466 - DNA, 22 bp, Artificial Sequence
  chemically synthesized
tcatgaccatgataatggaaac

SEQ ID NO: 1164467 - DNA, 22 bp, Artificial Sequence
  chemically synthesized
atgaccatgataatggaaactg

SEQ ID NO: 1164468 - DNA, 22 bp, Artificial Sequence
  chemically synthesized
aaataaattataacctgttcag

SEQ ID NO: 1164469 - DNA, 22 bp, Artificial Sequence
  chemically synthesized
caaataaattataacctgttca

SEQ ID NO: 1164470 - DNA, 22 bp, Artificial Sequence
  chemically synthesized
atgcttcaaataaattataacc

SEQ ID NO: 1164471 - DNA, 22 bp, Artificial Sequence
  chemically synthesized
aatgcttcaaataaattataac

SEQ ID NO: 1164472 - DNA, 22 bp, Artificial Sequence
  chemically synthesized
cttaatgcttcaaataaattat

SEQ ID NO: 1164473 - DNA, 22 bp, Artificial Sequence
  chemically synthesized
acttaatgcttcaaataaatta

SEQ ID NO: 1164474 - DNA, 22 bp, Artificial Sequence
  chemically synthesized
tacttaatgcttcaaataaatt

SEQ ID NO: 1164475 - DNA, 22 bp, Artificial Sequence
  chemically synthesized
aacaggttataatttatttgaa

SEQ ID NO: 1164476 - DNA, 22 bp, Artificial Sequence
  chemically synthesized
ggttttacttaatgcttcaaat

SEQ ID NO: 1164477 - DNA, 22 bp, Artificial Sequence
  chemically synthesized
atctaggttttacttaatgctt

SEQ ID NO: 1164478 - DNA, 22 bp, Artificial Sequence
  chemically synthesized
taatttatttgaagcattaagt

SEQ ID NO: 1164479 - DNA, 22 bp, Artificial Sequence
  chemically synthesized
atttgaagcattaagtaaaacc

SEQ ID NO: 1164480 - DNA, 22 bp, Artificial Sequence
  chemically synthesized
tttgaagcattaagtaaaacct

SEQ ID NO: 1164481 - DNA, 22 bp, Artificial Sequence
  chemically synthesized
aaaaactaatctaggttttact

SEQ ID NO: 1164482 - DNA, 22 bp, Artificial Sequence
  chemically synthesized
aaaaaactaatctaggttttac

SEQ ID NO: 1164483 - DNA, 22 bp, Artificial Sequence
  chemically synthesized
taaaaaactaatctaggtttta

SEQ ID NO: 1164484 - DNA, 22 bp, Artificial Sequence
  chemically synthesized
gaagcattaagtaaaacctaga

SEQ ID NO: 1164485 - DNA, 22 bp, Artificial Sequence
  chemically synthesized
ttaaaaaactaatctaggtttt

SEQ ID NO: 1164486 - DNA, 22 bp, Artificial Sequence
  chemically synthesized
aagcattaagtaaaacctagat

SEQ ID NO: 1164487 - DNA, 22 bp, Artificial Sequence
  chemically synthesized
tttttaaaaaactaatctaggt

SEQ ID NO: 1164488 - DNA, 22 bp, Artificial Sequence
  chemically synthesized
agtaaaacctagattagttttt

SEQ ID NO: 1164489 - DNA, 22 bp, Artificial Sequence
  chemically synthesized
tcattatttttaaaaaactaat

SEQ ID NO: 1164490 - DNA, 22 bp, Artificial Sequence
  chemically synthesized
gattagttttttaaaaataatg

SEQ ID NO: 1164491 - DNA, 22 bp, Artificial Sequence
  chemically synthesized
gttttttaaaaataatgacaat

SEQ ID NO: 1164492 - DNA, 22 bp, Artificial Sequence
  chemically synthesized
tgaaaagagggtattgtcatta

SEQ ID NO: 1164493 - DNA, 22 bp, Artificial Sequence
  chemically synthesized
tttaaaaataatgacaataccc

SEQ ID NO: 1164494 - DNA, 22 bp, Artificial Sequence
  chemically synthesized
ttaaaaataatgacaataccct

SEQ ID NO: 1164495 - DNA, 22 bp, Artificial Sequence
  chemically synthesized
taaaaataatgacaataccctc

SEQ ID NO: 1164496 - DNA, 22 bp, Artificial Sequence
  chemically synthesized
aaaaataatgacaataccctct

SEQ ID NO: 1164497 - DNA, 22 bp, Artificial Sequence
  chemically synthesized
aaaataatgacaataccctctt

SEQ ID NO: 1164498 - DNA, 22 bp, Artificial Sequence
  chemically synthesized
tgagaggaaacaaaaaacgtga

SEQ ID NO: 1164499 - DNA, 22 bp, Artificial Sequence
  chemically synthesized
gtgagaggaaacaaaaaacgtg

SEQ ID NO: 1164500 - DNA, 22 bp, Artificial Sequence
  chemically synthesized
tgtgagaggaaacaaaaaacgt

SEQ ID NO: 1164501 - DNA, 22 bp, Artificial Sequence
  chemically synthesized
ttttcataatcacgttttttgt

SEQ ID NO: 1164502 - DNA, 22 bp, Artificial Sequence
  chemically synthesized
ttcataatcacgttttttgttt

SEQ ID NO: 1164503 - DNA, 22 bp, Artificial Sequence
  chemically synthesized
tcataatcacgttttttgtttc

SEQ ID NO: 1164504 - DNA, 22 bp, Artificial Sequence
  chemically synthesized
cataatcacgttttttgtttcc

SEQ ID NO: 1164505 - DNA, 22 bp, Artificial Sequence
  chemically synthesized
ataatcacgttttttgtttcct

SEQ ID NO: 1164506 - DNA, 22 bp, Artificial Sequence
  chemically synthesized
aaagattttgtgagaggaaaca

SEQ ID NO: 1164507 - DNA, 22 bp, Artificial Sequence
  chemically synthesized
gaaagattttgtgagaggaaac

SEQ ID NO: 1164508 - DNA, 22 bp, Artificial Sequence
  chemically synthesized
tgaaagattttgtgagaggaaa

SEQ ID NO: 1164509 - DNA, 22 bp, Artificial Sequence
  chemically synthesized
ttgaaagattttgtgagaggaa

SEQ ID NO: 1164510 - DNA, 22 bp, Artificial Sequence
  chemically synthesized
atttttgaaagattttgtgaga

SEQ ID NO: 1164511 - DNA, 22 bp, Artificial Sequence
  chemically synthesized
tttgtttcctctcacaaaatct

SEQ ID NO: 1164512 - DNA, 22 bp, Artificial Sequence
  chemically synthesized
ttgtttcctctcacaaaatctt

SEQ ID NO: 1164513 - DNA, 22 bp, Artificial Sequence
  chemically synthesized
tgtttcctctcacaaaatcttt

SEQ ID NO: 1164514 - DNA, 22 bp, Artificial Sequence
  chemically synthesized
gtttcctctcacaaaatctttc

SEQ ID NO: 1164515 - DNA, 22 bp, Artificial Sequence
  chemically synthesized
aacctgatttttgaaagatttt

SEQ ID NO: 1164516 - DNA, 22 bp, Artificial Sequence
  chemically synthesized
tttcctctcacaaaatctttca

SEQ ID NO: 1164517 - DNA, 22 bp, Artificial Sequence
  chemically synthesized
ctgaacctgatttttgaaagat

SEQ ID NO: 1164518 - DNA, 22 bp, Artificial Sequence
  chemically synthesized
cctctcacaaaatctttcaaaa

SEQ ID NO: 1164519 - DNA, 22 bp, Artificial Sequence
  chemically synthesized
gctgaacctgatttttgaaaga

SEQ ID NO: 1164520 - DNA, 22 bp, Artificial Sequence
  chemically synthesized
ctctcacaaaatctttcaaaaa

SEQ ID NO: 1164521 - DNA, 22 bp, Artificial Sequence
  chemically synthesized
tgctgaacctgatttttgaaag

SEQ ID NO: 1164522 - DNA, 22 bp, Artificial Sequence
  chemically synthesized
tcacaaaatctttcaaaaatca

SEQ ID NO: 1164523 - DNA, 22 bp, Artificial Sequence
  chemically synthesized
acaaaatctttcaaaaatcagg

SEQ ID NO: 1164524 - DNA, 22 bp, Artificial Sequence
  chemically synthesized
tgtaagctttgctgaacctgat

SEQ ID NO: 1164525 - DNA, 22 bp, Artificial Sequence
  chemically synthesized
tcaaaaatcaggttcagcaaag

SEQ ID NO: 1164526 - DNA, 22 bp, Artificial Sequence
  chemically synthesized
caaaaatcaggttcagcaaagc

SEQ ID NO: 1164527 - DNA, 22 bp, Artificial Sequence
  chemically synthesized
aaaaatcaggttcagcaaagct

SEQ ID NO: 1164528 - DNA, 22 bp, Artificial Sequence
  chemically synthesized
atgtgataagccattatgtaag

SEQ ID NO: 1164529 - DNA, 22 bp, Artificial Sequence
  chemically synthesized
taatgtgataagccattatgta

SEQ ID NO: 1164530 - DNA, 22 bp, Artificial Sequence
  chemically synthesized
agcaaagcttacataatggctt

SEQ ID NO: 1164531 - DNA, 22 bp, Artificial Sequence
  chemically synthesized
aattctaatgtgataagccatt

SEQ ID NO: 1164532 - DNA, 22 bp, Artificial Sequence
  chemically synthesized
ttaaattctaatgtgataagcc

SEQ ID NO: 1164533 - DNA, 22 bp, Artificial Sequence
  chemically synthesized
acataatggcttatcacattag

SEQ ID NO: 1164534 - DNA, 22 bp, Artificial Sequence
  chemically synthesized
cataatggcttatcacattaga

SEQ ID NO: 1164535 - DNA, 22 bp, Artificial Sequence
  chemically synthesized
gtgcataaaacctattaaattc

SEQ ID NO: 1164536 - DNA, 22 bp, Artificial Sequence
  chemically synthesized
atcacattagaatttaataggt

SEQ ID NO: 1164537 - DNA, 22 bp, Artificial Sequence
  chemically synthesized
tcacattagaatttaataggtt

SEQ ID NO: 1164538 - DNA, 22 bp, Artificial Sequence
  chemically synthesized
tgtatgtgttcgtgcataaaac

SEQ ID NO: 1164539 - DNA, 22 bp, Artificial Sequence
  chemically synthesized
gaatttaataggttttatgcac

SEQ ID NO: 1164540 - DNA, 22 bp, Artificial Sequence
  chemically synthesized
actatgtatgtgttcgtgcata

SEQ ID NO: 1164541 - DNA, 22 bp, Artificial Sequence
  chemically synthesized
gactatgtatgtgttcgtgcat

SEQ ID NO: 1164542 - DNA, 22 bp, Artificial Sequence
  chemically synthesized
tgactatgtatgtgttcgtgca

SEQ ID NO: 1164543 - DNA, 22 bp, Artificial Sequence
  chemically synthesized
aataggttttatgcacgaacac

SEQ ID NO: 1164544 - DNA, 22 bp, Artificial Sequence
  chemically synthesized
ataggttttatgcacgaacaca

SEQ ID NO: 1164545 - DNA, 22 bp, Artificial Sequence
  chemically synthesized
ccactttgactatgtatgtgtt

SEQ ID NO: 1164546 - DNA, 22 bp, Artificial Sequence
  chemically synthesized
gccactttgactatgtatgtgt

SEQ ID NO: 1164547 - DNA, 22 bp, Artificial Sequence
  chemically synthesized
tatgcacgaacacatacatagt

SEQ ID NO: 1164548 - DNA, 22 bp, Artificial Sequence
  chemically synthesized
cttgccactttgactatgtatg

SEQ ID NO: 1164549 - DNA, 22 bp, Artificial Sequence
  chemically synthesized
atgcacgaacacatacatagtc

SEQ ID NO: 1164550 - DNA, 22 bp, Artificial Sequence
  chemically synthesized
ccttgccactttgactatgtat

SEQ ID NO: 1164551 - DNA, 22 bp, Artificial Sequence
  chemically synthesized
tgcacgaacacatacatagtca

SEQ ID NO: 1164552 - DNA, 22 bp, Artificial Sequence
  chemically synthesized
taaataacagtcttccttgcca

SEQ ID NO: 1164553 - DNA, 22 bp, Artificial Sequence
  chemically synthesized
ataaataacagtcttccttgcc

SEQ ID NO: 1164554 - DNA, 22 bp, Artificial Sequence
  chemically synthesized
agaaataatatgagagtttata

SEQ ID NO: 1164555 - DNA, 22 bp, Artificial Sequence
  chemically synthesized
ttatttataaactctcatatta

SEQ ID NO: 1164556 - DNA, 22 bp, Artificial Sequence
  chemically synthesized
tttataaactctcatattattt

SEQ ID NO: 1164557 - DNA, 22 bp, Artificial Sequence
  chemically synthesized
ataaactctcatattatttctg

SEQ ID NO: 1164558 - DNA, 22 bp, Artificial Sequence
  chemically synthesized
taaactctcatattatttctga

SEQ ID NO: 1164559 - DNA, 22 bp, Artificial Sequence
  chemically synthesized
agcaacacaaattcagaaataa

SEQ ID NO: 1164560 - DNA, 22 bp, Artificial Sequence
  chemically synthesized
gagcaacacaaattcagaaata

SEQ ID NO: 1164561 - DNA, 22 bp, Artificial Sequence
  chemically synthesized
tttgagcaacacaaattcagaa

SEQ ID NO: 1164562 - DNA, 22 bp, Artificial Sequence
  chemically synthesized
tcatattatttctgaatttgtg

SEQ ID NO: 1164563 - DNA, 22 bp, Artificial Sequence
  chemically synthesized
atattatttctgaatttgtgtt

SEQ ID NO: 1164564 - DNA, 22 bp, Artificial Sequence
  chemically synthesized
tttctgaatttgtgttgctcaa

SEQ ID NO: 1164565 - DNA, 22 bp, Artificial Sequence
  chemically synthesized
ctgaatttgtgttgctcaaata

SEQ ID NO: 1164566 - DNA, 22 bp, Artificial Sequence
  chemically synthesized
tgaatttgtgttgctcaaataa

SEQ ID NO: 1164567 - DNA, 22 bp, Artificial Sequence
  chemically synthesized
aatttgtgttgctcaaataatg

SEQ ID NO: 1164568 - DNA, 22 bp, Artificial Sequence
  chemically synthesized
gtgttgctcaaataatgctttg

SEQ ID NO: 1164569 - DNA, 22 bp, Artificial Sequence
  chemically synthesized
aaaatgaatatacaaagcatta

SEQ ID NO: 1164570 - DNA, 22 bp, Artificial Sequence
  chemically synthesized
tgttgctcaaataatgctttgt

SEQ ID NO: 1164571 - DNA, 22 bp, Artificial Sequence
  chemically synthesized
aaaaatgaatatacaaagcatt

SEQ ID NO: 1164572 - DNA, 22 bp, Artificial Sequence
  chemically synthesized
cttaaaaatgaatatacaaagc

SEQ ID NO: 1164573 - DNA, 22 bp, Artificial Sequence
  chemically synthesized
ctcaaataatgctttgtatatt

SEQ ID NO: 1164574 - DNA, 22 bp, Artificial Sequence
  chemically synthesized
aaataatgctttgtatattcat

SEQ ID NO: 1164575 - DNA, 22 bp, Artificial Sequence
  chemically synthesized
gaaaattccttaaaaatgaata

SEQ ID NO: 1164576 - DNA, 22 bp, Artificial Sequence
  chemically synthesized
tggaaaattccttaaaaatgaa

SEQ ID NO: 1164577 - DNA, 22 bp, Artificial Sequence
  chemically synthesized
ctggaaaattccttaaaaatga

SEQ ID NO: 1164578 - DNA, 22 bp, Artificial Sequence
  chemically synthesized
tctggaaaattccttaaaaatg

SEQ ID NO: 1164579 - DNA, 22 bp, Artificial Sequence
  chemically synthesized
ttctggaaaattccttaaaaat

SEQ ID NO: 1164580 - DNA, 22 bp, Artificial Sequence
  chemically synthesized
tgtatattcatttttaaggaat

SEQ ID NO: 1164581 - DNA, 22 bp, Artificial Sequence
  chemically synthesized
gtatattcatttttaaggaatt

SEQ ID NO: 1164582 - DNA, 22 bp, Artificial Sequence
  chemically synthesized
tatattcatttttaaggaattt

SEQ ID NO: 1164583 - DNA, 22 bp, Artificial Sequence
  chemically synthesized
atttttaaggaattttccagaa

SEQ ID NO: 1164584 - DNA, 22 bp, Artificial Sequence
  chemically synthesized
tcacatagacttttctggaaaa

SEQ ID NO: 1164585 - DNA, 22 bp, Artificial Sequence
  chemically synthesized
tatcacatagacttttctggaa

SEQ ID NO: 1164586 - DNA, 22 bp, Artificial Sequence
  chemically synthesized
ctatcacatagacttttctgga

SEQ ID NO: 1164587 - DNA, 22 bp, Artificial Sequence
  chemically synthesized
ttaaggaattttccagaaaagt

SEQ ID NO: 1164588 - DNA, 22 bp, Artificial Sequence
  chemically synthesized
taaggaattttccagaaaagtc

SEQ ID NO: 1164589 - DNA, 22 bp, Artificial Sequence
  chemically synthesized
aaggaattttccagaaaagtct

SEQ ID NO: 1164590 - DNA, 22 bp, Artificial Sequence
  chemically synthesized
aggaattttccagaaaagtcta

SEQ ID NO: 1164591 - DNA, 22 bp, Artificial Sequence
  chemically synthesized
tccagaaaagtctatgtgatag

SEQ ID NO: 1164592 - DNA, 22 bp, Artificial Sequence
  chemically synthesized
ccagaaaagtctatgtgataga

SEQ ID NO: 1164593 - DNA, 22 bp, Artificial Sequence
  chemically synthesized
cagaaaagtctatgtgatagaa

SEQ ID NO: 1164594 - DNA, 22 bp, Artificial Sequence
  chemically synthesized
tgtgatagaagtggttacatgt

SEQ ID NO: 1164595 - DNA, 22 bp, Artificial Sequence
  chemically synthesized
aaatgagacacgtacatgtaac

SEQ ID NO: 1164596 - DNA, 22 bp, Artificial Sequence
  chemically synthesized
aaaatgagacacgtacatgtaa

SEQ ID NO: 1164597 - DNA, 22 bp, Artificial Sequence
  chemically synthesized
taaaatgagacacgtacatgta

SEQ ID NO: 1164598 - DNA, 22 bp, Artificial Sequence
  chemically synthesized
ttaaaatgagacacgtacatgt

SEQ ID NO: 1164599 - DNA, 22 bp, Artificial Sequence
  chemically synthesized
acagagtttttaaaatgagaca

SEQ ID NO: 1164600 - DNA, 22 bp, Artificial Sequence
  chemically synthesized
catgtacgtgtctcattttaaa

SEQ ID NO: 1164601 - DNA, 22 bp, Artificial Sequence
  chemically synthesized
aaacatctcacagagtttttaa

SEQ ID NO: 1164602 - DNA, 22 bp, Artificial Sequence
  chemically synthesized
ctaaaacatctcacagagtttt

SEQ ID NO: 1164603 - DNA, 22 bp, Artificial Sequence
  chemically synthesized
gctaaaacatctcacagagttt

SEQ ID NO: 1164604 - DNA, 22 bp, Artificial Sequence
  chemically synthesized
tgctaaaacatctcacagagtt

SEQ ID NO: 1164605 - DNA, 22 bp, Artificial Sequence
  chemically synthesized
ttgctaaaacatctcacagagt

SEQ ID NO: 1164606 - DNA, 22 bp, Artificial Sequence
  chemically synthesized
attttaaaaactctgtgagatg

SEQ ID NO: 1164607 - DNA, 22 bp, Artificial Sequence
  chemically synthesized
taaaaactctgtgagatgtttt

SEQ ID NO: 1164608 - DNA, 22 bp, Artificial Sequence
  chemically synthesized
aaaaactctgtgagatgtttta

SEQ ID NO: 1164609 - DNA, 22 bp, Artificial Sequence
  chemically synthesized
aaaactctgtgagatgttttag

SEQ ID NO: 1164610 - DNA, 22 bp, Artificial Sequence
  chemically synthesized
gtatagcttttgctaaaacatc

SEQ ID NO: 1164611 - DNA, 22 bp, Artificial Sequence
  chemically synthesized
gctggtatagcttttgctaaaa

SEQ ID NO: 1164612 - DNA, 22 bp, Artificial Sequence
  chemically synthesized
tagctggtatagcttttgctaa

SEQ ID NO: 1164613 - DNA, 22 bp, Artificial Sequence
  chemically synthesized
tgtgagatgttttagcaaaagc

SEQ ID NO: 1164614 - DNA, 22 bp, Artificial Sequence
  chemically synthesized
ctagctggtatagcttttgcta

SEQ ID NO: 1164615 - DNA, 22 bp, Artificial Sequence
  chemically synthesized
tgagatgttttagcaaaagcta

SEQ ID NO: 1164616 - DNA, 22 bp, Artificial Sequence
  chemically synthesized
tagcaaaagctataccagctag

SEQ ID NO: 1164617 - DNA, 22 bp, Artificial Sequence
  chemically synthesized
agcaaaagctataccagctaga

SEQ ID NO: 1164618 - DNA, 22 bp, Artificial Sequence
  chemically synthesized
gcaaaagctataccagctagaa

SEQ ID NO: 1164619 - DNA, 22 bp, Artificial Sequence
  chemically synthesized
agaaggcaaggagagccttcta

SEQ ID NO: 1164620 - DNA, 22 bp, Artificial Sequence
  chemically synthesized
ttaagaaggcaaggagagcctt

SEQ ID NO: 1164621 - DNA, 22 bp, Artificial Sequence
  chemically synthesized
taccagctagaaggctctcctt

SEQ ID NO: 1164622 - DNA, 22 bp, Artificial Sequence
  chemically synthesized
gaataattattaagaaggcaag

SEQ ID NO: 1164623 - DNA, 22 bp, Artificial Sequence
  chemically synthesized
agaataattattaagaaggcaa

SEQ ID NO: 1164624 - DNA, 22 bp, Artificial Sequence
  chemically synthesized
gaaggctctccttgccttctta

SEQ ID NO: 1164625 - DNA, 22 bp, Artificial Sequence
  chemically synthesized
tagaataattattaagaaggca

SEQ ID NO: 1164626 - DNA, 22 bp, Artificial Sequence
  chemically synthesized
ttagaataattattaagaaggc

SEQ ID NO: 1164627 - DNA, 22 bp, Artificial Sequence
  chemically synthesized
cagcttttagaataattattaa

SEQ ID NO: 1164628 - DNA, 22 bp, Artificial Sequence
  chemically synthesized
tccttgccttcttaataattat

SEQ ID NO: 1164629 - DNA, 22 bp, Artificial Sequence
  chemically synthesized
cttgccttcttaataattattc

SEQ ID NO: 1164630 - DNA, 22 bp, Artificial Sequence
  chemically synthesized
gccttcttaataattattctaa

SEQ ID NO: 1164631 - DNA, 22 bp, Artificial Sequence
  chemically synthesized
ccttcttaataattattctaaa

SEQ ID NO: 1164632 - DNA, 22 bp, Artificial Sequence
  chemically synthesized
tacgtgttacagcttttagaat

SEQ ID NO: 1164633 - DNA, 22 bp, Artificial Sequence
  chemically synthesized
gtacgtgttacagcttttagaa

SEQ ID NO: 1164634 - DNA, 22 bp, Artificial Sequence
  chemically synthesized
cttaataattattctaaaagct

SEQ ID NO: 1164635 - DNA, 22 bp, Artificial Sequence
  chemically synthesized
tgtacgtgttacagcttttaga

SEQ ID NO: 1164636 - DNA, 22 bp, Artificial Sequence
  chemically synthesized
ttaataattattctaaaagctg

SEQ ID NO: 1164637 - DNA, 22 bp, Artificial Sequence
  chemically synthesized
ttgtacgtgttacagcttttag

SEQ ID NO: 1164638 - DNA, 22 bp, Artificial Sequence
  chemically synthesized
aataattattctaaaagctgta

SEQ ID NO: 1164639 - DNA, 22 bp, Artificial Sequence
  chemically synthesized
ataattattctaaaagctgtaa

SEQ ID NO: 1164640 - DNA, 22 bp, Artificial Sequence
  chemically synthesized
aagagcttttgtacgtgttaca

SEQ ID NO: 1164641 - DNA, 22 bp, Artificial Sequence
  chemically synthesized
ttctaaaagctgtaacacgtac

SEQ ID NO: 1164642 - DNA, 22 bp, Artificial Sequence
  chemically synthesized
taaaagctgtaacacgtacaaa

SEQ ID NO: 1164643 - DNA, 22 bp, Artificial Sequence
  chemically synthesized
aaagctgtaacacgtacaaaag

SEQ ID NO: 1164644 - DNA, 22 bp, Artificial Sequence
  chemically synthesized
gggaagattcaagagcttttgt

SEQ ID NO: 1164645 - DNA, 22 bp, Artificial Sequence
  chemically synthesized
agggaagattcaagagcttttg

SEQ ID NO: 1164646 - DNA, 22 bp, Artificial Sequence
  chemically synthesized
taacacgtacaaaagctcttga

SEQ ID NO: 1164647 - DNA, 22 bp, Artificial Sequence
  chemically synthesized
tccttagggaagattcaagagc

SEQ ID NO: 1164648 - DNA, 22 bp, Artificial Sequence
  chemically synthesized
gtccttagggaagattcaagag

SEQ ID NO: 1164649 - DNA, 22 bp, Artificial Sequence
  chemically synthesized
gtttgtccttagggaagattca

SEQ ID NO: 1164650 - DNA, 22 bp, Artificial Sequence
  chemically synthesized
ttgaatcttccctaaggacaaa

SEQ ID NO: 1164651 - DNA, 22 bp, Artificial Sequence
  chemically synthesized
gaatcttccctaaggacaaact

SEQ ID NO: 1164652 - DNA, 22 bp, Artificial Sequence
  chemically synthesized
acataaaaaattagtttgtcct

SEQ ID NO: 1164653 - DNA, 22 bp, Artificial Sequence
  chemically synthesized
aatcttccctaaggacaaacta

SEQ ID NO: 1164654 - DNA, 22 bp, Artificial Sequence
  chemically synthesized
agattgacataaaaaattagtt

SEQ ID NO: 1164655 - DNA, 22 bp, Artificial Sequence
  chemically synthesized
ccctaaggacaaactaattttt

SEQ ID NO: 1164656 - DNA, 22 bp, Artificial Sequence
  chemically synthesized
cctaaggacaaactaatttttt

SEQ ID NO: 1164657 - DNA, 22 bp, Artificial Sequence
  chemically synthesized
gctgagattgacataaaaaatt

SEQ ID NO: 1164658 - DNA, 22 bp, Artificial Sequence
  chemically synthesized
aggacaaactaattttttatgt

SEQ ID NO: 1164659 - DNA, 22 bp, Artificial Sequence
  chemically synthesized
ccacctagctgagattgacata

SEQ ID NO: 1164660 - DNA, 22 bp, Artificial Sequence
  chemically synthesized
attttttatgtcaatctcagct

SEQ ID NO: 1164661 - DNA, 22 bp, Artificial Sequence
  chemically synthesized
tttatgtcaatctcagctaggt

SEQ ID NO: 1164662 - DNA, 22 bp, Artificial Sequence
  chemically synthesized
ttatgtcaatctcagctaggtg

SEQ ID NO: 1164663 - DNA, 22 bp, Artificial Sequence
  chemically synthesized
tatgtcaatctcagctaggtgg

SEQ ID NO: 1164664 - DNA, 22 bp, Artificial Sequence
  chemically synthesized
atgtcaatctcagctaggtggt

SEQ ID NO: 1164665 - DNA, 22 bp, Artificial Sequence
  chemically synthesized
tgtcaatctcagctaggtggta

SEQ ID NO: 1164666 - DNA, 22 bp, Artificial Sequence
  chemically synthesized
aaatggcagtattaccacctag

SEQ ID NO: 1164667 - DNA, 22 bp, Artificial Sequence
  chemically synthesized
agctaggtggtaatactgccat

SEQ ID NO: 1164668 - DNA, 22 bp, Artificial Sequence
  chemically synthesized
ggtggtaatactgccattttag

SEQ ID NO: 1164669 - DNA, 22 bp, Artificial Sequence
  chemically synthesized
gagaatggaaatgctaaaatgg

SEQ ID NO: 1164670 - DNA, 22 bp, Artificial Sequence
  chemically synthesized
ccattttagcatttccattctc

SEQ ID NO: 1164671 - DNA, 22 bp, Artificial Sequence
  chemically synthesized
atccccatcccactagagaatg

SEQ ID NO: 1164672 - DNA, 22 bp, Artificial Sequence
  chemically synthesized
tagcatttccattctctagtgg

SEQ ID NO: 1164673 - DNA, 22 bp, Artificial Sequence
  chemically synthesized
ctcatccccatcccactagaga

SEQ ID NO: 1164674 - DNA, 22 bp, Artificial Sequence
  chemically synthesized
agcatttccattctctagtggg

SEQ ID NO: 1164675 - DNA, 22 bp, Artificial Sequence
  chemically synthesized
cctcatccccatcccactagag

SEQ ID NO: 1164676 - DNA, 22 bp, Artificial Sequence
  chemically synthesized
gcatttccattctctagtggga

SEQ ID NO: 1164677 - DNA, 22 bp, Artificial Sequence
  chemically synthesized
ccattctctagtgggatgggga

SEQ ID NO: 1164678 - DNA, 22 bp, Artificial Sequence
  chemically synthesized
cattctctagtgggatggggat

SEQ ID NO: 1164679 - DNA, 22 bp, Artificial Sequence
  chemically synthesized
tgcgtgtaatttcctcatcccc

SEQ ID NO: 1164680 - DNA, 22 bp, Artificial Sequence
  chemically synthesized
tctagtgggatggggatgagga

SEQ ID NO: 1164681 - DNA, 22 bp, Artificial Sequence
  chemically synthesized
tgtgcgtgtaatttcctcatcc

SEQ ID NO: 1164682 - DNA, 22 bp, Artificial Sequence
  chemically synthesized
tagtgggatggggatgaggaaa

SEQ ID NO: 1164683 - DNA, 22 bp, Artificial Sequence
  chemically synthesized
ctgtgcgtgtaatttcctcatc

SEQ ID NO: 1164684 - DNA, 22 bp, Artificial Sequence
  chemically synthesized
gtgggatggggatgaggaaatt

SEQ ID NO: 1164685 - DNA, 22 bp, Artificial Sequence
  chemically synthesized
gacttctgtgcgtgtaatttcc

SEQ ID NO: 1164686 - DNA, 22 bp, Artificial Sequence
  chemically synthesized
cacgcacagaagtctaggtgtc

SEQ ID NO: 1164687 - DNA, 22 bp, Artificial Sequence
  chemically synthesized
agtgaaggatgacagacaccta

SEQ ID NO: 1164688 - DNA, 22 bp, Artificial Sequence
  chemically synthesized
ccattaagtgaaggatgacaga

SEQ ID NO: 1164689 - DNA, 22 bp, Artificial Sequence
  chemically synthesized
ggtgtctgtcatccttcactta

SEQ ID NO: 1164690 - DNA, 22 bp, Artificial Sequence
  chemically synthesized
aagggatgtctgccattaagtg

SEQ ID NO: 1164691 - DNA, 22 bp, Artificial Sequence
  chemically synthesized
caagggatgtctgccattaagt

SEQ ID NO: 1164692 - DNA, 22 bp, Artificial Sequence
  chemically synthesized
tcatccttcacttaatggcaga

SEQ ID NO: 1164693 - DNA, 22 bp, Artificial Sequence
  chemically synthesized
cccccttcaagggatgtctgcc

SEQ ID NO: 1164694 - DNA, 22 bp, Artificial Sequence
  chemically synthesized
cacttaatggcagacatccctt

SEQ ID NO: 1164695 - DNA, 22 bp, Artificial Sequence
  chemically synthesized
acttaatggcagacatcccttg

SEQ ID NO: 1164696 - DNA, 22 bp, Artificial Sequence
  chemically synthesized
aaaaattccccccttcaaggga

SEQ ID NO: 1164697 - DNA, 22 bp, Artificial Sequence
  chemically synthesized
aatggcagacatcccttgaagg

SEQ ID NO: 1164698 - DNA, 22 bp, Artificial Sequence
  chemically synthesized
atggcagacatcccttgaaggg

SEQ ID NO: 1164699 - DNA, 22 bp, Artificial Sequence
  chemically synthesized
attcaaaaattccccccttcaa

SEQ ID NO: 1164700 - DNA, 22 bp, Artificial Sequence
  chemically synthesized
aaaagatgttcattcaaaaatt

SEQ ID NO: 1164701 - DNA, 22 bp, Artificial Sequence
  chemically synthesized
aaaaagatgttcattcaaaaat

SEQ ID NO: 1164702 - DNA, 22 bp, Artificial Sequence
  chemically synthesized
gaaggggggaatttttgaatga

SEQ ID NO: 1164703 - DNA, 22 bp, Artificial Sequence
  chemically synthesized
aaggggggaatttttgaatgaa

SEQ ID NO: 1164704 - DNA, 22 bp, Artificial Sequence
  chemically synthesized
acatttaaaaagatgttcattc

SEQ ID NO: 1164705 - DNA, 22 bp, Artificial Sequence
  chemically synthesized
taacatttaaaaagatgttcat

SEQ ID NO: 1164706 - DNA, 22 bp, Artificial Sequence
  chemically synthesized
tgattctaacatttaaaaagat

SEQ ID NO: 1164707 - DNA, 22 bp, Artificial Sequence
  chemically synthesized
ttgaatgaacatctttttaaat

SEQ ID NO: 1164708 - DNA, 22 bp, Artificial Sequence
  chemically synthesized
tgaatgaacatctttttaaatg

SEQ ID NO: 1164709 - DNA, 22 bp, Artificial Sequence
  chemically synthesized
gaatgaacatctttttaaatgt

SEQ ID NO: 1164710 - DNA, 22 bp, Artificial Sequence
  chemically synthesized
tctgtgattctaacatttaaaa

SEQ ID NO: 1164711 - DNA, 22 bp, Artificial Sequence
  chemically synthesized
aatgaacatctttttaaatgtt

SEQ ID NO: 1164712 - DNA, 22 bp, Artificial Sequence
  chemically synthesized
atctgtgattctaacatttaaa

SEQ ID NO: 1164713 - DNA, 22 bp, Artificial Sequence
  chemically synthesized
tatctgtgattctaacatttaa

SEQ ID NO: 1164714 - DNA, 22 bp, Artificial Sequence
  chemically synthesized
ttatctgtgattctaacattta

SEQ ID NO: 1164715 - DNA, 22 bp, Artificial Sequence
  chemically synthesized
tttaaatgttagaatcacagat

SEQ ID NO: 1164716 - DNA, 22 bp, Artificial Sequence
  chemically synthesized
ttaaatgttagaatcacagata

SEQ ID NO: 1164717 - DNA, 22 bp, Artificial Sequence
  chemically synthesized
taaatgttagaatcacagataa

SEQ ID NO: 1164718 - DNA, 22 bp, Artificial Sequence
  chemically synthesized
aaatgttagaatcacagataaa

SEQ ID NO: 1164719 - DNA, 22 bp, Artificial Sequence
  chemically synthesized
aatgttagaatcacagataaaa

SEQ ID NO: 1164720 - DNA, 22 bp, Artificial Sequence
  chemically synthesized
aaacataaaaaaagtcttttat

SEQ ID NO: 1164721 - DNA, 22 bp, Artificial Sequence
  chemically synthesized
gaatcacagataaaagactttt

SEQ ID NO: 1164722 - DNA, 22 bp, Artificial Sequence
  chemically synthesized
tctgaaacataaaaaaagtctt

SEQ ID NO: 1164723 - DNA, 22 bp, Artificial Sequence
  chemically synthesized
atctgaaacataaaaaaagtct

SEQ ID NO: 1164724 - DNA, 22 bp, Artificial Sequence
  chemically synthesized
cttatctgaaacataaaaaaag

SEQ ID NO: 1164725 - DNA, 22 bp, Artificial Sequence
  chemically synthesized
gcttatctgaaacataaaaaaa

SEQ ID NO: 1164726 - DNA, 22 bp, Artificial Sequence
  chemically synthesized
tgcttatctgaaacataaaaaa

SEQ ID NO: 1164727 - DNA, 22 bp, Artificial Sequence
  chemically synthesized
tttgcttatctgaaacataaaa

SEQ ID NO: 1164728 - DNA, 22 bp, Artificial Sequence
  chemically synthesized
ctttgcttatctgaaacataaa

SEQ ID NO: 1164729 - DNA, 22 bp, Artificial Sequence
  chemically synthesized
tctttgcttatctgaaacataa

SEQ ID NO: 1164730 - DNA, 22 bp, Artificial Sequence
  chemically synthesized
ttctttgcttatctgaaacata

SEQ ID NO: 1164731 - DNA, 22 bp, Artificial Sequence
  chemically synthesized
tttctttgcttatctgaaacat

SEQ ID NO: 1164732 - DNA, 22 bp, Artificial Sequence
  chemically synthesized
caactttttctttgcttatctg

SEQ ID NO: 1164733 - DNA, 22 bp, Artificial Sequence
  chemically synthesized
tttttatgtttcagataagcaa

SEQ ID NO: 1164734 - DNA, 22 bp, Artificial Sequence
  chemically synthesized
ttttatgtttcagataagcaaa

SEQ ID NO: 1164735 - DNA, 22 bp, Artificial Sequence
  chemically synthesized
tttatgtttcagataagcaaag

SEQ ID NO: 1164736 - DNA, 22 bp, Artificial Sequence
  chemically synthesized
ttatgtttcagataagcaaaga

SEQ ID NO: 1164737 - DNA, 22 bp, Artificial Sequence
  chemically synthesized
tatgtttcagataagcaaagaa

SEQ ID NO: 1164738 - DNA, 22 bp, Artificial Sequence
  chemically synthesized
atgtttcagataagcaaagaaa

SEQ ID NO: 1164739 - DNA, 22 bp, Artificial Sequence
  chemically synthesized
aaattgcaactttttctttgct

SEQ ID NO: 1164740 - DNA, 22 bp, Artificial Sequence
  chemically synthesized
tgtttcagataagcaaagaaaa

SEQ ID NO: 1164741 - DNA, 22 bp, Artificial Sequence
  chemically synthesized
cagataagcaaagaaaaagttg

SEQ ID NO: 1164742 - DNA, 22 bp, Artificial Sequence
  chemically synthesized
gaattaaaattgcaactttttc

SEQ ID NO: 1164743 - DNA, 22 bp, Artificial Sequence
  chemically synthesized
agataagcaaagaaaaagttgc

SEQ ID NO: 1164744 - DNA, 22 bp, Artificial Sequence
  chemically synthesized
ctggaattaaaattgcaacttt

SEQ ID NO: 1164745 - DNA, 22 bp, Artificial Sequence
  chemically synthesized
ctcctggaattaaaattgcaac

SEQ ID NO: 1164746 - DNA, 22 bp, Artificial Sequence
  chemically synthesized
caattttaattccaggaggaat

SEQ ID NO: 1164747 - DNA, 22 bp, Artificial Sequence
  chemically synthesized
caagaaaatatgaattcctcct

SEQ ID NO: 1164748 - DNA, 22 bp, Artificial Sequence
  chemically synthesized
taattccaggaggaattcatat

SEQ ID NO: 1164749 - DNA, 22 bp, Artificial Sequence
  chemically synthesized
agttgcaagaaaatatgaattc

SEQ ID NO: 1164750 - DNA, 22 bp, Artificial Sequence
  chemically synthesized
aattccaggaggaattcatatt

SEQ ID NO: 1164751 - DNA, 22 bp, Artificial Sequence
  chemically synthesized
attccaggaggaattcatattt

SEQ ID NO: 1164752 - DNA, 22 bp, Artificial Sequence
  chemically synthesized
caggaggaattcatattttctt

SEQ ID NO: 1164753 - DNA, 22 bp, Artificial Sequence
  chemically synthesized
tgtgaaattgagttgcaagaaa

SEQ ID NO: 1164754 - DNA, 22 bp, Artificial Sequence
  chemically synthesized
ctgtgtgaaattgagttgcaag

SEQ ID NO: 1164755 - DNA, 22 bp, Artificial Sequence
  chemically synthesized
attgctgtgtgaaattgagttg

SEQ ID NO: 1164756 - DNA, 22 bp, Artificial Sequence
  chemically synthesized
atattttcttgcaactcaattt

SEQ ID NO: 1164757 - DNA, 22 bp, Artificial Sequence
  chemically synthesized
attaattgctgtgtgaaattga

SEQ ID NO: 1164758 - DNA, 22 bp, Artificial Sequence
  chemically synthesized
tcttgcaactcaatttcacaca

SEQ ID NO: 1164759 - DNA, 22 bp, Artificial Sequence
  chemically synthesized
cttgcaactcaatttcacacag

SEQ ID NO: 1164760 - DNA, 22 bp, Artificial Sequence
  chemically synthesized
ttgcaactcaatttcacacagc

SEQ ID NO: 1164761 - DNA, 22 bp, Artificial Sequence
  chemically synthesized
gcaactcaatttcacacagcaa

SEQ ID NO: 1164762 - DNA, 22 bp, Artificial Sequence
  chemically synthesized
caactcaatttcacacagcaat

SEQ ID NO: 1164763 - DNA, 22 bp, Artificial Sequence
  chemically synthesized
atcagttaattaattgctgtgt

SEQ ID NO: 1164764 - DNA, 22 bp, Artificial Sequence
  chemically synthesized
aatttcacacagcaattaatta

SEQ ID NO: 1164765 - DNA, 22 bp, Artificial Sequence
  chemically synthesized
atactaatcagttaattaattg

SEQ ID NO: 1164766 - DNA, 22 bp, Artificial Sequence
  chemically synthesized
ttcatactaatcagttaattaa

SEQ ID NO: 1164767 - DNA, 22 bp, Artificial Sequence
  chemically synthesized
cacacagcaattaattaactga

SEQ ID NO: 1164768 - DNA, 22 bp, Artificial Sequence
  chemically synthesized
acacagcaattaattaactgat

SEQ ID NO: 1164769 - DNA, 22 bp, Artificial Sequence
  chemically synthesized
attattcatactaatcagttaa

SEQ ID NO: 1164770 - DNA, 22 bp, Artificial Sequence
  chemically synthesized
attaactgattagtatgaataa

SEQ ID NO: 1164771 - DNA, 22 bp, Artificial Sequence
  chemically synthesized
acaatatggcattaattattca

SEQ ID NO: 1164772 - DNA, 22 bp, Artificial Sequence
  chemically synthesized
actgattagtatgaataattaa

SEQ ID NO: 1164773 - DNA, 22 bp, Artificial Sequence
  chemically synthesized
attagtatgaataattaatgcc

SEQ ID NO: 1164774 - DNA, 22 bp, Artificial Sequence
  chemically synthesized
gtatgaataattaatgccatat

SEQ ID NO: 1164775 - DNA, 22 bp, Artificial Sequence
  chemically synthesized
aataaaactaacaatatggcat

SEQ ID NO: 1164776 - DNA, 22 bp, Artificial Sequence
  chemically synthesized
caataaaactaacaatatggca

SEQ ID NO: 1164777 - DNA, 22 bp, Artificial Sequence
  chemically synthesized
tcaataaaactaacaatatggc

SEQ ID NO: 1164778 - DNA, 22 bp, Artificial Sequence
  chemically synthesized
cccattttcaataaaactaaca

SEQ ID NO: 1164779 - DNA, 22 bp, Artificial Sequence
  chemically synthesized
atgccatattgttagttttatt

SEQ ID NO: 1164780 - DNA, 22 bp, Artificial Sequence
  chemically synthesized
cactccccattttcaataaaac

SEQ ID NO: 1164781 - DNA, 22 bp, Artificial Sequence
  chemically synthesized
acactccccattttcaataaaa

SEQ ID NO: 1164782 - DNA, 22 bp, Artificial Sequence
  chemically synthesized
ttacactccccattttcaataa

SEQ ID NO: 1164783 - DNA, 22 bp, Artificial Sequence
  chemically synthesized
cttacactccccattttcaata

SEQ ID NO: 1164784 - DNA, 22 bp, Artificial Sequence
  chemically synthesized
tcttacactccccattttcaat

SEQ ID NO: 1164785 - DNA, 22 bp, Artificial Sequence
  chemically synthesized
ttcttacactccccattttcaa

SEQ ID NO: 1164786 - DNA, 22 bp, Artificial Sequence
  chemically synthesized
ttagttttattgaaaatgggga

SEQ ID NO: 1164787 - DNA, 22 bp, Artificial Sequence
  chemically synthesized
atttttcttacactccccattt

SEQ ID NO: 1164788 - DNA, 22 bp, Artificial Sequence
  chemically synthesized
gttttattgaaaatggggagtg

SEQ ID NO: 1164789 - DNA, 22 bp, Artificial Sequence
  chemically synthesized
tcatttttcttacactccccat

SEQ ID NO: 1164790 - DNA, 22 bp, Artificial Sequence
  chemically synthesized
tattgaaaatggggagtgtaag

SEQ ID NO: 1164791 - DNA, 22 bp, Artificial Sequence
  chemically synthesized
attgaaaatggggagtgtaaga

SEQ ID NO: 1164792 - DNA, 22 bp, Artificial Sequence
  chemically synthesized
ttgaaaatggggagtgtaagaa

SEQ ID NO: 1164793 - DNA, 22 bp, Artificial Sequence
  chemically synthesized
aatgctctcatttttcttacac

SEQ ID NO: 1164794 - DNA, 22 bp, Artificial Sequence
  chemically synthesized
aaaatggggagtgtaagaaaaa

SEQ ID NO: 1164795 - DNA, 22 bp, Artificial Sequence
  chemically synthesized
gaggctaaatgctctcattttt

SEQ ID NO: 1164796 - DNA, 22 bp, Artificial Sequence
  chemically synthesized
ctggaggctaaatgctctcatt

SEQ ID NO: 1164797 - DNA, 22 bp, Artificial Sequence
  chemically synthesized
tcctggaggctaaatgctctca

SEQ ID NO: 1164798 - DNA, 22 bp, Artificial Sequence
  chemically synthesized
catcctctcctggaggctaaat

SEQ ID NO: 1164799 - DNA, 22 bp, Artificial Sequence
  chemically synthesized
ccatcctctcctggaggctaaa

SEQ ID NO: 1164800 - DNA, 22 bp, Artificial Sequence
  chemically synthesized
ggtttccatcctctcctggagg

SEQ ID NO: 1164801 - DNA, 22 bp, Artificial Sequence
  chemically synthesized
taggtttccatcctctcctgga

SEQ ID NO: 1164802 - DNA, 22 bp, Artificial Sequence
  chemically synthesized
tgcactctaggtttccatcctc

SEQ ID NO: 1164803 - DNA, 22 bp, Artificial Sequence
  chemically synthesized
agcctccaggagaggatggaaa

SEQ ID NO: 1164804 - DNA, 22 bp, Artificial Sequence
  chemically synthesized
gtgcactctaggtttccatcct

SEQ ID NO: 1164805 - DNA, 22 bp, Artificial Sequence
  chemically synthesized
gcctccaggagaggatggaaac

SEQ ID NO: 1164806 - DNA, 22 bp, Artificial Sequence
  chemically synthesized
tgtgcactctaggtttccatcc

SEQ ID NO: 1164807 - DNA, 22 bp, Artificial Sequence
  chemically synthesized
ctttgtgcactctaggtttcca

SEQ ID NO: 1164808 - DNA, 22 bp, Artificial Sequence
  chemically synthesized
caggagaggatggaaacctaga

SEQ ID NO: 1164809 - DNA, 22 bp, Artificial Sequence
  chemically synthesized
tcctttgtgcactctaggtttc

SEQ ID NO: 1164810 - DNA, 22 bp, Artificial Sequence
  chemically synthesized
ctcctttgtgcactctaggttt

SEQ ID NO: 1164811 - DNA, 22 bp, Artificial Sequence
  chemically synthesized
gagtgcacaaaggagaagacac

SEQ ID NO: 1164812 - DNA, 22 bp, Artificial Sequence
  chemically synthesized
ccataatagccaccagtgtctt

SEQ ID NO: 1164813 - DNA, 22 bp, Artificial Sequence
  chemically synthesized
gccataatagccaccagtgtct

SEQ ID NO: 1164814 - DNA, 22 bp, Artificial Sequence
  chemically synthesized
tccttgccataatagccaccag

SEQ ID NO: 1164815 - DNA, 22 bp, Artificial Sequence
  chemically synthesized
ctgtccttgccataatagccac

SEQ ID NO: 1164816 - DNA, 22 bp, Artificial Sequence
  chemically synthesized
actgtccttgccataatagcca

SEQ ID NO: 1164817 - DNA, 22 bp, Artificial Sequence
  chemically synthesized
tactgtccttgccataatagcc

SEQ ID NO: 1164818 - DNA, 22 bp, Artificial Sequence
  chemically synthesized
tttactgtccttgccataatag

SEQ ID NO: 1164819 - DNA, 22 bp, Artificial Sequence
  chemically synthesized
gtggctattatggcaaggacag

SEQ ID NO: 1164820 - DNA, 22 bp, Artificial Sequence
  chemically synthesized
ttatggcaaggacagtaaagag

SEQ ID NO: 1164821 - DNA, 22 bp, Artificial Sequence
  chemically synthesized
aaaatccaaccacctctttact

SEQ ID NO: 1164822 - DNA, 22 bp, Artificial Sequence
  chemically synthesized
gaaaatccaaccacctctttac

SEQ ID NO: 1164823 - DNA, 22 bp, Artificial Sequence
  chemically synthesized
tggcaaggacagtaaagaggtg

SEQ ID NO: 1164824 - DNA, 22 bp, Artificial Sequence
  chemically synthesized
tgaaaatccaaccacctcttta

SEQ ID NO: 1164825 - DNA, 22 bp, Artificial Sequence
  chemically synthesized
gaaagttttgaaaatccaacca

SEQ ID NO: 1164826 - DNA, 22 bp, Artificial Sequence
  chemically synthesized
aaacaaaattagaaagttttga

SEQ ID NO: 1164827 - DNA, 22 bp, Artificial Sequence
  chemically synthesized
gattttcaaaactttctaattt

SEQ ID NO: 1164828 - DNA, 22 bp, Artificial Sequence
  chemically synthesized
aagcaacctcaaacaaaattag

SEQ ID NO: 1164829 - DNA, 22 bp, Artificial Sequence
  chemically synthesized
aaagcaacctcaaacaaaatta

SEQ ID NO: 1164830 - DNA, 22 bp, Artificial Sequence
  chemically synthesized
tcaaaactttctaattttgttt

SEQ ID NO: 1164831 - DNA, 22 bp, Artificial Sequence
  chemically synthesized
caaaactttctaattttgtttg

SEQ ID NO: 1164832 - DNA, 22 bp, Artificial Sequence
  chemically synthesized
aaaactttctaattttgtttga

SEQ ID NO: 1164833 - DNA, 22 bp, Artificial Sequence
  chemically synthesized
tggaacttaaagcaacctcaaa

SEQ ID NO: 1164834 - DNA, 22 bp, Artificial Sequence
  chemically synthesized
tctaattttgtttgaggttgct

SEQ ID NO: 1164835 - DNA, 22 bp, Artificial Sequence
  chemically synthesized
ctaattttgtttgaggttgctt

SEQ ID NO: 1164836 - DNA, 22 bp, Artificial Sequence
  chemically synthesized
taattttgtttgaggttgcttt

SEQ ID NO: 1164837 - DNA, 22 bp, Artificial Sequence
  chemically synthesized
attttgtttgaggttgctttaa

SEQ ID NO: 1164838 - DNA, 22 bp, Artificial Sequence
  chemically synthesized
tgtttgaggttgctttaagttc

SEQ ID NO: 1164839 - DNA, 22 bp, Artificial Sequence
  chemically synthesized
cagtgatctgtggaacttaaag

SEQ ID NO: 1164840 - DNA, 22 bp, Artificial Sequence
  chemically synthesized
gtttgaggttgctttaagttcc

SEQ ID NO: 1164841 - DNA, 22 bp, Artificial Sequence
  chemically synthesized
gcagtgatctgtggaacttaaa

SEQ ID NO: 1164842 - DNA, 22 bp, Artificial Sequence
  chemically synthesized
tttgaggttgctttaagttcca

SEQ ID NO: 1164843 - DNA, 22 bp, Artificial Sequence
  chemically synthesized
tttgcagtgatctgtggaactt

SEQ ID NO: 1164844 - DNA, 22 bp, Artificial Sequence
  chemically synthesized
gaggttgctttaagttccacag

SEQ ID NO: 1164845 - DNA, 22 bp, Artificial Sequence
  chemically synthesized
aggttgctttaagttccacaga

SEQ ID NO: 1164846 - DNA, 22 bp, Artificial Sequence
  chemically synthesized
tatttgcagtgatctgtggaac

SEQ ID NO: 1164847 - DNA, 22 bp, Artificial Sequence
  chemically synthesized
ctatttgcagtgatctgtggaa

SEQ ID NO: 1164848 - DNA, 22 bp, Artificial Sequence
  chemically synthesized
ctttaagttccacagatcactg

SEQ ID NO: 1164849 - DNA, 22 bp, Artificial Sequence
  chemically synthesized
gaacttctatttgcagtgatct

SEQ ID NO: 1164850 - DNA, 22 bp, Artificial Sequence
  chemically synthesized
taagttccacagatcactgcaa

SEQ ID NO: 1164851 - DNA, 22 bp, Artificial Sequence
  chemically synthesized
aagttccacagatcactgcaaa

SEQ ID NO: 1164852 - DNA, 22 bp, Artificial Sequence
  chemically synthesized
agttccacagatcactgcaaat

SEQ ID NO: 1164853 - DNA, 22 bp, Artificial Sequence
  chemically synthesized
aggttagaacttctatttgcag

SEQ ID NO: 1164854 - DNA, 22 bp, Artificial Sequence
  chemically synthesized
caggttagaacttctatttgca

SEQ ID NO: 1164855 - DNA, 22 bp, Artificial Sequence
  chemically synthesized
cacagatcactgcaaatagaag

SEQ ID NO: 1164856 - DNA, 22 bp, Artificial Sequence
  chemically synthesized
ttcaggttagaacttctatttg

SEQ ID NO: 1164857 - DNA, 22 bp, Artificial Sequence
  chemically synthesized
caaatagaagttctaacctgaa

SEQ ID NO: 1164858 - DNA, 22 bp, Artificial Sequence
  chemically synthesized
tggtcatatgccaacattcttc

SEQ ID NO: 1164859 - DNA, 22 bp, Artificial Sequence
  chemically synthesized
tgtggtcatatgccaacattct

SEQ ID NO: 1164860 - DNA, 22 bp, Artificial Sequence
  chemically synthesized
ctgtggtcatatgccaacattc

SEQ ID NO: 1164861 - DNA, 22 bp, Artificial Sequence
  chemically synthesized
taacctgaagaatgttggcata

SEQ ID NO: 1164862 - DNA, 22 bp, Artificial Sequence
  chemically synthesized
ccttctgtggtcatatgccaac

SEQ ID NO: 1164863 - DNA, 22 bp, Artificial Sequence
  chemically synthesized
acctgaagaatgttggcatatg

SEQ ID NO: 1164864 - DNA, 22 bp, Artificial Sequence
  chemically synthesized
aagaatgttggcatatgaccac

SEQ ID NO: 1164865 - DNA, 22 bp, Artificial Sequence
  chemically synthesized
agatataagctgccttctgtgg

SEQ ID NO: 1164866 - DNA, 22 bp, Artificial Sequence
  chemically synthesized
gcatatgaccacagaaggcagc

SEQ ID NO: 1164867 - DNA, 22 bp, Artificial Sequence
  chemically synthesized
tcgatattaagatataagctgc

SEQ ID NO: 1164868 - DNA, 22 bp, Artificial Sequence
  chemically synthesized
ttatcgatattaagatataagc

SEQ ID NO: 1164869 - DNA, 22 bp, Artificial Sequence
  chemically synthesized
catctattatcgatattaagat

SEQ ID NO: 1164870 - DNA, 22 bp, Artificial Sequence
  chemically synthesized
ctccatctattatcgatattaa

SEQ ID NO: 1164871 - DNA, 22 bp, Artificial Sequence
  chemically synthesized
actccatctattatcgatatta

SEQ ID NO: 1164872 - DNA, 22 bp, Artificial Sequence
  chemically synthesized
atttactccatctattatcgat

SEQ ID NO: 1164873 - DNA, 22 bp, Artificial Sequence
  chemically synthesized
atatcttaatatcgataataga

SEQ ID NO: 1164874 - DNA, 22 bp, Artificial Sequence
  chemically synthesized
tatcttaatatcgataatagat

SEQ ID NO: 1164875 - DNA, 22 bp, Artificial Sequence
  chemically synthesized
aatatcgataatagatggagta

SEQ ID NO: 1164876 - DNA, 22 bp, Artificial Sequence
  chemically synthesized
atatcgataatagatggagtaa

SEQ ID NO: 1164877 - DNA, 22 bp, Artificial Sequence
  chemically synthesized
ccaggtccactaatttactcca

SEQ ID NO: 1164878 - DNA, 22 bp, Artificial Sequence
  chemically synthesized
accaggtccactaatttactcc

SEQ ID NO: 1164879 - DNA, 22 bp, Artificial Sequence
  chemically synthesized
cccagtgtttaccaggtccact

SEQ ID NO: 1164880 - DNA, 22 bp, Artificial Sequence
  chemically synthesized
cccactccccagtgtttaccag

SEQ ID NO: 1164881 - DNA, 22 bp, Artificial Sequence
  chemically synthesized
gtggacctggtaaacactgggg

SEQ ID NO: 1164882 - DNA, 22 bp, Artificial Sequence
  chemically synthesized
agtctgcccactccccagtgtt

SEQ ID NO: 1164883 - DNA, 22 bp, Artificial Sequence
  chemically synthesized
ttgagtctgcccactccccagt

SEQ ID NO: 1164884 - DNA, 22 bp, Artificial Sequence
  chemically synthesized
gtaaacactggggagtgggcag

SEQ ID NO: 1164885 - DNA, 22 bp, Artificial Sequence
  chemically synthesized
taactgttgagtctgcccactc

SEQ ID NO: 1164886 - DNA, 22 bp, Artificial Sequence
  chemically synthesized
gggagtgggcagactcaacagt

SEQ ID NO: 1164887 - DNA, 22 bp, Artificial Sequence
  chemically synthesized
aacagttataatatgattattg

SEQ ID NO: 1164888 - DNA, 22 bp, Artificial Sequence
  chemically synthesized
gatgtgagaggtacaataatca

SEQ ID NO: 1164889 - DNA, 22 bp, Artificial Sequence
  chemically synthesized
cccctagatgtgagaggtacaa

SEQ ID NO: 1164890 - DNA, 22 bp, Artificial Sequence
  chemically synthesized
taatatgattattgtacctctc

SEQ ID NO: 1164891 - DNA, 22 bp, Artificial Sequence
  chemically synthesized
tcactacccctagatgtgagag

SEQ ID NO: 1164892 - DNA, 22 bp, Artificial Sequence
  chemically synthesized
ttgtacctctcacatctagggg

SEQ ID NO: 1164893 - DNA, 22 bp, Artificial Sequence
  chemically synthesized
tacctctcacatctaggggtag

SEQ ID NO: 1164894 - DNA, 22 bp, Artificial Sequence
  chemically synthesized
tcacatctaggggtagtgacaa

SEQ ID NO: 1164895 - DNA, 22 bp, Artificial Sequence
  chemically synthesized
acatctaggggtagtgacaatc

SEQ ID NO: 1164896 - DNA, 22 bp, Artificial Sequence
  chemically synthesized
tgatcgtggtgatgattgtcac

SEQ ID NO: 1164897 - DNA, 22 bp, Artificial Sequence
  chemically synthesized
ctgtgatcgtggtgatgattgt

SEQ ID NO: 1164898 - DNA, 22 bp, Artificial Sequence
  chemically synthesized
ggggtagtgacaatcatcacca

SEQ ID NO: 1164899 - DNA, 22 bp, Artificial Sequence
  chemically synthesized
gcctgctgtgatcgtggtgatg

SEQ ID NO: 1164900 - DNA, 22 bp, Artificial Sequence
  chemically synthesized
ttcgcctgctgtgatcgtggtg

SEQ ID NO: 1164901 - DNA, 22 bp, Artificial Sequence
  chemically synthesized
atattattcgcctgctgtgatc

SEQ ID NO: 1164902 - DNA, 22 bp, Artificial Sequence
  chemically synthesized
tgcatattgatattattcgcct

SEQ ID NO: 1164903 - DNA, 22 bp, Artificial Sequence
  chemically synthesized
atctatgcatattgatattatt

SEQ ID NO: 1164904 - DNA, 22 bp, Artificial Sequence
  chemically synthesized
caagccaggagatactaatcta

SEQ ID NO: 1164905 - DNA, 22 bp, Artificial Sequence
  chemically synthesized
tatatgtattccaagccaggag

SEQ ID NO: 1164906 - DNA, 22 bp, Artificial Sequence
  chemically synthesized
ataactatatatgtattccaag

SEQ ID NO: 1164907 - DNA, 22 bp, Artificial Sequence
  chemically synthesized
gtatctcctggcttggaataca

SEQ ID NO: 1164908 - DNA, 22 bp, Artificial Sequence
  chemically synthesized
cataactatatatgtattccaa

SEQ ID NO: 1164909 - DNA, 22 bp, Artificial Sequence
  chemically synthesized
ctggcttggaatacatatatag

SEQ ID NO: 1164910 - DNA, 22 bp, Artificial Sequence
  chemically synthesized
gcttggaatacatatatagtta

SEQ ID NO: 1164911 - DNA, 22 bp, Artificial Sequence
  chemically synthesized
ggaatacatatatagttatgaa

SEQ ID NO: 1164912 - DNA, 22 bp, Artificial Sequence
  chemically synthesized
gaatacatatatagttatgaaa

SEQ ID NO: 1164913 - DNA, 22 bp, Artificial Sequence
  chemically synthesized
tgaaacctctatcttacatgta

SEQ ID NO: 1164914 - DNA, 22 bp, Artificial Sequence
  chemically synthesized
aaagaataaataaggtacatgt

SEQ ID NO: 1164915 - DNA, 22 bp, Artificial Sequence
  chemically synthesized
gaaagaataaataaggtacatg

SEQ ID NO: 1164916 - DNA, 22 bp, Artificial Sequence
  chemically synthesized
tgaaagaataaataaggtacat

SEQ ID NO: 1164917 - DNA, 22 bp, Artificial Sequence
  chemically synthesized
ttgaaagaataaataaggtaca

SEQ ID NO: 1164918 - DNA, 22 bp, Artificial Sequence
  chemically synthesized
tatcttacatgtaccttattta

SEQ ID NO: 1164919 - DNA, 22 bp, Artificial Sequence
  chemically synthesized
tcttacatgtaccttatttatt

SEQ ID NO: 1164920 - DNA, 22 bp, Artificial Sequence
  chemically synthesized
aggccttttgaaagaataaata

SEQ ID NO: 1164921 - DNA, 22 bp, Artificial Sequence
  chemically synthesized
acatgtaccttatttattcttt

SEQ ID NO: 1164922 - DNA, 22 bp, Artificial Sequence
  chemically synthesized
catgtaccttatttattctttc

SEQ ID NO: 1164923 - DNA, 22 bp, Artificial Sequence
  chemically synthesized
agctcaggccttttgaaagaat

SEQ ID NO: 1164924 - DNA, 22 bp, Artificial Sequence
  chemically synthesized
aagctcaggccttttgaaagaa

SEQ ID NO: 1164925 - DNA, 22 bp, Artificial Sequence
  chemically synthesized
taagctcaggccttttgaaaga

SEQ ID NO: 1164926 - DNA, 22 bp, Artificial Sequence
  chemically synthesized
ttaagctcaggccttttgaaag

SEQ ID NO: 1164927 - DNA, 22 bp, Artificial Sequence
  chemically synthesized
atttattctttcaaaaggcctg

SEQ ID NO: 1164928 - DNA, 22 bp, Artificial Sequence
  chemically synthesized
tttattctttcaaaaggcctga

SEQ ID NO: 1164929 - DNA, 22 bp, Artificial Sequence
  chemically synthesized
attctttcaaaaggcctgagct

SEQ ID NO: 1164930 - DNA, 22 bp, Artificial Sequence
  chemically synthesized
ttctttcaaaaggcctgagctt

SEQ ID NO: 1164931 - DNA, 22 bp, Artificial Sequence
  chemically synthesized
tttcaaaaggcctgagcttaaa

SEQ ID NO: 1164932 - DNA, 22 bp, Artificial Sequence
  chemically synthesized
tcaaaaggcctgagcttaaaaa

SEQ ID NO: 1164933 - DNA, 22 bp, Artificial Sequence
  chemically synthesized
caaaaggcctgagcttaaaaat

SEQ ID NO: 1164934 - DNA, 22 bp, Artificial Sequence
  chemically synthesized
aaaaggcctgagcttaaaaatg

SEQ ID NO: 1164935 - DNA, 22 bp, Artificial Sequence
  chemically synthesized
tggaggggaaaaacacattttt

SEQ ID NO: 1164936 - DNA, 22 bp, Artificial Sequence
  chemically synthesized
agcttaaaaatgtgtttttccc

SEQ ID NO: 1164937 - DNA, 22 bp, Artificial Sequence
  chemically synthesized
aaaaatgtgtttttcccctcca

SEQ ID NO: 1164938 - DNA, 22 bp, Artificial Sequence
  chemically synthesized
aaaatgtgtttttcccctccat

SEQ ID NO: 1164939 - DNA, 22 bp, Artificial Sequence
  chemically synthesized
tagtgtgaaattatggagggga

SEQ ID NO: 1164940 - DNA, 22 bp, Artificial Sequence
  chemically synthesized
aattatagtgtgaaattatgga

SEQ ID NO: 1164941 - DNA, 22 bp, Artificial Sequence
  chemically synthesized
ttcccctccataatttcacact

SEQ ID NO: 1164942 - DNA, 22 bp, Artificial Sequence
  chemically synthesized
tcccctccataatttcacacta

SEQ ID NO: 1164943 - DNA, 22 bp, Artificial Sequence
  chemically synthesized
cccctccataatttcacactat

SEQ ID NO: 1164944 - DNA, 22 bp, Artificial Sequence
  chemically synthesized
cagtactaaattatagtgtgaa

SEQ ID NO: 1164945 - DNA, 22 bp, Artificial Sequence
  chemically synthesized
ccctccataatttcacactata

SEQ ID NO: 1164946 - DNA, 22 bp, Artificial Sequence
  chemically synthesized
cataatttcacactataattta

SEQ ID NO: 1164947 - DNA, 22 bp, Artificial Sequence
  chemically synthesized
gtattccagtactaaattatag

SEQ ID NO: 1164948 - DNA, 22 bp, Artificial Sequence
  chemically synthesized
cacactataatttagtactgga

SEQ ID NO: 1164949 - DNA, 22 bp, Artificial Sequence
  chemically synthesized
acactataatttagtactggaa

SEQ ID NO: 1164950 - DNA, 22 bp, Artificial Sequence
  chemically synthesized
gaaggattggtattccagtact

SEQ ID NO: 1164951 - DNA, 22 bp, Artificial Sequence
  chemically synthesized
taatttagtactggaataccaa

SEQ ID NO: 1164952 - DNA, 22 bp, Artificial Sequence
  chemically synthesized
gatatgctagaaggattggtat

SEQ ID NO: 1164953 - DNA, 22 bp, Artificial Sequence
  chemically synthesized
agtactggaataccaatccttc

SEQ ID NO: 1164954 - DNA, 22 bp, Artificial Sequence
  chemically synthesized
gtactggaataccaatccttct

SEQ ID NO: 1164955 - DNA, 22 bp, Artificial Sequence
  chemically synthesized
attagatatgctagaaggattg

SEQ ID NO: 1164956 - DNA, 22 bp, Artificial Sequence
  chemically synthesized
gaataccaatccttctagcata

SEQ ID NO: 1164957 - DNA, 22 bp, Artificial Sequence
  chemically synthesized
ctagcatatctaatgagtttcc

SEQ ID NO: 1164958 - DNA, 22 bp, Artificial Sequence
  chemically synthesized
tagcatatctaatgagtttcct

SEQ ID NO: 1164959 - DNA, 22 bp, Artificial Sequence
  chemically synthesized
gcatatctaatgagtttccttg

SEQ ID NO: 1164960 - DNA, 22 bp, Artificial Sequence
  chemically synthesized
aaaaaaaaaaaggaccaaggaa

SEQ ID NO: 1164961 - DNA, 22 bp, Artificial Sequence
  chemically synthesized
atgagtttccttggtccttttt

SEQ ID NO: 1164962 - DNA, 22 bp, Artificial Sequence
  chemically synthesized
aaaagcgttaaaaaaaaaaaag

SEQ ID NO: 1164963 - DNA, 22 bp, Artificial Sequence
  chemically synthesized
ccttggtcctttttttttttta

SEQ ID NO: 1164964 - DNA, 22 bp, Artificial Sequence
  chemically synthesized
cttggtccttttttttttttaa

SEQ ID NO: 1164965 - DNA, 22 bp, Artificial Sequence
  chemically synthesized
ggtccttttttttttttaacgc

SEQ ID NO: 1164966 - DNA, 22 bp, Artificial Sequence
  chemically synthesized
tgaagttcaaaagcgttaaaaa

SEQ ID NO: 1164967 - DNA, 22 bp, Artificial Sequence
  chemically synthesized
gtccttttttttttttaacgct

SEQ ID NO: 1164968 - DNA, 22 bp, Artificial Sequence
  chemically synthesized
atgaagttcaaaagcgttaaaa

SEQ ID NO: 1164969 - DNA, 22 bp, Artificial Sequence
  chemically synthesized
tttatgaagttcaaaagcgtta

SEQ ID NO: 1164970 - DNA, 22 bp, Artificial Sequence
  chemically synthesized
ttttttttttaacgcttttgaa

SEQ ID NO: 1164971 - DNA, 22 bp, Artificial Sequence
  chemically synthesized
ttatttatgaagttcaaaagcg

SEQ ID NO: 1164972 - DNA, 22 bp, Artificial Sequence
  chemically synthesized
tttttttttaacgcttttgaac

SEQ ID NO: 1164973 - DNA, 22 bp, Artificial Sequence
  chemically synthesized
ttttttttaacgcttttgaact

SEQ ID NO: 1164974 - DNA, 22 bp, Artificial Sequence
  chemically synthesized
tttttttaacgcttttgaactt

SEQ ID NO: 1164975 - DNA, 22 bp, Artificial Sequence
  chemically synthesized
ttttttaacgcttttgaacttc

SEQ ID NO: 1164976 - DNA, 22 bp, Artificial Sequence
  chemically synthesized
actattatttatgaagttcaaa

SEQ ID NO: 1164977 - DNA, 22 bp, Artificial Sequence
  chemically synthesized
tttttaacgcttttgaacttca

SEQ ID NO: 1164978 - DNA, 22 bp, Artificial Sequence
  chemically synthesized
aactattatttatgaagttcaa

SEQ ID NO: 1164979 - DNA, 22 bp, Artificial Sequence
  chemically synthesized
ttttaacgcttttgaacttcat

SEQ ID NO: 1164980 - DNA, 22 bp, Artificial Sequence
  chemically synthesized
tttaacgcttttgaacttcata

SEQ ID NO: 1164981 - DNA, 22 bp, Artificial Sequence
  chemically synthesized
ttaacgcttttgaacttcataa

SEQ ID NO: 1164982 - DNA, 22 bp, Artificial Sequence
  chemically synthesized
tttaactattatttatgaagtt

SEQ ID NO: 1164983 - DNA, 22 bp, Artificial Sequence
  chemically synthesized
taacgcttttgaacttcataaa

SEQ ID NO: 1164984 - DNA, 22 bp, Artificial Sequence
  chemically synthesized
atttaactattatttatgaagt

SEQ ID NO: 1164985 - DNA, 22 bp, Artificial Sequence
  chemically synthesized
aacgcttttgaacttcataaat

SEQ ID NO: 1164986 - DNA, 22 bp, Artificial Sequence
  chemically synthesized
acgcttttgaacttcataaata

SEQ ID NO: 1164987 - DNA, 22 bp, Artificial Sequence
  chemically synthesized
agtttatttaactattatttat

SEQ ID NO: 1164988 - DNA, 22 bp, Artificial Sequence
  chemically synthesized
aagtttatttaactattattta

SEQ ID NO: 1164989 - DNA, 22 bp, Artificial Sequence
  chemically synthesized
ttgaacttcataaataatagtt

SEQ ID NO: 1164990 - DNA, 22 bp, Artificial Sequence
  chemically synthesized
tgaacttcataaataatagtta

SEQ ID NO: 1164991 - DNA, 22 bp, Artificial Sequence
  chemically synthesized
gaacttcataaataatagttaa

SEQ ID NO: 1164992 - DNA, 22 bp, Artificial Sequence
  chemically synthesized
aacttcataaataatagttaaa

SEQ ID NO: 1164993 - DNA, 22 bp, Artificial Sequence
  chemically synthesized
cataaataatagttaaataaac

SEQ ID NO: 1164994 - DNA, 22 bp, Artificial Sequence
  chemically synthesized
ataaataatagttaaataaact

SEQ ID NO: 1164995 - DNA, 22 bp, Artificial Sequence
  chemically synthesized
tccaaatgccttaagtttattt

SEQ ID NO: 1164996 - DNA, 22 bp, Artificial Sequence
  chemically synthesized
aataaacttaaggcatttggac

SEQ ID NO: 1164997 - DNA, 22 bp, Artificial Sequence
  chemically synthesized
agtgaaaaaaattgtccaaatg

SEQ ID NO: 1164998 - DNA, 22 bp, Artificial Sequence
  chemically synthesized
aaggcatttggacaattttttt

SEQ ID NO: 1164999 - DNA, 22 bp, Artificial Sequence
  chemically synthesized
aggcatttggacaatttttttc

SEQ ID NO: 1165000 - DNA, 22 bp, Artificial Sequence
  chemically synthesized
aatacattaagtgaaaaaaatt

SEQ ID NO: 1165001 - DNA, 22 bp, Artificial Sequence
  chemically synthesized
gaatacattaagtgaaaaaaat

SEQ ID NO: 1165002 - DNA, 22 bp, Artificial Sequence
  chemically synthesized
ggacaatttttttcacttaatg

SEQ ID NO: 1165003 - DNA, 22 bp, Artificial Sequence
  chemically synthesized
tggatttgaatacattaagtga

SEQ ID NO: 1165004 - DNA, 22 bp, Artificial Sequence
  chemically synthesized
gacaatttttttcacttaatgt

SEQ ID NO: 1165005 - DNA, 22 bp, Artificial Sequence
  chemically synthesized
ttttcacttaatgtattcaaat

SEQ ID NO: 1165006 - DNA, 22 bp, Artificial Sequence
  chemically synthesized
tttcacttaatgtattcaaatc

SEQ ID NO: 1165007 - DNA, 22 bp, Artificial Sequence
  chemically synthesized
ttcacttaatgtattcaaatcc

SEQ ID NO: 1165008 - DNA, 22 bp, Artificial Sequence
  chemically synthesized
tcacttaatgtattcaaatcca

SEQ ID NO: 1165009 - DNA, 22 bp, Artificial Sequence
  chemically synthesized
cacttaatgtattcaaatccac

SEQ ID NO: 1165010 - DNA, 22 bp, Artificial Sequence
  chemically synthesized
acttaatgtattcaaatccaca

SEQ ID NO: 1165011 - DNA, 22 bp, Artificial Sequence
  chemically synthesized
aatgtattcaaatccacagttg

SEQ ID NO: 1165012 - DNA, 22 bp, Artificial Sequence
  chemically synthesized
atgtattcaaatccacagttgg

SEQ ID NO: 1165013 - DNA, 22 bp, Artificial Sequence
  chemically synthesized
aatgaaaagaaatgaagtgcca

SEQ ID NO: 1165014 - DNA, 22 bp, Artificial Sequence
  chemically synthesized
aaatccacagttggcacttcat

SEQ ID NO: 1165015 - DNA, 22 bp, Artificial Sequence
  chemically synthesized
aaatgaaaagaaatgaagtgcc

SEQ ID NO: 1165016 - DNA, 22 bp, Artificial Sequence
  chemically synthesized
taaatgaaaagaaatgaagtgc

SEQ ID NO: 1165017 - DNA, 22 bp, Artificial Sequence
  chemically synthesized
ttaaatgaaaagaaatgaagtg

SEQ ID NO: 1165018 - DNA, 22 bp, Artificial Sequence
  chemically synthesized
tttttaaatgaaaagaaatgaa

SEQ ID NO: 1165019 - DNA, 22 bp, Artificial Sequence
  chemically synthesized
atttttaaatgaaaagaaatga

SEQ ID NO: 1165020 - DNA, 22 bp, Artificial Sequence
  chemically synthesized
gcacttcatttcttttcattta

SEQ ID NO: 1165021 - DNA, 22 bp, Artificial Sequence
  chemically synthesized
catttcttttcatttaaaaata

SEQ ID NO: 1165022 - DNA, 22 bp, Artificial Sequence
  chemically synthesized
atttcttttcatttaaaaataa

SEQ ID NO: 1165023 - DNA, 22 bp, Artificial Sequence
  chemically synthesized
cttttcatttaaaaataaatct

SEQ ID NO: 1165024 - DNA, 22 bp, Artificial Sequence
  chemically synthesized
tcaagacaagatagatttattt

SEQ ID NO: 1165025 - DNA, 22 bp, Artificial Sequence
  chemically synthesized
ttttcatttaaaaataaatcta

SEQ ID NO: 1165026 - DNA, 22 bp, Artificial Sequence
  chemically synthesized
ttcatttaaaaataaatctatc

SEQ ID NO: 1165027 - DNA, 22 bp, Artificial Sequence
  chemically synthesized
tcatttaaaaataaatctatct

SEQ ID NO: 1165028 - DNA, 22 bp, Artificial Sequence
  chemically synthesized
catttaaaaataaatctatctt

SEQ ID NO: 1165029 - DNA, 22 bp, Artificial Sequence
  chemically synthesized
atttaaaaataaatctatcttg

SEQ ID NO: 1165030 - DNA, 22 bp, Artificial Sequence
  chemically synthesized
aaaaataaatctatcttgtctt

SEQ ID NO: 1165031 - DNA, 22 bp, Artificial Sequence
  chemically synthesized
aaaataaatctatcttgtcttg

SEQ ID NO: 1165032 - DNA, 22 bp, Artificial Sequence
  chemically synthesized
atgtaaagcctatcaagacaag

SEQ ID NO: 1165033 - DNA, 22 bp, Artificial Sequence
  chemically synthesized
tcttgtcttgataggctttaca

SEQ ID NO: 1165034 - DNA, 22 bp, Artificial Sequence
  chemically synthesized
ggtgtgtatattcatgtaaagc

SEQ ID NO: 1165035 - DNA, 22 bp, Artificial Sequence
  chemically synthesized
gtcttgataggctttacatgaa

SEQ ID NO: 1165036 - DNA, 22 bp, Artificial Sequence
  chemically synthesized
tcttgataggctttacatgaat

SEQ ID NO: 1165037 - DNA, 22 bp, Artificial Sequence
  chemically synthesized
ttaggtgtgtatattcatgtaa

SEQ ID NO: 1165038 - DNA, 22 bp, Artificial Sequence
  chemically synthesized
gataggctttacatgaatatac

SEQ ID NO: 1165039 - DNA, 22 bp, Artificial Sequence
  chemically synthesized
ataggctttacatgaatataca

SEQ ID NO: 1165040 - DNA, 22 bp, Artificial Sequence
  chemically synthesized
tattgttaggtgtgtatattca

SEQ ID NO: 1165041 - DNA, 22 bp, Artificial Sequence
  chemically synthesized
atattgttaggtgtgtatattc

SEQ ID NO: 1165042 - DNA, 22 bp, Artificial Sequence
  chemically synthesized
atttatattgttaggtgtgtat

SEQ ID NO: 1165043 - DNA, 22 bp, Artificial Sequence
  chemically synthesized
gatttatattgttaggtgtgta

SEQ ID NO: 1165044 - DNA, 22 bp, Artificial Sequence
  chemically synthesized
tgatttatattgttaggtgtgt

SEQ ID NO: 1165045 - DNA, 22 bp, Artificial Sequence
  chemically synthesized
tacatgaatatacacacctaac

SEQ ID NO: 1165046 - DNA, 22 bp, Artificial Sequence
  chemically synthesized
acatgaatatacacacctaaca

SEQ ID NO: 1165047 - DNA, 22 bp, Artificial Sequence
  chemically synthesized
catgaatatacacacctaacaa

SEQ ID NO: 1165048 - DNA, 22 bp, Artificial Sequence
  chemically synthesized
gatatgtgttttgatttatatt

SEQ ID NO: 1165049 - DNA, 22 bp, Artificial Sequence
  chemically synthesized
tggatatgtgttttgatttata

SEQ ID NO: 1165050 - DNA, 22 bp, Artificial Sequence
  chemically synthesized
atcattctggatatgtgttttg

SEQ ID NO: 1165051 - DNA, 22 bp, Artificial Sequence
  chemically synthesized
acaatataaatcaaaacacata

SEQ ID NO: 1165052 - DNA, 22 bp, Artificial Sequence
  chemically synthesized
taaaggtaacaagcagatctca

SEQ ID NO: 1165053 - DNA, 22 bp, Artificial Sequence
  chemically synthesized
ataaaggtaacaagcagatctc

SEQ ID NO: 1165054 - DNA, 22 bp, Artificial Sequence
  chemically synthesized
ttataaaggtaacaagcagatc

SEQ ID NO: 1165055 - DNA, 22 bp, Artificial Sequence
  chemically synthesized
cttataaaggtaacaagcagat

SEQ ID NO: 1165056 - DNA, 22 bp, Artificial Sequence
  chemically synthesized
aaaaatgacatatttcttataa

SEQ ID NO: 1165057 - DNA, 22 bp, Artificial Sequence
  chemically synthesized
cttgttacctttataagaaata

SEQ ID NO: 1165058 - DNA, 22 bp, Artificial Sequence
  chemically synthesized
tgaaaaatgacatatttcttat

SEQ ID NO: 1165059 - DNA, 22 bp, Artificial Sequence
  chemically synthesized
ctgaaaaatgacatatttctta

SEQ ID NO: 1165060 - DNA, 22 bp, Artificial Sequence
  chemically synthesized
gttacctttataagaaatatgt

SEQ ID NO: 1165061 - DNA, 22 bp, Artificial Sequence
  chemically synthesized
ttacctttataagaaatatgtc

SEQ ID NO: 1165062 - DNA, 22 bp, Artificial Sequence
  chemically synthesized
cctttataagaaatatgtcatt

SEQ ID NO: 1165063 - DNA, 22 bp, Artificial Sequence
  chemically synthesized
agacatttctgaaaaatgacat

SEQ ID NO: 1165064 - DNA, 22 bp, Artificial Sequence
  chemically synthesized
gagacatttctgaaaaatgaca

SEQ ID NO: 1165065 - DNA, 22 bp, Artificial Sequence
  chemically synthesized
tataagaaatatgtcatttttc

SEQ ID NO: 1165066 - DNA, 22 bp, Artificial Sequence
  chemically synthesized
ataagaaatatgtcatttttca

SEQ ID NO: 1165067 - DNA, 22 bp, Artificial Sequence
  chemically synthesized
taagaaatatgtcatttttcag

SEQ ID NO: 1165068 - DNA, 22 bp, Artificial Sequence
  chemically synthesized
ataaaaaagaggatttgagaca

SEQ ID NO: 1165069 - DNA, 22 bp, Artificial Sequence
  chemically synthesized
aataaaaaagaggatttgagac

SEQ ID NO: 1165070 - DNA, 22 bp, Artificial Sequence
  chemically synthesized
ttcagaaatgtctcaaatcctc

SEQ ID NO: 1165071 - DNA, 22 bp, Artificial Sequence
  chemically synthesized
tcagaaatgtctcaaatcctct

SEQ ID NO: 1165072 - DNA, 22 bp, Artificial Sequence
  chemically synthesized
acttaataaaaaagaggatttg

SEQ ID NO: 1165073 - DNA, 22 bp, Artificial Sequence
  chemically synthesized
cagaaatgtctcaaatcctctt

SEQ ID NO: 1165074 - DNA, 22 bp, Artificial Sequence
  chemically synthesized
agaaatgtctcaaatcctcttt

SEQ ID NO: 1165075 - DNA, 22 bp, Artificial Sequence
  chemically synthesized
aaatcctcttttttattaagtc

SEQ ID NO: 1165076 - DNA, 22 bp, Artificial Sequence
  chemically synthesized
agaatatatattgacttaataa

SEQ ID NO: 1165077 - DNA, 22 bp, Artificial Sequence
  chemically synthesized
aagaatatatattgacttaata

SEQ ID NO: 1165078 - DNA, 22 bp, Artificial Sequence
  chemically synthesized
tcttaagaatatatattgactt

SEQ ID NO: 1165079 - DNA, 22 bp, Artificial Sequence
  chemically synthesized
ttttttattaagtcaatatata

SEQ ID NO: 1165080 - DNA, 22 bp, Artificial Sequence
  chemically synthesized
ttttattaagtcaatatatatt

SEQ ID NO: 1165081 - DNA, 22 bp, Artificial Sequence
  chemically synthesized
tttattaagtcaatatatattc

SEQ ID NO: 1165082 - DNA, 22 bp, Artificial Sequence
  chemically synthesized
ttattaagtcaatatatattct

SEQ ID NO: 1165083 - DNA, 22 bp, Artificial Sequence
  chemically synthesized
tgaattatcttaagaatatata

SEQ ID NO: 1165084 - DNA, 22 bp, Artificial Sequence
  chemically synthesized
tattaagtcaatatatattctt

SEQ ID NO: 1165085 - DNA, 22 bp, Artificial Sequence
  chemically synthesized
attaagtcaatatatattctta

SEQ ID NO: 1165086 - DNA, 22 bp, Artificial Sequence
  chemically synthesized
ttaagtcaatatatattcttaa

SEQ ID NO: 1165087 - DNA, 22 bp, Artificial Sequence
  chemically synthesized
agtcaatatatattcttaagat

SEQ ID NO: 1165088 - DNA, 22 bp, Artificial Sequence
  chemically synthesized
aaatacagtatggctatgaatt

SEQ ID NO: 1165089 - DNA, 22 bp, Artificial Sequence
  chemically synthesized
ttaaaatacagtatggctatga

SEQ ID NO: 1165090 - DNA, 22 bp, Artificial Sequence
  chemically synthesized
attaaaatacagtatggctatg

SEQ ID NO: 1165091 - DNA, 22 bp, Artificial Sequence
  chemically synthesized
ttaagataattcatagccatac

SEQ ID NO: 1165092 - DNA, 22 bp, Artificial Sequence
  chemically synthesized
ttattaaaatacagtatggcta

SEQ ID NO: 1165093 - DNA, 22 bp, Artificial Sequence
  chemically synthesized
aagataattcatagccatactg

SEQ ID NO: 1165094 - DNA, 22 bp, Artificial Sequence
  chemically synthesized
agataattcatagccatactgt

SEQ ID NO: 1165095 - DNA, 22 bp, Artificial Sequence
  chemically synthesized
ggaaattcttattaaaatacag

SEQ ID NO: 1165096 - DNA, 22 bp, Artificial Sequence
  chemically synthesized
gggaaattcttattaaaataca

SEQ ID NO: 1165097 - DNA, 22 bp, Artificial Sequence
  chemically synthesized
tgggaaattcttattaaaatac

SEQ ID NO: 1165098 - DNA, 22 bp, Artificial Sequence
  chemically synthesized
atagccatactgtattttaata

SEQ ID NO: 1165099 - DNA, 22 bp, Artificial Sequence
  chemically synthesized
aaacgttttgggaaattcttat

SEQ ID NO: 1165100 - DNA, 22 bp, Artificial Sequence
  chemically synthesized
ttcaaacgttttgggaaattct

SEQ ID NO: 1165101 - DNA, 22 bp, Artificial Sequence
  chemically synthesized
tattttaataagaatttcccaa

SEQ ID NO: 1165102 - DNA, 22 bp, Artificial Sequence
  chemically synthesized
taataagaatttcccaaaacgt

SEQ ID NO: 1165103 - DNA, 22 bp, Artificial Sequence
  chemically synthesized
aataagaatttcccaaaacgtt

SEQ ID NO: 1165104 - DNA, 22 bp, Artificial Sequence
  chemically synthesized
ataagaatttcccaaaacgttt

SEQ ID NO: 1165105 - DNA, 22 bp, Artificial Sequence
  chemically synthesized
aaaaacattattcaaacgtttt

SEQ ID NO: 1165106 - DNA, 22 bp, Artificial Sequence
  chemically synthesized
gaaaaacattattcaaacgttt

SEQ ID NO: 1165107 - DNA, 22 bp, Artificial Sequence
  chemically synthesized
ttgaaaaacattattcaaacgt

SEQ ID NO: 1165108 - DNA, 22 bp, Artificial Sequence
  chemically synthesized
cccaaaacgtttgaataatgtt

SEQ ID NO: 1165109 - DNA, 22 bp, Artificial Sequence
  chemically synthesized
ccaaaacgtttgaataatgttt

SEQ ID NO: 1165110 - DNA, 22 bp, Artificial Sequence
  chemically synthesized
tatatggaaatcctcttgaaaa

SEQ ID NO: 1165111 - DNA, 22 bp, Artificial Sequence
  chemically synthesized
gaataatgtttttcaagaggat

SEQ ID NO: 1165112 - DNA, 22 bp, Artificial Sequence
  chemically synthesized
aataatgtttttcaagaggatt

SEQ ID NO: 1165113 - DNA, 22 bp, Artificial Sequence
  chemically synthesized
atctatatatggaaatcctctt

SEQ ID NO: 1165114 - DNA, 22 bp, Artificial Sequence
  chemically synthesized
ctcatctatatatggaaatcct

SEQ ID NO: 1165115 - DNA, 22 bp, Artificial Sequence
  chemically synthesized
ttcaagaggatttccatatata

SEQ ID NO: 1165116 - DNA, 22 bp, Artificial Sequence
  chemically synthesized
tcaagaggatttccatatatag

SEQ ID NO: 1165117 - DNA, 22 bp, Artificial Sequence
  chemically synthesized
caagaggatttccatatataga

SEQ ID NO: 1165118 - DNA, 22 bp, Artificial Sequence
  chemically synthesized
aagagttactcatctatatatg

SEQ ID NO: 1165119 - DNA, 22 bp, Artificial Sequence
  chemically synthesized
aagaggatttccatatatagat

SEQ ID NO: 1165120 - DNA, 22 bp, Artificial Sequence
  chemically synthesized
aaaatattaaagagttactcat

SEQ ID NO: 1165121 - DNA, 22 bp, Artificial Sequence
  chemically synthesized
gaaaatattaaagagttactca

SEQ ID NO: 1165122 - DNA, 22 bp, Artificial Sequence
  chemically synthesized
ccatatatagatgagtaactct

SEQ ID NO: 1165123 - DNA, 22 bp, Artificial Sequence
  chemically synthesized
catatatagatgagtaactctt

SEQ ID NO: 1165124 - DNA, 22 bp, Artificial Sequence
  chemically synthesized
aagaaaaagcccttgaaaatat

SEQ ID NO: 1165125 - DNA, 22 bp, Artificial Sequence
  chemically synthesized
tgaagaaaaagcccttgaaaat

SEQ ID NO: 1165126 - DNA, 22 bp, Artificial Sequence
  chemically synthesized
ctgaagaaaaagcccttgaaaa

SEQ ID NO: 1165127 - DNA, 22 bp, Artificial Sequence
  chemically synthesized
ttctgaagaaaaagcccttgaa

SEQ ID NO: 1165128 - DNA, 22 bp, Artificial Sequence
  chemically synthesized
tcttctgaagaaaaagcccttg

SEQ ID NO: 1165129 - DNA, 22 bp, Artificial Sequence
  chemically synthesized
tttaatattttcaagggctttt

SEQ ID NO: 1165130 - DNA, 22 bp, Artificial Sequence
  chemically synthesized
ctcttctgaagaaaaagccctt

SEQ ID NO: 1165131 - DNA, 22 bp, Artificial Sequence
  chemically synthesized
taatattttcaagggctttttc

SEQ ID NO: 1165132 - DNA, 22 bp, Artificial Sequence
  chemically synthesized
aatattttcaagggctttttct

SEQ ID NO: 1165133 - DNA, 22 bp, Artificial Sequence
  chemically synthesized
atattttcaagggctttttctt

SEQ ID NO: 1165134 - DNA, 22 bp, Artificial Sequence
  chemically synthesized
tcaagggctttttcttcagaag

SEQ ID NO: 1165135 - DNA, 22 bp, Artificial Sequence
  chemically synthesized
caagggctttttcttcagaaga

SEQ ID NO: 1165136 - DNA, 22 bp, Artificial Sequence
  chemically synthesized
acacgaaacttctcttctgaag

SEQ ID NO: 1165137 - DNA, 22 bp, Artificial Sequence
  chemically synthesized
aagggctttttcttcagaagag

SEQ ID NO: 1165138 - DNA, 22 bp, Artificial Sequence
  chemically synthesized
tagttgacacgaaacttctctt

SEQ ID NO: 1165139 - DNA, 22 bp, Artificial Sequence
  chemically synthesized
tttcttcagaagagaagtttcg

SEQ ID NO: 1165140 - DNA, 22 bp, Artificial Sequence
  chemically synthesized
ttcttcagaagagaagtttcgt

SEQ ID NO: 1165141 - DNA, 22 bp, Artificial Sequence
  chemically synthesized
gctatagttgacacgaaacttc

SEQ ID NO: 1165142 - DNA, 22 bp, Artificial Sequence
  chemically synthesized
tcttcagaagagaagtttcgtg

SEQ ID NO: 1165143 - DNA, 22 bp, Artificial Sequence
  chemically synthesized
cttcagaagagaagtttcgtgt

SEQ ID NO: 1165144 - DNA, 22 bp, Artificial Sequence
  chemically synthesized
ttcagaagagaagtttcgtgtc

SEQ ID NO: 1165145 - DNA, 22 bp, Artificial Sequence
  chemically synthesized
ttagctatagttgacacgaaac

SEQ ID NO: 1165146 - DNA, 22 bp, Artificial Sequence
  chemically synthesized
cagaagagaagtttcgtgtcaa

SEQ ID NO: 1165147 - DNA, 22 bp, Artificial Sequence
  chemically synthesized
agaagagaagtttcgtgtcaac

SEQ ID NO: 1165148 - DNA, 22 bp, Artificial Sequence
  chemically synthesized
cgtgtcaactatagctaatagg

SEQ ID NO: 1165149 - DNA, 22 bp, Artificial Sequence
  chemically synthesized
gtgtcaactatagctaataggt

SEQ ID NO: 1165150 - DNA, 22 bp, Artificial Sequence
  chemically synthesized
tgtacataaaatcacctattag

SEQ ID NO: 1165151 - DNA, 22 bp, Artificial Sequence
  chemically synthesized
tagctaataggtgattttatgt

SEQ ID NO: 1165152 - DNA, 22 bp, Artificial Sequence
  chemically synthesized
ataggtgattttatgtacacaa

SEQ ID NO: 1165153 - DNA, 22 bp, Artificial Sequence
  chemically synthesized
tatgtacacaatctcctgtgca

SEQ ID NO: 1165154 - DNA, 22 bp, Artificial Sequence
  chemically synthesized
atgtacacaatctcctgtgcat

SEQ ID NO: 1165155 - DNA, 22 bp, Artificial Sequence
  chemically synthesized
tgtacacaatctcctgtgcatg

SEQ ID NO: 1165156 - DNA, 22 bp, Artificial Sequence
  chemically synthesized
taaaaggcacagaagcatgcac

SEQ ID NO: 1165157 - DNA, 22 bp, Artificial Sequence
  chemically synthesized
ctgtgcatgcttctgtgccttt

SEQ ID NO: 1165158 - DNA, 22 bp, Artificial Sequence
  chemically synthesized
aaatgtcactataaaaggcaca

SEQ ID NO: 1165159 - DNA, 22 bp, Artificial Sequence
  chemically synthesized
tgcatgcttctgtgccttttat

SEQ ID NO: 1165160 - DNA, 22 bp, Artificial Sequence
  chemically synthesized
caaacattaaaatgtcactata

SEQ ID NO: 1165161 - DNA, 22 bp, Artificial Sequence
  chemically synthesized
ctgtgccttttatagtgacatt

SEQ ID NO: 1165162 - DNA, 22 bp, Artificial Sequence
  chemically synthesized
tgtgccttttatagtgacattt

SEQ ID NO: 1165163 - DNA, 22 bp, Artificial Sequence
  chemically synthesized
ctccaaacattaaaatgtcact

SEQ ID NO: 1165164 - DNA, 22 bp, Artificial Sequence
  chemically synthesized
cctccaaacattaaaatgtcac

SEQ ID NO: 1165165 - DNA, 22 bp, Artificial Sequence
  chemically synthesized
tgccttttatagtgacatttta

SEQ ID NO: 1165166 - DNA, 22 bp, Artificial Sequence
  chemically synthesized
tcctccaaacattaaaatgtca

SEQ ID NO: 1165167 - DNA, 22 bp, Artificial Sequence
  chemically synthesized
ggttttcctccaaacattaaaa

SEQ ID NO: 1165168 - DNA, 22 bp, Artificial Sequence
  chemically synthesized
ttatagtgacattttaatgttt

SEQ ID NO: 1165169 - DNA, 22 bp, Artificial Sequence
  chemically synthesized
tatagtgacattttaatgtttg

SEQ ID NO: 1165170 - DNA, 22 bp, Artificial Sequence
  chemically synthesized
taggttttcctccaaacattaa

SEQ ID NO: 1165171 - DNA, 22 bp, Artificial Sequence
  chemically synthesized
atagtgacattttaatgtttgg

SEQ ID NO: 1165172 - DNA, 22 bp, Artificial Sequence
  chemically synthesized
ctaggttttcctccaaacatta

SEQ ID NO: 1165173 - DNA, 22 bp, Artificial Sequence
  chemically synthesized
tagtgacattttaatgtttgga

SEQ ID NO: 1165174 - DNA, 22 bp, Artificial Sequence
  chemically synthesized
tctaggttttcctccaaacatt

SEQ ID NO: 1165175 - DNA, 22 bp, Artificial Sequence
  chemically synthesized
ttttctaggttttcctccaaac

SEQ ID NO: 1165176 - DNA, 22 bp, Artificial Sequence
  chemically synthesized
ttattttctaggttttcctcca

SEQ ID NO: 1165177 - DNA, 22 bp, Artificial Sequence
  chemically synthesized
taatgtttggaggaaaacctag

SEQ ID NO: 1165178 - DNA, 22 bp, Artificial Sequence
  chemically synthesized
aatgtttggaggaaaacctaga

SEQ ID NO: 1165179 - DNA, 22 bp, Artificial Sequence
  chemically synthesized
atgtttggaggaaaacctagaa

SEQ ID NO: 1165180 - DNA, 22 bp, Artificial Sequence
  chemically synthesized
tcatagttattattttctaggt

SEQ ID NO: 1165181 - DNA, 22 bp, Artificial Sequence
  chemically synthesized
tgtcatagttattattttctag

SEQ ID NO: 1165182 - DNA, 22 bp, Artificial Sequence
  chemically synthesized
ggaggaaaacctagaaaataat

SEQ ID NO: 1165183 - DNA, 22 bp, Artificial Sequence
  chemically synthesized
gaggaaaacctagaaaataata

SEQ ID NO: 1165184 - DNA, 22 bp, Artificial Sequence
  chemically synthesized
ccaaaattctgtcatagttatt

SEQ ID NO: 1165185 - DNA, 22 bp, Artificial Sequence
  chemically synthesized
gccaaaattctgtcatagttat

SEQ ID NO: 1165186 - DNA, 22 bp, Artificial Sequence
  chemically synthesized
gaaaataataactatgacagaa

SEQ ID NO: 1165187 - DNA, 22 bp, Artificial Sequence
  chemically synthesized
agatttgccaaaattctgtcat

SEQ ID NO: 1165188 - DNA, 22 bp, Artificial Sequence
  chemically synthesized
aagatttgccaaaattctgtca

SEQ ID NO: 1165189 - DNA, 22 bp, Artificial Sequence
  chemically synthesized
taagatttgccaaaattctgtc

SEQ ID NO: 1165190 - DNA, 22 bp, Artificial Sequence
  chemically synthesized
tgttttaagatttgccaaaatt

SEQ ID NO: 1165191 - DNA, 22 bp, Artificial Sequence
  chemically synthesized
tgacagaattttggcaaatctt

SEQ ID NO: 1165192 - DNA, 22 bp, Artificial Sequence
  chemically synthesized
cagaactatgttttaagatttg

SEQ ID NO: 1165193 - DNA, 22 bp, Artificial Sequence
  chemically synthesized
tctacagaactatgttttaaga

SEQ ID NO: 1165194 - DNA, 22 bp, Artificial Sequence
  chemically synthesized
ttatctacagaactatgtttta

SEQ ID NO: 1165195 - DNA, 22 bp, Artificial Sequence
  chemically synthesized
tggcaaatcttaaaacatagtt

SEQ ID NO: 1165196 - DNA, 22 bp, Artificial Sequence
  chemically synthesized
ggcaaatcttaaaacatagttc

SEQ ID NO: 1165197 - DNA, 22 bp, Artificial Sequence
  chemically synthesized
gcaaatcttaaaacatagttct

SEQ ID NO: 1165198 - DNA, 22 bp, Artificial Sequence
  chemically synthesized
aaaacatagttctgtagataac

SEQ ID NO: 1165199 - DNA, 22 bp, Artificial Sequence
  chemically synthesized
gatagatgcactgttatctaca

SEQ ID NO: 1165200 - DNA, 22 bp, Artificial Sequence
  chemically synthesized
aaacatagttctgtagataaca

SEQ ID NO: 1165201 - DNA, 22 bp, Artificial Sequence
  chemically synthesized
tgtagataacagtgcatctatc

SEQ ID NO: 1165202 - DNA, 22 bp, Artificial Sequence
  chemically synthesized
tagataacagtgcatctatcta

SEQ ID NO: 1165203 - DNA, 22 bp, Artificial Sequence
  chemically synthesized
aaagagcagatgttagatagat

SEQ ID NO: 1165204 - DNA, 22 bp, Artificial Sequence
  chemically synthesized
taactaaaagagcagatgttag

SEQ ID NO: 1165205 - DNA, 22 bp, Artificial Sequence
  chemically synthesized
gtaactaaaagagcagatgtta

SEQ ID NO: 1165206 - DNA, 22 bp, Artificial Sequence
  chemically synthesized
tgtaactaaaagagcagatgtt

SEQ ID NO: 1165207 - DNA, 22 bp, Artificial Sequence
  chemically synthesized
ttgtaactaaaagagcagatgt

SEQ ID NO: 1165208 - DNA, 22 bp, Artificial Sequence
  chemically synthesized
acttttgtaactaaaagagcag

SEQ ID NO: 1165209 - DNA, 22 bp, Artificial Sequence
  chemically synthesized
cacttttgtaactaaaagagca

SEQ ID NO: 1165210 - DNA, 22 bp, Artificial Sequence
  chemically synthesized
tcacttttgtaactaaaagagc

SEQ ID NO: 1165211 - DNA, 22 bp, Artificial Sequence
  chemically synthesized
tctaacatctgctcttttagtt

SEQ ID NO: 1165212 - DNA, 22 bp, Artificial Sequence
  chemically synthesized
gttttcacttttgtaactaaaa

SEQ ID NO: 1165213 - DNA, 22 bp, Artificial Sequence
  chemically synthesized
ggttttcacttttgtaactaaa

SEQ ID NO: 1165214 - DNA, 22 bp, Artificial Sequence
  chemically synthesized
acatctgctcttttagttacaa

SEQ ID NO: 1165215 - DNA, 22 bp, Artificial Sequence
  chemically synthesized
tggttttcacttttgtaactaa

SEQ ID NO: 1165216 - DNA, 22 bp, Artificial Sequence
  chemically synthesized
ctcttttagttacaaaagtgaa

SEQ ID NO: 1165217 - DNA, 22 bp, Artificial Sequence
  chemically synthesized
ttttagttacaaaagtgaaaac

SEQ ID NO: 1165218 - DNA, 22 bp, Artificial Sequence
  chemically synthesized
ttagttacaaaagtgaaaacca

SEQ ID NO: 1165219 - DNA, 22 bp, Artificial Sequence
  chemically synthesized
tagttacaaaagtgaaaaccaa

SEQ ID NO: 1165220 - DNA, 22 bp, Artificial Sequence
  chemically synthesized
agttacaaaagtgaaaaccaaa

SEQ ID NO: 1165221 - DNA, 22 bp, Artificial Sequence
  chemically synthesized
gttacaaaagtgaaaaccaaaa

SEQ ID NO: 1165222 - DNA, 22 bp, Artificial Sequence
  chemically synthesized
atagaaataacattttggtttt

SEQ ID NO: 1165223 - DNA, 22 bp, Artificial Sequence
  chemically synthesized
catagaaataacattttggttt

SEQ ID NO: 1165224 - DNA, 22 bp, Artificial Sequence
  chemically synthesized
tcatagaaataacattttggtt

SEQ ID NO: 1165225 - DNA, 22 bp, Artificial Sequence
  chemically synthesized
caaaagtgaaaaccaaaatgtt

SEQ ID NO: 1165226 - DNA, 22 bp, Artificial Sequence
  chemically synthesized
gattttcatagaaataacattt

SEQ ID NO: 1165227 - DNA, 22 bp, Artificial Sequence
  chemically synthesized
gttggattttcatagaaataac

SEQ ID NO: 1165228 - DNA, 22 bp, Artificial Sequence
  chemically synthesized
aagggagactggttggattttc

SEQ ID NO: 1165229 - DNA, 22 bp, Artificial Sequence
  chemically synthesized
caagggagactggttggatttt

SEQ ID NO: 1165230 - DNA, 22 bp, Artificial Sequence
  chemically synthesized
tcaagggagactggttggattt

SEQ ID NO: 1165231 - DNA, 22 bp, Artificial Sequence
  chemically synthesized
tttcaagggagactggttggat

SEQ ID NO: 1165232 - DNA, 22 bp, Artificial Sequence
  chemically synthesized
tttctatgaaaatccaaccagt

SEQ ID NO: 1165233 - DNA, 22 bp, Artificial Sequence
  chemically synthesized
ctttcaagggagactggttgga

SEQ ID NO: 1165234 - DNA, 22 bp, Artificial Sequence
  chemically synthesized
tctttcaagggagactggttgg

SEQ ID NO: 1165235 - DNA, 22 bp, Artificial Sequence
  chemically synthesized
ctatgaaaatccaaccagtctc

SEQ ID NO: 1165236 - DNA, 22 bp, Artificial Sequence
  chemically synthesized
tatgaaaatccaaccagtctcc

SEQ ID NO: 1165237 - DNA, 22 bp, Artificial Sequence
  chemically synthesized
tgaaaatccaaccagtctccct

SEQ ID NO: 1165238 - DNA, 22 bp, Artificial Sequence
  chemically synthesized
ccaaggcacacagctttctttc

SEQ ID NO: 1165239 - DNA, 22 bp, Artificial Sequence
  chemically synthesized
ttcccaaggcacacagctttct

SEQ ID NO: 1165240 - DNA, 22 bp, Artificial Sequence
  chemically synthesized
gttcccaaggcacacagctttc

SEQ ID NO: 1165241 - DNA, 22 bp, Artificial Sequence
  chemically synthesized
ccttgaaagaaagctgtgtgcc

SEQ ID NO: 1165242 - DNA, 22 bp, Artificial Sequence
  chemically synthesized
agtttgttcccaaggcacacag

SEQ ID NO: 1165243 - DNA, 22 bp, Artificial Sequence
  chemically synthesized
tcagtttgttcccaaggcacac

SEQ ID NO: 1165244 - DNA, 22 bp, Artificial Sequence
  chemically synthesized
gaaagaaagctgtgtgccttgg

SEQ ID NO: 1165245 - DNA, 22 bp, Artificial Sequence
  chemically synthesized
aaagaaagctgtgtgccttggg

SEQ ID NO: 1165246 - DNA, 22 bp, Artificial Sequence
  chemically synthesized
cgattctcagtttgttcccaag

SEQ ID NO: 1165247 - DNA, 22 bp, Artificial Sequence
  chemically synthesized
agttacgattctcagtttgttc

SEQ ID NO: 1165248 - DNA, 22 bp, Artificial Sequence
  chemically synthesized
tgtgccttgggaacaaactgag

SEQ ID NO: 1165249 - DNA, 22 bp, Artificial Sequence
  chemically synthesized
atggttaagttacgattctcag

SEQ ID NO: 1165250 - DNA, 22 bp, Artificial Sequence
  chemically synthesized
gatggttaagttacgattctca

SEQ ID NO: 1165251 - DNA, 22 bp, Artificial Sequence
  chemically synthesized
gggaacaaactgagaatcgtaa

SEQ ID NO: 1165252 - DNA, 22 bp, Artificial Sequence
  chemically synthesized
ggaacaaactgagaatcgtaac

SEQ ID NO: 1165253 - DNA, 22 bp, Artificial Sequence
  chemically synthesized
atgtggtttgatggttaagtta

SEQ ID NO: 1165254 - DNA, 22 bp, Artificial Sequence
  chemically synthesized
gatgtggtttgatggttaagtt

SEQ ID NO: 1165255 - DNA, 22 bp, Artificial Sequence
  chemically synthesized
tgatgtggtttgatggttaagt

SEQ ID NO: 1165256 - DNA, 22 bp, Artificial Sequence
  chemically synthesized
agaatcgtaacttaaccatcaa

SEQ ID NO: 1165257 - DNA, 22 bp, Artificial Sequence
  chemically synthesized
ttttgatgtggtttgatggtta

SEQ ID NO: 1165258 - DNA, 22 bp, Artificial Sequence
  chemically synthesized
tgattattttgatgtggtttga

SEQ ID NO: 1165259 - DNA, 22 bp, Artificial Sequence
  chemically synthesized
gtgattattttgatgtggtttg

SEQ ID NO: 1165260 - DNA, 22 bp, Artificial Sequence
  chemically synthesized
aaccatcaaaccacatcaaaat

SEQ ID NO: 1165261 - DNA, 22 bp, Artificial Sequence
  chemically synthesized
accatcaaaccacatcaaaata

SEQ ID NO: 1165262 - DNA, 22 bp, Artificial Sequence
  chemically synthesized
gaagcttgtgattattttgatg

SEQ ID NO: 1165263 - DNA, 22 bp, Artificial Sequence
  chemically synthesized
ggaagcttgtgattattttgat

SEQ ID NO: 1165264 - DNA, 22 bp, Artificial Sequence
  chemically synthesized
tggaagcttgtgattattttga

SEQ ID NO: 1165265 - DNA, 22 bp, Artificial Sequence
  chemically synthesized
acaagttttggaagcttgtgat

SEQ ID NO: 1165266 - DNA, 22 bp, Artificial Sequence
  chemically synthesized
agaagactaacaagttttggaa

SEQ ID NO: 1165267 - DNA, 22 bp, Artificial Sequence
  chemically synthesized
attaagaagactaacaagtttt

SEQ ID NO: 1165268 - DNA, 22 bp, Artificial Sequence
  chemically synthesized
aattaagaagactaacaagttt

SEQ ID NO: 1165269 - DNA, 22 bp, Artificial Sequence
  chemically synthesized
taattaagaagactaacaagtt

SEQ ID NO: 1165270 - DNA, 22 bp, Artificial Sequence
  chemically synthesized
ttaattaagaagactaacaagt

SEQ ID NO: 1165271 - DNA, 22 bp, Artificial Sequence
  chemically synthesized
tttttaattaagaagactaaca

SEQ ID NO: 1165272 - DNA, 22 bp, Artificial Sequence
  chemically synthesized
gtttttaattaagaagactaac

SEQ ID NO: 1165273 - DNA, 22 bp, Artificial Sequence
  chemically synthesized
ccaaaacttgttagtcttctta

SEQ ID NO: 1165274 - DNA, 22 bp, Artificial Sequence
  chemically synthesized
tttgtttttaattaagaagact

SEQ ID NO: 1165275 - DNA, 22 bp, Artificial Sequence
  chemically synthesized
caaaacttgttagtcttcttaa

SEQ ID NO: 1165276 - DNA, 22 bp, Artificial Sequence
  chemically synthesized
atttgtttttaattaagaagac

SEQ ID NO: 1165277 - DNA, 22 bp, Artificial Sequence
  chemically synthesized
gttagtcttcttaattaaaaac

SEQ ID NO: 1165278 - DNA, 22 bp, Artificial Sequence
  chemically synthesized
ttagtcttcttaattaaaaaca

SEQ ID NO: 1165279 - DNA, 22 bp, Artificial Sequence
  chemically synthesized
gtcttcttaattaaaaacaaat

SEQ ID NO: 1165280 - DNA, 22 bp, Artificial Sequence
  chemically synthesized
cttaattaaaaacaaataagga

SEQ ID NO: 1165281 - DNA, 22 bp, Artificial Sequence
  chemically synthesized
ttaattaaaaacaaataaggac

SEQ ID NO: 1165282 - DNA, 22 bp, Artificial Sequence
  chemically synthesized
aattaaaaacaaataaggactt

SEQ ID NO: 1165283 - DNA, 22 bp, Artificial Sequence
  chemically synthesized
attaaaaacaaataaggactta

SEQ ID NO: 1165284 - DNA, 22 bp, Artificial Sequence
  chemically synthesized
aaaacaaataaggacttacttg

SEQ ID NO: 1165285 - DNA, 22 bp, Artificial Sequence
  chemically synthesized
gcatggaaaaacaaagcaagta

SEQ ID NO: 1165286 - DNA, 22 bp, Artificial Sequence
  chemically synthesized
agggtagctagcatggaaaaac

SEQ ID NO: 1165287 - DNA, 22 bp, Artificial Sequence
  chemically synthesized
acttgctttgtttttccatgct

SEQ ID NO: 1165288 - DNA, 22 bp, Artificial Sequence
  chemically synthesized
cttgctttgtttttccatgcta

SEQ ID NO: 1165289 - DNA, 22 bp, Artificial Sequence
  chemically synthesized
gctttgtttttccatgctagct

SEQ ID NO: 1165290 - DNA, 22 bp, Artificial Sequence
  chemically synthesized
ctttgtttttccatgctagcta

SEQ ID NO: 1165291 - DNA, 22 bp, Artificial Sequence
  chemically synthesized
tgtttttccatgctagctaccc

SEQ ID NO: 1165292 - DNA, 22 bp, Artificial Sequence
  chemically synthesized
gtttttccatgctagctaccct

SEQ ID NO: 1165293 - DNA, 22 bp, Artificial Sequence
  chemically synthesized
tttttccatgctagctaccctg

SEQ ID NO: 1165294 - DNA, 22 bp, Artificial Sequence
  chemically synthesized
ttccatgctagctaccctgagg

SEQ ID NO: 1165295 - DNA, 22 bp, Artificial Sequence
  chemically synthesized
aagatgggaatgcctcagggta

SEQ ID NO: 1165296 - DNA, 22 bp, Artificial Sequence
  chemically synthesized
tccatgctagctaccctgaggc

SEQ ID NO: 1165297 - DNA, 22 bp, Artificial Sequence
  chemically synthesized
ccatgctagctaccctgaggca

SEQ ID NO: 1165298 - DNA, 22 bp, Artificial Sequence
  chemically synthesized
catgctagctaccctgaggcat

SEQ ID NO: 1165299 - DNA, 22 bp, Artificial Sequence
  chemically synthesized
aattcaagatgggaatgcctca

SEQ ID NO: 1165300 - DNA, 22 bp, Artificial Sequence
  chemically synthesized
ctaaattcaagatgggaatgcc

SEQ ID NO: 1165301 - DNA, 22 bp, Artificial Sequence
  chemically synthesized
gctaccctgaggcattcccatc

SEQ ID NO: 1165302 - DNA, 22 bp, Artificial Sequence
  chemically synthesized
ccctgaggcattcccatcttga

SEQ ID NO: 1165303 - DNA, 22 bp, Artificial Sequence
  chemically synthesized
aggcattcccatcttgaattta

SEQ ID NO: 1165304 - DNA, 22 bp, Artificial Sequence
  chemically synthesized
ccatcttgaatttaggagattc

SEQ ID NO: 1165305 - DNA, 22 bp, Artificial Sequence
  chemically synthesized
aagtacaagagcagatgaatct

SEQ ID NO: 1165306 - DNA, 22 bp, Artificial Sequence
  chemically synthesized
gaatttaggagattcatctgct

SEQ ID NO: 1165307 - DNA, 22 bp, Artificial Sequence
  chemically synthesized
aatttaggagattcatctgctc

SEQ ID NO: 1165308 - DNA, 22 bp, Artificial Sequence
  chemically synthesized
aggagattcatctgctcttgta

SEQ ID NO: 1165309 - DNA, 22 bp, Artificial Sequence
  chemically synthesized
ggagattcatctgctcttgtac

SEQ ID NO: 1165310 - DNA, 22 bp, Artificial Sequence
  chemically synthesized
atctgctcttgtacttcagttt

SEQ ID NO: 1165311 - DNA, 22 bp, Artificial Sequence
  chemically synthesized
tcagaagatgaagaaactgaag

SEQ ID NO: 1165312 - DNA, 22 bp, Artificial Sequence
  chemically synthesized
ctcttgtacttcagtttcttca

SEQ ID NO: 1165313 - DNA, 22 bp, Artificial Sequence
  chemically synthesized
ttgtacttcagtttcttcatct

SEQ ID NO: 1165314 - DNA, 22 bp, Artificial Sequence
  chemically synthesized
gtacttcagtttcttcatcttc

SEQ ID NO: 1165315 - DNA, 22 bp, Artificial Sequence
  chemically synthesized
tacttcagtttcttcatcttct

SEQ ID NO: 1165316 - DNA, 22 bp, Artificial Sequence
  chemically synthesized
gaacaggaaaattatcagaaga

SEQ ID NO: 1165317 - DNA, 22 bp, Artificial Sequence
  chemically synthesized
cagtttcttcatcttctgataa

SEQ ID NO: 1165318 - DNA, 22 bp, Artificial Sequence
  chemically synthesized
agtttcttcatcttctgataat

SEQ ID NO: 1165319 - DNA, 22 bp, Artificial Sequence
  chemically synthesized
attggaacaggaaaattatcag

SEQ ID NO: 1165320 - DNA, 22 bp, Artificial Sequence
  chemically synthesized
cttcatcttctgataattttcc

SEQ ID NO: 1165321 - DNA, 22 bp, Artificial Sequence
  chemically synthesized
ttcatcttctgataattttcct

SEQ ID NO: 1165322 - DNA, 22 bp, Artificial Sequence
  chemically synthesized
catcttctgataattttcctgt

SEQ ID NO: 1165323 - DNA, 22 bp, Artificial Sequence
  chemically synthesized
atcttctgataattttcctgtt

SEQ ID NO: 1165324 - DNA, 22 bp, Artificial Sequence
  chemically synthesized
ctgataattttcctgttccaat

SEQ ID NO: 1165325 - DNA, 22 bp, Artificial Sequence
  chemically synthesized
ggaagtaagctgattggaacag

SEQ ID NO: 1165326 - DNA, 22 bp, Artificial Sequence
  chemically synthesized
tgataattttcctgttccaatc

SEQ ID NO: 1165327 - DNA, 22 bp, Artificial Sequence
  chemically synthesized
ataattttcctgttccaatcag

SEQ ID NO: 1165328 - DNA, 22 bp, Artificial Sequence
  chemically synthesized
caattgggaagtaagctgattg

SEQ ID NO: 1165329 - DNA, 22 bp, Artificial Sequence
  chemically synthesized
tacaattgggaagtaagctgat

SEQ ID NO: 1165330 - DNA, 22 bp, Artificial Sequence
  chemically synthesized
tcctgttccaatcagcttactt

SEQ ID NO: 1165331 - DNA, 22 bp, Artificial Sequence
  chemically synthesized
cctgttccaatcagcttacttc

SEQ ID NO: 1165332 - DNA, 22 bp, Artificial Sequence
  chemically synthesized
ctgttccaatcagcttacttcc

SEQ ID NO: 1165333 - DNA, 22 bp, Artificial Sequence
  chemically synthesized
ttccaatcagcttacttcccaa

SEQ ID NO: 1165334 - DNA, 22 bp, Artificial Sequence
  chemically synthesized
gtaatattctacaattgggaag

SEQ ID NO: 1165335 - DNA, 22 bp, Artificial Sequence
  chemically synthesized
caatcagcttacttcccaattg

SEQ ID NO: 1165336 - DNA, 22 bp, Artificial Sequence
  chemically synthesized
acttcccaattgtagaatatta

SEQ ID NO: 1165337 - DNA, 22 bp, Artificial Sequence
  chemically synthesized
cttcccaattgtagaatattac

SEQ ID NO: 1165338 - DNA, 22 bp, Artificial Sequence
  chemically synthesized
cccaattgtagaatattaccaa

SEQ ID NO: 1165339 - DNA, 22 bp, Artificial Sequence
  chemically synthesized
ccaattgtagaatattaccaac

SEQ ID NO: 1165340 - DNA, 22 bp, Artificial Sequence
  chemically synthesized
acagcccatcagggccgggttg

SEQ ID NO: 1165341 - DNA, 22 bp, Artificial Sequence
  chemically synthesized
tagaatattaccaacccggccc

SEQ ID NO: 1165342 - DNA, 22 bp, Artificial Sequence
  chemically synthesized
gacagcccatcagggccgggtt

SEQ ID NO: 1165343 - DNA, 22 bp, Artificial Sequence
  chemically synthesized
ccaacccggccctgatgggctg

SEQ ID NO: 1165344 - DNA, 22 bp, Artificial Sequence
  chemically synthesized
tcaggggtacatgatggatttg

SEQ ID NO: 1165345 - DNA, 22 bp, Artificial Sequence
  chemically synthesized
gtcaggggtacatgatggattt

SEQ ID NO: 1165346 - DNA, 22 bp, Artificial Sequence
  chemically synthesized
tgtcaggggtacatgatggatt

SEQ ID NO: 1165347 - DNA, 22 bp, Artificial Sequence
  chemically synthesized
atgggctgtcaaatccatcatg

SEQ ID NO: 1165348 - DNA, 22 bp, Artificial Sequence
  chemically synthesized
tttgtcaggggtacatgatgga

SEQ ID NO: 1165349 - DNA, 22 bp, Artificial Sequence
  chemically synthesized
ctttgtcaggggtacatgatgg

SEQ ID NO: 1165350 - DNA, 22 bp, Artificial Sequence
  chemically synthesized
cttctttgtcaggggtacatga

SEQ ID NO: 1165351 - DNA, 22 bp, Artificial Sequence
  chemically synthesized
ccttctttgtcaggggtacatg

SEQ ID NO: 1165352 - DNA, 22 bp, Artificial Sequence
  chemically synthesized
tcaaatccatcatgtacccctg

SEQ ID NO: 1165353 - DNA, 22 bp, Artificial Sequence
  chemically synthesized
acttccttctttgtcaggggta

SEQ ID NO: 1165354 - DNA, 22 bp, Artificial Sequence
  chemically synthesized
ttaacttccttctttgtcaggg

SEQ ID NO: 1165355 - DNA, 22 bp, Artificial Sequence
  chemically synthesized
caattgttaacttccttctttg

SEQ ID NO: 1165356 - DNA, 22 bp, Artificial Sequence
  chemically synthesized
attacaattgttaacttccttc

SEQ ID NO: 1165357 - DNA, 22 bp, Artificial Sequence
  chemically synthesized
taattacaattgttaacttcct

SEQ ID NO: 1165358 - DNA, 22 bp, Artificial Sequence
  chemically synthesized
acaaagaaggaagttaacaatt

SEQ ID NO: 1165359 - DNA, 22 bp, Artificial Sequence
  chemically synthesized
gagttctaattacaattgttaa

SEQ ID NO: 1165360 - DNA, 22 bp, Artificial Sequence
  chemically synthesized
cctagagttctaattacaattg

SEQ ID NO: 1165361 - DNA, 22 bp, Artificial Sequence
  chemically synthesized
acctagagttctaattacaatt

SEQ ID NO: 1165362 - DNA, 22 bp, Artificial Sequence
  chemically synthesized
acaattgtaattagaactctag

SEQ ID NO: 1165363 - DNA, 22 bp, Artificial Sequence
  chemically synthesized
aaaaccacaccgatttacctag

SEQ ID NO: 1165364 - DNA, 22 bp, Artificial Sequence
  chemically synthesized
taattagaactctaggtaaatc

SEQ ID NO: 1165365 - DNA, 22 bp, Artificial Sequence
  chemically synthesized
gaactctaggtaaatcggtgtg

SEQ ID NO: 1165366 - DNA, 22 bp, Artificial Sequence
  chemically synthesized
taggtaaatcggtgtggttttg

SEQ ID NO: 1165367 - DNA, 22 bp, Artificial Sequence
  chemically synthesized
ggtaaatcggtgtggttttgag

SEQ ID NO: 1165368 - DNA, 22 bp, Artificial Sequence
  chemically synthesized
caaacaaataaaactcaaaacc

SEQ ID NO: 1165369 - DNA, 22 bp, Artificial Sequence
  chemically synthesized
aaactgcaaacaaataaaactc

SEQ ID NO: 1165370 - DNA, 22 bp, Artificial Sequence
  chemically synthesized
aaaactgcaaacaaataaaact

SEQ ID NO: 1165371 - DNA, 22 bp, Artificial Sequence
  chemically synthesized
tgagttttatttgtttgcagtt

SEQ ID NO: 1165372 - DNA, 22 bp, Artificial Sequence
  chemically synthesized
gagttttatttgtttgcagttt

SEQ ID NO: 1165373 - DNA, 22 bp, Artificial Sequence
  chemically synthesized
agttttatttgtttgcagtttt

SEQ ID NO: 1165374 - DNA, 22 bp, Artificial Sequence
  chemically synthesized
aatgggccacaagtttaaaact

SEQ ID NO: 1165375 - DNA, 22 bp, Artificial Sequence
  chemically synthesized
tatttgtttgcagttttaaact

SEQ ID NO: 1165376 - DNA, 22 bp, Artificial Sequence
  chemically synthesized
atttgtttgcagttttaaactt

SEQ ID NO: 1165377 - DNA, 22 bp, Artificial Sequence
  chemically synthesized
tttgtttgcagttttaaacttg

SEQ ID NO: 1165378 - DNA, 22 bp, Artificial Sequence
  chemically synthesized
gtttgcagttttaaacttgtgg

SEQ ID NO: 1165379 - DNA, 22 bp, Artificial Sequence
  chemically synthesized
tttgcagttttaaacttgtggc

SEQ ID NO: 1165380 - DNA, 22 bp, Artificial Sequence
  chemically synthesized
gcagttttaaacttgtggccca

SEQ ID NO: 1165381 - DNA, 22 bp, Artificial Sequence
  chemically synthesized
cagttttaaacttgtggcccat

SEQ ID NO: 1165382 - DNA, 22 bp, Artificial Sequence
  chemically synthesized
ggaatataaatctaaatgggcc

SEQ ID NO: 1165383 - DNA, 22 bp, Artificial Sequence
  chemically synthesized
taaacttgtggcccatttagat

SEQ ID NO: 1165384 - DNA, 22 bp, Artificial Sequence
  chemically synthesized
ctgggaatataaatctaaatgg

SEQ ID NO: 1165385 - DNA, 22 bp, Artificial Sequence
  chemically synthesized
aaacttgtggcccatttagatt

SEQ ID NO: 1165386 - DNA, 22 bp, Artificial Sequence
  chemically synthesized
actgggaatataaatctaaatg

SEQ ID NO: 1165387 - DNA, 22 bp, Artificial Sequence
  chemically synthesized
aacttgtggcccatttagattt

SEQ ID NO: 1165388 - DNA, 22 bp, Artificial Sequence
  chemically synthesized
tactgggaatataaatctaaat

SEQ ID NO: 1165389 - DNA, 22 bp, Artificial Sequence
  chemically synthesized
ttactgggaatataaatctaaa

SEQ ID NO: 1165390 - DNA, 22 bp, Artificial Sequence
  chemically synthesized
cttttactgggaatataaatct

SEQ ID NO: 1165391 - DNA, 22 bp, Artificial Sequence
  chemically synthesized
gtggcccatttagatttatatt

SEQ ID NO: 1165392 - DNA, 22 bp, Artificial Sequence
  chemically synthesized
tggcccatttagatttatattc

SEQ ID NO: 1165393 - DNA, 22 bp, Artificial Sequence
  chemically synthesized
aattccttttactgggaatata

SEQ ID NO: 1165394 - DNA, 22 bp, Artificial Sequence
  chemically synthesized
agatttatattcccagtaaaag

SEQ ID NO: 1165395 - DNA, 22 bp, Artificial Sequence
  chemically synthesized
gatttatattcccagtaaaagg

SEQ ID NO: 1165396 - DNA, 22 bp, Artificial Sequence
  chemically synthesized
atattcccagtaaaaggaattt

SEQ ID NO: 1165397 - DNA, 22 bp, Artificial Sequence
  chemically synthesized
caaatacaaattaaattccttt

SEQ ID NO: 1165398 - DNA, 22 bp, Artificial Sequence
  chemically synthesized
tattcccagtaaaaggaattta

SEQ ID NO: 1165399 - DNA, 22 bp, Artificial Sequence
  chemically synthesized
tgcaaatacaaattaaattcct

SEQ ID NO: 1165400 - DNA, 22 bp, Artificial Sequence
  chemically synthesized
ccagtaaaaggaatttaatttg

SEQ ID NO: 1165401 - DNA, 22 bp, Artificial Sequence
  chemically synthesized
ggattctgcaaatacaaattaa

SEQ ID NO: 1165402 - DNA, 22 bp, Artificial Sequence
  chemically synthesized
gggattctgcaaatacaaatta

SEQ ID NO: 1165403 - DNA, 22 bp, Artificial Sequence
  chemically synthesized
tgggattctgcaaatacaaatt

SEQ ID NO: 1165404 - DNA, 22 bp, Artificial Sequence
  chemically synthesized
aaagtggttttgggattctgca

SEQ ID NO: 1165405 - DNA, 22 bp, Artificial Sequence
  chemically synthesized
aatttgtatttgcagaatccca

SEQ ID NO: 1165406 - DNA, 22 bp, Artificial Sequence
  chemically synthesized
atttgtatttgcagaatcccaa

SEQ ID NO: 1165407 - DNA, 22 bp, Artificial Sequence
  chemically synthesized
atattaaaagtggttttgggat

SEQ ID NO: 1165408 - DNA, 22 bp, Artificial Sequence
  chemically synthesized
gtatttgcagaatcccaaaacc

SEQ ID NO: 1165409 - DNA, 22 bp, Artificial Sequence
  chemically synthesized
tatttgcagaatcccaaaacca

SEQ ID NO: 1165410 - DNA, 22 bp, Artificial Sequence
  chemically synthesized
attcatattaaaagtggttttg

SEQ ID NO: 1165411 - DNA, 22 bp, Artificial Sequence
  chemically synthesized
aattcatattaaaagtggtttt

SEQ ID NO: 1165412 - DNA, 22 bp, Artificial Sequence
  chemically synthesized
gcagaatcccaaaaccactttt

SEQ ID NO: 1165413 - DNA, 22 bp, Artificial Sequence
  chemically synthesized
cagaatcccaaaaccactttta

SEQ ID NO: 1165414 - DNA, 22 bp, Artificial Sequence
  chemically synthesized
cttaattcatattaaaagtggt

SEQ ID NO: 1165415 - DNA, 22 bp, Artificial Sequence
  chemically synthesized
ccttaattcatattaaaagtgg

SEQ ID NO: 1165416 - DNA, 22 bp, Artificial Sequence
  chemically synthesized
tccttaattcatattaaaagtg

SEQ ID NO: 1165417 - DNA, 22 bp, Artificial Sequence
  chemically synthesized
agataattttccttaattcata

SEQ ID NO: 1165418 - DNA, 22 bp, Artificial Sequence
  chemically synthesized
aagataattttccttaattcat

SEQ ID NO: 1165419 - DNA, 22 bp, Artificial Sequence
  chemically synthesized
acttaagataattttccttaat

SEQ ID NO: 1165420 - DNA, 22 bp, Artificial Sequence
  chemically synthesized
gacttaagataattttccttaa

SEQ ID NO: 1165421 - DNA, 22 bp, Artificial Sequence
  chemically synthesized
ttaatatgaattaaggaaaatt

SEQ ID NO: 1165422 - DNA, 22 bp, Artificial Sequence
  chemically synthesized
taatatgaattaaggaaaatta

SEQ ID NO: 1165423 - DNA, 22 bp, Artificial Sequence
  chemically synthesized
aatatgaattaaggaaaattat

SEQ ID NO: 1165424 - DNA, 22 bp, Artificial Sequence
  chemically synthesized
atatgaattaaggaaaattatc

SEQ ID NO: 1165425 - DNA, 22 bp, Artificial Sequence
  chemically synthesized
aagaacttgacttaagataatt

SEQ ID NO: 1165426 - DNA, 22 bp, Artificial Sequence
  chemically synthesized
tgaagaacttgacttaagataa

SEQ ID NO: 1165427 - DNA, 22 bp, Artificial Sequence
  chemically synthesized
ctgaagaacttgacttaagata

SEQ ID NO: 1165428 - DNA, 22 bp, Artificial Sequence
  chemically synthesized
cttctgaagaacttgacttaag

SEQ ID NO: 1165429 - DNA, 22 bp, Artificial Sequence
  chemically synthesized
aggaaaattatcttaagtcaag

SEQ ID NO: 1165430 - DNA, 22 bp, Artificial Sequence
  chemically synthesized
ggggcctgcttctgaagaactt

SEQ ID NO: 1165431 - DNA, 22 bp, Artificial Sequence
  chemically synthesized
tcttaagtcaagttcttcagaa

SEQ ID NO: 1165432 - DNA, 22 bp, Artificial Sequence
  chemically synthesized
tctcggggcctgcttctgaaga

SEQ ID NO: 1165433 - DNA, 22 bp, Artificial Sequence
  chemically synthesized
atctcggggcctgcttctgaag

SEQ ID NO: 1165434 - DNA, 22 bp, Artificial Sequence
  chemically synthesized
aagtcaagttcttcagaagcag

SEQ ID NO: 1165435 - DNA, 22 bp, Artificial Sequence
  chemically synthesized
agtcaagttcttcagaagcagg

SEQ ID NO: 1165436 - DNA, 22 bp, Artificial Sequence
  chemically synthesized
aagtccttatctcggggcctgc

SEQ ID NO: 1165437 - DNA, 22 bp, Artificial Sequence
  chemically synthesized
ttcagaagcaggccccgagata

SEQ ID NO: 1165438 - DNA, 22 bp, Artificial Sequence
  chemically synthesized
cactgaagtccttatctcgggg

SEQ ID NO: 1165439 - DNA, 22 bp, Artificial Sequence
  chemically synthesized
gcactgaagtccttatctcggg

SEQ ID NO: 1165440 - DNA, 22 bp, Artificial Sequence
  chemically synthesized
cagaagcaggccccgagataag

SEQ ID NO: 1165441 - DNA, 22 bp, Artificial Sequence
  chemically synthesized
agaagcaggccccgagataagg

SEQ ID NO: 1165442 - DNA, 22 bp, Artificial Sequence
  chemically synthesized
ataaatcacttgcactgaagtc

SEQ ID NO: 1165443 - DNA, 22 bp, Artificial Sequence
  chemically synthesized
aataaatcacttgcactgaagt

SEQ ID NO: 1165444 - DNA, 22 bp, Artificial Sequence
  chemically synthesized
cttaataaatcacttgcactga

SEQ ID NO: 1165445 - DNA, 22 bp, Artificial Sequence
  chemically synthesized
ccttaataaatcacttgcactg

SEQ ID NO: 1165446 - DNA, 22 bp, Artificial Sequence
  chemically synthesized
ttccttaataaatcacttgcac

SEQ ID NO: 1165447 - DNA, 22 bp, Artificial Sequence
  chemically synthesized
ggagctcttccttaataaatca

SEQ ID NO: 1165448 - DNA, 22 bp, Artificial Sequence
  chemically synthesized
cagtgcaagtgatttattaagg

SEQ ID NO: 1165449 - DNA, 22 bp, Artificial Sequence
  chemically synthesized
ctgggagctcttccttaataaa

SEQ ID NO: 1165450 - DNA, 22 bp, Artificial Sequence
  chemically synthesized
agtgcaagtgatttattaagga

SEQ ID NO: 1165451 - DNA, 22 bp, Artificial Sequence
  chemically synthesized
cctgggagctcttccttaataa

SEQ ID NO: 1165452 - DNA, 22 bp, Artificial Sequence
  chemically synthesized
cggaacttcctgggagctcttc

SEQ ID NO: 1165453 - DNA, 22 bp, Artificial Sequence
  chemically synthesized
gcggaacttcctgggagctctt

SEQ ID NO: 1165454 - DNA, 22 bp, Artificial Sequence
  chemically synthesized
ccttgcggaacttcctgggagc

SEQ ID NO: 1165455 - DNA, 22 bp, Artificial Sequence
  chemically synthesized
attaaggaagagctcccaggaa

SEQ ID NO: 1165456 - DNA, 22 bp, Artificial Sequence
  chemically synthesized
ttaaggaagagctcccaggaag

SEQ ID NO: 1165457 - DNA, 22 bp, Artificial Sequence
  chemically synthesized
aggaagagctcccaggaagttc

SEQ ID NO: 1165458 - DNA, 22 bp, Artificial Sequence
  chemically synthesized
aactcccttgcggaacttcctg

SEQ ID NO: 1165459 - DNA, 22 bp, Artificial Sequence
  chemically synthesized
caactcccttgcggaacttcct

SEQ ID NO: 1165460 - DNA, 22 bp, Artificial Sequence
  chemically synthesized
catcttcaactcccttgcggaa

SEQ ID NO: 1165461 - DNA, 22 bp, Artificial Sequence
  chemically synthesized
ctccatcttcaactcccttgcg

SEQ ID NO: 1165462 - DNA, 22 bp, Artificial Sequence
  chemically synthesized
ccaggaagttccgcaagggagt

SEQ ID NO: 1165463 - DNA, 22 bp, Artificial Sequence
  chemically synthesized
cctccatcttcaactcccttgc

SEQ ID NO: 1165464 - DNA, 22 bp, Artificial Sequence
  chemically synthesized
tcctccatcttcaactcccttg

SEQ ID NO: 1165465 - DNA, 22 bp, Artificial Sequence
  chemically synthesized
ttcctccatcttcaactccctt

SEQ ID NO: 1165466 - DNA, 22 bp, Artificial Sequence
  chemically synthesized
tttcctccatcttcaactccct

SEQ ID NO: 1165467 - DNA, 22 bp, Artificial Sequence
  chemically synthesized
tcctttttcctccatcttcaac

SEQ ID NO: 1165468 - DNA, 22 bp, Artificial Sequence
  chemically synthesized
cgcaagggagttgaagatggag

SEQ ID NO: 1165469 - DNA, 22 bp, Artificial Sequence
  chemically synthesized
cctgtcctttttcctccatctt

SEQ ID NO: 1165470 - DNA, 22 bp, Artificial Sequence
  chemically synthesized
ccctgtcctttttcctccatct

SEQ ID NO: 1165471 - DNA, 22 bp, Artificial Sequence
  chemically synthesized
ccttccctgtcctttttcctcc

SEQ ID NO: 1165472 - DNA, 22 bp, Artificial Sequence
  chemically synthesized
cccttccctgtcctttttcctc

SEQ ID NO: 1165473 - DNA, 22 bp, Artificial Sequence
  chemically synthesized
tcccttccctgtcctttttcct

SEQ ID NO: 1165474 - DNA, 22 bp, Artificial Sequence
  chemically synthesized
tttcccttccctgtcctttttc

SEQ ID NO: 1165475 - DNA, 22 bp, Artificial Sequence
  chemically synthesized
ctttcccttccctgtccttttt

SEQ ID NO: 1165476 - DNA, 22 bp, Artificial Sequence
  chemically synthesized
aagatggaggaaaaaggacagg

SEQ ID NO: 1165477 - DNA, 22 bp, Artificial Sequence
  chemically synthesized
gcttctttcccttccctgtcct

SEQ ID NO: 1165478 - DNA, 22 bp, Artificial Sequence
  chemically synthesized
ggcttctttcccttccctgtcc

SEQ ID NO: 1165479 - DNA, 22 bp, Artificial Sequence
  chemically synthesized
gtttggcttctttcccttccct

SEQ ID NO: 1165480 - DNA, 22 bp, Artificial Sequence
  chemically synthesized
agatgatacactcgtttggctt

SEQ ID NO: 1165481 - DNA, 22 bp, Artificial Sequence
  chemically synthesized
ctgagatgatacactcgtttgg

SEQ ID NO: 1165482 - DNA, 22 bp, Artificial Sequence
  chemically synthesized
cctgagatgatacactcgtttg

SEQ ID NO: 1165483 - DNA, 22 bp, Artificial Sequence
  chemically synthesized
tcctgagatgatacactcgttt

SEQ ID NO: 1165484 - DNA, 22 bp, Artificial Sequence
  chemically synthesized
ttcctgagatgatacactcgtt

SEQ ID NO: 1165485 - DNA, 22 bp, Artificial Sequence
  chemically synthesized
agtgggagacttttcctgagat

SEQ ID NO: 1165486 - DNA, 22 bp, Artificial Sequence
  chemically synthesized
tcagtgggagacttttcctgag

SEQ ID NO: 1165487 - DNA, 22 bp, Artificial Sequence
  chemically synthesized
tctcagtgggagacttttcctg

SEQ ID NO: 1165488 - DNA, 22 bp, Artificial Sequence
  chemically synthesized
ctctcagtgggagacttttcct

SEQ ID NO: 1165489 - DNA, 22 bp, Artificial Sequence
  chemically synthesized
acttctctcagtgggagacttt

SEQ ID NO: 1165490 - DNA, 22 bp, Artificial Sequence
  chemically synthesized
aacttctctcagtgggagactt

SEQ ID NO: 1165491 - DNA, 22 bp, Artificial Sequence
  chemically synthesized
ggcttaacttctctcagtggga

SEQ ID NO: 1165492 - DNA, 22 bp, Artificial Sequence
  chemically synthesized
aggaaaagtctcccactgagag

SEQ ID NO: 1165493 - DNA, 22 bp, Artificial Sequence
  chemically synthesized
atgtatggtattgggcttaact

SEQ ID NO: 1165494 - DNA, 22 bp, Artificial Sequence
  chemically synthesized
ccactgagagaagttaagccca

SEQ ID NO: 1165495 - DNA, 22 bp, Artificial Sequence
  chemically synthesized
agttgatgtatggtattgggct

SEQ ID NO: 1165496 - DNA, 22 bp, Artificial Sequence
  chemically synthesized
agagaagttaagcccaatacca

SEQ ID NO: 1165497 - DNA, 22 bp, Artificial Sequence
  chemically synthesized
ctgagttgatgtatggtattgg

SEQ ID NO: 1165498 - DNA, 22 bp, Artificial Sequence
  chemically synthesized
cattcctgagttgatgtatggt

SEQ ID NO: 1165499 - DNA, 22 bp, Artificial Sequence
  chemically synthesized
acattcctgagttgatgtatgg

SEQ ID NO: 1165500 - DNA, 22 bp, Artificial Sequence
  chemically synthesized
agcccaataccatacatcaact

SEQ ID NO: 1165501 - DNA, 22 bp, Artificial Sequence
  chemically synthesized
cttacattcctgagttgatgta

SEQ ID NO: 1165502 - DNA, 22 bp, Artificial Sequence
  chemically synthesized
aggcattacttacattcctgag

SEQ ID NO: 1165503 - DNA, 22 bp, Artificial Sequence
  chemically synthesized
aggaatgtaagtaatgcctcag

SEQ ID NO: 1165504 - DNA, 22 bp, Artificial Sequence
  chemically synthesized
tgtcaaggcagtgctgaggcat

SEQ ID NO: 1165505 - DNA, 22 bp, Artificial Sequence
  chemically synthesized
gtgtcaaggcagtgctgaggca

SEQ ID NO: 1165506 - DNA, 22 bp, Artificial Sequence
  chemically synthesized
ttgtgtcaaggcagtgctgagg

SEQ ID NO: 1165507 - DNA, 22 bp, Artificial Sequence
  chemically synthesized
tcttgtgtcaaggcagtgctga

SEQ ID NO: 1165508 - DNA, 22 bp, Artificial Sequence
  chemically synthesized
ctcttgtgtcaaggcagtgctg

SEQ ID NO: 1165509 - DNA, 22 bp, Artificial Sequence
  chemically synthesized
tctcttgtgtcaaggcagtgct

SEQ ID NO: 1165510 - DNA, 22 bp, Artificial Sequence
  chemically synthesized
tttctcttgtgtcaaggcagtg

SEQ ID NO: 1165511 - DNA, 22 bp, Artificial Sequence
  chemically synthesized
ctttctcttgtgtcaaggcagt

SEQ ID NO: 1165512 - DNA, 22 bp, Artificial Sequence
  chemically synthesized
agcactgccttgacacaagaga

SEQ ID NO: 1165513 - DNA, 22 bp, Artificial Sequence
  chemically synthesized
ccttgacacaagagaaagaagt

SEQ ID NO: 1165514 - DNA, 22 bp, Artificial Sequence
  chemically synthesized
gacacaagagaaagaagttggg

SEQ ID NO: 1165515 - DNA, 22 bp, Artificial Sequence
  chemically synthesized
acacaagagaaagaagttgggc

SEQ ID NO: 1165516 - DNA, 22 bp, Artificial Sequence
  chemically synthesized
atcggccaacaggaatacgaaa

SEQ ID NO: 1165517 - DNA, 22 bp, Artificial Sequence
  chemically synthesized
cctgatcggccaacaggaatac

SEQ ID NO: 1165518 - DNA, 22 bp, Artificial Sequence
  chemically synthesized
tacctgatcggccaacaggaat

SEQ ID NO: 1165519 - DNA, 22 bp, Artificial Sequence
  chemically synthesized
ctacctgatcggccaacaggaa

SEQ ID NO: 1165520 - DNA, 22 bp, Artificial Sequence
  chemically synthesized
ggctttcgtattcctgttggcc

SEQ ID NO: 1165521 - DNA, 22 bp, Artificial Sequence
  chemically synthesized
tcgtattcctgttggccgatca

SEQ ID NO: 1165522 - DNA, 22 bp, Artificial Sequence
  chemically synthesized
cgtattcctgttggccgatcag

SEQ ID NO: 1165523 - DNA, 22 bp, Artificial Sequence
  chemically synthesized
gtattcctgttggccgatcagg

SEQ ID NO: 1165524 - DNA, 22 bp, Artificial Sequence
  chemically synthesized
aaggcatttctacctgatcggc

SEQ ID NO: 1165525 - DNA, 22 bp, Artificial Sequence
  chemically synthesized
ctgttggccgatcaggtagaaa

SEQ ID NO: 1165526 - DNA, 22 bp, Artificial Sequence
  chemically synthesized
ttggccgatcaggtagaaatgc

SEQ ID NO: 1165527 - DNA, 22 bp, Artificial Sequence
  chemically synthesized
gccgatcaggtagaaatgcctt

SEQ ID NO: 1165528 - DNA, 22 bp, Artificial Sequence
  chemically synthesized
gagagcaaccattgaaggcatt

SEQ ID NO: 1165529 - DNA, 22 bp, Artificial Sequence
  chemically synthesized
ggagagcaaccattgaaggcat

SEQ ID NO: 1165530 - DNA, 22 bp, Artificial Sequence
  chemically synthesized
tggagagcaaccattgaaggca

SEQ ID NO: 1165531 - DNA, 22 bp, Artificial Sequence
  chemically synthesized
ttggagagcaaccattgaaggc

SEQ ID NO: 1165532 - DNA, 22 bp, Artificial Sequence
  chemically synthesized
ttttggagagcaaccattgaag

SEQ ID NO: 1165533 - DNA, 22 bp, Artificial Sequence
  chemically synthesized
cttttggagagcaaccattgaa

SEQ ID NO: 1165534 - DNA, 22 bp, Artificial Sequence
  chemically synthesized
tcttttggagagcaaccattga

SEQ ID NO: 1165535 - DNA, 22 bp, Artificial Sequence
  chemically synthesized
aagttttcttttggagagcaac

SEQ ID NO: 1165536 - DNA, 22 bp, Artificial Sequence
  chemically synthesized
gaagttttcttttggagagcaa

SEQ ID NO: 1165537 - DNA, 22 bp, Artificial Sequence
  chemically synthesized
tgaagttttcttttggagagca

SEQ ID NO: 1165538 - DNA, 22 bp, Artificial Sequence
  chemically synthesized
caatggttgctctccaaaagaa

SEQ ID NO: 1165539 - DNA, 22 bp, Artificial Sequence
  chemically synthesized
aatggttgctctccaaaagaaa

SEQ ID NO: 1165540 - DNA, 22 bp, Artificial Sequence
  chemically synthesized
ctctccaaaagaaaacttcaaa

SEQ ID NO: 1165541 - DNA, 22 bp, Artificial Sequence
  chemically synthesized
caacagtcagattttgaagttt

SEQ ID NO: 1165542 - DNA, 22 bp, Artificial Sequence
  chemically synthesized
tccaaaagaaaacttcaaaatc

SEQ ID NO: 1165543 - DNA, 22 bp, Artificial Sequence
  chemically synthesized
caaaagaaaacttcaaaatctg

SEQ ID NO: 1165544 - DNA, 22 bp, Artificial Sequence
  chemically synthesized
ggattccaacagtcagattttg

SEQ ID NO: 1165545 - DNA, 22 bp, Artificial Sequence
  chemically synthesized
gggattccaacagtcagatttt

SEQ ID NO: 1165546 - DNA, 22 bp, Artificial Sequence
  chemically synthesized
tgatgtgcttgggattccaaca

SEQ ID NO: 1165547 - DNA, 22 bp, Artificial Sequence
  chemically synthesized
caaaatctgactgttggaatcc

SEQ ID NO: 1165548 - DNA, 22 bp, Artificial Sequence
  chemically synthesized
aaaatctgactgttggaatccc

SEQ ID NO: 1165549 - DNA, 22 bp, Artificial Sequence
  chemically synthesized
ctatgatgtgcttgggattcca

SEQ ID NO: 1165550 - DNA, 22 bp, Artificial Sequence
  chemically synthesized
gttactatgatgtgcttgggat

SEQ ID NO: 1165551 - DNA, 22 bp, Artificial Sequence
  chemically synthesized
agttactatgatgtgcttggga

SEQ ID NO: 1165552 - DNA, 22 bp, Artificial Sequence
  chemically synthesized
actgttggaatcccaagcacat

SEQ ID NO: 1165553 - DNA, 22 bp, Artificial Sequence
  chemically synthesized
ttggaatcccaagcacatcata

SEQ ID NO: 1165554 - DNA, 22 bp, Artificial Sequence
  chemically synthesized
gaaatttagttactatgatgtg

SEQ ID NO: 1165555 - DNA, 22 bp, Artificial Sequence
  chemically synthesized
ggaaatttagttactatgatgt

SEQ ID NO: 1165556 - DNA, 22 bp, Artificial Sequence
  chemically synthesized
gaatcccaagcacatcatagta

SEQ ID NO: 1165557 - DNA, 22 bp, Artificial Sequence
  chemically synthesized
tggaaatttagttactatgatg

SEQ ID NO: 1165558 - DNA, 22 bp, Artificial Sequence
  chemically synthesized
tattttggaaatttagttacta

SEQ ID NO: 1165559 - DNA, 22 bp, Artificial Sequence
  chemically synthesized
gtattttggaaatttagttact

SEQ ID NO: 1165560 - DNA, 22 bp, Artificial Sequence
  chemically synthesized
catccttgtattttggaaattt

SEQ ID NO: 1165561 - DNA, 22 bp, Artificial Sequence
  chemically synthesized
acatccttgtattttggaaatt

SEQ ID NO: 1165562 - DNA, 22 bp, Artificial Sequence
  chemically synthesized
ttacatccttgtattttggaaa

SEQ ID NO: 1165563 - DNA, 22 bp, Artificial Sequence
  chemically synthesized
tcttacatccttgtattttgga

SEQ ID NO: 1165564 - DNA, 22 bp, Artificial Sequence
  chemically synthesized
ctctcttacatccttgtatttt

SEQ ID NO: 1165565 - DNA, 22 bp, Artificial Sequence
  chemically synthesized
aatttccaaaatacaaggatgt

SEQ ID NO: 1165566 - DNA, 22 bp, Artificial Sequence
  chemically synthesized
aattactctcttacatccttgt

SEQ ID NO: 1165567 - DNA, 22 bp, Artificial Sequence
  chemically synthesized
ctcaattactctcttacatcct

SEQ ID NO: 1165568 - DNA, 22 bp, Artificial Sequence
  chemically synthesized
cctcaattactctcttacatcc

SEQ ID NO: 1165569 - DNA, 22 bp, Artificial Sequence
  chemically synthesized
ccaaaatacaaggatgtaagag

SEQ ID NO: 1165570 - DNA, 22 bp, Artificial Sequence
  chemically synthesized
tcctcaattactctcttacatc

SEQ ID NO: 1165571 - DNA, 22 bp, Artificial Sequence
  chemically synthesized
caaaatacaaggatgtaagaga

SEQ ID NO: 1165572 - DNA, 22 bp, Artificial Sequence
  chemically synthesized
ttcctcaattactctcttacat

SEQ ID NO: 1165573 - DNA, 22 bp, Artificial Sequence
  chemically synthesized
tttcctcaattactctcttaca

SEQ ID NO: 1165574 - DNA, 22 bp, Artificial Sequence
  chemically synthesized
taatggcaagtcatcctttttc

SEQ ID NO: 1165575 - DNA, 22 bp, Artificial Sequence
  chemically synthesized
ttataatggcaagtcatccttt

SEQ ID NO: 1165576 - DNA, 22 bp, Artificial Sequence
  chemically synthesized
gttataatggcaagtcatcctt

SEQ ID NO: 1165577 - DNA, 22 bp, Artificial Sequence
  chemically synthesized
aggaaaaaggatgacttgccat

SEQ ID NO: 1165578 - DNA, 22 bp, Artificial Sequence
  chemically synthesized
caaaacaaaacatatgacttgt

SEQ ID NO: 1165579 - DNA, 22 bp, Artificial Sequence
  chemically synthesized
acaaaacaaaacatatgacttg

SEQ ID NO: 1165580 - DNA, 22 bp, Artificial Sequence
  chemically synthesized
gccattataacaagtcatatgt

SEQ ID NO: 1165581 - DNA, 22 bp, Artificial Sequence
  chemically synthesized
ccattataacaagtcatatgtt

SEQ ID NO: 1165582 - DNA, 22 bp, Artificial Sequence
  chemically synthesized
atttacaaaacaaaacatatga

SEQ ID NO: 1165583 - DNA, 22 bp, Artificial Sequence
  chemically synthesized
taacaagtcatatgttttgttt

SEQ ID NO: 1165584 - DNA, 22 bp, Artificial Sequence
  chemically synthesized
aaacgttaatttacaaaacaaa

SEQ ID NO: 1165585 - DNA, 22 bp, Artificial Sequence
  chemically synthesized
atgaggtaaactaaaacgttaa

SEQ ID NO: 1165586 - DNA, 22 bp, Artificial Sequence
  chemically synthesized
tgttttgtaaattaacgtttta

SEQ ID NO: 1165587 - DNA, 22 bp, Artificial Sequence
  chemically synthesized
gttttgtaaattaacgttttag

SEQ ID NO: 1165588 - DNA, 22 bp, Artificial Sequence
  chemically synthesized
ttttgtaaattaacgttttagt

SEQ ID NO: 1165589 - DNA, 22 bp, Artificial Sequence
  chemically synthesized
tgtaaattaacgttttagttta

SEQ ID NO: 1165590 - DNA, 22 bp, Artificial Sequence
  chemically synthesized
atactcatgaggtaaactaaaa

SEQ ID NO: 1165591 - DNA, 22 bp, Artificial Sequence
  chemically synthesized
gtaaattaacgttttagtttac

SEQ ID NO: 1165592 - DNA, 22 bp, Artificial Sequence
  chemically synthesized
catactcatgaggtaaactaaa

SEQ ID NO: 1165593 - DNA, 22 bp, Artificial Sequence
  chemically synthesized
taaattaacgttttagtttacc

SEQ ID NO: 1165594 - DNA, 22 bp, Artificial Sequence
  chemically synthesized
acgttttagtttacctcatgag

SEQ ID NO: 1165595 - DNA, 22 bp, Artificial Sequence
  chemically synthesized
tagtttacctcatgagtatgaa

SEQ ID NO: 1165596 - DNA, 22 bp, Artificial Sequence
  chemically synthesized
agtttacctcatgagtatgaaa

SEQ ID NO: 1165597 - DNA, 22 bp, Artificial Sequence
  chemically synthesized
gtttacctcatgagtatgaaac

SEQ ID NO: 1165598 - DNA, 22 bp, Artificial Sequence
  chemically synthesized
acctcatgagtatgaaactggt

SEQ ID NO: 1165599 - DNA, 22 bp, Artificial Sequence
  chemically synthesized
cctcatgagtatgaaactggtc

SEQ ID NO: 1165600 - DNA, 22 bp, Artificial Sequence
  chemically synthesized
atgagtatgaaactggtctttc

SEQ ID NO: 1165601 - DNA, 22 bp, Artificial Sequence
  chemically synthesized
atgatgtggaagtggtgaaaga

SEQ ID NO: 1165602 - DNA, 22 bp, Artificial Sequence
  chemically synthesized
taatgatgtggaagtggtgaaa

SEQ ID NO: 1165603 - DNA, 22 bp, Artificial Sequence
  chemically synthesized
ctaatgatgtggaagtggtgaa

SEQ ID NO: 1165604 - DNA, 22 bp, Artificial Sequence
  chemically synthesized
gtctttcaccacttccacatca

SEQ ID NO: 1165605 - DNA, 22 bp, Artificial Sequence
  chemically synthesized
tcaccacttccacatcattaga

SEQ ID NO: 1165606 - DNA, 22 bp, Artificial Sequence
  chemically synthesized
caccacttccacatcattagaa

SEQ ID NO: 1165607 - DNA, 22 bp, Artificial Sequence
  chemically synthesized
accacttccacatcattagaaa

SEQ ID NO: 1165608 - DNA, 22 bp, Artificial Sequence
  chemically synthesized
caagcacaaggagagatttcta

SEQ ID NO: 1165609 - DNA, 22 bp, Artificial Sequence
  chemically synthesized
ccacatcattagaaatctctcc

SEQ ID NO: 1165610 - DNA, 22 bp, Artificial Sequence
  chemically synthesized
cacatcattagaaatctctcct

SEQ ID NO: 1165611 - DNA, 22 bp, Artificial Sequence
  chemically synthesized
aggacacattgcaagcacaagg

SEQ ID NO: 1165612 - DNA, 22 bp, Artificial Sequence
  chemically synthesized
gaaatctctccttgtgcttgca

SEQ ID NO: 1165613 - DNA, 22 bp, Artificial Sequence
  chemically synthesized
ctgaggacacattgcaagcaca

SEQ ID NO: 1165614 - DNA, 22 bp, Artificial Sequence
  chemically synthesized
tgctgaggacacattgcaagca

SEQ ID NO: 1165615 - DNA, 22 bp, Artificial Sequence
  chemically synthesized
ctgctgaggacacattgcaagc

SEQ ID NO: 1165616 - DNA, 22 bp, Artificial Sequence
  chemically synthesized
tctgctgaggacacattgcaag

SEQ ID NO: 1165617 - DNA, 22 bp, Artificial Sequence
  chemically synthesized
tttctgctgaggacacattgca

SEQ ID NO: 1165618 - DNA, 22 bp, Artificial Sequence
  chemically synthesized
ctttctgctgaggacacattgc

SEQ ID NO: 1165619 - DNA, 22 bp, Artificial Sequence
  chemically synthesized
tccttgtgcttgcaatgtgtcc

SEQ ID NO: 1165620 - DNA, 22 bp, Artificial Sequence
  chemically synthesized
cttgtgcttgcaatgtgtcctc

SEQ ID NO: 1165621 - DNA, 22 bp, Artificial Sequence
  chemically synthesized
gtgcttgcaatgtgtcctcagc

SEQ ID NO: 1165622 - DNA, 22 bp, Artificial Sequence
  chemically synthesized
tgcttgcaatgtgtcctcagca

SEQ ID NO: 1165623 - DNA, 22 bp, Artificial Sequence
  chemically synthesized
tcgtggcttctttctgctgagg

SEQ ID NO: 1165624 - DNA, 22 bp, Artificial Sequence
  chemically synthesized
gcaatgtgtcctcagcagaaag

SEQ ID NO: 1165625 - DNA, 22 bp, Artificial Sequence
  chemically synthesized
caatgtgtcctcagcagaaaga

SEQ ID NO: 1165626 - DNA, 22 bp, Artificial Sequence
  chemically synthesized
gaagaagtattatcgtggcttc

SEQ ID NO: 1165627 - DNA, 22 bp, Artificial Sequence
  chemically synthesized
agaagaagtattatcgtggctt

SEQ ID NO: 1165628 - DNA, 22 bp, Artificial Sequence
  chemically synthesized
tagaagaagtattatcgtggct

SEQ ID NO: 1165629 - DNA, 22 bp, Artificial Sequence
  chemically synthesized
agcagaaagaagccacgataat

SEQ ID NO: 1165630 - DNA, 22 bp, Artificial Sequence
  chemically synthesized
tcaaacagctttagaagaagta

SEQ ID NO: 1165631 - DNA, 22 bp, Artificial Sequence
  chemically synthesized
gaccgttatcaaacagctttag

SEQ ID NO: 1165632 - DNA, 22 bp, Artificial Sequence
  chemically synthesized
cttctaaagctgtttgataacg

SEQ ID NO: 1165633 - DNA, 22 bp, Artificial Sequence
  chemically synthesized
ttctaaagctgtttgataacgg

SEQ ID NO: 1165634 - DNA, 22 bp, Artificial Sequence
  chemically synthesized
ctaaagctgtttgataacggtc

SEQ ID NO: 1165635 - DNA, 22 bp, Artificial Sequence
  chemically synthesized
taaagctgtttgataacggtcc

SEQ ID NO: 1165636 - DNA, 22 bp, Artificial Sequence
  chemically synthesized
aagctgtttgataacggtccag

SEQ ID NO: 1165637 - DNA, 22 bp, Artificial Sequence
  chemically synthesized
tttgataacggtccaggtttac

SEQ ID NO: 1165638 - DNA, 22 bp, Artificial Sequence
  chemically synthesized
atggagagtgaagtaaacctgg

SEQ ID NO: 1165639 - DNA, 22 bp, Artificial Sequence
  chemically synthesized
gataacggtccaggtttacttc

SEQ ID NO: 1165640 - DNA, 22 bp, Artificial Sequence
  chemically synthesized
ataacggtccaggtttacttca

SEQ ID NO: 1165641 - DNA, 22 bp, Artificial Sequence
  chemically synthesized
attgatggagagtgaagtaaac

SEQ ID NO: 1165642 - DNA, 22 bp, Artificial Sequence
  chemically synthesized
gcagttcattgatggagagtga

SEQ ID NO: 1165643 - DNA, 22 bp, Artificial Sequence
  chemically synthesized
ggcagttcattgatggagagtg

SEQ ID NO: 1165644 - DNA, 22 bp, Artificial Sequence
  chemically synthesized
acttcactctccatcaatgaac

SEQ ID NO: 1165645 - DNA, 22 bp, Artificial Sequence
  chemically synthesized
cttcactctccatcaatgaact

SEQ ID NO: 1165646 - DNA, 22 bp, Artificial Sequence
  chemically synthesized
cactctccatcaatgaactgcc

SEQ ID NO: 1165647 - DNA, 22 bp, Artificial Sequence
  chemically synthesized
actctccatcaatgaactgcca

SEQ ID NO: 1165648 - DNA, 22 bp, Artificial Sequence
  chemically synthesized
aagacaagtcatttggcagttc

SEQ ID NO: 1165649 - DNA, 22 bp, Artificial Sequence
  chemically synthesized
tccatcaatgaactgccaaatg

SEQ ID NO: 1165650 - DNA, 22 bp, Artificial Sequence
  chemically synthesized
ctgaagacaagtcatttggcag

SEQ ID NO: 1165651 - DNA, 22 bp, Artificial Sequence
  chemically synthesized
catcaatgaactgccaaatgac

SEQ ID NO: 1165652 - DNA, 22 bp, Artificial Sequence
  chemically synthesized
gaagctcctgaagacaagtcat

SEQ ID NO: 1165653 - DNA, 22 bp, Artificial Sequence
  chemically synthesized
ggaagctcctgaagacaagtca

SEQ ID NO: 1165654 - DNA, 22 bp, Artificial Sequence
  chemically synthesized
ccaaatgacttgtcttcaggag

SEQ ID NO: 1165655 - DNA, 22 bp, Artificial Sequence
  chemically synthesized
tgcagcatttggaagctcctga

SEQ ID NO: 1165656 - DNA, 22 bp, Artificial Sequence
  chemically synthesized
ttgtgcagcatttggaagctcc

SEQ ID NO: 1165657 - DNA, 22 bp, Artificial Sequence
  chemically synthesized
attgtgcagcatttggaagctc

SEQ ID NO: 1165658 - DNA, 22 bp, Artificial Sequence
  chemically synthesized
tattgtgcagcatttggaagct

SEQ ID NO: 1165659 - DNA, 22 bp, Artificial Sequence
  chemically synthesized
gtcttcaggagcttccaaatgc

SEQ ID NO: 1165660 - DNA, 22 bp, Artificial Sequence
  chemically synthesized
ttttattgtgcagcatttggaa

SEQ ID NO: 1165661 - DNA, 22 bp, Artificial Sequence
  chemically synthesized
tcttcaggagcttccaaatgct

SEQ ID NO: 1165662 - DNA, 22 bp, Artificial Sequence
  chemically synthesized
attttattgtgcagcatttgga

SEQ ID NO: 1165663 - DNA, 22 bp, Artificial Sequence
  chemically synthesized
caggagcttccaaatgctgcac

SEQ ID NO: 1165664 - DNA, 22 bp, Artificial Sequence
  chemically synthesized
aggagcttccaaatgctgcaca

SEQ ID NO: 1165665 - DNA, 22 bp, Artificial Sequence
  chemically synthesized
ccaaatgctgcacaataaaata

SEQ ID NO: 1165666 - DNA, 22 bp, Artificial Sequence
  chemically synthesized
caaatgctgcacaataaaataa

SEQ ID NO: 1165667 - DNA, 22 bp, Artificial Sequence
  chemically synthesized
tgtaacacccaatttattttat

SEQ ID NO: 1165668 - DNA, 22 bp, Artificial Sequence
  chemically synthesized
attgtgtaacacccaatttatt

SEQ ID NO: 1165669 - DNA, 22 bp, Artificial Sequence
  chemically synthesized
cacaataaaataaattgggtgt

SEQ ID NO: 1165670 - DNA, 22 bp, Artificial Sequence
  chemically synthesized
caaagacattaattgtgtaaca

SEQ ID NO: 1165671 - DNA, 22 bp, Artificial Sequence
  chemically synthesized
ggtgttacacaattaatgtctt

SEQ ID NO: 1165672 - DNA, 22 bp, Artificial Sequence
  chemically synthesized
gaacaatctgcaaagacattaa

SEQ ID NO: 1165673 - DNA, 22 bp, Artificial Sequence
  chemically synthesized
cacaattaatgtctttgcagat

SEQ ID NO: 1165674 - DNA, 22 bp, Artificial Sequence
  chemically synthesized
atgtactggaacaatctgcaaa

SEQ ID NO: 1165675 - DNA, 22 bp, Artificial Sequence
  chemically synthesized
aatgtactggaacaatctgcaa

SEQ ID NO: 1165676 - DNA, 22 bp, Artificial Sequence
  chemically synthesized
atgtctttgcagattgttccag

SEQ ID NO: 1165677 - DNA, 22 bp, Artificial Sequence
  chemically synthesized
atcatttaatgtactggaacaa

SEQ ID NO: 1165678 - DNA, 22 bp, Artificial Sequence
  chemically synthesized
gattcatcatttaatgtactgg

SEQ ID NO: 1165679 - DNA, 22 bp, Artificial Sequence
  chemically synthesized
tgcagattgttccagtacatta

SEQ ID NO: 1165680 - DNA, 22 bp, Artificial Sequence
  chemically synthesized
gcagattgttccagtacattaa

SEQ ID NO: 1165681 - DNA, 22 bp, Artificial Sequence
  chemically synthesized
cagattgttccagtacattaaa

SEQ ID NO: 1165682 - DNA, 22 bp, Artificial Sequence
  chemically synthesized
attcgattcatcatttaatgta

SEQ ID NO: 1165683 - DNA, 22 bp, Artificial Sequence
  chemically synthesized
cattcgattcatcatttaatgt

SEQ ID NO: 1165684 - DNA, 22 bp, Artificial Sequence
  chemically synthesized
ttccagtacattaaatgatgaa

SEQ ID NO: 1165685 - DNA, 22 bp, Artificial Sequence
  chemically synthesized
aatatttcattcgattcatcat

SEQ ID NO: 1165686 - DNA, 22 bp, Artificial Sequence
  chemically synthesized
cagtacattaaatgatgaatcg

SEQ ID NO: 1165687 - DNA, 22 bp, Artificial Sequence
  chemically synthesized
aaatatttcattcgattcatca

SEQ ID NO: 1165688 - DNA, 22 bp, Artificial Sequence
  chemically synthesized
taaatatttcattcgattcatc

SEQ ID NO: 1165689 - DNA, 22 bp, Artificial Sequence
  chemically synthesized
gcattttaaatatttcattcga

SEQ ID NO: 1165690 - DNA, 22 bp, Artificial Sequence
  chemically synthesized
aatgatgaatcgaatgaaatat

SEQ ID NO: 1165691 - DNA, 22 bp, Artificial Sequence
  chemically synthesized
ataatgccagtggacagtccta

SEQ ID NO: 1165692 - DNA, 22 bp, Artificial Sequence
  chemically synthesized
gataatgccagtggacagtcct

SEQ ID NO: 1165693 - DNA, 22 bp, Artificial Sequence
  chemically synthesized
aaaatgctaggactgtccactg

SEQ ID NO: 1165694 - DNA, 22 bp, Artificial Sequence
  chemically synthesized
aaatgctaggactgtccactgg

SEQ ID NO: 1165695 - DNA, 22 bp, Artificial Sequence
  chemically synthesized
tgtttgataatgccagtggaca

SEQ ID NO: 1165696 - DNA, 22 bp, Artificial Sequence
  chemically synthesized
ctgtgtttgataatgccagtgg

SEQ ID NO: 1165697 - DNA, 22 bp, Artificial Sequence
  chemically synthesized
ttcctgtgtttgataatgccag

SEQ ID NO: 1165698 - DNA, 22 bp, Artificial Sequence
  chemically synthesized
ggactgtccactggcattatca

SEQ ID NO: 1165699 - DNA, 22 bp, Artificial Sequence
  chemically synthesized
ctgttcctgtgtttgataatgc

SEQ ID NO: 1165700 - DNA, 22 bp, Artificial Sequence
  chemically synthesized
tccactggcattatcaaacaca

SEQ ID NO: 1165701 - DNA, 22 bp, Artificial Sequence
  chemically synthesized
tatctgctgttcctgtgtttga

SEQ ID NO: 1165702 - DNA, 22 bp, Artificial Sequence
  chemically synthesized
tctgtatctgctgttcctgtgt

SEQ ID NO: 1165703 - DNA, 22 bp, Artificial Sequence
  chemically synthesized
gcattatcaaacacaggaacag

SEQ ID NO: 1165704 - DNA, 22 bp, Artificial Sequence
  chemically synthesized
ttgtctgtatctgctgttcctg

SEQ ID NO: 1165705 - DNA, 22 bp, Artificial Sequence
  chemically synthesized
cctattgtctgtatctgctgtt

SEQ ID NO: 1165706 - DNA, 22 bp, Artificial Sequence
  chemically synthesized
tcaaacacaggaacagcagata

SEQ ID NO: 1165707 - DNA, 22 bp, Artificial Sequence
  chemically synthesized
aaatgaaaactccctattgtct

SEQ ID NO: 1165708 - DNA, 22 bp, Artificial Sequence
  chemically synthesized
atgtatgcatgaggaagttaaa

SEQ ID NO: 1165709 - DNA, 22 bp, Artificial Sequence
  chemically synthesized
aaaattgatgtatgcatgagga

SEQ ID NO: 1165710 - DNA, 22 bp, Artificial Sequence
  chemically synthesized
tcattttaacttcctcatgcat

SEQ ID NO: 1165711 - DNA, 22 bp, Artificial Sequence
  chemically synthesized
gaaaattgatgtatgcatgagg

SEQ ID NO: 1165712 - DNA, 22 bp, Artificial Sequence
  chemically synthesized
cattttaacttcctcatgcata

SEQ ID NO: 1165713 - DNA, 22 bp, Artificial Sequence
  chemically synthesized
attttaacttcctcatgcatac

SEQ ID NO: 1165714 - DNA, 22 bp, Artificial Sequence
  chemically synthesized
tttgaaaattgatgtatgcatg

SEQ ID NO: 1165715 - DNA, 22 bp, Artificial Sequence
  chemically synthesized
taacttcctcatgcatacatca

SEQ ID NO: 1165716 - DNA, 22 bp, Artificial Sequence
  chemically synthesized
aacttcctcatgcatacatcaa

SEQ ID NO: 1165717 - DNA, 22 bp, Artificial Sequence
  chemically synthesized
acttcctcatgcatacatcaat

SEQ ID NO: 1165718 - DNA, 22 bp, Artificial Sequence
  chemically synthesized
accgctatttgaaaattgatgt

SEQ ID NO: 1165719 - DNA, 22 bp, Artificial Sequence
  chemically synthesized
gaccgctatttgaaaattgatg

SEQ ID NO: 1165720 - DNA, 22 bp, Artificial Sequence
  chemically synthesized
cctcatgcatacatcaattttc

SEQ ID NO: 1165721 - DNA, 22 bp, Artificial Sequence
  chemically synthesized
tgaccgctatttgaaaattgat

SEQ ID NO: 1165722 - DNA, 22 bp, Artificial Sequence
  chemically synthesized
ctcatgcatacatcaattttca

SEQ ID NO: 1165723 - DNA, 22 bp, Artificial Sequence
  chemically synthesized
atgcatacatcaattttcaaat

SEQ ID NO: 1165724 - DNA, 22 bp, Artificial Sequence
  chemically synthesized
gtgtggattttgaccgctattt

SEQ ID NO: 1165725 - DNA, 22 bp, Artificial Sequence
  chemically synthesized
ggtgtggattttgaccgctatt

SEQ ID NO: 1165726 - DNA, 22 bp, Artificial Sequence
  chemically synthesized
atttggtgtggattttgaccgc

SEQ ID NO: 1165727 - DNA, 22 bp, Artificial Sequence
  chemically synthesized
tcaaatagcggtcaaaatccac

SEQ ID NO: 1165728 - DNA, 22 bp, Artificial Sequence
  chemically synthesized
caaatagcggtcaaaatccaca

SEQ ID NO: 1165729 - DNA, 22 bp, Artificial Sequence
  chemically synthesized
aaatagcggtcaaaatccacac

SEQ ID NO: 1165730 - DNA, 22 bp, Artificial Sequence
  chemically synthesized
atacaatattaatttggtgtgg

SEQ ID NO: 1165731 - DNA, 22 bp, Artificial Sequence
  chemically synthesized
aatacaatattaatttggtgtg

SEQ ID NO: 1165732 - DNA, 22 bp, Artificial Sequence
  chemically synthesized
taatacaatattaatttggtgt

SEQ ID NO: 1165733 - DNA, 22 bp, Artificial Sequence
  chemically synthesized
gaagagctttaatacaatatta

SEQ ID NO: 1165734 - DNA, 22 bp, Artificial Sequence
  chemically synthesized
cagtaatctagaagagctttaa

SEQ ID NO: 1165735 - DNA, 22 bp, Artificial Sequence
  chemically synthesized
ccagtaatctagaagagcttta

SEQ ID NO: 1165736 - DNA, 22 bp, Artificial Sequence
  chemically synthesized
atattgtattaaagctcttcta

SEQ ID NO: 1165737 - DNA, 22 bp, Artificial Sequence
  chemically synthesized
cttccagtaatctagaagagct

SEQ ID NO: 1165738 - DNA, 22 bp, Artificial Sequence
  chemically synthesized
ctccttccagtaatctagaaga

SEQ ID NO: 1165739 - DNA, 22 bp, Artificial Sequence
  chemically synthesized
actccttccagtaatctagaag

SEQ ID NO: 1165740 - DNA, 22 bp, Artificial Sequence
  chemically synthesized
tattaaagctcttctagattac

SEQ ID NO: 1165741 - DNA, 22 bp, Artificial Sequence
  chemically synthesized
atttactccttccagtaatcta

SEQ ID NO: 1165742 - DNA, 22 bp, Artificial Sequence
  chemically synthesized
aagctcttctagattactggaa

SEQ ID NO: 1165743 - DNA, 22 bp, Artificial Sequence
  chemically synthesized
ttctagattactggaaggagta

SEQ ID NO: 1165744 - DNA, 22 bp, Artificial Sequence
  chemically synthesized
ctagattactggaaggagtaaa

SEQ ID NO: 1165745 - DNA, 22 bp, Artificial Sequence
  chemically synthesized
tagattactggaaggagtaaat

SEQ ID NO: 1165746 - DNA, 22 bp, Artificial Sequence
  chemically synthesized
gattactggaaggagtaaatta

SEQ ID NO: 1165747 - DNA, 22 bp, Artificial Sequence
  chemically synthesized
ctggaaggagtaaattagtata

SEQ ID NO: 1165748 - DNA, 22 bp, Artificial Sequence
  chemically synthesized
gaaggagtaaattagtatatca

SEQ ID NO: 1165749 - DNA, 22 bp, Artificial Sequence
  chemically synthesized
aaaagcaacatgaggtgatata

SEQ ID NO: 1165750 - DNA, 22 bp, Artificial Sequence
  chemically synthesized
aaaaagcaacatgaggtgatat

SEQ ID NO: 1165751 - DNA, 22 bp, Artificial Sequence
  chemically synthesized
tagcatttaaaaagcaacatga

SEQ ID NO: 1165752 - DNA, 22 bp, Artificial Sequence
  chemically synthesized
atagcatttaaaaagcaacatg

SEQ ID NO: 1165753 - DNA, 22 bp, Artificial Sequence
  chemically synthesized
gtatatcacctcatgttgcttt

SEQ ID NO: 1165754 - DNA, 22 bp, Artificial Sequence
  chemically synthesized
atgttgctttttaaatgctata

SEQ ID NO: 1165755 - DNA, 22 bp, Artificial Sequence
  chemically synthesized
cagatcaatatttatagcattt

SEQ ID NO: 1165756 - DNA, 22 bp, Artificial Sequence
  chemically synthesized
ctacagatcaatatttatagca

SEQ ID NO: 1165757 - DNA, 22 bp, Artificial Sequence
  chemically synthesized
ctttttaaatgctataaatatt

SEQ ID NO: 1165758 - DNA, 22 bp, Artificial Sequence
  chemically synthesized
tttaaatgctataaatattgat

SEQ ID NO: 1165759 - DNA, 22 bp, Artificial Sequence
  chemically synthesized
ttaaatgctataaatattgatc

SEQ ID NO: 1165760 - DNA, 22 bp, Artificial Sequence
  chemically synthesized
taaatgctataaatattgatct

SEQ ID NO: 1165761 - DNA, 22 bp, Artificial Sequence
  chemically synthesized
aaatgctataaatattgatctg

SEQ ID NO: 1165762 - DNA, 22 bp, Artificial Sequence
  chemically synthesized
aatgctataaatattgatctgt

SEQ ID NO: 1165763 - DNA, 22 bp, Artificial Sequence
  chemically synthesized
taaatattgatctgtaggaact

SEQ ID NO: 1165764 - DNA, 22 bp, Artificial Sequence
  chemically synthesized
taaataagaaatgaggaaagtt

SEQ ID NO: 1165765 - DNA, 22 bp, Artificial Sequence
  chemically synthesized
atctgtaggaactttcctcatt

SEQ ID NO: 1165766 - DNA, 22 bp, Artificial Sequence
  chemically synthesized
ttataaataagaaatgaggaaa

SEQ ID NO: 1165767 - DNA, 22 bp, Artificial Sequence
  chemically synthesized
taggaactttcctcatttctta

SEQ ID NO: 1165768 - DNA, 22 bp, Artificial Sequence
  chemically synthesized
tcctcatttcttatttataata

SEQ ID NO: 1165769 - DNA, 22 bp, Artificial Sequence
  chemically synthesized
cctcatttcttatttataataa

SEQ ID NO: 1165770 - DNA, 22 bp, Artificial Sequence
  chemically synthesized
ctcatttcttatttataataac

SEQ ID NO: 1165771 - DNA, 22 bp, Artificial Sequence
  chemically synthesized
atttcttatttataataactta

SEQ ID NO: 1165772 - DNA, 22 bp, Artificial Sequence
  chemically synthesized
ataatgtatatgtaagttatta

SEQ ID NO: 1165773 - DNA, 22 bp, Artificial Sequence
  chemically synthesized
tgataatgtatatgtaagttat

SEQ ID NO: 1165774 - DNA, 22 bp, Artificial Sequence
  chemically synthesized
cttatttataataacttacata

SEQ ID NO: 1165775 - DNA, 22 bp, Artificial Sequence
  chemically synthesized
ttatttataataacttacatat

SEQ ID NO: 1165776 - DNA, 22 bp, Artificial Sequence
  chemically synthesized
atttataataacttacatatac

SEQ ID NO: 1165777 - DNA, 22 bp, Artificial Sequence
  chemically synthesized
tttataataacttacatataca

SEQ ID NO: 1165778 - DNA, 22 bp, Artificial Sequence
  chemically synthesized
ataataacttacatatacatta

SEQ ID NO: 1165779 - DNA, 22 bp, Artificial Sequence
  chemically synthesized
taataacttacatatacattat

SEQ ID NO: 1165780 - DNA, 22 bp, Artificial Sequence
  chemically synthesized
acatatacattatcagaattat

SEQ ID NO: 1165781 - DNA, 22 bp, Artificial Sequence
  chemically synthesized
catatacattatcagaattata

SEQ ID NO: 1165782 - DNA, 22 bp, Artificial Sequence
  chemically synthesized
cagaggtatgtaaatataattc

SEQ ID NO: 1165783 - DNA, 22 bp, Artificial Sequence
  chemically synthesized
tcagaattatatttacatacct

SEQ ID NO: 1165784 - DNA, 22 bp, Artificial Sequence
  chemically synthesized
atgccattgcagaggtatgtaa

SEQ ID NO: 1165785 - DNA, 22 bp, Artificial Sequence
  chemically synthesized
aatgccattgcagaggtatgta

SEQ ID NO: 1165786 - DNA, 22 bp, Artificial Sequence
  chemically synthesized
taatgccattgcagaggtatgt

SEQ ID NO: 1165787 - DNA, 22 bp, Artificial Sequence
  chemically synthesized
ctttaatgccattgcagaggta

SEQ ID NO: 1165788 - DNA, 22 bp, Artificial Sequence
  chemically synthesized
cctttaatgccattgcagaggt

SEQ ID NO: 1165789 - DNA, 22 bp, Artificial Sequence
  chemically synthesized
tatttacatacctctgcaatgg

SEQ ID NO: 1165790 - DNA, 22 bp, Artificial Sequence
  chemically synthesized
acatacctctgcaatggcatta

SEQ ID NO: 1165791 - DNA, 22 bp, Artificial Sequence
  chemically synthesized
catacctctgcaatggcattaa

SEQ ID NO: 1165792 - DNA, 22 bp, Artificial Sequence
  chemically synthesized
aggaagagatatttcctttaat

SEQ ID NO: 1165793 - DNA, 22 bp, Artificial Sequence
  chemically synthesized
tcaggaagagatatttccttta

SEQ ID NO: 1165794 - DNA, 22 bp, Artificial Sequence
  chemically synthesized
tgcaatggcattaaaggaaata

SEQ ID NO: 1165795 - DNA, 22 bp, Artificial Sequence
  chemically synthesized
caatggcattaaaggaaatatc

SEQ ID NO: 1165796 - DNA, 22 bp, Artificial Sequence
  chemically synthesized
gggcctctcaggaagagatatt

SEQ ID NO: 1165797 - DNA, 22 bp, Artificial Sequence
  chemically synthesized
cctagggcctctcaggaagaga

SEQ ID NO: 1165798 - DNA, 22 bp, Artificial Sequence
  chemically synthesized
aaggaaatatctcttcctgaga

SEQ ID NO: 1165799 - DNA, 22 bp, Artificial Sequence
  chemically synthesized
attacctagggcctctcaggaa

SEQ ID NO: 1165800 - DNA, 22 bp, Artificial Sequence
  chemically synthesized
cattacctagggcctctcagga

SEQ ID NO: 1165801 - DNA, 22 bp, Artificial Sequence
  chemically synthesized
gaaatatttcattacctagggc

SEQ ID NO: 1165802 - DNA, 22 bp, Artificial Sequence
  chemically synthesized
ggaaatatttcattacctaggg

SEQ ID NO: 1165803 - DNA, 22 bp, Artificial Sequence
  chemically synthesized
ttcctgagaggccctaggtaat

SEQ ID NO: 1165804 - DNA, 22 bp, Artificial Sequence
  chemically synthesized
cctgagaggccctaggtaatga

SEQ ID NO: 1165805 - DNA, 22 bp, Artificial Sequence
  chemically synthesized
ctgagaggccctaggtaatgaa

SEQ ID NO: 1165806 - DNA, 22 bp, Artificial Sequence
  chemically synthesized
agaggccctaggtaatgaaata

SEQ ID NO: 1165807 - DNA, 22 bp, Artificial Sequence
  chemically synthesized
taaatatttggaaatatttcat

SEQ ID NO: 1165808 - DNA, 22 bp, Artificial Sequence
  chemically synthesized
gtctgtaaatatttggaaatat

SEQ ID NO: 1165809 - DNA, 22 bp, Artificial Sequence
  chemically synthesized
ggtaatgaaatatttccaaata

SEQ ID NO: 1165810 - DNA, 22 bp, Artificial Sequence
  chemically synthesized
ctggtctgtaaatatttggaaa

SEQ ID NO: 1165811 - DNA, 22 bp, Artificial Sequence
  chemically synthesized
actggtctgtaaatatttggaa

SEQ ID NO: 1165812 - DNA, 22 bp, Artificial Sequence
  chemically synthesized
tactggtctgtaaatatttgga

SEQ ID NO: 1165813 - DNA, 22 bp, Artificial Sequence
  chemically synthesized
atgcctttactggtctgtaaat

SEQ ID NO: 1165814 - DNA, 22 bp, Artificial Sequence
  chemically synthesized
ctgatgcctttactggtctgta

SEQ ID NO: 1165815 - DNA, 22 bp, Artificial Sequence
  chemically synthesized
actgatgcctttactggtctgt

SEQ ID NO: 1165816 - DNA, 22 bp, Artificial Sequence
  chemically synthesized
ccaaatatttacagaccagtaa

SEQ ID NO: 1165817 - DNA, 22 bp, Artificial Sequence
  chemically synthesized
ttactgatgcctttactggtct

SEQ ID NO: 1165818 - DNA, 22 bp, Artificial Sequence
  chemically synthesized
caaatatttacagaccagtaaa

SEQ ID NO: 1165819 - DNA, 22 bp, Artificial Sequence
  chemically synthesized
cttactgatgcctttactggtc

SEQ ID NO: 1165820 - DNA, 22 bp, Artificial Sequence
  chemically synthesized
tcttactgatgcctttactggt

SEQ ID NO: 1165821 - DNA, 22 bp, Artificial Sequence
  chemically synthesized
ttttcttactgatgcctttact

SEQ ID NO: 1165822 - DNA, 22 bp, Artificial Sequence
  chemically synthesized
gttttcttactgatgcctttac

SEQ ID NO: 1165823 - DNA, 22 bp, Artificial Sequence
  chemically synthesized
cttgttttcttactgatgcctt

SEQ ID NO: 1165824 - DNA, 22 bp, Artificial Sequence
  chemically synthesized
acagaccagtaaaggcatcagt

SEQ ID NO: 1165825 - DNA, 22 bp, Artificial Sequence
  chemically synthesized
cagaccagtaaaggcatcagta

SEQ ID NO: 1165826 - DNA, 22 bp, Artificial Sequence
  chemically synthesized
cctccttgttttcttactgatg

SEQ ID NO: 1165827 - DNA, 22 bp, Artificial Sequence
  chemically synthesized
ccctacctccttgttttcttac

SEQ ID NO: 1165828 - DNA, 22 bp, Artificial Sequence
  chemically synthesized
cccctacctccttgttttctta

SEQ ID NO: 1165829 - DNA, 22 bp, Artificial Sequence
  chemically synthesized
tcccctacctccttgttttctt

SEQ ID NO: 1165830 - DNA, 22 bp, Artificial Sequence
  chemically synthesized
ctttcccctacctccttgtttt

SEQ ID NO: 1165831 - DNA, 22 bp, Artificial Sequence
  chemically synthesized
cctttcccctacctccttgttt

SEQ ID NO: 1165832 - DNA, 22 bp, Artificial Sequence
  chemically synthesized
ccttcctttcccctacctcctt

SEQ ID NO: 1165833 - DNA, 22 bp, Artificial Sequence
  chemically synthesized
gccttcctttcccctacctcct

SEQ ID NO: 1165834 - DNA, 22 bp, Artificial Sequence
  chemically synthesized
tgccttcctttcccctacctcc

SEQ ID NO: 1165835 - DNA, 22 bp, Artificial Sequence
  chemically synthesized
aattttgccttcctttccccta

SEQ ID NO: 1165836 - DNA, 22 bp, Artificial Sequence
  chemically synthesized
taaattttgccttcctttcccc

SEQ ID NO: 1165837 - DNA, 22 bp, Artificial Sequence
  chemically synthesized
ctaaattttgccttcctttccc

SEQ ID NO: 1165838 - DNA, 22 bp, Artificial Sequence
  chemically synthesized
tctaaattttgccttcctttcc

SEQ ID NO: 1165839 - DNA, 22 bp, Artificial Sequence
  chemically synthesized
tttctaaattttgccttccttt

SEQ ID NO: 1165840 - DNA, 22 bp, Artificial Sequence
  chemically synthesized
ctttctaaattttgccttcctt

SEQ ID NO: 1165841 - DNA, 22 bp, Artificial Sequence
  chemically synthesized
tctttctaaattttgccttcct

SEQ ID NO: 1165842 - DNA, 22 bp, Artificial Sequence
  chemically synthesized
ttctttctaaattttgccttcc

SEQ ID NO: 1165843 - DNA, 22 bp, Artificial Sequence
  chemically synthesized
tttctttctaaattttgccttc

SEQ ID NO: 1165844 - DNA, 22 bp, Artificial Sequence
  chemically synthesized
ttttctttctaaattttgcctt

SEQ ID NO: 1165845 - DNA, 22 bp, Artificial Sequence
  chemically synthesized
tttttctttctaaattttgcct

SEQ ID NO: 1165846 - DNA, 22 bp, Artificial Sequence
  chemically synthesized
gatgggtgggtgaggtattttt

SEQ ID NO: 1165847 - DNA, 22 bp, Artificial Sequence
  chemically synthesized
agatgggtgggtgaggtatttt

SEQ ID NO: 1165848 - DNA, 22 bp, Artificial Sequence
  chemically synthesized
tagatgggtgggtgaggtattt

SEQ ID NO: 1165849 - DNA, 22 bp, Artificial Sequence
  chemically synthesized
agaaagaaaaaaaatacctcac

SEQ ID NO: 1165850 - DNA, 22 bp, Artificial Sequence
  chemically synthesized
gaaagaaaaaaaatacctcacc

SEQ ID NO: 1165851 - DNA, 22 bp, Artificial Sequence
  chemically synthesized
gaaattttagatgggtgggtga

SEQ ID NO: 1165852 - DNA, 22 bp, Artificial Sequence
  chemically synthesized
ttagaaattttagatgggtggg

SEQ ID NO: 1165853 - DNA, 22 bp, Artificial Sequence
  chemically synthesized
tgctgttagaaattttagatgg

SEQ ID NO: 1165854 - DNA, 22 bp, Artificial Sequence
  chemically synthesized
acccacccatctaaaatttcta

SEQ ID NO: 1165855 - DNA, 22 bp, Artificial Sequence
  chemically synthesized
aatcacagaagtcattatgctg

SEQ ID NO: 1165856 - DNA, 22 bp, Artificial Sequence
  chemically synthesized
aaatttctaacagcataatgac

SEQ ID NO: 1165857 - DNA, 22 bp, Artificial Sequence
  chemically synthesized
ctaacagcataatgacttctgt

SEQ ID NO: 1165858 - DNA, 22 bp, Artificial Sequence
  chemically synthesized
taacagcataatgacttctgtg

SEQ ID NO: 1165859 - DNA, 22 bp, Artificial Sequence
  chemically synthesized
acagcataatgacttctgtgat

SEQ ID NO: 1165860 - DNA, 22 bp, Artificial Sequence
  chemically synthesized
gaaataaaggctaaatcacaga

SEQ ID NO: 1165861 - DNA, 22 bp, Artificial Sequence
  chemically synthesized
tggaaataaaggctaaatcaca

SEQ ID NO: 1165862 - DNA, 22 bp, Artificial Sequence
  chemically synthesized
ctggaaataaaggctaaatcac

SEQ ID NO: 1165863 - DNA, 22 bp, Artificial Sequence
  chemically synthesized
ctgtgatttagcctttatttcc

SEQ ID NO: 1165864 - DNA, 22 bp, Artificial Sequence
  chemically synthesized
tgtgatttagcctttatttcca

SEQ ID NO: 1165865 - DNA, 22 bp, Artificial Sequence
  chemically synthesized
aatcgtggccttctggaaataa

SEQ ID NO: 1165866 - DNA, 22 bp, Artificial Sequence
  chemically synthesized
tgatttagcctttatttccaga

SEQ ID NO: 1165867 - DNA, 22 bp, Artificial Sequence
  chemically synthesized
aaatcgtggccttctggaaata

SEQ ID NO: 1165868 - DNA, 22 bp, Artificial Sequence
  chemically synthesized
tttaaatcgtggccttctggaa

SEQ ID NO: 1165869 - DNA, 22 bp, Artificial Sequence
  chemically synthesized
agcctttatttccagaaggcca

SEQ ID NO: 1165870 - DNA, 22 bp, Artificial Sequence
  chemically synthesized
ctatttaaatcgtggccttctg

SEQ ID NO: 1165871 - DNA, 22 bp, Artificial Sequence
  chemically synthesized
gcctttatttccagaaggccac

SEQ ID NO: 1165872 - DNA, 22 bp, Artificial Sequence
  chemically synthesized
actatttaaatcgtggccttct

SEQ ID NO: 1165873 - DNA, 22 bp, Artificial Sequence
  chemically synthesized
tatttccagaaggccacgattt

SEQ ID NO: 1165874 - DNA, 22 bp, Artificial Sequence
  chemically synthesized
atttccagaaggccacgattta

SEQ ID NO: 1165875 - DNA, 22 bp, Artificial Sequence
  chemically synthesized
tttccagaaggccacgatttaa

SEQ ID NO: 1165876 - DNA, 22 bp, Artificial Sequence
  chemically synthesized
ccagaaggccacgatttaaata

SEQ ID NO: 1165877 - DNA, 22 bp, Artificial Sequence
  chemically synthesized
cagaaggccacgatttaaatag

SEQ ID NO: 1165878 - DNA, 22 bp, Artificial Sequence
  chemically synthesized
agataatgtcttactatttaaa

SEQ ID NO: 1165879 - DNA, 22 bp, Artificial Sequence
  chemically synthesized
taagataatgtcttactattta

SEQ ID NO: 1165880 - DNA, 22 bp, Artificial Sequence
  chemically synthesized
ctaagataatgtcttactattt

SEQ ID NO: 1165881 - DNA, 22 bp, Artificial Sequence
  chemically synthesized
ttctaagataatgtcttactat

SEQ ID NO: 1165882 - DNA, 22 bp, Artificial Sequence
  chemically synthesized
gttcttctaagataatgtctta

SEQ ID NO: 1165883 - DNA, 22 bp, Artificial Sequence
  chemically synthesized
agttcttctaagataatgtctt

SEQ ID NO: 1165884 - DNA, 22 bp, Artificial Sequence
  chemically synthesized
tagttcttctaagataatgtct

SEQ ID NO: 1165885 - DNA, 22 bp, Artificial Sequence
  chemically synthesized
aaatagtaagacattatcttag

SEQ ID NO: 1165886 - DNA, 22 bp, Artificial Sequence
  chemically synthesized
aatagtaagacattatcttaga

SEQ ID NO: 1165887 - DNA, 22 bp, Artificial Sequence
  chemically synthesized
atattttagttcttctaagata

SEQ ID NO: 1165888 - DNA, 22 bp, Artificial Sequence
  chemically synthesized
catattttagttcttctaagat

SEQ ID NO: 1165889 - DNA, 22 bp, Artificial Sequence
  chemically synthesized
tcttagaagaactaaaatatga

SEQ ID NO: 1165890 - DNA, 22 bp, Artificial Sequence
  chemically synthesized
ggtaaagcatacttcatatttt

SEQ ID NO: 1165891 - DNA, 22 bp, Artificial Sequence
  chemically synthesized
agaagaactaaaatatgaagta

SEQ ID NO: 1165892 - DNA, 22 bp, Artificial Sequence
  chemically synthesized
gaagaactaaaatatgaagtat

SEQ ID NO: 1165893 - DNA, 22 bp, Artificial Sequence
  chemically synthesized
aattgggtaaagcatacttcat

SEQ ID NO: 1165894 - DNA, 22 bp, Artificial Sequence
  chemically synthesized
attaaattgggtaaagcatact

SEQ ID NO: 1165895 - DNA, 22 bp, Artificial Sequence
  chemically synthesized
ctaattaaattgggtaaagcat

SEQ ID NO: 1165896 - DNA, 22 bp, Artificial Sequence
  chemically synthesized
aaatatgaagtatgctttaccc

SEQ ID NO: 1165897 - DNA, 22 bp, Artificial Sequence
  chemically synthesized
atatcctgctaattaaattggg

SEQ ID NO: 1165898 - DNA, 22 bp, Artificial Sequence
  chemically synthesized
aatatcctgctaattaaattgg

SEQ ID NO: 1165899 - DNA, 22 bp, Artificial Sequence
  chemically synthesized
acttaatatcctgctaattaaa

SEQ ID NO: 1165900 - DNA, 22 bp, Artificial Sequence
  chemically synthesized
tcacttaatatcctgctaatta

SEQ ID NO: 1165901 - DNA, 22 bp, Artificial Sequence
  chemically synthesized
tacccaatttaattagcaggat

SEQ ID NO: 1165902 - DNA, 22 bp, Artificial Sequence
  chemically synthesized
acccaatttaattagcaggata

SEQ ID NO: 1165903 - DNA, 22 bp, Artificial Sequence
  chemically synthesized
cccaatttaattagcaggatat

SEQ ID NO: 1165904 - DNA, 22 bp, Artificial Sequence
  chemically synthesized
cattctcacttaatatcctgct

SEQ ID NO: 1165905 - DNA, 22 bp, Artificial Sequence
  chemically synthesized
gcattctcacttaatatcctgc

SEQ ID NO: 1165906 - DNA, 22 bp, Artificial Sequence
  chemically synthesized
aattagcaggatattaagtgag

SEQ ID NO: 1165907 - DNA, 22 bp, Artificial Sequence
  chemically synthesized
attagcaggatattaagtgaga

SEQ ID NO: 1165908 - DNA, 22 bp, Artificial Sequence
  chemically synthesized
gcaggatattaagtgagaatgc

SEQ ID NO: 1165909 - DNA, 22 bp, Artificial Sequence
  chemically synthesized
caagacaaccatttgcattctc

SEQ ID NO: 1165910 - DNA, 22 bp, Artificial Sequence
  chemically synthesized
agtgagaatgcaaatggttgtc

SEQ ID NO: 1165911 - DNA, 22 bp, Artificial Sequence
  chemically synthesized
gggtccagacggaaattccaag

SEQ ID NO: 1165912 - DNA, 22 bp, Artificial Sequence
  chemically synthesized
agggtccagacggaaattccaa

SEQ ID NO: 1165913 - DNA, 22 bp, Artificial Sequence
  chemically synthesized
tagggtccagacggaaattcca

SEQ ID NO: 1165914 - DNA, 22 bp, Artificial Sequence
  chemically synthesized
gctttagggtccagacggaaat

SEQ ID NO: 1165915 - DNA, 22 bp, Artificial Sequence
  chemically synthesized
ggctttagggtccagacggaaa

SEQ ID NO: 1165916 - DNA, 22 bp, Artificial Sequence
  chemically synthesized
ttggctttagggtccagacgga

SEQ ID NO: 1165917 - DNA, 22 bp, Artificial Sequence
  chemically synthesized
tcttggaatttccgtctggacc

SEQ ID NO: 1165918 - DNA, 22 bp, Artificial Sequence
  chemically synthesized
ctcttggctttagggtccagac

SEQ ID NO: 1165919 - DNA, 22 bp, Artificial Sequence
  chemically synthesized
gctcttggctttagggtccaga

SEQ ID NO: 1165920 - DNA, 22 bp, Artificial Sequence
  chemically synthesized
tgctcttggctttagggtccag

SEQ ID NO: 1165921 - DNA, 22 bp, Artificial Sequence
  chemically synthesized
ggaatttccgtctggaccctaa

SEQ ID NO: 1165922 - DNA, 22 bp, Artificial Sequence
  chemically synthesized
gaatttccgtctggaccctaaa

SEQ ID NO: 1165923 - DNA, 22 bp, Artificial Sequence
  chemically synthesized
ccgtctggaccctaaagccaag

SEQ ID NO: 1165924 - DNA, 22 bp, Artificial Sequence
  chemically synthesized
gtacactttgctcttggcttta

SEQ ID NO: 1165925 - DNA, 22 bp, Artificial Sequence
  chemically synthesized
cgtctggaccctaaagccaaga

SEQ ID NO: 1165926 - DNA, 22 bp, Artificial Sequence
  chemically synthesized
cgtacactttgctcttggcttt

SEQ ID NO: 1165927 - DNA, 22 bp, Artificial Sequence
  chemically synthesized
gaccctaaagccaagagcaaag

SEQ ID NO: 1165928 - DNA, 22 bp, Artificial Sequence
  chemically synthesized
tggatgcttcgtacactttgct

SEQ ID NO: 1165929 - DNA, 22 bp, Artificial Sequence
  chemically synthesized
aagccaagagcaaagtgtacga

SEQ ID NO: 1165930 - DNA, 22 bp, Artificial Sequence
  chemically synthesized
gaattatggatgcttcgtacac

SEQ ID NO: 1165931 - DNA, 22 bp, Artificial Sequence
  chemically synthesized
agaattatggatgcttcgtaca

SEQ ID NO: 1165932 - DNA, 22 bp, Artificial Sequence
  chemically synthesized
tagaattatggatgcttcgtac

SEQ ID NO: 1165933 - DNA, 22 bp, Artificial Sequence
  chemically synthesized
tttagaattatggatgcttcgt

SEQ ID NO: 1165934 - DNA, 22 bp, Artificial Sequence
  chemically synthesized
tctttagaattatggatgcttc

SEQ ID NO: 1165935 - DNA, 22 bp, Artificial Sequence
  chemically synthesized
ctctttagaattatggatgctt

SEQ ID NO: 1165936 - DNA, 22 bp, Artificial Sequence
  chemically synthesized
gatcttctctttagaattatgg

SEQ ID NO: 1165937 - DNA, 22 bp, Artificial Sequence
  chemically synthesized
acaggtaccctggatcttctct

SEQ ID NO: 1165938 - DNA, 22 bp, Artificial Sequence
  chemically synthesized
aacaggtaccctggatcttctc

SEQ ID NO: 1165939 - DNA, 22 bp, Artificial Sequence
  chemically synthesized
taacaggtaccctggatcttct

SEQ ID NO: 1165940 - DNA, 22 bp, Artificial Sequence
  chemically synthesized
ttaacaggtaccctggatcttc

SEQ ID NO: 1165941 - DNA, 22 bp, Artificial Sequence
  chemically synthesized
tttaacaggtaccctggatctt

SEQ ID NO: 1165942 - DNA, 22 bp, Artificial Sequence
  chemically synthesized
taaagagaagatccagggtacc

SEQ ID NO: 1165943 - DNA, 22 bp, Artificial Sequence
  chemically synthesized
aagagaagatccagggtacctg

SEQ ID NO: 1165944 - DNA, 22 bp, Artificial Sequence
  chemically synthesized
gcaattttttaacaggtaccct

SEQ ID NO: 1165945 - DNA, 22 bp, Artificial Sequence
  chemically synthesized
agcaattttttaacaggtaccc

SEQ ID NO: 1165946 - DNA, 22 bp, Artificial Sequence
  chemically synthesized
ttagcaattttttaacaggtac

SEQ ID NO: 1165947 - DNA, 22 bp, Artificial Sequence
  chemically synthesized
cttagcaattttttaacaggta

SEQ ID NO: 1165948 - DNA, 22 bp, Artificial Sequence
  chemically synthesized
tgatcacttcttagcaattttt

SEQ ID NO: 1165949 - DNA, 22 bp, Artificial Sequence
  chemically synthesized
gtgatcacttcttagcaatttt

SEQ ID NO: 1165950 - DNA, 22 bp, Artificial Sequence
  chemically synthesized
tgtgatcacttcttagcaattt

SEQ ID NO: 1165951 - DNA, 22 bp, Artificial Sequence
  chemically synthesized
ttaaaaaattgctaagaagtga

SEQ ID NO: 1165952 - DNA, 22 bp, Artificial Sequence
  chemically synthesized
aaaaattgctaagaagtgatca

SEQ ID NO: 1165953 - DNA, 22 bp, Artificial Sequence
  chemically synthesized
tgagaccaattttgtgatcact

SEQ ID NO: 1165954 - DNA, 22 bp, Artificial Sequence
  chemically synthesized
ctaagaagtgatcacaaaattg

SEQ ID NO: 1165955 - DNA, 22 bp, Artificial Sequence
  chemically synthesized
agggttgtgagaccaattttgt

SEQ ID NO: 1165956 - DNA, 22 bp, Artificial Sequence
  chemically synthesized
agaagtgatcacaaaattggtc

SEQ ID NO: 1165957 - DNA, 22 bp, Artificial Sequence
  chemically synthesized
gattaagggttgtgagaccaat

SEQ ID NO: 1165958 - DNA, 22 bp, Artificial Sequence
  chemically synthesized
gatattggattaagggttgtga

SEQ ID NO: 1165959 - DNA, 22 bp, Artificial Sequence
  chemically synthesized
agctagatattggattaagggt

SEQ ID NO: 1165960 - DNA, 22 bp, Artificial Sequence
  chemically synthesized
aagctagatattggattaaggg

SEQ ID NO: 1165961 - DNA, 22 bp, Artificial Sequence
  chemically synthesized
taagctagatattggattaagg

SEQ ID NO: 1165962 - DNA, 22 bp, Artificial Sequence
  chemically synthesized
gtctcacaacccttaatccaat

SEQ ID NO: 1165963 - DNA, 22 bp, Artificial Sequence
  chemically synthesized
acaacccttaatccaatatcta

SEQ ID NO: 1165964 - DNA, 22 bp, Artificial Sequence
  chemically synthesized
cacacctttaagctagatattg

SEQ ID NO: 1165965 - DNA, 22 bp, Artificial Sequence
  chemically synthesized
acacacctttaagctagatatt

SEQ ID NO: 1165966 - DNA, 22 bp, Artificial Sequence
  chemically synthesized
ttacacacctttaagctagata

SEQ ID NO: 1165967 - DNA, 22 bp, Artificial Sequence
  chemically synthesized
ctcttacacacctttaagctag

SEQ ID NO: 1165968 - DNA, 22 bp, Artificial Sequence
  chemically synthesized
gctcttacacacctttaagcta

SEQ ID NO: 1165969 - DNA, 22 bp, Artificial Sequence
  chemically synthesized
aatccaatatctagcttaaagg

SEQ ID NO: 1165970 - DNA, 22 bp, Artificial Sequence
  chemically synthesized
atccaatatctagcttaaaggt

SEQ ID NO: 1165971 - DNA, 22 bp, Artificial Sequence
  chemically synthesized
cttgctcttacacacctttaag

SEQ ID NO: 1165972 - DNA, 22 bp, Artificial Sequence
  chemically synthesized
gcttgctcttacacacctttaa

SEQ ID NO: 1165973 - DNA, 22 bp, Artificial Sequence
  chemically synthesized
cttgcttgctcttacacacctt

SEQ ID NO: 1165974 - DNA, 22 bp, Artificial Sequence
  chemically synthesized
gcttaaaggtgtgtaagagcaa

SEQ ID NO: 1165975 - DNA, 22 bp, Artificial Sequence
  chemically synthesized
atcgacctccttgcttgctctt

SEQ ID NO: 1165976 - DNA, 22 bp, Artificial Sequence
  chemically synthesized
aaaggtgtgtaagagcaagcaa

SEQ ID NO: 1165977 - DNA, 22 bp, Artificial Sequence
  chemically synthesized
taatcgacctccttgcttgctc

SEQ ID NO: 1165978 - DNA, 22 bp, Artificial Sequence
  chemically synthesized
aaggtgtgtaagagcaagcaag

SEQ ID NO: 1165979 - DNA, 22 bp, Artificial Sequence
  chemically synthesized
ctaatcgacctccttgcttgct

SEQ ID NO: 1165980 - DNA, 22 bp, Artificial Sequence
  chemically synthesized
tctaatcgacctccttgcttgc

SEQ ID NO: 1165981 - DNA, 22 bp, Artificial Sequence
  chemically synthesized
ttctaatcgacctccttgcttg

SEQ ID NO: 1165982 - DNA, 22 bp, Artificial Sequence
  chemically synthesized
accagatttttctaatcgacct

SEQ ID NO: 1165983 - DNA, 22 bp, Artificial Sequence
  chemically synthesized
tcaccagatttttctaatcgac

SEQ ID NO: 1165984 - DNA, 22 bp, Artificial Sequence
  chemically synthesized
ctcaccagatttttctaatcga

SEQ ID NO: 1165985 - DNA, 22 bp, Artificial Sequence
  chemically synthesized
tctcaccagatttttctaatcg

SEQ ID NO: 1165986 - DNA, 22 bp, Artificial Sequence
  chemically synthesized
cagaggaagcctttctcaccag

SEQ ID NO: 1165987 - DNA, 22 bp, Artificial Sequence
  chemically synthesized
tccagaggaagcctttctcacc

SEQ ID NO: 1165988 - DNA, 22 bp, Artificial Sequence
  chemically synthesized
gaaaaatctggtgagaaaggct

SEQ ID NO: 1165989 - DNA, 22 bp, Artificial Sequence
  chemically synthesized
cagcctctccagaggaagcctt

SEQ ID NO: 1165990 - DNA, 22 bp, Artificial Sequence
  chemically synthesized
gtgagaaaggcttcctctggag

SEQ ID NO: 1165991 - DNA, 22 bp, Artificial Sequence
  chemically synthesized
gagccacgcagagcgctccagc

SEQ ID NO: 1165992 - DNA, 22 bp, Artificial Sequence
  chemically synthesized
cctctggagaggctggagcgct

SEQ ID NO: 1165993 - DNA, 22 bp, Artificial Sequence
  chemically synthesized
ctctggagaggctggagcgctc

SEQ ID NO: 1165994 - DNA, 22 bp, Artificial Sequence
  chemically synthesized
tggagaggctggagcgctctgc

SEQ ID NO: 1165995 - DNA, 22 bp, Artificial Sequence
  chemically synthesized
gagaggctggagcgctctgcgt

SEQ ID NO: 1165996 - DNA, 22 bp, Artificial Sequence
  chemically synthesized
gagcgctctgcgtggctctaac

SEQ ID NO: 1165997 - DNA, 22 bp, Artificial Sequence
  chemically synthesized
agatggggagaagttagagcca

SEQ ID NO: 1165998 - DNA, 22 bp, Artificial Sequence
  chemically synthesized
cagatggggagaagttagagcc

SEQ ID NO: 1165999 - DNA, 22 bp, Artificial Sequence
  chemically synthesized
gcttcagatggggagaagttag

SEQ ID NO: 1166000 - DNA, 22 bp, Artificial Sequence
  chemically synthesized
ggcttcagatggggagaagtta

SEQ ID NO: 1166001 - DNA, 22 bp, Artificial Sequence
  chemically synthesized
tgcgtggctctaacttctcccc

SEQ ID NO: 1166002 - DNA, 22 bp, Artificial Sequence
  chemically synthesized
cttggcttcagatggggagaag

SEQ ID NO: 1166003 - DNA, 22 bp, Artificial Sequence
  chemically synthesized
cgtggctctaacttctccccat

SEQ ID NO: 1166004 - DNA, 22 bp, Artificial Sequence
  chemically synthesized
ttacttggcttcagatggggag

SEQ ID NO: 1166005 - DNA, 22 bp, Artificial Sequence
  chemically synthesized
tattacttggcttcagatgggg

SEQ ID NO: 1166006 - DNA, 22 bp, Artificial Sequence
  chemically synthesized
taacttctccccatctgaagcc

SEQ ID NO: 1166007 - DNA, 22 bp, Artificial Sequence
  chemically synthesized
acttctccccatctgaagccaa

SEQ ID NO: 1166008 - DNA, 22 bp, Artificial Sequence
  chemically synthesized
ccccgtctctattacttggctt

SEQ ID NO: 1166009 - DNA, 22 bp, Artificial Sequence
  chemically synthesized
ctccccatctgaagccaagtaa

SEQ ID NO: 1166010 - DNA, 22 bp, Artificial Sequence
  chemically synthesized
tccccatctgaagccaagtaat

SEQ ID NO: 1166011 - DNA, 22 bp, Artificial Sequence
  chemically synthesized
cccatctgaagccaagtaatag

SEQ ID NO: 1166012 - DNA, 22 bp, Artificial Sequence
  chemically synthesized
atgtaaactaccccgtctctat

SEQ ID NO: 1166013 - DNA, 22 bp, Artificial Sequence
  chemically synthesized
aagccaagtaatagagacgggg

SEQ ID NO: 1166014 - DNA, 22 bp, Artificial Sequence
  chemically synthesized
cagctcatgtaaactaccccgt

SEQ ID NO: 1166015 - DNA, 22 bp, Artificial Sequence
  chemically synthesized
acagctcatgtaaactaccccg

SEQ ID NO: 1166016 - DNA, 22 bp, Artificial Sequence
  chemically synthesized
caaacatatggccaggtttaca

SEQ ID NO: 1166017 - DNA, 22 bp, Artificial Sequence
  chemically synthesized
tgcaaacatatggccaggttta

SEQ ID NO: 1166018 - DNA, 22 bp, Artificial Sequence
  chemically synthesized
acatgagctgtaaacctggcca

SEQ ID NO: 1166019 - DNA, 22 bp, Artificial Sequence
  chemically synthesized
catgagctgtaaacctggccat

SEQ ID NO: 1166020 - DNA, 22 bp, Artificial Sequence
  chemically synthesized
taaacctggccatatgtttgca

SEQ ID NO: 1166021 - DNA, 22 bp, Artificial Sequence
  chemically synthesized
tagcatgcaaatctctgcaaac

SEQ ID NO: 1166022 - DNA, 22 bp, Artificial Sequence
  chemically synthesized
ctatagcatgcaaatctctgca

SEQ ID NO: 1166023 - DNA, 22 bp, Artificial Sequence
  chemically synthesized
gccatatgtttgcagagatttg

SEQ ID NO: 1166024 - DNA, 22 bp, Artificial Sequence
  chemically synthesized
agtgtatggttcctatagcatg

SEQ ID NO: 1166025 - DNA, 22 bp, Artificial Sequence
  chemically synthesized
gcagagatttgcatgctatagg

SEQ ID NO: 1166026 - DNA, 22 bp, Artificial Sequence
  chemically synthesized
gagtgtatggttcctatagcat

SEQ ID NO: 1166027 - DNA, 22 bp, Artificial Sequence
  chemically synthesized
cagagatttgcatgctatagga

SEQ ID NO: 1166028 - DNA, 22 bp, Artificial Sequence
  chemically synthesized
tcacttgagtgtatggttccta

SEQ ID NO: 1166029 - DNA, 22 bp, Artificial Sequence
  chemically synthesized
ctgtcacttgagtgtatggttc

SEQ ID NO: 1166030 - DNA, 22 bp, Artificial Sequence
  chemically synthesized
gcatgctataggaaccatacac

SEQ ID NO: 1166031 - DNA, 22 bp, Artificial Sequence
  chemically synthesized
catgctataggaaccatacact

SEQ ID NO: 1166032 - DNA, 22 bp, Artificial Sequence
  chemically synthesized
tcctgtcacttgagtgtatggt

SEQ ID NO: 1166033 - DNA, 22 bp, Artificial Sequence
  chemically synthesized
taggaaccatacactcaagtga

SEQ ID NO: 1166034 - DNA, 22 bp, Artificial Sequence
  chemically synthesized
tcccaagaagcctctcctgtca

SEQ ID NO: 1166035 - DNA, 22 bp, Artificial Sequence
  chemically synthesized
atcccaagaagcctctcctgtc

SEQ ID NO: 1166036 - DNA, 22 bp, Artificial Sequence
  chemically synthesized
aagtgacaggagaggcttcttg

SEQ ID NO: 1166037 - DNA, 22 bp, Artificial Sequence
  chemically synthesized
aagcagcagacatgtagtttat

SEQ ID NO: 1166038 - DNA, 22 bp, Artificial Sequence
  chemically synthesized
ggttaaagcagcagacatgtag

SEQ ID NO: 1166039 - DNA, 22 bp, Artificial Sequence
  chemically synthesized
cttgggataaactacatgtctg

SEQ ID NO: 1166040 - DNA, 22 bp, Artificial Sequence
  chemically synthesized
aggttaaagcagcagacatgta

SEQ ID NO: 1166041 - DNA, 22 bp, Artificial Sequence
  chemically synthesized
ttgggataaactacatgtctgc

SEQ ID NO: 1166042 - DNA, 22 bp, Artificial Sequence
  chemically synthesized
taggttaaagcagcagacatgt

SEQ ID NO: 1166043 - DNA, 22 bp, Artificial Sequence
  chemically synthesized
gggataaactacatgtctgctg

SEQ ID NO: 1166044 - DNA, 22 bp, Artificial Sequence
  chemically synthesized
ggataaactacatgtctgctgc

SEQ ID NO: 1166045 - DNA, 22 bp, Artificial Sequence
  chemically synthesized
ataaatgcctttaggttaaagc

SEQ ID NO: 1166046 - DNA, 22 bp, Artificial Sequence
  chemically synthesized
gataaatgcctttaggttaaag

SEQ ID NO: 1166047 - DNA, 22 bp, Artificial Sequence
  chemically synthesized
catgtctgctgctttaacctaa

SEQ ID NO: 1166048 - DNA, 22 bp, Artificial Sequence
  chemically synthesized
cccttgataaatgcctttaggt

SEQ ID NO: 1166049 - DNA, 22 bp, Artificial Sequence
  chemically synthesized
gcccttgataaatgcctttagg

SEQ ID NO: 1166050 - DNA, 22 bp, Artificial Sequence
  chemically synthesized
tgcccttgataaatgcctttag

SEQ ID NO: 1166051 - DNA, 22 bp, Artificial Sequence
  chemically synthesized
ttgcccttgataaatgccttta

SEQ ID NO: 1166052 - DNA, 22 bp, Artificial Sequence
  chemically synthesized
ctgctttaacctaaaggcattt

SEQ ID NO: 1166053 - DNA, 22 bp, Artificial Sequence
  chemically synthesized
ctttaacctaaaggcatttatc

SEQ ID NO: 1166054 - DNA, 22 bp, Artificial Sequence
  chemically synthesized
aaatttttgcccttgataaatg

SEQ ID NO: 1166055 - DNA, 22 bp, Artificial Sequence
  chemically synthesized
taacctaaaggcatttatcaag

SEQ ID NO: 1166056 - DNA, 22 bp, Artificial Sequence
  chemically synthesized
aacctaaaggcatttatcaagg

SEQ ID NO: 1166057 - DNA, 22 bp, Artificial Sequence
  chemically synthesized
acctaaaggcatttatcaaggg

SEQ ID NO: 1166058 - DNA, 22 bp, Artificial Sequence
  chemically synthesized
ctcaaatttttgcccttgataa

SEQ ID NO: 1166059 - DNA, 22 bp, Artificial Sequence
  chemically synthesized
actcaaatttttgcccttgata

SEQ ID NO: 1166060 - DNA, 22 bp, Artificial Sequence
  chemically synthesized
aaggcatttatcaagggcaaaa

SEQ ID NO: 1166061 - DNA, 22 bp, Artificial Sequence
  chemically synthesized
gtagtttactcaaatttttgcc

SEQ ID NO: 1166062 - DNA, 22 bp, Artificial Sequence
  chemically synthesized
agtagtttactcaaatttttgc

SEQ ID NO: 1166063 - DNA, 22 bp, Artificial Sequence
  chemically synthesized
atcaagggcaaaaatttgagta

SEQ ID NO: 1166064 - DNA, 22 bp, Artificial Sequence
  chemically synthesized
tcaagggcaaaaatttgagtaa

SEQ ID NO: 1166065 - DNA, 22 bp, Artificial Sequence
  chemically synthesized
caaacttagtagtttactcaaa

SEQ ID NO: 1166066 - DNA, 22 bp, Artificial Sequence
  chemically synthesized
ctgcaaacttagtagtttactc

SEQ ID NO: 1166067 - DNA, 22 bp, Artificial Sequence
  chemically synthesized
gagtaaactactaagtttgcag

SEQ ID NO: 1166068 - DNA, 22 bp, Artificial Sequence
  chemically synthesized
agtaaactactaagtttgcagg

SEQ ID NO: 1166069 - DNA, 22 bp, Artificial Sequence
  chemically synthesized
ccaaagcaaaacctcctgcaaa

SEQ ID NO: 1166070 - DNA, 22 bp, Artificial Sequence
  chemically synthesized
ctcccaaagcaaaacctcctgc

SEQ ID NO: 1166071 - DNA, 22 bp, Artificial Sequence
  chemically synthesized
ctaagtttgcaggaggttttgc

SEQ ID NO: 1166072 - DNA, 22 bp, Artificial Sequence
  chemically synthesized
agtttgcaggaggttttgcttt

SEQ ID NO: 1166073 - DNA, 22 bp, Artificial Sequence
  chemically synthesized
gcaggaggttttgctttgggag

SEQ ID NO: 1166074 - DNA, 22 bp, Artificial Sequence
  chemically synthesized
caggaggttttgctttgggagg

SEQ ID NO: 1166075 - DNA, 22 bp, Artificial Sequence
  chemically synthesized
caaggagtacactcctcccaaa

SEQ ID NO: 1166076 - DNA, 22 bp, Artificial Sequence
  chemically synthesized
tgctttgggaggagtgtactcc

SEQ ID NO: 1166077 - DNA, 22 bp, Artificial Sequence
  chemically synthesized
gctttgggaggagtgtactcct

SEQ ID NO: 1166078 - DNA, 22 bp, Artificial Sequence
  chemically synthesized
ctttgggaggagtgtactcctt

SEQ ID NO: 1166079 - DNA, 22 bp, Artificial Sequence
  chemically synthesized
tgggaggagtgtactccttgca

SEQ ID NO: 1166080 - DNA, 22 bp, Artificial Sequence
  chemically synthesized
gggaggagtgtactccttgcag

SEQ ID NO: 1166081 - DNA, 22 bp, Artificial Sequence
  chemically synthesized
aagcccggcgacctgcaaggag

SEQ ID NO: 1166082 - DNA, 22 bp, Artificial Sequence
  chemically synthesized
ggaggagtgtactccttgcagg

SEQ ID NO: 1166083 - DNA, 22 bp, Artificial Sequence
  chemically synthesized
gaagcccggcgacctgcaagga

SEQ ID NO: 1166084 - DNA, 22 bp, Artificial Sequence
  chemically synthesized
tgaagcccggcgacctgcaagg

SEQ ID NO: 1166085 - DNA, 22 bp, Artificial Sequence
  chemically synthesized
ttgaagcccggcgacctgcaag

SEQ ID NO: 1166086 - DNA, 22 bp, Artificial Sequence
  chemically synthesized
aggatttttgaagcccggcgac

SEQ ID NO: 1166087 - DNA, 22 bp, Artificial Sequence
  chemically synthesized
tcaggatttttgaagcccggcg

SEQ ID NO: 1166088 - DNA, 22 bp, Artificial Sequence
  chemically synthesized
cttgcaggtcgccgggcttcaa

SEQ ID NO: 1166089 - DNA, 22 bp, Artificial Sequence
  chemically synthesized
gcaggtcgccgggcttcaaaaa

SEQ ID NO: 1166090 - DNA, 22 bp, Artificial Sequence
  chemically synthesized
caggtcgccgggcttcaaaaat

SEQ ID NO: 1166091 - DNA, 22 bp, Artificial Sequence
  chemically synthesized
agcatgttctcaggatttttga

SEQ ID NO: 1166092 - DNA, 22 bp, Artificial Sequence
  chemically synthesized
gagcatgttctcaggatttttg

SEQ ID NO: 1166093 - DNA, 22 bp, Artificial Sequence
  chemically synthesized
ttgagcatgttctcaggatttt

SEQ ID NO: 1166094 - DNA, 22 bp, Artificial Sequence
  chemically synthesized
caaaaatcctgagaacatgctc

SEQ ID NO: 1166095 - DNA, 22 bp, Artificial Sequence
  chemically synthesized
aaaaatcctgagaacatgctca

SEQ ID NO: 1166096 - DNA, 22 bp, Artificial Sequence
  chemically synthesized
agcaaagtccctcttgagcatg

SEQ ID NO: 1166097 - DNA, 22 bp, Artificial Sequence
  chemically synthesized
acctcagcaaagtccctcttga

SEQ ID NO: 1166098 - DNA, 22 bp, Artificial Sequence
  chemically synthesized
gacctcagcaaagtccctcttg

SEQ ID NO: 1166099 - DNA, 22 bp, Artificial Sequence
  chemically synthesized
agaacatgctcaagagggactt

SEQ ID NO: 1166100 - DNA, 22 bp, Artificial Sequence
  chemically synthesized
tgtccttgacctcagcaaagtc

SEQ ID NO: 1166101 - DNA, 22 bp, Artificial Sequence
  chemically synthesized
aagagggactttgctgaggtca

SEQ ID NO: 1166102 - DNA, 22 bp, Artificial Sequence
  chemically synthesized
tgctgaggtcaaggacataggc

SEQ ID NO: 1166103 - DNA, 22 bp, Artificial Sequence
  chemically synthesized
cgtaaatagtatgcctatgtcc

SEQ ID NO: 1166104 - DNA, 22 bp, Artificial Sequence
  chemically synthesized
gctgaggtcaaggacataggca

SEQ ID NO: 1166105 - DNA, 22 bp, Artificial Sequence
  chemically synthesized
ctgaggtcaaggacataggcat

SEQ ID NO: 1166106 - DNA, 22 bp, Artificial Sequence
  chemically synthesized
aggtcaaggacataggcatact

SEQ ID NO: 1166107 - DNA, 22 bp, Artificial Sequence
  chemically synthesized
acctccgtaaatagtatgccta

SEQ ID NO: 1166108 - DNA, 22 bp, Artificial Sequence
  chemically synthesized
ctcacctccgtaaatagtatgc

SEQ ID NO: 1166109 - DNA, 22 bp, Artificial Sequence
  chemically synthesized
tgctcacctccgtaaatagtat

SEQ ID NO: 1166110 - DNA, 22 bp, Artificial Sequence
  chemically synthesized
ttctgctcacctccgtaaatag

SEQ ID NO: 1166111 - DNA, 22 bp, Artificial Sequence
  chemically synthesized
gttctgctcacctccgtaaata

SEQ ID NO: 1166112 - DNA, 22 bp, Artificial Sequence
  chemically synthesized
tttgttctgctcacctccgtaa

SEQ ID NO: 1166113 - DNA, 22 bp, Artificial Sequence
  chemically synthesized
gtttgttctgctcacctccgta

SEQ ID NO: 1166114 - DNA, 22 bp, Artificial Sequence
  chemically synthesized
caatatttgtttgttctgctca

SEQ ID NO: 1166115 - DNA, 22 bp, Artificial Sequence
  chemically synthesized
tttacggaggtgagcagaacaa

SEQ ID NO: 1166116 - DNA, 22 bp, Artificial Sequence
  chemically synthesized
tccaatatttgtttgttctgct

SEQ ID NO: 1166117 - DNA, 22 bp, Artificial Sequence
  chemically synthesized
ctccaatatttgtttgttctgc

SEQ ID NO: 1166118 - DNA, 22 bp, Artificial Sequence
  chemically synthesized
acggaggtgagcagaacaaaca

SEQ ID NO: 1166119 - DNA, 22 bp, Artificial Sequence
  chemically synthesized
cggaggtgagcagaacaaacaa

SEQ ID NO: 1166120 - DNA, 22 bp, Artificial Sequence
  chemically synthesized
caaatatttctccaatatttgt

SEQ ID NO: 1166121 - DNA, 22 bp, Artificial Sequence
  chemically synthesized
tacaaatatttctccaatattt

SEQ ID NO: 1166122 - DNA, 22 bp, Artificial Sequence
  chemically synthesized
ctacaaatatttctccaatatt

SEQ ID NO: 1166123 - DNA, 22 bp, Artificial Sequence
  chemically synthesized
ttctacaaatatttctccaata

SEQ ID NO: 1166124 - DNA, 22 bp, Artificial Sequence
  chemically synthesized
gagaaatatttgtagaagaatc

SEQ ID NO: 1166125 - DNA, 22 bp, Artificial Sequence
  chemically synthesized
tggaatgcagaagattcttcta

SEQ ID NO: 1166126 - DNA, 22 bp, Artificial Sequence
  chemically synthesized
gtggaatgcagaagattcttct

SEQ ID NO: 1166127 - DNA, 22 bp, Artificial Sequence
  chemically synthesized
caatatttgtggaatgcagaag

SEQ ID NO: 1166128 - DNA, 22 bp, Artificial Sequence
  chemically synthesized
gcaatatttgtggaatgcagaa

SEQ ID NO: 1166129 - DNA, 22 bp, Artificial Sequence
  chemically synthesized
gtagaagaatcttctgcattcc

SEQ ID NO: 1166130 - DNA, 22 bp, Artificial Sequence
  chemically synthesized
tagaagaatcttctgcattcca

SEQ ID NO: 1166131 - DNA, 22 bp, Artificial Sequence
  chemically synthesized
cttgcaatatttgtggaatgca

SEQ ID NO: 1166132 - DNA, 22 bp, Artificial Sequence
  chemically synthesized
gcttgcaatatttgtggaatgc

SEQ ID NO: 1166133 - DNA, 22 bp, Artificial Sequence
  chemically synthesized
ctgcattccacaaatattgcaa

SEQ ID NO: 1166134 - DNA, 22 bp, Artificial Sequence
  chemically synthesized
tgcattccacaaatattgcaag

SEQ ID NO: 1166135 - DNA, 22 bp, Artificial Sequence
  chemically synthesized
cattccacaaatattgcaagca

SEQ ID NO: 1166136 - DNA, 22 bp, Artificial Sequence
  chemically synthesized
gggggccccgtgcttgcttgca

SEQ ID NO: 1166137 - DNA, 22 bp, Artificial Sequence
  chemically synthesized
cacaaatattgcaagcaagcac

SEQ ID NO: 1166138 - DNA, 22 bp, Artificial Sequence
  chemically synthesized
ttagggggccccgtgcttgctt

SEQ ID NO: 1166139 - DNA, 22 bp, Artificial Sequence
  chemically synthesized
gttagggggccccgtgcttgct

SEQ ID NO: 1166140 - DNA, 22 bp, Artificial Sequence
  chemically synthesized
tttgttagggggccccgtgctt

SEQ ID NO: 1166141 - DNA, 22 bp, Artificial Sequence
  chemically synthesized
caagcaagcacggggcccccta

SEQ ID NO: 1166142 - DNA, 22 bp, Artificial Sequence
  chemically synthesized
caaaaccctgtttgttaggggg

SEQ ID NO: 1166143 - DNA, 22 bp, Artificial Sequence
  chemically synthesized
acaaaaccctgtttgttagggg

SEQ ID NO: 1166144 - DNA, 22 bp, Artificial Sequence
  chemically synthesized
tacaaaaccctgtttgttaggg

SEQ ID NO: 1166145 - DNA, 22 bp, Artificial Sequence
  chemically synthesized
ctttacaaaaccctgtttgtta

SEQ ID NO: 1166146 - DNA, 22 bp, Artificial Sequence
  chemically synthesized
attcctttacaaaaccctgttt

SEQ ID NO: 1166147 - DNA, 22 bp, Artificial Sequence
  chemically synthesized
gattcctttacaaaaccctgtt

SEQ ID NO: 1166148 - DNA, 22 bp, Artificial Sequence
  chemically synthesized
tgattcctttacaaaaccctgt

SEQ ID NO: 1166149 - DNA, 22 bp, Artificial Sequence
  chemically synthesized
ttgattcctttacaaaaccctg

SEQ ID NO: 1166150 - DNA, 22 bp, Artificial Sequence
  chemically synthesized
tttgattcctttacaaaaccct

SEQ ID NO: 1166151 - DNA, 22 bp, Artificial Sequence
  chemically synthesized
ctttttgattcctttacaaaac

SEQ ID NO: 1166152 - DNA, 22 bp, Artificial Sequence
  chemically synthesized
acaaacagggttttgtaaagga

SEQ ID NO: 1166153 - DNA, 22 bp, Artificial Sequence
  chemically synthesized
cactgctttttgattcctttac

SEQ ID NO: 1166154 - DNA, 22 bp, Artificial Sequence
  chemically synthesized
tacactgctttttgattccttt

SEQ ID NO: 1166155 - DNA, 22 bp, Artificial Sequence
  chemically synthesized
ttctacactgctttttgattcc

SEQ ID NO: 1166156 - DNA, 22 bp, Artificial Sequence
  chemically synthesized
ttgttctacactgctttttgat

SEQ ID NO: 1166157 - DNA, 22 bp, Artificial Sequence
  chemically synthesized
tgttgttctacactgctttttg

SEQ ID NO: 1166158 - DNA, 22 bp, Artificial Sequence
  chemically synthesized
tgtaaaggaatcaaaaagcagt

SEQ ID NO: 1166159 - DNA, 22 bp, Artificial Sequence
  chemically synthesized
ctgttgttctacactgcttttt

SEQ ID NO: 1166160 - DNA, 22 bp, Artificial Sequence
  chemically synthesized
gtaaaggaatcaaaaagcagtg

SEQ ID NO: 1166161 - DNA, 22 bp, Artificial Sequence
  chemically synthesized
taaaggaatcaaaaagcagtgt

SEQ ID NO: 1166162 - DNA, 22 bp, Artificial Sequence
  chemically synthesized
tgaaatcccccaaacagcttct

SEQ ID NO: 1166163 - DNA, 22 bp, Artificial Sequence
  chemically synthesized
ggtgagattatgaaatccccca

SEQ ID NO: 1166164 - DNA, 22 bp, Artificial Sequence
  chemically synthesized
tgggtgagattatgaaatcccc

SEQ ID NO: 1166165 - DNA, 22 bp, Artificial Sequence
  chemically synthesized
tctgggtgagattatgaaatcc

SEQ ID NO: 1166166 - DNA, 22 bp, Artificial Sequence
  chemically synthesized
ctctgggtgagattatgaaatc

SEQ ID NO: 1166167 - DNA, 22 bp, Artificial Sequence
  chemically synthesized
tctctgggtgagattatgaaat

SEQ ID NO: 1166168 - DNA, 22 bp, Artificial Sequence
  chemically synthesized
tttgggggatttcataatctca

SEQ ID NO: 1166169 - DNA, 22 bp, Artificial Sequence
  chemically synthesized
aattttctctgggtgagattat

SEQ ID NO: 1166170 - DNA, 22 bp, Artificial Sequence
  chemically synthesized
gggggatttcataatctcaccc

SEQ ID NO: 1166171 - DNA, 22 bp, Artificial Sequence
  chemically synthesized
ggggatttcataatctcaccca

SEQ ID NO: 1166172 - DNA, 22 bp, Artificial Sequence
  chemically synthesized
cataatctcacccagagaaaat

SEQ ID NO: 1166173 - DNA, 22 bp, Artificial Sequence
  chemically synthesized
ataatctcacccagagaaaatt

SEQ ID NO: 1166174 - DNA, 22 bp, Artificial Sequence
  chemically synthesized
acccagagaaaattcaaccttt

SEQ ID NO: 1166175 - DNA, 22 bp, Artificial Sequence
  chemically synthesized
aacctttggtggctttcccctg

SEQ ID NO: 1166176 - DNA, 22 bp, Artificial Sequence
  chemically synthesized
tggtggctttcccctggtgtgt

SEQ ID NO: 1166177 - DNA, 22 bp, Artificial Sequence
  chemically synthesized
ggtggctttcccctggtgtgta

SEQ ID NO: 1166178 - DNA, 22 bp, Artificial Sequence
  chemically synthesized
gtggctttcccctggtgtgtat

SEQ ID NO: 1166179 - DNA, 22 bp, Artificial Sequence
  chemically synthesized
tcccctggtgtgtatgtgctac

SEQ ID NO: 1166180 - DNA, 22 bp, Artificial Sequence
  chemically synthesized
cccctggtgtgtatgtgctaca

SEQ ID NO: 1166181 - DNA, 22 bp, Artificial Sequence
  chemically synthesized
ccctggtgtgtatgtgctacat

SEQ ID NO: 1166182 - DNA, 22 bp, Artificial Sequence
  chemically synthesized
agaaggacaggaaatgtagcac

SEQ ID NO: 1166183 - DNA, 22 bp, Artificial Sequence
  chemically synthesized
gtgtgtatgtgctacatttcct

SEQ ID NO: 1166184 - DNA, 22 bp, Artificial Sequence
  chemically synthesized
ccagaactgagaaggacaggaa

SEQ ID NO: 1166185 - DNA, 22 bp, Artificial Sequence
  chemically synthesized
attcccagaactgagaaggaca

SEQ ID NO: 1166186 - DNA, 22 bp, Artificial Sequence
  chemically synthesized
catttcctgtccttctcagttc

SEQ ID NO: 1166187 - DNA, 22 bp, Artificial Sequence
  chemically synthesized
gtgggttaattcccagaactga

SEQ ID NO: 1166188 - DNA, 22 bp, Artificial Sequence
  chemically synthesized
agtgggttaattcccagaactg

SEQ ID NO: 1166189 - DNA, 22 bp, Artificial Sequence
  chemically synthesized
cctgtccttctcagttctggga

SEQ ID NO: 1166190 - DNA, 22 bp, Artificial Sequence
  chemically synthesized
ctgtccttctcagttctgggaa

SEQ ID NO: 1166191 - DNA, 22 bp, Artificial Sequence
  chemically synthesized
tccttctcagttctgggaatta

SEQ ID NO: 1166192 - DNA, 22 bp, Artificial Sequence
  chemically synthesized
gcagcttagtgggttaattccc

SEQ ID NO: 1166193 - DNA, 22 bp, Artificial Sequence
  chemically synthesized
ctcagttctgggaattaaccca

SEQ ID NO: 1166194 - DNA, 22 bp, Artificial Sequence
  chemically synthesized
tcagttctgggaattaacccac

SEQ ID NO: 1166195 - DNA, 22 bp, Artificial Sequence
  chemically synthesized
agttctgggaattaacccacta

SEQ ID NO: 1166196 - DNA, 22 bp, Artificial Sequence
  chemically synthesized
gtgctggcagcttagtgggtta

SEQ ID NO: 1166197 - DNA, 22 bp, Artificial Sequence
  chemically synthesized
tgggaattaacccactaagctg

SEQ ID NO: 1166198 - DNA, 22 bp, Artificial Sequence
  chemically synthesized
ggaattaacccactaagctgcc

SEQ ID NO: 1166199 - DNA, 22 bp, Artificial Sequence
  chemically synthesized
acccactaagctgccagcacca

SEQ ID NO: 1166200 - DNA, 22 bp, Artificial Sequence
  chemically synthesized
agctgccagcaccaacttactt

SEQ ID NO: 1166201 - DNA, 22 bp, Artificial Sequence
  chemically synthesized
tcagaagagcacaagtaagttg

SEQ ID NO: 1166202 - DNA, 22 bp, Artificial Sequence
  chemically synthesized
atcagaagagcacaagtaagtt

SEQ ID NO: 1166203 - DNA, 22 bp, Artificial Sequence
  chemically synthesized
ccagcaccaacttacttgtgct

SEQ ID NO: 1166204 - DNA, 22 bp, Artificial Sequence
  chemically synthesized
agcatttatcagaagagcacaa

SEQ ID NO: 1166205 - DNA, 22 bp, Artificial Sequence
  chemically synthesized
gagcatttatcagaagagcaca

SEQ ID NO: 1166206 - DNA, 22 bp, Artificial Sequence
  chemically synthesized
aaaatttgagcatttatcagaa

SEQ ID NO: 1166207 - DNA, 22 bp, Artificial Sequence
  chemically synthesized
caaaatttgagcatttatcaga

SEQ ID NO: 1166208 - DNA, 22 bp, Artificial Sequence
  chemically synthesized
acttgtgctcttctgataaatg

SEQ ID NO: 1166209 - DNA, 22 bp, Artificial Sequence
  chemically synthesized
tcaaaatttgagcatttatcag

SEQ ID NO: 1166210 - DNA, 22 bp, Artificial Sequence
  chemically synthesized
cttgtgctcttctgataaatgc

SEQ ID NO: 1166211 - DNA, 22 bp, Artificial Sequence
  chemically synthesized
gtgctcttctgataaatgctca

SEQ ID NO: 1166212 - DNA, 22 bp, Artificial Sequence
  chemically synthesized
tgctcttctgataaatgctcaa

SEQ ID NO: 1166213 - DNA, 22 bp, Artificial Sequence
  chemically synthesized
aattttcaaaatttgagcattt

SEQ ID NO: 1166214 - DNA, 22 bp, Artificial Sequence
  chemically synthesized
ttctgataaatgctcaaatttt

SEQ ID NO: 1166215 - DNA, 22 bp, Artificial Sequence
  chemically synthesized
ctgataaatgctcaaattttga

SEQ ID NO: 1166216 - DNA, 22 bp, Artificial Sequence
  chemically synthesized
tgataaatgctcaaattttgaa

SEQ ID NO: 1166217 - DNA, 22 bp, Artificial Sequence
  chemically synthesized
aaatattgaattttcaaaattt

SEQ ID NO: 1166218 - DNA, 22 bp, Artificial Sequence
  chemically synthesized
aaaatattgaattttcaaaatt

SEQ ID NO: 1166219 - DNA, 22 bp, Artificial Sequence
  chemically synthesized
ataaatgctcaaattttgaaaa

SEQ ID NO: 1166220 - DNA, 22 bp, Artificial Sequence
  chemically synthesized
gggaaatttaaaatattgaatt

SEQ ID NO: 1166221 - DNA, 22 bp, Artificial Sequence
  chemically synthesized
aaattttgaaaattcaatattt

SEQ ID NO: 1166222 - DNA, 22 bp, Artificial Sequence
  chemically synthesized
acagttggggaaatttaaaata

SEQ ID NO: 1166223 - DNA, 22 bp, Artificial Sequence
  chemically synthesized
tgaaaattcaatattttaaatt

SEQ ID NO: 1166224 - DNA, 22 bp, Artificial Sequence
  chemically synthesized
aacagttggggaaatttaaaat

SEQ ID NO: 1166225 - DNA, 22 bp, Artificial Sequence
  chemically synthesized
gaaaattcaatattttaaattt

SEQ ID NO: 1166226 - DNA, 22 bp, Artificial Sequence
  chemically synthesized
aaaattcaatattttaaatttc

SEQ ID NO: 1166227 - DNA, 22 bp, Artificial Sequence
  chemically synthesized
aatattttaaatttccccaact

SEQ ID NO: 1166228 - DNA, 22 bp, Artificial Sequence
  chemically synthesized
gaaggacttaacagttggggaa

SEQ ID NO: 1166229 - DNA, 22 bp, Artificial Sequence
  chemically synthesized
taaatttccccaactgttaagt

SEQ ID NO: 1166230 - DNA, 22 bp, Artificial Sequence
  chemically synthesized
tcatctcgaaggacttaacagt

SEQ ID NO: 1166231 - DNA, 22 bp, Artificial Sequence
  chemically synthesized
aaatttccccaactgttaagtc

SEQ ID NO: 1166232 - DNA, 22 bp, Artificial Sequence
  chemically synthesized
gtcatctcgaaggacttaacag

SEQ ID NO: 1166233 - DNA, 22 bp, Artificial Sequence
  chemically synthesized
aatttccccaactgttaagtcc

SEQ ID NO: 1166234 - DNA, 22 bp, Artificial Sequence
  chemically synthesized
ccccaactgttaagtccttcga

SEQ ID NO: 1166235 - DNA, 22 bp, Artificial Sequence
  chemically synthesized
tgccttgtcatctcgaaggact

SEQ ID NO: 1166236 - DNA, 22 bp, Artificial Sequence
  chemically synthesized
cccaactgttaagtccttcgag

SEQ ID NO: 1166237 - DNA, 22 bp, Artificial Sequence
  chemically synthesized
ccactatgccttgtcatctcga

SEQ ID NO: 1166238 - DNA, 22 bp, Artificial Sequence
  chemically synthesized
ttaagtccttcgagatgacaag

SEQ ID NO: 1166239 - DNA, 22 bp, Artificial Sequence
  chemically synthesized
agtccttcgagatgacaaggca

SEQ ID NO: 1166240 - DNA, 22 bp, Artificial Sequence
  chemically synthesized
caataactgccactatgccttg

SEQ ID NO: 1166241 - DNA, 22 bp, Artificial Sequence
  chemically synthesized
cgagatgacaaggcatagtggc

SEQ ID NO: 1166242 - DNA, 22 bp, Artificial Sequence
  chemically synthesized
gagatgacaaggcatagtggca

SEQ ID NO: 1166243 - DNA, 22 bp, Artificial Sequence
  chemically synthesized
atgaaaatgtcattgcaataac

SEQ ID NO: 1166244 - DNA, 22 bp, Artificial Sequence
  chemically synthesized
gatgaaaatgtcattgcaataa

SEQ ID NO: 1166245 - DNA, 22 bp, Artificial Sequence
  chemically synthesized
ttgcaatgacattttcatcaaa

SEQ ID NO: 1166246 - DNA, 22 bp, Artificial Sequence
  chemically synthesized
caatgacattttcatcaaatga

SEQ ID NO: 1166247 - DNA, 22 bp, Artificial Sequence
  chemically synthesized
gaaaaagagtgcatcatttgat

SEQ ID NO: 1166248 - DNA, 22 bp, Artificial Sequence
  chemically synthesized
tagaaactggaaaaagagtgca

SEQ ID NO: 1166249 - DNA, 22 bp, Artificial Sequence
  chemically synthesized
tcatcaaatgatgcactctttt

SEQ ID NO: 1166250 - DNA, 22 bp, Artificial Sequence
  chemically synthesized
atagaaactggaaaaagagtgc

SEQ ID NO: 1166251 - DNA, 22 bp, Artificial Sequence
  chemically synthesized
catcaaatgatgcactcttttt

SEQ ID NO: 1166252 - DNA, 22 bp, Artificial Sequence
  chemically synthesized
tatagaaactggaaaaagagtg

SEQ ID NO: 1166253 - DNA, 22 bp, Artificial Sequence
  chemically synthesized
atcaaatgatgcactctttttc

SEQ ID NO: 1166254 - DNA, 22 bp, Artificial Sequence
  chemically synthesized
ttatagaaactggaaaaagagt

SEQ ID NO: 1166255 - DNA, 22 bp, Artificial Sequence
  chemically synthesized
ccacttttatagaaactggaaa

SEQ ID NO: 1166256 - DNA, 22 bp, Artificial Sequence
  chemically synthesized
tgccacttttatagaaactgga

SEQ ID NO: 1166257 - DNA, 22 bp, Artificial Sequence
  chemically synthesized
tctgccacttttatagaaactg

SEQ ID NO: 1166258 - DNA, 22 bp, Artificial Sequence
  chemically synthesized
ctctgccacttttatagaaact

SEQ ID NO: 1166259 - DNA, 22 bp, Artificial Sequence
  chemically synthesized
tctctgccacttttatagaaac

SEQ ID NO: 1166260 - DNA, 22 bp, Artificial Sequence
  chemically synthesized
tttttccagtttctataaaagt

SEQ ID NO: 1166261 - DNA, 22 bp, Artificial Sequence
  chemically synthesized
tttccagtttctataaaagtgg

SEQ ID NO: 1166262 - DNA, 22 bp, Artificial Sequence
  chemically synthesized
ttccagtttctataaaagtggc

SEQ ID NO: 1166263 - DNA, 22 bp, Artificial Sequence
  chemically synthesized
tccagtttctataaaagtggca

SEQ ID NO: 1166264 - DNA, 22 bp, Artificial Sequence
  chemically synthesized
ccagtttctataaaagtggcag

SEQ ID NO: 1166265 - DNA, 22 bp, Artificial Sequence
  chemically synthesized
cagtttctataaaagtggcaga

SEQ ID NO: 1166266 - DNA, 22 bp, Artificial Sequence
  chemically synthesized
ccaggatgacctttctctgcca

SEQ ID NO: 1166267 - DNA, 22 bp, Artificial Sequence
  chemically synthesized
accaggatgacctttctctgcc

SEQ ID NO: 1166268 - DNA, 22 bp, Artificial Sequence
  chemically synthesized
ctataaaagtggcagagaaagg

SEQ ID NO: 1166269 - DNA, 22 bp, Artificial Sequence
  chemically synthesized
tataaaagtggcagagaaaggt

SEQ ID NO: 1166270 - DNA, 22 bp, Artificial Sequence
  chemically synthesized
acttaccaggatgacctttctc

SEQ ID NO: 1166271 - DNA, 22 bp, Artificial Sequence
  chemically synthesized
taaaagtggcagagaaaggtca

SEQ ID NO: 1166272 - DNA, 22 bp, Artificial Sequence
  chemically synthesized
gacttaccaggatgacctttct

SEQ ID NO: 1166273 - DNA, 22 bp, Artificial Sequence
  chemically synthesized
tgacttaccaggatgacctttc

SEQ ID NO: 1166274 - DNA, 22 bp, Artificial Sequence
  chemically synthesized
ggtgattttgacttaccaggat

SEQ ID NO: 1166275 - DNA, 22 bp, Artificial Sequence
  chemically synthesized
atatgatgaagttcggtgattt

SEQ ID NO: 1166276 - DNA, 22 bp, Artificial Sequence
  chemically synthesized
gatatgatgaagttcggtgatt

SEQ ID NO: 1166277 - DNA, 22 bp, Artificial Sequence
  chemically synthesized
tgatatgatgaagttcggtgat

SEQ ID NO: 1166278 - DNA, 22 bp, Artificial Sequence
  chemically synthesized
gtaagtcaaaatcaccgaactt

SEQ ID NO: 1166279 - DNA, 22 bp, Artificial Sequence
  chemically synthesized
tttgatatgatgaagttcggtg

SEQ ID NO: 1166280 - DNA, 22 bp, Artificial Sequence
  chemically synthesized
ccctctttgatatgatgaagtt

SEQ ID NO: 1166281 - DNA, 22 bp, Artificial Sequence
  chemically synthesized
accctctttgatatgatgaagt

SEQ ID NO: 1166282 - DNA, 22 bp, Artificial Sequence
  chemically synthesized
agtgcacttaccctctttgata

SEQ ID NO: 1166283 - DNA, 22 bp, Artificial Sequence
  chemically synthesized
cagtgcacttaccctctttgat

SEQ ID NO: 1166284 - DNA, 22 bp, Artificial Sequence
  chemically synthesized
tcagtgcacttaccctctttga

SEQ ID NO: 1166285 - DNA, 22 bp, Artificial Sequence
  chemically synthesized
catcatatcaaagagggtaagt

SEQ ID NO: 1166286 - DNA, 22 bp, Artificial Sequence
  chemically synthesized
atcatatcaaagagggtaagtg

SEQ ID NO: 1166287 - DNA, 22 bp, Artificial Sequence
  chemically synthesized
catgcaaatagccctttcagtg

SEQ ID NO: 1166288 - DNA, 22 bp, Artificial Sequence
  chemically synthesized
gacaagggttccatgcaaatag

SEQ ID NO: 1166289 - DNA, 22 bp, Artificial Sequence
  chemically synthesized
ttagacaagggttccatgcaaa

SEQ ID NO: 1166290 - DNA, 22 bp, Artificial Sequence
  chemically synthesized
aaagggctatttgcatggaacc

SEQ ID NO: 1166291 - DNA, 22 bp, Artificial Sequence
  chemically synthesized
ctgttagacaagggttccatgc

SEQ ID NO: 1166292 - DNA, 22 bp, Artificial Sequence
  chemically synthesized
actgttagacaagggttccatg

SEQ ID NO: 1166293 - DNA, 22 bp, Artificial Sequence
  chemically synthesized
ccttactgttagacaagggttc

SEQ ID NO: 1166294 - DNA, 22 bp, Artificial Sequence
  chemically synthesized
tttgcatggaacccttgtctaa

SEQ ID NO: 1166295 - DNA, 22 bp, Artificial Sequence
  chemically synthesized
gcatggaacccttgtctaacag

SEQ ID NO: 1166296 - DNA, 22 bp, Artificial Sequence
  chemically synthesized
catggaacccttgtctaacagt

SEQ ID NO: 1166297 - DNA, 22 bp, Artificial Sequence
  chemically synthesized
agaaattgccttactgttagac

SEQ ID NO: 1166298 - DNA, 22 bp, Artificial Sequence
  chemically synthesized
cagaaattgccttactgttaga

SEQ ID NO: 1166299 - DNA, 22 bp, Artificial Sequence
  chemically synthesized
agaccttcagaaattgccttac

SEQ ID NO: 1166300 - DNA, 22 bp, Artificial Sequence
  chemically synthesized
gtctaacagtaaggcaatttct

SEQ ID NO: 1166301 - DNA, 22 bp, Artificial Sequence
  chemically synthesized
tctaacagtaaggcaatttctg

SEQ ID NO: 1166302 - DNA, 22 bp, Artificial Sequence
  chemically synthesized
acccctaagaccttcagaaatt

SEQ ID NO: 1166303 - DNA, 22 bp, Artificial Sequence
  chemically synthesized
acagtaaggcaatttctgaagg

SEQ ID NO: 1166304 - DNA, 22 bp, Artificial Sequence
  chemically synthesized
taacccctaagaccttcagaaa

SEQ ID NO: 1166305 - DNA, 22 bp, Artificial Sequence
  chemically synthesized
ttctaacccctaagaccttcag

SEQ ID NO: 1166306 - DNA, 22 bp, Artificial Sequence
  chemically synthesized
ctgaaggtcttaggggttagaa

SEQ ID NO: 1166307 - DNA, 22 bp, Artificial Sequence
  chemically synthesized
tgaaggtcttaggggttagaac

SEQ ID NO: 1166308 - DNA, 22 bp, Artificial Sequence
  chemically synthesized
aaggtcttaggggttagaacaa

SEQ ID NO: 1166309 - DNA, 22 bp, Artificial Sequence
  chemically synthesized
aggggttagaacaacttccatg

SEQ ID NO: 1166310 - DNA, 22 bp, Artificial Sequence
  chemically synthesized
ggggttagaacaacttccatgg

SEQ ID NO: 1166311 - DNA, 22 bp, Artificial Sequence
  chemically synthesized
gagacggaagagatacaccatg

SEQ ID NO: 1166312 - DNA, 22 bp, Artificial Sequence
  chemically synthesized
agagacggaagagatacaccat

SEQ ID NO: 1166313 - DNA, 22 bp, Artificial Sequence
  chemically synthesized
gaacaacttccatggtgtatct

SEQ ID NO: 1166314 - DNA, 22 bp, Artificial Sequence
  chemically synthesized
atagtatttagagacggaagag

SEQ ID NO: 1166315 - DNA, 22 bp, Artificial Sequence
  chemically synthesized
ccatggtgtatctcttccgtct

SEQ ID NO: 1166316 - DNA, 22 bp, Artificial Sequence
  chemically synthesized
catggtgtatctcttccgtctc

SEQ ID NO: 1166317 - DNA, 22 bp, Artificial Sequence
  chemically synthesized
ttaatagtatttagagacggaa

SEQ ID NO: 1166318 - DNA, 22 bp, Artificial Sequence
  chemically synthesized
ttattaatagtatttagagacg

SEQ ID NO: 1166319 - DNA, 22 bp, Artificial Sequence
  chemically synthesized
atagttattattaatagtattt

SEQ ID NO: 1166320 - DNA, 22 bp, Artificial Sequence
  chemically synthesized
gatagttattattaatagtatt

SEQ ID NO: 1166321 - DNA, 22 bp, Artificial Sequence
  chemically synthesized
ttccgtctctaaatactattaa

SEQ ID NO: 1166322 - DNA, 22 bp, Artificial Sequence
  chemically synthesized
tgatagttattattaatagtat

SEQ ID NO: 1166323 - DNA, 22 bp, Artificial Sequence
  chemically synthesized
ccgtctctaaatactattaata

SEQ ID NO: 1166324 - DNA, 22 bp, Artificial Sequence
  chemically synthesized
cgtctctaaatactattaataa

SEQ ID NO: 1166325 - DNA, 22 bp, Artificial Sequence
  chemically synthesized
actttgatagttattattaata

SEQ ID NO: 1166326 - DNA, 22 bp, Artificial Sequence
  chemically synthesized
taaatactattaataataacta

SEQ ID NO: 1166327 - DNA, 22 bp, Artificial Sequence
  chemically synthesized
atgctgactttgatagttatta

SEQ ID NO: 1166328 - DNA, 22 bp, Artificial Sequence
  chemically synthesized
aatactattaataataactatc

SEQ ID NO: 1166329 - DNA, 22 bp, Artificial Sequence
  chemically synthesized
aatgctgactttgatagttatt

SEQ ID NO: 1166330 - DNA, 22 bp, Artificial Sequence
  chemically synthesized
ccccttaatgctgactttgata

SEQ ID NO: 1166331 - DNA, 22 bp, Artificial Sequence
  chemically synthesized
ttaataataactatcaaagtca

SEQ ID NO: 1166332 - DNA, 22 bp, Artificial Sequence
  chemically synthesized
cccccttaatgctgactttgat

SEQ ID NO: 1166333 - DNA, 22 bp, Artificial Sequence
  chemically synthesized
tcccccttaatgctgactttga

SEQ ID NO: 1166334 - DNA, 22 bp, Artificial Sequence
  chemically synthesized
ataataactatcaaagtcagca

SEQ ID NO: 1166335 - DNA, 22 bp, Artificial Sequence
  chemically synthesized
tatcattttcccccttaatgct

SEQ ID NO: 1166336 - DNA, 22 bp, Artificial Sequence
  chemically synthesized
atatcattttcccccttaatgc

SEQ ID NO: 1166337 - DNA, 22 bp, Artificial Sequence
  chemically synthesized
tatatcattttcccccttaatg

SEQ ID NO: 1166338 - DNA, 22 bp, Artificial Sequence
  chemically synthesized
tcaaagtcagcattaaggggga

SEQ ID NO: 1166339 - DNA, 22 bp, Artificial Sequence
  chemically synthesized
cctttatatcattttccccctt

SEQ ID NO: 1166340 - DNA, 22 bp, Artificial Sequence
  chemically synthesized
aggctgcctttatatcattttc

SEQ ID NO: 1166341 - DNA, 22 bp, Artificial Sequence
  chemically synthesized
tcaggctgcctttatatcattt

SEQ ID NO: 1166342 - DNA, 22 bp, Artificial Sequence
  chemically synthesized
agggggaaaatgatataaaggc

SEQ ID NO: 1166343 - DNA, 22 bp, Artificial Sequence
  chemically synthesized
cgcacatctctcaggctgcctt

SEQ ID NO: 1166344 - DNA, 22 bp, Artificial Sequence
  chemically synthesized
cacctgcgcacatctctcaggc

SEQ ID NO: 1166345 - DNA, 22 bp, Artificial Sequence
  chemically synthesized
gttccacctgcgcacatctctc

SEQ ID NO: 1166346 - DNA, 22 bp, Artificial Sequence
  chemically synthesized
agagatgtgcgcaggtggaacc

SEQ ID NO: 1166347 - DNA, 22 bp, Artificial Sequence
  chemically synthesized
cacaaacgtgaagctggttcca

SEQ ID NO: 1166348 - DNA, 22 bp, Artificial Sequence
  chemically synthesized
aggttgcacaaacgtgaagctg

SEQ ID NO: 1166349 - DNA, 22 bp, Artificial Sequence
  chemically synthesized
ctcaggttgcacaaacgtgaag

SEQ ID NO: 1166350 - DNA, 22 bp, Artificial Sequence
  chemically synthesized
tgcaactgctcaggttgcacaa

SEQ ID NO: 1166351 - DNA, 22 bp, Artificial Sequence
  chemically synthesized
cacgtttgtgcaacctgagcag

SEQ ID NO: 1166352 - DNA, 22 bp, Artificial Sequence
  chemically synthesized
acgtttgtgcaacctgagcagt

SEQ ID NO: 1166353 - DNA, 22 bp, Artificial Sequence
  chemically synthesized
agggccctgtgcaactgctcag

SEQ ID NO: 1166354 - DNA, 22 bp, Artificial Sequence
  chemically synthesized
gtgcaacctgagcagttgcaca

SEQ ID NO: 1166355 - DNA, 22 bp, Artificial Sequence
  chemically synthesized
cgctcagggccctgtgcaactg

SEQ ID NO: 1166356 - DNA, 22 bp, Artificial Sequence
  chemically synthesized
tgcaacctgagcagttgcacag

SEQ ID NO: 1166357 - DNA, 22 bp, Artificial Sequence
  chemically synthesized
tgcgctcagggccctgtgcaac

SEQ ID NO: 1166358 - DNA, 22 bp, Artificial Sequence
  chemically synthesized
ctgcgctcagggccctgtgcaa

SEQ ID NO: 1166359 - DNA, 22 bp, Artificial Sequence
  chemically synthesized
ttctgcgctcagggccctgtgc

SEQ ID NO: 1166360 - DNA, 22 bp, Artificial Sequence
  chemically synthesized
cttctgcgctcagggccctgtg

SEQ ID NO: 1166361 - DNA, 22 bp, Artificial Sequence
  chemically synthesized
agcagttgcacagggccctgag

SEQ ID NO: 1166362 - DNA, 22 bp, Artificial Sequence
  chemically synthesized
cacagggccctgagcgcagaag

SEQ ID NO: 1166363 - DNA, 22 bp, Artificial Sequence
  chemically synthesized
agcgcagaagaaacacatgcct

SEQ ID NO: 1166364 - DNA, 22 bp, Artificial Sequence
  chemically synthesized
aggatagtatcagcagataata

SEQ ID NO: 1166365 - DNA, 22 bp, Artificial Sequence
  chemically synthesized
caggatagtatcagcagataat

SEQ ID NO: 1166366 - DNA, 22 bp, Artificial Sequence
  chemically synthesized
caatttcaggatagtatcagca

SEQ ID NO: 1166367 - DNA, 22 bp, Artificial Sequence
  chemically synthesized
acaatttcaggatagtatcagc

SEQ ID NO: 1166368 - DNA, 22 bp, Artificial Sequence
  chemically synthesized
tttacaatttcaggatagtatc

SEQ ID NO: 1166369 - DNA, 22 bp, Artificial Sequence
  chemically synthesized
tattatctgctgatactatcct

SEQ ID NO: 1166370 - DNA, 22 bp, Artificial Sequence
  chemically synthesized
ttatctgctgatactatcctga

SEQ ID NO: 1166371 - DNA, 22 bp, Artificial Sequence
  chemically synthesized
tctgctgatactatcctgaaat

SEQ ID NO: 1166372 - DNA, 22 bp, Artificial Sequence
  chemically synthesized
ctgatactatcctgaaattgta

SEQ ID NO: 1166373 - DNA, 22 bp, Artificial Sequence
  chemically synthesized
atactatcctgaaattgtaaat

SEQ ID NO: 1166374 - DNA, 22 bp, Artificial Sequence
  chemically synthesized
aaaaataaaattatttacaatt

SEQ ID NO: 1166375 - DNA, 22 bp, Artificial Sequence
  chemically synthesized
tcctgaaattgtaaataatttt

SEQ ID NO: 1166376 - DNA, 22 bp, Artificial Sequence
  chemically synthesized
aaattgtaaataattttatttt

SEQ ID NO: 1166377 - DNA, 22 bp, Artificial Sequence
  chemically synthesized
aaacacaaattcaaaaataaaa

SEQ ID NO: 1166378 - DNA, 22 bp, Artificial Sequence
  chemically synthesized
taaaacacaaattcaaaaataa

SEQ ID NO: 1166379 - DNA, 22 bp, Artificial Sequence
  chemically synthesized
ctaaaacacaaattcaaaaata

SEQ ID NO: 1166380 - DNA, 22 bp, Artificial Sequence
  chemically synthesized
taaataattttatttttgaatt

SEQ ID NO: 1166381 - DNA, 22 bp, Artificial Sequence
  chemically synthesized
acttctaaaacacaaattcaaa

SEQ ID NO: 1166382 - DNA, 22 bp, Artificial Sequence
  chemically synthesized
cacttctaaaacacaaattcaa

SEQ ID NO: 1166383 - DNA, 22 bp, Artificial Sequence
  chemically synthesized
tatttttgaatttgtgttttag

SEQ ID NO: 1166384 - DNA, 22 bp, Artificial Sequence
  chemically synthesized
atttttgaatttgtgttttaga

SEQ ID NO: 1166385 - DNA, 22 bp, Artificial Sequence
  chemically synthesized
tttttgaatttgtgttttagaa

SEQ ID NO: 1166386 - DNA, 22 bp, Artificial Sequence
  chemically synthesized
ttgaatttgtgttttagaagtg

SEQ ID NO: 1166387 - DNA, 22 bp, Artificial Sequence
  chemically synthesized
cacataggacttcacttctaaa

SEQ ID NO: 1166388 - DNA, 22 bp, Artificial Sequence
  chemically synthesized
tgaatttgtgttttagaagtga

SEQ ID NO: 1166389 - DNA, 22 bp, Artificial Sequence
  chemically synthesized
gaatttgtgttttagaagtgaa

SEQ ID NO: 1166390 - DNA, 22 bp, Artificial Sequence
  chemically synthesized
aatttgtgttttagaagtgaag

SEQ ID NO: 1166391 - DNA, 22 bp, Artificial Sequence
  chemically synthesized
attgcacataggacttcacttc

SEQ ID NO: 1166392 - DNA, 22 bp, Artificial Sequence
  chemically synthesized
cattgcacataggacttcactt

SEQ ID NO: 1166393 - DNA, 22 bp, Artificial Sequence
  chemically synthesized
gtgttttagaagtgaagtccta

SEQ ID NO: 1166394 - DNA, 22 bp, Artificial Sequence
  chemically synthesized
tgttttagaagtgaagtcctat

SEQ ID NO: 1166395 - DNA, 22 bp, Artificial Sequence
  chemically synthesized
tagaagtgaagtcctatgtgca

SEQ ID NO: 1166396 - DNA, 22 bp, Artificial Sequence
  chemically synthesized
agaagtgaagtcctatgtgcaa

SEQ ID NO: 1166397 - DNA, 22 bp, Artificial Sequence
  chemically synthesized
gaagtgaagtcctatgtgcaat

SEQ ID NO: 1166398 - DNA, 22 bp, Artificial Sequence
  chemically synthesized
cgcatgtgcatccttcattgca

SEQ ID NO: 1166399 - DNA, 22 bp, Artificial Sequence
  chemically synthesized
tgcgcatgtgcatccttcattg

SEQ ID NO: 1166400 - DNA, 22 bp, Artificial Sequence
  chemically synthesized
ctctgcgcatgtgcatccttca

SEQ ID NO: 1166401 - DNA, 22 bp, Artificial Sequence
  chemically synthesized
tctcctctgcgcatgtgcatcc

SEQ ID NO: 1166402 - DNA, 22 bp, Artificial Sequence
  chemically synthesized
tgtgcaatgaaggatgcacatg

SEQ ID NO: 1166403 - DNA, 22 bp, Artificial Sequence
  chemically synthesized
taccacctgtctcctctgcgca

SEQ ID NO: 1166404 - DNA, 22 bp, Artificial Sequence
  chemically synthesized
tatgcaaataggacagatacac

SEQ ID NO: 1166405 - DNA, 22 bp, Artificial Sequence
  chemically synthesized
aaaatgctatatgcaaatagga

SEQ ID NO: 1166406 - DNA, 22 bp, Artificial Sequence
  chemically synthesized
gggcattgaaaatgctatatgc

SEQ ID NO: 1166407 - DNA, 22 bp, Artificial Sequence
  chemically synthesized
tagggcattgaaaatgctatat

SEQ ID NO: 1166408 - DNA, 22 bp, Artificial Sequence
  chemically synthesized
ctagggcattgaaaatgctata

SEQ ID NO: 1166409 - DNA, 22 bp, Artificial Sequence
  chemically synthesized
tcctatttgcatatagcatttt

SEQ ID NO: 1166410 - DNA, 22 bp, Artificial Sequence
  chemically synthesized
tgcttctagggcattgaaaatg

SEQ ID NO: 1166411 - DNA, 22 bp, Artificial Sequence
  chemically synthesized
tttgcatatagcattttcaatg

SEQ ID NO: 1166412 - DNA, 22 bp, Artificial Sequence
  chemically synthesized
tgtgcttctagggcattgaaaa

SEQ ID NO: 1166413 - DNA, 22 bp, Artificial Sequence
  chemically synthesized
ctgtgcttctagggcattgaaa

SEQ ID NO: 1166414 - DNA, 22 bp, Artificial Sequence
  chemically synthesized
gcatatagcattttcaatgccc

SEQ ID NO: 1166415 - DNA, 22 bp, Artificial Sequence
  chemically synthesized
catatagcattttcaatgccct

SEQ ID NO: 1166416 - DNA, 22 bp, Artificial Sequence
  chemically synthesized
accagacttctgtgcttctagg

SEQ ID NO: 1166417 - DNA, 22 bp, Artificial Sequence
  chemically synthesized
tcaatgccctagaagcacagaa

SEQ ID NO: 1166418 - DNA, 22 bp, Artificial Sequence
  chemically synthesized
caatgccctagaagcacagaag

SEQ ID NO: 1166419 - DNA, 22 bp, Artificial Sequence
  chemically synthesized
aatgccctagaagcacagaagt

SEQ ID NO: 1166420 - DNA, 22 bp, Artificial Sequence
  chemically synthesized
tgagctcaccagacttctgtgc

SEQ ID NO: 1166421 - DNA, 22 bp, Artificial Sequence
  chemically synthesized
ctgtgagctcaccagacttctg

SEQ ID NO: 1166422 - DNA, 22 bp, Artificial Sequence
  chemically synthesized
actgtgagctcaccagacttct

SEQ ID NO: 1166423 - DNA, 22 bp, Artificial Sequence
  chemically synthesized
gaagcacagaagtctggtgagc

SEQ ID NO: 1166424 - DNA, 22 bp, Artificial Sequence
  chemically synthesized
aacttactgtgagctcaccaga

SEQ ID NO: 1166425 - DNA, 22 bp, Artificial Sequence
  chemically synthesized
ctaaacttactgtgagctcacc

SEQ ID NO: 1166426 - DNA, 22 bp, Artificial Sequence
  chemically synthesized
actaaacttactgtgagctcac

SEQ ID NO: 1166427 - DNA, 22 bp, Artificial Sequence
  chemically synthesized
aatcttactaaacttactgtga

SEQ ID NO: 1166428 - DNA, 22 bp, Artificial Sequence
  chemically synthesized
gaatcttactaaacttactgtg

SEQ ID NO: 1166429 - DNA, 22 bp, Artificial Sequence
  chemically synthesized
tgaatcttactaaacttactgt

SEQ ID NO: 1166430 - DNA, 22 bp, Artificial Sequence
  chemically synthesized
tttgaatcttactaaacttact

SEQ ID NO: 1166431 - DNA, 22 bp, Artificial Sequence
  chemically synthesized
gtgagctcacagtaagtttagt

SEQ ID NO: 1166432 - DNA, 22 bp, Artificial Sequence
  chemically synthesized
acagtaagtttagtaagattca

SEQ ID NO: 1166433 - DNA, 22 bp, Artificial Sequence
  chemically synthesized
cgccatattctttgaatcttac

SEQ ID NO: 1166434 - DNA, 22 bp, Artificial Sequence
  chemically synthesized
acgccatattctttgaatctta

SEQ ID NO: 1166435 - DNA, 22 bp, Artificial Sequence
  chemically synthesized
agtaagattcaaagaatatggc

SEQ ID NO: 1166436 - DNA, 22 bp, Artificial Sequence
  chemically synthesized
gtaagattcaaagaatatggcg

SEQ ID NO: 1166437 - DNA, 22 bp, Artificial Sequence
  chemically synthesized
tagacataacacacttacgcca

SEQ ID NO: 1166438 - DNA, 22 bp, Artificial Sequence
  chemically synthesized
aaagaatatggcgtaagtgtgt

SEQ ID NO: 1166439 - DNA, 22 bp, Artificial Sequence
  chemically synthesized
agttatagacataacacactta

SEQ ID NO: 1166440 - DNA, 22 bp, Artificial Sequence
  chemically synthesized
ctcagttatagacataacacac

SEQ ID NO: 1166441 - DNA, 22 bp, Artificial Sequence
  chemically synthesized
actcagttatagacataacaca

SEQ ID NO: 1166442 - DNA, 22 bp, Artificial Sequence
  chemically synthesized
tttactcagttatagacataac

SEQ ID NO: 1166443 - DNA, 22 bp, Artificial Sequence
  chemically synthesized
gtttactcagttatagacataa

SEQ ID NO: 1166444 - DNA, 22 bp, Artificial Sequence
  chemically synthesized
ccagcaaccttgtttactcagt

SEQ ID NO: 1166445 - DNA, 22 bp, Artificial Sequence
  chemically synthesized
tgtctataactgagtaaacaag

SEQ ID NO: 1166446 - DNA, 22 bp, Artificial Sequence
  chemically synthesized
ccagggctgccagcaaccttgt

SEQ ID NO: 1166447 - DNA, 22 bp, Artificial Sequence
  chemically synthesized
taactgagtaaacaaggttgct

SEQ ID NO: 1166448 - DNA, 22 bp, Artificial Sequence
  chemically synthesized
tctcccagggctgccagcaacc

SEQ ID NO: 1166449 - DNA, 22 bp, Artificial Sequence
  chemically synthesized
agtaaacaaggttgctggcagc

SEQ ID NO: 1166450 - DNA, 22 bp, Artificial Sequence
  chemically synthesized
agataggaagcattatctccca

SEQ ID NO: 1166451 - DNA, 22 bp, Artificial Sequence
  chemically synthesized
ctggcagccctgggagataatg

SEQ ID NO: 1166452 - DNA, 22 bp, Artificial Sequence
  chemically synthesized
gttcagataggaagcattatct

SEQ ID NO: 1166453 - DNA, 22 bp, Artificial Sequence
  chemically synthesized
gcagccctgggagataatgctt

SEQ ID NO: 1166454 - DNA, 22 bp, Artificial Sequence
  chemically synthesized
ggagataatgcttcctatctga

SEQ ID NO: 1166455 - DNA, 22 bp, Artificial Sequence
  chemically synthesized
aagcagggtctggttcagatag

SEQ ID NO: 1166456 - DNA, 22 bp, Artificial Sequence
  chemically synthesized
gaagcagggtctggttcagata

SEQ ID NO: 1166457 - DNA, 22 bp, Artificial Sequence
  chemically synthesized
catttgaagcagggtctggttc

SEQ ID NO: 1166458 - DNA, 22 bp, Artificial Sequence
  chemically synthesized
ctgcatttgaagcagggtctgg

SEQ ID NO: 1166459 - DNA, 22 bp, Artificial Sequence
  chemically synthesized
gctgcatttgaagcagggtctg

SEQ ID NO: 1166460 - DNA, 22 bp, Artificial Sequence
  chemically synthesized
cctatctgaaccagaccctgct

SEQ ID NO: 1166461 - DNA, 22 bp, Artificial Sequence
  chemically synthesized
ctatctgaaccagaccctgctt

SEQ ID NO: 1166462 - DNA, 22 bp, Artificial Sequence
  chemically synthesized
ttgctgcatttgaagcagggtc

SEQ ID NO: 1166463 - DNA, 22 bp, Artificial Sequence
  chemically synthesized
cttgctgcatttgaagcagggt

SEQ ID NO: 1166464 - DNA, 22 bp, Artificial Sequence
  chemically synthesized
tctgaaccagaccctgcttcaa

SEQ ID NO: 1166465 - DNA, 22 bp, Artificial Sequence
  chemically synthesized
ccttcttgctgcatttgaagca

SEQ ID NO: 1166466 - DNA, 22 bp, Artificial Sequence
  chemically synthesized
aaccagaccctgcttcaaatgc

SEQ ID NO: 1166467 - DNA, 22 bp, Artificial Sequence
  chemically synthesized
aaaaaattgccttcttgctgca

SEQ ID NO: 1166468 - DNA, 22 bp, Artificial Sequence
  chemically synthesized
gaaaaaattgccttcttgctgc

SEQ ID NO: 1166469 - DNA, 22 bp, Artificial Sequence
  chemically synthesized
ttgaaaaaattgccttcttgct

SEQ ID NO: 1166470 - DNA, 22 bp, Artificial Sequence
  chemically synthesized
cttgaaaaaattgccttcttgc

SEQ ID NO: 1166471 - DNA, 22 bp, Artificial Sequence
  chemically synthesized
cttcaaatgcagcaagaaggca

SEQ ID NO: 1166472 - DNA, 22 bp, Artificial Sequence
  chemically synthesized
tcttgaaaaaattgccttcttg

SEQ ID NO: 1166473 - DNA, 22 bp, Artificial Sequence
  chemically synthesized
caaatgcagcaagaaggcaatt

SEQ ID NO: 1166474 - DNA, 22 bp, Artificial Sequence
  chemically synthesized
aaatgcagcaagaaggcaattt

SEQ ID NO: 1166475 - DNA, 22 bp, Artificial Sequence
  chemically synthesized
tattttcttgaaaaaattgcct

SEQ ID NO: 1166476 - DNA, 22 bp, Artificial Sequence
  chemically synthesized
gtattttcttgaaaaaattgcc

SEQ ID NO: 1166477 - DNA, 22 bp, Artificial Sequence
  chemically synthesized
gtcgtttgtattttcttgaaaa

SEQ ID NO: 1166478 - DNA, 22 bp, Artificial Sequence
  chemically synthesized
ggtcgtttgtattttcttgaaa

SEQ ID NO: 1166479 - DNA, 22 bp, Artificial Sequence
  chemically synthesized
ttggtcgtttgtattttcttga

SEQ ID NO: 1166480 - DNA, 22 bp, Artificial Sequence
  chemically synthesized
cttggtcgtttgtattttcttg

SEQ ID NO: 1166481 - DNA, 22 bp, Artificial Sequence
  chemically synthesized
tttcaagaaaatacaaacgacc

SEQ ID NO: 1166482 - DNA, 22 bp, Artificial Sequence
  chemically synthesized
ttcaagaaaatacaaacgacca

SEQ ID NO: 1166483 - DNA, 22 bp, Artificial Sequence
  chemically synthesized
tcaagaaaatacaaacgaccaa

SEQ ID NO: 1166484 - DNA, 22 bp, Artificial Sequence
  chemically synthesized
caagaaaatacaaacgaccaag

SEQ ID NO: 1166485 - DNA, 22 bp, Artificial Sequence
  chemically synthesized
aagaaaatacaaacgaccaaga

SEQ ID NO: 1166486 - DNA, 22 bp, Artificial Sequence
  chemically synthesized
tcatatcctttcctactcctgt

SEQ ID NO: 1166487 - DNA, 22 bp, Artificial Sequence
  chemically synthesized
atataggaacataacaggagta

SEQ ID NO: 1166488 - DNA, 22 bp, Artificial Sequence
  chemically synthesized
gttcatataggaacataacagg

SEQ ID NO: 1166489 - DNA, 22 bp, Artificial Sequence
  chemically synthesized
tcctactcctgttatgttccta

SEQ ID NO: 1166490 - DNA, 22 bp, Artificial Sequence
  chemically synthesized
cctactcctgttatgttcctat

SEQ ID NO: 1166491 - DNA, 22 bp, Artificial Sequence
  chemically synthesized
ctactcctgttatgttcctata

SEQ ID NO: 1166492 - DNA, 22 bp, Artificial Sequence
  chemically synthesized
ctcctgttatgttcctatatga

SEQ ID NO: 1166493 - DNA, 22 bp, Artificial Sequence
  chemically synthesized
ctgttatgttcctatatgaacc

SEQ ID NO: 1166494 - DNA, 22 bp, Artificial Sequence
  chemically synthesized
agcataagtggttggttcatat

SEQ ID NO: 1166495 - DNA, 22 bp, Artificial Sequence
  chemically synthesized
cagcataagtggttggttcata

SEQ ID NO: 1166496 - DNA, 22 bp, Artificial Sequence
  chemically synthesized
ttatgttcctatatgaaccaac

SEQ ID NO: 1166497 - DNA, 22 bp, Artificial Sequence
  chemically synthesized
tgttcctatatgaaccaaccac

SEQ ID NO: 1166498 - DNA, 22 bp, Artificial Sequence
  chemically synthesized
ctatatgaaccaaccacttatg

SEQ ID NO: 1166499 - DNA, 22 bp, Artificial Sequence
  chemically synthesized
tatgaaccaaccacttatgctg

SEQ ID NO: 1166500 - DNA, 22 bp, Artificial Sequence
  chemically synthesized
tatcatcaatttcagcataagt

SEQ ID NO: 1166501 - DNA, 22 bp, Artificial Sequence
  chemically synthesized
tatatcatcaatttcagcataa

SEQ ID NO: 1166502 - DNA, 22 bp, Artificial Sequence
  chemically synthesized
ctatatcatcaatttcagcata

SEQ ID NO: 1166503 - DNA, 22 bp, Artificial Sequence
  chemically synthesized
tctatatcatcaatttcagcat

SEQ ID NO: 1166504 - DNA, 22 bp, Artificial Sequence
  chemically synthesized
tttctatatcatcaatttcagc

SEQ ID NO: 1166505 - DNA, 22 bp, Artificial Sequence
  chemically synthesized
ctttctatatcatcaatttcag

SEQ ID NO: 1166506 - DNA, 22 bp, Artificial Sequence
  chemically synthesized
tctttctatatcatcaatttca

SEQ ID NO: 1166507 - DNA, 22 bp, Artificial Sequence
  chemically synthesized
cctttctttctatatcatcaat

SEQ ID NO: 1166508 - DNA, 22 bp, Artificial Sequence
  chemically synthesized
atgctgaaattgatgatataga

SEQ ID NO: 1166509 - DNA, 22 bp, Artificial Sequence
  chemically synthesized
tgctgaaattgatgatatagaa

SEQ ID NO: 1166510 - DNA, 22 bp, Artificial Sequence
  chemically synthesized
aaattgatgatatagaaagaaa

SEQ ID NO: 1166511 - DNA, 22 bp, Artificial Sequence
  chemically synthesized
atgatatagaaagaaagggaat

SEQ ID NO: 1166512 - DNA, 22 bp, Artificial Sequence
  chemically synthesized
ccaaagtcacaagattcccttt

SEQ ID NO: 1166513 - DNA, 22 bp, Artificial Sequence
  chemically synthesized
ggtaactcccaaagtcacaaga

SEQ ID NO: 1166514 - DNA, 22 bp, Artificial Sequence
  chemically synthesized
tgcagggctaggtaactcccaa

SEQ ID NO: 1166515 - DNA, 22 bp, Artificial Sequence
  chemically synthesized
atgcagggctaggtaactccca

SEQ ID NO: 1166516 - DNA, 22 bp, Artificial Sequence
  chemically synthesized
gtgactttgggagttacctagc

SEQ ID NO: 1166517 - DNA, 22 bp, Artificial Sequence
  chemically synthesized
tgactttgggagttacctagcc

SEQ ID NO: 1166518 - DNA, 22 bp, Artificial Sequence
  chemically synthesized
aggcttatgcagggctaggtaa

SEQ ID NO: 1166519 - DNA, 22 bp, Artificial Sequence
  chemically synthesized
tgggagttacctagccctgcat

SEQ ID NO: 1166520 - DNA, 22 bp, Artificial Sequence
  chemically synthesized
gggagttacctagccctgcata

SEQ ID NO: 1166521 - DNA, 22 bp, Artificial Sequence
  chemically synthesized
ggagttacctagccctgcataa

SEQ ID NO: 1166522 - DNA, 22 bp, Artificial Sequence
  chemically synthesized
cctagccctgcataagccttag

SEQ ID NO: 1166523 - DNA, 22 bp, Artificial Sequence
  chemically synthesized
cagaagcagaaactaaggctta

SEQ ID NO: 1166524 - DNA, 22 bp, Artificial Sequence
  chemically synthesized
acagaagcagaaactaaggctt

SEQ ID NO: 1166525 - DNA, 22 bp, Artificial Sequence
  chemically synthesized
tacagaagcagaaactaaggct

SEQ ID NO: 1166526 - DNA, 22 bp, Artificial Sequence
  chemically synthesized
gccctgcataagccttagtttc

SEQ ID NO: 1166527 - DNA, 22 bp, Artificial Sequence
  chemically synthesized
ccattttacagaagcagaaact

SEQ ID NO: 1166528 - DNA, 22 bp, Artificial Sequence
  chemically synthesized
cataagccttagtttctgcttc

SEQ ID NO: 1166529 - DNA, 22 bp, Artificial Sequence
  chemically synthesized
ttcccattttacagaagcagaa

SEQ ID NO: 1166530 - DNA, 22 bp, Artificial Sequence
  chemically synthesized
ttgttcccattttacagaagca

SEQ ID NO: 1166531 - DNA, 22 bp, Artificial Sequence
  chemically synthesized
agtttctgcttctgtaaaatgg

SEQ ID NO: 1166532 - DNA, 22 bp, Artificial Sequence
  chemically synthesized
gtttctgcttctgtaaaatggg

SEQ ID NO: 1166533 - DNA, 22 bp, Artificial Sequence
  chemically synthesized
ctgcttctgtaaaatgggaaca

SEQ ID NO: 1166534 - DNA, 22 bp, Artificial Sequence
  chemically synthesized
tggaagtattattgttcccatt

SEQ ID NO: 1166535 - DNA, 22 bp, Artificial Sequence
  chemically synthesized
tgcttctgtaaaatgggaacaa

SEQ ID NO: 1166536 - DNA, 22 bp, Artificial Sequence
  chemically synthesized
cttctgtaaaatgggaacaata

SEQ ID NO: 1166537 - DNA, 22 bp, Artificial Sequence
  chemically synthesized
ttatggaagtattattgttccc

SEQ ID NO: 1166538 - DNA, 22 bp, Artificial Sequence
  chemically synthesized
attatggaagtattattgttcc

SEQ ID NO: 1166539 - DNA, 22 bp, Artificial Sequence
  chemically synthesized
ctgtaaaatgggaacaataata

SEQ ID NO: 1166540 - DNA, 22 bp, Artificial Sequence
  chemically synthesized
tgtaaaatgggaacaataatac

SEQ ID NO: 1166541 - DNA, 22 bp, Artificial Sequence
  chemically synthesized
taaaatgggaacaataatactt

SEQ ID NO: 1166542 - DNA, 22 bp, Artificial Sequence
  chemically synthesized
ccacaatcttattatggaagta

SEQ ID NO: 1166543 - DNA, 22 bp, Artificial Sequence
  chemically synthesized
accacaatcttattatggaagt

SEQ ID NO: 1166544 - DNA, 22 bp, Artificial Sequence
  chemically synthesized
ttaccacaatcttattatggaa

SEQ ID NO: 1166545 - DNA, 22 bp, Artificial Sequence
  chemically synthesized
attcttaccacaatcttattat

SEQ ID NO: 1166546 - DNA, 22 bp, Artificial Sequence
  chemically synthesized
aattcttaccacaatcttatta

SEQ ID NO: 1166547 - DNA, 22 bp, Artificial Sequence
  chemically synthesized
taattcttaccacaatcttatt

SEQ ID NO: 1166548 - DNA, 22 bp, Artificial Sequence
  chemically synthesized
tttaattcttaccacaatctta

SEQ ID NO: 1166549 - DNA, 22 bp, Artificial Sequence
  chemically synthesized
ccataataagattgtggtaaga

SEQ ID NO: 1166550 - DNA, 22 bp, Artificial Sequence
  chemically synthesized
cataataagattgtggtaagaa

SEQ ID NO: 1166551 - DNA, 22 bp, Artificial Sequence
  chemically synthesized
tgcactctttaattcttaccac

SEQ ID NO: 1166552 - DNA, 22 bp, Artificial Sequence
  chemically synthesized
tgaagtgcattatgcactcttt

SEQ ID NO: 1166553 - DNA, 22 bp, Artificial Sequence
  chemically synthesized
tggtaagaattaaagagtgcat

SEQ ID NO: 1166554 - DNA, 22 bp, Artificial Sequence
  chemically synthesized
tgtgaagtgcattatgcactct

SEQ ID NO: 1166555 - DNA, 22 bp, Artificial Sequence
  chemically synthesized
aagagtgcataatgcacttcac

SEQ ID NO: 1166556 - DNA, 22 bp, Artificial Sequence
  chemically synthesized
tacaaggtcactctgtgaagtg

SEQ ID NO: 1166557 - DNA, 22 bp, Artificial Sequence
  chemically synthesized
ttatacaaggtcactctgtgaa

SEQ ID NO: 1166558 - DNA, 22 bp, Artificial Sequence
  chemically synthesized
gttgttatacaaggtcactctg

SEQ ID NO: 1166559 - DNA, 22 bp, Artificial Sequence
  chemically synthesized
agttgttatacaaggtcactct

SEQ ID NO: 1166560 - DNA, 22 bp, Artificial Sequence
  chemically synthesized
tttagttgttatacaaggtcac

SEQ ID NO: 1166561 - DNA, 22 bp, Artificial Sequence
  chemically synthesized
atttagttgttatacaaggtca

SEQ ID NO: 1166562 - DNA, 22 bp, Artificial Sequence
  chemically synthesized
tatttagttgttatacaaggtc

SEQ ID NO: 1166563 - DNA, 22 bp, Artificial Sequence
  chemically synthesized
cacagagtgaccttgtataaca

SEQ ID NO: 1166564 - DNA, 22 bp, Artificial Sequence
  chemically synthesized
acagagtgaccttgtataacaa

SEQ ID NO: 1166565 - DNA, 22 bp, Artificial Sequence
  chemically synthesized
cagccgtaacatactttattta

SEQ ID NO: 1166566 - DNA, 22 bp, Artificial Sequence
  chemically synthesized
gtataacaactaaataaagtat

SEQ ID NO: 1166567 - DNA, 22 bp, Artificial Sequence
  chemically synthesized
tataacaactaaataaagtatg

SEQ ID NO: 1166568 - DNA, 22 bp, Artificial Sequence
  chemically synthesized
ataataattacagccgtaacat

SEQ ID NO: 1166569 - DNA, 22 bp, Artificial Sequence
  chemically synthesized
gataataattacagccgtaaca

SEQ ID NO: 1166570 - DNA, 22 bp, Artificial Sequence
  chemically synthesized
aataaagtatgttacggctgta

SEQ ID NO: 1166571 - DNA, 22 bp, Artificial Sequence
  chemically synthesized
cggctgtaattattatcaaatt

SEQ ID NO: 1166572 - DNA, 22 bp, Artificial Sequence
  chemically synthesized
tatatgcagaggaatttgataa

SEQ ID NO: 1166573 - DNA, 22 bp, Artificial Sequence
  chemically synthesized
atatatgcagaggaatttgata

SEQ ID NO: 1166574 - DNA, 22 bp, Artificial Sequence
  chemically synthesized
ttatatatgcagaggaatttga

SEQ ID NO: 1166575 - DNA, 22 bp, Artificial Sequence
  chemically synthesized
cttatatatgcagaggaatttg

SEQ ID NO: 1166576 - DNA, 22 bp, Artificial Sequence
  chemically synthesized
taattattatcaaattcctctg

SEQ ID NO: 1166577 - DNA, 22 bp, Artificial Sequence
  chemically synthesized
ttatcaaattcctctgcatata

SEQ ID NO: 1166578 - DNA, 22 bp, Artificial Sequence
  chemically synthesized
aaaacacttcttatatatgcag

SEQ ID NO: 1166579 - DNA, 22 bp, Artificial Sequence
  chemically synthesized
caaaacacttcttatatatgca

SEQ ID NO: 1166580 - DNA, 22 bp, Artificial Sequence
  chemically synthesized
tcaaattcctctgcatatataa

SEQ ID NO: 1166581 - DNA, 22 bp, Artificial Sequence
  chemically synthesized
tgcttcaaaacacttcttatat

SEQ ID NO: 1166582 - DNA, 22 bp, Artificial Sequence
  chemically synthesized
atgcttcaaaacacttcttata

SEQ ID NO: 1166583 - DNA, 22 bp, Artificial Sequence
  chemically synthesized
ctctgcatatataagaagtgtt

SEQ ID NO: 1166584 - DNA, 22 bp, Artificial Sequence
  chemically synthesized
tgcatatataagaagtgttttg

SEQ ID NO: 1166585 - DNA, 22 bp, Artificial Sequence
  chemically synthesized
catatataagaagtgttttgaa

SEQ ID NO: 1166586 - DNA, 22 bp, Artificial Sequence
  chemically synthesized
gggcaatttatgcttcaaaaca

SEQ ID NO: 1166587 - DNA, 22 bp, Artificial Sequence
  chemically synthesized
ggggcaatttatgcttcaaaac

SEQ ID NO: 1166588 - DNA, 22 bp, Artificial Sequence
  chemically synthesized
agaaggtaatcttggggcaatt

SEQ ID NO: 1166589 - DNA, 22 bp, Artificial Sequence
  chemically synthesized
aagaaggtaatcttggggcaat

SEQ ID NO: 1166590 - DNA, 22 bp, Artificial Sequence
  chemically synthesized
tgaagcataaattgccccaaga

SEQ ID NO: 1166591 - DNA, 22 bp, Artificial Sequence
  chemically synthesized
gaagcataaattgccccaagat

SEQ ID NO: 1166592 - DNA, 22 bp, Artificial Sequence
  chemically synthesized
aagcataaattgccccaagatt

SEQ ID NO: 1166593 - DNA, 22 bp, Artificial Sequence
  chemically synthesized
aacagtgacttaagaaggtaat

SEQ ID NO: 1166594 - DNA, 22 bp, Artificial Sequence
  chemically synthesized
ccccaagattaccttcttaagt

SEQ ID NO: 1166595 - DNA, 22 bp, Artificial Sequence
  chemically synthesized
aaacctgaacagtgacttaaga

SEQ ID NO: 1166596 - DNA, 22 bp, Artificial Sequence
  chemically synthesized
ctgaaacctgaacagtgactta

SEQ ID NO: 1166597 - DNA, 22 bp, Artificial Sequence
  chemically synthesized
ccttcttaagtcactgttcagg

SEQ ID NO: 1166598 - DNA, 22 bp, Artificial Sequence
  chemically synthesized
catctcctgaaacctgaacagt

SEQ ID NO: 1166599 - DNA, 22 bp, Artificial Sequence
  chemically synthesized
ccatctcctgaaacctgaacag

SEQ ID NO: 1166600 - DNA, 22 bp, Artificial Sequence
  chemically synthesized
tccatctcctgaaacctgaaca

SEQ ID NO: 1166601 - DNA, 22 bp, Artificial Sequence
  chemically synthesized
cttaagtcactgttcaggtttc

SEQ ID NO: 1166602 - DNA, 22 bp, Artificial Sequence
  chemically synthesized
ttaagtcactgttcaggtttca

SEQ ID NO: 1166603 - DNA, 22 bp, Artificial Sequence
  chemically synthesized
aagtcactgttcaggtttcagg

SEQ ID NO: 1166604 - DNA, 22 bp, Artificial Sequence
  chemically synthesized
agtcactgttcaggtttcagga

SEQ ID NO: 1166605 - DNA, 22 bp, Artificial Sequence
  chemically synthesized
gacaataattttccatctcctg

SEQ ID NO: 1166606 - DNA, 22 bp, Artificial Sequence
  chemically synthesized
cgacaataattttccatctcct

SEQ ID NO: 1166607 - DNA, 22 bp, Artificial Sequence
  chemically synthesized
tcgacaataattttccatctcc

SEQ ID NO: 1166608 - DNA, 22 bp, Artificial Sequence
  chemically synthesized
ttcaggtttcaggagatggaaa

SEQ ID NO: 1166609 - DNA, 22 bp, Artificial Sequence
  chemically synthesized
aggtttcaggagatggaaaatt

SEQ ID NO: 1166610 - DNA, 22 bp, Artificial Sequence
  chemically synthesized
caggagatggaaaattattgtc

SEQ ID NO: 1166611 - DNA, 22 bp, Artificial Sequence
  chemically synthesized
aggagatggaaaattattgtcg

SEQ ID NO: 1166612 - DNA, 22 bp, Artificial Sequence
  chemically synthesized
ggggcgtattttcgacaataat

SEQ ID NO: 1166613 - DNA, 22 bp, Artificial Sequence
  chemically synthesized
gggggcgtattttcgacaataa

SEQ ID NO: 1166614 - DNA, 22 bp, Artificial Sequence
  chemically synthesized
tgggggcgtattttcgacaata

SEQ ID NO: 1166615 - DNA, 22 bp, Artificial Sequence
  chemically synthesized
ttgggggcgtattttcgacaat

SEQ ID NO: 1166616 - DNA, 22 bp, Artificial Sequence
  chemically synthesized
cacatttttgggggcgtatttt

SEQ ID NO: 1166617 - DNA, 22 bp, Artificial Sequence
  chemically synthesized
acacatttttgggggcgtattt

SEQ ID NO: 1166618 - DNA, 22 bp, Artificial Sequence
  chemically synthesized
ttacacatttttgggggcgtat

SEQ ID NO: 1166619 - DNA, 22 bp, Artificial Sequence
  chemically synthesized
ttgtcgaaaatacgcccccaaa

SEQ ID NO: 1166620 - DNA, 22 bp, Artificial Sequence
  chemically synthesized
ctcttacacatttttgggggcg

SEQ ID NO: 1166621 - DNA, 22 bp, Artificial Sequence
  chemically synthesized
gctcttacacatttttgggggc

SEQ ID NO: 1166622 - DNA, 22 bp, Artificial Sequence
  chemically synthesized
tcgaaaatacgcccccaaaaat

SEQ ID NO: 1166623 - DNA, 22 bp, Artificial Sequence
  chemically synthesized
aataatgtttgctcttacacat

SEQ ID NO: 1166624 - DNA, 22 bp, Artificial Sequence
  chemically synthesized
aaaaagagttaaataatgtttg

SEQ ID NO: 1166625 - DNA, 22 bp, Artificial Sequence
  chemically synthesized
caaaaagagttaaataatgttt

SEQ ID NO: 1166626 - DNA, 22 bp, Artificial Sequence
  chemically synthesized
agatttcaaaaagagttaaata

SEQ ID NO: 1166627 - DNA, 22 bp, Artificial Sequence
  chemically synthesized
aggttcagatttcaaaaagagt

SEQ ID NO: 1166628 - DNA, 22 bp, Artificial Sequence
  chemically synthesized
ggttaaggttcagatttcaaaa

SEQ ID NO: 1166629 - DNA, 22 bp, Artificial Sequence
  chemically synthesized
tttaactctttttgaaatctga

SEQ ID NO: 1166630 - DNA, 22 bp, Artificial Sequence
  chemically synthesized
aactctttttgaaatctgaacc

SEQ ID NO: 1166631 - DNA, 22 bp, Artificial Sequence
  chemically synthesized
actctttttgaaatctgaacct

SEQ ID NO: 1166632 - DNA, 22 bp, Artificial Sequence
  chemically synthesized
tttttgaaatctgaaccttaac

SEQ ID NO: 1166633 - DNA, 22 bp, Artificial Sequence
  chemically synthesized
aatacgagctaggttaaggttc

SEQ ID NO: 1166634 - DNA, 22 bp, Artificial Sequence
  chemically synthesized
aaatacgagctaggttaaggtt

SEQ ID NO: 1166635 - DNA, 22 bp, Artificial Sequence
  chemically synthesized
tttgaaatctgaaccttaacct

SEQ ID NO: 1166636 - DNA, 22 bp, Artificial Sequence
  chemically synthesized
ttgaaatctgaaccttaaccta

SEQ ID NO: 1166637 - DNA, 22 bp, Artificial Sequence
  chemically synthesized
ttaaatacgagctaggttaagg

SEQ ID NO: 1166638 - DNA, 22 bp, Artificial Sequence
  chemically synthesized
tgaaatctgaaccttaacctag

SEQ ID NO: 1166639 - DNA, 22 bp, Artificial Sequence
  chemically synthesized
gaaatctgaaccttaacctagc

SEQ ID NO: 1166640 - DNA, 22 bp, Artificial Sequence
  chemically synthesized
aaatctgaaccttaacctagct

SEQ ID NO: 1166641 - DNA, 22 bp, Artificial Sequence
  chemically synthesized
agaactcttaaatacgagctag

SEQ ID NO: 1166642 - DNA, 22 bp, Artificial Sequence
  chemically synthesized
aagaactcttaaatacgagcta

SEQ ID NO: 1166643 - DNA, 22 bp, Artificial Sequence
  chemically synthesized
taagaactcttaaatacgagct

SEQ ID NO: 1166644 - DNA, 22 bp, Artificial Sequence
  chemically synthesized
aaccttaacctagctcgtattt

SEQ ID NO: 1166645 - DNA, 22 bp, Artificial Sequence
  chemically synthesized
ttaagaactcttaaatacgagc

SEQ ID NO: 1166646 - DNA, 22 bp, Artificial Sequence
  chemically synthesized
aacctagctcgtatttaagagt

SEQ ID NO: 1166647 - DNA, 22 bp, Artificial Sequence
  chemically synthesized
acctagctcgtatttaagagtt

SEQ ID NO: 1166648 - DNA, 22 bp, Artificial Sequence
  chemically synthesized
atgatttttaagaactcttaaa

SEQ ID NO: 1166649 - DNA, 22 bp, Artificial Sequence
  chemically synthesized
gctcgtatttaagagttcttaa

SEQ ID NO: 1166650 - DNA, 22 bp, Artificial Sequence
  chemically synthesized
gtatttaagagttcttaaaaat

SEQ ID NO: 1166651 - DNA, 22 bp, Artificial Sequence
  chemically synthesized
aagatagttaatgatttttaag

SEQ ID NO: 1166652 - DNA, 22 bp, Artificial Sequence
  chemically synthesized
aagagttcttaaaaatcattaa

SEQ ID NO: 1166653 - DNA, 22 bp, Artificial Sequence
  chemically synthesized
aactcaagatagttaatgattt

SEQ ID NO: 1166654 - DNA, 22 bp, Artificial Sequence
  chemically synthesized
agagttcttaaaaatcattaac

SEQ ID NO: 1166655 - DNA, 22 bp, Artificial Sequence
  chemically synthesized
gaactcaagatagttaatgatt

SEQ ID NO: 1166656 - DNA, 22 bp, Artificial Sequence
  chemically synthesized
tttgaactcaagatagttaatg

SEQ ID NO: 1166657 - DNA, 22 bp, Artificial Sequence
  chemically synthesized
ttaaaaatcattaactatcttg

SEQ ID NO: 1166658 - DNA, 22 bp, Artificial Sequence
  chemically synthesized
aaaaatcattaactatcttgag

SEQ ID NO: 1166659 - DNA, 22 bp, Artificial Sequence
  chemically synthesized
aaaatcattaactatcttgagt

SEQ ID NO: 1166660 - DNA, 22 bp, Artificial Sequence
  chemically synthesized
gagaagattatttgaactcaag

SEQ ID NO: 1166661 - DNA, 22 bp, Artificial Sequence
  chemically synthesized
ggagaagattatttgaactcaa

SEQ ID NO: 1166662 - DNA, 22 bp, Artificial Sequence
  chemically synthesized
gtttggagaagattatttgaac

SEQ ID NO: 1166663 - DNA, 22 bp, Artificial Sequence
  chemically synthesized
cgtttggagaagattatttgaa

SEQ ID NO: 1166664 - DNA, 22 bp, Artificial Sequence
  chemically synthesized
actatcttgagttcaaataatc

SEQ ID NO: 1166665 - DNA, 22 bp, Artificial Sequence
  chemically synthesized
tcttgagttcaaataatcttct

SEQ ID NO: 1166666 - DNA, 22 bp, Artificial Sequence
  chemically synthesized
caatgcttcgtttggagaagat

SEQ ID NO: 1166667 - DNA, 22 bp, Artificial Sequence
  chemically synthesized
gagttcaaataatcttctccaa

SEQ ID NO: 1166668 - DNA, 22 bp, Artificial Sequence
  chemically synthesized
acaatgcttcgtttggagaaga

SEQ ID NO: 1166669 - DNA, 22 bp, Artificial Sequence
  chemically synthesized
agttcaaataatcttctccaaa

SEQ ID NO: 1166670 - DNA, 22 bp, Artificial Sequence
  chemically synthesized
tttacaatgcttcgtttggaga

SEQ ID NO: 1166671 - DNA, 22 bp, Artificial Sequence
  chemically synthesized
aaataatcttctccaaacgaag

SEQ ID NO: 1166672 - DNA, 22 bp, Artificial Sequence
  chemically synthesized
gtgctgtttacaatgcttcgtt

SEQ ID NO: 1166673 - DNA, 22 bp, Artificial Sequence
  chemically synthesized
ctccaaacgaagcattgtaaac

SEQ ID NO: 1166674 - DNA, 22 bp, Artificial Sequence
  chemically synthesized
agtattagtgctgtttacaatg

SEQ ID NO: 1166675 - DNA, 22 bp, Artificial Sequence
  chemically synthesized
tccaaacgaagcattgtaaaca

SEQ ID NO: 1166676 - DNA, 22 bp, Artificial Sequence
  chemically synthesized
gagtattagtgctgtttacaat

SEQ ID NO: 1166677 - DNA, 22 bp, Artificial Sequence
  chemically synthesized
caaacgaagcattgtaaacagc

SEQ ID NO: 1166678 - DNA, 22 bp, Artificial Sequence
  chemically synthesized
cttgagtattagtgctgtttac

SEQ ID NO: 1166679 - DNA, 22 bp, Artificial Sequence
  chemically synthesized
tgttacttgagtattagtgctg

SEQ ID NO: 1166680 - DNA, 22 bp, Artificial Sequence
  chemically synthesized
taaacagcactaatactcaagt

SEQ ID NO: 1166681 - DNA, 22 bp, Artificial Sequence
  chemically synthesized
cacagtgtaaagtattgtgtta

SEQ ID NO: 1166682 - DNA, 22 bp, Artificial Sequence
  chemically synthesized
atactcaagtaacacaatactt

SEQ ID NO: 1166683 - DNA, 22 bp, Artificial Sequence
  chemically synthesized
aaattgcacagtgtaaagtatt

SEQ ID NO: 1166684 - DNA, 22 bp, Artificial Sequence
  chemically synthesized
aagtaacacaatactttacact

SEQ ID NO: 1166685 - DNA, 22 bp, Artificial Sequence
  chemically synthesized
attcaaattgcacagtgtaaag

SEQ ID NO: 1166686 - DNA, 22 bp, Artificial Sequence
  chemically synthesized
gattcaaattgcacagtgtaaa

SEQ ID NO: 1166687 - DNA, 22 bp, Artificial Sequence
  chemically synthesized
tgattcaaattgcacagtgtaa

SEQ ID NO: 1166688 - DNA, 22 bp, Artificial Sequence
  chemically synthesized
atattttgattcaaattgcaca

SEQ ID NO: 1166689 - DNA, 22 bp, Artificial Sequence
  chemically synthesized
aatattttgattcaaattgcac

SEQ ID NO: 1166690 - DNA, 22 bp, Artificial Sequence
  chemically synthesized
tacactgtgcaatttgaatcaa

SEQ ID NO: 1166691 - DNA, 22 bp, Artificial Sequence
  chemically synthesized
acactgtgcaatttgaatcaaa

SEQ ID NO: 1166692 - DNA, 22 bp, Artificial Sequence
  chemically synthesized
cactgtgcaatttgaatcaaaa

SEQ ID NO: 1166693 - DNA, 22 bp, Artificial Sequence
  chemically synthesized
tgcaatttgaatcaaaatatta

SEQ ID NO: 1166694 - DNA, 22 bp, Artificial Sequence
  chemically synthesized
gaatcaaaatattaaacacttt

SEQ ID NO: 1166695 - DNA, 22 bp, Artificial Sequence
  chemically synthesized
aatcaaaatattaaacacttta

SEQ ID NO: 1166696 - DNA, 22 bp, Artificial Sequence
  chemically synthesized
tgtaaatatcaataaatcataa

SEQ ID NO: 1166697 - DNA, 22 bp, Artificial Sequence
  chemically synthesized
aacactttatgatttattgata

SEQ ID NO: 1166698 - DNA, 22 bp, Artificial Sequence
  chemically synthesized
aatcctgtgtaaatatcaataa

SEQ ID NO: 1166699 - DNA, 22 bp, Artificial Sequence
  chemically synthesized
tatgatttattgatatttacac

SEQ ID NO: 1166700 - DNA, 22 bp, Artificial Sequence
  chemically synthesized
atgatttattgatatttacaca

SEQ ID NO: 1166701 - DNA, 22 bp, Artificial Sequence
  chemically synthesized
tgatttattgatatttacacag

SEQ ID NO: 1166702 - DNA, 22 bp, Artificial Sequence
  chemically synthesized
caaaattcaatcctgtgtaaat

SEQ ID NO: 1166703 - DNA, 22 bp, Artificial Sequence
  chemically synthesized
ccaaaattcaatcctgtgtaaa

SEQ ID NO: 1166704 - DNA, 22 bp, Artificial Sequence
  chemically synthesized
ttccaaaattcaatcctgtgta

SEQ ID NO: 1166705 - DNA, 22 bp, Artificial Sequence
  chemically synthesized
cttccaaaattcaatcctgtgt

SEQ ID NO: 1166706 - DNA, 22 bp, Artificial Sequence
  chemically synthesized
tcttccaaaattcaatcctgtg

SEQ ID NO: 1166707 - DNA, 22 bp, Artificial Sequence
  chemically synthesized
attgatatttacacaggattga

SEQ ID NO: 1166708 - DNA, 22 bp, Artificial Sequence
  chemically synthesized
ttgatatttacacaggattgaa

SEQ ID NO: 1166709 - DNA, 22 bp, Artificial Sequence
  chemically synthesized
atatttacacaggattgaattt

SEQ ID NO: 1166710 - DNA, 22 bp, Artificial Sequence
  chemically synthesized
atattttcttccaaaattcaat

SEQ ID NO: 1166711 - DNA, 22 bp, Artificial Sequence
  chemically synthesized
aatattttcttccaaaattcaa

SEQ ID NO: 1166712 - DNA, 22 bp, Artificial Sequence
  chemically synthesized
taatattttcttccaaaattca

SEQ ID NO: 1166713 - DNA, 22 bp, Artificial Sequence
  chemically synthesized
ttaatattttcttccaaaattc

SEQ ID NO: 1166714 - DNA, 22 bp, Artificial Sequence
  chemically synthesized
acacaggattgaattttggaag

SEQ ID NO: 1166715 - DNA, 22 bp, Artificial Sequence
  chemically synthesized
cacaggattgaattttggaaga

SEQ ID NO: 1166716 - DNA, 22 bp, Artificial Sequence
  chemically synthesized
aattttggaagaaaatattaaa

SEQ ID NO: 1166717 - DNA, 22 bp, Artificial Sequence
  chemically synthesized
tggaagaaaatattaaaaggtg

SEQ ID NO: 1166718 - DNA, 22 bp, Artificial Sequence
  chemically synthesized
agtataagtatacaccttttaa

SEQ ID NO: 1166719 - DNA, 22 bp, Artificial Sequence
  chemically synthesized
ggaagaaaatattaaaaggtgt

SEQ ID NO: 1166720 - DNA, 22 bp, Artificial Sequence
  chemically synthesized
gagtataagtatacacctttta

SEQ ID NO: 1166721 - DNA, 22 bp, Artificial Sequence
  chemically synthesized
gaagaaaatattaaaaggtgta

SEQ ID NO: 1166722 - DNA, 22 bp, Artificial Sequence
  chemically synthesized
aaaggtgtatacttatactcaa

SEQ ID NO: 1166723 - DNA, 22 bp, Artificial Sequence
  chemically synthesized
gatgtcatgtccttgagtataa

SEQ ID NO: 1166724 - DNA, 22 bp, Artificial Sequence
  chemically synthesized
agtactagatgtcatgtccttg

SEQ ID NO: 1166725 - DNA, 22 bp, Artificial Sequence
  chemically synthesized
gagtactagatgtcatgtcctt

SEQ ID NO: 1166726 - DNA, 22 bp, Artificial Sequence
  chemically synthesized
atactcaaggacatgacatcta

SEQ ID NO: 1166727 - DNA, 22 bp, Artificial Sequence
  chemically synthesized
tactcaaggacatgacatctag

SEQ ID NO: 1166728 - DNA, 22 bp, Artificial Sequence
  chemically synthesized
agaatttgagtactagatgtca

SEQ ID NO: 1166729 - DNA, 22 bp, Artificial Sequence
  chemically synthesized
aaggacatgacatctagtactc

SEQ ID NO: 1166730 - DNA, 22 bp, Artificial Sequence
  chemically synthesized
ggttcagaatttgagtactaga

SEQ ID NO: 1166731 - DNA, 22 bp, Artificial Sequence
  chemically synthesized
aggttcagaatttgagtactag

SEQ ID NO: 1166732 - DNA, 22 bp, Artificial Sequence
  chemically synthesized
agacaaaatatttaggttcaga

SEQ ID NO: 1166733 - DNA, 22 bp, Artificial Sequence
  chemically synthesized
gtactcaaattctgaacctaaa

SEQ ID NO: 1166734 - DNA, 22 bp, Artificial Sequence
  chemically synthesized
aaattctgaacctaaatatttt

SEQ ID NO: 1166735 - DNA, 22 bp, Artificial Sequence
  chemically synthesized
tgcacatcctcagacaaaatat

SEQ ID NO: 1166736 - DNA, 22 bp, Artificial Sequence
  chemically synthesized
atgcacatcctcagacaaaata

SEQ ID NO: 1166737 - DNA, 22 bp, Artificial Sequence
  chemically synthesized
tatgcacatcctcagacaaaat

SEQ ID NO: 1166738 - DNA, 22 bp, Artificial Sequence
  chemically synthesized
tgaacctaaatattttgtctga

SEQ ID NO: 1166739 - DNA, 22 bp, Artificial Sequence
  chemically synthesized
aacctaaatattttgtctgagg

SEQ ID NO: 1166740 - DNA, 22 bp, Artificial Sequence
  chemically synthesized
ttttatgcacatcctcagacaa

SEQ ID NO: 1166741 - DNA, 22 bp, Artificial Sequence
  chemically synthesized
gttttatgcacatcctcagaca

SEQ ID NO: 1166742 - DNA, 22 bp, Artificial Sequence
  chemically synthesized
tgttttatgcacatcctcagac

SEQ ID NO: 1166743 - DNA, 22 bp, Artificial Sequence
  chemically synthesized
ttgttttatgcacatcctcaga

SEQ ID NO: 1166744 - DNA, 22 bp, Artificial Sequence
  chemically synthesized
aatattttgtctgaggatgtgc

SEQ ID NO: 1166745 - DNA, 22 bp, Artificial Sequence
  chemically synthesized
aaatgtttttgttttatgcaca

SEQ ID NO: 1166746 - DNA, 22 bp, Artificial Sequence
  chemically synthesized
gaaatgtttttgttttatgcac

SEQ ID NO: 1166747 - DNA, 22 bp, Artificial Sequence
  chemically synthesized
tgtctgaggatgtgcataaaac

SEQ ID NO: 1166748 - DNA, 22 bp, Artificial Sequence
  chemically synthesized
tgaaatgtttttgttttatgca

SEQ ID NO: 1166749 - DNA, 22 bp, Artificial Sequence
  chemically synthesized
gtctgaggatgtgcataaaaca

SEQ ID NO: 1166750 - DNA, 22 bp, Artificial Sequence
  chemically synthesized
tctgaggatgtgcataaaacaa

SEQ ID NO: 1166751 - DNA, 22 bp, Artificial Sequence
  chemically synthesized
tctttgaaatgtttttgtttta

SEQ ID NO: 1166752 - DNA, 22 bp, Artificial Sequence
  chemically synthesized
aggatgtgcataaaacaaaaac

SEQ ID NO: 1166753 - DNA, 22 bp, Artificial Sequence
  chemically synthesized
agaaggctgtctttgaaatgtt

SEQ ID NO: 1166754 - DNA, 22 bp, Artificial Sequence
  chemically synthesized
aagaaggctgtctttgaaatgt

SEQ ID NO: 1166755 - DNA, 22 bp, Artificial Sequence
  chemically synthesized
taagaaggctgtctttgaaatg

SEQ ID NO: 1166756 - DNA, 22 bp, Artificial Sequence
  chemically synthesized
tctttaagaaggctgtctttga

SEQ ID NO: 1166757 - DNA, 22 bp, Artificial Sequence
  chemically synthesized
atctttaagaaggctgtctttg

SEQ ID NO: 1166758 - DNA, 22 bp, Artificial Sequence
  chemically synthesized
aatttatctttaagaaggctgt

SEQ ID NO: 1166759 - DNA, 22 bp, Artificial Sequence
  chemically synthesized
gaatttatctttaagaaggctg

SEQ ID NO: 1166760 - DNA, 22 bp, Artificial Sequence
  chemically synthesized
caaagacagccttcttaaagat

SEQ ID NO: 1166761 - DNA, 22 bp, Artificial Sequence
  chemically synthesized
agatttgaatttatctttaaga

SEQ ID NO: 1166762 - DNA, 22 bp, Artificial Sequence
  chemically synthesized
aaagacagccttcttaaagata

SEQ ID NO: 1166763 - DNA, 22 bp, Artificial Sequence
  chemically synthesized
ttcagatttgaatttatcttta

SEQ ID NO: 1166764 - DNA, 22 bp, Artificial Sequence
  chemically synthesized
attcagatttgaatttatcttt

SEQ ID NO: 1166765 - DNA, 22 bp, Artificial Sequence
  chemically synthesized
catagcttattcagatttgaat

SEQ ID NO: 1166766 - DNA, 22 bp, Artificial Sequence
  chemically synthesized
cttaaagataaattcaaatctg

SEQ ID NO: 1166767 - DNA, 22 bp, Artificial Sequence
  chemically synthesized
gcatagcttattcagatttgaa

SEQ ID NO: 1166768 - DNA, 22 bp, Artificial Sequence
  chemically synthesized
ttaaagataaattcaaatctga

SEQ ID NO: 1166769 - DNA, 22 bp, Artificial Sequence
  chemically synthesized
tgcatagcttattcagatttga

SEQ ID NO: 1166770 - DNA, 22 bp, Artificial Sequence
  chemically synthesized
aaagataaattcaaatctgaat

SEQ ID NO: 1166771 - DNA, 22 bp, Artificial Sequence
  chemically synthesized
aagataaattcaaatctgaata

SEQ ID NO: 1166772 - DNA, 22 bp, Artificial Sequence
  chemically synthesized
aaatctgaataagctatgcaaa

SEQ ID NO: 1166773 - DNA, 22 bp, Artificial Sequence
  chemically synthesized
aataagctatgcaaaattttat

SEQ ID NO: 1166774 - DNA, 22 bp, Artificial Sequence
  chemically synthesized
atggatataaatataaaatttt

SEQ ID NO: 1166775 - DNA, 22 bp, Artificial Sequence
  chemically synthesized
aattgatggatataaatataaa

SEQ ID NO: 1166776 - DNA, 22 bp, Artificial Sequence
  chemically synthesized
tgcaaaattttatatttatatc

SEQ ID NO: 1166777 - DNA, 22 bp, Artificial Sequence
  chemically synthesized
tatatttatatccatcaattca

SEQ ID NO: 1166778 - DNA, 22 bp, Artificial Sequence
  chemically synthesized
tatatatatagttgaattgatg

SEQ ID NO: 1166779 - DNA, 22 bp, Artificial Sequence
  chemically synthesized
atatttatatccatcaattcaa

SEQ ID NO: 1166780 - DNA, 22 bp, Artificial Sequence
  chemically synthesized
tatttatatccatcaattcaac

SEQ ID NO: 1166781 - DNA, 22 bp, Artificial Sequence
  chemically synthesized
tgtatatatatagttgaattga

SEQ ID NO: 1166782 - DNA, 22 bp, Artificial Sequence
  chemically synthesized
atatccatcaattcaactatat

SEQ ID NO: 1166783 - DNA, 22 bp, Artificial Sequence
  chemically synthesized
tatccatcaattcaactatata

SEQ ID NO: 1166784 - DNA, 22 bp, Artificial Sequence
  chemically synthesized
taattctgtatatatatagttg

SEQ ID NO: 1166785 - DNA, 22 bp, Artificial Sequence
  chemically synthesized
attataattctgtatatatata

SEQ ID NO: 1166786 - DNA, 22 bp, Artificial Sequence
  chemically synthesized
gattataattctgtatatatat

SEQ ID NO: 1166787 - DNA, 22 bp, Artificial Sequence
  chemically synthesized
tgattataattctgtatatata

SEQ ID NO: 1166788 - DNA, 22 bp, Artificial Sequence
  chemically synthesized
aaattttgattataattctgta

SEQ ID NO: 1166789 - DNA, 22 bp, Artificial Sequence
  chemically synthesized
aactatatatatacagaattat

SEQ ID NO: 1166790 - DNA, 22 bp, Artificial Sequence
  chemically synthesized
aattcaaattttgattataatt

SEQ ID NO: 1166791 - DNA, 22 bp, Artificial Sequence
  chemically synthesized
tatatatacagaattataatca

SEQ ID NO: 1166792 - DNA, 22 bp, Artificial Sequence
  chemically synthesized
aaattcaaattttgattataat

SEQ ID NO: 1166793 - DNA, 22 bp, Artificial Sequence
  chemically synthesized
agatcttaaattcaaattttga

SEQ ID NO: 1166794 - DNA, 22 bp, Artificial Sequence
  chemically synthesized
ctcagatcttaaattcaaattt

SEQ ID NO: 1166795 - DNA, 22 bp, Artificial Sequence
  chemically synthesized
taatcaaaatttgaatttaaga

SEQ ID NO: 1166796 - DNA, 22 bp, Artificial Sequence
  chemically synthesized
gacaaataattactcagatctt

SEQ ID NO: 1166797 - DNA, 22 bp, Artificial Sequence
  chemically synthesized
tctagacaaataattactcaga

SEQ ID NO: 1166798 - DNA, 22 bp, Artificial Sequence
  chemically synthesized
gaatttaagatctgagtaatta

SEQ ID NO: 1166799 - DNA, 22 bp, Artificial Sequence
  chemically synthesized
aatttaagatctgagtaattat

SEQ ID NO: 1166800 - DNA, 22 bp, Artificial Sequence
  chemically synthesized
aagatctgagtaattatttgtc

SEQ ID NO: 1166801 - DNA, 22 bp, Artificial Sequence
  chemically synthesized
agatctgagtaattatttgtct

SEQ ID NO: 1166802 - DNA, 22 bp, Artificial Sequence
  chemically synthesized
aaaaacaatagtctatctagac

SEQ ID NO: 1166803 - DNA, 22 bp, Artificial Sequence
  chemically synthesized
agtaattatttgtctagataga

SEQ ID NO: 1166804 - DNA, 22 bp, Artificial Sequence
  chemically synthesized
gaaaaacaatagtctatctaga

SEQ ID NO: 1166805 - DNA, 22 bp, Artificial Sequence
  chemically synthesized
caatttgaaaaacaatagtcta

SEQ ID NO: 1166806 - DNA, 22 bp, Artificial Sequence
  chemically synthesized
acaatttgaaaaacaatagtct

SEQ ID NO: 1166807 - DNA, 22 bp, Artificial Sequence
  chemically synthesized
tttgtctagatagactattgtt

SEQ ID NO: 1166808 - DNA, 22 bp, Artificial Sequence
  chemically synthesized
gtctagatagactattgttttt

SEQ ID NO: 1166809 - DNA, 22 bp, Artificial Sequence
  chemically synthesized
acttacaatttgaaaaacaata

SEQ ID NO: 1166810 - DNA, 22 bp, Artificial Sequence
  chemically synthesized
tctagatagactattgtttttc

SEQ ID NO: 1166811 - DNA, 22 bp, Artificial Sequence
  chemically synthesized
tgacttacaatttgaaaaacaa

SEQ ID NO: 1166812 - DNA, 22 bp, Artificial Sequence
  chemically synthesized
gatagactattgtttttcaaat

SEQ ID NO: 1166813 - DNA, 22 bp, Artificial Sequence
  chemically synthesized
ttgtttttcaaattgtaagtca

SEQ ID NO: 1166814 - DNA, 22 bp, Artificial Sequence
  chemically synthesized
tttttcaaattgtaagtcagaa

SEQ ID NO: 1166815 - DNA, 22 bp, Artificial Sequence
  chemically synthesized
ttcaaattgtaagtcagaatcc

SEQ ID NO: 1166816 - DNA, 22 bp, Artificial Sequence
  chemically synthesized
tgaaccatgaatggattctgac

SEQ ID NO: 1166817 - DNA, 22 bp, Artificial Sequence
  chemically synthesized
tcaaattgtaagtcagaatcca

SEQ ID NO: 1166818 - DNA, 22 bp, Artificial Sequence
  chemically synthesized
atgaaccatgaatggattctga

SEQ ID NO: 1166819 - DNA, 22 bp, Artificial Sequence
  chemically synthesized
caaattgtaagtcagaatccat

SEQ ID NO: 1166820 - DNA, 22 bp, Artificial Sequence
  chemically synthesized
tatgaaccatgaatggattctg

SEQ ID NO: 1166821 - DNA, 22 bp, Artificial Sequence
  chemically synthesized
aaattgtaagtcagaatccatt

SEQ ID NO: 1166822 - DNA, 22 bp, Artificial Sequence
  chemically synthesized
taagtcagaatccattcatggt

SEQ ID NO: 1166823 - DNA, 22 bp, Artificial Sequence
  chemically synthesized
acatgattttatgaaccatgaa

SEQ ID NO: 1166824 - DNA, 22 bp, Artificial Sequence
  chemically synthesized
ctaacatgattttatgaaccat

SEQ ID NO: 1166825 - DNA, 22 bp, Artificial Sequence
  chemically synthesized
gtcataacctactaacatgatt

SEQ ID NO: 1166826 - DNA, 22 bp, Artificial Sequence
  chemically synthesized
atggttcataaaatcatgttag

SEQ ID NO: 1166827 - DNA, 22 bp, Artificial Sequence
  chemically synthesized
ctagtcataacctactaacatg

SEQ ID NO: 1166828 - DNA, 22 bp, Artificial Sequence
  chemically synthesized
ataaaatcatgttagtaggtta

SEQ ID NO: 1166829 - DNA, 22 bp, Artificial Sequence
  chemically synthesized
aaatattcctagtcataaccta

SEQ ID NO: 1166830 - DNA, 22 bp, Artificial Sequence
  chemically synthesized
aaaatattcctagtcataacct

SEQ ID NO: 1166831 - DNA, 22 bp, Artificial Sequence
  chemically synthesized
taaaatattcctagtcataacc

SEQ ID NO: 1166832 - DNA, 22 bp, Artificial Sequence
  chemically synthesized
attttaaaatattcctagtcat

SEQ ID NO: 1166833 - DNA, 22 bp, Artificial Sequence
  chemically synthesized
aattttaaaatattcctagtca

SEQ ID NO: 1166834 - DNA, 22 bp, Artificial Sequence
  chemically synthesized
tttaattttaaaatattcctag

SEQ ID NO: 1166835 - DNA, 22 bp, Artificial Sequence
  chemically synthesized
gtaggttatgactaggaatatt

SEQ ID NO: 1166836 - DNA, 22 bp, Artificial Sequence
  chemically synthesized
tgtttaattttaaaatattcct

SEQ ID NO: 1166837 - DNA, 22 bp, Artificial Sequence
  chemically synthesized
ctgtttaattttaaaatattcc

SEQ ID NO: 1166838 - DNA, 22 bp, Artificial Sequence
  chemically synthesized
tctgtttaattttaaaatattc

SEQ ID NO: 1166839 - DNA, 22 bp, Artificial Sequence
  chemically synthesized
ttctgtttaattttaaaatatt

SEQ ID NO: 1166840 - DNA, 22 bp, Artificial Sequence
  chemically synthesized
tttttctgtttaattttaaaat

SEQ ID NO: 1166841 - DNA, 22 bp, Artificial Sequence
  chemically synthesized
tgactaggaatattttaaaatt

SEQ ID NO: 1166842 - DNA, 22 bp, Artificial Sequence
  chemically synthesized
ctatttttctgtttaattttaa

SEQ ID NO: 1166843 - DNA, 22 bp, Artificial Sequence
  chemically synthesized
ggaatattttaaaattaaacag

SEQ ID NO: 1166844 - DNA, 22 bp, Artificial Sequence
  chemically synthesized
taaaattaaacagaaaaatagt

SEQ ID NO: 1166845 - DNA, 22 bp, Artificial Sequence
  chemically synthesized
aaaattaaacagaaaaatagta

SEQ ID NO: 1166846 - DNA, 22 bp, Artificial Sequence
  chemically synthesized
aaattaaacagaaaaatagtag

SEQ ID NO: 1166847 - DNA, 22 bp, Artificial Sequence
  chemically synthesized
tataagtgacacagactactat

SEQ ID NO: 1166848 - DNA, 22 bp, Artificial Sequence
  chemically synthesized
aacagaaaaatagtagtctgtg

SEQ ID NO: 1166849 - DNA, 22 bp, Artificial Sequence
  chemically synthesized
gtattatataagtgacacagac

SEQ ID NO: 1166850 - DNA, 22 bp, Artificial Sequence
  chemically synthesized
ttagtattatataagtgacaca

SEQ ID NO: 1166851 - DNA, 22 bp, Artificial Sequence
  chemically synthesized
agacaataattgttagtattat

SEQ ID NO: 1166852 - DNA, 22 bp, Artificial Sequence
  chemically synthesized
tgtcacttatataatactaaca

SEQ ID NO: 1166853 - DNA, 22 bp, Artificial Sequence
  chemically synthesized
atataatactaacaattattgt

SEQ ID NO: 1166854 - DNA, 22 bp, Artificial Sequence
  chemically synthesized
tataatactaacaattattgtc

SEQ ID NO: 1166855 - DNA, 22 bp, Artificial Sequence
  chemically synthesized
aaacaaaaattgagacaataat

SEQ ID NO: 1166856 - DNA, 22 bp, Artificial Sequence
  chemically synthesized
acaattattgtctcaatttttg

SEQ ID NO: 1166857 - DNA, 22 bp, Artificial Sequence
  chemically synthesized
ttgtctcaatttttgtttcaga

SEQ ID NO: 1166858 - DNA, 22 bp, Artificial Sequence
  chemically synthesized
tctcaatttttgtttcagatgt

SEQ ID NO: 1166859 - DNA, 22 bp, Artificial Sequence
  chemically synthesized
aatttttgtttcagatgtgcat

SEQ ID NO: 1166860 - DNA, 22 bp, Artificial Sequence
  chemically synthesized
ttgtttcagatgtgcatatggg

SEQ ID NO: 1166861 - DNA, 22 bp, Artificial Sequence
  chemically synthesized
tgtttcagatgtgcatatgggt

SEQ ID NO: 1166862 - DNA, 22 bp, Artificial Sequence
  chemically synthesized
gtttcagatgtgcatatgggtt

SEQ ID NO: 1166863 - DNA, 22 bp, Artificial Sequence
  chemically synthesized
tttcagatgtgcatatgggttt

SEQ ID NO: 1166864 - DNA, 22 bp, Artificial Sequence
  chemically synthesized
cagatgtgcatatgggtttatt

SEQ ID NO: 1166865 - DNA, 22 bp, Artificial Sequence
  chemically synthesized
agatgtgcatatgggtttattt

SEQ ID NO: 1166866 - DNA, 22 bp, Artificial Sequence
  chemically synthesized
gaacatatatacatatacatat

SEQ ID NO: 1166867 - DNA, 22 bp, Artificial Sequence
  chemically synthesized
agaacatatatacatatacata

SEQ ID NO: 1166868 - DNA, 22 bp, Artificial Sequence
  chemically synthesized
attttgatatgtatatgtatat

SEQ ID NO: 1166869 - DNA, 22 bp, Artificial Sequence
  chemically synthesized
accttagaacatatatacatat

SEQ ID NO: 1166870 - DNA, 22 bp, Artificial Sequence
  chemically synthesized
ttttgatatgtatatgtatata

SEQ ID NO: 1166871 - DNA, 22 bp, Artificial Sequence
  chemically synthesized
tgatatgtatatgtatatatgt

SEQ ID NO: 1166872 - DNA, 22 bp, Artificial Sequence
  chemically synthesized
gatatgtatatgtatatatgtt

SEQ ID NO: 1166873 - DNA, 22 bp, Artificial Sequence
  chemically synthesized
atctcaccttagaacatatata

SEQ ID NO: 1166874 - DNA, 22 bp, Artificial Sequence
  chemically synthesized
atatgtatatgtatatatgttc

SEQ ID NO: 1166875 - DNA, 22 bp, Artificial Sequence
  chemically synthesized
aatctcaccttagaacatatat

SEQ ID NO: 1166876 - DNA, 22 bp, Artificial Sequence
  chemically synthesized
cagaaaaaagtttaatctcacc

SEQ ID NO: 1166877 - DNA, 22 bp, Artificial Sequence
  chemically synthesized
caaactgcagaaaaaagtttaa

SEQ ID NO: 1166878 - DNA, 22 bp, Artificial Sequence
  chemically synthesized
acaaactgcagaaaaaagttta

SEQ ID NO: 1166879 - DNA, 22 bp, Artificial Sequence
  chemically synthesized
taaggtgagattaaactttttt

SEQ ID NO: 1166880 - DNA, 22 bp, Artificial Sequence
  chemically synthesized
tacaaactgcagaaaaaagttt

SEQ ID NO: 1166881 - DNA, 22 bp, Artificial Sequence
  chemically synthesized
aggtgagattaaacttttttct

SEQ ID NO: 1166882 - DNA, 22 bp, Artificial Sequence
  chemically synthesized
ttttacaaactgcagaaaaaag

SEQ ID NO: 1166883 - DNA, 22 bp, Artificial Sequence
  chemically synthesized
gttttacaaactgcagaaaaaa

SEQ ID NO: 1166884 - DNA, 22 bp, Artificial Sequence
  chemically synthesized
tgttttacaaactgcagaaaaa

SEQ ID NO: 1166885 - DNA, 22 bp, Artificial Sequence
  chemically synthesized
caattttgttttacaaactgca

SEQ ID NO: 1166886 - DNA, 22 bp, Artificial Sequence
  chemically synthesized
ccaattttgttttacaaactgc

SEQ ID NO: 1166887 - DNA, 22 bp, Artificial Sequence
  chemically synthesized
aacttttttctgcagtttgtaa

SEQ ID NO: 1166888 - DNA, 22 bp, Artificial Sequence
  chemically synthesized
ttttctgcagtttgtaaaacaa

SEQ ID NO: 1166889 - DNA, 22 bp, Artificial Sequence
  chemically synthesized
tttctgcagtttgtaaaacaaa

SEQ ID NO: 1166890 - DNA, 22 bp, Artificial Sequence
  chemically synthesized
ttctgcagtttgtaaaacaaaa

SEQ ID NO: 1166891 - DNA, 22 bp, Artificial Sequence
  chemically synthesized
tctgcagtttgtaaaacaaaat

SEQ ID NO: 1166892 - DNA, 22 bp, Artificial Sequence
  chemically synthesized
gagccatttccaattttgtttt

SEQ ID NO: 1166893 - DNA, 22 bp, Artificial Sequence
  chemically synthesized
ctgcagtttgtaaaacaaaatt

SEQ ID NO: 1166894 - DNA, 22 bp, Artificial Sequence
  chemically synthesized
tgcagtttgtaaaacaaaattg

SEQ ID NO: 1166895 - DNA, 22 bp, Artificial Sequence
  chemically synthesized
tagagccatttccaattttgtt

SEQ ID NO: 1166896 - DNA, 22 bp, Artificial Sequence
  chemically synthesized
cagtttgtaaaacaaaattgga

SEQ ID NO: 1166897 - DNA, 22 bp, Artificial Sequence
  chemically synthesized
aaattctagagccatttccaat

SEQ ID NO: 1166898 - DNA, 22 bp, Artificial Sequence
  chemically synthesized
gtaaaacaaaattggaaatggc

SEQ ID NO: 1166899 - DNA, 22 bp, Artificial Sequence
  chemically synthesized
taaaacaaaattggaaatggct

SEQ ID NO: 1166900 - DNA, 22 bp, Artificial Sequence
  chemically synthesized
gtctgaaattctagagccattt

SEQ ID NO: 1166901 - DNA, 22 bp, Artificial Sequence
  chemically synthesized
agtctgaaattctagagccatt

SEQ ID NO: 1166902 - DNA, 22 bp, Artificial Sequence
  chemically synthesized
cttagtctgaaattctagagcc

SEQ ID NO: 1166903 - DNA, 22 bp, Artificial Sequence
  chemically synthesized
gcttagtctgaaattctagagc

SEQ ID NO: 1166904 - DNA, 22 bp, Artificial Sequence
  chemically synthesized
gaaatggctctagaatttcaga

SEQ ID NO: 1166905 - DNA, 22 bp, Artificial Sequence
  chemically synthesized
gtcggtttgcttagtctgaaat

SEQ ID NO: 1166906 - DNA, 22 bp, Artificial Sequence
  chemically synthesized
cgtcggtttgcttagtctgaaa

SEQ ID NO: 1166907 - DNA, 22 bp, Artificial Sequence
  chemically synthesized
tcgtcggtttgcttagtctgaa

SEQ ID NO: 1166908 - DNA, 22 bp, Artificial Sequence
  chemically synthesized
ttcgtcggtttgcttagtctga

SEQ ID NO: 1166909 - DNA, 22 bp, Artificial Sequence
  chemically synthesized
tttcgtcggtttgcttagtctg

SEQ ID NO: 1166910 - DNA, 22 bp, Artificial Sequence
  chemically synthesized
ttttcgtcggtttgcttagtct

SEQ ID NO: 1166911 - DNA, 22 bp, Artificial Sequence
  chemically synthesized
ttttttcgtcggtttgcttagt

SEQ ID NO: 1166912 - DNA, 22 bp, Artificial Sequence
  chemically synthesized
tagaatttcagactaagcaaac

SEQ ID NO: 1166913 - DNA, 22 bp, Artificial Sequence
  chemically synthesized
cttttttcgtcggtttgcttag

SEQ ID NO: 1166914 - DNA, 22 bp, Artificial Sequence
  chemically synthesized
gaatttcagactaagcaaaccg

SEQ ID NO: 1166915 - DNA, 22 bp, Artificial Sequence
  chemically synthesized
cagactaagcaaaccgacgaaa

SEQ ID NO: 1166916 - DNA, 22 bp, Artificial Sequence
  chemically synthesized
agactaagcaaaccgacgaaaa

SEQ ID NO: 1166917 - DNA, 22 bp, Artificial Sequence
  chemically synthesized
aggcaaatttcttttttcgtcg

SEQ ID NO: 1166918 - DNA, 22 bp, Artificial Sequence
  chemically synthesized
agcaaaccgacgaaaaaagaaa

SEQ ID NO: 1166919 - DNA, 22 bp, Artificial Sequence
  chemically synthesized
tggaaaatatacaaatgtagaa

SEQ ID NO: 1166920 - DNA, 22 bp, Artificial Sequence
  chemically synthesized
tatggaaaatatacaaatgtag

SEQ ID NO: 1166921 - DNA, 22 bp, Artificial Sequence
  chemically synthesized
gcctgaattctacatttgtata

SEQ ID NO: 1166922 - DNA, 22 bp, Artificial Sequence
  chemically synthesized
cctgaattctacatttgtatat

SEQ ID NO: 1166923 - DNA, 22 bp, Artificial Sequence
  chemically synthesized
aattctacatttgtatattttc

SEQ ID NO: 1166924 - DNA, 22 bp, Artificial Sequence
  chemically synthesized
caaggtctctatggaaaatata

SEQ ID NO: 1166925 - DNA, 22 bp, Artificial Sequence
  chemically synthesized
ttccaaggtctctatggaaaat

SEQ ID NO: 1166926 - DNA, 22 bp, Artificial Sequence
  chemically synthesized
tacatttgtatattttccatag

SEQ ID NO: 1166927 - DNA, 22 bp, Artificial Sequence
  chemically synthesized
attccaaggtctctatggaaaa

SEQ ID NO: 1166928 - DNA, 22 bp, Artificial Sequence
  chemically synthesized
tattccaaggtctctatggaaa

SEQ ID NO: 1166929 - DNA, 22 bp, Artificial Sequence
  chemically synthesized
catttgtatattttccatagag

SEQ ID NO: 1166930 - DNA, 22 bp, Artificial Sequence
  chemically synthesized
ttattccaaggtctctatggaa

SEQ ID NO: 1166931 - DNA, 22 bp, Artificial Sequence
  chemically synthesized
gtatattttccatagagacctt

SEQ ID NO: 1166932 - DNA, 22 bp, Artificial Sequence
  chemically synthesized
tatattttccatagagaccttg

SEQ ID NO: 1166933 - DNA, 22 bp, Artificial Sequence
  chemically synthesized
aaatgtcttttattccaaggtc

SEQ ID NO: 1166934 - DNA, 22 bp, Artificial Sequence
  chemically synthesized
aaaatgtcttttattccaaggt

SEQ ID NO: 1166935 - DNA, 22 bp, Artificial Sequence
  chemically synthesized
taaaatgtcttttattccaagg

SEQ ID NO: 1166936 - DNA, 22 bp, Artificial Sequence
  chemically synthesized
tccatagagaccttggaataaa

SEQ ID NO: 1166937 - DNA, 22 bp, Artificial Sequence
  chemically synthesized
ccatagagaccttggaataaaa

SEQ ID NO: 1166938 - DNA, 22 bp, Artificial Sequence
  chemically synthesized
ttttaaaatgtcttttattcca

SEQ ID NO: 1166939 - DNA, 22 bp, Artificial Sequence
  chemically synthesized
catagagaccttggaataaaag

SEQ ID NO: 1166940 - DNA, 22 bp, Artificial Sequence
  chemically synthesized
attttaaaatgtcttttattcc

SEQ ID NO: 1166941 - DNA, 22 bp, Artificial Sequence
  chemically synthesized
tattttaaaatgtcttttattc

SEQ ID NO: 1166942 - DNA, 22 bp, Artificial Sequence
  chemically synthesized
aacatcgttttattttaaaatg

SEQ ID NO: 1166943 - DNA, 22 bp, Artificial Sequence
  chemically synthesized
ggaataaaagacattttaaaat

SEQ ID NO: 1166944 - DNA, 22 bp, Artificial Sequence
  chemically synthesized
gaataaaagacattttaaaata

SEQ ID NO: 1166945 - DNA, 22 bp, Artificial Sequence
  chemically synthesized
agattaaacatcgttttatttt

SEQ ID NO: 1166946 - DNA, 22 bp, Artificial Sequence
  chemically synthesized
tcagattaaacatcgttttatt

SEQ ID NO: 1166947 - DNA, 22 bp, Artificial Sequence
  chemically synthesized
caaattctcagattaaacatcg

SEQ ID NO: 1166948 - DNA, 22 bp, Artificial Sequence
  chemically synthesized
ccaaattctcagattaaacatc

SEQ ID NO: 1166949 - DNA, 22 bp, Artificial Sequence
  chemically synthesized
taaaataaaacgatgtttaatc

SEQ ID NO: 1166950 - DNA, 22 bp, Artificial Sequence
  chemically synthesized
aaaataaaacgatgtttaatct

SEQ ID NO: 1166951 - DNA, 22 bp, Artificial Sequence
  chemically synthesized
aaataaaacgatgtttaatctg

SEQ ID NO: 1166952 - DNA, 22 bp, Artificial Sequence
  chemically synthesized
tttccaaattctcagattaaac

SEQ ID NO: 1166953 - DNA, 22 bp, Artificial Sequence
  chemically synthesized
atttccaaattctcagattaaa

SEQ ID NO: 1166954 - DNA, 22 bp, Artificial Sequence
  chemically synthesized
tatttccaaattctcagattaa

SEQ ID NO: 1166955 - DNA, 22 bp, Artificial Sequence
  chemically synthesized
tatctttatttccaaattctca

SEQ ID NO: 1166956 - DNA, 22 bp, Artificial Sequence
  chemically synthesized
atatctttatttccaaattctc

SEQ ID NO: 1166957 - DNA, 22 bp, Artificial Sequence
  chemically synthesized
tatatctttatttccaaattct

SEQ ID NO: 1166958 - DNA, 22 bp, Artificial Sequence
  chemically synthesized
ttatatctttatttccaaattc

SEQ ID NO: 1166959 - DNA, 22 bp, Artificial Sequence
  chemically synthesized
tttatatctttatttccaaatt

SEQ ID NO: 1166960 - DNA, 22 bp, Artificial Sequence
  chemically synthesized
aatctgagaatttggaaataaa

SEQ ID NO: 1166961 - DNA, 22 bp, Artificial Sequence
  chemically synthesized
atctgagaatttggaaataaag

SEQ ID NO: 1166962 - DNA, 22 bp, Artificial Sequence
  chemically synthesized
agaatttggaaataaagatata

SEQ ID NO: 1166963 - DNA, 22 bp, Artificial Sequence
  chemically synthesized
ggaaataaagatataaaaagtg

SEQ ID NO: 1166964 - DNA, 22 bp, Artificial Sequence
  chemically synthesized
gaaataaagatataaaaagtgg

SEQ ID NO: 1166965 - DNA, 22 bp, Artificial Sequence
  chemically synthesized
aaacaaagcataagccactttt

SEQ ID NO: 1166966 - DNA, 22 bp, Artificial Sequence
  chemically synthesized
gggtgctgaaacaaagcataag

SEQ ID NO: 1166967 - DNA, 22 bp, Artificial Sequence
  chemically synthesized
ggggtgctgaaacaaagcataa

SEQ ID NO: 1166968 - DNA, 22 bp, Artificial Sequence
  chemically synthesized
tggggtgctgaaacaaagcata

SEQ ID NO: 1166969 - DNA, 22 bp, Artificial Sequence
  chemically synthesized
atgctttgtttcagcaccccaa

SEQ ID NO: 1166970 - DNA, 22 bp, Artificial Sequence
  chemically synthesized
tgctttgtttcagcaccccaaa

SEQ ID NO: 1166971 - DNA, 22 bp, Artificial Sequence
  chemically synthesized
tgtttcagcaccccaaaatatg

SEQ ID NO: 1166972 - DNA, 22 bp, Artificial Sequence
  chemically synthesized
tgatgataaaaacatattttgg

SEQ ID NO: 1166973 - DNA, 22 bp, Artificial Sequence
  chemically synthesized
gtttcagcaccccaaaatatgt

SEQ ID NO: 1166974 - DNA, 22 bp, Artificial Sequence
  chemically synthesized
tttcagcaccccaaaatatgtt

SEQ ID NO: 1166975 - DNA, 22 bp, Artificial Sequence
  chemically synthesized
tgtgatgataaaaacatatttt

SEQ ID NO: 1166976 - DNA, 22 bp, Artificial Sequence
  chemically synthesized
cagcaccccaaaatatgttttt

SEQ ID NO: 1166977 - DNA, 22 bp, Artificial Sequence
  chemically synthesized
agcaccccaaaatatgttttta

SEQ ID NO: 1166978 - DNA, 22 bp, Artificial Sequence
  chemically synthesized
ggtacaatgtaaaattctgtga

SEQ ID NO: 1166979 - DNA, 22 bp, Artificial Sequence
  chemically synthesized
aggtacaatgtaaaattctgtg

SEQ ID NO: 1166980 - DNA, 22 bp, Artificial Sequence
  chemically synthesized
ttatcatcacagaattttacat

SEQ ID NO: 1166981 - DNA, 22 bp, Artificial Sequence
  chemically synthesized
tatcatcacagaattttacatt

SEQ ID NO: 1166982 - DNA, 22 bp, Artificial Sequence
  chemically synthesized
atcatcacagaattttacattg

SEQ ID NO: 1166983 - DNA, 22 bp, Artificial Sequence
  chemically synthesized
caatcttaggtacaatgtaaaa

SEQ ID NO: 1166984 - DNA, 22 bp, Artificial Sequence
  chemically synthesized
tcatcacagaattttacattgt

SEQ ID NO: 1166985 - DNA, 22 bp, Artificial Sequence
  chemically synthesized
tacattgtacctaagattggag

SEQ ID NO: 1166986 - DNA, 22 bp, Artificial Sequence
  chemically synthesized
acattgtacctaagattggaga

SEQ ID NO: 1166987 - DNA, 22 bp, Artificial Sequence
  chemically synthesized
cattgtacctaagattggagat

SEQ ID NO: 1166988 - DNA, 22 bp, Artificial Sequence
  chemically synthesized
tacctaagattggagatcactt

SEQ ID NO: 1166989 - DNA, 22 bp, Artificial Sequence
  chemically synthesized
atgccatgacatgtatgaagtg

SEQ ID NO: 1166990 - DNA, 22 bp, Artificial Sequence
  chemically synthesized
agattggagatcacttcataca

SEQ ID NO: 1166991 - DNA, 22 bp, Artificial Sequence
  chemically synthesized
gatgccatgacatgtatgaagt

SEQ ID NO: 1166992 - DNA, 22 bp, Artificial Sequence
  chemically synthesized
atttgatgccatgacatgtatg

SEQ ID NO: 1166993 - DNA, 22 bp, Artificial Sequence
  chemically synthesized
catttgatgccatgacatgtat

SEQ ID NO: 1166994 - DNA, 22 bp, Artificial Sequence
  chemically synthesized
gagatcacttcatacatgtcat

SEQ ID NO: 1166995 - DNA, 22 bp, Artificial Sequence
  chemically synthesized
ttcatttgatgccatgacatgt

SEQ ID NO: 1166996 - DNA, 22 bp, Artificial Sequence
  chemically synthesized
catacatgtcatggcatcaaat

SEQ ID NO: 1166997 - DNA, 22 bp, Artificial Sequence
  chemically synthesized
gaaaatctcttcatttgatgcc

SEQ ID NO: 1166998 - DNA, 22 bp, Artificial Sequence
  chemically synthesized
atacatgtcatggcatcaaatg

SEQ ID NO: 1166999 - DNA, 22 bp, Artificial Sequence
  chemically synthesized
ctagaaaatctcttcatttgat

SEQ ID NO: 1167000 - DNA, 22 bp, Artificial Sequence
  chemically synthesized
cctagaaaatctcttcatttga

SEQ ID NO: 1167001 - DNA, 22 bp, Artificial Sequence
  chemically synthesized
tcctagaaaatctcttcatttg

SEQ ID NO: 1167002 - DNA, 22 bp, Artificial Sequence
  chemically synthesized
taaagaacaaaaaccaactttc

SEQ ID NO: 1167003 - DNA, 22 bp, Artificial Sequence
  chemically synthesized
tctaggaaagttggtttttgtt

SEQ ID NO: 1167004 - DNA, 22 bp, Artificial Sequence
  chemically synthesized
ctaggaaagttggtttttgttc

SEQ ID NO: 1167005 - DNA, 22 bp, Artificial Sequence
  chemically synthesized
taggaaagttggtttttgttct

SEQ ID NO: 1167006 - DNA, 22 bp, Artificial Sequence
  chemically synthesized
ggaaagttggtttttgttcttt

SEQ ID NO: 1167007 - DNA, 22 bp, Artificial Sequence
  chemically synthesized
taaatagatctataaagaacaa

SEQ ID NO: 1167008 - DNA, 22 bp, Artificial Sequence
  chemically synthesized
ataaatagatctataaagaaca

SEQ ID NO: 1167009 - DNA, 22 bp, Artificial Sequence
  chemically synthesized
ttataaatagatctataaagaa

SEQ ID NO: 1167010 - DNA, 22 bp, Artificial Sequence
  chemically synthesized
cttataaatagatctataaaga

SEQ ID NO: 1167011 - DNA, 22 bp, Artificial Sequence
  chemically synthesized
tcttataaatagatctataaag

SEQ ID NO: 1167012 - DNA, 22 bp, Artificial Sequence
  chemically synthesized
gtttttgttctttatagatcta

SEQ ID NO: 1167013 - DNA, 22 bp, Artificial Sequence
  chemically synthesized
tctttcttataaatagatctat

SEQ ID NO: 1167014 - DNA, 22 bp, Artificial Sequence
  chemically synthesized
ttgttctttatagatctattta

SEQ ID NO: 1167015 - DNA, 22 bp, Artificial Sequence
  chemically synthesized
tgttctttatagatctatttat

SEQ ID NO: 1167016 - DNA, 22 bp, Artificial Sequence
  chemically synthesized
gttctttatagatctatttata

SEQ ID NO: 1167017 - DNA, 22 bp, Artificial Sequence
  chemically synthesized
ttctttatagatctatttataa

SEQ ID NO: 1167018 - DNA, 22 bp, Artificial Sequence
  chemically synthesized
gggtctatctttcttataaata

SEQ ID NO: 1167019 - DNA, 22 bp, Artificial Sequence
  chemically synthesized
tttatagatctatttataagaa

SEQ ID NO: 1167020 - DNA, 22 bp, Artificial Sequence
  chemically synthesized
tatagatctatttataagaaag

SEQ ID NO: 1167021 - DNA, 22 bp, Artificial Sequence
  chemically synthesized
atagatctatttataagaaaga

SEQ ID NO: 1167022 - DNA, 22 bp, Artificial Sequence
  chemically synthesized
tagatctatttataagaaagat

SEQ ID NO: 1167023 - DNA, 22 bp, Artificial Sequence
  chemically synthesized
atgaaacgattggggtctatct

SEQ ID NO: 1167024 - DNA, 22 bp, Artificial Sequence
  chemically synthesized
tttataagaaagatagacccca

SEQ ID NO: 1167025 - DNA, 22 bp, Artificial Sequence
  chemically synthesized
attcatgaaacgattggggtct

SEQ ID NO: 1167026 - DNA, 22 bp, Artificial Sequence
  chemically synthesized
ataagaaagatagaccccaatc

SEQ ID NO: 1167027 - DNA, 22 bp, Artificial Sequence
  chemically synthesized
cattcatgaaacgattggggtc

SEQ ID NO: 1167028 - DNA, 22 bp, Artificial Sequence
  chemically synthesized
taagaaagatagaccccaatcg

SEQ ID NO: 1167029 - DNA, 22 bp, Artificial Sequence
  chemically synthesized
gcatcttcattcatgaaacgat

SEQ ID NO: 1167030 - DNA, 22 bp, Artificial Sequence
  chemically synthesized
atgatactggcatcttcattca

SEQ ID NO: 1167031 - DNA, 22 bp, Artificial Sequence
  chemically synthesized
cagttgatgatactggcatctt

SEQ ID NO: 1167032 - DNA, 22 bp, Artificial Sequence
  chemically synthesized
catgaatgaagatgccagtatc

SEQ ID NO: 1167033 - DNA, 22 bp, Artificial Sequence
  chemically synthesized
gttccagttgatgatactggca

SEQ ID NO: 1167034 - DNA, 22 bp, Artificial Sequence
  chemically synthesized
atgaatgaagatgccagtatca

SEQ ID NO: 1167035 - DNA, 22 bp, Artificial Sequence
  chemically synthesized
aagcataggaaaaataattagt

SEQ ID NO: 1167036 - DNA, 22 bp, Artificial Sequence
  chemically synthesized
gaactaattatttttcctatgc

SEQ ID NO: 1167037 - DNA, 22 bp, Artificial Sequence
  chemically synthesized
attatttttcctatgcttcaat

SEQ ID NO: 1167038 - DNA, 22 bp, Artificial Sequence
  chemically synthesized
tttttcctatgcttcaatccta

SEQ ID NO: 1167039 - DNA, 22 bp, Artificial Sequence
  chemically synthesized
tgataaagacaaaataggattg

SEQ ID NO: 1167040 - DNA, 22 bp, Artificial Sequence
  chemically synthesized
ttcctatgcttcaatcctattt

SEQ ID NO: 1167041 - DNA, 22 bp, Artificial Sequence
  chemically synthesized
tcctatgcttcaatcctatttt

SEQ ID NO: 1167042 - DNA, 22 bp, Artificial Sequence
  chemically synthesized
cctatgcttcaatcctattttg

SEQ ID NO: 1167043 - DNA, 22 bp, Artificial Sequence
  chemically synthesized
ctgtgataaagacaaaatagga

SEQ ID NO: 1167044 - DNA, 22 bp, Artificial Sequence
  chemically synthesized
ctatgcttcaatcctattttgt

SEQ ID NO: 1167045 - DNA, 22 bp, Artificial Sequence
  chemically synthesized
tgcttcaatcctattttgtctt

SEQ ID NO: 1167046 - DNA, 22 bp, Artificial Sequence
  chemically synthesized
caatcctattttgtctttatca

SEQ ID NO: 1167047 - DNA, 22 bp, Artificial Sequence
  chemically synthesized
aatcctattttgtctttatcac

SEQ ID NO: 1167048 - DNA, 22 bp, Artificial Sequence
  chemically synthesized
ttttgtctttatcacagtagtt

SEQ ID NO: 1167049 - DNA, 22 bp, Artificial Sequence
  chemically synthesized
aagagaaacataaactactgtg

SEQ ID NO: 1167050 - DNA, 22 bp, Artificial Sequence
  chemically synthesized
tgtctttatcacagtagtttat

SEQ ID NO: 1167051 - DNA, 22 bp, Artificial Sequence
  chemically synthesized
gtctttatcacagtagtttatg

SEQ ID NO: 1167052 - DNA, 22 bp, Artificial Sequence
  chemically synthesized
tctttatcacagtagtttatgt

SEQ ID NO: 1167053 - DNA, 22 bp, Artificial Sequence
  chemically synthesized
tatcacagtagtttatgtttct

SEQ ID NO: 1167054 - DNA, 22 bp, Artificial Sequence
  chemically synthesized
atcacagtagtttatgtttctc

SEQ ID NO: 1167055 - DNA, 22 bp, Artificial Sequence
  chemically synthesized
tcacagtagtttatgtttctct

SEQ ID NO: 1167056 - DNA, 22 bp, Artificial Sequence
  chemically synthesized
cccaatgtactgaagagaaaca

SEQ ID NO: 1167057 - DNA, 22 bp, Artificial Sequence
  chemically synthesized
gcccaatgtactgaagagaaac

SEQ ID NO: 1167058 - DNA, 22 bp, Artificial Sequence
  chemically synthesized
tttgcccaatgtactgaagaga

SEQ ID NO: 1167059 - DNA, 22 bp, Artificial Sequence
  chemically synthesized
atgtttctcttcagtacattgg

SEQ ID NO: 1167060 - DNA, 22 bp, Artificial Sequence
  chemically synthesized
tgtttctcttcagtacattggg

SEQ ID NO: 1167061 - DNA, 22 bp, Artificial Sequence
  chemically synthesized
ctcttcagtacattgggcaaat

SEQ ID NO: 1167062 - DNA, 22 bp, Artificial Sequence
  chemically synthesized
atcgtaatcattatttgcccaa

SEQ ID NO: 1167063 - DNA, 22 bp, Artificial Sequence
  chemically synthesized
tcttcagtacattgggcaaata

SEQ ID NO: 1167064 - DNA, 22 bp, Artificial Sequence
  chemically synthesized
tcatcgtaatcattatttgccc

SEQ ID NO: 1167065 - DNA, 22 bp, Artificial Sequence
  chemically synthesized
ttcagtacattgggcaaataat

SEQ ID NO: 1167066 - DNA, 22 bp, Artificial Sequence
  chemically synthesized
cagtacattgggcaaataatga

SEQ ID NO: 1167067 - DNA, 22 bp, Artificial Sequence
  chemically synthesized
agtacattgggcaaataatgat

SEQ ID NO: 1167068 - DNA, 22 bp, Artificial Sequence
  chemically synthesized
tcatgcctctcatcgtaatcat

SEQ ID NO: 1167069 - DNA, 22 bp, Artificial Sequence
  chemically synthesized
ggcaaataatgattacgatgag

SEQ ID NO: 1167070 - DNA, 22 bp, Artificial Sequence
  chemically synthesized
actgtcatgcctctcatcgtaa

SEQ ID NO: 1167071 - DNA, 22 bp, Artificial Sequence
  chemically synthesized
atccattcactgtcatgcctct

SEQ ID NO: 1167072 - DNA, 22 bp, Artificial Sequence
  chemically synthesized
catccattcactgtcatgcctc

SEQ ID NO: 1167073 - DNA, 22 bp, Artificial Sequence
  chemically synthesized
cgatgagaggcatgacagtgaa

SEQ ID NO: 1167074 - DNA, 22 bp, Artificial Sequence
  chemically synthesized
ggggaaaaaaaaaaaacaaaaa

SEQ ID NO: 1167075 - DNA, 22 bp, Artificial Sequence
  chemically synthesized
gggggaaaaaaaaaaaacaaaa

SEQ ID NO: 1167076 - DNA, 22 bp, Artificial Sequence
  chemically synthesized
tgggggaaaaaaaaaaaacaaa

SEQ ID NO: 1167077 - DNA, 22 bp, Artificial Sequence
  chemically synthesized
aattttgggggaaaaaaaaaaa

SEQ ID NO: 1167078 - DNA, 22 bp, Artificial Sequence
  chemically synthesized
tgtttttgttttttttttttcc

SEQ ID NO: 1167079 - DNA, 22 bp, Artificial Sequence
  chemically synthesized
tttttgttttttttttttcccc

SEQ ID NO: 1167080 - DNA, 22 bp, Artificial Sequence
  chemically synthesized
ttgttttttttttttcccccaa

SEQ ID NO: 1167081 - DNA, 22 bp, Artificial Sequence
  chemically synthesized
tgttttttttttttcccccaaa

SEQ ID NO: 1167082 - DNA, 22 bp, Artificial Sequence
  chemically synthesized
agtgtactcaattttgggggaa

SEQ ID NO: 1167083 - DNA, 22 bp, Artificial Sequence
  chemically synthesized
gttttttttttttcccccaaaa

SEQ ID NO: 1167084 - DNA, 22 bp, Artificial Sequence
  chemically synthesized
gagtgtactcaattttggggga

SEQ ID NO: 1167085 - DNA, 22 bp, Artificial Sequence
  chemically synthesized
ttttttttttttcccccaaaat

SEQ ID NO: 1167086 - DNA, 22 bp, Artificial Sequence
  chemically synthesized
tttttttttcccccaaaattga

SEQ ID NO: 1167087 - DNA, 22 bp, Artificial Sequence
  chemically synthesized
ttttttttcccccaaaattgag

SEQ ID NO: 1167088 - DNA, 22 bp, Artificial Sequence
  chemically synthesized
tttttttcccccaaaattgagt

SEQ ID NO: 1167089 - DNA, 22 bp, Artificial Sequence
  chemically synthesized
ttttttcccccaaaattgagta

SEQ ID NO: 1167090 - DNA, 22 bp, Artificial Sequence
  chemically synthesized
tttttcccccaaaattgagtac

SEQ ID NO: 1167091 - DNA, 22 bp, Artificial Sequence
  chemically synthesized
ttttcccccaaaattgagtaca

SEQ ID NO: 1167092 - DNA, 22 bp, Artificial Sequence
  chemically synthesized
aataaatttgagtgtactcaat

SEQ ID NO: 1167093 - DNA, 22 bp, Artificial Sequence
  chemically synthesized
tttcccccaaaattgagtacac

SEQ ID NO: 1167094 - DNA, 22 bp, Artificial Sequence
  chemically synthesized
ttcccccaaaattgagtacact

SEQ ID NO: 1167095 - DNA, 22 bp, Artificial Sequence
  chemically synthesized
tcccccaaaattgagtacactc

SEQ ID NO: 1167096 - DNA, 22 bp, Artificial Sequence
  chemically synthesized
cccccaaaattgagtacactca

SEQ ID NO: 1167097 - DNA, 22 bp, Artificial Sequence
  chemically synthesized
ccccaaaattgagtacactcaa

SEQ ID NO: 1167098 - DNA, 22 bp, Artificial Sequence
  chemically synthesized
tggataacgttgaataaatttg

SEQ ID NO: 1167099 - DNA, 22 bp, Artificial Sequence
  chemically synthesized
agtacactcaaatttattcaac

SEQ ID NO: 1167100 - DNA, 22 bp, Artificial Sequence
  chemically synthesized
aagtctgtggataacgttgaat

SEQ ID NO: 1167101 - DNA, 22 bp, Artificial Sequence
  chemically synthesized
tgaagtctgtggataacgttga

SEQ ID NO: 1167102 - DNA, 22 bp, Artificial Sequence
  chemically synthesized
aaatttattcaacgttatccac

SEQ ID NO: 1167103 - DNA, 22 bp, Artificial Sequence
  chemically synthesized
agcctctgaagtctgtggataa

SEQ ID NO: 1167104 - DNA, 22 bp, Artificial Sequence
  chemically synthesized
attcaacgttatccacagactt

SEQ ID NO: 1167105 - DNA, 22 bp, Artificial Sequence
  chemically synthesized
ttcaacgttatccacagacttc

SEQ ID NO: 1167106 - DNA, 22 bp, Artificial Sequence
  chemically synthesized
aacgttatccacagacttcaga

SEQ ID NO: 1167107 - DNA, 22 bp, Artificial Sequence
  chemically synthesized
acaggcagtaattaagcctctg

SEQ ID NO: 1167108 - DNA, 22 bp, Artificial Sequence
  chemically synthesized
tccacagacttcagaggcttaa

SEQ ID NO: 1167109 - DNA, 22 bp, Artificial Sequence
  chemically synthesized
aatctaacaggcagtaattaag

SEQ ID NO: 1167110 - DNA, 22 bp, Artificial Sequence
  chemically synthesized
ctaaatctaacaggcagtaatt

SEQ ID NO: 1167111 - DNA, 22 bp, Artificial Sequence
  chemically synthesized
cctaaatctaacaggcagtaat

SEQ ID NO: 1167112 - DNA, 22 bp, Artificial Sequence
  chemically synthesized
cagaggcttaattactgcctgt

SEQ ID NO: 1167113 - DNA, 22 bp, Artificial Sequence
  chemically synthesized
agaggcttaattactgcctgtt

SEQ ID NO: 1167114 - DNA, 22 bp, Artificial Sequence
  chemically synthesized
atacttcctaaatctaacaggc

SEQ ID NO: 1167115 - DNA, 22 bp, Artificial Sequence
  chemically synthesized
aattactgcctgttagatttag

SEQ ID NO: 1167116 - DNA, 22 bp, Artificial Sequence
  chemically synthesized
attactgcctgttagatttagg

SEQ ID NO: 1167117 - DNA, 22 bp, Artificial Sequence
  chemically synthesized
ctgcctgttagatttaggaagt

SEQ ID NO: 1167118 - DNA, 22 bp, Artificial Sequence
  chemically synthesized
cctgttagatttaggaagtatt

SEQ ID NO: 1167119 - DNA, 22 bp, Artificial Sequence
  chemically synthesized
ttagatttaggaagtattagat

SEQ ID NO: 1167120 - DNA, 22 bp, Artificial Sequence
  chemically synthesized
gatttaggaagtattagatatt

SEQ ID NO: 1167121 - DNA, 22 bp, Artificial Sequence
  chemically synthesized
aaggaacataggtgacaatatc

SEQ ID NO: 1167122 - DNA, 22 bp, Artificial Sequence
  chemically synthesized
aggaagtattagatattgtcac

SEQ ID NO: 1167123 - DNA, 22 bp, Artificial Sequence
  chemically synthesized
caaggaacataggtgacaatat

SEQ ID NO: 1167124 - DNA, 22 bp, Artificial Sequence
  chemically synthesized
ggaagtattagatattgtcacc

SEQ ID NO: 1167125 - DNA, 22 bp, Artificial Sequence
  chemically synthesized
gatattgtcacctatgttcctt

SEQ ID NO: 1167126 - DNA, 22 bp, Artificial Sequence
  chemically synthesized
atgagcgatgtcttcaaggaac

SEQ ID NO: 1167127 - DNA, 22 bp, Artificial Sequence
  chemically synthesized
aatgagcgatgtcttcaaggaa

SEQ ID NO: 1167128 - DNA, 22 bp, Artificial Sequence
  chemically synthesized
taatgagcgatgtcttcaagga

SEQ ID NO: 1167129 - DNA, 22 bp, Artificial Sequence
  chemically synthesized
ttaatgagcgatgtcttcaagg

SEQ ID NO: 1167130 - DNA, 22 bp, Artificial Sequence
  chemically synthesized
tcacctatgttccttgaagaca

SEQ ID NO: 1167131 - DNA, 22 bp, Artificial Sequence
  chemically synthesized
tttaatgagcgatgtcttcaag

SEQ ID NO: 1167132 - DNA, 22 bp, Artificial Sequence
  chemically synthesized
ttttaatgagcgatgtcttcaa

SEQ ID NO: 1167133 - DNA, 22 bp, Artificial Sequence
  chemically synthesized
tgttccttgaagacatcgctca

SEQ ID NO: 1167134 - DNA, 22 bp, Artificial Sequence
  chemically synthesized
caccttttttaatgagcgatgt

SEQ ID NO: 1167135 - DNA, 22 bp, Artificial Sequence
  chemically synthesized
ccaccttttttaatgagcgatg

SEQ ID NO: 1167136 - DNA, 22 bp, Artificial Sequence
  chemically synthesized
ttccaccttttttaatgagcga

SEQ ID NO: 1167137 - DNA, 22 bp, Artificial Sequence
  chemically synthesized
cttgaagacatcgctcattaaa

SEQ ID NO: 1167138 - DNA, 22 bp, Artificial Sequence
  chemically synthesized
gaagacatcgctcattaaaaaa

SEQ ID NO: 1167139 - DNA, 22 bp, Artificial Sequence
  chemically synthesized
aagacatcgctcattaaaaaag

SEQ ID NO: 1167140 - DNA, 22 bp, Artificial Sequence
  chemically synthesized
attaaaaaaggtggaagaggcc

SEQ ID NO: 1167141 - DNA, 22 bp, Artificial Sequence
  chemically synthesized
agccaccgcacccggcctcttc

SEQ ID NO: 1167142 - DNA, 22 bp, Artificial Sequence
  chemically synthesized
aaaaaggtggaagaggccgggt

SEQ ID NO: 1167143 - DNA, 22 bp, Artificial Sequence
  chemically synthesized
caggtctgagccaccgcacccg

SEQ ID NO: 1167144 - DNA, 22 bp, Artificial Sequence
  chemically synthesized
ggattacaggtctgagccaccg

SEQ ID NO: 1167145 - DNA, 22 bp, Artificial Sequence
  chemically synthesized
ccaaagtgctgggattacaggt

SEQ ID NO: 1167146 - DNA, 22 bp, Artificial Sequence
  chemically synthesized
agcctcccaaagtgctgggatt

SEQ ID NO: 1167147 - DNA, 22 bp, Artificial Sequence
  chemically synthesized
agacctgtaatcccagcacttt

SEQ ID NO: 1167148 - DNA, 22 bp, Artificial Sequence
  chemically synthesized
cctcagcctcccaaagtgctgg

SEQ ID NO: 1167149 - DNA, 22 bp, Artificial Sequence
  chemically synthesized
taatcccagcactttgggaggc

SEQ ID NO: 1167150 - DNA, 22 bp, Artificial Sequence
  chemically synthesized
gtgatccgcctgcctcagcctc

SEQ ID NO: 1167151 - DNA, 22 bp, Artificial Sequence
  chemically synthesized
acctcgtgatccgcctgcctca

SEQ ID NO: 1167152 - DNA, 22 bp, Artificial Sequence
  chemically synthesized
ctgacctcgtgatccgcctgcc

SEQ ID NO: 1167153 - DNA, 22 bp, Artificial Sequence
  chemically synthesized
tgggaggctgaggcaggcggat

SEQ ID NO: 1167154 - DNA, 22 bp, Artificial Sequence
  chemically synthesized
gggaggctgaggcaggcggatc

SEQ ID NO: 1167155 - DNA, 22 bp, Artificial Sequence
  chemically synthesized
ggaggctgaggcaggcggatca

SEQ ID NO: 1167156 - DNA, 22 bp, Artificial Sequence
  chemically synthesized
gatctcctgacctcgtgatccg

SEQ ID NO: 1167157 - DNA, 22 bp, Artificial Sequence
  chemically synthesized
aggcaggcggatcacgaggtca

SEQ ID NO: 1167158 - DNA, 22 bp, Artificial Sequence
  chemically synthesized
gcgaagatggtctcgatctcct

SEQ ID NO: 1167159 - DNA, 22 bp, Artificial Sequence
  chemically synthesized
accatgttagcgaagatggtct

SEQ ID NO: 1167160 - DNA, 22 bp, Artificial Sequence
  chemically synthesized
aaccatgttagcgaagatggtc

SEQ ID NO: 1167161 - DNA, 22 bp, Artificial Sequence
  chemically synthesized
gtagagacggggtttaaccatg

SEQ ID NO: 1167162 - DNA, 22 bp, Artificial Sequence
  chemically synthesized
agtagagacggggtttaaccat

SEQ ID NO: 1167163 - DNA, 22 bp, Artificial Sequence
  chemically synthesized
tagtagagacggggtttaacca

SEQ ID NO: 1167164 - DNA, 22 bp, Artificial Sequence
  chemically synthesized
ttagtagagacggggtttaacc

SEQ ID NO: 1167165 - DNA, 22 bp, Artificial Sequence
  chemically synthesized
cgctaacatggttaaaccccgt

SEQ ID NO: 1167166 - DNA, 22 bp, Artificial Sequence
  chemically synthesized
gctaacatggttaaaccccgtc

SEQ ID NO: 1167167 - DNA, 22 bp, Artificial Sequence
  chemically synthesized
tatttttagtagagacggggtt

SEQ ID NO: 1167168 - DNA, 22 bp, Artificial Sequence
  chemically synthesized
gtatttttagtagagacggggt

SEQ ID NO: 1167169 - DNA, 22 bp, Artificial Sequence
  chemically synthesized
tgtatttttagtagagacgggg

SEQ ID NO: 1167170 - DNA, 22 bp, Artificial Sequence
  chemically synthesized
acatggttaaaccccgtctcta

SEQ ID NO: 1167171 - DNA, 22 bp, Artificial Sequence
  chemically synthesized
ttgtatttttagtagagacggg

SEQ ID NO: 1167172 - DNA, 22 bp, Artificial Sequence
  chemically synthesized
tttgtatttttagtagagacgg

SEQ ID NO: 1167173 - DNA, 22 bp, Artificial Sequence
  chemically synthesized
attttttgtatttttagtagag

SEQ ID NO: 1167174 - DNA, 22 bp, Artificial Sequence
  chemically synthesized
aaccccgtctctactaaaaata

SEQ ID NO: 1167175 - DNA, 22 bp, Artificial Sequence
  chemically synthesized
tactaaaaatacaaaaaattag

SEQ ID NO: 1167176 - DNA, 22 bp, Artificial Sequence
  chemically synthesized
ctaaaaatacaaaaaattagcc

SEQ ID NO: 1167177 - DNA, 22 bp, Artificial Sequence
  chemically synthesized
aaaatacaaaaaattagccggg

SEQ ID NO: 1167178 - DNA, 22 bp, Artificial Sequence
  chemically synthesized
caggcgccgccaccgcgcccgg

SEQ ID NO: 1167179 - DNA, 22 bp, Artificial Sequence
  chemically synthesized
ggactacaggcgccgccaccgc

SEQ ID NO: 1167180 - DNA, 22 bp, Artificial Sequence
  chemically synthesized
gccgggcgcggtggcggcgcct

SEQ ID NO: 1167181 - DNA, 22 bp, Artificial Sequence
  chemically synthesized
ccgagtaactgggactacaggc

SEQ ID NO: 1167182 - DNA, 22 bp, Artificial Sequence
  chemically synthesized
agcctcccgagtaactgggact

SEQ ID NO: 1167183 - DNA, 22 bp, Artificial Sequence
  chemically synthesized
cctcagcctcccgagtaactgg

SEQ ID NO: 1167184 - DNA, 22 bp, Artificial Sequence
  chemically synthesized
ctacctcagcctcccgagtaac

SEQ ID NO: 1167185 - DNA, 22 bp, Artificial Sequence
  chemically synthesized
ctcctacctcagcctcccgagt

SEQ ID NO: 1167186 - DNA, 22 bp, Artificial Sequence
  chemically synthesized
tagtcccagttactcgggaggc

SEQ ID NO: 1167187 - DNA, 22 bp, Artificial Sequence
  chemically synthesized
tcctcctacctcagcctcccga

SEQ ID NO: 1167188 - DNA, 22 bp, Artificial Sequence
  chemically synthesized
ctcctcctacctcagcctcccg

SEQ ID NO: 1167189 - DNA, 22 bp, Artificial Sequence
  chemically synthesized
tctcctcctacctcagcctccc

SEQ ID NO: 1167190 - DNA, 22 bp, Artificial Sequence
  chemically synthesized
acgcctttctcctcctacctca

SEQ ID NO: 1167191 - DNA, 22 bp, Artificial Sequence
  chemically synthesized
ctcgggaggctgaggtaggagg

SEQ ID NO: 1167192 - DNA, 22 bp, Artificial Sequence
  chemically synthesized
gggaggctgaggtaggaggaga

SEQ ID NO: 1167193 - DNA, 22 bp, Artificial Sequence
  chemically synthesized
ccgggttcacgcctttctcctc

SEQ ID NO: 1167194 - DNA, 22 bp, Artificial Sequence
  chemically synthesized
aggtaggaggagaaaggcgtga

SEQ ID NO: 1167195 - DNA, 22 bp, Artificial Sequence
  chemically synthesized
cgcctcccgggttcacgccttt

SEQ ID NO: 1167196 - DNA, 22 bp, Artificial Sequence
  chemically synthesized
caagctccgcctcccgggttca

SEQ ID NO: 1167197 - DNA, 22 bp, Artificial Sequence
  chemically synthesized
actgcaagctccgcctcccggg

SEQ ID NO: 1167198 - DNA, 22 bp, Artificial Sequence
  chemically synthesized
ggctcactgcaagctccgcctc

SEQ ID NO: 1167199 - DNA, 22 bp, Artificial Sequence
  chemically synthesized
tcggctcactgcaagctccgcc

SEQ ID NO: 1167200 - DNA, 22 bp, Artificial Sequence
  chemically synthesized
ctcggctcactgcaagctccgc

SEQ ID NO: 1167201 - DNA, 22 bp, Artificial Sequence
  chemically synthesized
tctcggctcactgcaagctccg

SEQ ID NO: 1167202 - DNA, 22 bp, Artificial Sequence
  chemically synthesized
gcagtgagccgagaaagcgcca

SEQ ID NO: 1167203 - DNA, 22 bp, Artificial Sequence
  chemically synthesized
cagtgagccgagaaagcgccac

SEQ ID NO: 1167204 - DNA, 22 bp, Artificial Sequence
  chemically synthesized
cccaggccggagtgcagtggcg

SEQ ID NO: 1167205 - DNA, 22 bp, Artificial Sequence
  chemically synthesized
gcccaggccggagtgcagtggc

SEQ ID NO: 1167206 - DNA, 22 bp, Artificial Sequence
  chemically synthesized
tgcccaggccggagtgcagtgg

SEQ ID NO: 1167207 - DNA, 22 bp, Artificial Sequence
  chemically synthesized
ttttgcccaggccggagtgcag

SEQ ID NO: 1167208 - DNA, 22 bp, Artificial Sequence
  chemically synthesized
ctgttttgcccaggccggagtg

SEQ ID NO: 1167209 - DNA, 22 bp, Artificial Sequence
  chemically synthesized
gctgttttgcccaggccggagt

SEQ ID NO: 1167210 - DNA, 22 bp, Artificial Sequence
  chemically synthesized
cactccggcctgggcaaaacag

SEQ ID NO: 1167211 - DNA, 22 bp, Artificial Sequence
  chemically synthesized
cggcctgggcaaaacagcaaga

SEQ ID NO: 1167212 - DNA, 22 bp, Artificial Sequence
  chemically synthesized
aaagagacggagtcttgctgtt

SEQ ID NO: 1167213 - DNA, 22 bp, Artificial Sequence
  chemically synthesized
aaaagagacggagtcttgctgt

SEQ ID NO: 1167214 - DNA, 22 bp, Artificial Sequence
  chemically synthesized
taaaagagacggagtcttgctg

SEQ ID NO: 1167215 - DNA, 22 bp, Artificial Sequence
  chemically synthesized
ttaaaagagacggagtcttgct

SEQ ID NO: 1167216 - DNA, 22 bp, Artificial Sequence
  chemically synthesized
tttaaaagagacggagtcttgc

SEQ ID NO: 1167217 - DNA, 22 bp, Artificial Sequence
  chemically synthesized
ttttaaaagagacggagtcttg

SEQ ID NO: 1167218 - DNA, 22 bp, Artificial Sequence
  chemically synthesized
tttttaaaagagacggagtctt

SEQ ID NO: 1167219 - DNA, 22 bp, Artificial Sequence
  chemically synthesized
ggcaaaacagcaagactccgtc

SEQ ID NO: 1167220 - DNA, 22 bp, Artificial Sequence
  chemically synthesized
ttttttaaaagagacggagtct

SEQ ID NO: 1167221 - DNA, 22 bp, Artificial Sequence
  chemically synthesized
tttttttaaaagagacggagtc

SEQ ID NO: 1167222 - DNA, 22 bp, Artificial Sequence
  chemically synthesized
ttttttttaaaagagacggagt

SEQ ID NO: 1167223 - DNA, 22 bp, Artificial Sequence
  chemically synthesized
tttttttttaaaagagacggag

SEQ ID NO: 1167224 - DNA, 22 bp, Artificial Sequence
  chemically synthesized
ttttttttttaaaagagacgga

SEQ ID NO: 1167225 - DNA, 22 bp, Artificial Sequence
  chemically synthesized
tttttttttttaaaagagacgg

SEQ ID NO: 1167226 - DNA, 22 bp, Artificial Sequence
  chemically synthesized
ttttttttttttaaaagagacg

SEQ ID NO: 1167227 - DNA, 22 bp, Artificial Sequence
  chemically synthesized
tttttttttttttaaaagagac

SEQ ID NO: 1167228 - DNA, 22 bp, Artificial Sequence
  chemically synthesized
ttttttttttttttaaaagaga

SEQ ID NO: 1167229 - DNA, 22 bp, Artificial Sequence
  chemically synthesized
tttttttttttttttaaaagag

SEQ ID NO: 1167230 - DNA, 22 bp, Artificial Sequence
  chemically synthesized
ttttttttttttttttaaaaga

SEQ ID NO: 1167231 - DNA, 22 bp, Artificial Sequence
  chemically synthesized
tttttttttttttttttaaaag

SEQ ID NO: 1167232 - DNA, 22 bp, Artificial Sequence
  chemically synthesized
ttttttttttttttttttaaaa

SEQ ID NO: 1167233 - DNA, 22 bp, Artificial Sequence
  chemically synthesized
tttttttttttttttttttaaa

SEQ ID NO: 1167234 - DNA, 22 bp, Artificial Sequence
  chemically synthesized
ttttttttttttttttttttaa

SEQ ID NO: 1167235 - DNA, 22 bp, Artificial Sequence
  chemically synthesized
ttttttttttttttttttttta

SEQ ID NO: 1167236 - DNA, 22 bp, Artificial Sequence
  chemically synthesized
tttttttttttttttttttttt

SEQ ID NO: 1167237 - DNA, 22 bp, Artificial Sequence
  chemically synthesized
cgtctcttttaaaaaaaaaaaa

SEQ ID NO: 1167238 - DNA, 22 bp, Artificial Sequence
  chemically synthesized
accttttttttttttttttttt

SEQ ID NO: 1167239 - DNA, 22 bp, Artificial Sequence
  chemically synthesized
cacctttttttttttttttttt

SEQ ID NO: 1167240 - DNA, 22 bp, Artificial Sequence
  chemically synthesized
tcaccttttttttttttttttt

SEQ ID NO: 1167241 - DNA, 22 bp, Artificial Sequence
  chemically synthesized
ttttaaaaaaaaaaaaaaaaaa

SEQ ID NO: 1167242 - DNA, 22 bp, Artificial Sequence
  chemically synthesized
tttcaccttttttttttttttt

SEQ ID NO: 1167243 - DNA, 22 bp, Artificial Sequence
  chemically synthesized
ttaaaaaaaaaaaaaaaaaaaa

SEQ ID NO: 1167244 - DNA, 22 bp, Artificial Sequence
  chemically synthesized
taaaaaaaaaaaaaaaaaaaaa

SEQ ID NO: 1167245 - DNA, 22 bp, Artificial Sequence
  chemically synthesized
aaaaaaaaaaaaaaaaaaaaaa

SEQ ID NO: 1167246 - DNA, 22 bp, Artificial Sequence
  chemically synthesized
ctctttcacctttttttttttt

SEQ ID NO: 1167247 - DNA, 22 bp, Artificial Sequence
  chemically synthesized
aaaaaaaaaaaaaaaaaaaaaa

SEQ ID NO: 1167248 - DNA, 22 bp, Artificial Sequence
  chemically synthesized
tgctctttcacctttttttttt

SEQ ID NO: 1167249 - DNA, 22 bp, Artificial Sequence
  chemically synthesized
ctgctctttcaccttttttttt

SEQ ID NO: 1167250 - DNA, 22 bp, Artificial Sequence
  chemically synthesized
tctgctctttcacctttttttt

SEQ ID NO: 1167251 - DNA, 22 bp, Artificial Sequence
  chemically synthesized
ctttctgctctttcaccttttt

SEQ ID NO: 1167252 - DNA, 22 bp, Artificial Sequence
  chemically synthesized
tcctttctgctctttcaccttt

SEQ ID NO: 1167253 - DNA, 22 bp, Artificial Sequence
  chemically synthesized
ctcctttctgctctttcacctt

SEQ ID NO: 1167254 - DNA, 22 bp, Artificial Sequence
  chemically synthesized
tctcctttctgctctttcacct

SEQ ID NO: 1167255 - DNA, 22 bp, Artificial Sequence
  chemically synthesized
cctttctcctttctgctctttc

SEQ ID NO: 1167256 - DNA, 22 bp, Artificial Sequence
  chemically synthesized
acctttctcctttctgctcttt

SEQ ID NO: 1167257 - DNA, 22 bp, Artificial Sequence
  chemically synthesized
tacctttctcctttctgctctt

SEQ ID NO: 1167258 - DNA, 22 bp, Artificial Sequence
  chemically synthesized
ttacctttctcctttctgctct

SEQ ID NO: 1167259 - DNA, 22 bp, Artificial Sequence
  chemically synthesized
tttacctttctcctttctgctc

SEQ ID NO: 1167260 - DNA, 22 bp, Artificial Sequence
  chemically synthesized
ttttacctttctcctttctgct

SEQ ID NO: 1167261 - DNA, 22 bp, Artificial Sequence
  chemically synthesized
atttttttacctttctcctttc

SEQ ID NO: 1167262 - DNA, 22 bp, Artificial Sequence
  chemically synthesized
tcatccctgatttttttacctt

SEQ ID NO: 1167263 - DNA, 22 bp, Artificial Sequence
  chemically synthesized
atcatccctgatttttttacct

SEQ ID NO: 1167264 - DNA, 22 bp, Artificial Sequence
  chemically synthesized
aaacagtcatttatcatccctg

SEQ ID NO: 1167265 - DNA, 22 bp, Artificial Sequence
  chemically synthesized
gactaaaacagtcatttatcat

SEQ ID NO: 1167266 - DNA, 22 bp, Artificial Sequence
  chemically synthesized
ctggactaaaacagtcatttat

SEQ ID NO: 1167267 - DNA, 22 bp, Artificial Sequence
  chemically synthesized
gacattgctggactaaaacagt

SEQ ID NO: 1167268 - DNA, 22 bp, Artificial Sequence
  chemically synthesized
tagacattgctggactaaaaca

SEQ ID NO: 1167269 - DNA, 22 bp, Artificial Sequence
  chemically synthesized
ctagacattgctggactaaaac

SEQ ID NO: 1167270 - DNA, 22 bp, Artificial Sequence
  chemically synthesized
tctagacattgctggactaaaa

SEQ ID NO: 1167271 - DNA, 22 bp, Artificial Sequence
  chemically synthesized
ttctagacattgctggactaaa

SEQ ID NO: 1167272 - DNA, 22 bp, Artificial Sequence
  chemically synthesized
gagatttttctagacattgctg

SEQ ID NO: 1167273 - DNA, 22 bp, Artificial Sequence
  chemically synthesized
ttttagtccagcaatgtctaga

SEQ ID NO: 1167274 - DNA, 22 bp, Artificial Sequence
  chemically synthesized
tagtccagcaatgtctagaaaa

SEQ ID NO: 1167275 - DNA, 22 bp, Artificial Sequence
  chemically synthesized
agtccagcaatgtctagaaaaa

SEQ ID NO: 1167276 - DNA, 22 bp, Artificial Sequence
  chemically synthesized
gtccagcaatgtctagaaaaat

SEQ ID NO: 1167277 - DNA, 22 bp, Artificial Sequence
  chemically synthesized
cagaaatgagtgtctagagatt

SEQ ID NO: 1167278 - DNA, 22 bp, Artificial Sequence
  chemically synthesized
tctccagaaatgagtgtctaga

SEQ ID NO: 1167279 - DNA, 22 bp, Artificial Sequence
  chemically synthesized
gaaaaatctctagacactcatt

SEQ ID NO: 1167280 - DNA, 22 bp, Artificial Sequence
  chemically synthesized
gaaattgtctccagaaatgagt

SEQ ID NO: 1167281 - DNA, 22 bp, Artificial Sequence
  chemically synthesized
tgactagaaattgtctccagaa

SEQ ID NO: 1167282 - DNA, 22 bp, Artificial Sequence
  chemically synthesized
tagacactcatttctggagaca

SEQ ID NO: 1167283 - DNA, 22 bp, Artificial Sequence
  chemically synthesized
gacactcatttctggagacaat

SEQ ID NO: 1167284 - DNA, 22 bp, Artificial Sequence
  chemically synthesized
atttctggagacaatttctagt

SEQ ID NO: 1167285 - DNA, 22 bp, Artificial Sequence
  chemically synthesized
cgagtagaaattatgactagaa

SEQ ID NO: 1167286 - DNA, 22 bp, Artificial Sequence
  chemically synthesized
ctggagacaatttctagtcata

SEQ ID NO: 1167287 - DNA, 22 bp, Artificial Sequence
  chemically synthesized
tggagacaatttctagtcataa

SEQ ID NO: 1167288 - DNA, 22 bp, Artificial Sequence
  chemically synthesized
tacgagtagaaattatgactag

SEQ ID NO: 1167289 - DNA, 22 bp, Artificial Sequence
  chemically synthesized
gagacaatttctagtcataatt

SEQ ID NO: 1167290 - DNA, 22 bp, Artificial Sequence
  chemically synthesized
ctagtcataatttctactcgta

SEQ ID NO: 1167291 - DNA, 22 bp, Artificial Sequence
  chemically synthesized
tagtcataatttctactcgtag

SEQ ID NO: 1167292 - DNA, 22 bp, Artificial Sequence
  chemically synthesized
gtcagagaaattctacgagtag

SEQ ID NO: 1167293 - DNA, 22 bp, Artificial Sequence
  chemically synthesized
gtcataatttctactcgtagaa

SEQ ID NO: 1167294 - DNA, 22 bp, Artificial Sequence
  chemically synthesized
tagtcagagaaattctacgagt

SEQ ID NO: 1167295 - DNA, 22 bp, Artificial Sequence
  chemically synthesized
ctagtcagagaaattctacgag

SEQ ID NO: 1167296 - DNA, 22 bp, Artificial Sequence
  chemically synthesized
ctactcgtagaatttctctgac

SEQ ID NO: 1167297 - DNA, 22 bp, Artificial Sequence
  chemically synthesized
gaaccatttctagtcagagaaa

SEQ ID NO: 1167298 - DNA, 22 bp, Artificial Sequence
  chemically synthesized
tactcgtagaatttctctgact

SEQ ID NO: 1167299 - DNA, 22 bp, Artificial Sequence
  chemically synthesized
ctcgtagaatttctctgactag

SEQ ID NO: 1167300 - DNA, 22 bp, Artificial Sequence
  chemically synthesized
attagaaccatttctagtcaga

SEQ ID NO: 1167301 - DNA, 22 bp, Artificial Sequence
  chemically synthesized
cattagaaccatttctagtcag

SEQ ID NO: 1167302 - DNA, 22 bp, Artificial Sequence
  chemically synthesized
gtagaatttctctgactagaaa

SEQ ID NO: 1167303 - DNA, 22 bp, Artificial Sequence
  chemically synthesized
tatacttcattagaaccatttc

SEQ ID NO: 1167304 - DNA, 22 bp, Artificial Sequence
  chemically synthesized
ctctgactagaaatggttctaa

SEQ ID NO: 1167305 - DNA, 22 bp, Artificial Sequence
  chemically synthesized
ctgtatacttcattagaaccat

SEQ ID NO: 1167306 - DNA, 22 bp, Artificial Sequence
  chemically synthesized
tctgactagaaatggttctaat

SEQ ID NO: 1167307 - DNA, 22 bp, Artificial Sequence
  chemically synthesized
tgactagaaatggttctaatga

SEQ ID NO: 1167308 - DNA, 22 bp, Artificial Sequence
  chemically synthesized
ttgctgtatacttcattagaac

SEQ ID NO: 1167309 - DNA, 22 bp, Artificial Sequence
  chemically synthesized
actagaaatggttctaatgaag

SEQ ID NO: 1167310 - DNA, 22 bp, Artificial Sequence
  chemically synthesized
gaaatggttctaatgaagtata

SEQ ID NO: 1167311 - DNA, 22 bp, Artificial Sequence
  chemically synthesized
taatgaagtatacagcaatagc

SEQ ID NO: 1167312 - DNA, 22 bp, Artificial Sequence
  chemically synthesized
agaagtatcaaggctattgctg

SEQ ID NO: 1167313 - DNA, 22 bp, Artificial Sequence
  chemically synthesized
atgaagtatacagcaatagcct

SEQ ID NO: 1167314 - DNA, 22 bp, Artificial Sequence
  chemically synthesized
tatattcagaagtatcaaggct

SEQ ID NO: 1167315 - DNA, 22 bp, Artificial Sequence
  chemically synthesized
atatattcagaagtatcaaggc

SEQ ID NO: 1167316 - DNA, 22 bp, Artificial Sequence
  chemically synthesized
aaatatatttatatattcagaa

SEQ ID NO: 1167317 - DNA, 22 bp, Artificial Sequence
  chemically synthesized
aaaatatatttatatattcaga

SEQ ID NO: 1167318 - DNA, 22 bp, Artificial Sequence
  chemically synthesized
taaaatatatttatatattcag

SEQ ID NO: 1167319 - DNA, 22 bp, Artificial Sequence
  chemically synthesized
gatacttctgaatatataaata

SEQ ID NO: 1167320 - DNA, 22 bp, Artificial Sequence
  chemically synthesized
gattttaaaatatatttatata

SEQ ID NO: 1167321 - DNA, 22 bp, Artificial Sequence
  chemically synthesized
atacttctgaatatataaatat

SEQ ID NO: 1167322 - DNA, 22 bp, Artificial Sequence
  chemically synthesized
ctgaatatataaatatatttta

SEQ ID NO: 1167323 - DNA, 22 bp, Artificial Sequence
  chemically synthesized
tgaatatataaatatattttaa

SEQ ID NO: 1167324 - DNA, 22 bp, Artificial Sequence
  chemically synthesized
aatatataaatatattttaaaa

SEQ ID NO: 1167325 - DNA, 22 bp, Artificial Sequence
  chemically synthesized
taaaatccagtttactatctgt

SEQ ID NO: 1167326 - DNA, 22 bp, Artificial Sequence
  chemically synthesized
aaaatccagtttactatctgtc

SEQ ID NO: 1167327 - DNA, 22 bp, Artificial Sequence
  chemically synthesized
aaatccagtttactatctgtct

SEQ ID NO: 1167328 - DNA, 22 bp, Artificial Sequence
  chemically synthesized
aatacccaagatcagacagata

SEQ ID NO: 1167329 - DNA, 22 bp, Artificial Sequence
  chemically synthesized
actatctgtctgatcttgggta

SEQ ID NO: 1167330 - DNA, 22 bp, Artificial Sequence
  chemically synthesized
ctatctgtctgatcttgggtat

SEQ ID NO: 1167331 - DNA, 22 bp, Artificial Sequence
  chemically synthesized
tctgtctgatcttgggtattta

SEQ ID NO: 1167332 - DNA, 22 bp, Artificial Sequence
  chemically synthesized
agatgcagagaggttaaatacc

SEQ ID NO: 1167333 - DNA, 22 bp, Artificial Sequence
  chemically synthesized
tctgatcttgggtatttaacct

SEQ ID NO: 1167334 - DNA, 22 bp, Artificial Sequence
  chemically synthesized
atcttgggtatttaacctctct

SEQ ID NO: 1167335 - DNA, 22 bp, Artificial Sequence
  chemically synthesized
gggtatttaacctctctgcatc

SEQ ID NO: 1167336 - DNA, 22 bp, Artificial Sequence
  chemically synthesized
ggtatttaacctctctgcatct

SEQ ID NO: 1167337 - DNA, 22 bp, Artificial Sequence
  chemically synthesized
tagatggggtaactgagatgca

SEQ ID NO: 1167338 - DNA, 22 bp, Artificial Sequence
  chemically synthesized
atagatggggtaactgagatgc

SEQ ID NO: 1167339 - DNA, 22 bp, Artificial Sequence
  chemically synthesized
tatagatggggtaactgagatg

SEQ ID NO: 1167340 - DNA, 22 bp, Artificial Sequence
  chemically synthesized
aacctctctgcatctcagttac

SEQ ID NO: 1167341 - DNA, 22 bp, Artificial Sequence
  chemically synthesized
acctctctgcatctcagttacc

SEQ ID NO: 1167342 - DNA, 22 bp, Artificial Sequence
  chemically synthesized
ttttatagatggggtaactgag

SEQ ID NO: 1167343 - DNA, 22 bp, Artificial Sequence
  chemically synthesized
gttttatagatggggtaactga

SEQ ID NO: 1167344 - DNA, 22 bp, Artificial Sequence
  chemically synthesized
ttgttttatagatggggtaact

SEQ ID NO: 1167345 - DNA, 22 bp, Artificial Sequence
  chemically synthesized
cttgttttatagatggggtaac

SEQ ID NO: 1167346 - DNA, 22 bp, Artificial Sequence
  chemically synthesized
tctgcatctcagttaccccatc

SEQ ID NO: 1167347 - DNA, 22 bp, Artificial Sequence
  chemically synthesized
tcttgttttatagatggggtaa

SEQ ID NO: 1167348 - DNA, 22 bp, Artificial Sequence
  chemically synthesized
ttcttgttttatagatggggta

SEQ ID NO: 1167349 - DNA, 22 bp, Artificial Sequence
  chemically synthesized
tgcatctcagttaccccatcta

SEQ ID NO: 1167350 - DNA, 22 bp, Artificial Sequence
  chemically synthesized
catctcagttaccccatctata

SEQ ID NO: 1167351 - DNA, 22 bp, Artificial Sequence
  chemically synthesized
tttttcttgttttatagatggg

SEQ ID NO: 1167352 - DNA, 22 bp, Artificial Sequence
  chemically synthesized
atttttcttgttttatagatgg

SEQ ID NO: 1167353 - DNA, 22 bp, Artificial Sequence
  chemically synthesized
tatttttcttgttttatagatg

SEQ ID NO: 1167354 - DNA, 22 bp, Artificial Sequence
  chemically synthesized
ttatttttcttgttttatagat

SEQ ID NO: 1167355 - DNA, 22 bp, Artificial Sequence
  chemically synthesized
agttaccccatctataaaacaa

SEQ ID NO: 1167356 - DNA, 22 bp, Artificial Sequence
  chemically synthesized
ccccatctataaaacaagaaaa

SEQ ID NO: 1167357 - DNA, 22 bp, Artificial Sequence
  chemically synthesized
cgtacgtatatttttatttttc

SEQ ID NO: 1167358 - DNA, 22 bp, Artificial Sequence
  chemically synthesized
acgtacgtatatttttattttt

SEQ ID NO: 1167359 - DNA, 22 bp, Artificial Sequence
  chemically synthesized
taaaacaagaaaaataaaaata

SEQ ID NO: 1167360 - DNA, 22 bp, Artificial Sequence
  chemically synthesized
cagcagccttacgtacgtatat

SEQ ID NO: 1167361 - DNA, 22 bp, Artificial Sequence
  chemically synthesized
ccagcagccttacgtacgtata

SEQ ID NO: 1167362 - DNA, 22 bp, Artificial Sequence
  chemically synthesized
tccagcagccttacgtacgtat

SEQ ID NO: 1167363 - DNA, 22 bp, Artificial Sequence
  chemically synthesized
atctttccagcagccttacgta

SEQ ID NO: 1167364 - DNA, 22 bp, Artificial Sequence
  chemically synthesized
atctaatctttccagcagcctt

SEQ ID NO: 1167365 - DNA, 22 bp, Artificial Sequence
  chemically synthesized
tctcatctaatctttccagcag

SEQ ID NO: 1167366 - DNA, 22 bp, Artificial Sequence
  chemically synthesized
tatgcactatctcatctaatct

SEQ ID NO: 1167367 - DNA, 22 bp, Artificial Sequence
  chemically synthesized
atatgcactatctcatctaatc

SEQ ID NO: 1167368 - DNA, 22 bp, Artificial Sequence
  chemically synthesized
tatatgcactatctcatctaat

SEQ ID NO: 1167369 - DNA, 22 bp, Artificial Sequence
  chemically synthesized
ctggaaagattagatgagatag

SEQ ID NO: 1167370 - DNA, 22 bp, Artificial Sequence
  chemically synthesized
gcattttatatgcactatctca

SEQ ID NO: 1167371 - DNA, 22 bp, Artificial Sequence
  chemically synthesized
gaaagattagatgagatagtgc

SEQ ID NO: 1167372 - DNA, 22 bp, Artificial Sequence
  chemically synthesized
agcattttatatgcactatctc

SEQ ID NO: 1167373 - DNA, 22 bp, Artificial Sequence
  chemically synthesized
gatgagatagtgcatataaaat

SEQ ID NO: 1167374 - DNA, 22 bp, Artificial Sequence
  chemically synthesized
gaatgtgcttagcattttatat

SEQ ID NO: 1167375 - DNA, 22 bp, Artificial Sequence
  chemically synthesized
ggatctagaatgtgcttagcat

SEQ ID NO: 1167376 - DNA, 22 bp, Artificial Sequence
  chemically synthesized
gggatctagaatgtgcttagca

SEQ ID NO: 1167377 - DNA, 22 bp, Artificial Sequence
  chemically synthesized
ttgggatctagaatgtgcttag

SEQ ID NO: 1167378 - DNA, 22 bp, Artificial Sequence
  chemically synthesized
cttgggatctagaatgtgctta

SEQ ID NO: 1167379 - DNA, 22 bp, Artificial Sequence
  chemically synthesized
cagagcatttcttgggatctag

SEQ ID NO: 1167380 - DNA, 22 bp, Artificial Sequence
  chemically synthesized
agcacattctagatcccaagaa

SEQ ID NO: 1167381 - DNA, 22 bp, Artificial Sequence
  chemically synthesized
tagatcccaagaaatgctctgc

SEQ ID NO: 1167382 - DNA, 22 bp, Artificial Sequence
  chemically synthesized
gatcccaagaaatgctctgcaa

SEQ ID NO: 1167383 - DNA, 22 bp, Artificial Sequence
  chemically synthesized
gcccccaaacacaggcattgca

SEQ ID NO: 1167384 - DNA, 22 bp, Artificial Sequence
  chemically synthesized
ggcccccaaacacaggcattgc

SEQ ID NO: 1167385 - DNA, 22 bp, Artificial Sequence
  chemically synthesized
tggcccccaaacacaggcattg

SEQ ID NO: 1167386 - DNA, 22 bp, Artificial Sequence
  chemically synthesized
aatgaactttggcccccaaaca

SEQ ID NO: 1167387 - DNA, 22 bp, Artificial Sequence
  chemically synthesized
tgcaatgcctgtgtttgggggc

SEQ ID NO: 1167388 - DNA, 22 bp, Artificial Sequence
  chemically synthesized
caatgaactttggcccccaaac

SEQ ID NO: 1167389 - DNA, 22 bp, Artificial Sequence
  chemically synthesized
caatgcctgtgtttgggggcca

SEQ ID NO: 1167390 - DNA, 22 bp, Artificial Sequence
  chemically synthesized
tcatttcaatgaactttggccc

SEQ ID NO: 1167391 - DNA, 22 bp, Artificial Sequence
  chemically synthesized
atcatttcaatgaactttggcc

SEQ ID NO: 1167392 - DNA, 22 bp, Artificial Sequence
  chemically synthesized
tgtttgggggccaaagttcatt

SEQ ID NO: 1167393 - DNA, 22 bp, Artificial Sequence
  chemically synthesized
gggggccaaagttcattgaaat

SEQ ID NO: 1167394 - DNA, 22 bp, Artificial Sequence
  chemically synthesized
ggggccaaagttcattgaaatg

SEQ ID NO: 1167395 - DNA, 22 bp, Artificial Sequence
  chemically synthesized
cccataaaaatcatttatcatt

SEQ ID NO: 1167396 - DNA, 22 bp, Artificial Sequence
  chemically synthesized
ccccataaaaatcatttatcat

SEQ ID NO: 1167397 - DNA, 22 bp, Artificial Sequence
  chemically synthesized
tttccccataaaaatcatttat

SEQ ID NO: 1167398 - DNA, 22 bp, Artificial Sequence
  chemically synthesized
attgaaatgataaatgattttt

SEQ ID NO: 1167399 - DNA, 22 bp, Artificial Sequence
  chemically synthesized
acctgtttccccataaaaatca

SEQ ID NO: 1167400 - DNA, 22 bp, Artificial Sequence
  chemically synthesized
aaatgataaatgatttttatgg

SEQ ID NO: 1167401 - DNA, 22 bp, Artificial Sequence
  chemically synthesized
attcacctgtttccccataaaa

SEQ ID NO: 1167402 - DNA, 22 bp, Artificial Sequence
  chemically synthesized
ttatggggaaacaggtgaatga

SEQ ID NO: 1167403 - DNA, 22 bp, Artificial Sequence
  chemically synthesized
tatggggaaacaggtgaatgag

SEQ ID NO: 1167404 - DNA, 22 bp, Artificial Sequence
  chemically synthesized
atggggaaacaggtgaatgagc

SEQ ID NO: 1167405 - DNA, 22 bp, Artificial Sequence
  chemically synthesized
tggggaaacaggtgaatgagct

SEQ ID NO: 1167406 - DNA, 22 bp, Artificial Sequence
  chemically synthesized
cagaaacacacagagctcattc

SEQ ID NO: 1167407 - DNA, 22 bp, Artificial Sequence
  chemically synthesized
ccagaaacacacagagctcatt

SEQ ID NO: 1167408 - DNA, 22 bp, Artificial Sequence
  chemically synthesized
cccaaatcatgcttccagaaac

SEQ ID NO: 1167409 - DNA, 22 bp, Artificial Sequence
  chemically synthesized
aattgcccaaatcatgcttcca

SEQ ID NO: 1167410 - DNA, 22 bp, Artificial Sequence
  chemically synthesized
gaattgcccaaatcatgcttcc

SEQ ID NO: 1167411 - DNA, 22 bp, Artificial Sequence
  chemically synthesized
tgtgtgtttctggaagcatgat

SEQ ID NO: 1167412 - DNA, 22 bp, Artificial Sequence
  chemically synthesized
tgtgtttctggaagcatgattt

SEQ ID NO: 1167413 - DNA, 22 bp, Artificial Sequence
  chemically synthesized
agtttgaattgcccaaatcatg

SEQ ID NO: 1167414 - DNA, 22 bp, Artificial Sequence
  chemically synthesized
tctcagtttgaattgcccaaat

SEQ ID NO: 1167415 - DNA, 22 bp, Artificial Sequence
  chemically synthesized
ctggaagcatgatttgggcaat

SEQ ID NO: 1167416 - DNA, 22 bp, Artificial Sequence
  chemically synthesized
atctcagtttgaattgcccaaa

SEQ ID NO: 1167417 - DNA, 22 bp, Artificial Sequence
  chemically synthesized
tggaagcatgatttgggcaatt

SEQ ID NO: 1167418 - DNA, 22 bp, Artificial Sequence
  chemically synthesized
gaagcatgatttgggcaattca

SEQ ID NO: 1167419 - DNA, 22 bp, Artificial Sequence
  chemically synthesized
cttatctcagtttgaattgccc

SEQ ID NO: 1167420 - DNA, 22 bp, Artificial Sequence
  chemically synthesized
attacttatctcagtttgaatt

SEQ ID NO: 1167421 - DNA, 22 bp, Artificial Sequence
  chemically synthesized
gattacttatctcagtttgaat

SEQ ID NO: 1167422 - DNA, 22 bp, Artificial Sequence
  chemically synthesized
gggcaattcaaactgagataag

SEQ ID NO: 1167423 - DNA, 22 bp, Artificial Sequence
  chemically synthesized
ggcaattcaaactgagataagt

SEQ ID NO: 1167424 - DNA, 22 bp, Artificial Sequence
  chemically synthesized
catgtagccacttgattactta

SEQ ID NO: 1167425 - DNA, 22 bp, Artificial Sequence
  chemically synthesized
aaactgagataagtaatcaagt

SEQ ID NO: 1167426 - DNA, 22 bp, Artificial Sequence
  chemically synthesized
cctacatgtagccacttgatta

SEQ ID NO: 1167427 - DNA, 22 bp, Artificial Sequence
  chemically synthesized
actacctacatgtagccacttg

SEQ ID NO: 1167428 - DNA, 22 bp, Artificial Sequence
  chemically synthesized
agataagtaatcaagtggctac

SEQ ID NO: 1167429 - DNA, 22 bp, Artificial Sequence
  chemically synthesized
cactacctacatgtagccactt

SEQ ID NO: 1167430 - DNA, 22 bp, Artificial Sequence
  chemically synthesized
gtttcactacctacatgtagcc

SEQ ID NO: 1167431 - DNA, 22 bp, Artificial Sequence
  chemically synthesized
ctggtttcactacctacatgta

SEQ ID NO: 1167432 - DNA, 22 bp, Artificial Sequence
  chemically synthesized
ggctgctggtttcactacctac

SEQ ID NO: 1167433 - DNA, 22 bp, Artificial Sequence
  chemically synthesized
ctgggctgctggtttcactacc

SEQ ID NO: 1167434 - DNA, 22 bp, Artificial Sequence
  chemically synthesized
gctgggctgctggtttcactac

SEQ ID NO: 1167435 - DNA, 22 bp, Artificial Sequence
  chemically synthesized
catgtaggtagtgaaaccagca

SEQ ID NO: 1167436 - DNA, 22 bp, Artificial Sequence
  chemically synthesized
tggtttgctgggctgctggttt

SEQ ID NO: 1167437 - DNA, 22 bp, Artificial Sequence
  chemically synthesized
gtggtttgctgggctgctggtt

SEQ ID NO: 1167438 - DNA, 22 bp, Artificial Sequence
  chemically synthesized
tgtggtttgctgggctgctggt

SEQ ID NO: 1167439 - DNA, 22 bp, Artificial Sequence
  chemically synthesized
agagctttgtggtttgctgggc

SEQ ID NO: 1167440 - DNA, 22 bp, Artificial Sequence
  chemically synthesized
taagagctttgtggtttgctgg

SEQ ID NO: 1167441 - DNA, 22 bp, Artificial Sequence
  chemically synthesized
ctaagagctttgtggtttgctg

SEQ ID NO: 1167442 - DNA, 22 bp, Artificial Sequence
  chemically synthesized
tctaagagctttgtggtttgct

SEQ ID NO: 1167443 - DNA, 22 bp, Artificial Sequence
  chemically synthesized
ttctaagagctttgtggtttgc

SEQ ID NO: 1167444 - DNA, 22 bp, Artificial Sequence
  chemically synthesized
tttctaagagctttgtggtttg

SEQ ID NO: 1167445 - DNA, 22 bp, Artificial Sequence
  chemically synthesized
ttttttctaagagctttgtggt

SEQ ID NO: 1167446 - DNA, 22 bp, Artificial Sequence
  chemically synthesized
atagtgtcccagctattttttc

SEQ ID NO: 1167447 - DNA, 22 bp, Artificial Sequence
  chemically synthesized
tcatagtgtcccagctattttt

SEQ ID NO: 1167448 - DNA, 22 bp, Artificial Sequence
  chemically synthesized
ttagaaaaaatagctgggacac

SEQ ID NO: 1167449 - DNA, 22 bp, Artificial Sequence
  chemically synthesized
tgccctctcatagtgtcccagc

SEQ ID NO: 1167450 - DNA, 22 bp, Artificial Sequence
  chemically synthesized
agaaaaaatagctgggacacta

SEQ ID NO: 1167451 - DNA, 22 bp, Artificial Sequence
  chemically synthesized
gaaaaaatagctgggacactat

SEQ ID NO: 1167452 - DNA, 22 bp, Artificial Sequence
  chemically synthesized
agtgatagactgtgccctctca

SEQ ID NO: 1167453 - DNA, 22 bp, Artificial Sequence
  chemically synthesized
ctcagtgatagactgtgccctc

SEQ ID NO: 1167454 - DNA, 22 bp, Artificial Sequence
  chemically synthesized
ggacactatgagagggcacagt

SEQ ID NO: 1167455 - DNA, 22 bp, Artificial Sequence
  chemically synthesized
tgagagggcacagtctatcact

SEQ ID NO: 1167456 - DNA, 22 bp, Artificial Sequence
  chemically synthesized
tcagtgatataaaactgctcag

SEQ ID NO: 1167457 - DNA, 22 bp, Artificial Sequence
  chemically synthesized
atcagtgatataaaactgctca

SEQ ID NO: 1167458 - DNA, 22 bp, Artificial Sequence
  chemically synthesized
tatcagtgatataaaactgctc

SEQ ID NO: 1167459 - DNA, 22 bp, Artificial Sequence
  chemically synthesized
tcactgagcagttttatatcac

SEQ ID NO: 1167460 - DNA, 22 bp, Artificial Sequence
  chemically synthesized
agcagttttatatcactgataa

SEQ ID NO: 1167461 - DNA, 22 bp, Artificial Sequence
  chemically synthesized
ccaaaatccattttatcagtga

SEQ ID NO: 1167462 - DNA, 22 bp, Artificial Sequence
  chemically synthesized
tatatcactgataaaatggatt

SEQ ID NO: 1167463 - DNA, 22 bp, Artificial Sequence
  chemically synthesized
atatcactgataaaatggattt

SEQ ID NO: 1167464 - DNA, 22 bp, Artificial Sequence
  chemically synthesized
gataaattgccaaaatccattt

SEQ ID NO: 1167465 - DNA, 22 bp, Artificial Sequence
  chemically synthesized
tatcactgataaaatggatttt

SEQ ID NO: 1167466 - DNA, 22 bp, Artificial Sequence
  chemically synthesized
agataaattgccaaaatccatt

SEQ ID NO: 1167467 - DNA, 22 bp, Artificial Sequence
  chemically synthesized
aatttagataaattgccaaaat

SEQ ID NO: 1167468 - DNA, 22 bp, Artificial Sequence
  chemically synthesized
ataaaatggattttggcaattt

SEQ ID NO: 1167469 - DNA, 22 bp, Artificial Sequence
  chemically synthesized
aggctgaatttagataaattgc

SEQ ID NO: 1167470 - DNA, 22 bp, Artificial Sequence
  chemically synthesized
aaggctgaatttagataaattg

SEQ ID NO: 1167471 - DNA, 22 bp, Artificial Sequence
  chemically synthesized
taaggctgaatttagataaatt

SEQ ID NO: 1167472 - DNA, 22 bp, Artificial Sequence
  chemically synthesized
tggcaatttatctaaattcagc

SEQ ID NO: 1167473 - DNA, 22 bp, Artificial Sequence
  chemically synthesized
ggcaatttatctaaattcagcc

SEQ ID NO: 1167474 - DNA, 22 bp, Artificial Sequence
  chemically synthesized
gcaatttatctaaattcagcct

SEQ ID NO: 1167475 - DNA, 22 bp, Artificial Sequence
  chemically synthesized
atctaaattcagccttaaagta

SEQ ID NO: 1167476 - DNA, 22 bp, Artificial Sequence
  chemically synthesized
acagtcgtatcatactttaagg

SEQ ID NO: 1167477 - DNA, 22 bp, Artificial Sequence
  chemically synthesized
tctaaattcagccttaaagtat

SEQ ID NO: 1167478 - DNA, 22 bp, Artificial Sequence
  chemically synthesized
aattcagccttaaagtatgata

SEQ ID NO: 1167479 - DNA, 22 bp, Artificial Sequence
  chemically synthesized
agccttaaagtatgatacgact

SEQ ID NO: 1167480 - DNA, 22 bp, Artificial Sequence
  chemically synthesized
atccaggttaacagtcgtatca

SEQ ID NO: 1167481 - DNA, 22 bp, Artificial Sequence
  chemically synthesized
gatccaggttaacagtcgtatc

SEQ ID NO: 1167482 - DNA, 22 bp, Artificial Sequence
  chemically synthesized
tgatccaggttaacagtcgtat

SEQ ID NO: 1167483 - DNA, 22 bp, Artificial Sequence
  chemically synthesized
ttgatccaggttaacagtcgta

SEQ ID NO: 1167484 - DNA, 22 bp, Artificial Sequence
  chemically synthesized
aaagtatgatacgactgttaac

SEQ ID NO: 1167485 - DNA, 22 bp, Artificial Sequence
  chemically synthesized
tttttgatccaggttaacagtc

SEQ ID NO: 1167486 - DNA, 22 bp, Artificial Sequence
  chemically synthesized
aagtatgatacgactgttaacc

SEQ ID NO: 1167487 - DNA, 22 bp, Artificial Sequence
  chemically synthesized
aagaccaataaaactgtttttg

SEQ ID NO: 1167488 - DNA, 22 bp, Artificial Sequence
  chemically synthesized
ttaacctggatcaaaaacagtt

SEQ ID NO: 1167489 - DNA, 22 bp, Artificial Sequence
  chemically synthesized
acctggatcaaaaacagtttta

SEQ ID NO: 1167490 - DNA, 22 bp, Artificial Sequence
  chemically synthesized
tgcattcaagaccaataaaact

SEQ ID NO: 1167491 - DNA, 22 bp, Artificial Sequence
  chemically synthesized
atgcattcaagaccaataaaac

SEQ ID NO: 1167492 - DNA, 22 bp, Artificial Sequence
  chemically synthesized
gatcaaaaacagttttattggt

SEQ ID NO: 1167493 - DNA, 22 bp, Artificial Sequence
  chemically synthesized
aagcatttatgcattcaagacc

SEQ ID NO: 1167494 - DNA, 22 bp, Artificial Sequence
  chemically synthesized
gaagcatttatgcattcaagac

SEQ ID NO: 1167495 - DNA, 22 bp, Artificial Sequence
  chemically synthesized
ttgaagcatttatgcattcaag

SEQ ID NO: 1167496 - DNA, 22 bp, Artificial Sequence
  chemically synthesized
tattggtcttgaatgcataaat

SEQ ID NO: 1167497 - DNA, 22 bp, Artificial Sequence
  chemically synthesized
attggtcttgaatgcataaatg

SEQ ID NO: 1167498 - DNA, 22 bp, Artificial Sequence
  chemically synthesized
ttggtcttgaatgcataaatgc

SEQ ID NO: 1167499 - DNA, 22 bp, Artificial Sequence
  chemically synthesized
caaatgttcttgaagcatttat

SEQ ID NO: 1167500 - DNA, 22 bp, Artificial Sequence
  chemically synthesized
gtcttgaatgcataaatgcttc

SEQ ID NO: 1167501 - DNA, 22 bp, Artificial Sequence
  chemically synthesized
gcaaatgttcttgaagcattta

SEQ ID NO: 1167502 - DNA, 22 bp, Artificial Sequence
  chemically synthesized
gaatgcataaatgcttcaagaa

SEQ ID NO: 1167503 - DNA, 22 bp, Artificial Sequence
  chemically synthesized
aatgcataaatgcttcaagaac

SEQ ID NO: 1167504 - DNA, 22 bp, Artificial Sequence
  chemically synthesized
agaatgataaaatttgcaaatg

SEQ ID NO: 1167505 - DNA, 22 bp, Artificial Sequence
  chemically synthesized
caagaacatttgcaaattttat

SEQ ID NO: 1167506 - DNA, 22 bp, Artificial Sequence
  chemically synthesized
aagaacatttgcaaattttatc

SEQ ID NO: 1167507 - DNA, 22 bp, Artificial Sequence
  chemically synthesized
aatgaactgagaatgataaaat

SEQ ID NO: 1167508 - DNA, 22 bp, Artificial Sequence
  chemically synthesized
aaatgaactgagaatgataaaa

SEQ ID NO: 1167509 - DNA, 22 bp, Artificial Sequence
  chemically synthesized
gcaaattttatcattctcagtt

SEQ ID NO: 1167510 - DNA, 22 bp, Artificial Sequence
  chemically synthesized
caaattttatcattctcagttc

SEQ ID NO: 1167511 - DNA, 22 bp, Artificial Sequence
  chemically synthesized
tatcattctcagttcatttaaa

SEQ ID NO: 1167512 - DNA, 22 bp, Artificial Sequence
  chemically synthesized
atcattctcagttcatttaaat

SEQ ID NO: 1167513 - DNA, 22 bp, Artificial Sequence
  chemically synthesized
tcattctcagttcatttaaatg

SEQ ID NO: 1167514 - DNA, 22 bp, Artificial Sequence
  chemically synthesized
tcagttcatttaaatgtatcat

SEQ ID NO: 1167515 - DNA, 22 bp, Artificial Sequence
  chemically synthesized
agttcatttaaatgtatcatac

SEQ ID NO: 1167516 - DNA, 22 bp, Artificial Sequence
  chemically synthesized
catgaaaaagaagtatgataca

SEQ ID NO: 1167517 - DNA, 22 bp, Artificial Sequence
  chemically synthesized
atttaaatgtatcatacttctt

SEQ ID NO: 1167518 - DNA, 22 bp, Artificial Sequence
  chemically synthesized
gactccatgaaaaagaagtatg

SEQ ID NO: 1167519 - DNA, 22 bp, Artificial Sequence
  chemically synthesized
agactccatgaaaaagaagtat

SEQ ID NO: 1167520 - DNA, 22 bp, Artificial Sequence
  chemically synthesized
aaatgtatcatacttctttttc

SEQ ID NO: 1167521 - DNA, 22 bp, Artificial Sequence
  chemically synthesized
aatgtatcatacttctttttca

SEQ ID NO: 1167522 - DNA, 22 bp, Artificial Sequence
  chemically synthesized
acttagactccatgaaaaagaa

SEQ ID NO: 1167523 - DNA, 22 bp, Artificial Sequence
  chemically synthesized
ctttttcatggagtctaagtca

SEQ ID NO: 1167524 - DNA, 22 bp, Artificial Sequence
  chemically synthesized
tttttcatggagtctaagtcaa

SEQ ID NO: 1167525 - DNA, 22 bp, Artificial Sequence
  chemically synthesized
accatccatgcattgacttaga

SEQ ID NO: 1167526 - DNA, 22 bp, Artificial Sequence
  chemically synthesized
tttcatggagtctaagtcaatg

SEQ ID NO: 1167527 - DNA, 22 bp, Artificial Sequence
  chemically synthesized
ttcatggagtctaagtcaatgc

SEQ ID NO: 1167528 - DNA, 22 bp, Artificial Sequence
  chemically synthesized
tcatggagtctaagtcaatgca

SEQ ID NO: 1167529 - DNA, 22 bp, Artificial Sequence
  chemically synthesized
catggagtctaagtcaatgcat

SEQ ID NO: 1167530 - DNA, 22 bp, Artificial Sequence
  chemically synthesized
atggagtctaagtcaatgcatg

SEQ ID NO: 1167531 - DNA, 22 bp, Artificial Sequence
  chemically synthesized
agtcaatgcatggatggtgaat

SEQ ID NO: 1167532 - DNA, 22 bp, Artificial Sequence
  chemically synthesized
tagaatacaccaaaaaattcac

SEQ ID NO: 1167533 - DNA, 22 bp, Artificial Sequence
  chemically synthesized
aggggtaaaaagattatagaat

SEQ ID NO: 1167534 - DNA, 22 bp, Artificial Sequence
  chemically synthesized
ctgaggggtaaaaagattatag

SEQ ID NO: 1167535 - DNA, 22 bp, Artificial Sequence
  chemically synthesized
tttggtgtattctataatcttt

SEQ ID NO: 1167536 - DNA, 22 bp, Artificial Sequence
  chemically synthesized
actgaggggtaaaaagattata

SEQ ID NO: 1167537 - DNA, 22 bp, Artificial Sequence
  chemically synthesized
ttggtgtattctataatctttt

SEQ ID NO: 1167538 - DNA, 22 bp, Artificial Sequence
  chemically synthesized
tactgaggggtaaaaagattat

SEQ ID NO: 1167539 - DNA, 22 bp, Artificial Sequence
  chemically synthesized
tggtgtattctataatcttttt

SEQ ID NO: 1167540 - DNA, 22 bp, Artificial Sequence
  chemically synthesized
ttactgaggggtaaaaagatta

SEQ ID NO: 1167541 - DNA, 22 bp, Artificial Sequence
  chemically synthesized
ggtgtattctataatcttttta

SEQ ID NO: 1167542 - DNA, 22 bp, Artificial Sequence
  chemically synthesized
gtgtattctataatctttttac

SEQ ID NO: 1167543 - DNA, 22 bp, Artificial Sequence
  chemically synthesized
tataatctttttacccctcagt

SEQ ID NO: 1167544 - DNA, 22 bp, Artificial Sequence
  chemically synthesized
gaaataatcttttactgagggg

SEQ ID NO: 1167545 - DNA, 22 bp, Artificial Sequence
  chemically synthesized
taatctttttacccctcagtaa

SEQ ID NO: 1167546 - DNA, 22 bp, Artificial Sequence
  chemically synthesized
ggaaataatcttttactgaggg

SEQ ID NO: 1167547 - DNA, 22 bp, Artificial Sequence
  chemically synthesized
tcttggaaataatcttttactg

SEQ ID NO: 1167548 - DNA, 22 bp, Artificial Sequence
  chemically synthesized
atcttggaaataatcttttact

SEQ ID NO: 1167549 - DNA, 22 bp, Artificial Sequence
  chemically synthesized
tatcttggaaataatcttttac

SEQ ID NO: 1167550 - DNA, 22 bp, Artificial Sequence
  chemically synthesized
tttacccctcagtaaaagatta

SEQ ID NO: 1167551 - DNA, 22 bp, Artificial Sequence
  chemically synthesized
ttacccctcagtaaaagattat

SEQ ID NO: 1167552 - DNA, 22 bp, Artificial Sequence
  chemically synthesized
tacccctcagtaaaagattatt

SEQ ID NO: 1167553 - DNA, 22 bp, Artificial Sequence
  chemically synthesized
acccctcagtaaaagattattt

SEQ ID NO: 1167554 - DNA, 22 bp, Artificial Sequence
  chemically synthesized
cccctcagtaaaagattatttc

SEQ ID NO: 1167555 - DNA, 22 bp, Artificial Sequence
  chemically synthesized
taatcctttatcttggaaataa

SEQ ID NO: 1167556 - DNA, 22 bp, Artificial Sequence
  chemically synthesized
tgtaatcctttatcttggaaat

SEQ ID NO: 1167557 - DNA, 22 bp, Artificial Sequence
  chemically synthesized
agtaaaagattatttccaagat

SEQ ID NO: 1167558 - DNA, 22 bp, Artificial Sequence
  chemically synthesized
tccctctgtaatcctttatctt

SEQ ID NO: 1167559 - DNA, 22 bp, Artificial Sequence
  chemically synthesized
gttatccctctgtaatccttta

SEQ ID NO: 1167560 - DNA, 22 bp, Artificial Sequence
  chemically synthesized
ggttatccctctgtaatccttt

SEQ ID NO: 1167561 - DNA, 22 bp, Artificial Sequence
  chemically synthesized
tttccaagataaaggattacag

SEQ ID NO: 1167562 - DNA, 22 bp, Artificial Sequence
  chemically synthesized
ccaagataaaggattacagagg

SEQ ID NO: 1167563 - DNA, 22 bp, Artificial Sequence
  chemically synthesized
caagataaaggattacagaggg

SEQ ID NO: 1167564 - DNA, 22 bp, Artificial Sequence
  chemically synthesized
gtgaaagaaccgcttggttatc

SEQ ID NO: 1167565 - DNA, 22 bp, Artificial Sequence
  chemically synthesized
agtgaaagaaccgcttggttat

SEQ ID NO: 1167566 - DNA, 22 bp, Artificial Sequence
  chemically synthesized
tttagtgaaagaaccgcttggt

SEQ ID NO: 1167567 - DNA, 22 bp, Artificial Sequence
  chemically synthesized
cagagggataaccaagcggttc

SEQ ID NO: 1167568 - DNA, 22 bp, Artificial Sequence
  chemically synthesized
ttatttagtgaaagaaccgctt

SEQ ID NO: 1167569 - DNA, 22 bp, Artificial Sequence
  chemically synthesized
tgttatttagtgaaagaaccgc

SEQ ID NO: 1167570 - DNA, 22 bp, Artificial Sequence
  chemically synthesized
ctgttatttagtgaaagaaccg

SEQ ID NO: 1167571 - DNA, 22 bp, Artificial Sequence
  chemically synthesized
ttctgttatttagtgaaagaac

SEQ ID NO: 1167572 - DNA, 22 bp, Artificial Sequence
  chemically synthesized
agaaatgctcttctgttattta

SEQ ID NO: 1167573 - DNA, 22 bp, Artificial Sequence
  chemically synthesized
ttcagaaatgctcttctgttat

SEQ ID NO: 1167574 - DNA, 22 bp, Artificial Sequence
  chemically synthesized
tttcactaaataacagaagagc

SEQ ID NO: 1167575 - DNA, 22 bp, Artificial Sequence
  chemically synthesized
gttgttcagaaatgctcttctg

SEQ ID NO: 1167576 - DNA, 22 bp, Artificial Sequence
  chemically synthesized
tcactaaataacagaagagcat

SEQ ID NO: 1167577 - DNA, 22 bp, Artificial Sequence
  chemically synthesized
cactaaataacagaagagcatt

SEQ ID NO: 1167578 - DNA, 22 bp, Artificial Sequence
  chemically synthesized
actaaataacagaagagcattt

SEQ ID NO: 1167579 - DNA, 22 bp, Artificial Sequence
  chemically synthesized
atcctggttgttcagaaatgct

SEQ ID NO: 1167580 - DNA, 22 bp, Artificial Sequence
  chemically synthesized
aataacagaagagcatttctga

SEQ ID NO: 1167581 - DNA, 22 bp, Artificial Sequence
  chemically synthesized
caggtactaatcctggttgttc

SEQ ID NO: 1167582 - DNA, 22 bp, Artificial Sequence
  chemically synthesized
ccaggtactaatcctggttgtt

SEQ ID NO: 1167583 - DNA, 22 bp, Artificial Sequence
  chemically synthesized
ctgaacaaccaggattagtacc

SEQ ID NO: 1167584 - DNA, 22 bp, Artificial Sequence
  chemically synthesized
tgaacaaccaggattagtacct

SEQ ID NO: 1167585 - DNA, 22 bp, Artificial Sequence
  chemically synthesized
aacaaccaggattagtacctgg

SEQ ID NO: 1167586 - DNA, 22 bp, Artificial Sequence
  chemically synthesized
gtacctggaaatattcttgaca

SEQ ID NO: 1167587 - DNA, 22 bp, Artificial Sequence
  chemically synthesized
gaaatattcttgacacatttcc

SEQ ID NO: 1167588 - DNA, 22 bp, Artificial Sequence
  chemically synthesized
tgagaaaacacagcggaaatgt

SEQ ID NO: 1167589 - DNA, 22 bp, Artificial Sequence
  chemically synthesized
tatctgtgagaaaacacagcgg

SEQ ID NO: 1167590 - DNA, 22 bp, Artificial Sequence
  chemically synthesized
ttgacacatttccgctgtgttt

SEQ ID NO: 1167591 - DNA, 22 bp, Artificial Sequence
  chemically synthesized
gacacatttccgctgtgttttc

SEQ ID NO: 1167592 - DNA, 22 bp, Artificial Sequence
  chemically synthesized
acacatttccgctgtgttttct

SEQ ID NO: 1167593 - DNA, 22 bp, Artificial Sequence
  chemically synthesized
cgtgttatatctgtgagaaaac

SEQ ID NO: 1167594 - DNA, 22 bp, Artificial Sequence
  chemically synthesized
acgtgttatatctgtgagaaaa

SEQ ID NO: 1167595 - DNA, 22 bp, Artificial Sequence
  chemically synthesized
ccgctgtgttttctcacagata

SEQ ID NO: 1167596 - DNA, 22 bp, Artificial Sequence
  chemically synthesized
gtttacgtgttatatctgtgag

SEQ ID NO: 1167597 - DNA, 22 bp, Artificial Sequence
  chemically synthesized
cgctgtgttttctcacagatat

SEQ ID NO: 1167598 - DNA, 22 bp, Artificial Sequence
  chemically synthesized
ggtttacgtgttatatctgtga

SEQ ID NO: 1167599 - DNA, 22 bp, Artificial Sequence
  chemically synthesized
tgttttctcacagatataacac

SEQ ID NO: 1167600 - DNA, 22 bp, Artificial Sequence
  chemically synthesized
tctcacagatataacacgtaaa

SEQ ID NO: 1167601 - DNA, 22 bp, Artificial Sequence
  chemically synthesized
ctcacagatataacacgtaaac

SEQ ID NO: 1167602 - DNA, 22 bp, Artificial Sequence
  chemically synthesized
aatagtaccttggtttacgtgt

SEQ ID NO: 1167603 - DNA, 22 bp, Artificial Sequence
  chemically synthesized
tcacagatataacacgtaaacc

SEQ ID NO: 1167604 - DNA, 22 bp, Artificial Sequence
  chemically synthesized
gaatagtaccttggtttacgtg

SEQ ID NO: 1167605 - DNA, 22 bp, Artificial Sequence
  chemically synthesized
tgaatagtaccttggtttacgt

SEQ ID NO: 1167606 - DNA, 22 bp, Artificial Sequence
  chemically synthesized
acagatataacacgtaaaccaa

SEQ ID NO: 1167607 - DNA, 22 bp, Artificial Sequence
  chemically synthesized
tgctttgaatagtaccttggtt

SEQ ID NO: 1167608 - DNA, 22 bp, Artificial Sequence
  chemically synthesized
atgctttgaatagtaccttggt

SEQ ID NO: 1167609 - DNA, 22 bp, Artificial Sequence
  chemically synthesized
tatgctttgaatagtaccttgg

SEQ ID NO: 1167610 - DNA, 22 bp, Artificial Sequence
  chemically synthesized
ttatgctttgaatagtaccttg

SEQ ID NO: 1167611 - DNA, 22 bp, Artificial Sequence
  chemically synthesized
agtaatcatttttatgctttga

SEQ ID NO: 1167612 - DNA, 22 bp, Artificial Sequence
  chemically synthesized
cagtaatcatttttatgctttg

SEQ ID NO: 1167613 - DNA, 22 bp, Artificial Sequence
  chemically synthesized
ttcaaagcataaaaatgattac

SEQ ID NO: 1167614 - DNA, 22 bp, Artificial Sequence
  chemically synthesized
ataaatcacttcagtaatcatt

SEQ ID NO: 1167615 - DNA, 22 bp, Artificial Sequence
  chemically synthesized
aaagcataaaaatgattactga

SEQ ID NO: 1167616 - DNA, 22 bp, Artificial Sequence
  chemically synthesized
tcataaatcacttcagtaatca

SEQ ID NO: 1167617 - DNA, 22 bp, Artificial Sequence
  chemically synthesized
ctcataaatcacttcagtaatc

SEQ ID NO: 1167618 - DNA, 22 bp, Artificial Sequence
  chemically synthesized
atttctcataaatcacttcagt

SEQ ID NO: 1167619 - DNA, 22 bp, Artificial Sequence
  chemically synthesized
catgatggattaatttctcata

SEQ ID NO: 1167620 - DNA, 22 bp, Artificial Sequence
  chemically synthesized
ctgaagtgatttatgagaaatt

SEQ ID NO: 1167621 - DNA, 22 bp, Artificial Sequence
  chemically synthesized
aagtgatttatgagaaattaat

SEQ ID NO: 1167622 - DNA, 22 bp, Artificial Sequence
  chemically synthesized
atgagaaattaatccatcatgc

SEQ ID NO: 1167623 - DNA, 22 bp, Artificial Sequence
  chemically synthesized
tgagaaattaatccatcatgca

SEQ ID NO: 1167624 - DNA, 22 bp, Artificial Sequence
  chemically synthesized
aatgtcatgtacagtgttgcat

SEQ ID NO: 1167625 - DNA, 22 bp, Artificial Sequence
  chemically synthesized
atccatcatgcaacactgtaca

SEQ ID NO: 1167626 - DNA, 22 bp, Artificial Sequence
  chemically synthesized
ggttgaatgtcatgtacagtgt

SEQ ID NO: 1167627 - DNA, 22 bp, Artificial Sequence
  chemically synthesized
atagtgtcattaggttgaatgt

SEQ ID NO: 1167628 - DNA, 22 bp, Artificial Sequence
  chemically synthesized
aatagtgtcattaggttgaatg

SEQ ID NO: 1167629 - DNA, 22 bp, Artificial Sequence
  chemically synthesized
tttaatagtgtcattaggttga

SEQ ID NO: 1167630 - DNA, 22 bp, Artificial Sequence
  chemically synthesized
tacatgacattcaacctaatga

SEQ ID NO: 1167631 - DNA, 22 bp, Artificial Sequence
  chemically synthesized
cctatttaatagtgtcattagg

SEQ ID NO: 1167632 - DNA, 22 bp, Artificial Sequence
  chemically synthesized
aaaattacctatttaatagtgt

SEQ ID NO: 1167633 - DNA, 22 bp, Artificial Sequence
  chemically synthesized
aacctaatgacactattaaata

SEQ ID NO: 1167634 - DNA, 22 bp, Artificial Sequence
  chemically synthesized
tattaaaaattacctatttaat

SEQ ID NO: 1167635 - DNA, 22 bp, Artificial Sequence
  chemically synthesized
atgacactattaaataggtaat

SEQ ID NO: 1167636 - DNA, 22 bp, Artificial Sequence
  chemically synthesized
tctatattaaaaattacctatt

SEQ ID NO: 1167637 - DNA, 22 bp, Artificial Sequence
  chemically synthesized
aggccctatctatattaaaaat

SEQ ID NO: 1167638 - DNA, 22 bp, Artificial Sequence
  chemically synthesized
ttaaataggtaatttttaatat

SEQ ID NO: 1167639 - DNA, 22 bp, Artificial Sequence
  chemically synthesized
caggccctatctatattaaaaa

SEQ ID NO: 1167640 - DNA, 22 bp, Artificial Sequence
  chemically synthesized
aataggtaatttttaatataga

SEQ ID NO: 1167641 - DNA, 22 bp, Artificial Sequence
  chemically synthesized
aatttcaggccctatctatatt

SEQ ID NO: 1167642 - DNA, 22 bp, Artificial Sequence
  chemically synthesized
aactcaatttcaggccctatct

SEQ ID NO: 1167643 - DNA, 22 bp, Artificial Sequence
  chemically synthesized
gaactcaatttcaggccctatc

SEQ ID NO: 1167644 - DNA, 22 bp, Artificial Sequence
  chemically synthesized
tgaactcaatttcaggccctat

SEQ ID NO: 1167645 - DNA, 22 bp, Artificial Sequence
  chemically synthesized
ttaatatagatagggcctgaaa

SEQ ID NO: 1167646 - DNA, 22 bp, Artificial Sequence
  chemically synthesized
taatatagatagggcctgaaat

SEQ ID NO: 1167647 - DNA, 22 bp, Artificial Sequence
  chemically synthesized
actttgaactcaatttcaggcc

SEQ ID NO: 1167648 - DNA, 22 bp, Artificial Sequence
  chemically synthesized
aatatagatagggcctgaaatt

SEQ ID NO: 1167649 - DNA, 22 bp, Artificial Sequence
  chemically synthesized
aactttgaactcaatttcaggc

SEQ ID NO: 1167650 - DNA, 22 bp, Artificial Sequence
  chemically synthesized
atatagatagggcctgaaattg

SEQ ID NO: 1167651 - DNA, 22 bp, Artificial Sequence
  chemically synthesized
gggcttaactttgaactcaatt

SEQ ID NO: 1167652 - DNA, 22 bp, Artificial Sequence
  chemically synthesized
attagggcttaactttgaactc

SEQ ID NO: 1167653 - DNA, 22 bp, Artificial Sequence
  chemically synthesized
aaattgagttcaaagttaagcc

SEQ ID NO: 1167654 - DNA, 22 bp, Artificial Sequence
  chemically synthesized
aatcctcattagggcttaactt

SEQ ID NO: 1167655 - DNA, 22 bp, Artificial Sequence
  chemically synthesized
ctaaatcctcattagggcttaa

SEQ ID NO: 1167656 - DNA, 22 bp, Artificial Sequence
  chemically synthesized
cctaaatcctcattagggctta

SEQ ID NO: 1167657 - DNA, 22 bp, Artificial Sequence
  chemically synthesized
tcctaaatcctcattagggctt

SEQ ID NO: 1167658 - DNA, 22 bp, Artificial Sequence
  chemically synthesized
agttcaaagttaagccctaatg

SEQ ID NO: 1167659 - DNA, 22 bp, Artificial Sequence
  chemically synthesized
ttcctaaatcctcattagggct

SEQ ID NO: 1167660 - DNA, 22 bp, Artificial Sequence
  chemically synthesized
aaagttaagccctaatgaggat

SEQ ID NO: 1167661 - DNA, 22 bp, Artificial Sequence
  chemically synthesized
agccctaatgaggatttaggaa

SEQ ID NO: 1167662 - DNA, 22 bp, Artificial Sequence
  chemically synthesized
acagcaggccatgatttttcct

SEQ ID NO: 1167663 - DNA, 22 bp, Artificial Sequence
  chemically synthesized
atgaggatttaggaaaaatcat

SEQ ID NO: 1167664 - DNA, 22 bp, Artificial Sequence
  chemically synthesized
ccctaacagcaggccatgattt

SEQ ID NO: 1167665 - DNA, 22 bp, Artificial Sequence
  chemically synthesized
ttgccctaacagcaggccatga

SEQ ID NO: 1167666 - DNA, 22 bp, Artificial Sequence
  chemically synthesized
aggaaaaatcatggcctgctgt

SEQ ID NO: 1167667 - DNA, 22 bp, Artificial Sequence
  chemically synthesized
attgttgccctaacagcaggcc

SEQ ID NO: 1167668 - DNA, 22 bp, Artificial Sequence
  chemically synthesized
ggaaaaatcatggcctgctgtt

SEQ ID NO: 1167669 - DNA, 22 bp, Artificial Sequence
  chemically synthesized
ttgattgttgccctaacagcag

SEQ ID NO: 1167670 - DNA, 22 bp, Artificial Sequence
  chemically synthesized
ttgttgattgttgccctaacag

SEQ ID NO: 1167671 - DNA, 22 bp, Artificial Sequence
  chemically synthesized
gttgttgattgttgccctaaca

SEQ ID NO: 1167672 - DNA, 22 bp, Artificial Sequence
  chemically synthesized
tatttgttgttgattgttgccc

SEQ ID NO: 1167673 - DNA, 22 bp, Artificial Sequence
  chemically synthesized
ctgttagggcaacaatcaacaa

SEQ ID NO: 1167674 - DNA, 22 bp, Artificial Sequence
  chemically synthesized
ttagggcaacaatcaacaacaa

SEQ ID NO: 1167675 - DNA, 22 bp, Artificial Sequence
  chemically synthesized
gggcaacaatcaacaacaaata

SEQ ID NO: 1167676 - DNA, 22 bp, Artificial Sequence
  chemically synthesized
tatatgcggtagtagttgtatt

SEQ ID NO: 1167677 - DNA, 22 bp, Artificial Sequence
  chemically synthesized
ttgtatatgcggtagtagttgt

SEQ ID NO: 1167678 - DNA, 22 bp, Artificial Sequence
  chemically synthesized
ctgttgtatatgcggtagtagt

SEQ ID NO: 1167679 - DNA, 22 bp, Artificial Sequence
  chemically synthesized
ttgctgttgtatatgcggtagt

SEQ ID NO: 1167680 - DNA, 22 bp, Artificial Sequence
  chemically synthesized
ttattgctgttgtatatgcggt

SEQ ID NO: 1167681 - DNA, 22 bp, Artificial Sequence
  chemically synthesized
ttgttattgctgttgtatatgc

SEQ ID NO: 1167682 - DNA, 22 bp, Artificial Sequence
  chemically synthesized
ctaccgcatatacaacagcaat

SEQ ID NO: 1167683 - DNA, 22 bp, Artificial Sequence
  chemically synthesized
ccgcatatacaacagcaataac

SEQ ID NO: 1167684 - DNA, 22 bp, Artificial Sequence
  chemically synthesized
aataaataatggcagctgttgt

SEQ ID NO: 1167685 - DNA, 22 bp, Artificial Sequence
  chemically synthesized
agtactcaataaataatggcag

SEQ ID NO: 1167686 - DNA, 22 bp, Artificial Sequence
  chemically synthesized
acactaagtactcaataaataa

SEQ ID NO: 1167687 - DNA, 22 bp, Artificial Sequence
  chemically synthesized
actgacactaagtactcaataa

SEQ ID NO: 1167688 - DNA, 22 bp, Artificial Sequence
  chemically synthesized
ccattatttattgagtacttag

SEQ ID NO: 1167689 - DNA, 22 bp, Artificial Sequence
  chemically synthesized
gcaaattgactgacactaagta

SEQ ID NO: 1167690 - DNA, 22 bp, Artificial Sequence
  chemically synthesized
tttattgagtacttagtgtcag

SEQ ID NO: 1167691 - DNA, 22 bp, Artificial Sequence
  chemically synthesized
attgagtacttagtgtcagtca

SEQ ID NO: 1167692 - DNA, 22 bp, Artificial Sequence
  chemically synthesized
ttgagtacttagtgtcagtcaa

SEQ ID NO: 1167693 - DNA, 22 bp, Artificial Sequence
  chemically synthesized
agtgattagcaaattgactgac

SEQ ID NO: 1167694 - DNA, 22 bp, Artificial Sequence
  chemically synthesized
agtacttagtgtcagtcaattt

SEQ ID NO: 1167695 - DNA, 22 bp, Artificial Sequence
  chemically synthesized
agtgtcagtcaatttgctaatc

SEQ ID NO: 1167696 - DNA, 22 bp, Artificial Sequence
  chemically synthesized
gtgtcagtcaatttgctaatca

SEQ ID NO: 1167697 - DNA, 22 bp, Artificial Sequence
  chemically synthesized
gctaatcacttaacacgcatta

SEQ ID NO: 1167698 - DNA, 22 bp, Artificial Sequence
  chemically synthesized
ctaatcacttaacacgcattat

SEQ ID NO: 1167699 - DNA, 22 bp, Artificial Sequence
  chemically synthesized
tagtgaaaaatgatataatgcg

SEQ ID NO: 1167700 - DNA, 22 bp, Artificial Sequence
  chemically synthesized
atcacttaacacgcattatatc

SEQ ID NO: 1167701 - DNA, 22 bp, Artificial Sequence
  chemically synthesized
ttgtagtgaaaaatgatataat

SEQ ID NO: 1167702 - DNA, 22 bp, Artificial Sequence
  chemically synthesized
aacacgcattatatcatttttc

SEQ ID NO: 1167703 - DNA, 22 bp, Artificial Sequence
  chemically synthesized
atctgttgtagtgaaaaatgat

SEQ ID NO: 1167704 - DNA, 22 bp, Artificial Sequence
  chemically synthesized
acacgcattatatcatttttca

SEQ ID NO: 1167705 - DNA, 22 bp, Artificial Sequence
  chemically synthesized
tcaccctgatctgttgtagtga

SEQ ID NO: 1167706 - DNA, 22 bp, Artificial Sequence
  chemically synthesized
tatcaccctgatctgttgtagt

SEQ ID NO: 1167707 - DNA, 22 bp, Artificial Sequence
  chemically synthesized
tatcatttttcactacaacaga

SEQ ID NO: 1167708 - DNA, 22 bp, Artificial Sequence
  chemically synthesized
ctatcaccctgatctgttgtag

SEQ ID NO: 1167709 - DNA, 22 bp, Artificial Sequence
  chemically synthesized
atttctatcaccctgatctgtt

SEQ ID NO: 1167710 - DNA, 22 bp, Artificial Sequence
  chemically synthesized
ctaatttctatcaccctgatct

SEQ ID NO: 1167711 - DNA, 22 bp, Artificial Sequence
  chemically synthesized
ttcactacaacagatcagggtg

SEQ ID NO: 1167712 - DNA, 22 bp, Artificial Sequence
  chemically synthesized
tcactacaacagatcagggtga

SEQ ID NO: 1167713 - DNA, 22 bp, Artificial Sequence
  chemically synthesized
cactacaacagatcagggtgat

SEQ ID NO: 1167714 - DNA, 22 bp, Artificial Sequence
  chemically synthesized
actacaacagatcagggtgata

SEQ ID NO: 1167715 - DNA, 22 bp, Artificial Sequence
  chemically synthesized
atcctactaatttctatcaccc

SEQ ID NO: 1167716 - DNA, 22 bp, Artificial Sequence
  chemically synthesized
caacagatcagggtgatagaaa

SEQ ID NO: 1167717 - DNA, 22 bp, Artificial Sequence
  chemically synthesized
ctcatcctactaatttctatca

SEQ ID NO: 1167718 - DNA, 22 bp, Artificial Sequence
  chemically synthesized
cctcatcctactaatttctatc

SEQ ID NO: 1167719 - DNA, 22 bp, Artificial Sequence
  chemically synthesized
catttcctcatcctactaattt

SEQ ID NO: 1167720 - DNA, 22 bp, Artificial Sequence
  chemically synthesized
ccatttcctcatcctactaatt

SEQ ID NO: 1167721 - DNA, 22 bp, Artificial Sequence
  chemically synthesized
tttccatttcctcatcctacta

SEQ ID NO: 1167722 - DNA, 22 bp, Artificial Sequence
  chemically synthesized
tatttccatttcctcatcctac

SEQ ID NO: 1167723 - DNA, 22 bp, Artificial Sequence
  chemically synthesized
ctatttccatttcctcatccta

SEQ ID NO: 1167724 - DNA, 22 bp, Artificial Sequence
  chemically synthesized
tctatttccatttcctcatcct

SEQ ID NO: 1167725 - DNA, 22 bp, Artificial Sequence
  chemically synthesized
ttctatttccatttcctcatcc

SEQ ID NO: 1167726 - DNA, 22 bp, Artificial Sequence
  chemically synthesized
atttttctatttccatttcctc

SEQ ID NO: 1167727 - DNA, 22 bp, Artificial Sequence
  chemically synthesized
gtaggatgaggaaatggaaata

SEQ ID NO: 1167728 - DNA, 22 bp, Artificial Sequence
  chemically synthesized
gcaagtcatctaatttttctat

SEQ ID NO: 1167729 - DNA, 22 bp, Artificial Sequence
  chemically synthesized
ggcaagtcatctaatttttcta

SEQ ID NO: 1167730 - DNA, 22 bp, Artificial Sequence
  chemically synthesized
tggcaagtcatctaatttttct

SEQ ID NO: 1167731 - DNA, 22 bp, Artificial Sequence
  chemically synthesized
tgacctttggcaagtcatctaa

SEQ ID NO: 1167732 - DNA, 22 bp, Artificial Sequence
  chemically synthesized
gtgacctttggcaagtcatcta

SEQ ID NO: 1167733 - DNA, 22 bp, Artificial Sequence
  chemically synthesized
tgtgacctttggcaagtcatct

SEQ ID NO: 1167734 - DNA, 22 bp, Artificial Sequence
  chemically synthesized
cctttgtgacctttggcaagtc

SEQ ID NO: 1167735 - DNA, 22 bp, Artificial Sequence
  chemically synthesized
gatgacttgccaaaggtcacaa

SEQ ID NO: 1167736 - DNA, 22 bp, Artificial Sequence
  chemically synthesized
gccaaaggtcacaaaggtaact

SEQ ID NO: 1167737 - DNA, 22 bp, Artificial Sequence
  chemically synthesized
ccaaaggtcacaaaggtaactg

SEQ ID NO: 1167738 - DNA, 22 bp, Artificial Sequence
  chemically synthesized
agtcccagaaccaccagttacc

SEQ ID NO: 1167739 - DNA, 22 bp, Artificial Sequence
  chemically synthesized
aagtcccagaaccaccagttac

SEQ ID NO: 1167740 - DNA, 22 bp, Artificial Sequence
  chemically synthesized
taagtcccagaaccaccagtta

SEQ ID NO: 1167741 - DNA, 22 bp, Artificial Sequence
  chemically synthesized
gttttaagtcccagaaccacca

SEQ ID NO: 1167742 - DNA, 22 bp, Artificial Sequence
  chemically synthesized
gtggttctgggacttaaaacca

SEQ ID NO: 1167743 - DNA, 22 bp, Artificial Sequence
  chemically synthesized
gaatccaaacaacctggtttta

SEQ ID NO: 1167744 - DNA, 22 bp, Artificial Sequence
  chemically synthesized
ggaatccaaacaacctggtttt

SEQ ID NO: 1167745 - DNA, 22 bp, Artificial Sequence
  chemically synthesized
tggaatccaaacaacctggttt

SEQ ID NO: 1167746 - DNA, 22 bp, Artificial Sequence
  chemically synthesized
tgggacttaaaaccaggttgtt

SEQ ID NO: 1167747 - DNA, 22 bp, Artificial Sequence
  chemically synthesized
ggacttaaaaccaggttgtttg

SEQ ID NO: 1167748 - DNA, 22 bp, Artificial Sequence
  chemically synthesized
aaaaccaggttgtttggattcc

SEQ ID NO: 1167749 - DNA, 22 bp, Artificial Sequence
  chemically synthesized
aaaccaggttgtttggattcca

SEQ ID NO: 1167750 - DNA, 22 bp, Artificial Sequence
  chemically synthesized
ggataaagacgtgttttggaat

SEQ ID NO: 1167751 - DNA, 22 bp, Artificial Sequence
  chemically synthesized
tttggattccaaaacacgtctt

SEQ ID NO: 1167752 - DNA, 22 bp, Artificial Sequence
  chemically synthesized
atcatattgggataaagacgtg

SEQ ID NO: 1167753 - DNA, 22 bp, Artificial Sequence
  chemically synthesized
ggattccaaaacacgtctttat

SEQ ID NO: 1167754 - DNA, 22 bp, Artificial Sequence
  chemically synthesized
gattccaaaacacgtctttatc

SEQ ID NO: 1167755 - DNA, 22 bp, Artificial Sequence
  chemically synthesized
caaaacacgtctttatcccaat

SEQ ID NO: 1167756 - DNA, 22 bp, Artificial Sequence
  chemically synthesized
aagagattgatcatattgggat

SEQ ID NO: 1167757 - DNA, 22 bp, Artificial Sequence
  chemically synthesized
aaagagattgatcatattggga

SEQ ID NO: 1167758 - DNA, 22 bp, Artificial Sequence
  chemically synthesized
atttaaagagattgatcatatt

SEQ ID NO: 1167759 - DNA, 22 bp, Artificial Sequence
  chemically synthesized
catttaaagagattgatcatat

SEQ ID NO: 1167760 - DNA, 22 bp, Artificial Sequence
  chemically synthesized
ttcatttaaagagattgatcat

SEQ ID NO: 1167761 - DNA, 22 bp, Artificial Sequence
  chemically synthesized
cttcatttaaagagattgatca

SEQ ID NO: 1167762 - DNA, 22 bp, Artificial Sequence
  chemically synthesized
tcttcatttaaagagattgatc

SEQ ID NO: 1167763 - DNA, 22 bp, Artificial Sequence
  chemically synthesized
tatcccaatatgatcaatctct

SEQ ID NO: 1167764 - DNA, 22 bp, Artificial Sequence
  chemically synthesized
atcccaatatgatcaatctctt

SEQ ID NO: 1167765 - DNA, 22 bp, Artificial Sequence
  chemically synthesized
tcccaatatgatcaatctcttt

SEQ ID NO: 1167766 - DNA, 22 bp, Artificial Sequence
  chemically synthesized
attttcttcatttaaagagatt

SEQ ID NO: 1167767 - DNA, 22 bp, Artificial Sequence
  chemically synthesized
attcattttcttcatttaaaga

SEQ ID NO: 1167768 - DNA, 22 bp, Artificial Sequence
  chemically synthesized
aattcattttcttcatttaaag

SEQ ID NO: 1167769 - DNA, 22 bp, Artificial Sequence
  chemically synthesized
ttaattcattttcttcatttaa

SEQ ID NO: 1167770 - DNA, 22 bp, Artificial Sequence
  chemically synthesized
gactcttaattcattttcttca

SEQ ID NO: 1167771 - DNA, 22 bp, Artificial Sequence
  chemically synthesized
agactcttaattcattttcttc

SEQ ID NO: 1167772 - DNA, 22 bp, Artificial Sequence
  chemically synthesized
cttagactcttaattcattttc

SEQ ID NO: 1167773 - DNA, 22 bp, Artificial Sequence
  chemically synthesized
tttaaatgaagaaaatgaatta

SEQ ID NO: 1167774 - DNA, 22 bp, Artificial Sequence
  chemically synthesized
ttgcttagactcttaattcatt

SEQ ID NO: 1167775 - DNA, 22 bp, Artificial Sequence
  chemically synthesized
taaatgaagaaaatgaattaag

SEQ ID NO: 1167776 - DNA, 22 bp, Artificial Sequence
  chemically synthesized
aaatgaagaaaatgaattaaga

SEQ ID NO: 1167777 - DNA, 22 bp, Artificial Sequence
  chemically synthesized
aatgaagaaaatgaattaagag

SEQ ID NO: 1167778 - DNA, 22 bp, Artificial Sequence
  chemically synthesized
aaagtgctgttgcttagactct

SEQ ID NO: 1167779 - DNA, 22 bp, Artificial Sequence
  chemically synthesized
aaaagtgctgttgcttagactc

SEQ ID NO: 1167780 - DNA, 22 bp, Artificial Sequence
  chemically synthesized
taaaagtgctgttgcttagact

SEQ ID NO: 1167781 - DNA, 22 bp, Artificial Sequence
  chemically synthesized
ttaaaagtgctgttgcttagac

SEQ ID NO: 1167782 - DNA, 22 bp, Artificial Sequence
  chemically synthesized
tttaaaagtgctgttgcttaga

SEQ ID NO: 1167783 - DNA, 22 bp, Artificial Sequence
  chemically synthesized
ttttaaaagtgctgttgcttag

SEQ ID NO: 1167784 - DNA, 22 bp, Artificial Sequence
  chemically synthesized
tatttttttaaaagtgctgttg

SEQ ID NO: 1167785 - DNA, 22 bp, Artificial Sequence
  chemically synthesized
agagtctaagcaacagcacttt

SEQ ID NO: 1167786 - DNA, 22 bp, Artificial Sequence
  chemically synthesized
tattatatttttttaaaagtgc

SEQ ID NO: 1167787 - DNA, 22 bp, Artificial Sequence
  chemically synthesized
agcaacagcacttttaaaaaaa

SEQ ID NO: 1167788 - DNA, 22 bp, Artificial Sequence
  chemically synthesized
ttaaaaaaatataatataactt

SEQ ID NO: 1167789 - DNA, 22 bp, Artificial Sequence
  chemically synthesized
taaaaaaatataatataacttt

SEQ ID NO: 1167790 - DNA, 22 bp, Artificial Sequence
  chemically synthesized
aaaaaaatataatataactttt

SEQ ID NO: 1167791 - DNA, 22 bp, Artificial Sequence
  chemically synthesized
aaaaaatataatataacttttt

SEQ ID NO: 1167792 - DNA, 22 bp, Artificial Sequence
  chemically synthesized
aaaaaaacagaaaaaaaaaaag

SEQ ID NO: 1167793 - DNA, 22 bp, Artificial Sequence
  chemically synthesized
aatctcaaaaaaacagaaaaaa

SEQ ID NO: 1167794 - DNA, 22 bp, Artificial Sequence
  chemically synthesized
tttttttttctgtttttttgag

SEQ ID NO: 1167795 - DNA, 22 bp, Artificial Sequence
  chemically synthesized
ttttttttctgtttttttgaga

SEQ ID NO: 1167796 - DNA, 22 bp, Artificial Sequence
  chemically synthesized
tttttttctgtttttttgagat

SEQ ID NO: 1167797 - DNA, 22 bp, Artificial Sequence
  chemically synthesized
ttttttctgtttttttgagatt

SEQ ID NO: 1167798 - DNA, 22 bp, Artificial Sequence
  chemically synthesized
tttttctgtttttttgagattg

SEQ ID NO: 1167799 - DNA, 22 bp, Artificial Sequence
  chemically synthesized
ttttctgtttttttgagattga

SEQ ID NO: 1167800 - DNA, 22 bp, Artificial Sequence
  chemically synthesized
tttctgtttttttgagattgag

SEQ ID NO: 1167801 - DNA, 22 bp, Artificial Sequence
  chemically synthesized
ttctgtttttttgagattgagt

SEQ ID NO: 1167802 - DNA, 22 bp, Artificial Sequence
  chemically synthesized
tctgtttttttgagattgagta

SEQ ID NO: 1167803 - DNA, 22 bp, Artificial Sequence
  chemically synthesized
ctgtttttttgagattgagtat

SEQ ID NO: 1167804 - DNA, 22 bp, Artificial Sequence
  chemically synthesized
tgtttttttgagattgagtatt

SEQ ID NO: 1167805 - DNA, 22 bp, Artificial Sequence
  chemically synthesized
ggcaggaagagcaatactcaat

SEQ ID NO: 1167806 - DNA, 22 bp, Artificial Sequence
  chemically synthesized
tttttttgagattgagtattgc

SEQ ID NO: 1167807 - DNA, 22 bp, Artificial Sequence
  chemically synthesized
ttttgagattgagtattgctct

SEQ ID NO: 1167808 - DNA, 22 bp, Artificial Sequence
  chemically synthesized
tttgagattgagtattgctctt

SEQ ID NO: 1167809 - DNA, 22 bp, Artificial Sequence
  chemically synthesized
ttgagattgagtattgctcttc

SEQ ID NO: 1167810 - DNA, 22 bp, Artificial Sequence
  chemically synthesized
cagcctgggcaggaagagcaat

SEQ ID NO: 1167811 - DNA, 22 bp, Artificial Sequence
  chemically synthesized
tgagattgagtattgctcttcc

SEQ ID NO: 1167812 - DNA, 22 bp, Artificial Sequence
  chemically synthesized
gagattgagtattgctcttcct

SEQ ID NO: 1167813 - DNA, 22 bp, Artificial Sequence
  chemically synthesized
agattgagtattgctcttcctg

SEQ ID NO: 1167814 - DNA, 22 bp, Artificial Sequence
  chemically synthesized
cactccagcctgggcaggaaga

SEQ ID NO: 1167815 - DNA, 22 bp, Artificial Sequence
  chemically synthesized
agtattgctcttcctgcccagg

SEQ ID NO: 1167816 - DNA, 22 bp, Artificial Sequence
  chemically synthesized
ctcttcctgcccaggctggagt

SEQ ID NO: 1167817 - DNA, 22 bp, Artificial Sequence
  chemically synthesized
ttcctgcccaggctggagtgca

SEQ ID NO: 1167818 - DNA, 22 bp, Artificial Sequence
  chemically synthesized
cctgcccaggctggagtgcaat

SEQ ID NO: 1167819 - DNA, 22 bp, Artificial Sequence
  chemically synthesized
ctgcccaggctggagtgcaatg

SEQ ID NO: 1167820 - DNA, 22 bp, Artificial Sequence
  chemically synthesized
cccaggctggagtgcaatggtg

SEQ ID NO: 1167821 - DNA, 22 bp, Artificial Sequence
  chemically synthesized
cagtgagccgagatcccaccat

SEQ ID NO: 1167822 - DNA, 22 bp, Artificial Sequence
  chemically synthesized
gagtgcaatggtgggatctcgg

SEQ ID NO: 1167823 - DNA, 22 bp, Artificial Sequence
  chemically synthesized
aacccagaagggagaggctgca

SEQ ID NO: 1167824 - DNA, 22 bp, Artificial Sequence
  chemically synthesized
gaacccagaagggagaggctgc

SEQ ID NO: 1167825 - DNA, 22 bp, Artificial Sequence
  chemically synthesized
ggctcactgcagcctctccctt

SEQ ID NO: 1167826 - DNA, 22 bp, Artificial Sequence
  chemically synthesized
actgcagcctctcccttctggg

SEQ ID NO: 1167827 - DNA, 22 bp, Artificial Sequence
  chemically synthesized
cagcctctcccttctgggttca

SEQ ID NO: 1167828 - DNA, 22 bp, Artificial Sequence
  chemically synthesized
aggcaggagaatggcttgaacc

SEQ ID NO: 1167829 - DNA, 22 bp, Artificial Sequence
  chemically synthesized
tcccttctgggttcaagccatt

SEQ ID NO: 1167830 - DNA, 22 bp, Artificial Sequence
  chemically synthesized
ccttctgggttcaagccattct

SEQ ID NO: 1167831 - DNA, 22 bp, Artificial Sequence
  chemically synthesized
ctgggttcaagccattctcctg

SEQ ID NO: 1167832 - DNA, 22 bp, Artificial Sequence
  chemically synthesized
gggaggctgaggcaggagaatg

SEQ ID NO: 1167833 - DNA, 22 bp, Artificial Sequence
  chemically synthesized
tgggttcaagccattctcctgc

SEQ ID NO: 1167834 - DNA, 22 bp, Artificial Sequence
  chemically synthesized
ggttcaagccattctcctgcct

SEQ ID NO: 1167835 - DNA, 22 bp, Artificial Sequence
  chemically synthesized
ctcgggaggctgaggcaggaga

SEQ ID NO: 1167836 - DNA, 22 bp, Artificial Sequence
  chemically synthesized
aagccattctcctgcctcagcc

SEQ ID NO: 1167837 - DNA, 22 bp, Artificial Sequence
  chemically synthesized
taatcccagctactcgggaggc

SEQ ID NO: 1167838 - DNA, 22 bp, Artificial Sequence
  chemically synthesized
tcctgcctcagcctcccgagta

SEQ ID NO: 1167839 - DNA, 22 bp, Artificial Sequence
  chemically synthesized
ctgcctcagcctcccgagtagc

SEQ ID NO: 1167840 - DNA, 22 bp, Artificial Sequence
  chemically synthesized
tgcctgtaatcccagctactcg

SEQ ID NO: 1167841 - DNA, 22 bp, Artificial Sequence
  chemically synthesized
cctcagcctcccgagtagctgg

SEQ ID NO: 1167842 - DNA, 22 bp, Artificial Sequence
  chemically synthesized
gtgcctgtaatcccagctactc

SEQ ID NO: 1167843 - DNA, 22 bp, Artificial Sequence
  chemically synthesized
agcctcccgagtagctgggatt

SEQ ID NO: 1167844 - DNA, 22 bp, Artificial Sequence
  chemically synthesized
ccgagtagctgggattacaggc

SEQ ID NO: 1167845 - DNA, 22 bp, Artificial Sequence
  chemically synthesized
gcccggtgtggtggcttgtgcc

SEQ ID NO: 1167846 - DNA, 22 bp, Artificial Sequence
  chemically synthesized
ggattacaggcacaagccacca

SEQ ID NO: 1167847 - DNA, 22 bp, Artificial Sequence
  chemically synthesized
caggcacaagccaccacaccgg

SEQ ID NO: 1167848 - DNA, 22 bp, Artificial Sequence
  chemically synthesized
aaaatataaaaattagcccggt

SEQ ID NO: 1167849 - DNA, 22 bp, Artificial Sequence
  chemically synthesized
ttaaaaatataaaaattagccc

SEQ ID NO: 1167850 - DNA, 22 bp, Artificial Sequence
  chemically synthesized
tattaaaaatataaaaattagc

SEQ ID NO: 1167851 - DNA, 22 bp, Artificial Sequence
  chemically synthesized
tctctattaaaaatataaaaat

SEQ ID NO: 1167852 - DNA, 22 bp, Artificial Sequence
  chemically synthesized
aaaccctgtctctattaaaaat

SEQ ID NO: 1167853 - DNA, 22 bp, Artificial Sequence
  chemically synthesized
atttttatatttttaatagaga

SEQ ID NO: 1167854 - DNA, 22 bp, Artificial Sequence
  chemically synthesized
ttatatttttaatagagacagg

SEQ ID NO: 1167855 - DNA, 22 bp, Artificial Sequence
  chemically synthesized
tatatttttaatagagacaggg

SEQ ID NO: 1167856 - DNA, 22 bp, Artificial Sequence
  chemically synthesized
atatttttaatagagacagggt

SEQ ID NO: 1167857 - DNA, 22 bp, Artificial Sequence
  chemically synthesized
tatttttaatagagacagggtt

SEQ ID NO: 1167858 - DNA, 22 bp, Artificial Sequence
  chemically synthesized
gccaacgtgttgaaaccctgtc

SEQ ID NO: 1167859 - DNA, 22 bp, Artificial Sequence
  chemically synthesized
ttaatagagacagggtttcaac

SEQ ID NO: 1167860 - DNA, 22 bp, Artificial Sequence
  chemically synthesized
taatagagacagggtttcaaca

SEQ ID NO: 1167861 - DNA, 22 bp, Artificial Sequence
  chemically synthesized
aatagagacagggtttcaacac

SEQ ID NO: 1167862 - DNA, 22 bp, Artificial Sequence
  chemically synthesized
atagagacagggtttcaacacg

SEQ ID NO: 1167863 - DNA, 22 bp, Artificial Sequence
  chemically synthesized
agaccagcctggccaacgtgtt

SEQ ID NO: 1167864 - DNA, 22 bp, Artificial Sequence
  chemically synthesized
gagaccagcctggccaacgtgt

SEQ ID NO: 1167865 - DNA, 22 bp, Artificial Sequence
  chemically synthesized
caacacgttggccaggctggtc

SEQ ID NO: 1167866 - DNA, 22 bp, Artificial Sequence
  chemically synthesized
aacacgttggccaggctggtct

SEQ ID NO: 1167867 - DNA, 22 bp, Artificial Sequence
  chemically synthesized
aggtcaggagtttgagaccagc

SEQ ID NO: 1167868 - DNA, 22 bp, Artificial Sequence
  chemically synthesized
gccaggctggtctcaaactcct

SEQ ID NO: 1167869 - DNA, 22 bp, Artificial Sequence
  chemically synthesized
gtctcaaactcctgacctcagg

SEQ ID NO: 1167870 - DNA, 22 bp, Artificial Sequence
  chemically synthesized
aggtgggcggatgacctgaggt

SEQ ID NO: 1167871 - DNA, 22 bp, Artificial Sequence
  chemically synthesized
aaactcctgacctcaggtcatc

SEQ ID NO: 1167872 - DNA, 22 bp, Artificial Sequence
  chemically synthesized
ggaggctgaggtgggcggatga

SEQ ID NO: 1167873 - DNA, 22 bp, Artificial Sequence
  chemically synthesized
ctgacctcaggtcatccgccca

SEQ ID NO: 1167874 - DNA, 22 bp, Artificial Sequence
  chemically synthesized
gggaggctgaggtgggcggatg

SEQ ID NO: 1167875 - DNA, 22 bp, Artificial Sequence
  chemically synthesized
tgggaggctgaggtgggcggat

SEQ ID NO: 1167876 - DNA, 22 bp, Artificial Sequence
  chemically synthesized
acctcaggtcatccgcccacct

SEQ ID NO: 1167877 - DNA, 22 bp, Artificial Sequence
  chemically synthesized
aggtcatccgcccacctcagcc

SEQ ID NO: 1167878 - DNA, 22 bp, Artificial Sequence
  chemically synthesized
taatcccagcactttgggaggc

SEQ ID NO: 1167879 - DNA, 22 bp, Artificial Sequence
  chemically synthesized
acacctgtaatcccagcacttt

SEQ ID NO: 1167880 - DNA, 22 bp, Artificial Sequence
  chemically synthesized
agcctcccaaagtgctgggatt

SEQ ID NO: 1167881 - DNA, 22 bp, Artificial Sequence
  chemically synthesized
ccaaagtgctgggattacaggt

SEQ ID NO: 1167882 - DNA, 22 bp, Artificial Sequence
  chemically synthesized
ggattacaggtgtgagccacgg

SEQ ID NO: 1167883 - DNA, 22 bp, Artificial Sequence
  chemically synthesized
cgtgagggccggacaccgtggc

SEQ ID NO: 1167884 - DNA, 22 bp, Artificial Sequence
  chemically synthesized
caggtgtgagccacggtgtccg

SEQ ID NO: 1167885 - DNA, 22 bp, Artificial Sequence
  chemically synthesized
agaagttacgtgagggccggac

SEQ ID NO: 1167886 - DNA, 22 bp, Artificial Sequence
  chemically synthesized
aagaagttacgtgagggccgga

SEQ ID NO: 1167887 - DNA, 22 bp, Artificial Sequence
  chemically synthesized
taagaagttacgtgagggccgg

SEQ ID NO: 1167888 - DNA, 22 bp, Artificial Sequence
  chemically synthesized
ttaagaagttacgtgagggccg

SEQ ID NO: 1167889 - DNA, 22 bp, Artificial Sequence
  chemically synthesized
tttttaagaagttacgtgaggg

SEQ ID NO: 1167890 - DNA, 22 bp, Artificial Sequence
  chemically synthesized
atttttaagaagttacgtgagg

SEQ ID NO: 1167891 - DNA, 22 bp, Artificial Sequence
  chemically synthesized
acttatttttaagaagttacgt

SEQ ID NO: 1167892 - DNA, 22 bp, Artificial Sequence
  chemically synthesized
gacttatttttaagaagttacg

SEQ ID NO: 1167893 - DNA, 22 bp, Artificial Sequence
  chemically synthesized
tgacttatttttaagaagttac

SEQ ID NO: 1167894 - DNA, 22 bp, Artificial Sequence
  chemically synthesized
acgtaacttcttaaaaataagt

SEQ ID NO: 1167895 - DNA, 22 bp, Artificial Sequence
  chemically synthesized
agaaaaaatacactttgactta

SEQ ID NO: 1167896 - DNA, 22 bp, Artificial Sequence
  chemically synthesized
cttaaaaataagtcaaagtgta

SEQ ID NO: 1167897 - DNA, 22 bp, Artificial Sequence
  chemically synthesized
ttaaaaataagtcaaagtgtat

SEQ ID NO: 1167898 - DNA, 22 bp, Artificial Sequence
  chemically synthesized
aaaaataagtcaaagtgtattt

SEQ ID NO: 1167899 - DNA, 22 bp, Artificial Sequence
  chemically synthesized
aaaataagtcaaagtgtatttt

SEQ ID NO: 1167900 - DNA, 22 bp, Artificial Sequence
  chemically synthesized
tggaaattaagaaaaaatacac

SEQ ID NO: 1167901 - DNA, 22 bp, Artificial Sequence
  chemically synthesized
gtggaaattaagaaaaaataca

SEQ ID NO: 1167902 - DNA, 22 bp, Artificial Sequence
  chemically synthesized
aatttgtggaaattaagaaaaa

SEQ ID NO: 1167903 - DNA, 22 bp, Artificial Sequence
  chemically synthesized
attgaatttgtggaaattaaga

SEQ ID NO: 1167904 - DNA, 22 bp, Artificial Sequence
  chemically synthesized
tttcttaatttccacaaattca

SEQ ID NO: 1167905 - DNA, 22 bp, Artificial Sequence
  chemically synthesized
caaaccattgattgaatttgtg

SEQ ID NO: 1167906 - DNA, 22 bp, Artificial Sequence
  chemically synthesized
ttcttaatttccacaaattcaa

SEQ ID NO: 1167907 - DNA, 22 bp, Artificial Sequence
  chemically synthesized
ccaaaccattgattgaatttgt

SEQ ID NO: 1167908 - DNA, 22 bp, Artificial Sequence
  chemically synthesized
tcttaatttccacaaattcaat

SEQ ID NO: 1167909 - DNA, 22 bp, Artificial Sequence
  chemically synthesized
cttaatttccacaaattcaatc

SEQ ID NO: 1167910 - DNA, 22 bp, Artificial Sequence
  chemically synthesized
ttaatttccacaaattcaatca

SEQ ID NO: 1167911 - DNA, 22 bp, Artificial Sequence
  chemically synthesized
aatttccacaaattcaatcaat

SEQ ID NO: 1167912 - DNA, 22 bp, Artificial Sequence
  chemically synthesized
atttccacaaattcaatcaatg

SEQ ID NO: 1167913 - DNA, 22 bp, Artificial Sequence
  chemically synthesized
gtagcttccaaaccattgattg

SEQ ID NO: 1167914 - DNA, 22 bp, Artificial Sequence
  chemically synthesized
ccacaaattcaatcaatggttt

SEQ ID NO: 1167915 - DNA, 22 bp, Artificial Sequence
  chemically synthesized
ctagtagcttccaaaccattga

SEQ ID NO: 1167916 - DNA, 22 bp, Artificial Sequence
  chemically synthesized
cacaaattcaatcaatggtttg

SEQ ID NO: 1167917 - DNA, 22 bp, Artificial Sequence
  chemically synthesized
cctagtagcttccaaaccattg

SEQ ID NO: 1167918 - DNA, 22 bp, Artificial Sequence
  chemically synthesized
tcctagtagcttccaaaccatt

SEQ ID NO: 1167919 - DNA, 22 bp, Artificial Sequence
  chemically synthesized
aatcaatggtttggaagctact

SEQ ID NO: 1167920 - DNA, 22 bp, Artificial Sequence
  chemically synthesized
ggaagctactaggaaaatacct

SEQ ID NO: 1167921 - DNA, 22 bp, Artificial Sequence
  chemically synthesized
gaagctactaggaaaatacctc

SEQ ID NO: 1167922 - DNA, 22 bp, Artificial Sequence
  chemically synthesized
agcaacgtaatgaagacgaggt

SEQ ID NO: 1167923 - DNA, 22 bp, Artificial Sequence
  chemically synthesized
ctaggaaaatacctcgtcttca

SEQ ID NO: 1167924 - DNA, 22 bp, Artificial Sequence
  chemically synthesized
ctcagcaacgtaatgaagacga

SEQ ID NO: 1167925 - DNA, 22 bp, Artificial Sequence
  chemically synthesized
ggaaaatacctcgtcttcatta

SEQ ID NO: 1167926 - DNA, 22 bp, Artificial Sequence
  chemically synthesized
ctactcagcaacgtaatgaaga

SEQ ID NO: 1167927 - DNA, 22 bp, Artificial Sequence
  chemically synthesized
cctactcagcaacgtaatgaag

SEQ ID NO: 1167928 - DNA, 22 bp, Artificial Sequence
  chemically synthesized
atttcctactcagcaacgtaat

SEQ ID NO: 1167929 - DNA, 22 bp, Artificial Sequence
  chemically synthesized
gatttcctactcagcaacgtaa

SEQ ID NO: 1167930 - DNA, 22 bp, Artificial Sequence
  chemically synthesized
gtcttcattacgttgctgagta

SEQ ID NO: 1167931 - DNA, 22 bp, Artificial Sequence
  chemically synthesized
acatttgatttcctactcagca

SEQ ID NO: 1167932 - DNA, 22 bp, Artificial Sequence
  chemically synthesized
gacatttgatttcctactcagc

SEQ ID NO: 1167933 - DNA, 22 bp, Artificial Sequence
  chemically synthesized
cattacgttgctgagtaggaaa

SEQ ID NO: 1167934 - DNA, 22 bp, Artificial Sequence
  chemically synthesized
attacgttgctgagtaggaaat

SEQ ID NO: 1167935 - DNA, 22 bp, Artificial Sequence
  chemically synthesized
gacttgacatttgatttcctac

SEQ ID NO: 1167936 - DNA, 22 bp, Artificial Sequence
  chemically synthesized
agacttgacatttgatttccta

SEQ ID NO: 1167937 - DNA, 22 bp, Artificial Sequence
  chemically synthesized
cgttgctgagtaggaaatcaaa

SEQ ID NO: 1167938 - DNA, 22 bp, Artificial Sequence
  chemically synthesized
tttagacttgacatttgatttc

SEQ ID NO: 1167939 - DNA, 22 bp, Artificial Sequence
  chemically synthesized
ctgagtaggaaatcaaatgtca

SEQ ID NO: 1167940 - DNA, 22 bp, Artificial Sequence
  chemically synthesized
agtaggaaatcaaatgtcaagt

SEQ ID NO: 1167941 - DNA, 22 bp, Artificial Sequence
  chemically synthesized
cgtgcattatttagacttgaca

SEQ ID NO: 1167942 - DNA, 22 bp, Artificial Sequence
  chemically synthesized
gcgtgcattatttagacttgac

SEQ ID NO: 1167943 - DNA, 22 bp, Artificial Sequence
  chemically synthesized
tgacttgcgtgcattatttaga

SEQ ID NO: 1167944 - DNA, 22 bp, Artificial Sequence
  chemically synthesized
aataatgcacgcaagtcacaga

SEQ ID NO: 1167945 - DNA, 22 bp, Artificial Sequence
  chemically synthesized
agtgtgatatcagtgtctgtga

SEQ ID NO: 1167946 - DNA, 22 bp, Artificial Sequence
  chemically synthesized
ctcagtgtgatatcagtgtctg

SEQ ID NO: 1167947 - DNA, 22 bp, Artificial Sequence
  chemically synthesized
cctcagtgtgatatcagtgtct

SEQ ID NO: 1167948 - DNA, 22 bp, Artificial Sequence
  chemically synthesized
gtatcttcctcagtgtgatatc

SEQ ID NO: 1167949 - DNA, 22 bp, Artificial Sequence
  chemically synthesized
tggtatcttcctcagtgtgata

SEQ ID NO: 1167950 - DNA, 22 bp, Artificial Sequence
  chemically synthesized
gtattctggtatcttcctcagt

SEQ ID NO: 1167951 - DNA, 22 bp, Artificial Sequence
  chemically synthesized
tggtattctggtatcttcctca

SEQ ID NO: 1167952 - DNA, 22 bp, Artificial Sequence
  chemically synthesized
ctggtattctggtatcttcctc

SEQ ID NO: 1167953 - DNA, 22 bp, Artificial Sequence
  chemically synthesized
tctggtattctggtatcttcct

SEQ ID NO: 1167954 - DNA, 22 bp, Artificial Sequence
  chemically synthesized
atatcacactgaggaagatacc

SEQ ID NO: 1167955 - DNA, 22 bp, Artificial Sequence
  chemically synthesized
tctttctggtattctggtatct

SEQ ID NO: 1167956 - DNA, 22 bp, Artificial Sequence
  chemically synthesized
ctgtctttctggtattctggta

SEQ ID NO: 1167957 - DNA, 22 bp, Artificial Sequence
  chemically synthesized
aggaagataccagaataccaga

SEQ ID NO: 1167958 - DNA, 22 bp, Artificial Sequence
  chemically synthesized
tgtcccattgctgtctttctgg

SEQ ID NO: 1167959 - DNA, 22 bp, Artificial Sequence
  chemically synthesized
ggctgtgtcccattgctgtctt

SEQ ID NO: 1167960 - DNA, 22 bp, Artificial Sequence
  chemically synthesized
ccatctgggctgtgtcccattg

SEQ ID NO: 1167961 - DNA, 22 bp, Artificial Sequence
  chemically synthesized
tactaccatctgggctgtgtcc

SEQ ID NO: 1167962 - DNA, 22 bp, Artificial Sequence
  chemically synthesized
ccgggtctgtactaccatctgg

SEQ ID NO: 1167963 - DNA, 22 bp, Artificial Sequence
  chemically synthesized
accgggtctgtactaccatctg

SEQ ID NO: 1167964 - DNA, 22 bp, Artificial Sequence
  chemically synthesized
cattatccatgatgtccttatt

SEQ ID NO: 1167965 - DNA, 22 bp, Artificial Sequence
  chemically synthesized
tccatgatgtccttatttcaca

SEQ ID NO: 1167966 - DNA, 22 bp, Artificial Sequence
  chemically synthesized
atacagacatgcagtgtgaaat

SEQ ID NO: 1167967 - DNA, 22 bp, Artificial Sequence
  chemically synthesized
gatacagacatgcagtgtgaaa

SEQ ID NO: 1167968 - DNA, 22 bp, Artificial Sequence
  chemically synthesized
tgatacagacatgcagtgtgaa

SEQ ID NO: 1167969 - DNA, 22 bp, Artificial Sequence
  chemically synthesized
atttcacactgcatgtctgtat

SEQ ID NO: 1167970 - DNA, 22 bp, Artificial Sequence
  chemically synthesized
tttcacactgcatgtctgtatc

SEQ ID NO: 1167971 - DNA, 22 bp, Artificial Sequence
  chemically synthesized
cacactgcatgtctgtatcaaa

SEQ ID NO: 1167972 - DNA, 22 bp, Artificial Sequence
  chemically synthesized
acactgcatgtctgtatcaaaa

SEQ ID NO: 1167973 - DNA, 22 bp, Artificial Sequence
  chemically synthesized
tggggtacatgagatgttttga

SEQ ID NO: 1167974 - DNA, 22 bp, Artificial Sequence
  chemically synthesized
atggggtacatgagatgttttg

SEQ ID NO: 1167975 - DNA, 22 bp, Artificial Sequence
  chemically synthesized
catgtctgtatcaaaacatctc

SEQ ID NO: 1167976 - DNA, 22 bp, Artificial Sequence
  chemically synthesized
tatcaaaacatctcatgtaccc

SEQ ID NO: 1167977 - DNA, 22 bp, Artificial Sequence
  chemically synthesized
cgtagtaggtgtatgtatttat

SEQ ID NO: 1167978 - DNA, 22 bp, Artificial Sequence
  chemically synthesized
atgtaccccataaatacataca

SEQ ID NO: 1167979 - DNA, 22 bp, Artificial Sequence
  chemically synthesized
tggctacgtagtaggtgtatgt

SEQ ID NO: 1167980 - DNA, 22 bp, Artificial Sequence
  chemically synthesized
gtggctacgtagtaggtgtatg

SEQ ID NO: 1167981 - DNA, 22 bp, Artificial Sequence
  chemically synthesized
tgtggctacgtagtaggtgtat

SEQ ID NO: 1167982 - DNA, 22 bp, Artificial Sequence
  chemically synthesized
ttgtggctacgtagtaggtgta

SEQ ID NO: 1167983 - DNA, 22 bp, Artificial Sequence
  chemically synthesized
aatttttgtggctacgtagtag

SEQ ID NO: 1167984 - DNA, 22 bp, Artificial Sequence
  chemically synthesized
aaatttttgtggctacgtagta

SEQ ID NO: 1167985 - DNA, 22 bp, Artificial Sequence
  chemically synthesized
taaatttttgtggctacgtagt

SEQ ID NO: 1167986 - DNA, 22 bp, Artificial Sequence
  chemically synthesized
tgttttaaatttttgtggctac

SEQ ID NO: 1167987 - DNA, 22 bp, Artificial Sequence
  chemically synthesized
aaattatgttttaaatttttgt

SEQ ID NO: 1167988 - DNA, 22 bp, Artificial Sequence
  chemically synthesized
ctacgtagccacaaaaatttaa

SEQ ID NO: 1167989 - DNA, 22 bp, Artificial Sequence
  chemically synthesized
ttaaaattatgttttaaatttt

SEQ ID NO: 1167990 - DNA, 22 bp, Artificial Sequence
  chemically synthesized
cgtagccacaaaaatttaaaac

SEQ ID NO: 1167991 - DNA, 22 bp, Artificial Sequence
  chemically synthesized
aaaaactgttaaaattatgttt

SEQ ID NO: 1167992 - DNA, 22 bp, Artificial Sequence
  chemically synthesized
aaaaaactgttaaaattatgtt

SEQ ID NO: 1167993 - DNA, 22 bp, Artificial Sequence
  chemically synthesized
taaaaaactgttaaaattatgt

SEQ ID NO: 1167994 - DNA, 22 bp, Artificial Sequence
  chemically synthesized
ttaaaaaactgttaaaattatg

SEQ ID NO: 1167995 - DNA, 22 bp, Artificial Sequence
  chemically synthesized
tgtttttaaaaaactgttaaaa

SEQ ID NO: 1167996 - DNA, 22 bp, Artificial Sequence
  chemically synthesized
atgtttttaaaaaactgttaaa

SEQ ID NO: 1167997 - DNA, 22 bp, Artificial Sequence
  chemically synthesized
aaaacataattttaacagtttt

SEQ ID NO: 1167998 - DNA, 22 bp, Artificial Sequence
  chemically synthesized
aaacataattttaacagttttt

SEQ ID NO: 1167999 - DNA, 22 bp, Artificial Sequence
  chemically synthesized
tttatgtttttaaaaaactgtt

SEQ ID NO: 1168000 - DNA, 22 bp, Artificial Sequence
  chemically synthesized
tgtttatgtttttaaaaaactg

SEQ ID NO: 1168001 - DNA, 22 bp, Artificial Sequence
  chemically synthesized
ctgtttatgtttttaaaaaact

SEQ ID NO: 1168002 - DNA, 22 bp, Artificial Sequence
  chemically synthesized
tctgtttatgtttttaaaaaac

SEQ ID NO: 1168003 - DNA, 22 bp, Artificial Sequence
  chemically synthesized
ttctgtttatgtttttaaaaaa

SEQ ID NO: 1168004 - DNA, 22 bp, Artificial Sequence
  chemically synthesized
tttctgtttatgtttttaaaaa

SEQ ID NO: 1168005 - DNA, 22 bp, Artificial Sequence
  chemically synthesized
tttttctgtttatgtttttaaa

SEQ ID NO: 1168006 - DNA, 22 bp, Artificial Sequence
  chemically synthesized
ctttttctgtttatgtttttaa

SEQ ID NO: 1168007 - DNA, 22 bp, Artificial Sequence
  chemically synthesized
taacagttttttaaaaacataa

SEQ ID NO: 1168008 - DNA, 22 bp, Artificial Sequence
  chemically synthesized
aacagttttttaaaaacataaa

SEQ ID NO: 1168009 - DNA, 22 bp, Artificial Sequence
  chemically synthesized
acagttttttaaaaacataaac

SEQ ID NO: 1168010 - DNA, 22 bp, Artificial Sequence
  chemically synthesized
acttctttttctgtttatgttt

SEQ ID NO: 1168011 - DNA, 22 bp, Artificial Sequence
  chemically synthesized
tgacttctttttctgtttatgt

SEQ ID NO: 1168012 - DNA, 22 bp, Artificial Sequence
  chemically synthesized
ctgacttctttttctgtttatg

SEQ ID NO: 1168013 - DNA, 22 bp, Artificial Sequence
  chemically synthesized
ttctgacttctttttctgttta

SEQ ID NO: 1168014 - DNA, 22 bp, Artificial Sequence
  chemically synthesized
cttctgacttctttttctgttt

SEQ ID NO: 1168015 - DNA, 22 bp, Artificial Sequence
  chemically synthesized
tttaaaaacataaacagaaaaa

SEQ ID NO: 1168016 - DNA, 22 bp, Artificial Sequence
  chemically synthesized
ttaaaaacataaacagaaaaag

SEQ ID NO: 1168017 - DNA, 22 bp, Artificial Sequence
  chemically synthesized
taaaaacataaacagaaaaaga

SEQ ID NO: 1168018 - DNA, 22 bp, Artificial Sequence
  chemically synthesized
aaaaacataaacagaaaaagaa

SEQ ID NO: 1168019 - DNA, 22 bp, Artificial Sequence
  chemically synthesized
aaaacataaacagaaaaagaag

SEQ ID NO: 1168020 - DNA, 22 bp, Artificial Sequence
  chemically synthesized
agcttcttctgacttctttttc

SEQ ID NO: 1168021 - DNA, 22 bp, Artificial Sequence
  chemically synthesized
ctcagcttcttctgacttcttt

SEQ ID NO: 1168022 - DNA, 22 bp, Artificial Sequence
  chemically synthesized
gctcagcttcttctgacttctt

SEQ ID NO: 1168023 - DNA, 22 bp, Artificial Sequence
  chemically synthesized
tgctcagcttcttctgacttct

SEQ ID NO: 1168024 - DNA, 22 bp, Artificial Sequence
  chemically synthesized
ttgctcagcttcttctgacttc

SEQ ID NO: 1168025 - DNA, 22 bp, Artificial Sequence
  chemically synthesized
tttgctcagcttcttctgactt

SEQ ID NO: 1168026 - DNA, 22 bp, Artificial Sequence
  chemically synthesized
ttttttgctcagcttcttctga

SEQ ID NO: 1168027 - DNA, 22 bp, Artificial Sequence
  chemically synthesized
attttttgctcagcttcttctg

SEQ ID NO: 1168028 - DNA, 22 bp, Artificial Sequence
  chemically synthesized
tattttttgctcagcttcttct

SEQ ID NO: 1168029 - DNA, 22 bp, Artificial Sequence
  chemically synthesized
gctttattttttgctcagcttc

SEQ ID NO: 1168030 - DNA, 22 bp, Artificial Sequence
  chemically synthesized
ttagctttattttttgctcagc

SEQ ID NO: 1168031 - DNA, 22 bp, Artificial Sequence
  chemically synthesized
gttagctttattttttgctcag

SEQ ID NO: 1168032 - DNA, 22 bp, Artificial Sequence
  chemically synthesized
gaaagaatttgttagctttatt

SEQ ID NO: 1168033 - DNA, 22 bp, Artificial Sequence
  chemically synthesized
agaaagaatttgttagctttat

SEQ ID NO: 1168034 - DNA, 22 bp, Artificial Sequence
  chemically synthesized
tagaaagaatttgttagcttta

SEQ ID NO: 1168035 - DNA, 22 bp, Artificial Sequence
  chemically synthesized
ttagaaagaatttgttagcttt

SEQ ID NO: 1168036 - DNA, 22 bp, Artificial Sequence
  chemically synthesized
agcaaaaaataaagctaacaaa

SEQ ID NO: 1168037 - DNA, 22 bp, Artificial Sequence
  chemically synthesized
ttttagaaagaatttgttagct

SEQ ID NO: 1168038 - DNA, 22 bp, Artificial Sequence
  chemically synthesized
cttttagaaagaatttgttagc

SEQ ID NO: 1168039 - DNA, 22 bp, Artificial Sequence
  chemically synthesized
acacatgccttcttttagaaag

SEQ ID NO: 1168040 - DNA, 22 bp, Artificial Sequence
  chemically synthesized
gacacatgccttcttttagaaa

SEQ ID NO: 1168041 - DNA, 22 bp, Artificial Sequence
  chemically synthesized
acaaattctttctaaaagaagg

SEQ ID NO: 1168042 - DNA, 22 bp, Artificial Sequence
  chemically synthesized
tttctaaaagaaggcatgtgtc

SEQ ID NO: 1168043 - DNA, 22 bp, Artificial Sequence
  chemically synthesized
gaatggtggacttgacacatgc

SEQ ID NO: 1168044 - DNA, 22 bp, Artificial Sequence
  chemically synthesized
tctaaaagaaggcatgtgtcaa

SEQ ID NO: 1168045 - DNA, 22 bp, Artificial Sequence
  chemically synthesized
ctaaaagaaggcatgtgtcaag

SEQ ID NO: 1168046 - DNA, 22 bp, Artificial Sequence
  chemically synthesized
taaaagaaggcatgtgtcaagt

SEQ ID NO: 1168047 - DNA, 22 bp, Artificial Sequence
  chemically synthesized
aaagaaggcatgtgtcaagtcc

SEQ ID NO: 1168048 - DNA, 22 bp, Artificial Sequence
  chemically synthesized
acagaaggcgcagagttcgaat

SEQ ID NO: 1168049 - DNA, 22 bp, Artificial Sequence
  chemically synthesized
gaactctgcgccttctgttaat

SEQ ID NO: 1168050 - DNA, 22 bp, Artificial Sequence
  chemically synthesized
tgcgccttctgttaatccctat

SEQ ID NO: 1168051 - DNA, 22 bp, Artificial Sequence
  chemically synthesized
cgccttctgttaatccctatga

SEQ ID NO: 1168052 - DNA, 22 bp, Artificial Sequence
  chemically synthesized
acatcaaaggcaaatcataggg

SEQ ID NO: 1168053 - DNA, 22 bp, Artificial Sequence
  chemically synthesized
aacatcaaaggcaaatcatagg

SEQ ID NO: 1168054 - DNA, 22 bp, Artificial Sequence
  chemically synthesized
ctgttaatccctatgatttgcc

SEQ ID NO: 1168055 - DNA, 22 bp, Artificial Sequence
  chemically synthesized
tgttaatccctatgatttgcct

SEQ ID NO: 1168056 - DNA, 22 bp, Artificial Sequence
  chemically synthesized
ttaatccctatgatttgccttt

SEQ ID NO: 1168057 - DNA, 22 bp, Artificial Sequence
  chemically synthesized
acatttaacatcaaaggcaaat

SEQ ID NO: 1168058 - DNA, 22 bp, Artificial Sequence
  chemically synthesized
atccctatgatttgcctttgat

SEQ ID NO: 1168059 - DNA, 22 bp, Artificial Sequence
  chemically synthesized
ctgacatttaacatcaaaggca

SEQ ID NO: 1168060 - DNA, 22 bp, Artificial Sequence
  chemically synthesized
gctgacatttaacatcaaaggc

SEQ ID NO: 1168061 - DNA, 22 bp, Artificial Sequence
  chemically synthesized
aatttgctgacatttaacatca

SEQ ID NO: 1168062 - DNA, 22 bp, Artificial Sequence
  chemically synthesized
tgatttgcctttgatgttaaat

SEQ ID NO: 1168063 - DNA, 22 bp, Artificial Sequence
  chemically synthesized
gcctttgatgttaaatgtcagc

SEQ ID NO: 1168064 - DNA, 22 bp, Artificial Sequence
  chemically synthesized
cctttgatgttaaatgtcagca

SEQ ID NO: 1168065 - DNA, 22 bp, Artificial Sequence
  chemically synthesized
tgatgttaaatgtcagcaaatt

SEQ ID NO: 1168066 - DNA, 22 bp, Artificial Sequence
  chemically synthesized
gatgttaaatgtcagcaaattt

SEQ ID NO: 1168067 - DNA, 22 bp, Artificial Sequence
  chemically synthesized
atgttaaatgtcagcaaattta

SEQ ID NO: 1168068 - DNA, 22 bp, Artificial Sequence
  chemically synthesized
caatagtgaagaatgttaaatt

SEQ ID NO: 1168069 - DNA, 22 bp, Artificial Sequence
  chemically synthesized
aatgtcagcaaatttaacattc

SEQ ID NO: 1168070 - DNA, 22 bp, Artificial Sequence
  chemically synthesized
tgcaatagtgaagaatgttaaa

SEQ ID NO: 1168071 - DNA, 22 bp, Artificial Sequence
  chemically synthesized
tgagtggttctgcaatagtgaa

SEQ ID NO: 1168072 - DNA, 22 bp, Artificial Sequence
  chemically synthesized
tgtgagtggttctgcaatagtg

SEQ ID NO: 1168073 - DNA, 22 bp, Artificial Sequence
  chemically synthesized
ctgtgagtggttctgcaatagt

SEQ ID NO: 1168074 - DNA, 22 bp, Artificial Sequence
  chemically synthesized
aacattcttcactattgcagaa

SEQ ID NO: 1168075 - DNA, 22 bp, Artificial Sequence
  chemically synthesized
acattcttcactattgcagaac

SEQ ID NO: 1168076 - DNA, 22 bp, Artificial Sequence
  chemically synthesized
ttcactattgcagaaccactca

SEQ ID NO: 1168077 - DNA, 22 bp, Artificial Sequence
  chemically synthesized
cactattgcagaaccactcaca

SEQ ID NO: 1168078 - DNA, 22 bp, Artificial Sequence
  chemically synthesized
actattgcagaaccactcacag

SEQ ID NO: 1168079 - DNA, 22 bp, Artificial Sequence
  chemically synthesized
ttgcagaaccactcacagaaat

SEQ ID NO: 1168080 - DNA, 22 bp, Artificial Sequence
  chemically synthesized
cagaaccactcacagaaatgct

SEQ ID NO: 1168081 - DNA, 22 bp, Artificial Sequence
  chemically synthesized
gagcatcggaggcacaatgtag

SEQ ID NO: 1168082 - DNA, 22 bp, Artificial Sequence
  chemically synthesized
acagaaatgctacattgtgcct

SEQ ID NO: 1168083 - DNA, 22 bp, Artificial Sequence
  chemically synthesized
actggagcatcggaggcacaat

SEQ ID NO: 1168084 - DNA, 22 bp, Artificial Sequence
  chemically synthesized
aactggagcatcggaggcacaa

SEQ ID NO: 1168085 - DNA, 22 bp, Artificial Sequence
  chemically synthesized
ttaactggagcatcggaggcac

SEQ ID NO: 1168086 - DNA, 22 bp, Artificial Sequence
  chemically synthesized
cttaactggagcatcggaggca

SEQ ID NO: 1168087 - DNA, 22 bp, Artificial Sequence
  chemically synthesized
tcttcttaactggagcatcgga

SEQ ID NO: 1168088 - DNA, 22 bp, Artificial Sequence
  chemically synthesized
gtcttcttaactggagcatcgg

SEQ ID NO: 1168089 - DNA, 22 bp, Artificial Sequence
  chemically synthesized
tgtcttcttaactggagcatcg

SEQ ID NO: 1168090 - DNA, 22 bp, Artificial Sequence
  chemically synthesized
cattgtgcctccgatgctccag

SEQ ID NO: 1168091 - DNA, 22 bp, Artificial Sequence
  chemically synthesized
ttgtcttcttaactggagcatc

SEQ ID NO: 1168092 - DNA, 22 bp, Artificial Sequence
  chemically synthesized
tgcctccgatgctccagttaag

SEQ ID NO: 1168093 - DNA, 22 bp, Artificial Sequence
  chemically synthesized
cgatgctccagttaagaagaca

SEQ ID NO: 1168094 - DNA, 22 bp, Artificial Sequence
  chemically synthesized
cagttaagaagacaaaaatggg

SEQ ID NO: 1168095 - DNA, 22 bp, Artificial Sequence
  chemically synthesized
agaagacaaaaatgggtatcat

SEQ ID NO: 1168096 - DNA, 22 bp, Artificial Sequence
  chemically synthesized
aaataccccatatgtgtacgta

SEQ ID NO: 1168097 - DNA, 22 bp, Artificial Sequence
  chemically synthesized
aaaactaaaataccccatatgt

SEQ ID NO: 1168098 - DNA, 22 bp, Artificial Sequence
  chemically synthesized
aaaaactaaaataccccatatg

SEQ ID NO: 1168099 - DNA, 22 bp, Artificial Sequence
  chemically synthesized
taaaaactaaaataccccatat

SEQ ID NO: 1168100 - DNA, 22 bp, Artificial Sequence
  chemically synthesized
ttaaaaactaaaataccccata

SEQ ID NO: 1168101 - DNA, 22 bp, Artificial Sequence
  chemically synthesized
tagaatgagatttttaaaaact

SEQ ID NO: 1168102 - DNA, 22 bp, Artificial Sequence
  chemically synthesized
ataggctatagaatgagatttt

SEQ ID NO: 1168103 - DNA, 22 bp, Artificial Sequence
  chemically synthesized
aataggctatagaatgagattt

SEQ ID NO: 1168104 - DNA, 22 bp, Artificial Sequence
  chemically synthesized
tagtttttaaaaatctcattct

SEQ ID NO: 1168105 - DNA, 22 bp, Artificial Sequence
  chemically synthesized
agtttttaaaaatctcattcta

SEQ ID NO: 1168106 - DNA, 22 bp, Artificial Sequence
  chemically synthesized
tttaataggctatagaatgaga

SEQ ID NO: 1168107 - DNA, 22 bp, Artificial Sequence
  chemically synthesized
gtttttaaaaatctcattctat

SEQ ID NO: 1168108 - DNA, 22 bp, Artificial Sequence
  chemically synthesized
gtttaataggctatagaatgag

SEQ ID NO: 1168109 - DNA, 22 bp, Artificial Sequence
  chemically synthesized
tgtttaataggctatagaatga

SEQ ID NO: 1168110 - DNA, 22 bp, Artificial Sequence
  chemically synthesized
ttgtttaataggctatagaatg

SEQ ID NO: 1168111 - DNA, 22 bp, Artificial Sequence
  chemically synthesized
ttaaaaatctcattctatagcc

SEQ ID NO: 1168112 - DNA, 22 bp, Artificial Sequence
  chemically synthesized
taaaaatctcattctatagcct

SEQ ID NO: 1168113 - DNA, 22 bp, Artificial Sequence
  chemically synthesized
aaaaatctcattctatagccta

SEQ ID NO: 1168114 - DNA, 22 bp, Artificial Sequence
  chemically synthesized
aaaatctcattctatagcctat

SEQ ID NO: 1168115 - DNA, 22 bp, Artificial Sequence
  chemically synthesized
gaaccttttgtttaataggcta

SEQ ID NO: 1168116 - DNA, 22 bp, Artificial Sequence
  chemically synthesized
tagaaccttttgtttaataggc

SEQ ID NO: 1168117 - DNA, 22 bp, Artificial Sequence
  chemically synthesized
attctatagcctattaaacaaa

SEQ ID NO: 1168118 - DNA, 22 bp, Artificial Sequence
  chemically synthesized
gctctagaaccttttgtttaat

SEQ ID NO: 1168119 - DNA, 22 bp, Artificial Sequence
  chemically synthesized
ggctctagaaccttttgtttaa

SEQ ID NO: 1168120 - DNA, 22 bp, Artificial Sequence
  chemically synthesized
tggctctagaaccttttgttta

SEQ ID NO: 1168121 - DNA, 22 bp, Artificial Sequence
  chemically synthesized
ttggctctagaaccttttgttt

SEQ ID NO: 1168122 - DNA, 22 bp, Artificial Sequence
  chemically synthesized
tatagcctattaaacaaaaggt

SEQ ID NO: 1168123 - DNA, 22 bp, Artificial Sequence
  chemically synthesized
tagcctattaaacaaaaggttc

SEQ ID NO: 1168124 - DNA, 22 bp, Artificial Sequence
  chemically synthesized
atgtttttggctctagaacctt

SEQ ID NO: 1168125 - DNA, 22 bp, Artificial Sequence
  chemically synthesized
ttaaacaaaaggttctagagcc

SEQ ID NO: 1168126 - DNA, 22 bp, Artificial Sequence
  chemically synthesized
aacaaaaggttctagagccaaa

SEQ ID NO: 1168127 - DNA, 22 bp, Artificial Sequence
  chemically synthesized
tagagccaaaaacattaatctt

SEQ ID NO: 1168128 - DNA, 22 bp, Artificial Sequence
  chemically synthesized
aagtataaaaaaaaagattaat

SEQ ID NO: 1168129 - DNA, 22 bp, Artificial Sequence
  chemically synthesized
gagccaaaaacattaatctttt

SEQ ID NO: 1168130 - DNA, 22 bp, Artificial Sequence
  chemically synthesized
aaagtataaaaaaaaagattaa

SEQ ID NO: 1168131 - DNA, 22 bp, Artificial Sequence
  chemically synthesized
gtatttaaagtataaaaaaaaa

SEQ ID NO: 1168132 - DNA, 22 bp, Artificial Sequence
  chemically synthesized
atctttttttttatactttaaa

SEQ ID NO: 1168133 - DNA, 22 bp, Artificial Sequence
  chemically synthesized
tttttttatactttaaatacta

SEQ ID NO: 1168134 - DNA, 22 bp, Artificial Sequence
  chemically synthesized
ttttttatactttaaatactag

SEQ ID NO: 1168135 - DNA, 22 bp, Artificial Sequence
  chemically synthesized
tgcacatgtaccctagtattta

SEQ ID NO: 1168136 - DNA, 22 bp, Artificial Sequence
  chemically synthesized
tttttatactttaaatactagg

SEQ ID NO: 1168137 - DNA, 22 bp, Artificial Sequence
  chemically synthesized
ttttatactttaaatactaggg

SEQ ID NO: 1168138 - DNA, 22 bp, Artificial Sequence
  chemically synthesized
tttatactttaaatactagggt

SEQ ID NO: 1168139 - DNA, 22 bp, Artificial Sequence
  chemically synthesized
ttatactttaaatactagggta

SEQ ID NO: 1168140 - DNA, 22 bp, Artificial Sequence
  chemically synthesized
tatactttaaatactagggtac

SEQ ID NO: 1168141 - DNA, 22 bp, Artificial Sequence
  chemically synthesized
atactttaaatactagggtaca

SEQ ID NO: 1168142 - DNA, 22 bp, Artificial Sequence
  chemically synthesized
tactttaaatactagggtacat

SEQ ID NO: 1168143 - DNA, 22 bp, Artificial Sequence
  chemically synthesized
aacgttgtgcacatgtacccta

SEQ ID NO: 1168144 - DNA, 22 bp, Artificial Sequence
  chemically synthesized
taaatactagggtacatgtgca

SEQ ID NO: 1168145 - DNA, 22 bp, Artificial Sequence
  chemically synthesized
aaatactagggtacatgtgcac

SEQ ID NO: 1168146 - DNA, 22 bp, Artificial Sequence
  chemically synthesized
aatactagggtacatgtgcaca

SEQ ID NO: 1168147 - DNA, 22 bp, Artificial Sequence
  chemically synthesized
gggtacatgtgcacaacgttca

SEQ ID NO: 1168148 - DNA, 22 bp, Artificial Sequence
  chemically synthesized
aggtttgttacatatgtataca

SEQ ID NO: 1168149 - DNA, 22 bp, Artificial Sequence
  chemically synthesized
gttacatatgtatacatgtgcc

SEQ ID NO: 1168150 - DNA, 22 bp, Artificial Sequence
  chemically synthesized
ttacatatgtatacatgtgcca

SEQ ID NO: 1168151 - DNA, 22 bp, Artificial Sequence
  chemically synthesized
catatgtatacatgtgccatga

SEQ ID NO: 1168152 - DNA, 22 bp, Artificial Sequence
  chemically synthesized
atgggtgtagcacaccatcatg

SEQ ID NO: 1168153 - DNA, 22 bp, Artificial Sequence
  chemically synthesized
aatgacgagttaatgggtgtag

SEQ ID NO: 1168154 - DNA, 22 bp, Artificial Sequence
  chemically synthesized
atgttaaatgacgagttaatgg

SEQ ID NO: 1168155 - DNA, 22 bp, Artificial Sequence
  chemically synthesized
cacccattaactcgtcatttaa

SEQ ID NO: 1168156 - DNA, 22 bp, Artificial Sequence
  chemically synthesized
ggagatatacctgatgttaaat

SEQ ID NO: 1168157 - DNA, 22 bp, Artificial Sequence
  chemically synthesized
actcgtcatttaacatcaggta

SEQ ID NO: 1168158 - DNA, 22 bp, Artificial Sequence
  chemically synthesized
gtcatttaacatcaggtatatc

SEQ ID NO: 1168159 - DNA, 22 bp, Artificial Sequence
  chemically synthesized
aacatcaggtatatctcctaat

SEQ ID NO: 1168160 - DNA, 22 bp, Artificial Sequence
  chemically synthesized
acatcaggtatatctcctaata

SEQ ID NO: 1168161 - DNA, 22 bp, Artificial Sequence
  chemically synthesized
ctaatactatccctcccccctc

SEQ ID NO: 1168162 - DNA, 22 bp, Artificial Sequence
  chemically synthesized
atactatccctcccccctcccc

SEQ ID NO: 1168163 - DNA, 22 bp, Artificial Sequence
  chemically synthesized
tccctcccccctccccccaccc

SEQ ID NO: 1168164 - DNA, 22 bp, Artificial Sequence
  chemically synthesized
ggtcccgtagtggggtgggggg

SEQ ID NO: 1168165 - DNA, 22 bp, Artificial Sequence
  chemically synthesized
ccccctccccccaccccactac

SEQ ID NO: 1168166 - DNA, 22 bp, Artificial Sequence
  chemically synthesized
cccccaccccactacgggaccc

SEQ ID NO: 1168167 - DNA, 22 bp, Artificial Sequence
  chemically synthesized
cgggacccagtgtgtgatgttc

SEQ ID NO: 1168168 - DNA, 22 bp, Artificial Sequence
  chemically synthesized
gacacaggaaggggaacatcac

SEQ ID NO: 1168169 - DNA, 22 bp, Artificial Sequence
  chemically synthesized
ggacacaggaaggggaacatca

SEQ ID NO: 1168170 - DNA, 22 bp, Artificial Sequence
  chemically synthesized
aacaatgagaacccttggacac

SEQ ID NO: 1168171 - DNA, 22 bp, Artificial Sequence
  chemically synthesized
cccttcctgtgtccaagggttc

SEQ ID NO: 1168172 - DNA, 22 bp, Artificial Sequence
  chemically synthesized
cctgtgtccaagggttctcatt

SEQ ID NO: 1168173 - DNA, 22 bp, Artificial Sequence
  chemically synthesized
ctgtgtccaagggttctcattg

SEQ ID NO: 1168174 - DNA, 22 bp, Artificial Sequence
  chemically synthesized
tgtccaagggttctcattgttc

SEQ ID NO: 1168175 - DNA, 22 bp, Artificial Sequence
  chemically synthesized
atgggtgggaattgaacaatga

SEQ ID NO: 1168176 - DNA, 22 bp, Artificial Sequence
  chemically synthesized
actcatgggtgggaattgaaca

SEQ ID NO: 1168177 - DNA, 22 bp, Artificial Sequence
  chemically synthesized
tcactcatgggtgggaattgaa

SEQ ID NO: 1168178 - DNA, 22 bp, Artificial Sequence
  chemically synthesized
tcattgttcaattcccacccat

SEQ ID NO: 1168179 - DNA, 22 bp, Artificial Sequence
  chemically synthesized
attgttcaattcccacccatga

SEQ ID NO: 1168180 - DNA, 22 bp, Artificial Sequence
  chemically synthesized
ttcaattcccacccatgagtga

SEQ ID NO: 1168181 - DNA, 22 bp, Artificial Sequence
  chemically synthesized
aattcccacccatgagtgagaa

SEQ ID NO: 1168182 - DNA, 22 bp, Artificial Sequence
  chemically synthesized
ccacccatgagtgagaacatgt

SEQ ID NO: 1168183 - DNA, 22 bp, Artificial Sequence
  chemically synthesized
acgcaaggacaaaaaaccaaat

SEQ ID NO: 1168184 - DNA, 22 bp, Artificial Sequence
  chemically synthesized
agcaagctaacgcaaggacaaa

SEQ ID NO: 1168185 - DNA, 22 bp, Artificial Sequence
  chemically synthesized
tcagcaagctaacgcaaggaca

SEQ ID NO: 1168186 - DNA, 22 bp, Artificial Sequence
  chemically synthesized
ggttttttgtccttgcgttagc

SEQ ID NO: 1168187 - DNA, 22 bp, Artificial Sequence
  chemically synthesized
gttttttgtccttgcgttagct

SEQ ID NO: 1168188 - DNA, 22 bp, Artificial Sequence
  chemically synthesized
tttgtccttgcgttagcttgct

SEQ ID NO: 1168189 - DNA, 22 bp, Artificial Sequence
  chemically synthesized
ttgtccttgcgttagcttgctg

SEQ ID NO: 1168190 - DNA, 22 bp, Artificial Sequence
  chemically synthesized
tgtccttgcgttagcttgctga

SEQ ID NO: 1168191 - DNA, 22 bp, Artificial Sequence
  chemically synthesized
gtccttgcgttagcttgctgag

SEQ ID NO: 1168192 - DNA, 22 bp, Artificial Sequence
  chemically synthesized
gagaccatcattctcagcaagc

SEQ ID NO: 1168193 - DNA, 22 bp, Artificial Sequence
  chemically synthesized
tccttgcgttagcttgctgaga

SEQ ID NO: 1168194 - DNA, 22 bp, Artificial Sequence
  chemically synthesized
gcgttagcttgctgagaatgat

SEQ ID NO: 1168195 - DNA, 22 bp, Artificial Sequence
  chemically synthesized
cgttagcttgctgagaatgatg

SEQ ID NO: 1168196 - DNA, 22 bp, Artificial Sequence
  chemically synthesized
gcttgctgagaatgatggtctc

SEQ ID NO: 1168197 - DNA, 22 bp, Artificial Sequence
  chemically synthesized
gctgagaatgatggtctccagc

SEQ ID NO: 1168198 - DNA, 22 bp, Artificial Sequence
  chemically synthesized
ctgagaatgatggtctccagct

SEQ ID NO: 1168199 - DNA, 22 bp, Artificial Sequence
  chemically synthesized
agaatgatggtctccagcttca

SEQ ID NO: 1168200 - DNA, 22 bp, Artificial Sequence
  chemically synthesized
tagggacatggatgaagctgga

SEQ ID NO: 1168201 - DNA, 22 bp, Artificial Sequence
  chemically synthesized
gtagggacatggatgaagctgg

SEQ ID NO: 1168202 - DNA, 22 bp, Artificial Sequence
  chemically synthesized
tgtagggacatggatgaagctg

SEQ ID NO: 1168203 - DNA, 22 bp, Artificial Sequence
  chemically synthesized
atgtcctttgtagggacatgga

SEQ ID NO: 1168204 - DNA, 22 bp, Artificial Sequence
  chemically synthesized
cagcttcatccatgtccctaca

SEQ ID NO: 1168205 - DNA, 22 bp, Artificial Sequence
  chemically synthesized
catccatgtccctacaaaggac

SEQ ID NO: 1168206 - DNA, 22 bp, Artificial Sequence
  chemically synthesized
atccatgtccctacaaaggaca

SEQ ID NO: 1168207 - DNA, 22 bp, Artificial Sequence
  chemically synthesized
caaaggacatgaactcatcctg

SEQ ID NO: 1168208 - DNA, 22 bp, Artificial Sequence
  chemically synthesized
tgcagccataaaacaggatgag

SEQ ID NO: 1168209 - DNA, 22 bp, Artificial Sequence
  chemically synthesized
atcctgttttatggctgcatag

SEQ ID NO: 1168210 - DNA, 22 bp, Artificial Sequence
  chemically synthesized
ttttatggctgcatagtatttc

SEQ ID NO: 1168211 - DNA, 22 bp, Artificial Sequence
  chemically synthesized
tatggctgcatagtatttcatg

SEQ ID NO: 1168212 - DNA, 22 bp, Artificial Sequence
  chemically synthesized
atggctgcatagtatttcatgg

SEQ ID NO: 1168213 - DNA, 22 bp, Artificial Sequence
  chemically synthesized
tggctgcatagtatttcatggt

SEQ ID NO: 1168214 - DNA, 22 bp, Artificial Sequence
  chemically synthesized
catagtatttcatggtgtatat

SEQ ID NO: 1168215 - DNA, 22 bp, Artificial Sequence
  chemically synthesized
agaaaatgtggcacatatacac

SEQ ID NO: 1168216 - DNA, 22 bp, Artificial Sequence
  chemically synthesized
gattaagaaaatgtggcacata

SEQ ID NO: 1168217 - DNA, 22 bp, Artificial Sequence
  chemically synthesized
catggtgtatatgtgccacatt

SEQ ID NO: 1168218 - DNA, 22 bp, Artificial Sequence
  chemically synthesized
atggtgtatatgtgccacattt

SEQ ID NO: 1168219 - DNA, 22 bp, Artificial Sequence
  chemically synthesized
tcttaatccagtctatcatcga

SEQ ID NO: 1168220 - DNA, 22 bp, Artificial Sequence
  chemically synthesized
cttaatccagtctatcatcgat

SEQ ID NO: 1168221 - DNA, 22 bp, Artificial Sequence
  chemically synthesized
ttaatccagtctatcatcgatg

SEQ ID NO: 1168222 - DNA, 22 bp, Artificial Sequence
  chemically synthesized
aatccagtctatcatcgatgga

SEQ ID NO: 1168223 - DNA, 22 bp, Artificial Sequence
  chemically synthesized
atccagtctatcatcgatggac

SEQ ID NO: 1168224 - DNA, 22 bp, Artificial Sequence
  chemically synthesized
gaaccaacccaaatgtccatcg

SEQ ID NO: 1168225 - DNA, 22 bp, Artificial Sequence
  chemically synthesized
ggaaccaacccaaatgtccatc

SEQ ID NO: 1168226 - DNA, 22 bp, Artificial Sequence
  chemically synthesized
tcatcgatggacatttgggttg

SEQ ID NO: 1168227 - DNA, 22 bp, Artificial Sequence
  chemically synthesized
acaatagcaaagacttggaacc

SEQ ID NO: 1168228 - DNA, 22 bp, Artificial Sequence
  chemically synthesized
ttcacaatagcaaagacttgga

SEQ ID NO: 1168229 - DNA, 22 bp, Artificial Sequence
  chemically synthesized
gggttggttccaagtctttgct

SEQ ID NO: 1168230 - DNA, 22 bp, Artificial Sequence
  chemically synthesized
ggttggttccaagtctttgcta

SEQ ID NO: 1168231 - DNA, 22 bp, Artificial Sequence
  chemically synthesized
cggcactattcacaatagcaaa

SEQ ID NO: 1168232 - DNA, 22 bp, Artificial Sequence
  chemically synthesized
gttccaagtctttgctattgtg

SEQ ID NO: 1168233 - DNA, 22 bp, Artificial Sequence
  chemically synthesized
ttgcggcactattcacaatagc

SEQ ID NO: 1168234 - DNA, 22 bp, Artificial Sequence
  chemically synthesized
attgcggcactattcacaatag

SEQ ID NO: 1168235 - DNA, 22 bp, Artificial Sequence
  chemically synthesized
caagtctttgctattgtgaata

SEQ ID NO: 1168236 - DNA, 22 bp, Artificial Sequence
  chemically synthesized
tgctattgtgaatagtgccgca

SEQ ID NO: 1168237 - DNA, 22 bp, Artificial Sequence
  chemically synthesized
gctattgtgaatagtgccgcaa

SEQ ID NO: 1168238 - DNA, 22 bp, Artificial Sequence
  chemically synthesized
ctattgtgaatagtgccgcaat

SEQ ID NO: 1168239 - DNA, 22 bp, Artificial Sequence
  chemically synthesized
ttgtgaatagtgccgcaataaa

SEQ ID NO: 1168240 - DNA, 22 bp, Artificial Sequence
  chemically synthesized
tgaatagtgccgcaataaacat

SEQ ID NO: 1168241 - DNA, 22 bp, Artificial Sequence
  chemically synthesized
taaagacagatgcacacgtatg

SEQ ID NO: 1168242 - DNA, 22 bp, Artificial Sequence
  chemically synthesized
ctataaagacagatgcacacgt

SEQ ID NO: 1168243 - DNA, 22 bp, Artificial Sequence
  chemically synthesized
aaaatcatgctgctataaagac

SEQ ID NO: 1168244 - DNA, 22 bp, Artificial Sequence
  chemically synthesized
ccaaaggattaaaaatcatgct

SEQ ID NO: 1168245 - DNA, 22 bp, Artificial Sequence
  chemically synthesized
tctttatagcagcatgattttt

SEQ ID NO: 1168246 - DNA, 22 bp, Artificial Sequence
  chemically synthesized
tatagcagcatgatttttaatc

SEQ ID NO: 1168247 - DNA, 22 bp, Artificial Sequence
  chemically synthesized
atagcagcatgatttttaatcc

SEQ ID NO: 1168248 - DNA, 22 bp, Artificial Sequence
  chemically synthesized
tagcagcatgatttttaatcct

SEQ ID NO: 1168249 - DNA, 22 bp, Artificial Sequence
  chemically synthesized
ggtatattcccaaaggattaaa

SEQ ID NO: 1168250 - DNA, 22 bp, Artificial Sequence
  chemically synthesized
ctgggtatattcccaaaggatt

SEQ ID NO: 1168251 - DNA, 22 bp, Artificial Sequence
  chemically synthesized
ttaatcctttgggaatataccc

SEQ ID NO: 1168252 - DNA, 22 bp, Artificial Sequence
  chemically synthesized
taatcctttgggaatataccca

SEQ ID NO: 1168253 - DNA, 22 bp, Artificial Sequence
  chemically synthesized
aatcctttgggaatatacccag

SEQ ID NO: 1168254 - DNA, 22 bp, Artificial Sequence
  chemically synthesized
atcctttgggaatatacccagt

SEQ ID NO: 1168255 - DNA, 22 bp, Artificial Sequence
  chemically synthesized
cagtaatatacccattactggg

SEQ ID NO: 1168256 - DNA, 22 bp, Artificial Sequence
  chemically synthesized
tgggaatatacccagtaatggg

SEQ ID NO: 1168257 - DNA, 22 bp, Artificial Sequence
  chemically synthesized
gggaatatacccagtaatgggt

SEQ ID NO: 1168258 - DNA, 22 bp, Artificial Sequence
  chemically synthesized
ggaatatacccagtaatgggta

SEQ ID NO: 1168259 - DNA, 22 bp, Artificial Sequence
  chemically synthesized
tcccattacagtaatataccca

SEQ ID NO: 1168260 - DNA, 22 bp, Artificial Sequence
  chemically synthesized
atcccattacagtaatataccc

SEQ ID NO: 1168261 - DNA, 22 bp, Artificial Sequence
  chemically synthesized
tatcccattacagtaatatacc

SEQ ID NO: 1168262 - DNA, 22 bp, Artificial Sequence
  chemically synthesized
acccagccatcccattttatcc

SEQ ID NO: 1168263 - DNA, 22 bp, Artificial Sequence
  chemically synthesized
gacccagccatcccattttatc

SEQ ID NO: 1168264 - DNA, 22 bp, Artificial Sequence
  chemically synthesized
ctgtaatgggataaaatgggat

SEQ ID NO: 1168265 - DNA, 22 bp, Artificial Sequence
  chemically synthesized
taatgggataaaatgggatggc

SEQ ID NO: 1168266 - DNA, 22 bp, Artificial Sequence
  chemically synthesized
gaaataccatttgacccagcca

SEQ ID NO: 1168267 - DNA, 22 bp, Artificial Sequence
  chemically synthesized
gaactagaaataccatttgacc

SEQ ID NO: 1168268 - DNA, 22 bp, Artificial Sequence
  chemically synthesized
aaggatctagaactagaaatac

SEQ ID NO: 1168269 - DNA, 22 bp, Artificial Sequence
  chemically synthesized
ggtcaaatggtatttctagttc

SEQ ID NO: 1168270 - DNA, 22 bp, Artificial Sequence
  chemically synthesized
ctcaaggatctagaactagaaa

SEQ ID NO: 1168271 - DNA, 22 bp, Artificial Sequence
  chemically synthesized
ctagttctagatccttgaggaa

SEQ ID NO: 1168272 - DNA, 22 bp, Artificial Sequence
  chemically synthesized
tagttctagatccttgaggaat

SEQ ID NO: 1168273 - DNA, 22 bp, Artificial Sequence
  chemically synthesized
gttctagatccttgaggaattg

SEQ ID NO: 1168274 - DNA, 22 bp, Artificial Sequence
  chemically synthesized
tggaagagagtgtgcaattcct

SEQ ID NO: 1168275 - DNA, 22 bp, Artificial Sequence
  chemically synthesized
tagatccttgaggaattgcaca

SEQ ID NO: 1168276 - DNA, 22 bp, Artificial Sequence
  chemically synthesized
gatccttgaggaattgcacact

SEQ ID NO: 1168277 - DNA, 22 bp, Artificial Sequence
  chemically synthesized
aaccattgtggaagagagtgtg

SEQ ID NO: 1168278 - DNA, 22 bp, Artificial Sequence
  chemically synthesized
gaggaattgcacactctcttcc

SEQ ID NO: 1168279 - DNA, 22 bp, Artificial Sequence
  chemically synthesized
aggaattgcacactctcttcca

SEQ ID NO: 1168280 - DNA, 22 bp, Artificial Sequence
  chemically synthesized
gttcaaccattgtggaagagag

SEQ ID NO: 1168281 - DNA, 22 bp, Artificial Sequence
  chemically synthesized
taaactagttcaaccattgtgg

SEQ ID NO: 1168282 - DNA, 22 bp, Artificial Sequence
  chemically synthesized
cacactctcttccacaatggtt

SEQ ID NO: 1168283 - DNA, 22 bp, Artificial Sequence
  chemically synthesized
tcttccacaatggttgaactag

SEQ ID NO: 1168284 - DNA, 22 bp, Artificial Sequence
  chemically synthesized
atgggattgtaaactagttcaa

SEQ ID NO: 1168285 - DNA, 22 bp, Artificial Sequence
  chemically synthesized
ttccacaatggttgaactagtt

SEQ ID NO: 1168286 - DNA, 22 bp, Artificial Sequence
  chemically synthesized
ccacaatggttgaactagttta

SEQ ID NO: 1168287 - DNA, 22 bp, Artificial Sequence
  chemically synthesized
ttgatgggattgtaaactagtt

SEQ ID NO: 1168288 - DNA, 22 bp, Artificial Sequence
  chemically synthesized
cacaatggttgaactagtttac

SEQ ID NO: 1168289 - DNA, 22 bp, Artificial Sequence
  chemically synthesized
cactgttgatgggattgtaaac

SEQ ID NO: 1168290 - DNA, 22 bp, Artificial Sequence
  chemically synthesized
acactgttgatgggattgtaaa

SEQ ID NO: 1168291 - DNA, 22 bp, Artificial Sequence
  chemically synthesized
tacactgttgatgggattgtaa

SEQ ID NO: 1168292 - DNA, 22 bp, Artificial Sequence
  chemically synthesized
ttacactgttgatgggattgta

SEQ ID NO: 1168293 - DNA, 22 bp, Artificial Sequence
  chemically synthesized
aactagtttacaatcccatcaa

SEQ ID NO: 1168294 - DNA, 22 bp, Artificial Sequence
  chemically synthesized
gtttacaatcccatcaacagtg

SEQ ID NO: 1168295 - DNA, 22 bp, Artificial Sequence
  chemically synthesized
acaatcccatcaacagtgtaaa

SEQ ID NO: 1168296 - DNA, 22 bp, Artificial Sequence
  chemically synthesized
caatcccatcaacagtgtaaaa

SEQ ID NO: 1168297 - DNA, 22 bp, Artificial Sequence
  chemically synthesized
gagaggatgtggagaaataaga

SEQ ID NO: 1168298 - DNA, 22 bp, Artificial Sequence
  chemically synthesized
ttatttctccacatcctctcca

SEQ ID NO: 1168299 - DNA, 22 bp, Artificial Sequence
  chemically synthesized
atttctccacatcctctccagc

SEQ ID NO: 1168300 - DNA, 22 bp, Artificial Sequence
  chemically synthesized
tttctccacatcctctccagca

SEQ ID NO: 1168301 - DNA, 22 bp, Artificial Sequence
  chemically synthesized
ctccacatcctctccagcacct

SEQ ID NO: 1168302 - DNA, 22 bp, Artificial Sequence
  chemically synthesized
tccacatcctctccagcacctg

SEQ ID NO: 1168303 - DNA, 22 bp, Artificial Sequence
  chemically synthesized
cacatcctctccagcacctgtt

SEQ ID NO: 1168304 - DNA, 22 bp, Artificial Sequence
  chemically synthesized
tccagcacctgttgtttcctga

SEQ ID NO: 1168305 - DNA, 22 bp, Artificial Sequence
  chemically synthesized
cagcacctgttgtttcctgact

SEQ ID NO: 1168306 - DNA, 22 bp, Artificial Sequence
  chemically synthesized
gaatggtgaacaataaaaagtc

SEQ ID NO: 1168307 - DNA, 22 bp, Artificial Sequence
  chemically synthesized
ttgtttcctgactttttattgt

SEQ ID NO: 1168308 - DNA, 22 bp, Artificial Sequence
  chemically synthesized
tttcctgactttttattgttca

SEQ ID NO: 1168309 - DNA, 22 bp, Artificial Sequence
  chemically synthesized
cctgactttttattgttcacca

SEQ ID NO: 1168310 - DNA, 22 bp, Artificial Sequence
  chemically synthesized
ctgactttttattgttcaccat

SEQ ID NO: 1168311 - DNA, 22 bp, Artificial Sequence
  chemically synthesized
cacatagttagaatggtgaaca

SEQ ID NO: 1168312 - DNA, 22 bp, Artificial Sequence
  chemically synthesized
actttttattgttcaccattct

SEQ ID NO: 1168313 - DNA, 22 bp, Artificial Sequence
  chemically synthesized
tttattgttcaccattctaact

SEQ ID NO: 1168314 - DNA, 22 bp, Artificial Sequence
  chemically synthesized
ttattgttcaccattctaacta

SEQ ID NO: 1168315 - DNA, 22 bp, Artificial Sequence
  chemically synthesized
tattgttcaccattctaactat

SEQ ID NO: 1168316 - DNA, 22 bp, Artificial Sequence
  chemically synthesized
attgttcaccattctaactatg

SEQ ID NO: 1168317 - DNA, 22 bp, Artificial Sequence
  chemically synthesized
ttgttcaccattctaactatgt

SEQ ID NO: 1168318 - DNA, 22 bp, Artificial Sequence
  chemically synthesized
ttcaccattctaactatgtgca

SEQ ID NO: 1168319 - DNA, 22 bp, Artificial Sequence
  chemically synthesized
accattctaactatgtgcaatg

SEQ ID NO: 1168320 - DNA, 22 bp, Artificial Sequence
  chemically synthesized
taactatgtgcaatggtatctc

SEQ ID NO: 1168321 - DNA, 22 bp, Artificial Sequence
  chemically synthesized
actatgtgcaatggtatctcat

SEQ ID NO: 1168322 - DNA, 22 bp, Artificial Sequence
  chemically synthesized
tgtgcaatggtatctcattgtg

SEQ ID NO: 1168323 - DNA, 22 bp, Artificial Sequence
  chemically synthesized
gccatcagagaaatgcaaatca

SEQ ID NO: 1168324 - DNA, 22 bp, Artificial Sequence
  chemically synthesized
attgtggttttgatttgcattt

SEQ ID NO: 1168325 - DNA, 22 bp, Artificial Sequence
  chemically synthesized
tggttttgatttgcatttctct

SEQ ID NO: 1168326 - DNA, 22 bp, Artificial Sequence
  chemically synthesized
atcatcactggccatcagagaa

SEQ ID NO: 1168327 - DNA, 22 bp, Artificial Sequence
  chemically synthesized
tgatttgcatttctctgatggc

SEQ ID NO: 1168328 - DNA, 22 bp, Artificial Sequence
  chemically synthesized
gatttgcatttctctgatggcc

SEQ ID NO: 1168329 - DNA, 22 bp, Artificial Sequence
  chemically synthesized
atttgcatttctctgatggcca

SEQ ID NO: 1168330 - DNA, 22 bp, Artificial Sequence
  chemically synthesized
gcatttctctgatggccagtga

SEQ ID NO: 1168331 - DNA, 22 bp, Artificial Sequence
  chemically synthesized
catttctctgatggccagtgat

SEQ ID NO: 1168332 - DNA, 22 bp, Artificial Sequence
  chemically synthesized
ctctgatggccagtgatgatga

SEQ ID NO: 1168333 - DNA, 22 bp, Artificial Sequence
  chemically synthesized
tctgatggccagtgatgatgag

SEQ ID NO: 1168334 - DNA, 22 bp, Artificial Sequence
  chemically synthesized
tgatggccagtgatgatgagca

SEQ ID NO: 1168335 - DNA, 22 bp, Artificial Sequence
  chemically synthesized
atggccagtgatgatgagcatt

SEQ ID NO: 1168336 - DNA, 22 bp, Artificial Sequence
  chemically synthesized
atgcagccaacagacacatgaa

SEQ ID NO: 1168337 - DNA, 22 bp, Artificial Sequence
  chemically synthesized
ttttcatgtgtctgttggctgc

SEQ ID NO: 1168338 - DNA, 22 bp, Artificial Sequence
  chemically synthesized
tttcatgtgtctgttggctgca

SEQ ID NO: 1168339 - DNA, 22 bp, Artificial Sequence
  chemically synthesized
ttcatgtgtctgttggctgcat

SEQ ID NO: 1168340 - DNA, 22 bp, Artificial Sequence
  chemically synthesized
tcatgtgtctgttggctgcatc

SEQ ID NO: 1168341 - DNA, 22 bp, Artificial Sequence
  chemically synthesized
aaaaaaggcattgatgcagcca

SEQ ID NO: 1168342 - DNA, 22 bp, Artificial Sequence
  chemically synthesized
catgtgtctgttggctgcatca

SEQ ID NO: 1168343 - DNA, 22 bp, Artificial Sequence
  chemically synthesized
atgtgtctgttggctgcatcaa

SEQ ID NO: 1168344 - DNA, 22 bp, Artificial Sequence
  chemically synthesized
tcaaaaaaggcattgatgcagc

SEQ ID NO: 1168345 - DNA, 22 bp, Artificial Sequence
  chemically synthesized
ctcaaaaaaggcattgatgcag

SEQ ID NO: 1168346 - DNA, 22 bp, Artificial Sequence
  chemically synthesized
ttggctgcatcaatgccttttt

SEQ ID NO: 1168347 - DNA, 22 bp, Artificial Sequence
  chemically synthesized
gctgcatcaatgccttttttga

SEQ ID NO: 1168348 - DNA, 22 bp, Artificial Sequence
  chemically synthesized
catcaatgccttttttgagaag

SEQ ID NO: 1168349 - DNA, 22 bp, Artificial Sequence
  chemically synthesized
ttttgagaagtgtctgttcata

SEQ ID NO: 1168350 - DNA, 22 bp, Artificial Sequence
  chemically synthesized
tttgagaagtgtctgttcatat

SEQ ID NO: 1168351 - DNA, 22 bp, Artificial Sequence
  chemically synthesized
ttgagaagtgtctgttcatatc

SEQ ID NO: 1168352 - DNA, 22 bp, Artificial Sequence
  chemically synthesized
tgagaagtgtctgttcatatcc

SEQ ID NO: 1168353 - DNA, 22 bp, Artificial Sequence
  chemically synthesized
gagaagtgtctgttcatatcct

SEQ ID NO: 1168354 - DNA, 22 bp, Artificial Sequence
  chemically synthesized
agaagtgtctgttcatatcctt

SEQ ID NO: 1168355 - DNA, 22 bp, Artificial Sequence
  chemically synthesized
tcaaaaagtgggcaaaggatat

SEQ ID NO: 1168356 - DNA, 22 bp, Artificial Sequence
  chemically synthesized
ttcatatcctttgcccactttt

SEQ ID NO: 1168357 - DNA, 22 bp, Artificial Sequence
  chemically synthesized
atatcctttgcccactttttga

SEQ ID NO: 1168358 - DNA, 22 bp, Artificial Sequence
  chemically synthesized
caagaaaaaaacaaccctatca

SEQ ID NO: 1168359 - DNA, 22 bp, Artificial Sequence
  chemically synthesized
tgcccactttttgatagggttg

SEQ ID NO: 1168360 - DNA, 22 bp, Artificial Sequence
  chemically synthesized
acaagaaaaaaacaaccctatc

SEQ ID NO: 1168361 - DNA, 22 bp, Artificial Sequence
  chemically synthesized
gcccactttttgatagggttgt

SEQ ID NO: 1168362 - DNA, 22 bp, Artificial Sequence
  chemically synthesized
cccactttttgatagggttgtt

SEQ ID NO: 1168363 - DNA, 22 bp, Artificial Sequence
  chemically synthesized
tttgatagggttgtttttttct

SEQ ID NO: 1168364 - DNA, 22 bp, Artificial Sequence
  chemically synthesized
ttgatagggttgtttttttctt

SEQ ID NO: 1168365 - DNA, 22 bp, Artificial Sequence
  chemically synthesized
tgatagggttgtttttttcttg

SEQ ID NO: 1168366 - DNA, 22 bp, Artificial Sequence
  chemically synthesized
gatagggttgtttttttcttgt

SEQ ID NO: 1168367 - DNA, 22 bp, Artificial Sequence
  chemically synthesized
atagggttgtttttttcttgta

SEQ ID NO: 1168368 - DNA, 22 bp, Artificial Sequence
  chemically synthesized
caaagaagtcaaacaaatttac

SEQ ID NO: 1168369 - DNA, 22 bp, Artificial Sequence
  chemically synthesized
tttttttcttgtaaatttgttt

SEQ ID NO: 1168370 - DNA, 22 bp, Artificial Sequence
  chemically synthesized
ttttcttgtaaatttgtttgac

SEQ ID NO: 1168371 - DNA, 22 bp, Artificial Sequence
  chemically synthesized
tttcttgtaaatttgtttgact

SEQ ID NO: 1168372 - DNA, 22 bp, Artificial Sequence
  chemically synthesized
ttcttgtaaatttgtttgactt

SEQ ID NO: 1168373 - DNA, 22 bp, Artificial Sequence
  chemically synthesized
tcttgtaaatttgtttgacttc

SEQ ID NO: 1168374 - DNA, 22 bp, Artificial Sequence
  chemically synthesized
cttgtaaatttgtttgacttct

SEQ ID NO: 1168375 - DNA, 22 bp, Artificial Sequence
  chemically synthesized
ttgtaaatttgtttgacttctt

SEQ ID NO: 1168376 - DNA, 22 bp, Artificial Sequence
  chemically synthesized
gtaaatttgtttgacttctttg

SEQ ID NO: 1168377 - DNA, 22 bp, Artificial Sequence
  chemically synthesized
taaatttgtttgacttctttgt

SEQ ID NO: 1168378 - DNA, 22 bp, Artificial Sequence
  chemically synthesized
atatccagaatctacaaagaag

SEQ ID NO: 1168379 - DNA, 22 bp, Artificial Sequence
  chemically synthesized
gtttgacttctttgtagattct

SEQ ID NO: 1168380 - DNA, 22 bp, Artificial Sequence
  chemically synthesized
tttgacttctttgtagattctg

SEQ ID NO: 1168381 - DNA, 22 bp, Artificial Sequence
  chemically synthesized
gacttctttgtagattctggat

SEQ ID NO: 1168382 - DNA, 22 bp, Artificial Sequence
  chemically synthesized
acttctttgtagattctggata

SEQ ID NO: 1168383 - DNA, 22 bp, Artificial Sequence
  chemically synthesized
gcaaagggctaatatccagaat

SEQ ID NO: 1168384 - DNA, 22 bp, Artificial Sequence
  chemically synthesized
ctttgtagattctggatattag

SEQ ID NO: 1168385 - DNA, 22 bp, Artificial Sequence
  chemically synthesized
tttgtagattctggatattagc

SEQ ID NO: 1168386 - DNA, 22 bp, Artificial Sequence
  chemically synthesized
tgtagattctggatattagccc

SEQ ID NO: 1168387 - DNA, 22 bp, Artificial Sequence
  chemically synthesized
gtagattctggatattagccct

SEQ ID NO: 1168388 - DNA, 22 bp, Artificial Sequence
  chemically synthesized
atcatctggcaaagggctaata

SEQ ID NO: 1168389 - DNA, 22 bp, Artificial Sequence
  chemically synthesized
tagattctggatattagccctt

SEQ ID NO: 1168390 - DNA, 22 bp, Artificial Sequence
  chemically synthesized
caatctaatcatctggcaaagg

SEQ ID NO: 1168391 - DNA, 22 bp, Artificial Sequence
  chemically synthesized
tggatattagccctttgccaga

SEQ ID NO: 1168392 - DNA, 22 bp, Artificial Sequence
  chemically synthesized
acaatctaatcatctggcaaag

SEQ ID NO: 1168393 - DNA, 22 bp, Artificial Sequence
  chemically synthesized
tacaatctaatcatctggcaaa

SEQ ID NO: 1168394 - DNA, 22 bp, Artificial Sequence
  chemically synthesized
gatattagccctttgccagatg

SEQ ID NO: 1168395 - DNA, 22 bp, Artificial Sequence
  chemically synthesized
ttacaatctaatcatctggcaa

SEQ ID NO: 1168396 - DNA, 22 bp, Artificial Sequence
  chemically synthesized
gccctttgccagatgattagat

SEQ ID NO: 1168397 - DNA, 22 bp, Artificial Sequence
  chemically synthesized
tgccagatgattagattgtaaa

SEQ ID NO: 1168398 - DNA, 22 bp, Artificial Sequence
  chemically synthesized
gccagatgattagattgtaaaa

SEQ ID NO: 1168399 - DNA, 22 bp, Artificial Sequence
  chemically synthesized
ccagatgattagattgtaaaaa

SEQ ID NO: 1168400 - DNA, 22 bp, Artificial Sequence
  chemically synthesized
cagaatgggagaaaatttttac

SEQ ID NO: 1168401 - DNA, 22 bp, Artificial Sequence
  chemically synthesized
gattgtaaaaattttctcccat

SEQ ID NO: 1168402 - DNA, 22 bp, Artificial Sequence
  chemically synthesized
taaaaattttctcccattctgt

SEQ ID NO: 1168403 - DNA, 22 bp, Artificial Sequence
  chemically synthesized
tctcccattctgtaggttgcct

SEQ ID NO: 1168404 - DNA, 22 bp, Artificial Sequence
  chemically synthesized
ctcccattctgtaggttgcctg

SEQ ID NO: 1168405 - DNA, 22 bp, Artificial Sequence
  chemically synthesized
tcccattctgtaggttgcctgt

SEQ ID NO: 1168406 - DNA, 22 bp, Artificial Sequence
  chemically synthesized
ccatcatagtgaacaggcaacc

SEQ ID NO: 1168407 - DNA, 22 bp, Artificial Sequence
  chemically synthesized
ccattctgtaggttgcctgttc

SEQ ID NO: 1168408 - DNA, 22 bp, Artificial Sequence
  chemically synthesized
tgtaggttgcctgttcactatg

SEQ ID NO: 1168409 - DNA, 22 bp, Artificial Sequence
  chemically synthesized
taggttgcctgttcactatgat

SEQ ID NO: 1168410 - DNA, 22 bp, Artificial Sequence
  chemically synthesized
cctgttcactatgatggtagtt

SEQ ID NO: 1168411 - DNA, 22 bp, Artificial Sequence
  chemically synthesized
caaagcaaaagaaactaccatc

SEQ ID NO: 1168412 - DNA, 22 bp, Artificial Sequence
  chemically synthesized
tgcaaagcaaaagaaactacca

SEQ ID NO: 1168413 - DNA, 22 bp, Artificial Sequence
  chemically synthesized
ctgcaaagcaaaagaaactacc

SEQ ID NO: 1168414 - DNA, 22 bp, Artificial Sequence
  chemically synthesized
ttcactatgatggtagtttctt

SEQ ID NO: 1168415 - DNA, 22 bp, Artificial Sequence
  chemically synthesized
actatgatggtagtttcttttg

SEQ ID NO: 1168416 - DNA, 22 bp, Artificial Sequence
  chemically synthesized
tgatggtagtttcttttgcttt

SEQ ID NO: 1168417 - DNA, 22 bp, Artificial Sequence
  chemically synthesized
aaccaaggagcttctgcaaagc

SEQ ID NO: 1168418 - DNA, 22 bp, Artificial Sequence
  chemically synthesized
attaaaccaaggagcttctgca

SEQ ID NO: 1168419 - DNA, 22 bp, Artificial Sequence
  chemically synthesized
cttttgctttgcagaagctcct

SEQ ID NO: 1168420 - DNA, 22 bp, Artificial Sequence
  chemically synthesized
ttttgctttgcagaagctcctt

SEQ ID NO: 1168421 - DNA, 22 bp, Artificial Sequence
  chemically synthesized
ttgctttgcagaagctccttgg

SEQ ID NO: 1168422 - DNA, 22 bp, Artificial Sequence
  chemically synthesized
tgctttgcagaagctccttggt

SEQ ID NO: 1168423 - DNA, 22 bp, Artificial Sequence
  chemically synthesized
gctttgcagaagctccttggtt

SEQ ID NO: 1168424 - DNA, 22 bp, Artificial Sequence
  chemically synthesized
ctttgcagaagctccttggttt

SEQ ID NO: 1168425 - DNA, 22 bp, Artificial Sequence
  chemically synthesized
tgcagaagctccttggtttaat

SEQ ID NO: 1168426 - DNA, 22 bp, Artificial Sequence
  chemically synthesized
gcagaagctccttggtttaatt

SEQ ID NO: 1168427 - DNA, 22 bp, Artificial Sequence
  chemically synthesized
cagaagctccttggtttaatta

SEQ ID NO: 1168428 - DNA, 22 bp, Artificial Sequence
  chemically synthesized
acaaatgggatctaattaaacc

SEQ ID NO: 1168429 - DNA, 22 bp, Artificial Sequence
  chemically synthesized
cttggtttaattagatcccatt

SEQ ID NO: 1168430 - DNA, 22 bp, Artificial Sequence
  chemically synthesized
ggtttaattagatcccatttgt

SEQ ID NO: 1168431 - DNA, 22 bp, Artificial Sequence
  chemically synthesized
gtttaattagatcccatttgtc

SEQ ID NO: 1168432 - DNA, 22 bp, Artificial Sequence
  chemically synthesized
aattagatcccatttgtcaatt

SEQ ID NO: 1168433 - DNA, 22 bp, Artificial Sequence
  chemically synthesized
attagatcccatttgtcaattt

SEQ ID NO: 1168434 - DNA, 22 bp, Artificial Sequence
  chemically synthesized
gatcccatttgtcaattttgac

SEQ ID NO: 1168435 - DNA, 22 bp, Artificial Sequence
  chemically synthesized
gtcaattttgactcttgttgcc

SEQ ID NO: 1168436 - DNA, 22 bp, Artificial Sequence
  chemically synthesized
tcaattttgactcttgttgcca

SEQ ID NO: 1168437 - DNA, 22 bp, Artificial Sequence
  chemically synthesized
tgactcttgttgccattgcttt

SEQ ID NO: 1168438 - DNA, 22 bp, Artificial Sequence
  chemically synthesized
gactcttgttgccattgctttt

SEQ ID NO: 1168439 - DNA, 22 bp, Artificial Sequence
  chemically synthesized
actcttgttgccattgcttttg

SEQ ID NO: 1168440 - DNA, 22 bp, Artificial Sequence
  chemically synthesized
atgtccaaaacaccaaaagcaa

SEQ ID NO: 1168441 - DNA, 22 bp, Artificial Sequence
  chemically synthesized
catgtccaaaacaccaaaagca

SEQ ID NO: 1168442 - DNA, 22 bp, Artificial Sequence
  chemically synthesized
ttgttgccattgcttttggtgt

SEQ ID NO: 1168443 - DNA, 22 bp, Artificial Sequence
  chemically synthesized
gttgccattgcttttggtgttt

SEQ ID NO: 1168444 - DNA, 22 bp, Artificial Sequence
  chemically synthesized
ttgccattgcttttggtgtttt

SEQ ID NO: 1168445 - DNA, 22 bp, Artificial Sequence
  chemically synthesized
ccattgcttttggtgttttgga

SEQ ID NO: 1168446 - DNA, 22 bp, Artificial Sequence
  chemically synthesized
cttttggtgttttggacatgaa

SEQ ID NO: 1168447 - DNA, 22 bp, Artificial Sequence
  chemically synthesized
ttggtgttttggacatgaagtc

SEQ ID NO: 1168448 - DNA, 22 bp, Artificial Sequence
  chemically synthesized
tggtgttttggacatgaagtcc

SEQ ID NO: 1168449 - DNA, 22 bp, Artificial Sequence
  chemically synthesized
ggtgttttggacatgaagtcct

SEQ ID NO: 1168450 - DNA, 22 bp, Artificial Sequence
  chemically synthesized
gtgttttggacatgaagtcctt

SEQ ID NO: 1168451 - DNA, 22 bp, Artificial Sequence
  chemically synthesized
aggacataggcatgggtaagga

SEQ ID NO: 1168452 - DNA, 22 bp, Artificial Sequence
  chemically synthesized
tggacatgaagtccttacccat

SEQ ID NO: 1168453 - DNA, 22 bp, Artificial Sequence
  chemically synthesized
caggacataggcatgggtaagg

SEQ ID NO: 1168454 - DNA, 22 bp, Artificial Sequence
  chemically synthesized
ggacatgaagtccttacccatg

SEQ ID NO: 1168455 - DNA, 22 bp, Artificial Sequence
  chemically synthesized
tcaggacataggcatgggtaag

SEQ ID NO: 1168456 - DNA, 22 bp, Artificial Sequence
  chemically synthesized
gacatgaagtccttacccatgc

SEQ ID NO: 1168457 - DNA, 22 bp, Artificial Sequence
  chemically synthesized
ggcaatacctttcaggacatag

SEQ ID NO: 1168458 - DNA, 22 bp, Artificial Sequence
  chemically synthesized
acccatgcctatgtcctgaaag

SEQ ID NO: 1168459 - DNA, 22 bp, Artificial Sequence
  chemically synthesized
cccatgcctatgtcctgaaagg

SEQ ID NO: 1168460 - DNA, 22 bp, Artificial Sequence
  chemically synthesized
gaagaaaacctaggcaatacct

SEQ ID NO: 1168461 - DNA, 22 bp, Artificial Sequence
  chemically synthesized
tgtcctgaaaggtattgcctag

SEQ ID NO: 1168462 - DNA, 22 bp, Artificial Sequence
  chemically synthesized
aaaggtattgcctaggttttct

SEQ ID NO: 1168463 - DNA, 22 bp, Artificial Sequence
  chemically synthesized
aaaccataaaaacctagaagaa

SEQ ID NO: 1168464 - DNA, 22 bp, Artificial Sequence
  chemically synthesized
cctaggttttcttctaggtttt

SEQ ID NO: 1168465 - DNA, 22 bp, Artificial Sequence
  chemically synthesized
gacctaaaaccataaaaaccta

SEQ ID NO: 1168466 - DNA, 22 bp, Artificial Sequence
  chemically synthesized
ggttttcttctaggtttttatg

SEQ ID NO: 1168467 - DNA, 22 bp, Artificial Sequence
  chemically synthesized
tcttctaggtttttatggtttt

SEQ ID NO: 1168468 - DNA, 22 bp, Artificial Sequence
  chemically synthesized
aatgttagacctaaaaccataa

SEQ ID NO: 1168469 - DNA, 22 bp, Artificial Sequence
  chemically synthesized
cttctaggtttttatggtttta

SEQ ID NO: 1168470 - DNA, 22 bp, Artificial Sequence
  chemically synthesized
aaatgttagacctaaaaccata

SEQ ID NO: 1168471 - DNA, 22 bp, Artificial Sequence
  chemically synthesized
ttctaggtttttatggttttag

SEQ ID NO: 1168472 - DNA, 22 bp, Artificial Sequence
  chemically synthesized
ctaggtttttatggttttaggt

SEQ ID NO: 1168473 - DNA, 22 bp, Artificial Sequence
  chemically synthesized
taggtttttatggttttaggtc

SEQ ID NO: 1168474 - DNA, 22 bp, Artificial Sequence
  chemically synthesized
ggtttttatggttttaggtcta

SEQ ID NO: 1168475 - DNA, 22 bp, Artificial Sequence
  chemically synthesized
ttatggttttaggtctaacatt

SEQ ID NO: 1168476 - DNA, 22 bp, Artificial Sequence
  chemically synthesized
tatggttttaggtctaacattt

SEQ ID NO: 1168477 - DNA, 22 bp, Artificial Sequence
  chemically synthesized
atggttttaggtctaacattta

SEQ ID NO: 1168478 - DNA, 22 bp, Artificial Sequence
  chemically synthesized
tggttttaggtctaacatttaa

SEQ ID NO: 1168479 - DNA, 22 bp, Artificial Sequence
  chemically synthesized
aagatggatcaaagacttaaat

SEQ ID NO: 1168480 - DNA, 22 bp, Artificial Sequence
  chemically synthesized
taggtctaacatttaagtcttt

SEQ ID NO: 1168481 - DNA, 22 bp, Artificial Sequence
  chemically synthesized
aggtctaacatttaagtctttg

SEQ ID NO: 1168482 - DNA, 22 bp, Artificial Sequence
  chemically synthesized
ggtctaacatttaagtctttga

SEQ ID NO: 1168483 - DNA, 22 bp, Artificial Sequence
  chemically synthesized
acatttaagtctttgatccatc

SEQ ID NO: 1168484 - DNA, 22 bp, Artificial Sequence
  chemically synthesized
tacaaaaatgaattcaagatgg

SEQ ID NO: 1168485 - DNA, 22 bp, Artificial Sequence
  chemically synthesized
aagtctttgatccatcttgaat

SEQ ID NO: 1168486 - DNA, 22 bp, Artificial Sequence
  chemically synthesized
agtctttgatccatcttgaatt

SEQ ID NO: 1168487 - DNA, 22 bp, Artificial Sequence
  chemically synthesized
cacattatacaaaaatgaattc

SEQ ID NO: 1168488 - DNA, 22 bp, Artificial Sequence
  chemically synthesized
tgatccatcttgaattcatttt

SEQ ID NO: 1168489 - DNA, 22 bp, Artificial Sequence
  chemically synthesized
acacattatacaaaaatgaatt

SEQ ID NO: 1168490 - DNA, 22 bp, Artificial Sequence
  chemically synthesized
gatccatcttgaattcattttt

SEQ ID NO: 1168491 - DNA, 22 bp, Artificial Sequence
  chemically synthesized
atccatcttgaattcatttttg

SEQ ID NO: 1168492 - DNA, 22 bp, Artificial Sequence
  chemically synthesized
cttacacattatacaaaaatga

SEQ ID NO: 1168493 - DNA, 22 bp, Artificial Sequence
  chemically synthesized
ccttacacattatacaaaaatg

SEQ ID NO: 1168494 - DNA, 22 bp, Artificial Sequence
  chemically synthesized
gaattcatttttgtataatgtg

SEQ ID NO: 1168495 - DNA, 22 bp, Artificial Sequence
  chemically synthesized
aattcatttttgtataatgtgt

SEQ ID NO: 1168496 - DNA, 22 bp, Artificial Sequence
  chemically synthesized
gatcccttccttacacattata

SEQ ID NO: 1168497 - DNA, 22 bp, Artificial Sequence
  chemically synthesized
atttttgtataatgtgtaagga

SEQ ID NO: 1168498 - DNA, 22 bp, Artificial Sequence
  chemically synthesized
aaactggatcccttccttacac

SEQ ID NO: 1168499 - DNA, 22 bp, Artificial Sequence
  chemically synthesized
ttgtataatgtgtaaggaaggg

SEQ ID NO: 1168500 - DNA, 22 bp, Artificial Sequence
  chemically synthesized
tgtataatgtgtaaggaaggga

SEQ ID NO: 1168501 - DNA, 22 bp, Artificial Sequence
  chemically synthesized
gtataatgtgtaaggaagggat

SEQ ID NO: 1168502 - DNA, 22 bp, Artificial Sequence
  chemically synthesized
tataatgtgtaaggaagggatc

SEQ ID NO: 1168503 - DNA, 22 bp, Artificial Sequence
  chemically synthesized
gccatatgtagaaagctgaaac

SEQ ID NO: 1168504 - DNA, 22 bp, Artificial Sequence
  chemically synthesized
gctagccatatgtagaaagctg

SEQ ID NO: 1168505 - DNA, 22 bp, Artificial Sequence
  chemically synthesized
ggaaaactggctagccatatgt

SEQ ID NO: 1168506 - DNA, 22 bp, Artificial Sequence
  chemically synthesized
cagctttctacatatggctagc

SEQ ID NO: 1168507 - DNA, 22 bp, Artificial Sequence
  chemically synthesized
agctttctacatatggctagcc

SEQ ID NO: 1168508 - DNA, 22 bp, Artificial Sequence
  chemically synthesized
tctacatatggctagccagttt

SEQ ID NO: 1168509 - DNA, 22 bp, Artificial Sequence
  chemically synthesized
ctacatatggctagccagtttt

SEQ ID NO: 1168510 - DNA, 22 bp, Artificial Sequence
  chemically synthesized
tacatatggctagccagttttc

SEQ ID NO: 1168511 - DNA, 22 bp, Artificial Sequence
  chemically synthesized
catatggctagccagttttccc

SEQ ID NO: 1168512 - DNA, 22 bp, Artificial Sequence
  chemically synthesized
ataaatggtgctgggaaaactg

SEQ ID NO: 1168513 - DNA, 22 bp, Artificial Sequence
  chemically synthesized
aataaatggtgctgggaaaact

SEQ ID NO: 1168514 - DNA, 22 bp, Artificial Sequence
  chemically synthesized
tttaataaatggtgctgggaaa

SEQ ID NO: 1168515 - DNA, 22 bp, Artificial Sequence
  chemically synthesized
cctatttaataaatggtgctgg

SEQ ID NO: 1168516 - DNA, 22 bp, Artificial Sequence
  chemically synthesized
gccagttttcccagcaccattt

SEQ ID NO: 1168517 - DNA, 22 bp, Artificial Sequence
  chemically synthesized
tcccagcaccatttattaaata

SEQ ID NO: 1168518 - DNA, 22 bp, Artificial Sequence
  chemically synthesized
cccagcaccatttattaaatag

SEQ ID NO: 1168519 - DNA, 22 bp, Artificial Sequence
  chemically synthesized
ccagcaccatttattaaatagg

SEQ ID NO: 1168520 - DNA, 22 bp, Artificial Sequence
  chemically synthesized
attaaatagggaatcctttccc

SEQ ID NO: 1168521 - DNA, 22 bp, Artificial Sequence
  chemically synthesized
ttaaatagggaatcctttcccc

SEQ ID NO: 1168522 - DNA, 22 bp, Artificial Sequence
  chemically synthesized
aatagggaatcctttccccatt

SEQ ID NO: 1168523 - DNA, 22 bp, Artificial Sequence
  chemically synthesized
agaaaaacaagcaatggggaaa

SEQ ID NO: 1168524 - DNA, 22 bp, Artificial Sequence
  chemically synthesized
acaaacctgagaaaaacaagca

SEQ ID NO: 1168525 - DNA, 22 bp, Artificial Sequence
  chemically synthesized
gacaaacctgagaaaaacaagc

SEQ ID NO: 1168526 - DNA, 22 bp, Artificial Sequence
  chemically synthesized
tgacaaacctgagaaaaacaag

SEQ ID NO: 1168527 - DNA, 22 bp, Artificial Sequence
  chemically synthesized
tccccattgcttgtttttctca

SEQ ID NO: 1168528 - DNA, 22 bp, Artificial Sequence
  chemically synthesized
ccccattgcttgtttttctcag

SEQ ID NO: 1168529 - DNA, 22 bp, Artificial Sequence
  chemically synthesized
cccattgcttgtttttctcagg

SEQ ID NO: 1168530 - DNA, 22 bp, Artificial Sequence
  chemically synthesized
atctttgacaaacctgagaaaa

SEQ ID NO: 1168531 - DNA, 22 bp, Artificial Sequence
  chemically synthesized
tctgatctttgacaaacctgag

SEQ ID NO: 1168532 - DNA, 22 bp, Artificial Sequence
  chemically synthesized
cttgtttttctcaggtttgtca

SEQ ID NO: 1168533 - DNA, 22 bp, Artificial Sequence
  chemically synthesized
ctatctgatctttgacaaacct

SEQ ID NO: 1168534 - DNA, 22 bp, Artificial Sequence
  chemically synthesized
gtttttctcaggtttgtcaaag

SEQ ID NO: 1168535 - DNA, 22 bp, Artificial Sequence
  chemically synthesized
ctactatctgatctttgacaaa

SEQ ID NO: 1168536 - DNA, 22 bp, Artificial Sequence
  chemically synthesized
tttttctcaggtttgtcaaaga

SEQ ID NO: 1168537 - DNA, 22 bp, Artificial Sequence
  chemically synthesized
ttctcaggtttgtcaaagatca

SEQ ID NO: 1168538 - DNA, 22 bp, Artificial Sequence
  chemically synthesized
tctcaggtttgtcaaagatcag

SEQ ID NO: 1168539 - DNA, 22 bp, Artificial Sequence
  chemically synthesized
ctcaggtttgtcaaagatcaga

SEQ ID NO: 1168540 - DNA, 22 bp, Artificial Sequence
  chemically synthesized
tcaggtttgtcaaagatcagat

SEQ ID NO: 1168541 - DNA, 22 bp, Artificial Sequence
  chemically synthesized
aggtttgtcaaagatcagatag

SEQ ID NO: 1168542 - DNA, 22 bp, Artificial Sequence
  chemically synthesized
gtcaaagatcagatagtagtag

SEQ ID NO: 1168543 - DNA, 22 bp, Artificial Sequence
  chemically synthesized
tcaaagatcagatagtagtaga

SEQ ID NO: 1168544 - DNA, 22 bp, Artificial Sequence
  chemically synthesized
agaaataatgccacatatctac

SEQ ID NO: 1168545 - DNA, 22 bp, Artificial Sequence
  chemically synthesized
tttctgagggctttgttctgtt

SEQ ID NO: 1168546 - DNA, 22 bp, Artificial Sequence
  chemically synthesized
ctgagggctttgttctgttcca

SEQ ID NO: 1168547 - DNA, 22 bp, Artificial Sequence
  chemically synthesized
tgagggctttgttctgttccat

SEQ ID NO: 1168548 - DNA, 22 bp, Artificial Sequence
  chemically synthesized
agggctttgttctgttccattg

SEQ ID NO: 1168549 - DNA, 22 bp, Artificial Sequence
  chemically synthesized
tgttctgttccattggtctata

SEQ ID NO: 1168550 - DNA, 22 bp, Artificial Sequence
  chemically synthesized
gttctgttccattggtctatat

SEQ ID NO: 1168551 - DNA, 22 bp, Artificial Sequence
  chemically synthesized
ttctgttccattggtctatatc

SEQ ID NO: 1168552 - DNA, 22 bp, Artificial Sequence
  chemically synthesized
gtatcagaatagagatatagac

SEQ ID NO: 1168553 - DNA, 22 bp, Artificial Sequence
  chemically synthesized
tgttccattggtctatatctct

SEQ ID NO: 1168554 - DNA, 22 bp, Artificial Sequence
  chemically synthesized
ttccattggtctatatctctat

SEQ ID NO: 1168555 - DNA, 22 bp, Artificial Sequence
  chemically synthesized
cattggtctatatctctattct

SEQ ID NO: 1168556 - DNA, 22 bp, Artificial Sequence
  chemically synthesized
gtctatatctctattctgatac

SEQ ID NO: 1168557 - DNA, 22 bp, Artificial Sequence
  chemically synthesized
tatctctattctgataccagta

SEQ ID NO: 1168558 - DNA, 22 bp, Artificial Sequence
  chemically synthesized
tattctgataccagtaccatgc

SEQ ID NO: 1168559 - DNA, 22 bp, Artificial Sequence
  chemically synthesized
ttctgataccagtaccatgctg

SEQ ID NO: 1168560 - DNA, 22 bp, Artificial Sequence
  chemically synthesized
cagtaaccaaaacagcatggta

SEQ ID NO: 1168561 - DNA, 22 bp, Artificial Sequence
  chemically synthesized
tgataccagtaccatgctgttt

SEQ ID NO: 1168562 - DNA, 22 bp, Artificial Sequence
  chemically synthesized
ataccagtaccatgctgttttg

SEQ ID NO: 1168563 - DNA, 22 bp, Artificial Sequence
  chemically synthesized
caaggctacagtaaccaaaaca

SEQ ID NO: 1168564 - DNA, 22 bp, Artificial Sequence
  chemically synthesized
tactacaaggctacagtaacca

SEQ ID NO: 1168565 - DNA, 22 bp, Artificial Sequence
  chemically synthesized
aactatactacaaggctacagt

SEQ ID NO: 1168566 - DNA, 22 bp, Artificial Sequence
  chemically synthesized
aaactatactacaaggctacag

SEQ ID NO: 1168567 - DNA, 22 bp, Artificial Sequence
  chemically synthesized
taaactatactacaaggctaca

SEQ ID NO: 1168568 - DNA, 22 bp, Artificial Sequence
  chemically synthesized
ttttggttactgtagccttgta

SEQ ID NO: 1168569 - DNA, 22 bp, Artificial Sequence
  chemically synthesized
attttaaactatactacaaggc

SEQ ID NO: 1168570 - DNA, 22 bp, Artificial Sequence
  chemically synthesized
tggttactgtagccttgtagta

SEQ ID NO: 1168571 - DNA, 22 bp, Artificial Sequence
  chemically synthesized
ggttactgtagccttgtagtat

SEQ ID NO: 1168572 - DNA, 22 bp, Artificial Sequence
  chemically synthesized
gttactgtagccttgtagtata

SEQ ID NO: 1168573 - DNA, 22 bp, Artificial Sequence
  chemically synthesized
cctgattttaaactatactaca

SEQ ID NO: 1168574 - DNA, 22 bp, Artificial Sequence
  chemically synthesized
ctgtagccttgtagtatagttt

SEQ ID NO: 1168575 - DNA, 22 bp, Artificial Sequence
  chemically synthesized
tagccttgtagtatagtttaaa

SEQ ID NO: 1168576 - DNA, 22 bp, Artificial Sequence
  chemically synthesized
gtagtatagtttaaaatcaggt

SEQ ID NO: 1168577 - DNA, 22 bp, Artificial Sequence
  chemically synthesized
tagtatagtttaaaatcaggta

SEQ ID NO: 1168578 - DNA, 22 bp, Artificial Sequence
  chemically synthesized
gaggtatcacactacctgattt

SEQ ID NO: 1168579 - DNA, 22 bp, Artificial Sequence
  chemically synthesized
aaaatcaggtagtgtgatacct

SEQ ID NO: 1168580 - DNA, 22 bp, Artificial Sequence
  chemically synthesized
aaatcaggtagtgtgatacctc

SEQ ID NO: 1168581 - DNA, 22 bp, Artificial Sequence
  chemically synthesized
agccaaaagaacaaagctggag

SEQ ID NO: 1168582 - DNA, 22 bp, Artificial Sequence
  chemically synthesized
ccaggtcaatcctaagccaaaa

SEQ ID NO: 1168583 - DNA, 22 bp, Artificial Sequence
  chemically synthesized
cagctttgttcttttggcttag

SEQ ID NO: 1168584 - DNA, 22 bp, Artificial Sequence
  chemically synthesized
tgttcttttggcttaggattga

SEQ ID NO: 1168585 - DNA, 22 bp, Artificial Sequence
  chemically synthesized
gttcttttggcttaggattgac

SEQ ID NO: 1168586 - DNA, 22 bp, Artificial Sequence
  chemically synthesized
ttcttttggcttaggattgacc

SEQ ID NO: 1168587 - DNA, 22 bp, Artificial Sequence
  chemically synthesized
ttttggcttaggattgacctgg

SEQ ID NO: 1168588 - DNA, 22 bp, Artificial Sequence
  chemically synthesized
ttggcttaggattgacctggca

SEQ ID NO: 1168589 - DNA, 22 bp, Artificial Sequence
  chemically synthesized
tggcttaggattgacctggcaa

SEQ ID NO: 1168590 - DNA, 22 bp, Artificial Sequence
  chemically synthesized
ggcttaggattgacctggcaat

SEQ ID NO: 1168591 - DNA, 22 bp, Artificial Sequence
  chemically synthesized
gcttaggattgacctggcaatg

SEQ ID NO: 1168592 - DNA, 22 bp, Artificial Sequence
  chemically synthesized
aggattgacctggcaatgtggg

SEQ ID NO: 1168593 - DNA, 22 bp, Artificial Sequence
  chemically synthesized
ggattgacctggcaatgtgggc

SEQ ID NO: 1168594 - DNA, 22 bp, Artificial Sequence
  chemically synthesized
acctggcaatgtgggctctttt

SEQ ID NO: 1168595 - DNA, 22 bp, Artificial Sequence
  chemically synthesized
atatggaaccaaaaaagagccc

SEQ ID NO: 1168596 - DNA, 22 bp, Artificial Sequence
  chemically synthesized
gcaatgtgggctcttttttggt

SEQ ID NO: 1168597 - DNA, 22 bp, Artificial Sequence
  chemically synthesized
aagttcatatggaaccaaaaaa

SEQ ID NO: 1168598 - DNA, 22 bp, Artificial Sequence
  chemically synthesized
aaagttcatatggaaccaaaaa

SEQ ID NO: 1168599 - DNA, 22 bp, Artificial Sequence
  chemically synthesized
taaagttcatatggaaccaaaa

SEQ ID NO: 1168600 - DNA, 22 bp, Artificial Sequence
  chemically synthesized
ctttaaagttcatatggaacca

SEQ ID NO: 1168601 - DNA, 22 bp, Artificial Sequence
  chemically synthesized
ttttttggttccatatgaactt

SEQ ID NO: 1168602 - DNA, 22 bp, Artificial Sequence
  chemically synthesized
ttttggttccatatgaacttta

SEQ ID NO: 1168603 - DNA, 22 bp, Artificial Sequence
  chemically synthesized
tttggttccatatgaactttaa

SEQ ID NO: 1168604 - DNA, 22 bp, Artificial Sequence
  chemically synthesized
gaaaaaactactttaaagttca

SEQ ID NO: 1168605 - DNA, 22 bp, Artificial Sequence
  chemically synthesized
ttggttccatatgaactttaaa

SEQ ID NO: 1168606 - DNA, 22 bp, Artificial Sequence
  chemically synthesized
tggttccatatgaactttaaag

SEQ ID NO: 1168607 - DNA, 22 bp, Artificial Sequence
  chemically synthesized
ggttccatatgaactttaaagt

SEQ ID NO: 1168608 - DNA, 22 bp, Artificial Sequence
  chemically synthesized
gttccatatgaactttaaagta

SEQ ID NO: 1168609 - DNA, 22 bp, Artificial Sequence
  chemically synthesized
catatgaactttaaagtagttt

SEQ ID NO: 1168610 - DNA, 22 bp, Artificial Sequence
  chemically synthesized
cacggaattggaaaaaactact

SEQ ID NO: 1168611 - DNA, 22 bp, Artificial Sequence
  chemically synthesized
tacacggaattggaaaaaacta

SEQ ID NO: 1168612 - DNA, 22 bp, Artificial Sequence
  chemically synthesized
ctacacggaattggaaaaaact

SEQ ID NO: 1168613 - DNA, 22 bp, Artificial Sequence
  chemically synthesized
tctacacggaattggaaaaaac

SEQ ID NO: 1168614 - DNA, 22 bp, Artificial Sequence
  chemically synthesized
taaagtagttttttccaattcc

SEQ ID NO: 1168615 - DNA, 22 bp, Artificial Sequence
  chemically synthesized
aaagtagttttttccaattccg

SEQ ID NO: 1168616 - DNA, 22 bp, Artificial Sequence
  chemically synthesized
aagtagttttttccaattccgt

SEQ ID NO: 1168617 - DNA, 22 bp, Artificial Sequence
  chemically synthesized
ccaatgactttctacacggaat

SEQ ID NO: 1168618 - DNA, 22 bp, Artificial Sequence
  chemically synthesized
tttccaattccgtgtagaaagt

SEQ ID NO: 1168619 - DNA, 22 bp, Artificial Sequence
  chemically synthesized
ttccaattccgtgtagaaagtc

SEQ ID NO: 1168620 - DNA, 22 bp, Artificial Sequence
  chemically synthesized
tccaattccgtgtagaaagtca

SEQ ID NO: 1168621 - DNA, 22 bp, Artificial Sequence
  chemically synthesized
ccaattccgtgtagaaagtcat

SEQ ID NO: 1168622 - DNA, 22 bp, Artificial Sequence
  chemically synthesized
caattccgtgtagaaagtcatt

SEQ ID NO: 1168623 - DNA, 22 bp, Artificial Sequence
  chemically synthesized
cgtgtagaaagtcattggtagc

SEQ ID NO: 1168624 - DNA, 22 bp, Artificial Sequence
  chemically synthesized
aatgccatccccatcaagctac

SEQ ID NO: 1168625 - DNA, 22 bp, Artificial Sequence
  chemically synthesized
tagattcaatgccatccccatc

SEQ ID NO: 1168626 - DNA, 22 bp, Artificial Sequence
  chemically synthesized
atagattcaatgccatccccat

SEQ ID NO: 1168627 - DNA, 22 bp, Artificial Sequence
  chemically synthesized
gtagcttgatggggatggcatt

SEQ ID NO: 1168628 - DNA, 22 bp, Artificial Sequence
  chemically synthesized
gatggggatggcattgaatcta

SEQ ID NO: 1168629 - DNA, 22 bp, Artificial Sequence
  chemically synthesized
atggggatggcattgaatctat

SEQ ID NO: 1168630 - DNA, 22 bp, Artificial Sequence
  chemically synthesized
cccaaggtaatttatagattca

SEQ ID NO: 1168631 - DNA, 22 bp, Artificial Sequence
  chemically synthesized
aatctataaattaccttgggca

SEQ ID NO: 1168632 - DNA, 22 bp, Artificial Sequence
  chemically synthesized
tgaaaatggccatactgcccaa

SEQ ID NO: 1168633 - DNA, 22 bp, Artificial Sequence
  chemically synthesized
taaattaccttgggcagtatgg

SEQ ID NO: 1168634 - DNA, 22 bp, Artificial Sequence
  chemically synthesized
ccttgggcagtatggccatttt

SEQ ID NO: 1168635 - DNA, 22 bp, Artificial Sequence
  chemically synthesized
gggcagtatggccattttcaca

SEQ ID NO: 1168636 - DNA, 22 bp, Artificial Sequence
  chemically synthesized
ggcagtatggccattttcacaa

SEQ ID NO: 1168637 - DNA, 22 bp, Artificial Sequence
  chemically synthesized
atggataggaagaatcaatatt

SEQ ID NO: 1168638 - DNA, 22 bp, Artificial Sequence
  chemically synthesized
tgctcatggataggaagaatca

SEQ ID NO: 1168639 - DNA, 22 bp, Artificial Sequence
  chemically synthesized
tatgctcatggataggaagaat

SEQ ID NO: 1168640 - DNA, 22 bp, Artificial Sequence
  chemically synthesized
tcacaatattgattcttcctat

SEQ ID NO: 1168641 - DNA, 22 bp, Artificial Sequence
  chemically synthesized
cacaatattgattcttcctatc

SEQ ID NO: 1168642 - DNA, 22 bp, Artificial Sequence
  chemically synthesized
acaatattgattcttcctatcc

SEQ ID NO: 1168643 - DNA, 22 bp, Artificial Sequence
  chemically synthesized
attcttcctatccatgagcata

SEQ ID NO: 1168644 - DNA, 22 bp, Artificial Sequence
  chemically synthesized
ttcctatccatgagcatagaat

SEQ ID NO: 1168645 - DNA, 22 bp, Artificial Sequence
  chemically synthesized
cctatccatgagcatagaatgt

SEQ ID NO: 1168646 - DNA, 22 bp, Artificial Sequence
  chemically synthesized
ctatccatgagcatagaatgtt

SEQ ID NO: 1168647 - DNA, 22 bp, Artificial Sequence
  chemically synthesized
tccatgagcatagaatgttctt

SEQ ID NO: 1168648 - DNA, 22 bp, Artificial Sequence
  chemically synthesized
accaaaatacaagaggacacaa

SEQ ID NO: 1168649 - DNA, 22 bp, Artificial Sequence
  chemically synthesized
ttccatttgtttgtgtcctctt

SEQ ID NO: 1168650 - DNA, 22 bp, Artificial Sequence
  chemically synthesized
ctcaccaaaatacaagaggaca

SEQ ID NO: 1168651 - DNA, 22 bp, Artificial Sequence
  chemically synthesized
ccatttgtttgtgtcctcttgt

SEQ ID NO: 1168652 - DNA, 22 bp, Artificial Sequence
  chemically synthesized
catttgtttgtgtcctcttgta

SEQ ID NO: 1168653 - DNA, 22 bp, Artificial Sequence
  chemically synthesized
gtttgtgtcctcttgtattttg

SEQ ID NO: 1168654 - DNA, 22 bp, Artificial Sequence
  chemically synthesized
tttgtgtcctcttgtattttgg

SEQ ID NO: 1168655 - DNA, 22 bp, Artificial Sequence
  chemically synthesized
caaaccactgctcaccaaaata

SEQ ID NO: 1168656 - DNA, 22 bp, Artificial Sequence
  chemically synthesized
gtgtcctcttgtattttggtga

SEQ ID NO: 1168657 - DNA, 22 bp, Artificial Sequence
  chemically synthesized
tgtcctcttgtattttggtgag

SEQ ID NO: 1168658 - DNA, 22 bp, Artificial Sequence
  chemically synthesized
ttgtattttggtgagcagtggt

SEQ ID NO: 1168659 - DNA, 22 bp, Artificial Sequence
  chemically synthesized
gtattttggtgagcagtggttt

SEQ ID NO: 1168660 - DNA, 22 bp, Artificial Sequence
  chemically synthesized
aaggagaactacaaaccactgc

SEQ ID NO: 1168661 - DNA, 22 bp, Artificial Sequence
  chemically synthesized
tattttggtgagcagtggtttg

SEQ ID NO: 1168662 - DNA, 22 bp, Artificial Sequence
  chemically synthesized
caaggagaactacaaaccactg

SEQ ID NO: 1168663 - DNA, 22 bp, Artificial Sequence
  chemically synthesized
ttcaaggagaactacaaaccac

SEQ ID NO: 1168664 - DNA, 22 bp, Artificial Sequence
  chemically synthesized
tggtgagcagtggtttgtagtt

SEQ ID NO: 1168665 - DNA, 22 bp, Artificial Sequence
  chemically synthesized
ggtgagcagtggtttgtagttc

SEQ ID NO: 1168666 - DNA, 22 bp, Artificial Sequence
  chemically synthesized
gtgagcagtggtttgtagttct

SEQ ID NO: 1168667 - DNA, 22 bp, Artificial Sequence
  chemically synthesized
gtagttctccttgaagaggtcc

SEQ ID NO: 1168668 - DNA, 22 bp, Artificial Sequence
  chemically synthesized
tagttctccttgaagaggtcct

SEQ ID NO: 1168669 - DNA, 22 bp, Artificial Sequence
  chemically synthesized
caagggatgtgaaggacctctt

SEQ ID NO: 1168670 - DNA, 22 bp, Artificial Sequence
  chemically synthesized
gcaagggatgtgaaggacctct

SEQ ID NO: 1168671 - DNA, 22 bp, Artificial Sequence
  chemically synthesized
tccttgaagaggtccttcacat

SEQ ID NO: 1168672 - DNA, 22 bp, Artificial Sequence
  chemically synthesized
cttgaagaggtccttcacatcc

SEQ ID NO: 1168673 - DNA, 22 bp, Artificial Sequence
  chemically synthesized
gaagaggtccttcacatccctt

SEQ ID NO: 1168674 - DNA, 22 bp, Artificial Sequence
  chemically synthesized
aagaggtccttcacatcccttg

SEQ ID NO: 1168675 - DNA, 22 bp, Artificial Sequence
  chemically synthesized
ggaatccaacttgcaagggatg

SEQ ID NO: 1168676 - DNA, 22 bp, Artificial Sequence
  chemically synthesized
cacatcccttgcaagttggatt

SEQ ID NO: 1168677 - DNA, 22 bp, Artificial Sequence
  chemically synthesized
acatcccttgcaagttggattc

SEQ ID NO: 1168678 - DNA, 22 bp, Artificial Sequence
  chemically synthesized
aaagagaataaaatacctagga

SEQ ID NO: 1168679 - DNA, 22 bp, Artificial Sequence
  chemically synthesized
gcaagttggattcctaggtatt

SEQ ID NO: 1168680 - DNA, 22 bp, Artificial Sequence
  chemically synthesized
caaagagaataaaatacctagg

SEQ ID NO: 1168681 - DNA, 22 bp, Artificial Sequence
  chemically synthesized
caagttggattcctaggtattt

SEQ ID NO: 1168682 - DNA, 22 bp, Artificial Sequence
  chemically synthesized
cttcaaagagaataaaatacct

SEQ ID NO: 1168683 - DNA, 22 bp, Artificial Sequence
  chemically synthesized
gattcctaggtattttattctc

SEQ ID NO: 1168684 - DNA, 22 bp, Artificial Sequence
  chemically synthesized
acaattgcttcaaagagaataa

SEQ ID NO: 1168685 - DNA, 22 bp, Artificial Sequence
  chemically synthesized
ctaggtattttattctctttga

SEQ ID NO: 1168686 - DNA, 22 bp, Artificial Sequence
  chemically synthesized
cattcacaattgcttcaaagag

SEQ ID NO: 1168687 - DNA, 22 bp, Artificial Sequence
  chemically synthesized
ggtattttattctctttgaagc

SEQ ID NO: 1168688 - DNA, 22 bp, Artificial Sequence
  chemically synthesized
tattctctttgaagcaattgtg

SEQ ID NO: 1168689 - DNA, 22 bp, Artificial Sequence
  chemically synthesized
attctctttgaagcaattgtga

SEQ ID NO: 1168690 - DNA, 22 bp, Artificial Sequence
  chemically synthesized
ttctctttgaagcaattgtgaa

SEQ ID NO: 1168691 - DNA, 22 bp, Artificial Sequence
  chemically synthesized
tctttgaagcaattgtgaatgg

SEQ ID NO: 1168692 - DNA, 22 bp, Artificial Sequence
  chemically synthesized
tttgaagcaattgtgaatggag

SEQ ID NO: 1168693 - DNA, 22 bp, Artificial Sequence
  chemically synthesized
tgaagcaattgtgaatggagtt

SEQ ID NO: 1168694 - DNA, 22 bp, Artificial Sequence
  chemically synthesized
gaagcaattgtgaatggagttc

SEQ ID NO: 1168695 - DNA, 22 bp, Artificial Sequence
  chemically synthesized
aagcaattgtgaatggagttca

SEQ ID NO: 1168696 - DNA, 22 bp, Artificial Sequence
  chemically synthesized
tgaatggagttcactcatgatt

SEQ ID NO: 1168697 - DNA, 22 bp, Artificial Sequence
  chemically synthesized
tacaccaataacagacagaggc

SEQ ID NO: 1168698 - DNA, 22 bp, Artificial Sequence
  chemically synthesized
actcatgatttgcctctgtctg

SEQ ID NO: 1168699 - DNA, 22 bp, Artificial Sequence
  chemically synthesized
atacaccaataacagacagagg

SEQ ID NO: 1168700 - DNA, 22 bp, Artificial Sequence
  chemically synthesized
ttatacaccaataacagacaga

SEQ ID NO: 1168701 - DNA, 22 bp, Artificial Sequence
  chemically synthesized
atgatttgcctctgtctgttat

SEQ ID NO: 1168702 - DNA, 22 bp, Artificial Sequence
  chemically synthesized
gcctctgtctgttattggtgta

SEQ ID NO: 1168703 - DNA, 22 bp, Artificial Sequence
  chemically synthesized
cctctgtctgttattggtgtat

SEQ ID NO: 1168704 - DNA, 22 bp, Artificial Sequence
  chemically synthesized
tgtctgttattggtgtataaga

SEQ ID NO: 1168705 - DNA, 22 bp, Artificial Sequence
  chemically synthesized
tctgttattggtgtataagaat

SEQ ID NO: 1168706 - DNA, 22 bp, Artificial Sequence
  chemically synthesized
ttattggtgtataagaatgctt

SEQ ID NO: 1168707 - DNA, 22 bp, Artificial Sequence
  chemically synthesized
ttggtgtataagaatgcttgtg

SEQ ID NO: 1168708 - DNA, 22 bp, Artificial Sequence
  chemically synthesized
gtgtataagaatgcttgtgatt

SEQ ID NO: 1168709 - DNA, 22 bp, Artificial Sequence
  chemically synthesized
aggatacaaatcaatgtgcaaa

SEQ ID NO: 1168710 - DNA, 22 bp, Artificial Sequence
  chemically synthesized
gtgatttttgcacattgatttg

SEQ ID NO: 1168711 - DNA, 22 bp, Artificial Sequence
  chemically synthesized
tgatttttgcacattgatttgt

SEQ ID NO: 1168712 - DNA, 22 bp, Artificial Sequence
  chemically synthesized
agcaaagtctcaggatacaaat

SEQ ID NO: 1168713 - DNA, 22 bp, Artificial Sequence
  chemically synthesized
cagcaaagtctcaggatacaaa

SEQ ID NO: 1168714 - DNA, 22 bp, Artificial Sequence
  chemically synthesized
ttgcacattgatttgtatcctg

SEQ ID NO: 1168715 - DNA, 22 bp, Artificial Sequence
  chemically synthesized
tgcacattgatttgtatcctga

SEQ ID NO: 1168716 - DNA, 22 bp, Artificial Sequence
  chemically synthesized
gcacattgatttgtatcctgag

SEQ ID NO: 1168717 - DNA, 22 bp, Artificial Sequence
  chemically synthesized
cacattgatttgtatcctgaga

SEQ ID NO: 1168718 - DNA, 22 bp, Artificial Sequence
  chemically synthesized
atttgtatcctgagactttgct

SEQ ID NO: 1168719 - DNA, 22 bp, Artificial Sequence
  chemically synthesized
ataagcaacttcagcaaagtct

SEQ ID NO: 1168720 - DNA, 22 bp, Artificial Sequence
  chemically synthesized
gtatcctgagactttgctgaag

SEQ ID NO: 1168721 - DNA, 22 bp, Artificial Sequence
  chemically synthesized
tatcctgagactttgctgaagt

SEQ ID NO: 1168722 - DNA, 22 bp, Artificial Sequence
  chemically synthesized
agctgataagcaacttcagcaa

SEQ ID NO: 1168723 - DNA, 22 bp, Artificial Sequence
  chemically synthesized
aagctgataagcaacttcagca

SEQ ID NO: 1168724 - DNA, 22 bp, Artificial Sequence
  chemically synthesized
cttaagctgataagcaacttca

SEQ ID NO: 1168725 - DNA, 22 bp, Artificial Sequence
  chemically synthesized
agactttgctgaagttgcttat

SEQ ID NO: 1168726 - DNA, 22 bp, Artificial Sequence
  chemically synthesized
tgctgaagttgcttatcagctt

SEQ ID NO: 1168727 - DNA, 22 bp, Artificial Sequence
  chemically synthesized
gctgaagttgcttatcagctta

SEQ ID NO: 1168728 - DNA, 22 bp, Artificial Sequence
  chemically synthesized
ctgaagttgcttatcagcttaa

SEQ ID NO: 1168729 - DNA, 22 bp, Artificial Sequence
  chemically synthesized
agcccaaaatctacttaagctg

SEQ ID NO: 1168730 - DNA, 22 bp, Artificial Sequence
  chemically synthesized
aagttgcttatcagcttaagta

SEQ ID NO: 1168731 - DNA, 22 bp, Artificial Sequence
  chemically synthesized
tctcagcccaaaatctacttaa

SEQ ID NO: 1168732 - DNA, 22 bp, Artificial Sequence
  chemically synthesized
cttatcagcttaagtagatttt

SEQ ID NO: 1168733 - DNA, 22 bp, Artificial Sequence
  chemically synthesized
atcagcttaagtagattttggg

SEQ ID NO: 1168734 - DNA, 22 bp, Artificial Sequence
  chemically synthesized
tcagcttaagtagattttgggc

SEQ ID NO: 1168735 - DNA, 22 bp, Artificial Sequence
  chemically synthesized
gaaaaccccattgtctcagccc

SEQ ID NO: 1168736 - DNA, 22 bp, Artificial Sequence
  chemically synthesized
aagtagattttgggctgagaca

SEQ ID NO: 1168737 - DNA, 22 bp, Artificial Sequence
  chemically synthesized
agtagattttgggctgagacaa

SEQ ID NO: 1168738 - DNA, 22 bp, Artificial Sequence
  chemically synthesized
tatatctagaaaaccccattgt

SEQ ID NO: 1168739 - DNA, 22 bp, Artificial Sequence
  chemically synthesized
tgggctgagacaatggggtttt

SEQ ID NO: 1168740 - DNA, 22 bp, Artificial Sequence
  chemically synthesized
gggctgagacaatggggttttc

SEQ ID NO: 1168741 - DNA, 22 bp, Artificial Sequence
  chemically synthesized
ggctgagacaatggggttttct

SEQ ID NO: 1168742 - DNA, 22 bp, Artificial Sequence
  chemically synthesized
agacaatggggttttctagata

SEQ ID NO: 1168743 - DNA, 22 bp, Artificial Sequence
  chemically synthesized
cagatgacatgattgtatatct

SEQ ID NO: 1168744 - DNA, 22 bp, Artificial Sequence
  chemically synthesized
gcagatgacatgattgtatatc

SEQ ID NO: 1168745 - DNA, 22 bp, Artificial Sequence
  chemically synthesized
tttgcagatgacatgattgtat

SEQ ID NO: 1168746 - DNA, 22 bp, Artificial Sequence
  chemically synthesized
tctagatatacaatcatgtcat

SEQ ID NO: 1168747 - DNA, 22 bp, Artificial Sequence
  chemically synthesized
ctagatatacaatcatgtcatc

SEQ ID NO: 1168748 - DNA, 22 bp, Artificial Sequence
  chemically synthesized
tccctgtttgcagatgacatga

SEQ ID NO: 1168749 - DNA, 22 bp, Artificial Sequence
  chemically synthesized
tagatatacaatcatgtcatct

SEQ ID NO: 1168750 - DNA, 22 bp, Artificial Sequence
  chemically synthesized
gatatacaatcatgtcatctgc

SEQ ID NO: 1168751 - DNA, 22 bp, Artificial Sequence
  chemically synthesized
ggaaaagaggaagtcaaattgt

SEQ ID NO: 1168752 - DNA, 22 bp, Artificial Sequence
  chemically synthesized
caaacagggacaatttgacttc

SEQ ID NO: 1168753 - DNA, 22 bp, Artificial Sequence
  chemically synthesized
aattaggaaaagaggaagtcaa

SEQ ID NO: 1168754 - DNA, 22 bp, Artificial Sequence
  chemically synthesized
gacttcctcttttcctaattga

SEQ ID NO: 1168755 - DNA, 22 bp, Artificial Sequence
  chemically synthesized
acttcctcttttcctaattgaa

SEQ ID NO: 1168756 - DNA, 22 bp, Artificial Sequence
  chemically synthesized
cctcttttcctaattgaatacc

SEQ ID NO: 1168757 - DNA, 22 bp, Artificial Sequence
  chemically synthesized
ctcttttcctaattgaataccc

SEQ ID NO: 1168758 - DNA, 22 bp, Artificial Sequence
  chemically synthesized
ttttcctaattgaatacccttt

SEQ ID NO: 1168759 - DNA, 22 bp, Artificial Sequence
  chemically synthesized
ttcctaattgaataccctttat

SEQ ID NO: 1168760 - DNA, 22 bp, Artificial Sequence
  chemically synthesized
tcctaattgaataccctttatt

SEQ ID NO: 1168761 - DNA, 22 bp, Artificial Sequence
  chemically synthesized
cctaattgaataccctttattt

SEQ ID NO: 1168762 - DNA, 22 bp, Artificial Sequence
  chemically synthesized
ctaattgaataccctttatttc

SEQ ID NO: 1168763 - DNA, 22 bp, Artificial Sequence
  chemically synthesized
attgaataccctttatttcctt

SEQ ID NO: 1168764 - DNA, 22 bp, Artificial Sequence
  chemically synthesized
aataccctttatttccttcttc

SEQ ID NO: 1168765 - DNA, 22 bp, Artificial Sequence
  chemically synthesized
cggccagggcaatcaggcagaa

SEQ ID NO: 1168766 - DNA, 22 bp, Artificial Sequence
  chemically synthesized
tatttccttcttctgcctgatt

SEQ ID NO: 1168767 - DNA, 22 bp, Artificial Sequence
  chemically synthesized
atttccttcttctgcctgattg

SEQ ID NO: 1168768 - DNA, 22 bp, Artificial Sequence
  chemically synthesized
tttccttcttctgcctgattgc

SEQ ID NO: 1168769 - DNA, 22 bp, Artificial Sequence
  chemically synthesized
ccttcttctgcctgattgccct

SEQ ID NO: 1168770 - DNA, 22 bp, Artificial Sequence
  chemically synthesized
gaagttccggccagggcaatca

SEQ ID NO: 1168771 - DNA, 22 bp, Artificial Sequence
  chemically synthesized
cttcttctgcctgattgccctg

SEQ ID NO: 1168772 - DNA, 22 bp, Artificial Sequence
  chemically synthesized
cttctgcctgattgccctggcc

SEQ ID NO: 1168773 - DNA, 22 bp, Artificial Sequence
  chemically synthesized
ttctgcctgattgccctggccg

SEQ ID NO: 1168774 - DNA, 22 bp, Artificial Sequence
  chemically synthesized
ctgcctgattgccctggccgga

SEQ ID NO: 1168775 - DNA, 22 bp, Artificial Sequence
  chemically synthesized
tgcctgattgccctggccggaa

SEQ ID NO: 1168776 - DNA, 22 bp, Artificial Sequence
  chemically synthesized
cctgattgccctggccggaact

SEQ ID NO: 1168777 - DNA, 22 bp, Artificial Sequence
  chemically synthesized
aacatagtgttggaagttccgg

SEQ ID NO: 1168778 - DNA, 22 bp, Artificial Sequence
  chemically synthesized
attgccctggccggaacttcca

SEQ ID NO: 1168779 - DNA, 22 bp, Artificial Sequence
  chemically synthesized
ttcaacatagtgttggaagttc

SEQ ID NO: 1168780 - DNA, 22 bp, Artificial Sequence
  chemically synthesized
ccctggccggaacttccaacac

SEQ ID NO: 1168781 - DNA, 22 bp, Artificial Sequence
  chemically synthesized
ctattcaacatagtgttggaag

SEQ ID NO: 1168782 - DNA, 22 bp, Artificial Sequence
  chemically synthesized
gccggaacttccaacactatgt

SEQ ID NO: 1168783 - DNA, 22 bp, Artificial Sequence
  chemically synthesized
accactcctattcaacatagtg

SEQ ID NO: 1168784 - DNA, 22 bp, Artificial Sequence
  chemically synthesized
tcaccactcctattcaacatag

SEQ ID NO: 1168785 - DNA, 22 bp, Artificial Sequence
  chemically synthesized
tctcaccactcctattcaacat

SEQ ID NO: 1168786 - DNA, 22 bp, Artificial Sequence
  chemically synthesized
ccaacactatgttgaataggag

SEQ ID NO: 1168787 - DNA, 22 bp, Artificial Sequence
  chemically synthesized
caacactatgttgaataggagt

SEQ ID NO: 1168788 - DNA, 22 bp, Artificial Sequence
  chemically synthesized
tgttgaataggagtggtgagag

SEQ ID NO: 1168789 - DNA, 22 bp, Artificial Sequence
  chemically synthesized
aataggagtggtgagagagggc

SEQ ID NO: 1168790 - DNA, 22 bp, Artificial Sequence
  chemically synthesized
gcacaagacagggatgccctct

SEQ ID NO: 1168791 - DNA, 22 bp, Artificial Sequence
  chemically synthesized
aaaactggcacaagacagggat

SEQ ID NO: 1168792 - DNA, 22 bp, Artificial Sequence
  chemically synthesized
gaaaactggcacaagacaggga

SEQ ID NO: 1168793 - DNA, 22 bp, Artificial Sequence
  chemically synthesized
tgaaaactggcacaagacaggg

SEQ ID NO: 1168794 - DNA, 22 bp, Artificial Sequence
  chemically synthesized
cctttgaaaactggcacaagac

SEQ ID NO: 1168795 - DNA, 22 bp, Artificial Sequence
  chemically synthesized
gaagcattccctttgaaaactg

SEQ ID NO: 1168796 - DNA, 22 bp, Artificial Sequence
  chemically synthesized
tcttgtgccagttttcaaaggg

SEQ ID NO: 1168797 - DNA, 22 bp, Artificial Sequence
  chemically synthesized
gtgccagttttcaaagggaatg

SEQ ID NO: 1168798 - DNA, 22 bp, Artificial Sequence
  chemically synthesized
tgccagttttcaaagggaatgc

SEQ ID NO: 1168799 - DNA, 22 bp, Artificial Sequence
  chemically synthesized
aatgggcaaaaactggaagcat

SEQ ID NO: 1168800 - DNA, 22 bp, Artificial Sequence
  chemically synthesized
tcaaagggaatgcttccagttt

SEQ ID NO: 1168801 - DNA, 22 bp, Artificial Sequence
  chemically synthesized
caaagggaatgcttccagtttt

SEQ ID NO: 1168802 - DNA, 22 bp, Artificial Sequence
  chemically synthesized
aaagggaatgcttccagttttt

SEQ ID NO: 1168803 - DNA, 22 bp, Artificial Sequence
  chemically synthesized
tcatattgaatgggcaaaaact

SEQ ID NO: 1168804 - DNA, 22 bp, Artificial Sequence
  chemically synthesized
ccagtttttgcccattcaatat

SEQ ID NO: 1168805 - DNA, 22 bp, Artificial Sequence
  chemically synthesized
cagtttttgcccattcaatatg

SEQ ID NO: 1168806 - DNA, 22 bp, Artificial Sequence
  chemically synthesized
ttgcccattcaatatgatagtg

SEQ ID NO: 1168807 - DNA, 22 bp, Artificial Sequence
  chemically synthesized
tgcccattcaatatgatagtgg

SEQ ID NO: 1168808 - DNA, 22 bp, Artificial Sequence
  chemically synthesized
gcccattcaatatgatagtggc

SEQ ID NO: 1168809 - DNA, 22 bp, Artificial Sequence
  chemically synthesized
cccattcaatatgatagtggct

SEQ ID NO: 1168810 - DNA, 22 bp, Artificial Sequence
  chemically synthesized
tgtatgacaaacccacagccac

SEQ ID NO: 1168811 - DNA, 22 bp, Artificial Sequence
  chemically synthesized
aatatgatagtggctgtgggtt

SEQ ID NO: 1168812 - DNA, 22 bp, Artificial Sequence
  chemically synthesized
aaataataagagctatgtatga

SEQ ID NO: 1168813 - DNA, 22 bp, Artificial Sequence
  chemically synthesized
aaaataataagagctatgtatg

SEQ ID NO: 1168814 - DNA, 22 bp, Artificial Sequence
  chemically synthesized
tgggtttgtcatacatagctct

SEQ ID NO: 1168815 - DNA, 22 bp, Artificial Sequence
  chemically synthesized
gtcatacatagctcttattatt

SEQ ID NO: 1168816 - DNA, 22 bp, Artificial Sequence
  chemically synthesized
tcatacatagctcttattattt

SEQ ID NO: 1168817 - DNA, 22 bp, Artificial Sequence
  chemically synthesized
atgggacgtatcttaaaataat

SEQ ID NO: 1168818 - DNA, 22 bp, Artificial Sequence
  chemically synthesized
ggtattgatgggacgtatctta

SEQ ID NO: 1168819 - DNA, 22 bp, Artificial Sequence
  chemically synthesized
ttattattttaagatacgtccc

SEQ ID NO: 1168820 - DNA, 22 bp, Artificial Sequence
  chemically synthesized
attattttaagatacgtcccat

SEQ ID NO: 1168821 - DNA, 22 bp, Artificial Sequence
  chemically synthesized
ttattttaagatacgtcccatc

SEQ ID NO: 1168822 - DNA, 22 bp, Artificial Sequence
  chemically synthesized
ttttaagatacgtcccatcaat

SEQ ID NO: 1168823 - DNA, 22 bp, Artificial Sequence
  chemically synthesized
aataaattaggtattgatggga

SEQ ID NO: 1168824 - DNA, 22 bp, Artificial Sequence
  chemically synthesized
tcaataaattaggtattgatgg

SEQ ID NO: 1168825 - DNA, 22 bp, Artificial Sequence
  chemically synthesized
taagatacgtcccatcaatacc

SEQ ID NO: 1168826 - DNA, 22 bp, Artificial Sequence
  chemically synthesized
aagatacgtcccatcaatacct

SEQ ID NO: 1168827 - DNA, 22 bp, Artificial Sequence
  chemically synthesized
agatacgtcccatcaataccta

SEQ ID NO: 1168828 - DNA, 22 bp, Artificial Sequence
  chemically synthesized
aaaactctcaataaattaggta

SEQ ID NO: 1168829 - DNA, 22 bp, Artificial Sequence
  chemically synthesized
atgctaaaaactctcaataaat

SEQ ID NO: 1168830 - DNA, 22 bp, Artificial Sequence
  chemically synthesized
catgctaaaaactctcaataaa

SEQ ID NO: 1168831 - DNA, 22 bp, Artificial Sequence
  chemically synthesized
aacaaccttcatgctaaaaact

SEQ ID NO: 1168832 - DNA, 22 bp, Artificial Sequence
  chemically synthesized
atttattgagagtttttagcat

SEQ ID NO: 1168833 - DNA, 22 bp, Artificial Sequence
  chemically synthesized
attgagagtttttagcatgaag

SEQ ID NO: 1168834 - DNA, 22 bp, Artificial Sequence
  chemically synthesized
ttgagagtttttagcatgaagg

SEQ ID NO: 1168835 - DNA, 22 bp, Artificial Sequence
  chemically synthesized
acaaaattcaacaaccttcatg

SEQ ID NO: 1168836 - DNA, 22 bp, Artificial Sequence
  chemically synthesized
agagtttttagcatgaaggttg

SEQ ID NO: 1168837 - DNA, 22 bp, Artificial Sequence
  chemically synthesized
gacaaaattcaacaaccttcat

SEQ ID NO: 1168838 - DNA, 22 bp, Artificial Sequence
  chemically synthesized
tgacaaaattcaacaaccttca

SEQ ID NO: 1168839 - DNA, 22 bp, Artificial Sequence
  chemically synthesized
ttagcatgaaggttgttgaatt

SEQ ID NO: 1168840 - DNA, 22 bp, Artificial Sequence
  chemically synthesized
tagcatgaaggttgttgaattt

SEQ ID NO: 1168841 - DNA, 22 bp, Artificial Sequence
  chemically synthesized
agcatgaaggttgttgaatttt

SEQ ID NO: 1168842 - DNA, 22 bp, Artificial Sequence
  chemically synthesized
gcatgaaggttgttgaattttg

SEQ ID NO: 1168843 - DNA, 22 bp, Artificial Sequence
  chemically synthesized
ttgaattttgtcaaaggccttt

SEQ ID NO: 1168844 - DNA, 22 bp, Artificial Sequence
  chemically synthesized
catagatgcagaaaaggccttt

SEQ ID NO: 1168845 - DNA, 22 bp, Artificial Sequence
  chemically synthesized
aattttgtcaaaggccttttct

SEQ ID NO: 1168846 - DNA, 22 bp, Artificial Sequence
  chemically synthesized
tctccatagatgcagaaaaggc

SEQ ID NO: 1168847 - DNA, 22 bp, Artificial Sequence
  chemically synthesized
tgtcaaaggccttttctgcatc

SEQ ID NO: 1168848 - DNA, 22 bp, Artificial Sequence
  chemically synthesized
gtcaaaggccttttctgcatct

SEQ ID NO: 1168849 - DNA, 22 bp, Artificial Sequence
  chemically synthesized
tcaaaggccttttctgcatcta

SEQ ID NO: 1168850 - DNA, 22 bp, Artificial Sequence
  chemically synthesized
ttctgcatctatggagataatc

SEQ ID NO: 1168851 - DNA, 22 bp, Artificial Sequence
  chemically synthesized
tctgcatctatggagataatca

SEQ ID NO: 1168852 - DNA, 22 bp, Artificial Sequence
  chemically synthesized
ctgcatctatggagataatcat

SEQ ID NO: 1168853 - DNA, 22 bp, Artificial Sequence
  chemically synthesized
tgcatctatggagataatcatg

SEQ ID NO: 1168854 - DNA, 22 bp, Artificial Sequence
  chemically synthesized
catctatggagataatcatgtg

SEQ ID NO: 1168855 - DNA, 22 bp, Artificial Sequence
  chemically synthesized
tggagataatcatgtggtttct

SEQ ID NO: 1168856 - DNA, 22 bp, Artificial Sequence
  chemically synthesized
ctatctttggttctgtttatat

SEQ ID NO: 1168857 - DNA, 22 bp, Artificial Sequence
  chemically synthesized
tatctttggttctgtttatatg

SEQ ID NO: 1168858 - DNA, 22 bp, Artificial Sequence
  chemically synthesized
tctttggttctgtttatatgct

SEQ ID NO: 1168859 - DNA, 22 bp, Artificial Sequence
  chemically synthesized
tggttctgtttatatgctgcat

SEQ ID NO: 1168860 - DNA, 22 bp, Artificial Sequence
  chemically synthesized
ggttctgtttatatgctgcatt

SEQ ID NO: 1168861 - DNA, 22 bp, Artificial Sequence
  chemically synthesized
gttctgtttatatgctgcatta

SEQ ID NO: 1168862 - DNA, 22 bp, Artificial Sequence
  chemically synthesized
tgtttatatgctgcattatatt

SEQ ID NO: 1168863 - DNA, 22 bp, Artificial Sequence
  chemically synthesized
tttatatgctgcattatattta

SEQ ID NO: 1168864 - DNA, 22 bp, Artificial Sequence
  chemically synthesized
atatgctgcattatatttattg

SEQ ID NO: 1168865 - DNA, 22 bp, Artificial Sequence
  chemically synthesized
tatgctgcattatatttattga

SEQ ID NO: 1168866 - DNA, 22 bp, Artificial Sequence
  chemically synthesized
aacacacacaaatcaataaata

SEQ ID NO: 1168867 - DNA, 22 bp, Artificial Sequence
  chemically synthesized
gttcaacacacacaaatcaata

SEQ ID NO: 1168868 - DNA, 22 bp, Artificial Sequence
  chemically synthesized
cattatatttattgatttgtgt

SEQ ID NO: 1168869 - DNA, 22 bp, Artificial Sequence
  chemically synthesized
tatttattgatttgtgtgtgtt

SEQ ID NO: 1168870 - DNA, 22 bp, Artificial Sequence
  chemically synthesized
attgatttgtgtgtgttgaacc

SEQ ID NO: 1168871 - DNA, 22 bp, Artificial Sequence
  chemically synthesized
ggatgcagggctggttcaacac

SEQ ID NO: 1168872 - DNA, 22 bp, Artificial Sequence
  chemically synthesized
ttgatttgtgtgtgttgaacca

SEQ ID NO: 1168873 - DNA, 22 bp, Artificial Sequence
  chemically synthesized
atttgtgtgtgttgaaccagcc

SEQ ID NO: 1168874 - DNA, 22 bp, Artificial Sequence
  chemically synthesized
atccctgggatgcagggctggt

SEQ ID NO: 1168875 - DNA, 22 bp, Artificial Sequence
  chemically synthesized
gtgtgtgttgaaccagccctgc

SEQ ID NO: 1168876 - DNA, 22 bp, Artificial Sequence
  chemically synthesized
catccctgggatgcagggctgg

SEQ ID NO: 1168877 - DNA, 22 bp, Artificial Sequence
  chemically synthesized
tgtgtgttgaaccagccctgca

SEQ ID NO: 1168878 - DNA, 22 bp, Artificial Sequence
  chemically synthesized
aaccagccctgcatcccaggga

SEQ ID NO: 1168879 - DNA, 22 bp, Artificial Sequence
  chemically synthesized
tcaagtgggcttcatccctggg

SEQ ID NO: 1168880 - DNA, 22 bp, Artificial Sequence
  chemically synthesized
catcccagggatgaagcccact

SEQ ID NO: 1168881 - DNA, 22 bp, Artificial Sequence
  chemically synthesized
tccaccattatcaagtgggctt

SEQ ID NO: 1168882 - DNA, 22 bp, Artificial Sequence
  chemically synthesized
atccaccattatcaagtgggct

SEQ ID NO: 1168883 - DNA, 22 bp, Artificial Sequence
  chemically synthesized
gataatggtggataagcttttt

SEQ ID NO: 1168884 - DNA, 22 bp, Artificial Sequence
  chemically synthesized
ataatggtggataagctttttg

SEQ ID NO: 1168885 - DNA, 22 bp, Artificial Sequence
  chemically synthesized
gcaatccgaatccagcagcaca

SEQ ID NO: 1168886 - DNA, 22 bp, Artificial Sequence
  chemically synthesized
tttgatgtgctgctggattcgg

SEQ ID NO: 1168887 - DNA, 22 bp, Artificial Sequence
  chemically synthesized
ttgatgtgctgctggattcgga

SEQ ID NO: 1168888 - DNA, 22 bp, Artificial Sequence
  chemically synthesized
tgatgtgctgctggattcggat

SEQ ID NO: 1168889 - DNA, 22 bp, Artificial Sequence
  chemically synthesized
gatgtgctgctggattcggatt

SEQ ID NO: 1168890 - DNA, 22 bp, Artificial Sequence
  chemically synthesized
atgtgctgctggattcggattg

SEQ ID NO: 1168891 - DNA, 22 bp, Artificial Sequence
  chemically synthesized
aataaaatactggcaatccgaa

SEQ ID NO: 1168892 - DNA, 22 bp, Artificial Sequence
  chemically synthesized
ctggattcggattgccagtatt

SEQ ID NO: 1168893 - DNA, 22 bp, Artificial Sequence
  chemically synthesized
gattcggattgccagtatttta

SEQ ID NO: 1168894 - DNA, 22 bp, Artificial Sequence
  chemically synthesized
atgcaaaaatcctcaataaaat

SEQ ID NO: 1168895 - DNA, 22 bp, Artificial Sequence
  chemically synthesized
ggattgccagtattttattgag

SEQ ID NO: 1168896 - DNA, 22 bp, Artificial Sequence
  chemically synthesized
ccagtattttattgaggatttt

SEQ ID NO: 1168897 - DNA, 22 bp, Artificial Sequence
  chemically synthesized
atgaacattgatgcaaaaatcc

SEQ ID NO: 1168898 - DNA, 22 bp, Artificial Sequence
  chemically synthesized
gatgaacattgatgcaaaaatc

SEQ ID NO: 1168899 - DNA, 22 bp, Artificial Sequence
  chemically synthesized
tattgaggatttttgcatcaat

SEQ ID NO: 1168900 - DNA, 22 bp, Artificial Sequence
  chemically synthesized
attgaggatttttgcatcaatg

SEQ ID NO: 1168901 - DNA, 22 bp, Artificial Sequence
  chemically synthesized
ttgaggatttttgcatcaatgt

SEQ ID NO: 1168902 - DNA, 22 bp, Artificial Sequence
  chemically synthesized
aggatttttgcatcaatgttca

SEQ ID NO: 1168903 - DNA, 22 bp, Artificial Sequence
  chemically synthesized
gaccaatatccttgatgaacat

SEQ ID NO: 1168904 - DNA, 22 bp, Artificial Sequence
  chemically synthesized
agaccaatatccttgatgaaca

SEQ ID NO: 1168905 - DNA, 22 bp, Artificial Sequence
  chemically synthesized
tagaccaatatccttgatgaac

SEQ ID NO: 1168906 - DNA, 22 bp, Artificial Sequence
  chemically synthesized
ttgcatcaatgttcatcaagga

SEQ ID NO: 1168907 - DNA, 22 bp, Artificial Sequence
  chemically synthesized
tgcatcaatgttcatcaaggat

SEQ ID NO: 1168908 - DNA, 22 bp, Artificial Sequence
  chemically synthesized
gcatcaatgttcatcaaggata

SEQ ID NO: 1168909 - DNA, 22 bp, Artificial Sequence
  chemically synthesized
catcaatgttcatcaaggatat

SEQ ID NO: 1168910 - DNA, 22 bp, Artificial Sequence
  chemically synthesized
atcaaggatattggtctaaaat

SEQ ID NO: 1168911 - DNA, 22 bp, Artificial Sequence
  chemically synthesized
gtctaaaattctcttttttttg

SEQ ID NO: 1168912 - DNA, 22 bp, Artificial Sequence
  chemically synthesized
gcagagacaaaacaaaaaaaag

SEQ ID NO: 1168913 - DNA, 22 bp, Artificial Sequence
  chemically synthesized
aaattctcttttttttgttttg

SEQ ID NO: 1168914 - DNA, 22 bp, Artificial Sequence
  chemically synthesized
tcttttttttgttttgtctctg

SEQ ID NO: 1168915 - DNA, 22 bp, Artificial Sequence
  chemically synthesized
ttttttttgttttgtctctgcc

SEQ ID NO: 1168916 - DNA, 22 bp, Artificial Sequence
  chemically synthesized
ataccaaagcctggcagagaca

SEQ ID NO: 1168917 - DNA, 22 bp, Artificial Sequence
  chemically synthesized
ttttttgttttgtctctgccag

SEQ ID NO: 1168918 - DNA, 22 bp, Artificial Sequence
  chemically synthesized
tttttgttttgtctctgccagg

SEQ ID NO: 1168919 - DNA, 22 bp, Artificial Sequence
  chemically synthesized
ttttgttttgtctctgccaggc

SEQ ID NO: 1168920 - DNA, 22 bp, Artificial Sequence
  chemically synthesized
tttgttttgtctctgccaggct

SEQ ID NO: 1168921 - DNA, 22 bp, Artificial Sequence
  chemically synthesized
ttgttttgtctctgccaggctt

SEQ ID NO: 1168922 - DNA, 22 bp, Artificial Sequence
  chemically synthesized
tgttttgtctctgccaggcttt

SEQ ID NO: 1168923 - DNA, 22 bp, Artificial Sequence
  chemically synthesized
gttttgtctctgccaggctttg

SEQ ID NO: 1168924 - DNA, 22 bp, Artificial Sequence
  chemically synthesized
ttttgtctctgccaggctttgg

SEQ ID NO: 1168925 - DNA, 22 bp, Artificial Sequence
  chemically synthesized
tgtctctgccaggctttggtat

SEQ ID NO: 1168926 - DNA, 22 bp, Artificial Sequence
  chemically synthesized
gtctctgccaggctttggtatc

SEQ ID NO: 1168927 - DNA, 22 bp, Artificial Sequence
  chemically synthesized
tctctgccaggctttggtatca

SEQ ID NO: 1168928 - DNA, 22 bp, Artificial Sequence
  chemically synthesized
tgccaggctttggtatcaggat

SEQ ID NO: 1168929 - DNA, 22 bp, Artificial Sequence
  chemically synthesized
tgaggcaagcatcatcctgata

SEQ ID NO: 1168930 - DNA, 22 bp, Artificial Sequence
  chemically synthesized
ccaggctttggtatcaggatga

SEQ ID NO: 1168931 - DNA, 22 bp, Artificial Sequence
  chemically synthesized
atgaggcaagcatcatcctgat

SEQ ID NO: 1168932 - DNA, 22 bp, Artificial Sequence
  chemically synthesized
tatgaggcaagcatcatcctga

SEQ ID NO: 1168933 - DNA, 22 bp, Artificial Sequence
  chemically synthesized
attttatgaggcaagcatcatc

SEQ ID NO: 1168934 - DNA, 22 bp, Artificial Sequence
  chemically synthesized
tggtatcaggatgatgcttgcc

SEQ ID NO: 1168935 - DNA, 22 bp, Artificial Sequence
  chemically synthesized
ggtatcaggatgatgcttgcct

SEQ ID NO: 1168936 - DNA, 22 bp, Artificial Sequence
  chemically synthesized
actcattttatgaggcaagcat

SEQ ID NO: 1168937 - DNA, 22 bp, Artificial Sequence
  chemically synthesized
gtatcaggatgatgcttgcctc

SEQ ID NO: 1168938 - DNA, 22 bp, Artificial Sequence
  chemically synthesized
cctaactcattttatgaggcaa

SEQ ID NO: 1168939 - DNA, 22 bp, Artificial Sequence
  chemically synthesized
gcctcataaaatgagttaggga

SEQ ID NO: 1168940 - DNA, 22 bp, Artificial Sequence
  chemically synthesized
cctcataaaatgagttagggag

SEQ ID NO: 1168941 - DNA, 22 bp, Artificial Sequence
  chemically synthesized
ataaaatgagttagggaggatt

SEQ ID NO: 1168942 - DNA, 22 bp, Artificial Sequence
  chemically synthesized
caatgaatagaaaaagagggaa

SEQ ID NO: 1168943 - DNA, 22 bp, Artificial Sequence
  chemically synthesized
ttccaatgaatagaaaaagagg

SEQ ID NO: 1168944 - DNA, 22 bp, Artificial Sequence
  chemically synthesized
gggaggattccctctttttcta

SEQ ID NO: 1168945 - DNA, 22 bp, Artificial Sequence
  chemically synthesized
aaactattccaatgaatagaaa

SEQ ID NO: 1168946 - DNA, 22 bp, Artificial Sequence
  chemically synthesized
tgaaactattccaatgaataga

SEQ ID NO: 1168947 - DNA, 22 bp, Artificial Sequence
  chemically synthesized
ctgaaactattccaatgaatag

SEQ ID NO: 1168948 - DNA, 22 bp, Artificial Sequence
  chemically synthesized
cctctttttctattcattggaa

SEQ ID NO: 1168949 - DNA, 22 bp, Artificial Sequence
  chemically synthesized
cttctgaaactattccaatgaa

SEQ ID NO: 1168950 - DNA, 22 bp, Artificial Sequence
  chemically synthesized
tttttctattcattggaatagt

SEQ ID NO: 1168951 - DNA, 22 bp, Artificial Sequence
  chemically synthesized
tttctattcattggaatagttt

SEQ ID NO: 1168952 - DNA, 22 bp, Artificial Sequence
  chemically synthesized
ttctattcattggaatagtttc

SEQ ID NO: 1168953 - DNA, 22 bp, Artificial Sequence
  chemically synthesized
tctattcattggaatagtttca

SEQ ID NO: 1168954 - DNA, 22 bp, Artificial Sequence
  chemically synthesized
ctattcattggaatagtttcag

SEQ ID NO: 1168955 - DNA, 22 bp, Artificial Sequence
  chemically synthesized
gtaccattccttctgaaactat

SEQ ID NO: 1168956 - DNA, 22 bp, Artificial Sequence
  chemically synthesized
tattcattggaatagtttcaga

SEQ ID NO: 1168957 - DNA, 22 bp, Artificial Sequence
  chemically synthesized
ttcattggaatagtttcagaag

SEQ ID NO: 1168958 - DNA, 22 bp, Artificial Sequence
  chemically synthesized
attggaatagtttcagaaggaa

SEQ ID NO: 1168959 - DNA, 22 bp, Artificial Sequence
  chemically synthesized
gaatagtttcagaaggaatggt

SEQ ID NO: 1168960 - DNA, 22 bp, Artificial Sequence
  chemically synthesized
cagaaggaatggtaccagctct

SEQ ID NO: 1168961 - DNA, 22 bp, Artificial Sequence
  chemically synthesized
agaaggaatggtaccagctctt

SEQ ID NO: 1168962 - DNA, 22 bp, Artificial Sequence
  chemically synthesized
ccagaggtacaaggaagagctg

SEQ ID NO: 1168963 - DNA, 22 bp, Artificial Sequence
  chemically synthesized
taccagaggtacaaggaagagc

SEQ ID NO: 1168964 - DNA, 22 bp, Artificial Sequence
  chemically synthesized
acagccgaattctaccagaggt

SEQ ID NO: 1168965 - DNA, 22 bp, Artificial Sequence
  chemically synthesized
ttccttgtacctctggtagaat

SEQ ID NO: 1168966 - DNA, 22 bp, Artificial Sequence
  chemically synthesized
ccttgtacctctggtagaattc

SEQ ID NO: 1168967 - DNA, 22 bp, Artificial Sequence
  chemically synthesized
cttgtacctctggtagaattcg

SEQ ID NO: 1168968 - DNA, 22 bp, Artificial Sequence
  chemically synthesized
gtacctctggtagaattcggct

SEQ ID NO: 1168969 - DNA, 22 bp, Artificial Sequence
  chemically synthesized
tacctctggtagaattcggctg

SEQ ID NO: 1168970 - DNA, 22 bp, Artificial Sequence
  chemically synthesized
tggtagaattcggctgtgaatc

SEQ ID NO: 1168971 - DNA, 22 bp, Artificial Sequence
  chemically synthesized
gtagaattcggctgtgaatcca

SEQ ID NO: 1168972 - DNA, 22 bp, Artificial Sequence
  chemically synthesized
ggctgtgaatccatctggtcct

SEQ ID NO: 1168973 - DNA, 22 bp, Artificial Sequence
  chemically synthesized
tgaatccatctggtcctggact

SEQ ID NO: 1168974 - DNA, 22 bp, Artificial Sequence
  chemically synthesized
ccaaccaaaaaaagtccaggac

SEQ ID NO: 1168975 - DNA, 22 bp, Artificial Sequence
  chemically synthesized
atagcctaccaaccaaaaaaag

SEQ ID NO: 1168976 - DNA, 22 bp, Artificial Sequence
  chemically synthesized
gtcctggactttttttggttgg

SEQ ID NO: 1168977 - DNA, 22 bp, Artificial Sequence
  chemically synthesized
gactttttttggttggtaggct

SEQ ID NO: 1168978 - DNA, 22 bp, Artificial Sequence
  chemically synthesized
aggcaataattaatagcctacc

SEQ ID NO: 1168979 - DNA, 22 bp, Artificial Sequence
  chemically synthesized
tttttggttggtaggctattaa

SEQ ID NO: 1168980 - DNA, 22 bp, Artificial Sequence
  chemically synthesized
ttttggttggtaggctattaat

SEQ ID NO: 1168981 - DNA, 22 bp, Artificial Sequence
  chemically synthesized
tttggttggtaggctattaatt

SEQ ID NO: 1168982 - DNA, 22 bp, Artificial Sequence
  chemically synthesized
ttggttggtaggctattaatta

SEQ ID NO: 1168983 - DNA, 22 bp, Artificial Sequence
  chemically synthesized
aaattgaggcaataattaatag

SEQ ID NO: 1168984 - DNA, 22 bp, Artificial Sequence
  chemically synthesized
tggttggtaggctattaattat

SEQ ID NO: 1168985 - DNA, 22 bp, Artificial Sequence
  chemically synthesized
ggttggtaggctattaattatt

SEQ ID NO: 1168986 - DNA, 22 bp, Artificial Sequence
  chemically synthesized
tgaaattgaggcaataattaat

SEQ ID NO: 1168987 - DNA, 22 bp, Artificial Sequence
  chemically synthesized
gttggtaggctattaattattg

SEQ ID NO: 1168988 - DNA, 22 bp, Artificial Sequence
  chemically synthesized
gtaggctattaattattgcctc

SEQ ID NO: 1168989 - DNA, 22 bp, Artificial Sequence
  chemically synthesized
ttaattattgcctcaatttcag

SEQ ID NO: 1168990 - DNA, 22 bp, Artificial Sequence
  chemically synthesized
attattgcctcaatttcagagc

SEQ ID NO: 1168991 - DNA, 22 bp, Artificial Sequence
  chemically synthesized
ttgcctcaatttcagagcctgt

SEQ ID NO: 1168992 - DNA, 22 bp, Artificial Sequence
  chemically synthesized
aatagaccaataacaggctctg

SEQ ID NO: 1168993 - DNA, 22 bp, Artificial Sequence
  chemically synthesized
cctcaatttcagagcctgttat

SEQ ID NO: 1168994 - DNA, 22 bp, Artificial Sequence
  chemically synthesized
aatttcagagcctgttattggt

SEQ ID NO: 1168995 - DNA, 22 bp, Artificial Sequence
  chemically synthesized
aatccctgaatagaccaataac

SEQ ID NO: 1168996 - DNA, 22 bp, Artificial Sequence
  chemically synthesized
cagagcctgttattggtctatt

SEQ ID NO: 1168997 - DNA, 22 bp, Artificial Sequence
  chemically synthesized
agagcctgttattggtctattc

SEQ ID NO: 1168998 - DNA, 22 bp, Artificial Sequence
  chemically synthesized
ttattggtctattcagggattc

SEQ ID NO: 1168999 - DNA, 22 bp, Artificial Sequence
  chemically synthesized
aaccaggaagttgaatccctga

SEQ ID NO: 1169000 - DNA, 22 bp, Artificial Sequence
  chemically synthesized
ttggtctattcagggattcaac

SEQ ID NO: 1169001 - DNA, 22 bp, Artificial Sequence
  chemically synthesized
gtctattcagggattcaacttc

SEQ ID NO: 1169002 - DNA, 22 bp, Artificial Sequence
  chemically synthesized
ccaagactaaaccaggaagttg

SEQ ID NO: 1169003 - DNA, 22 bp, Artificial Sequence
  chemically synthesized
ttcagggattcaacttcctggt

SEQ ID NO: 1169004 - DNA, 22 bp, Artificial Sequence
  chemically synthesized
agggattcaacttcctggttta

SEQ ID NO: 1169005 - DNA, 22 bp, Artificial Sequence
  chemically synthesized
aacttcctggtttagtcttggg

SEQ ID NO: 1169006 - DNA, 22 bp, Artificial Sequence
  chemically synthesized
cctggtttagtcttgggagggt

SEQ ID NO: 1169007 - DNA, 22 bp, Artificial Sequence
  chemically synthesized
gtggacacatacaccctcccaa

SEQ ID NO: 1169008 - DNA, 22 bp, Artificial Sequence
  chemically synthesized
ctggtttagtcttgggagggtg

SEQ ID NO: 1169009 - DNA, 22 bp, Artificial Sequence
  chemically synthesized
gtttagtcttgggagggtgtat

SEQ ID NO: 1169010 - DNA, 22 bp, Artificial Sequence
  chemically synthesized
agtcttgggagggtgtatgtgt

SEQ ID NO: 1169011 - DNA, 22 bp, Artificial Sequence
  chemically synthesized
gtcttgggagggtgtatgtgtc

SEQ ID NO: 1169012 - DNA, 22 bp, Artificial Sequence
  chemically synthesized
gggagggtgtatgtgtccacga

SEQ ID NO: 1169013 - DNA, 22 bp, Artificial Sequence
  chemically synthesized
ggagggtgtatgtgtccacgaa

SEQ ID NO: 1169014 - DNA, 22 bp, Artificial Sequence
  chemically synthesized
gaaggaatggataaattcgtgg

SEQ ID NO: 1169015 - DNA, 22 bp, Artificial Sequence
  chemically synthesized
gaaaatctagaaggaatggata

SEQ ID NO: 1169016 - DNA, 22 bp, Artificial Sequence
  chemically synthesized
atccattccttctagattttct

SEQ ID NO: 1169017 - DNA, 22 bp, Artificial Sequence
  chemically synthesized
cgcaaataaactagaaaatcta

SEQ ID NO: 1169018 - DNA, 22 bp, Artificial Sequence
  chemically synthesized
tccattccttctagattttcta

SEQ ID NO: 1169019 - DNA, 22 bp, Artificial Sequence
  chemically synthesized
tacgcaaataaactagaaaatc

SEQ ID NO: 1169020 - DNA, 22 bp, Artificial Sequence
  chemically synthesized
cttctagattttctagtttatt

SEQ ID NO: 1169021 - DNA, 22 bp, Artificial Sequence
  chemically synthesized
ctagattttctagtttatttgc

SEQ ID NO: 1169022 - DNA, 22 bp, Artificial Sequence
  chemically synthesized
tagattttctagtttatttgcg

SEQ ID NO: 1169023 - DNA, 22 bp, Artificial Sequence
  chemically synthesized
taaacacctctacgcaaataaa

SEQ ID NO: 1169024 - DNA, 22 bp, Artificial Sequence
  chemically synthesized
gattttctagtttatttgcgta

SEQ ID NO: 1169025 - DNA, 22 bp, Artificial Sequence
  chemically synthesized
tctagtttatttgcgtagaggt

SEQ ID NO: 1169026 - DNA, 22 bp, Artificial Sequence
  chemically synthesized
ctagtttatttgcgtagaggtg

SEQ ID NO: 1169027 - DNA, 22 bp, Artificial Sequence
  chemically synthesized
tagtttatttgcgtagaggtgt

SEQ ID NO: 1169028 - DNA, 22 bp, Artificial Sequence
  chemically synthesized
gtttatttgcgtagaggtgttt

SEQ ID NO: 1169029 - DNA, 22 bp, Artificial Sequence
  chemically synthesized
atttgcgtagaggtgtttacag

SEQ ID NO: 1169030 - DNA, 22 bp, Artificial Sequence
  chemically synthesized
tttgcgtagaggtgtttacagt

SEQ ID NO: 1169031 - DNA, 22 bp, Artificial Sequence
  chemically synthesized
ccatcagagaaaactgtaaaca

SEQ ID NO: 1169032 - DNA, 22 bp, Artificial Sequence
  chemically synthesized
gcgtagaggtgtttacagtttt

SEQ ID NO: 1169033 - DNA, 22 bp, Artificial Sequence
  chemically synthesized
cgtagaggtgtttacagttttc

SEQ ID NO: 1169034 - DNA, 22 bp, Artificial Sequence
  chemically synthesized
aaactaccatcagagaaaactg

SEQ ID NO: 1169035 - DNA, 22 bp, Artificial Sequence
  chemically synthesized
acagttttctctgatggtagtt

SEQ ID NO: 1169036 - DNA, 22 bp, Artificial Sequence
  chemically synthesized
cagttttctctgatggtagttt

SEQ ID NO: 1169037 - DNA, 22 bp, Artificial Sequence
  chemically synthesized
tctctgatggtagtttgaattt

SEQ ID NO: 1169038 - DNA, 22 bp, Artificial Sequence
  chemically synthesized
ctctgatggtagtttgaatttc

SEQ ID NO: 1169039 - DNA, 22 bp, Artificial Sequence
  chemically synthesized
tctgatggtagtttgaatttct

SEQ ID NO: 1169040 - DNA, 22 bp, Artificial Sequence
  chemically synthesized
tgatggtagtttgaatttctgt

SEQ ID NO: 1169041 - DNA, 22 bp, Artificial Sequence
  chemically synthesized
atggtagtttgaatttctgtgg

SEQ ID NO: 1169042 - DNA, 22 bp, Artificial Sequence
  chemically synthesized
gaatttctgtgggatcggtggt

SEQ ID NO: 1169043 - DNA, 22 bp, Artificial Sequence
  chemically synthesized
aatttctgtgggatcggtggtg

SEQ ID NO: 1169044 - DNA, 22 bp, Artificial Sequence
  chemically synthesized
ctgtgggatcggtggtgatatc

SEQ ID NO: 1169045 - DNA, 22 bp, Artificial Sequence
  chemically synthesized
tgtgggatcggtggtgatatcc

SEQ ID NO: 1169046 - DNA, 22 bp, Artificial Sequence
  chemically synthesized
tgggatcggtggtgatatcccc

SEQ ID NO: 1169047 - DNA, 22 bp, Artificial Sequence
  chemically synthesized
tattattttttattgcatctat

SEQ ID NO: 1169048 - DNA, 22 bp, Artificial Sequence
  chemically synthesized
attattttttattgcatctatt

SEQ ID NO: 1169049 - DNA, 22 bp, Artificial Sequence
  chemically synthesized
ttattttttattgcatctattt

SEQ ID NO: 1169050 - DNA, 22 bp, Artificial Sequence
  chemically synthesized
ttttttattgcatctatttgat

SEQ ID NO: 1169051 - DNA, 22 bp, Artificial Sequence
  chemically synthesized
tttattgcatctatttgattct

SEQ ID NO: 1169052 - DNA, 22 bp, Artificial Sequence
  chemically synthesized
ttattgcatctatttgattctt

SEQ ID NO: 1169053 - DNA, 22 bp, Artificial Sequence
  chemically synthesized
tattgcatctatttgattcttc

SEQ ID NO: 1169054 - DNA, 22 bp, Artificial Sequence
  chemically synthesized
attgcatctatttgattcttct

SEQ ID NO: 1169055 - DNA, 22 bp, Artificial Sequence
  chemically synthesized
ataagaaaagagagaagaatca

SEQ ID NO: 1169056 - DNA, 22 bp, Artificial Sequence
  chemically synthesized
ttgcatctatttgattcttctc

SEQ ID NO: 1169057 - DNA, 22 bp, Artificial Sequence
  chemically synthesized
catctatttgattcttctctct

SEQ ID NO: 1169058 - DNA, 22 bp, Artificial Sequence
  chemically synthesized
gcaagactaataagaaaagaga

SEQ ID NO: 1169059 - DNA, 22 bp, Artificial Sequence
  chemically synthesized
tttgattcttctctcttttctt

SEQ ID NO: 1169060 - DNA, 22 bp, Artificial Sequence
  chemically synthesized
gattcttctctcttttcttatt

SEQ ID NO: 1169061 - DNA, 22 bp, Artificial Sequence
  chemically synthesized
attcttctctcttttcttatta

SEQ ID NO: 1169062 - DNA, 22 bp, Artificial Sequence
  chemically synthesized
ttctctcttttcttattagtct

SEQ ID NO: 1169063 - DNA, 22 bp, Artificial Sequence
  chemically synthesized
ctctcttttcttattagtcttg

SEQ ID NO: 1169064 - DNA, 22 bp, Artificial Sequence
  chemically synthesized
atagatcgctagcaagactaat

SEQ ID NO: 1169065 - DNA, 22 bp, Artificial Sequence
  chemically synthesized
tctcttttcttattagtcttgc

SEQ ID NO: 1169066 - DNA, 22 bp, Artificial Sequence
  chemically synthesized
tcttttcttattagtcttgcta

SEQ ID NO: 1169067 - DNA, 22 bp, Artificial Sequence
  chemically synthesized
ttttcttattagtcttgctagc

SEQ ID NO: 1169068 - DNA, 22 bp, Artificial Sequence
  chemically synthesized
ttcttattagtcttgctagcga

SEQ ID NO: 1169069 - DNA, 22 bp, Artificial Sequence
  chemically synthesized
tcttattagtcttgctagcgat

SEQ ID NO: 1169070 - DNA, 22 bp, Artificial Sequence
  chemically synthesized
cttattagtcttgctagcgatc

SEQ ID NO: 1169071 - DNA, 22 bp, Artificial Sequence
  chemically synthesized
ttattagtcttgctagcgatct

SEQ ID NO: 1169072 - DNA, 22 bp, Artificial Sequence
  chemically synthesized
attagtcttgctagcgatctat

SEQ ID NO: 1169073 - DNA, 22 bp, Artificial Sequence
  chemically synthesized
ttagtcttgctagcgatctatc

SEQ ID NO: 1169074 - DNA, 22 bp, Artificial Sequence
  chemically synthesized
tgatcaacaaaattgatagatc

SEQ ID NO: 1169075 - DNA, 22 bp, Artificial Sequence
  chemically synthesized
gtcttgctagcgatctatcaat

SEQ ID NO: 1169076 - DNA, 22 bp, Artificial Sequence
  chemically synthesized
gttatgatcaacaaaattgata

SEQ ID NO: 1169077 - DNA, 22 bp, Artificial Sequence
  chemically synthesized
gctagcgatctatcaattttgt

SEQ ID NO: 1169078 - DNA, 22 bp, Artificial Sequence
  chemically synthesized
ctagcgatctatcaattttgtt

SEQ ID NO: 1169079 - DNA, 22 bp, Artificial Sequence
  chemically synthesized
gcgatctatcaattttgttgat

SEQ ID NO: 1169080 - DNA, 22 bp, Artificial Sequence
  chemically synthesized
ggagctggttatgatcaacaaa

SEQ ID NO: 1169081 - DNA, 22 bp, Artificial Sequence
  chemically synthesized
tcaattttgttgatcataacca

SEQ ID NO: 1169082 - DNA, 22 bp, Artificial Sequence
  chemically synthesized
tgttgatcataaccagctccta

SEQ ID NO: 1169083 - DNA, 22 bp, Artificial Sequence
  chemically synthesized
gttgatcataaccagctcctag

SEQ ID NO: 1169084 - DNA, 22 bp, Artificial Sequence
  chemically synthesized
ttgatcataaccagctcctaga

SEQ ID NO: 1169085 - DNA, 22 bp, Artificial Sequence
  chemically synthesized
aaaaatcaatgaatctaggagc

SEQ ID NO: 1169086 - DNA, 22 bp, Artificial Sequence
  chemically synthesized
aaaaaatcaatgaatctaggag

SEQ ID NO: 1169087 - DNA, 22 bp, Artificial Sequence
  chemically synthesized
atcataaccagctcctagattc

SEQ ID NO: 1169088 - DNA, 22 bp, Artificial Sequence
  chemically synthesized
taaaaaatcaatgaatctagga

SEQ ID NO: 1169089 - DNA, 22 bp, Artificial Sequence
  chemically synthesized
ctagattcattgattttttaaa

SEQ ID NO: 1169090 - DNA, 22 bp, Artificial Sequence
  chemically synthesized
gattcattgattttttaaaggg

SEQ ID NO: 1169091 - DNA, 22 bp, Artificial Sequence
  chemically synthesized
attgattttttaaagggctttt

SEQ ID NO: 1169092 - DNA, 22 bp, Artificial Sequence
  chemically synthesized
attttttaaagggctttttgtg

SEQ ID NO: 1169093 - DNA, 22 bp, Artificial Sequence
  chemically synthesized
aaggaaatagagacacaaaaag

SEQ ID NO: 1169094 - DNA, 22 bp, Artificial Sequence
  chemically synthesized
tttaaagggctttttgtgtctc

SEQ ID NO: 1169095 - DNA, 22 bp, Artificial Sequence
  chemically synthesized
ttaaagggctttttgtgtctct

SEQ ID NO: 1169096 - DNA, 22 bp, Artificial Sequence
  chemically synthesized
taaagggctttttgtgtctcta

SEQ ID NO: 1169097 - DNA, 22 bp, Artificial Sequence
  chemically synthesized
aaagggctttttgtgtctctat

SEQ ID NO: 1169098 - DNA, 22 bp, Artificial Sequence
  chemically synthesized
aagggctttttgtgtctctatt

SEQ ID NO: 1169099 - DNA, 22 bp, Artificial Sequence
  chemically synthesized
tttgtgtctctatttccttcag

SEQ ID NO: 1169100 - DNA, 22 bp, Artificial Sequence
  chemically synthesized
ttgtgtctctatttccttcagt

SEQ ID NO: 1169101 - DNA, 22 bp, Artificial Sequence
  chemically synthesized
tgtgtctctatttccttcagtt

SEQ ID NO: 1169102 - DNA, 22 bp, Artificial Sequence
  chemically synthesized
agatcagagcccaactgaagga

SEQ ID NO: 1169103 - DNA, 22 bp, Artificial Sequence
  chemically synthesized
gtgtctctatttccttcagttg

SEQ ID NO: 1169104 - DNA, 22 bp, Artificial Sequence
  chemically synthesized
tgtctctatttccttcagttgg

SEQ ID NO: 1169105 - DNA, 22 bp, Artificial Sequence
  chemically synthesized
tatttccttcagttgggctctg

SEQ ID NO: 1169106 - DNA, 22 bp, Artificial Sequence
  chemically synthesized
tttccttcagttgggctctgat

SEQ ID NO: 1169107 - DNA, 22 bp, Artificial Sequence
  chemically synthesized
ccttcagttgggctctgatctt

SEQ ID NO: 1169108 - DNA, 22 bp, Artificial Sequence
  chemically synthesized
cttcagttgggctctgatctta

SEQ ID NO: 1169109 - DNA, 22 bp, Artificial Sequence
  chemically synthesized
cagttgggctctgatcttagtt

SEQ ID NO: 1169110 - DNA, 22 bp, Artificial Sequence
  chemically synthesized
agttgggctctgatcttagtta

SEQ ID NO: 1169111 - DNA, 22 bp, Artificial Sequence
  chemically synthesized
gcagaaggcaagaaataactaa

SEQ ID NO: 1169112 - DNA, 22 bp, Artificial Sequence
  chemically synthesized
ggctctgatcttagttatttct

SEQ ID NO: 1169113 - DNA, 22 bp, Artificial Sequence
  chemically synthesized
tgatcttagttatttcttgcct

SEQ ID NO: 1169114 - DNA, 22 bp, Artificial Sequence
  chemically synthesized
aaaagctagcagaaggcaagaa

SEQ ID NO: 1169115 - DNA, 22 bp, Artificial Sequence
  chemically synthesized
atcttagttatttcttgccttc

SEQ ID NO: 1169116 - DNA, 22 bp, Artificial Sequence
  chemically synthesized
agttatttcttgccttctgcta

SEQ ID NO: 1169117 - DNA, 22 bp, Artificial Sequence
  chemically synthesized
gttatttcttgccttctgctag

SEQ ID NO: 1169118 - DNA, 22 bp, Artificial Sequence
  chemically synthesized
tttcttgccttctgctagcttt

SEQ ID NO: 1169119 - DNA, 22 bp, Artificial Sequence
  chemically synthesized
cttgccttctgctagcttttga

SEQ ID NO: 1169120 - DNA, 22 bp, Artificial Sequence
  chemically synthesized
ttgccttctgctagcttttgaa

SEQ ID NO: 1169121 - DNA, 22 bp, Artificial Sequence
  chemically synthesized
gccttctgctagcttttgaatg

SEQ ID NO: 1169122 - DNA, 22 bp, Artificial Sequence
  chemically synthesized
ccttctgctagcttttgaatgt

SEQ ID NO: 1169123 - DNA, 22 bp, Artificial Sequence
  chemically synthesized
ctgctagcttttgaatgtgttt

SEQ ID NO: 1169124 - DNA, 22 bp, Artificial Sequence
  chemically synthesized
tgctagcttttgaatgtgtttg

SEQ ID NO: 1169125 - DNA, 22 bp, Artificial Sequence
  chemically synthesized
gagaagcaagagcaaacacatt

SEQ ID NO: 1169126 - DNA, 22 bp, Artificial Sequence
  chemically synthesized
ctagcttttgaatgtgtttgct

SEQ ID NO: 1169127 - DNA, 22 bp, Artificial Sequence
  chemically synthesized
gcttttgaatgtgtttgctctt

SEQ ID NO: 1169128 - DNA, 22 bp, Artificial Sequence
  chemically synthesized
ttgaatgtgtttgctcttgctt

SEQ ID NO: 1169129 - DNA, 22 bp, Artificial Sequence
  chemically synthesized
aaagaactagagaagcaagagc

SEQ ID NO: 1169130 - DNA, 22 bp, Artificial Sequence
  chemically synthesized
tgaatgtgtttgctcttgcttc

SEQ ID NO: 1169131 - DNA, 22 bp, Artificial Sequence
  chemically synthesized
gaatgtgtttgctcttgcttct

SEQ ID NO: 1169132 - DNA, 22 bp, Artificial Sequence
  chemically synthesized
aatgtgtttgctcttgcttctc

SEQ ID NO: 1169133 - DNA, 22 bp, Artificial Sequence
  chemically synthesized
gctcttgcttctctagttcttt

SEQ ID NO: 1169134 - DNA, 22 bp, Artificial Sequence
  chemically synthesized
acataacaattaaaagaactag

SEQ ID NO: 1169135 - DNA, 22 bp, Artificial Sequence
  chemically synthesized
ctcttgcttctctagttctttt

SEQ ID NO: 1169136 - DNA, 22 bp, Artificial Sequence
  chemically synthesized
ttgcttctctagttcttttaat

SEQ ID NO: 1169137 - DNA, 22 bp, Artificial Sequence
  chemically synthesized
gcttctctagttcttttaattg

SEQ ID NO: 1169138 - DNA, 22 bp, Artificial Sequence
  chemically synthesized
cttctctagttcttttaattgt

SEQ ID NO: 1169139 - DNA, 22 bp, Artificial Sequence
  chemically synthesized
acaccctaacataacaattaaa

SEQ ID NO: 1169140 - DNA, 22 bp, Artificial Sequence
  chemically synthesized
ctctagttcttttaattgttat

SEQ ID NO: 1169141 - DNA, 22 bp, Artificial Sequence
  chemically synthesized
tctagttcttttaattgttatg

SEQ ID NO: 1169142 - DNA, 22 bp, Artificial Sequence
  chemically synthesized
tagttcttttaattgttatgtt

SEQ ID NO: 1169143 - DNA, 22 bp, Artificial Sequence
  chemically synthesized
aaattgacaccctaacataaca

SEQ ID NO: 1169144 - DNA, 22 bp, Artificial Sequence
  chemically synthesized
gttcttttaattgttatgttag

SEQ ID NO: 1169145 - DNA, 22 bp, Artificial Sequence
  chemically synthesized
ttttaattgttatgttagggtg

SEQ ID NO: 1169146 - DNA, 22 bp, Artificial Sequence
  chemically synthesized
ttaattgttatgttagggtgtc

SEQ ID NO: 1169147 - DNA, 22 bp, Artificial Sequence
  chemically synthesized
taattgttatgttagggtgtca

SEQ ID NO: 1169148 - DNA, 22 bp, Artificial Sequence
  chemically synthesized
aattgttatgttagggtgtcaa

SEQ ID NO: 1169149 - DNA, 22 bp, Artificial Sequence
  chemically synthesized
attgttatgttagggtgtcaat

SEQ ID NO: 1169150 - DNA, 22 bp, Artificial Sequence
  chemically synthesized
ttatgttagggtgtcaatttta

SEQ ID NO: 1169151 - DNA, 22 bp, Artificial Sequence
  chemically synthesized
tgttagggtgtcaattttagat

SEQ ID NO: 1169152 - DNA, 22 bp, Artificial Sequence
  chemically synthesized
gggtgtcaattttagatctttc

SEQ ID NO: 1169153 - DNA, 22 bp, Artificial Sequence
  chemically synthesized
aatgcccacaagagaaagcagg

SEQ ID NO: 1169154 - DNA, 22 bp, Artificial Sequence
  chemically synthesized
tagatctttcctgctttctctt

SEQ ID NO: 1169155 - DNA, 22 bp, Artificial Sequence
  chemically synthesized
agatctttcctgctttctcttg

SEQ ID NO: 1169156 - DNA, 22 bp, Artificial Sequence
  chemically synthesized
gatctttcctgctttctcttgt

SEQ ID NO: 1169157 - DNA, 22 bp, Artificial Sequence
  chemically synthesized
tagcactgaatgcccacaagag

SEQ ID NO: 1169158 - DNA, 22 bp, Artificial Sequence
  chemically synthesized
atagcactgaatgcccacaaga

SEQ ID NO: 1169159 - DNA, 22 bp, Artificial Sequence
  chemically synthesized
tcctgctttctcttgtgggcat

SEQ ID NO: 1169160 - DNA, 22 bp, Artificial Sequence
  chemically synthesized
cctgctttctcttgtgggcatt

SEQ ID NO: 1169161 - DNA, 22 bp, Artificial Sequence
  chemically synthesized
ctgctttctcttgtgggcattc

SEQ ID NO: 1169162 - DNA, 22 bp, Artificial Sequence
  chemically synthesized
ctttctcttgtgggcattcagt

SEQ ID NO: 1169163 - DNA, 22 bp, Artificial Sequence
  chemically synthesized
tctcttgtgggcattcagtgct

SEQ ID NO: 1169164 - DNA, 22 bp, Artificial Sequence
  chemically synthesized
ctcttgtgggcattcagtgcta

SEQ ID NO: 1169165 - DNA, 22 bp, Artificial Sequence
  chemically synthesized
tcttgtgggcattcagtgctat

SEQ ID NO: 1169166 - DNA, 22 bp, Artificial Sequence
  chemically synthesized
ttgtgggcattcagtgctataa

SEQ ID NO: 1169167 - DNA, 22 bp, Artificial Sequence
  chemically synthesized
gtgggcattcagtgctataaat

SEQ ID NO: 1169168 - DNA, 22 bp, Artificial Sequence
  chemically synthesized
tgggcattcagtgctataaatt

SEQ ID NO: 1169169 - DNA, 22 bp, Artificial Sequence
  chemically synthesized
aagcagtgtgtagagggaaatt

SEQ ID NO: 1169170 - DNA, 22 bp, Artificial Sequence
  chemically synthesized
aaagcagtgtgtagagggaaat

SEQ ID NO: 1169171 - DNA, 22 bp, Artificial Sequence
  chemically synthesized
agtgctataaatttccctctac

SEQ ID NO: 1169172 - DNA, 22 bp, Artificial Sequence
  chemically synthesized
taaatttccctctacacactgc

SEQ ID NO: 1169173 - DNA, 22 bp, Artificial Sequence
  chemically synthesized
tgggacacatttaaagcagtgt

SEQ ID NO: 1169174 - DNA, 22 bp, Artificial Sequence
  chemically synthesized
ccctctacacactgctttaaat

SEQ ID NO: 1169175 - DNA, 22 bp, Artificial Sequence
  chemically synthesized
cctctacacactgctttaaatg

SEQ ID NO: 1169176 - DNA, 22 bp, Artificial Sequence
  chemically synthesized
tacacactgctttaaatgtgtc

SEQ ID NO: 1169177 - DNA, 22 bp, Artificial Sequence
  chemically synthesized
cacactgctttaaatgtgtccc

SEQ ID NO: 1169178 - DNA, 22 bp, Artificial Sequence
  chemically synthesized
ctttaaatgtgtcccacagatt

SEQ ID NO: 1169179 - DNA, 22 bp, Artificial Sequence
  chemically synthesized
taaatgtgtcccacagattctg

SEQ ID NO: 1169180 - DNA, 22 bp, Artificial Sequence
  chemically synthesized
aaatgtgtcccacagattctgg

SEQ ID NO: 1169181 - DNA, 22 bp, Artificial Sequence
  chemically synthesized
aatgtgtcccacagattctggt

SEQ ID NO: 1169182 - DNA, 22 bp, Artificial Sequence
  chemically synthesized
aaaccaatgagaacaaagacac

SEQ ID NO: 1169183 - DNA, 22 bp, Artificial Sequence
  chemically synthesized
gaaaccaatgagaacaaagaca

SEQ ID NO: 1169184 - DNA, 22 bp, Artificial Sequence
  chemically synthesized
tgaaaccaatgagaacaaagac

SEQ ID NO: 1169185 - DNA, 22 bp, Artificial Sequence
  chemically synthesized
tggtatgttgtgtctttgttct

SEQ ID NO: 1169186 - DNA, 22 bp, Artificial Sequence
  chemically synthesized
tttgaaaccaatgagaacaaag

SEQ ID NO: 1169187 - DNA, 22 bp, Artificial Sequence
  chemically synthesized
gtatgttgtgtctttgttctca

SEQ ID NO: 1169188 - DNA, 22 bp, Artificial Sequence
  chemically synthesized
tgtctttgttctcattggtttc

SEQ ID NO: 1169189 - DNA, 22 bp, Artificial Sequence
  chemically synthesized
tgttctcattggtttcaaagaa

SEQ ID NO: 1169190 - DNA, 22 bp, Artificial Sequence
  chemically synthesized
gttctcattggtttcaaagaac

SEQ ID NO: 1169191 - DNA, 22 bp, Artificial Sequence
  chemically synthesized
ttctcattggtttcaaagaaca

SEQ ID NO: 1169192 - DNA, 22 bp, Artificial Sequence
  chemically synthesized
tcattggtttcaaagaacatct

SEQ ID NO: 1169193 - DNA, 22 bp, Artificial Sequence
  chemically synthesized
attggtttcaaagaacatcttt

SEQ ID NO: 1169194 - DNA, 22 bp, Artificial Sequence
  chemically synthesized
gtttcaaagaacatctttattt

SEQ ID NO: 1169195 - DNA, 22 bp, Artificial Sequence
  chemically synthesized
caaagaacatctttatttctgc

SEQ ID NO: 1169196 - DNA, 22 bp, Artificial Sequence
  chemically synthesized
aaagaacatctttatttctgcc

SEQ ID NO: 1169197 - DNA, 22 bp, Artificial Sequence
  chemically synthesized
ggtacataacgaaatgaaggca

SEQ ID NO: 1169198 - DNA, 22 bp, Artificial Sequence
  chemically synthesized
ctgggtacataacgaaatgaag

SEQ ID NO: 1169199 - DNA, 22 bp, Artificial Sequence
  chemically synthesized
tatttctgccttcatttcgtta

SEQ ID NO: 1169200 - DNA, 22 bp, Artificial Sequence
  chemically synthesized
atttctgccttcatttcgttat

SEQ ID NO: 1169201 - DNA, 22 bp, Artificial Sequence
  chemically synthesized
tttctgccttcatttcgttatg

SEQ ID NO: 1169202 - DNA, 22 bp, Artificial Sequence
  chemically synthesized
ctgccttcatttcgttatgtac

SEQ ID NO: 1169203 - DNA, 22 bp, Artificial Sequence
  chemically synthesized
aatgactactgggtacataacg

SEQ ID NO: 1169204 - DNA, 22 bp, Artificial Sequence
  chemically synthesized
tgccttcatttcgttatgtacc

SEQ ID NO: 1169205 - DNA, 22 bp, Artificial Sequence
  chemically synthesized
ccttcatttcgttatgtaccca

SEQ ID NO: 1169206 - DNA, 22 bp, Artificial Sequence
  chemically synthesized
ctgaatgactactgggtacata

SEQ ID NO: 1169207 - DNA, 22 bp, Artificial Sequence
  chemically synthesized
ctgctgaatgactactgggtac

SEQ ID NO: 1169208 - DNA, 22 bp, Artificial Sequence
  chemically synthesized
catttcgttatgtacccagtag

SEQ ID NO: 1169209 - DNA, 22 bp, Artificial Sequence
  chemically synthesized
atttcgttatgtacccagtagt

SEQ ID NO: 1169210 - DNA, 22 bp, Artificial Sequence
  chemically synthesized
cgttatgtacccagtagtcatt

SEQ ID NO: 1169211 - DNA, 22 bp, Artificial Sequence
  chemically synthesized
gttatgtacccagtagtcattc

SEQ ID NO: 1169212 - DNA, 22 bp, Artificial Sequence
  chemically synthesized
aacaacctgctgctgaatgact

SEQ ID NO: 1169213 - DNA, 22 bp, Artificial Sequence
  chemically synthesized
tgtacccagtagtcattcagca

SEQ ID NO: 1169214 - DNA, 22 bp, Artificial Sequence
  chemically synthesized
catggaaactgaacaacctgct

SEQ ID NO: 1169215 - DNA, 22 bp, Artificial Sequence
  chemically synthesized
aactacatggaaactgaacaac

SEQ ID NO: 1169216 - DNA, 22 bp, Artificial Sequence
  chemically synthesized
agcagcaggttgttcagtttcc

SEQ ID NO: 1169217 - DNA, 22 bp, Artificial Sequence
  chemically synthesized
aaaaccactcaactacatggaa

SEQ ID NO: 1169218 - DNA, 22 bp, Artificial Sequence
  chemically synthesized
actcaaaaccactcaactacat

SEQ ID NO: 1169219 - DNA, 22 bp, Artificial Sequence
  chemically synthesized
ttcagtttccatgtagttgagt

SEQ ID NO: 1169220 - DNA, 22 bp, Artificial Sequence
  chemically synthesized
agtttccatgtagttgagtggt

SEQ ID NO: 1169221 - DNA, 22 bp, Artificial Sequence
  chemically synthesized
agaaactcactcaaaaccactc

SEQ ID NO: 1169222 - DNA, 22 bp, Artificial Sequence
  chemically synthesized
ccatgtagttgagtggttttga

SEQ ID NO: 1169223 - DNA, 22 bp, Artificial Sequence
  chemically synthesized
catgtagttgagtggttttgag

SEQ ID NO: 1169224 - DNA, 22 bp, Artificial Sequence
  chemically synthesized
gattaagaaactcactcaaaac

SEQ ID NO: 1169225 - DNA, 22 bp, Artificial Sequence
  chemically synthesized
tggattaagaaactcactcaaa

SEQ ID NO: 1169226 - DNA, 22 bp, Artificial Sequence
  chemically synthesized
agtggttttgagtgagtttctt

SEQ ID NO: 1169227 - DNA, 22 bp, Artificial Sequence
  chemically synthesized
gaactctggattaagaaactca

SEQ ID NO: 1169228 - DNA, 22 bp, Artificial Sequence
  chemically synthesized
tgagtgagtttcttaatccaga

SEQ ID NO: 1169229 - DNA, 22 bp, Artificial Sequence
  chemically synthesized
gagtgagtttcttaatccagag

SEQ ID NO: 1169230 - DNA, 22 bp, Artificial Sequence
  chemically synthesized
agtgagtttcttaatccagagt

SEQ ID NO: 1169231 - DNA, 22 bp, Artificial Sequence
  chemically synthesized
aatcaaactagaactctggatt

SEQ ID NO: 1169232 - DNA, 22 bp, Artificial Sequence
  chemically synthesized
cttaatccagagttctagtttg

SEQ ID NO: 1169233 - DNA, 22 bp, Artificial Sequence
  chemically synthesized
ttaatccagagttctagtttga

SEQ ID NO: 1169234 - DNA, 22 bp, Artificial Sequence
  chemically synthesized
aatccagagttctagtttgatt

SEQ ID NO: 1169235 - DNA, 22 bp, Artificial Sequence
  chemically synthesized
agaccacagttcaatcaaacta

SEQ ID NO: 1169236 - DNA, 22 bp, Artificial Sequence
  chemically synthesized
atccagagttctagtttgattg

SEQ ID NO: 1169237 - DNA, 22 bp, Artificial Sequence
  chemically synthesized
tcagaccacagttcaatcaaac

SEQ ID NO: 1169238 - DNA, 22 bp, Artificial Sequence
  chemically synthesized
tagtttgattgaactgtggtct

SEQ ID NO: 1169239 - DNA, 22 bp, Artificial Sequence
  chemically synthesized
gtttgattgaactgtggtctga

SEQ ID NO: 1169240 - DNA, 22 bp, Artificial Sequence
  chemically synthesized
taacaaagtgtctctcagacca

SEQ ID NO: 1169241 - DNA, 22 bp, Artificial Sequence
  chemically synthesized
gattgaactgtggtctgagaga

SEQ ID NO: 1169242 - DNA, 22 bp, Artificial Sequence
  chemically synthesized
attgaactgtggtctgagagac

SEQ ID NO: 1169243 - DNA, 22 bp, Artificial Sequence
  chemically synthesized
aactgtggtctgagagacactt

SEQ ID NO: 1169244 - DNA, 22 bp, Artificial Sequence
  chemically synthesized
tggtctgagagacactttgtta

SEQ ID NO: 1169245 - DNA, 22 bp, Artificial Sequence
  chemically synthesized
agagacactttgttataatttc

SEQ ID NO: 1169246 - DNA, 22 bp, Artificial Sequence
  chemically synthesized
agcaaatgtaaaagaacagaaa

SEQ ID NO: 1169247 - DNA, 22 bp, Artificial Sequence
  chemically synthesized
tgttataatttctgttctttta

SEQ ID NO: 1169248 - DNA, 22 bp, Artificial Sequence
  chemically synthesized
gttataatttctgttcttttac

SEQ ID NO: 1169249 - DNA, 22 bp, Artificial Sequence
  chemically synthesized
ttataatttctgttcttttaca

SEQ ID NO: 1169250 - DNA, 22 bp, Artificial Sequence
  chemically synthesized
taatttctgttcttttacattt

SEQ ID NO: 1169251 - DNA, 22 bp, Artificial Sequence
  chemically synthesized
aagcacccctcagcaaatgtaa

SEQ ID NO: 1169252 - DNA, 22 bp, Artificial Sequence
  chemically synthesized
ctgttcttttacatttgctgag

SEQ ID NO: 1169253 - DNA, 22 bp, Artificial Sequence
  chemically synthesized
tgttcttttacatttgctgagg

SEQ ID NO: 1169254 - DNA, 22 bp, Artificial Sequence
  chemically synthesized
ttcttttacatttgctgagggg

SEQ ID NO: 1169255 - DNA, 22 bp, Artificial Sequence
  chemically synthesized
gaagttaaagcacccctcagca

SEQ ID NO: 1169256 - DNA, 22 bp, Artificial Sequence
  chemically synthesized
ttttacatttgctgaggggtgc

SEQ ID NO: 1169257 - DNA, 22 bp, Artificial Sequence
  chemically synthesized
ttacatttgctgaggggtgctt

SEQ ID NO: 1169258 - DNA, 22 bp, Artificial Sequence
  chemically synthesized
tacatttgctgaggggtgcttt

SEQ ID NO: 1169259 - DNA, 22 bp, Artificial Sequence
  chemically synthesized
acatttgctgaggggtgcttta

SEQ ID NO: 1169260 - DNA, 22 bp, Artificial Sequence
  chemically synthesized
catttgctgaggggtgctttaa

SEQ ID NO: 1169261 - DNA, 22 bp, Artificial Sequence
  chemically synthesized
accacatagttggaagttaaag

SEQ ID NO: 1169262 - DNA, 22 bp, Artificial Sequence
  chemically synthesized
gctgaggggtgctttaacttcc

SEQ ID NO: 1169263 - DNA, 22 bp, Artificial Sequence
  chemically synthesized
ctgaggggtgctttaacttcca

SEQ ID NO: 1169264 - DNA, 22 bp, Artificial Sequence
  chemically synthesized
aggggtgctttaacttccaact

SEQ ID NO: 1169265 - DNA, 22 bp, Artificial Sequence
  chemically synthesized
caaaattgaccacatagttgga

SEQ ID NO: 1169266 - DNA, 22 bp, Artificial Sequence
  chemically synthesized
ttccaaaattgaccacatagtt

SEQ ID NO: 1169267 - DNA, 22 bp, Artificial Sequence
  chemically synthesized
attccaaaattgaccacatagt

SEQ ID NO: 1169268 - DNA, 22 bp, Artificial Sequence
  chemically synthesized
taacttccaactatgtggtcaa

SEQ ID NO: 1169269 - DNA, 22 bp, Artificial Sequence
  chemically synthesized
aacttccaactatgtggtcaat

SEQ ID NO: 1169270 - DNA, 22 bp, Artificial Sequence
  chemically synthesized
acttccaactatgtggtcaatt

SEQ ID NO: 1169271 - DNA, 22 bp, Artificial Sequence
  chemically synthesized
ccaactatgtggtcaattttgg

SEQ ID NO: 1169272 - DNA, 22 bp, Artificial Sequence
  chemically synthesized
caactatgtggtcaattttgga

SEQ ID NO: 1169273 - DNA, 22 bp, Artificial Sequence
  chemically synthesized
tgtggtcaattttggaataagt

SEQ ID NO: 1169274 - DNA, 22 bp, Artificial Sequence
  chemically synthesized
agcaccacatcacacttattcc

SEQ ID NO: 1169275 - DNA, 22 bp, Artificial Sequence
  chemically synthesized
tcagcaccacatcacacttatt

SEQ ID NO: 1169276 - DNA, 22 bp, Artificial Sequence
  chemically synthesized
ctcagcaccacatcacacttat

SEQ ID NO: 1169277 - DNA, 22 bp, Artificial Sequence
  chemically synthesized
ttctcagcaccacatcacactt

SEQ ID NO: 1169278 - DNA, 22 bp, Artificial Sequence
  chemically synthesized
tggaataagtgtgatgtggtgc

SEQ ID NO: 1169279 - DNA, 22 bp, Artificial Sequence
  chemically synthesized
ggaataagtgtgatgtggtgct

SEQ ID NO: 1169280 - DNA, 22 bp, Artificial Sequence
  chemically synthesized
tacattcttctcagcaccacat

SEQ ID NO: 1169281 - DNA, 22 bp, Artificial Sequence
  chemically synthesized
gaataagtgtgatgtggtgctg

SEQ ID NO: 1169282 - DNA, 22 bp, Artificial Sequence
  chemically synthesized
atcaacagattatacattcttc

SEQ ID NO: 1169283 - DNA, 22 bp, Artificial Sequence
  chemically synthesized
cacccctaatcaacagattata

SEQ ID NO: 1169284 - DNA, 22 bp, Artificial Sequence
  chemically synthesized
tccacccctaatcaacagatta

SEQ ID NO: 1169285 - DNA, 22 bp, Artificial Sequence
  chemically synthesized
agaagaatgtataatctgttga

SEQ ID NO: 1169286 - DNA, 22 bp, Artificial Sequence
  chemically synthesized
cagaactctccacccctaatca

SEQ ID NO: 1169287 - DNA, 22 bp, Artificial Sequence
  chemically synthesized
ttgattaggggtggagagttct

SEQ ID NO: 1169288 - DNA, 22 bp, Artificial Sequence
  chemically synthesized
atagacatctacagaactctcc

SEQ ID NO: 1169289 - DNA, 22 bp, Artificial Sequence
  chemically synthesized
attaggggtggagagttctgta

SEQ ID NO: 1169290 - DNA, 22 bp, Artificial Sequence
  chemically synthesized
ggggtggagagttctgtagatg

SEQ ID NO: 1169291 - DNA, 22 bp, Artificial Sequence
  chemically synthesized
caacaagcggacctcatagaca

SEQ ID NO: 1169292 - DNA, 22 bp, Artificial Sequence
  chemically synthesized
tgcaacaagcggacctcataga

SEQ ID NO: 1169293 - DNA, 22 bp, Artificial Sequence
  chemically synthesized
tgtagatgtctatgaggtccgc

SEQ ID NO: 1169294 - DNA, 22 bp, Artificial Sequence
  chemically synthesized
agctctgcaacaagcggacctc

SEQ ID NO: 1169295 - DNA, 22 bp, Artificial Sequence
  chemically synthesized
tagatgtctatgaggtccgctt

SEQ ID NO: 1169296 - DNA, 22 bp, Artificial Sequence
  chemically synthesized
aactcagctctgcaacaagcgg

SEQ ID NO: 1169297 - DNA, 22 bp, Artificial Sequence
  chemically synthesized
tgaggtccgcttgttgcagagc

SEQ ID NO: 1169298 - DNA, 22 bp, Artificial Sequence
  chemically synthesized
gttgcagagctgagttcaattc

SEQ ID NO: 1169299 - DNA, 22 bp, Artificial Sequence
  chemically synthesized
ttgcagagctgagttcaattct

SEQ ID NO: 1169300 - DNA, 22 bp, Artificial Sequence
  chemically synthesized
cagagctgagttcaattcttgg

SEQ ID NO: 1169301 - DNA, 22 bp, Artificial Sequence
  chemically synthesized
agttcaattcttggatatcctt

SEQ ID NO: 1169302 - DNA, 22 bp, Artificial Sequence
  chemically synthesized
aattcttggatatccttgttga

SEQ ID NO: 1169303 - DNA, 22 bp, Artificial Sequence
  chemically synthesized
ttggatatccttgttgacattc

SEQ ID NO: 1169304 - DNA, 22 bp, Artificial Sequence
  chemically synthesized
ggatatccttgttgacattctg

SEQ ID NO: 1169305 - DNA, 22 bp, Artificial Sequence
  chemically synthesized
gatatccttgttgacattctgt

SEQ ID NO: 1169306 - DNA, 22 bp, Artificial Sequence
  chemically synthesized
gacagatcagtgagacagaatg

SEQ ID NO: 1169307 - DNA, 22 bp, Artificial Sequence
  chemically synthesized
gttgacattctgtctcactgat

SEQ ID NO: 1169308 - DNA, 22 bp, Artificial Sequence
  chemically synthesized
ttgacattctgtctcactgatc

SEQ ID NO: 1169309 - DNA, 22 bp, Artificial Sequence
  chemically synthesized
acaacattagacagatcagtga

SEQ ID NO: 1169310 - DNA, 22 bp, Artificial Sequence
  chemically synthesized
acattctgtctcactgatctgt

SEQ ID NO: 1169311 - DNA, 22 bp, Artificial Sequence
  chemically synthesized
tgtctcactgatctgtctaatg

SEQ ID NO: 1169312 - DNA, 22 bp, Artificial Sequence
  chemically synthesized
tctcactgatctgtctaatgtt

SEQ ID NO: 1169313 - DNA, 22 bp, Artificial Sequence
  chemically synthesized
acaccccactgacaacattaga

SEQ ID NO: 1169314 - DNA, 22 bp, Artificial Sequence
  chemically synthesized
aacaccccactgacaacattag

SEQ ID NO: 1169315 - DNA, 22 bp, Artificial Sequence
  chemically synthesized
taacaccccactgacaacatta

SEQ ID NO: 1169316 - DNA, 22 bp, Artificial Sequence
  chemically synthesized
actgatctgtctaatgttgtca

SEQ ID NO: 1169317 - DNA, 22 bp, Artificial Sequence
  chemically synthesized
atctgtctaatgttgtcagtgg

SEQ ID NO: 1169318 - DNA, 22 bp, Artificial Sequence
  chemically synthesized
tctaatgttgtcagtggggtgt

SEQ ID NO: 1169319 - DNA, 22 bp, Artificial Sequence
  chemically synthesized
atgttgtcagtggggtgttaaa

SEQ ID NO: 1169320 - DNA, 22 bp, Artificial Sequence
  chemically synthesized
ataatgggagactttaacaccc

SEQ ID NO: 1169321 - DNA, 22 bp, Artificial Sequence
  chemically synthesized
tcagtggggtgttaaagtctcc

SEQ ID NO: 1169322 - DNA, 22 bp, Artificial Sequence
  chemically synthesized
ccacacgttaataatgggagac

SEQ ID NO: 1169323 - DNA, 22 bp, Artificial Sequence
  chemically synthesized
gactcccacacgttaataatgg

SEQ ID NO: 1169324 - DNA, 22 bp, Artificial Sequence
  chemically synthesized
agactcccacacgttaataatg

SEQ ID NO: 1169325 - DNA, 22 bp, Artificial Sequence
  chemically synthesized
aagtctcccattattaacgtgt

SEQ ID NO: 1169326 - DNA, 22 bp, Artificial Sequence
  chemically synthesized
ccattattaacgtgtgggagtc

SEQ ID NO: 1169327 - DNA, 22 bp, Artificial Sequence
  chemically synthesized
caaagagacttagactcccaca

SEQ ID NO: 1169328 - DNA, 22 bp, Artificial Sequence
  chemically synthesized
ttaacgtgtgggagtctaagtc

SEQ ID NO: 1169329 - DNA, 22 bp, Artificial Sequence
  chemically synthesized
tagacctacaaagagacttaga

SEQ ID NO: 1169330 - DNA, 22 bp, Artificial Sequence
  chemically synthesized
acgtgtgggagtctaagtctct

SEQ ID NO: 1169331 - DNA, 22 bp, Artificial Sequence
  chemically synthesized
atagacctacaaagagacttag

SEQ ID NO: 1169332 - DNA, 22 bp, Artificial Sequence
  chemically synthesized
agtctctttgtaggtctataag

SEQ ID NO: 1169333 - DNA, 22 bp, Artificial Sequence
  chemically synthesized
ataaagcaagtccttatagacc

SEQ ID NO: 1169334 - DNA, 22 bp, Artificial Sequence
  chemically synthesized
tttgtaggtctataaggacttg

SEQ ID NO: 1169335 - DNA, 22 bp, Artificial Sequence
  chemically synthesized
tgtaggtctataaggacttgct

SEQ ID NO: 1169336 - DNA, 22 bp, Artificial Sequence
  chemically synthesized
gtaggtctataaggacttgctt

SEQ ID NO: 1169337 - DNA, 22 bp, Artificial Sequence
  chemically synthesized
taggtctataaggacttgcttt

SEQ ID NO: 1169338 - DNA, 22 bp, Artificial Sequence
  chemically synthesized
aggagcacccagattcataaag

SEQ ID NO: 1169339 - DNA, 22 bp, Artificial Sequence
  chemically synthesized
taaggacttgctttatgaatct

SEQ ID NO: 1169340 - DNA, 22 bp, Artificial Sequence
  chemically synthesized
gctttatgaatctgggtgctcc

SEQ ID NO: 1169341 - DNA, 22 bp, Artificial Sequence
  chemically synthesized
ctttatgaatctgggtgctcct

SEQ ID NO: 1169342 - DNA, 22 bp, Artificial Sequence
  chemically synthesized
tatgaatctgggtgctcctgaa

SEQ ID NO: 1169343 - DNA, 22 bp, Artificial Sequence
  chemically synthesized
atgaatctgggtgctcctgaat

SEQ ID NO: 1169344 - DNA, 22 bp, Artificial Sequence
  chemically synthesized
tgaatctgggtgctcctgaatt

SEQ ID NO: 1169345 - DNA, 22 bp, Artificial Sequence
  chemically synthesized
aatatatatgcacccaattcag

SEQ ID NO: 1169346 - DNA, 22 bp, Artificial Sequence
  chemically synthesized
ggtgctcctgaattgggtgcat

SEQ ID NO: 1169347 - DNA, 22 bp, Artificial Sequence
  chemically synthesized
tcctaaatatatatgcacccaa

SEQ ID NO: 1169348 - DNA, 22 bp, Artificial Sequence
  chemically synthesized
actatcctaaatatatatgcac

SEQ ID NO: 1169349 - DNA, 22 bp, Artificial Sequence
  chemically synthesized
ctgaattgggtgcatatatatt

SEQ ID NO: 1169350 - DNA, 22 bp, Artificial Sequence
  chemically synthesized
aattgggtgcatatatatttag

SEQ ID NO: 1169351 - DNA, 22 bp, Artificial Sequence
  chemically synthesized
ggtgcatatatatttaggatag

SEQ ID NO: 1169352 - DNA, 22 bp, Artificial Sequence
  chemically synthesized
aacaagaagagctaactatcct

SEQ ID NO: 1169353 - DNA, 22 bp, Artificial Sequence
  chemically synthesized
aggatagttagctcttcttgtt

SEQ ID NO: 1169354 - DNA, 22 bp, Artificial Sequence
  chemically synthesized
ggatagttagctcttcttgttg

SEQ ID NO: 1169355 - DNA, 22 bp, Artificial Sequence
  chemically synthesized
gctcttcttgttgaattgatcc

SEQ ID NO: 1169356 - DNA, 22 bp, Artificial Sequence
  chemically synthesized
cataatggtaaagggatcaatt

SEQ ID NO: 1169357 - DNA, 22 bp, Artificial Sequence
  chemically synthesized
ttcttgttgaattgatcccttt

SEQ ID NO: 1169358 - DNA, 22 bp, Artificial Sequence
  chemically synthesized
cttgttgaattgatccctttac

SEQ ID NO: 1169359 - DNA, 22 bp, Artificial Sequence
  chemically synthesized
ttgttgaattgatccctttacc

SEQ ID NO: 1169360 - DNA, 22 bp, Artificial Sequence
  chemically synthesized
gttgaattgatccctttaccat

SEQ ID NO: 1169361 - DNA, 22 bp, Artificial Sequence
  chemically synthesized
ttgaattgatccctttaccatt

SEQ ID NO: 1169362 - DNA, 22 bp, Artificial Sequence
  chemically synthesized
aattgatccctttaccattatg

SEQ ID NO: 1169363 - DNA, 22 bp, Artificial Sequence
  chemically synthesized
atccctttaccattatgtaatg

SEQ ID NO: 1169364 - DNA, 22 bp, Artificial Sequence
  chemically synthesized
taccattatgtaatggccttct

SEQ ID NO: 1169365 - DNA, 22 bp, Artificial Sequence
  chemically synthesized
accattatgtaatggccttctt

SEQ ID NO: 1169366 - DNA, 22 bp, Artificial Sequence
  chemically synthesized
ccattatgtaatggccttcttt

SEQ ID NO: 1169367 - DNA, 22 bp, Artificial Sequence
  chemically synthesized
tgtaatggccttctttgtctct

SEQ ID NO: 1169368 - DNA, 22 bp, Artificial Sequence
  chemically synthesized
gaccaacaaagatcaaaagaga

SEQ ID NO: 1169369 - DNA, 22 bp, Artificial Sequence
  chemically synthesized
agaccaacaaagatcaaaagag

SEQ ID NO: 1169370 - DNA, 22 bp, Artificial Sequence
  chemically synthesized
tagaccaacaaagatcaaaaga

SEQ ID NO: 1169371 - DNA, 22 bp, Artificial Sequence
  chemically synthesized
ctttgtctcttttgatctttgt

SEQ ID NO: 1169372 - DNA, 22 bp, Artificial Sequence
  chemically synthesized
tttgtctcttttgatctttgtt

SEQ ID NO: 1169373 - DNA, 22 bp, Artificial Sequence
  chemically synthesized
tgtctcttttgatctttgttgg

SEQ ID NO: 1169374 - DNA, 22 bp, Artificial Sequence
  chemically synthesized
gtctcttttgatctttgttggt

SEQ ID NO: 1169375 - DNA, 22 bp, Artificial Sequence
  chemically synthesized
tctcttttgatctttgttggtc

SEQ ID NO: 1169376 - DNA, 22 bp, Artificial Sequence
  chemically synthesized
ataaaacagactttagaccaac

SEQ ID NO: 1169377 - DNA, 22 bp, Artificial Sequence
  chemically synthesized
ttttgatctttgttggtctaaa

SEQ ID NO: 1169378 - DNA, 22 bp, Artificial Sequence
  chemically synthesized
ttgatctttgttggtctaaagt

SEQ ID NO: 1169379 - DNA, 22 bp, Artificial Sequence
  chemically synthesized
tgatctttgttggtctaaagtc

SEQ ID NO: 1169380 - DNA, 22 bp, Artificial Sequence
  chemically synthesized
gatctttgttggtctaaagtct

SEQ ID NO: 1169381 - DNA, 22 bp, Artificial Sequence
  chemically synthesized
atctttgttggtctaaagtctg

SEQ ID NO: 1169382 - DNA, 22 bp, Artificial Sequence
  chemically synthesized
gtgtctgataaaacagacttta

SEQ ID NO: 1169383 - DNA, 22 bp, Artificial Sequence
  chemically synthesized
tgttggtctaaagtctgtttta

SEQ ID NO: 1169384 - DNA, 22 bp, Artificial Sequence
  chemically synthesized
gttggtctaaagtctgttttat

SEQ ID NO: 1169385 - DNA, 22 bp, Artificial Sequence
  chemically synthesized
ttggtctaaagtctgttttatc

SEQ ID NO: 1169386 - DNA, 22 bp, Artificial Sequence
  chemically synthesized
caatcctagtgtctgataaaac

SEQ ID NO: 1169387 - DNA, 22 bp, Artificial Sequence
  chemically synthesized
gtctaaagtctgttttatcaga

SEQ ID NO: 1169388 - DNA, 22 bp, Artificial Sequence
  chemically synthesized
aagtctgttttatcagacacta

SEQ ID NO: 1169389 - DNA, 22 bp, Artificial Sequence
  chemically synthesized
ttttatcagacactaggattgc

SEQ ID NO: 1169390 - DNA, 22 bp, Artificial Sequence
  chemically synthesized
tatcagacactaggattgcaac

SEQ ID NO: 1169391 - DNA, 22 bp, Artificial Sequence
  chemically synthesized
atcagacactaggattgcaacc

SEQ ID NO: 1169392 - DNA, 22 bp, Artificial Sequence
  chemically synthesized
tcagacactaggattgcaaccc

SEQ ID NO: 1169393 - DNA, 22 bp, Artificial Sequence
  chemically synthesized
aaaaaaaggcaggggttgcaat

SEQ ID NO: 1169394 - DNA, 22 bp, Artificial Sequence
  chemically synthesized
caaaaaaaggcaggggttgcaa

SEQ ID NO: 1169395 - DNA, 22 bp, Artificial Sequence
  chemically synthesized
tcaaaaaaaggcaggggttgca

SEQ ID NO: 1169396 - DNA, 22 bp, Artificial Sequence
  chemically synthesized
ttcaaaaaaaggcaggggttgc

SEQ ID NO: 1169397 - DNA, 22 bp, Artificial Sequence
  chemically synthesized
atgtttttcaaaaaaaggcagg

SEQ ID NO: 1169398 - DNA, 22 bp, Artificial Sequence
  chemically synthesized
ggattgcaacccctgccttttt

SEQ ID NO: 1169399 - DNA, 22 bp, Artificial Sequence
  chemically synthesized
agattaatgtttttcaaaaaaa

SEQ ID NO: 1169400 - DNA, 22 bp, Artificial Sequence
  chemically synthesized
caacccctgcctttttttgaaa

SEQ ID NO: 1169401 - DNA, 22 bp, Artificial Sequence
  chemically synthesized
cctttttttgaaaaacattaat

SEQ ID NO: 1169402 - DNA, 22 bp, Artificial Sequence
  chemically synthesized
atgtaggaattaagattaatgt

SEQ ID NO: 1169403 - DNA, 22 bp, Artificial Sequence
  chemically synthesized
aatgtaggaattaagattaatg

SEQ ID NO: 1169404 - DNA, 22 bp, Artificial Sequence
  chemically synthesized
tttttgaaaaacattaatctta

SEQ ID NO: 1169405 - DNA, 22 bp, Artificial Sequence
  chemically synthesized
taatgtaggaattaagattaat

SEQ ID NO: 1169406 - DNA, 22 bp, Artificial Sequence
  chemically synthesized
ttttgaaaaacattaatcttaa

SEQ ID NO: 1169407 - DNA, 22 bp, Artificial Sequence
  chemically synthesized
ttaatgtaggaattaagattaa

SEQ ID NO: 1169408 - DNA, 22 bp, Artificial Sequence
  chemically synthesized
tttgaaaaacattaatcttaat

SEQ ID NO: 1169409 - DNA, 22 bp, Artificial Sequence
  chemically synthesized
tttaatgtaggaattaagatta

SEQ ID NO: 1169410 - DNA, 22 bp, Artificial Sequence
  chemically synthesized
ttgaaaaacattaatcttaatt

SEQ ID NO: 1169411 - DNA, 22 bp, Artificial Sequence
  chemically synthesized
ttttaatgtaggaattaagatt

SEQ ID NO: 1169412 - DNA, 22 bp, Artificial Sequence
  chemically synthesized
tgaaaaacattaatcttaattc

SEQ ID NO: 1169413 - DNA, 22 bp, Artificial Sequence
  chemically synthesized
gaaaaacattaatcttaattcc

SEQ ID NO: 1169414 - DNA, 22 bp, Artificial Sequence
  chemically synthesized
aaaaacattaatcttaattcct

SEQ ID NO: 1169415 - DNA, 22 bp, Artificial Sequence
  chemically synthesized
ccagagccatttttttaatgta

SEQ ID NO: 1169416 - DNA, 22 bp, Artificial Sequence
  chemically synthesized
atcttaattcctacattaaaaa

SEQ ID NO: 1169417 - DNA, 22 bp, Artificial Sequence
  chemically synthesized
gccagagccatttttttaatgt

SEQ ID NO: 1169418 - DNA, 22 bp, Artificial Sequence
  chemically synthesized
tgccagagccatttttttaatg

SEQ ID NO: 1169419 - DNA, 22 bp, Artificial Sequence
  chemically synthesized
aattcctacattaaaaaaatgg

SEQ ID NO: 1169420 - DNA, 22 bp, Artificial Sequence
  chemically synthesized
attcctacattaaaaaaatggc

SEQ ID NO: 1169421 - DNA, 22 bp, Artificial Sequence
  chemically synthesized
ctacattaaaaaaatggctctg

SEQ ID NO: 1169422 - DNA, 22 bp, Artificial Sequence
  chemically synthesized
cattaaaaaaatggctctggca

SEQ ID NO: 1169423 - DNA, 22 bp, Artificial Sequence
  chemically synthesized
gaggatgagcaatctttgccag

SEQ ID NO: 1169424 - DNA, 22 bp, Artificial Sequence
  chemically synthesized
aaaaaatggctctggcaaagat

SEQ ID NO: 1169425 - DNA, 22 bp, Artificial Sequence
  chemically synthesized
tggcaaagattgctcatcctcc

SEQ ID NO: 1169426 - DNA, 22 bp, Artificial Sequence
  chemically synthesized
gcaaagattgctcatcctccaa

SEQ ID NO: 1169427 - DNA, 22 bp, Artificial Sequence
  chemically synthesized
ctcatcctccaatatgtatctt

SEQ ID NO: 1169428 - DNA, 22 bp, Artificial Sequence
  chemically synthesized
atcctccaatatgtatctttct

SEQ ID NO: 1169429 - DNA, 22 bp, Artificial Sequence
  chemically synthesized
cataaagggtgaagaaagatac

SEQ ID NO: 1169430 - DNA, 22 bp, Artificial Sequence
  chemically synthesized
caatatgtatctttcttcaccc

SEQ ID NO: 1169431 - DNA, 22 bp, Artificial Sequence
  chemically synthesized
atactacataaagggtgaagaa

SEQ ID NO: 1169432 - DNA, 22 bp, Artificial Sequence
  chemically synthesized
taatactacataaagggtgaag

SEQ ID NO: 1169433 - DNA, 22 bp, Artificial Sequence
  chemically synthesized
ctaatactacataaagggtgaa

SEQ ID NO: 1169434 - DNA, 22 bp, Artificial Sequence
  chemically synthesized
tctaatactacataaagggtga

SEQ ID NO: 1169435 - DNA, 22 bp, Artificial Sequence
  chemically synthesized
aactttctaatactacataaag

SEQ ID NO: 1169436 - DNA, 22 bp, Artificial Sequence
  chemically synthesized
tcttcaccctttatgtagtatt

SEQ ID NO: 1169437 - DNA, 22 bp, Artificial Sequence
  chemically synthesized
cttcaccctttatgtagtatta

SEQ ID NO: 1169438 - DNA, 22 bp, Artificial Sequence
  chemically synthesized
ttcaccctttatgtagtattag

SEQ ID NO: 1169439 - DNA, 22 bp, Artificial Sequence
  chemically synthesized
tcccctaaactttctaatacta

SEQ ID NO: 1169440 - DNA, 22 bp, Artificial Sequence
  chemically synthesized
caccctttatgtagtattagaa

SEQ ID NO: 1169441 - DNA, 22 bp, Artificial Sequence
  chemically synthesized
accctttatgtagtattagaaa

SEQ ID NO: 1169442 - DNA, 22 bp, Artificial Sequence
  chemically synthesized
tatgtagtattagaaagtttag

SEQ ID NO: 1169443 - DNA, 22 bp, Artificial Sequence
  chemically synthesized
atgtagtattagaaagtttagg

SEQ ID NO: 1169444 - DNA, 22 bp, Artificial Sequence
  chemically synthesized
tgtagtattagaaagtttaggg

SEQ ID NO: 1169445 - DNA, 22 bp, Artificial Sequence
  chemically synthesized
gatagccaaattgtcccctaaa

SEQ ID NO: 1169446 - DNA, 22 bp, Artificial Sequence
  chemically synthesized
tagatagccaaattgtccccta

SEQ ID NO: 1169447 - DNA, 22 bp, Artificial Sequence
  chemically synthesized
ctagatagccaaattgtcccct

SEQ ID NO: 1169448 - DNA, 22 bp, Artificial Sequence
  chemically synthesized
gaaagtttaggggacaatttgg

SEQ ID NO: 1169449 - DNA, 22 bp, Artificial Sequence
  chemically synthesized
tagtgacatttctagatagcca

SEQ ID NO: 1169450 - DNA, 22 bp, Artificial Sequence
  chemically synthesized
aggggacaatttggctatctag

SEQ ID NO: 1169451 - DNA, 22 bp, Artificial Sequence
  chemically synthesized
ggggacaatttggctatctaga

SEQ ID NO: 1169452 - DNA, 22 bp, Artificial Sequence
  chemically synthesized
ggctatctagaaatgtcactac

SEQ ID NO: 1169453 - DNA, 22 bp, Artificial Sequence
  chemically synthesized
gctatctagaaatgtcactaca

SEQ ID NO: 1169454 - DNA, 22 bp, Artificial Sequence
  chemically synthesized
tctagaaatgtcactacagttc

SEQ ID NO: 1169455 - DNA, 22 bp, Artificial Sequence
  chemically synthesized
caagggaaagtgggaactgtag

SEQ ID NO: 1169456 - DNA, 22 bp, Artificial Sequence
  chemically synthesized
gaaatgtcactacagttcccac

SEQ ID NO: 1169457 - DNA, 22 bp, Artificial Sequence
  chemically synthesized
actgcaagggaaagtgggaact

SEQ ID NO: 1169458 - DNA, 22 bp, Artificial Sequence
  chemically synthesized
cagttcccactttcccttgcag

SEQ ID NO: 1169459 - DNA, 22 bp, Artificial Sequence
  chemically synthesized
catgccacatctaactgcaagg

SEQ ID NO: 1169460 - DNA, 22 bp, Artificial Sequence
  chemically synthesized
ccactttcccttgcagttagat

SEQ ID NO: 1169461 - DNA, 22 bp, Artificial Sequence
  chemically synthesized
gttacatgccacatctaactgc

SEQ ID NO: 1169462 - DNA, 22 bp, Artificial Sequence
  chemically synthesized
ggttacatgccacatctaactg

SEQ ID NO: 1169463 - DNA, 22 bp, Artificial Sequence
  chemically synthesized
tcccttgcagttagatgtggca

SEQ ID NO: 1169464 - DNA, 22 bp, Artificial Sequence
  chemically synthesized
cccttgcagttagatgtggcat

SEQ ID NO: 1169465 - DNA, 22 bp, Artificial Sequence
  chemically synthesized
ccttgcagttagatgtggcatg

SEQ ID NO: 1169466 - DNA, 22 bp, Artificial Sequence
  chemically synthesized
gccaatacttggttacatgcca

SEQ ID NO: 1169467 - DNA, 22 bp, Artificial Sequence
  chemically synthesized
gcagttagatgtggcatgtaac

SEQ ID NO: 1169468 - DNA, 22 bp, Artificial Sequence
  chemically synthesized
cagttagatgtggcatgtaacc

SEQ ID NO: 1169469 - DNA, 22 bp, Artificial Sequence
  chemically synthesized
gatgtggcatgtaaccaagtat

SEQ ID NO: 1169470 - DNA, 22 bp, Artificial Sequence
  chemically synthesized
tatccaactggccaatacttgg

SEQ ID NO: 1169471 - DNA, 22 bp, Artificial Sequence
  chemically synthesized
gatgcgttatatccaactggcc

SEQ ID NO: 1169472 - DNA, 22 bp, Artificial Sequence
  chemically synthesized
atgacgaagttggatgcgttat

SEQ ID NO: 1169473 - DNA, 22 bp, Artificial Sequence
  chemically synthesized
gccagttggatataacgcatcc

SEQ ID NO: 1169474 - DNA, 22 bp, Artificial Sequence
  chemically synthesized
aatgacgaagttggatgcgtta

SEQ ID NO: 1169475 - DNA, 22 bp, Artificial Sequence
  chemically synthesized
cgtcttaatgacgaagttggat

SEQ ID NO: 1169476 - DNA, 22 bp, Artificial Sequence
  chemically synthesized
acgtcttaatgacgaagttgga

SEQ ID NO: 1169477 - DNA, 22 bp, Artificial Sequence
  chemically synthesized
gatataacgcatccaacttcgt

SEQ ID NO: 1169478 - DNA, 22 bp, Artificial Sequence
  chemically synthesized
tgcccatttacgtcttaatgac

SEQ ID NO: 1169479 - DNA, 22 bp, Artificial Sequence
  chemically synthesized
cgtcattaagacgtaaatgggc

SEQ ID NO: 1169480 - DNA, 22 bp, Artificial Sequence
  chemically synthesized
gtcattaagacgtaaatgggca

SEQ ID NO: 1169481 - DNA, 22 bp, Artificial Sequence
  chemically synthesized
agacgtaaatgggcatagatat

SEQ ID NO: 1169482 - DNA, 22 bp, Artificial Sequence
  chemically synthesized
aggagggaggacgaagaagaga

SEQ ID NO: 1169483 - DNA, 22 bp, Artificial Sequence
  chemically synthesized
caggagggaggacgaagaagag

SEQ ID NO: 1169484 - DNA, 22 bp, Artificial Sequence
  chemically synthesized
tcttcttcgtcctccctcctga

SEQ ID NO: 1169485 - DNA, 22 bp, Artificial Sequence
  chemically synthesized
ttcttcgtcctccctcctgaag

SEQ ID NO: 1169486 - DNA, 22 bp, Artificial Sequence
  chemically synthesized
cttcgtcctccctcctgaaggt

SEQ ID NO: 1169487 - DNA, 22 bp, Artificial Sequence
  chemically synthesized
ttcgtcctccctcctgaaggtc

SEQ ID NO: 1169488 - DNA, 22 bp, Artificial Sequence
  chemically synthesized
atgtgtgtatcacgaccttcag

SEQ ID NO: 1169489 - DNA, 22 bp, Artificial Sequence
  chemically synthesized
cgtcctccctcctgaaggtcgt

SEQ ID NO: 1169490 - DNA, 22 bp, Artificial Sequence
  chemically synthesized
catgtgtgtatcacgaccttca

SEQ ID NO: 1169491 - DNA, 22 bp, Artificial Sequence
  chemically synthesized
gtcctccctcctgaaggtcgtg

SEQ ID NO: 1169492 - DNA, 22 bp, Artificial Sequence
  chemically synthesized
cctcctgaaggtcgtgatacac

SEQ ID NO: 1169493 - DNA, 22 bp, Artificial Sequence
  chemically synthesized
accagcttcatgtgtgtatcac

SEQ ID NO: 1169494 - DNA, 22 bp, Artificial Sequence
  chemically synthesized
ctgaaggtcgtgatacacacat

SEQ ID NO: 1169495 - DNA, 22 bp, Artificial Sequence
  chemically synthesized
aaggtcgtgatacacacatgaa

SEQ ID NO: 1169496 - DNA, 22 bp, Artificial Sequence
  chemically synthesized
aggatagctcaccagcttcatg

SEQ ID NO: 1169497 - DNA, 22 bp, Artificial Sequence
  chemically synthesized
gtagtcacggttgaggatagct

SEQ ID NO: 1169498 - DNA, 22 bp, Artificial Sequence
  chemically synthesized
cgtagtcacggttgaggatagc

SEQ ID NO: 1169499 - DNA, 22 bp, Artificial Sequence
  chemically synthesized
tcttcgtagtcacggttgagga

SEQ ID NO: 1169500 - DNA, 22 bp, Artificial Sequence
  chemically synthesized
gtgagctatcctcaaccgtgac

SEQ ID NO: 1169501 - DNA, 22 bp, Artificial Sequence
  chemically synthesized
ggacgctgtcttcgtagtcacg

SEQ ID NO: 1169502 - DNA, 22 bp, Artificial Sequence
  chemically synthesized
tcctcaaccgtgactacgaaga

SEQ ID NO: 1169503 - DNA, 22 bp, Artificial Sequence
  chemically synthesized
aaccgtgactacgaagacagcg

SEQ ID NO: 1169504 - DNA, 22 bp, Artificial Sequence
  chemically synthesized
gatcatcccctgggacgctgtc

SEQ ID NO: 1169505 - DNA, 22 bp, Artificial Sequence
  chemically synthesized
cgatcatcccctgggacgctgt

SEQ ID NO: 1169506 - DNA, 22 bp, Artificial Sequence
  chemically synthesized
tcgatcatcccctgggacgctg

SEQ ID NO: 1169507 - DNA, 22 bp, Artificial Sequence
  chemically synthesized
ttcgatcatcccctgggacgct

SEQ ID NO: 1169508 - DNA, 22 bp, Artificial Sequence
  chemically synthesized
cgaagacagcgtcccaggggat

SEQ ID NO: 1169509 - DNA, 22 bp, Artificial Sequence
  chemically synthesized
cccagtttttcgatcatcccct

SEQ ID NO: 1169510 - DNA, 22 bp, Artificial Sequence
  chemically synthesized
ttgcccagtttttcgatcatcc

SEQ ID NO: 1169511 - DNA, 22 bp, Artificial Sequence
  chemically synthesized
agggatccatagtcctgttgcc

SEQ ID NO: 1169512 - DNA, 22 bp, Artificial Sequence
  chemically synthesized
attcagggatccatagtcctgt

SEQ ID NO: 1169513 - DNA, 22 bp, Artificial Sequence
  chemically synthesized
ctcattcagggatccatagtcc

SEQ ID NO: 1169514 - DNA, 22 bp, Artificial Sequence
  chemically synthesized
tgctcattcagggatccatagt

SEQ ID NO: 1169515 - DNA, 22 bp, Artificial Sequence
  chemically synthesized
ggcaacaggactatggatccct

SEQ ID NO: 1169516 - DNA, 22 bp, Artificial Sequence
  chemically synthesized
taggaagtctctgctcattcag

SEQ ID NO: 1169517 - DNA, 22 bp, Artificial Sequence
  chemically synthesized
gtaggaagtctctgctcattca

SEQ ID NO: 1169518 - DNA, 22 bp, Artificial Sequence
  chemically synthesized
tggatccctgaatgagcagaga

SEQ ID NO: 1169519 - DNA, 22 bp, Artificial Sequence
  chemically synthesized
aatgagcagagacttcctacaa

SEQ ID NO: 1169520 - DNA, 22 bp, Artificial Sequence
  chemically synthesized
tgtagatgggagtgatggaggc

SEQ ID NO: 1169521 - DNA, 22 bp, Artificial Sequence
  chemically synthesized
cctacaaggcctccatcactcc

SEQ ID NO: 1169522 - DNA, 22 bp, Artificial Sequence
  chemically synthesized
ctacaaggcctccatcactccc

SEQ ID NO: 1169523 - DNA, 22 bp, Artificial Sequence
  chemically synthesized
aatgttgtgtagatgggagtga

SEQ ID NO: 1169524 - DNA, 22 bp, Artificial Sequence
  chemically synthesized
caaggcctccatcactcccatc

SEQ ID NO: 1169525 - DNA, 22 bp, Artificial Sequence
  chemically synthesized
aaatgttgtgtagatgggagtg

SEQ ID NO: 1169526 - DNA, 22 bp, Artificial Sequence
  chemically synthesized
ttaaatgttgtgtagatgggag

SEQ ID NO: 1169527 - DNA, 22 bp, Artificial Sequence
  chemically synthesized
tcttaaatgttgtgtagatggg

SEQ ID NO: 1169528 - DNA, 22 bp, Artificial Sequence
  chemically synthesized
ctcttaaatgttgtgtagatgg

SEQ ID NO: 1169529 - DNA, 22 bp, Artificial Sequence
  chemically synthesized
cttctcttaaatgttgtgtaga

SEQ ID NO: 1169530 - DNA, 22 bp, Artificial Sequence
  chemically synthesized
catcactcccatctacacaaca

SEQ ID NO: 1169531 - DNA, 22 bp, Artificial Sequence
  chemically synthesized
acttctcttaaatgttgtgtag

SEQ ID NO: 1169532 - DNA, 22 bp, Artificial Sequence
  chemically synthesized
agacttacttctcttaaatgtt

SEQ ID NO: 1169533 - DNA, 22 bp, Artificial Sequence
  chemically synthesized
cagacttacttctcttaaatgt

SEQ ID NO: 1169534 - DNA, 22 bp, Artificial Sequence
  chemically synthesized
ccatctacacaacatttaagag

SEQ ID NO: 1169535 - DNA, 22 bp, Artificial Sequence
  chemically synthesized
tcagacttacttctcttaaatg

SEQ ID NO: 1169536 - DNA, 22 bp, Artificial Sequence
  chemically synthesized
tttcagacttacttctcttaaa

SEQ ID NO: 1169537 - DNA, 22 bp, Artificial Sequence
  chemically synthesized
tctttcagacttacttctctta

SEQ ID NO: 1169538 - DNA, 22 bp, Artificial Sequence
  chemically synthesized
ctctttcagacttacttctctt

SEQ ID NO: 1169539 - DNA, 22 bp, Artificial Sequence
  chemically synthesized
cacaacatttaagagaagtaag

SEQ ID NO: 1169540 - DNA, 22 bp, Artificial Sequence
  chemically synthesized
tttctctttcagacttacttct

SEQ ID NO: 1169541 - DNA, 22 bp, Artificial Sequence
  chemically synthesized
gtttctctttcagacttacttc

SEQ ID NO: 1169542 - DNA, 22 bp, Artificial Sequence
  chemically synthesized
aagagaagtaagtctgaaagag

SEQ ID NO: 1169543 - DNA, 22 bp, Artificial Sequence
  chemically synthesized
agagaagtaagtctgaaagaga

SEQ ID NO: 1169544 - DNA, 22 bp, Artificial Sequence
  chemically synthesized
aaaaatgagtttgtttctcttt

SEQ ID NO: 1169545 - DNA, 22 bp, Artificial Sequence
  chemically synthesized
aaagagaaacaaactcattttt

SEQ ID NO: 1169546 - DNA, 22 bp, Artificial Sequence
  chemically synthesized
acaaaaacacaaggatggatga

SEQ ID NO: 1169547 - DNA, 22 bp, Artificial Sequence
  chemically synthesized
attttttagttcatccatcctt

SEQ ID NO: 1169548 - DNA, 22 bp, Artificial Sequence
  chemically synthesized
tttagttcatccatccttgtgt

SEQ ID NO: 1169549 - DNA, 22 bp, Artificial Sequence
  chemically synthesized
ttagttcatccatccttgtgtt

SEQ ID NO: 1169550 - DNA, 22 bp, Artificial Sequence
  chemically synthesized
tagttcatccatccttgtgttt

SEQ ID NO: 1169551 - DNA, 22 bp, Artificial Sequence
  chemically synthesized
agttcatccatccttgtgtttt

SEQ ID NO: 1169552 - DNA, 22 bp, Artificial Sequence
  chemically synthesized
gtggcactaacaaaaacacaag

SEQ ID NO: 1169553 - DNA, 22 bp, Artificial Sequence
  chemically synthesized
gttcatccatccttgtgttttt

SEQ ID NO: 1169554 - DNA, 22 bp, Artificial Sequence
  chemically synthesized
cgtggcactaacaaaaacacaa

SEQ ID NO: 1169555 - DNA, 22 bp, Artificial Sequence
  chemically synthesized
atccatccttgtgtttttgtta

SEQ ID NO: 1169556 - DNA, 22 bp, Artificial Sequence
  chemically synthesized
taggtttcgtggcactaacaaa

SEQ ID NO: 1169557 - DNA, 22 bp, Artificial Sequence
  chemically synthesized
ctgtaggtttcgtggcactaac

SEQ ID NO: 1169558 - DNA, 22 bp, Artificial Sequence
  chemically synthesized
gtgtttttgttagtgccacgaa

SEQ ID NO: 1169559 - DNA, 22 bp, Artificial Sequence
  chemically synthesized
tgtttttgttagtgccacgaaa

SEQ ID NO: 1169560 - DNA, 22 bp, Artificial Sequence
  chemically synthesized
ttgttagtgccacgaaacctac

SEQ ID NO: 1169561 - DNA, 22 bp, Artificial Sequence
  chemically synthesized
tgttagtgccacgaaacctaca

SEQ ID NO: 1169562 - DNA, 22 bp, Artificial Sequence
  chemically synthesized
gttagtgccacgaaacctacag

SEQ ID NO: 1169563 - DNA, 22 bp, Artificial Sequence
  chemically synthesized
ttagtgccacgaaacctacagc

SEQ ID NO: 1169564 - DNA, 22 bp, Artificial Sequence
  chemically synthesized
gtgccacgaaacctacagcaat

SEQ ID NO: 1169565 - DNA, 22 bp, Artificial Sequence
  chemically synthesized
gagtatatcagtatatgagatt

SEQ ID NO: 1169566 - DNA, 22 bp, Artificial Sequence
  chemically synthesized
cagcaatctcatatactgatat

SEQ ID NO: 1169567 - DNA, 22 bp, Artificial Sequence
  chemically synthesized
gaaaattagagtatatcagtat

SEQ ID NO: 1169568 - DNA, 22 bp, Artificial Sequence
  chemically synthesized
ctagaaaattagagtatatcag

SEQ ID NO: 1169569 - DNA, 22 bp, Artificial Sequence
  chemically synthesized
agctgctagaaaattagagtat

SEQ ID NO: 1169570 - DNA, 22 bp, Artificial Sequence
  chemically synthesized
atatactgatatactctaattt

SEQ ID NO: 1169571 - DNA, 22 bp, Artificial Sequence
  chemically synthesized
atatactctaattttctagcag

SEQ ID NO: 1169572 - DNA, 22 bp, Artificial Sequence
  chemically synthesized
tagtaaaatctcagctgctaga

SEQ ID NO: 1169573 - DNA, 22 bp, Artificial Sequence
  chemically synthesized
atagtaaaatctcagctgctag

SEQ ID NO: 1169574 - DNA, 22 bp, Artificial Sequence
  chemically synthesized
tatagtaaaatctcagctgcta

SEQ ID NO: 1169575 - DNA, 22 bp, Artificial Sequence
  chemically synthesized
ttatagtaaaatctcagctgct

SEQ ID NO: 1169576 - DNA, 22 bp, Artificial Sequence
  chemically synthesized
taattttctagcagctgagatt

SEQ ID NO: 1169577 - DNA, 22 bp, Artificial Sequence
  chemically synthesized
attttctagcagctgagatttt

SEQ ID NO: 1169578 - DNA, 22 bp, Artificial Sequence
  chemically synthesized
tctagcagctgagattttacta

SEQ ID NO: 1169579 - DNA, 22 bp, Artificial Sequence
  chemically synthesized
ctagcagctgagattttactat

SEQ ID NO: 1169580 - DNA, 22 bp, Artificial Sequence
  chemically synthesized
tagcagctgagattttactata

SEQ ID NO: 1169581 - DNA, 22 bp, Artificial Sequence
  chemically synthesized
cagatacatttttatagtaaaa

SEQ ID NO: 1169582 - DNA, 22 bp, Artificial Sequence
  chemically synthesized
acagatacatttttatagtaaa

SEQ ID NO: 1169583 - DNA, 22 bp, Artificial Sequence
  chemically synthesized
gcagctgagattttactataaa

SEQ ID NO: 1169584 - DNA, 22 bp, Artificial Sequence
  chemically synthesized
tacagatacatttttatagtaa

SEQ ID NO: 1169585 - DNA, 22 bp, Artificial Sequence
  chemically synthesized
ttacagatacatttttatagta

SEQ ID NO: 1169586 - DNA, 22 bp, Artificial Sequence
  chemically synthesized
agattttactataaaaatgtat

SEQ ID NO: 1169587 - DNA, 22 bp, Artificial Sequence
  chemically synthesized
tactataaaaatgtatctgtaa

SEQ ID NO: 1169588 - DNA, 22 bp, Artificial Sequence
  chemically synthesized
acatataagcttttacagatac

SEQ ID NO: 1169589 - DNA, 22 bp, Artificial Sequence
  chemically synthesized
actataaaaatgtatctgtaaa

SEQ ID NO: 1169590 - DNA, 22 bp, Artificial Sequence
  chemically synthesized
ctataaaaatgtatctgtaaaa

SEQ ID NO: 1169591 - DNA, 22 bp, Artificial Sequence
  chemically synthesized
taaaaatgtatctgtaaaagct

SEQ ID NO: 1169592 - DNA, 22 bp, Artificial Sequence
  chemically synthesized
aactcacatataagcttttaca

SEQ ID NO: 1169593 - DNA, 22 bp, Artificial Sequence
  chemically synthesized
aaactcacatataagcttttac

SEQ ID NO: 1169594 - DNA, 22 bp, Artificial Sequence
  chemically synthesized
taaactcacatataagctttta

SEQ ID NO: 1169595 - DNA, 22 bp, Artificial Sequence
  chemically synthesized
ttttaaactcacatataagctt

SEQ ID NO: 1169596 - DNA, 22 bp, Artificial Sequence
  chemically synthesized
attttaaactcacatataagct

SEQ ID NO: 1169597 - DNA, 22 bp, Artificial Sequence
  chemically synthesized
taaaagcttatatgtgagttta

SEQ ID NO: 1169598 - DNA, 22 bp, Artificial Sequence
  chemically synthesized
tagtagaaagtttattttaaac

SEQ ID NO: 1169599 - DNA, 22 bp, Artificial Sequence
  chemically synthesized
atagtagaaagtttattttaaa

SEQ ID NO: 1169600 - DNA, 22 bp, Artificial Sequence
  chemically synthesized
tatagtagaaagtttattttaa

SEQ ID NO: 1169601 - DNA, 22 bp, Artificial Sequence
  chemically synthesized
atatgtgagtttaaaataaact

SEQ ID NO: 1169602 - DNA, 22 bp, Artificial Sequence
  chemically synthesized
tatgtgagtttaaaataaactt

SEQ ID NO: 1169603 - DNA, 22 bp, Artificial Sequence
  chemically synthesized
attttatagtagaaagtttatt

SEQ ID NO: 1169604 - DNA, 22 bp, Artificial Sequence
  chemically synthesized
aaaataaactttctactataaa

SEQ ID NO: 1169605 - DNA, 22 bp, Artificial Sequence
  chemically synthesized
aaataaactttctactataaaa

SEQ ID NO: 1169606 - DNA, 22 bp, Artificial Sequence
  chemically synthesized
gagagacatctgattttatagt

SEQ ID NO: 1169607 - DNA, 22 bp, Artificial Sequence
  chemically synthesized
agagagacatctgattttatag

SEQ ID NO: 1169608 - DNA, 22 bp, Artificial Sequence
  chemically synthesized
tagagagacatctgattttata

SEQ ID NO: 1169609 - DNA, 22 bp, Artificial Sequence
  chemically synthesized
tctactataaaatcagatgtct

SEQ ID NO: 1169610 - DNA, 22 bp, Artificial Sequence
  chemically synthesized
ctactataaaatcagatgtctc

SEQ ID NO: 1169611 - DNA, 22 bp, Artificial Sequence
  chemically synthesized
tactataaaatcagatgtctct

SEQ ID NO: 1169612 - DNA, 22 bp, Artificial Sequence
  chemically synthesized
ctataaaatcagatgtctctct

SEQ ID NO: 1169613 - DNA, 22 bp, Artificial Sequence
  chemically synthesized
taaaatcagatgtctctctaaa

SEQ ID NO: 1169614 - DNA, 22 bp, Artificial Sequence
  chemically synthesized
gagagacagagtagagttttag

SEQ ID NO: 1169615 - DNA, 22 bp, Artificial Sequence
  chemically synthesized
agagagacagagtagagtttta

SEQ ID NO: 1169616 - DNA, 22 bp, Artificial Sequence
  chemically synthesized
tagagagacagagtagagtttt

SEQ ID NO: 1169617 - DNA, 22 bp, Artificial Sequence
  chemically synthesized
tctaaaactctactctgtctct

SEQ ID NO: 1169618 - DNA, 22 bp, Artificial Sequence
  chemically synthesized
taaaactctactctgtctctct

SEQ ID NO: 1169619 - DNA, 22 bp, Artificial Sequence
  chemically synthesized
agagtatgttttagagagacag

SEQ ID NO: 1169620 - DNA, 22 bp, Artificial Sequence
  chemically synthesized
aaactctactctgtctctctaa

SEQ ID NO: 1169621 - DNA, 22 bp, Artificial Sequence
  chemically synthesized
attgagagtatgttttagagag

SEQ ID NO: 1169622 - DNA, 22 bp, Artificial Sequence
  chemically synthesized
cattgagagtatgttttagaga

SEQ ID NO: 1169623 - DNA, 22 bp, Artificial Sequence
  chemically synthesized
tactctgtctctctaaaacata

SEQ ID NO: 1169624 - DNA, 22 bp, Artificial Sequence
  chemically synthesized
ctctgtctctctaaaacatact

SEQ ID NO: 1169625 - DNA, 22 bp, Artificial Sequence
  chemically synthesized
gaaccttcattgagagtatgtt

SEQ ID NO: 1169626 - DNA, 22 bp, Artificial Sequence
  chemically synthesized
tgtctctctaaaacatactctc

SEQ ID NO: 1169627 - DNA, 22 bp, Artificial Sequence
  chemically synthesized
tctctctaaaacatactctcaa

SEQ ID NO: 1169628 - DNA, 22 bp, Artificial Sequence
  chemically synthesized
tctaaaacatactctcaatgaa

SEQ ID NO: 1169629 - DNA, 22 bp, Artificial Sequence
  chemically synthesized
taaaacatactctcaatgaagg

SEQ ID NO: 1169630 - DNA, 22 bp, Artificial Sequence
  chemically synthesized
aaacatactctcaatgaaggtt

SEQ ID NO: 1169631 - DNA, 22 bp, Artificial Sequence
  chemically synthesized
tcaatgaaggttccagtcattt

SEQ ID NO: 1169632 - DNA, 22 bp, Artificial Sequence
  chemically synthesized
aatgaaggttccagtcattttg

SEQ ID NO: 1169633 - DNA, 22 bp, Artificial Sequence
  chemically synthesized
aaaaacgatgaagcaaaatgac

SEQ ID NO: 1169634 - DNA, 22 bp, Artificial Sequence
  chemically synthesized
gaaaaacgatgaagcaaaatga

SEQ ID NO: 1169635 - DNA, 22 bp, Artificial Sequence
  chemically synthesized
cagtcattttgcttcatcgttt

SEQ ID NO: 1169636 - DNA, 22 bp, Artificial Sequence
  chemically synthesized
aaggtatgtgacttgaaaaacg

SEQ ID NO: 1169637 - DNA, 22 bp, Artificial Sequence
  chemically synthesized
tgcttcatcgtttttcaagtca

SEQ ID NO: 1169638 - DNA, 22 bp, Artificial Sequence
  chemically synthesized
gcttcatcgtttttcaagtcac

SEQ ID NO: 1169639 - DNA, 22 bp, Artificial Sequence
  chemically synthesized
cttcatcgtttttcaagtcaca

SEQ ID NO: 1169640 - DNA, 22 bp, Artificial Sequence
  chemically synthesized
catcgtttttcaagtcacatac

SEQ ID NO: 1169641 - DNA, 22 bp, Artificial Sequence
  chemically synthesized
atcgtttttcaagtcacatacc

SEQ ID NO: 1169642 - DNA, 22 bp, Artificial Sequence
  chemically synthesized
gtgtaatatctaaaggtatgtg

SEQ ID NO: 1169643 - DNA, 22 bp, Artificial Sequence
  chemically synthesized
ttcaagtcacatacctttagat

SEQ ID NO: 1169644 - DNA, 22 bp, Artificial Sequence
  chemically synthesized
tcaagtcacatacctttagata

SEQ ID NO: 1169645 - DNA, 22 bp, Artificial Sequence
  chemically synthesized
caagtcacatacctttagatat

SEQ ID NO: 1169646 - DNA, 22 bp, Artificial Sequence
  chemically synthesized
aagtcacatacctttagatatt

SEQ ID NO: 1169647 - DNA, 22 bp, Artificial Sequence
  chemically synthesized
caatgcaagggttagtgtaata

SEQ ID NO: 1169648 - DNA, 22 bp, Artificial Sequence
  chemically synthesized
ctacaatgcaagggttagtgta

SEQ ID NO: 1169649 - DNA, 22 bp, Artificial Sequence
  chemically synthesized
cctacaatgcaagggttagtgt

SEQ ID NO: 1169650 - DNA, 22 bp, Artificial Sequence
  chemically synthesized
tagatattacactaacccttgc

SEQ ID NO: 1169651 - DNA, 22 bp, Artificial Sequence
  chemically synthesized
agatattacactaacccttgca

SEQ ID NO: 1169652 - DNA, 22 bp, Artificial Sequence
  chemically synthesized
gatattacactaacccttgcat

SEQ ID NO: 1169653 - DNA, 22 bp, Artificial Sequence
  chemically synthesized
cactaacccttgcattgtagga

SEQ ID NO: 1169654 - DNA, 22 bp, Artificial Sequence
  chemically synthesized
acccttgcattgtaggaaggcg

SEQ ID NO: 1169655 - DNA, 22 bp, Artificial Sequence
  chemically synthesized
gcattgtaggaaggcggggaca

SEQ ID NO: 1169656 - DNA, 22 bp, Artificial Sequence
  chemically synthesized
cattgtaggaaggcggggacac

SEQ ID NO: 1169657 - DNA, 22 bp, Artificial Sequence
  chemically synthesized
ggcacggggtcagtgtccccgc

SEQ ID NO: 1169658 - DNA, 22 bp, Artificial Sequence
  chemically synthesized
ttaggcacggggtcagtgtccc

SEQ ID NO: 1169659 - DNA, 22 bp, Artificial Sequence
  chemically synthesized
taggaaggcggggacactgacc

SEQ ID NO: 1169660 - DNA, 22 bp, Artificial Sequence
  chemically synthesized
tgctgttaggcacggggtcagt

SEQ ID NO: 1169661 - DNA, 22 bp, Artificial Sequence
  chemically synthesized
tgtactgtgctgttaggcacgg

SEQ ID NO: 1169662 - DNA, 22 bp, Artificial Sequence
  chemically synthesized
tctgtgtactgtgctgttaggc

SEQ ID NO: 1169663 - DNA, 22 bp, Artificial Sequence
  chemically synthesized
ttatctgtgtactgtgctgtta

SEQ ID NO: 1169664 - DNA, 22 bp, Artificial Sequence
  chemically synthesized
attatctgtgtactgtgctgtt

SEQ ID NO: 1169665 - DNA, 22 bp, Artificial Sequence
  chemically synthesized
accccgtgcctaacagcacagt

SEQ ID NO: 1169666 - DNA, 22 bp, Artificial Sequence
  chemically synthesized
gtaaatatttattatctgtgta

SEQ ID NO: 1169667 - DNA, 22 bp, Artificial Sequence
  chemically synthesized
agtaaatatttattatctgtgt

SEQ ID NO: 1169668 - DNA, 22 bp, Artificial Sequence
  chemically synthesized
acagcacagtacacagataata

SEQ ID NO: 1169669 - DNA, 22 bp, Artificial Sequence
  chemically synthesized
ccccaaacaatttagtaaatat

SEQ ID NO: 1169670 - DNA, 22 bp, Artificial Sequence
  chemically synthesized
aaattaccccaaacaatttagt

SEQ ID NO: 1169671 - DNA, 22 bp, Artificial Sequence
  chemically synthesized
actaaattgtttggggtaattt

SEQ ID NO: 1169672 - DNA, 22 bp, Artificial Sequence
  chemically synthesized
aataagaaattaaaattacccc

SEQ ID NO: 1169673 - DNA, 22 bp, Artificial Sequence
  chemically synthesized
ctaaattgtttggggtaatttt

SEQ ID NO: 1169674 - DNA, 22 bp, Artificial Sequence
  chemically synthesized
aaataagaaattaaaattaccc

SEQ ID NO: 1169675 - DNA, 22 bp, Artificial Sequence
  chemically synthesized
aattgtttggggtaattttaat

SEQ ID NO: 1169676 - DNA, 22 bp, Artificial Sequence
  chemically synthesized
tttggggtaattttaatttctt

SEQ ID NO: 1169677 - DNA, 22 bp, Artificial Sequence
  chemically synthesized
ggggtaattttaatttcttatt

SEQ ID NO: 1169678 - DNA, 22 bp, Artificial Sequence
  chemically synthesized
gggtaattttaatttcttattt

SEQ ID NO: 1169679 - DNA, 22 bp, Artificial Sequence
  chemically synthesized
gaagcacaaatgaccttaaata

SEQ ID NO: 1169680 - DNA, 22 bp, Artificial Sequence
  chemically synthesized
taatttcttatttaaggtcatt

SEQ ID NO: 1169681 - DNA, 22 bp, Artificial Sequence
  chemically synthesized
aatttcttatttaaggtcattt

SEQ ID NO: 1169682 - DNA, 22 bp, Artificial Sequence
  chemically synthesized
atttcttatttaaggtcatttg

SEQ ID NO: 1169683 - DNA, 22 bp, Artificial Sequence
  chemically synthesized
aaattggaagcacaaatgacct

SEQ ID NO: 1169684 - DNA, 22 bp, Artificial Sequence
  chemically synthesized
cttatttaaggtcatttgtgct

SEQ ID NO: 1169685 - DNA, 22 bp, Artificial Sequence
  chemically synthesized
ttatttaaggtcatttgtgctt

SEQ ID NO: 1169686 - DNA, 22 bp, Artificial Sequence
  chemically synthesized
atttaaggtcatttgtgcttcc

SEQ ID NO: 1169687 - DNA, 22 bp, Artificial Sequence
  chemically synthesized
tttaaggtcatttgtgcttcca

SEQ ID NO: 1169688 - DNA, 22 bp, Artificial Sequence
  chemically synthesized
aaggtcatttgtgcttccaatt

SEQ ID NO: 1169689 - DNA, 22 bp, Artificial Sequence
  chemically synthesized
tataaaacctgaaattggaagc

SEQ ID NO: 1169690 - DNA, 22 bp, Artificial Sequence
  chemically synthesized
aggtcatttgtgcttccaattt

SEQ ID NO: 1169691 - DNA, 22 bp, Artificial Sequence
  chemically synthesized
atataaaacctgaaattggaag

SEQ ID NO: 1169692 - DNA, 22 bp, Artificial Sequence
  chemically synthesized
tatataaaacctgaaattggaa

SEQ ID NO: 1169693 - DNA, 22 bp, Artificial Sequence
  chemically synthesized
gtgcttccaatttcaggtttta

SEQ ID NO: 1169694 - DNA, 22 bp, Artificial Sequence
  chemically synthesized
tgcttccaatttcaggttttat

SEQ ID NO: 1169695 - DNA, 22 bp, Artificial Sequence
  chemically synthesized
aaacatattttatataaaacct

SEQ ID NO: 1169696 - DNA, 22 bp, Artificial Sequence
  chemically synthesized
ccaatttcaggttttatataaa

SEQ ID NO: 1169697 - DNA, 22 bp, Artificial Sequence
  chemically synthesized
gttaaaacatattttatataaa

SEQ ID NO: 1169698 - DNA, 22 bp, Artificial Sequence
  chemically synthesized
caatttcaggttttatataaaa

SEQ ID NO: 1169699 - DNA, 22 bp, Artificial Sequence
  chemically synthesized
attggttaaaacatattttata

SEQ ID NO: 1169700 - DNA, 22 bp, Artificial Sequence
  chemically synthesized
caggttttatataaaatatgtt

SEQ ID NO: 1169701 - DNA, 22 bp, Artificial Sequence
  chemically synthesized
aggttttatataaaatatgttt

SEQ ID NO: 1169702 - DNA, 22 bp, Artificial Sequence
  chemically synthesized
aaggtattgattggttaaaaca

SEQ ID NO: 1169703 - DNA, 22 bp, Artificial Sequence
  chemically synthesized
tatataaaatatgttttaacca

SEQ ID NO: 1169704 - DNA, 22 bp, Artificial Sequence
  chemically synthesized
caaggtattgattggttaaaac

SEQ ID NO: 1169705 - DNA, 22 bp, Artificial Sequence
  chemically synthesized
atataaaatatgttttaaccaa

SEQ ID NO: 1169706 - DNA, 22 bp, Artificial Sequence
  chemically synthesized
tcaaggtattgattggttaaaa

SEQ ID NO: 1169707 - DNA, 22 bp, Artificial Sequence
  chemically synthesized
tataaaatatgttttaaccaat

SEQ ID NO: 1169708 - DNA, 22 bp, Artificial Sequence
  chemically synthesized
cattttcaaggtattgattggt

SEQ ID NO: 1169709 - DNA, 22 bp, Artificial Sequence
  chemically synthesized
ctccattttcaaggtattgatt

SEQ ID NO: 1169710 - DNA, 22 bp, Artificial Sequence
  chemically synthesized
taaccaatcaataccttgaaaa

SEQ ID NO: 1169711 - DNA, 22 bp, Artificial Sequence
  chemically synthesized
aaccaatcaataccttgaaaat

SEQ ID NO: 1169712 - DNA, 22 bp, Artificial Sequence
  chemically synthesized
accaatcaataccttgaaaatg

SEQ ID NO: 1169713 - DNA, 22 bp, Artificial Sequence
  chemically synthesized
tgccatattactccattttcaa

SEQ ID NO: 1169714 - DNA, 22 bp, Artificial Sequence
  chemically synthesized
atgccatattactccattttca

SEQ ID NO: 1169715 - DNA, 22 bp, Artificial Sequence
  chemically synthesized
tatgccatattactccattttc

SEQ ID NO: 1169716 - DNA, 22 bp, Artificial Sequence
  chemically synthesized
tgaatattttatgccatattac

SEQ ID NO: 1169717 - DNA, 22 bp, Artificial Sequence
  chemically synthesized
gaaaatggagtaatatggcata

SEQ ID NO: 1169718 - DNA, 22 bp, Artificial Sequence
  chemically synthesized
aaaatggagtaatatggcataa

SEQ ID NO: 1169719 - DNA, 22 bp, Artificial Sequence
  chemically synthesized
aaactatgaatattttatgcca

SEQ ID NO: 1169720 - DNA, 22 bp, Artificial Sequence
  chemically synthesized
gaaactatgaatattttatgcc

SEQ ID NO: 1169721 - DNA, 22 bp, Artificial Sequence
  chemically synthesized
ggaagacatatatttgaaacta

SEQ ID NO: 1169722 - DNA, 22 bp, Artificial Sequence
  chemically synthesized
atagtttcaaatatatgtcttc

SEQ ID NO: 1169723 - DNA, 22 bp, Artificial Sequence
  chemically synthesized
caaatatatgtcttcccaatat

SEQ ID NO: 1169724 - DNA, 22 bp, Artificial Sequence
  chemically synthesized
aaatatatgtcttcccaatatt

SEQ ID NO: 1169725 - DNA, 22 bp, Artificial Sequence
  chemically synthesized
cccaatattcctattcatattt

SEQ ID NO: 1169726 - DNA, 22 bp, Artificial Sequence
  chemically synthesized
ccaatattcctattcatatttc

SEQ ID NO: 1169727 - DNA, 22 bp, Artificial Sequence
  chemically synthesized
ctattcatatttcatatgtgtt

SEQ ID NO: 1169728 - DNA, 22 bp, Artificial Sequence
  chemically synthesized
ttcatatttcatatgtgtttat

SEQ ID NO: 1169729 - DNA, 22 bp, Artificial Sequence
  chemically synthesized
atatttcatatgtgtttataca

SEQ ID NO: 1169730 - DNA, 22 bp, Artificial Sequence
  chemically synthesized
catatgtgtttatacatatata

SEQ ID NO: 1169731 - DNA, 22 bp, Artificial Sequence
  chemically synthesized
atatgtgtttatacatatatac

SEQ ID NO: 1169732 - DNA, 22 bp, Artificial Sequence
  chemically synthesized
tatatgtatgtgaatatgtata

SEQ ID NO: 1169733 - DNA, 22 bp, Artificial Sequence
  chemically synthesized
atacatatatacatattcacat

SEQ ID NO: 1169734 - DNA, 22 bp, Artificial Sequence
  chemically synthesized
tacatatatacatattcacata

SEQ ID NO: 1169735 - DNA, 22 bp, Artificial Sequence
  chemically synthesized
gtatactatatatgtatgtgaa

SEQ ID NO: 1169736 - DNA, 22 bp, Artificial Sequence
  chemically synthesized
acatacatatatagtataccaa

SEQ ID NO: 1169737 - DNA, 22 bp, Artificial Sequence
  chemically synthesized
atatgtgtgtgtgtgtgtgtgt

SEQ ID NO: 1169738 - DNA, 22 bp, Artificial Sequence
  chemically synthesized
tatgtgtgtgtgtgtgtgtgtg

SEQ ID NO: 1169739 - DNA, 22 bp, Artificial Sequence
  chemically synthesized
gaggaagaaaacacacacacac

SEQ ID NO: 1169740 - DNA, 22 bp, Artificial Sequence
  chemically synthesized
gagaaattagaggaagaaaaca

SEQ ID NO: 1169741 - DNA, 22 bp, Artificial Sequence
  chemically synthesized
tcttcctctaatttctctaatt

SEQ ID NO: 1169742 - DNA, 22 bp, Artificial Sequence
  chemically synthesized
cttcctctaatttctctaattc

SEQ ID NO: 1169743 - DNA, 22 bp, Artificial Sequence
  chemically synthesized
ttcctctaatttctctaattct

SEQ ID NO: 1169744 - DNA, 22 bp, Artificial Sequence
  chemically synthesized
cctctaatttctctaattctac

SEQ ID NO: 1169745 - DNA, 22 bp, Artificial Sequence
  chemically synthesized
ctctaatttctctaattctacc

SEQ ID NO: 1169746 - DNA, 22 bp, Artificial Sequence
  chemically synthesized
taatttctctaattctaccatt

SEQ ID NO: 1169747 - DNA, 22 bp, Artificial Sequence
  chemically synthesized
atttctctaattctaccattta

SEQ ID NO: 1169748 - DNA, 22 bp, Artificial Sequence
  chemically synthesized
ctctaattctaccatttatatc

SEQ ID NO: 1169749 - DNA, 22 bp, Artificial Sequence
  chemically synthesized
tctaattctaccatttatatct

SEQ ID NO: 1169750 - DNA, 22 bp, Artificial Sequence
  chemically synthesized
taattctaccatttatatcttt

SEQ ID NO: 1169751 - DNA, 22 bp, Artificial Sequence
  chemically synthesized
attctaccatttatatctttgg

SEQ ID NO: 1169752 - DNA, 22 bp, Artificial Sequence
  chemically synthesized
taccatttatatctttgggtat

SEQ ID NO: 1169753 - DNA, 22 bp, Artificial Sequence
  chemically synthesized
gaaagtaaatgtatacccaaag

SEQ ID NO: 1169754 - DNA, 22 bp, Artificial Sequence
  chemically synthesized
ccatttatatctttgggtatac

SEQ ID NO: 1169755 - DNA, 22 bp, Artificial Sequence
  chemically synthesized
atatctttgggtatacatttac

SEQ ID NO: 1169756 - DNA, 22 bp, Artificial Sequence
  chemically synthesized
tatctttgggtatacatttact

SEQ ID NO: 1169757 - DNA, 22 bp, Artificial Sequence
  chemically synthesized
tgggtatacatttactttctaa

SEQ ID NO: 1169758 - DNA, 22 bp, Artificial Sequence
  chemically synthesized
gggtatacatttactttctaac

SEQ ID NO: 1169759 - DNA, 22 bp, Artificial Sequence
  chemically synthesized
ggtatacatttactttctaact

SEQ ID NO: 1169760 - DNA, 22 bp, Artificial Sequence
  chemically synthesized
actttctaacttattttatatt

SEQ ID NO: 1169761 - DNA, 22 bp, Artificial Sequence
  chemically synthesized
ctttctaacttattttatattt

SEQ ID NO: 1169762 - DNA, 22 bp, Artificial Sequence
  chemically synthesized
tctaacttattttatattttat

SEQ ID NO: 1169763 - DNA, 22 bp, Artificial Sequence
  chemically synthesized
ctaacttattttatattttatt

SEQ ID NO: 1169764 - DNA, 22 bp, Artificial Sequence
  chemically synthesized
taacttattttatattttattc

SEQ ID NO: 1169765 - DNA, 22 bp, Artificial Sequence
  chemically synthesized
acttattttatattttattcct

SEQ ID NO: 1169766 - DNA, 22 bp, Artificial Sequence
  chemically synthesized
attttatattttattcctttat

SEQ ID NO: 1169767 - DNA, 22 bp, Artificial Sequence
  chemically synthesized
ttttatattttattcctttatt

SEQ ID NO: 1169768 - DNA, 22 bp, Artificial Sequence
  chemically synthesized
tatattttattcctttattttt

SEQ ID NO: 1169769 - DNA, 22 bp, Artificial Sequence
  chemically synthesized
atattttattcctttatttttt

SEQ ID NO: 1169770 - DNA, 22 bp, Artificial Sequence
  chemically synthesized
tattttattcctttattttttc

SEQ ID NO: 1169771 - DNA, 22 bp, Artificial Sequence
  chemically synthesized
aggtgaagtacaggaaaaaata

SEQ ID NO: 1169772 - DNA, 22 bp, Artificial Sequence
  chemically synthesized
tattcctttattttttcctgta

SEQ ID NO: 1169773 - DNA, 22 bp, Artificial Sequence
  chemically synthesized
attcctttattttttcctgtac

SEQ ID NO: 1169774 - DNA, 22 bp, Artificial Sequence
  chemically synthesized
ttcctttattttttcctgtact

SEQ ID NO: 1169775 - DNA, 22 bp, Artificial Sequence
  chemically synthesized
ctttattttttcctgtacttca

SEQ ID NO: 1169776 - DNA, 22 bp, Artificial Sequence
  chemically synthesized
tattttttcctgtacttcacct

SEQ ID NO: 1169777 - DNA, 22 bp, Artificial Sequence
  chemically synthesized
attttttcctgtacttcacctg

SEQ ID NO: 1169778 - DNA, 22 bp, Artificial Sequence
  chemically synthesized
ttttttcctgtacttcacctga

SEQ ID NO: 1169779 - DNA, 22 bp, Artificial Sequence
  chemically synthesized
tttcctgtacttcacctgagac

SEQ ID NO: 1169780 - DNA, 22 bp, Artificial Sequence
  chemically synthesized
ttcctgtacttcacctgagact

SEQ ID NO: 1169781 - DNA, 22 bp, Artificial Sequence
  chemically synthesized
tcctgtacttcacctgagactt

SEQ ID NO: 1169782 - DNA, 22 bp, Artificial Sequence
  chemically synthesized
cctgtacttcacctgagacttt

SEQ ID NO: 1169783 - DNA, 22 bp, Artificial Sequence
  chemically synthesized
ctgtacttcacctgagactttc

SEQ ID NO: 1169784 - DNA, 22 bp, Artificial Sequence
  chemically synthesized
taatagccaagacagaaagtct

SEQ ID NO: 1169785 - DNA, 22 bp, Artificial Sequence
  chemically synthesized
tacttcacctgagactttctgt

SEQ ID NO: 1169786 - DNA, 22 bp, Artificial Sequence
  chemically synthesized
cacctgagactttctgtcttgg

SEQ ID NO: 1169787 - DNA, 22 bp, Artificial Sequence
  chemically synthesized
acctgagactttctgtcttggc

SEQ ID NO: 1169788 - DNA, 22 bp, Artificial Sequence
  chemically synthesized
tgtggattataatagccaagac

SEQ ID NO: 1169789 - DNA, 22 bp, Artificial Sequence
  chemically synthesized
agactttctgtcttggctatta

SEQ ID NO: 1169790 - DNA, 22 bp, Artificial Sequence
  chemically synthesized
ttgtgtggattataatagccaa

SEQ ID NO: 1169791 - DNA, 22 bp, Artificial Sequence
  chemically synthesized
tattgtgtggattataatagcc

SEQ ID NO: 1169792 - DNA, 22 bp, Artificial Sequence
  chemically synthesized
tctgtcttggctattataatcc

SEQ ID NO: 1169793 - DNA, 22 bp, Artificial Sequence
  chemically synthesized
ctgtcttggctattataatcca

SEQ ID NO: 1169794 - DNA, 22 bp, Artificial Sequence
  chemically synthesized
tgtcttggctattataatccac

SEQ ID NO: 1169795 - DNA, 22 bp, Artificial Sequence
  chemically synthesized
tcttggctattataatccacac

SEQ ID NO: 1169796 - DNA, 22 bp, Artificial Sequence
  chemically synthesized
ggctattataatccacacaata

SEQ ID NO: 1169797 - DNA, 22 bp, Artificial Sequence
  chemically synthesized
tgagaaaggttctattgtgtgg

SEQ ID NO: 1169798 - DNA, 22 bp, Artificial Sequence
  chemically synthesized
gctattataatccacacaatag

SEQ ID NO: 1169799 - DNA, 22 bp, Artificial Sequence
  chemically synthesized
atgagaaaggttctattgtgtg

SEQ ID NO: 1169800 - DNA, 22 bp, Artificial Sequence
  chemically synthesized
tatgagaaaggttctattgtgt

SEQ ID NO: 1169801 - DNA, 22 bp, Artificial Sequence
  chemically synthesized
ttataatccacacaatagaacc

SEQ ID NO: 1169802 - DNA, 22 bp, Artificial Sequence
  chemically synthesized
attttatgagaaaggttctatt

SEQ ID NO: 1169803 - DNA, 22 bp, Artificial Sequence
  chemically synthesized
gattttatgagaaaggttctat

SEQ ID NO: 1169804 - DNA, 22 bp, Artificial Sequence
  chemically synthesized
taatccacacaatagaaccttt

SEQ ID NO: 1169805 - DNA, 22 bp, Artificial Sequence
  chemically synthesized
ttgattttatgagaaaggttct

SEQ ID NO: 1169806 - DNA, 22 bp, Artificial Sequence
  chemically synthesized
cttgattttatgagaaaggttc

SEQ ID NO: 1169807 - DNA, 22 bp, Artificial Sequence
  chemically synthesized
cttcttgattttatgagaaagg

SEQ ID NO: 1169808 - DNA, 22 bp, Artificial Sequence
  chemically synthesized
ccttcttgattttatgagaaag

SEQ ID NO: 1169809 - DNA, 22 bp, Artificial Sequence
  chemically synthesized
ttccttcttgattttatgagaa

SEQ ID NO: 1169810 - DNA, 22 bp, Artificial Sequence
  chemically synthesized
cttccttcttgattttatgaga

SEQ ID NO: 1169811 - DNA, 22 bp, Artificial Sequence
  chemically synthesized
tcttccttcttgattttatgag

SEQ ID NO: 1169812 - DNA, 22 bp, Artificial Sequence
  chemically synthesized
ttcttccttcttgattttatga

SEQ ID NO: 1169813 - DNA, 22 bp, Artificial Sequence
  chemically synthesized
tttcttccttcttgattttatg

SEQ ID NO: 1169814 - DNA, 22 bp, Artificial Sequence
  chemically synthesized
tttttcttccttcttgatttta

SEQ ID NO: 1169815 - DNA, 22 bp, Artificial Sequence
  chemically synthesized
ctttttcttccttcttgatttt

SEQ ID NO: 1169816 - DNA, 22 bp, Artificial Sequence
  chemically synthesized
tttctttttcttccttcttgat

SEQ ID NO: 1169817 - DNA, 22 bp, Artificial Sequence
  chemically synthesized
atttctttttcttccttcttga

SEQ ID NO: 1169818 - DNA, 22 bp, Artificial Sequence
  chemically synthesized
tctcataaaatcaagaaggaag

SEQ ID NO: 1169819 - DNA, 22 bp, Artificial Sequence
  chemically synthesized
ctcataaaatcaagaaggaaga

SEQ ID NO: 1169820 - DNA, 22 bp, Artificial Sequence
  chemically synthesized
tcataaaatcaagaaggaagaa

SEQ ID NO: 1169821 - DNA, 22 bp, Artificial Sequence
  chemically synthesized
ataaaatcaagaaggaagaaaa

SEQ ID NO: 1169822 - DNA, 22 bp, Artificial Sequence
  chemically synthesized
ccataacagtgcttatttcttt

SEQ ID NO: 1169823 - DNA, 22 bp, Artificial Sequence
  chemically synthesized
gccataacagtgcttatttctt

SEQ ID NO: 1169824 - DNA, 22 bp, Artificial Sequence
  chemically synthesized
ggagaatttgccataacagtgc

SEQ ID NO: 1169825 - DNA, 22 bp, Artificial Sequence
  chemically synthesized
aggagaatttgccataacagtg

SEQ ID NO: 1169826 - DNA, 22 bp, Artificial Sequence
  chemically synthesized
atttaggagaatttgccataac

SEQ ID NO: 1169827 - DNA, 22 bp, Artificial Sequence
  chemically synthesized
cattgatttaggagaatttgcc

SEQ ID NO: 1169828 - DNA, 22 bp, Artificial Sequence
  chemically synthesized
ccattgatttaggagaatttgc

SEQ ID NO: 1169829 - DNA, 22 bp, Artificial Sequence
  chemically synthesized
accttccattgatttaggagaa

SEQ ID NO: 1169830 - DNA, 22 bp, Artificial Sequence
  chemically synthesized
ttatggcaaattctcctaaatc

SEQ ID NO: 1169831 - DNA, 22 bp, Artificial Sequence
  chemically synthesized
tgaccttccattgatttaggag

SEQ ID NO: 1169832 - DNA, 22 bp, Artificial Sequence
  chemically synthesized
tctgaccttccattgatttagg

SEQ ID NO: 1169833 - DNA, 22 bp, Artificial Sequence
  chemically synthesized
tggcaaattctcctaaatcaat

SEQ ID NO: 1169834 - DNA, 22 bp, Artificial Sequence
  chemically synthesized
tctctgaccttccattgattta

SEQ ID NO: 1169835 - DNA, 22 bp, Artificial Sequence
  chemically synthesized
ctctctgaccttccattgattt

SEQ ID NO: 1169836 - DNA, 22 bp, Artificial Sequence
  chemically synthesized
tctctctgaccttccattgatt

SEQ ID NO: 1169837 - DNA, 22 bp, Artificial Sequence
  chemically synthesized
ttttctctctgaccttccattg

SEQ ID NO: 1169838 - DNA, 22 bp, Artificial Sequence
  chemically synthesized
ttattttctctctgaccttcca

SEQ ID NO: 1169839 - DNA, 22 bp, Artificial Sequence
  chemically synthesized
tcctaaatcaatggaaggtcag

SEQ ID NO: 1169840 - DNA, 22 bp, Artificial Sequence
  chemically synthesized
tattattttctctctgaccttc

SEQ ID NO: 1169841 - DNA, 22 bp, Artificial Sequence
  chemically synthesized
ctaaatcaatggaaggtcagag

SEQ ID NO: 1169842 - DNA, 22 bp, Artificial Sequence
  chemically synthesized
ctattattttctctctgacctt

SEQ ID NO: 1169843 - DNA, 22 bp, Artificial Sequence
  chemically synthesized
aatcaatggaaggtcagagaga

SEQ ID NO: 1169844 - DNA, 22 bp, Artificial Sequence
  chemically synthesized
aatcttctattattttctctct

SEQ ID NO: 1169845 - DNA, 22 bp, Artificial Sequence
  chemically synthesized
taaatcttctattattttctct

SEQ ID NO: 1169846 - DNA, 22 bp, Artificial Sequence
  chemically synthesized
tctaaatcttctattattttct

SEQ ID NO: 1169847 - DNA, 22 bp, Artificial Sequence
  chemically synthesized
ctctaaatcttctattattttc

SEQ ID NO: 1169848 - DNA, 22 bp, Artificial Sequence
  chemically synthesized
ggtacatttctctaaatcttct

SEQ ID NO: 1169849 - DNA, 22 bp, Artificial Sequence
  chemically synthesized
taggtacatttctctaaatctt

SEQ ID NO: 1169850 - DNA, 22 bp, Artificial Sequence
  chemically synthesized
ttctaggtacatttctctaaat

SEQ ID NO: 1169851 - DNA, 22 bp, Artificial Sequence
  chemically synthesized
aattgttctaggtacatttctc

SEQ ID NO: 1169852 - DNA, 22 bp, Artificial Sequence
  chemically synthesized
ttaaattgttctaggtacattt

SEQ ID NO: 1169853 - DNA, 22 bp, Artificial Sequence
  chemically synthesized
ggttattaaattgttctaggta

SEQ ID NO: 1169854 - DNA, 22 bp, Artificial Sequence
  chemically synthesized
agagaaatgtacctagaacaat

SEQ ID NO: 1169855 - DNA, 22 bp, Artificial Sequence
  chemically synthesized
gagaaatgtacctagaacaatt

SEQ ID NO: 1169856 - DNA, 22 bp, Artificial Sequence
  chemically synthesized
tattgggttattaaattgttct

SEQ ID NO: 1169857 - DNA, 22 bp, Artificial Sequence
  chemically synthesized
atattgggttattaaattgttc

SEQ ID NO: 1169858 - DNA, 22 bp, Artificial Sequence
  chemically synthesized
tatattgggttattaaattgtt

SEQ ID NO: 1169859 - DNA, 22 bp, Artificial Sequence
  chemically synthesized
ttatattgggttattaaattgt

SEQ ID NO: 1169860 - DNA, 22 bp, Artificial Sequence
  chemically synthesized
gaacaatttaataacccaatat

SEQ ID NO: 1169861 - DNA, 22 bp, Artificial Sequence
  chemically synthesized
aaaagaaatcttttatattggg

SEQ ID NO: 1169862 - DNA, 22 bp, Artificial Sequence
  chemically synthesized
aaaaagaaatcttttatattgg

SEQ ID NO: 1169863 - DNA, 22 bp, Artificial Sequence
  chemically synthesized
taaaaagaaatcttttatattg

SEQ ID NO: 1169864 - DNA, 22 bp, Artificial Sequence
  chemically synthesized
ttaaaaagaaatcttttatatt

SEQ ID NO: 1169865 - DNA, 22 bp, Artificial Sequence
  chemically synthesized
cttttaaaaagaaatcttttat

SEQ ID NO: 1169866 - DNA, 22 bp, Artificial Sequence
  chemically synthesized
aataacccaatataaaagattt

SEQ ID NO: 1169867 - DNA, 22 bp, Artificial Sequence
  chemically synthesized
gcttttaaaaagaaatctttta

SEQ ID NO: 1169868 - DNA, 22 bp, Artificial Sequence
  chemically synthesized
ataacccaatataaaagatttc

SEQ ID NO: 1169869 - DNA, 22 bp, Artificial Sequence
  chemically synthesized
taaacttgcttttaaaaagaaa

SEQ ID NO: 1169870 - DNA, 22 bp, Artificial Sequence
  chemically synthesized
ttataaacttgcttttaaaaag

SEQ ID NO: 1169871 - DNA, 22 bp, Artificial Sequence
  chemically synthesized
attataaacttgcttttaaaaa

SEQ ID NO: 1169872 - DNA, 22 bp, Artificial Sequence
  chemically synthesized
tattataaacttgcttttaaaa

SEQ ID NO: 1169873 - DNA, 22 bp, Artificial Sequence
  chemically synthesized
tgaaaattttattataaacttg

SEQ ID NO: 1169874 - DNA, 22 bp, Artificial Sequence
  chemically synthesized
ctttttaaaagcaagtttataa

SEQ ID NO: 1169875 - DNA, 22 bp, Artificial Sequence
  chemically synthesized
atgaaaattttattataaactt

SEQ ID NO: 1169876 - DNA, 22 bp, Artificial Sequence
  chemically synthesized
tttttaaaagcaagtttataat

SEQ ID NO: 1169877 - DNA, 22 bp, Artificial Sequence
  chemically synthesized
tttaaaagcaagtttataataa

SEQ ID NO: 1169878 - DNA, 22 bp, Artificial Sequence
  chemically synthesized
ttaaaagcaagtttataataaa

SEQ ID NO: 1169879 - DNA, 22 bp, Artificial Sequence
  chemically synthesized
taaaagcaagtttataataaaa

SEQ ID NO: 1169880 - DNA, 22 bp, Artificial Sequence
  chemically synthesized
aaaagcaagtttataataaaat

SEQ ID NO: 1169881 - DNA, 22 bp, Artificial Sequence
  chemically synthesized
atgcttatgaaaattttattat

SEQ ID NO: 1169882 - DNA, 22 bp, Artificial Sequence
  chemically synthesized
aaagcaagtttataataaaatt

SEQ ID NO: 1169883 - DNA, 22 bp, Artificial Sequence
  chemically synthesized
ttgatgcttatgaaaattttat

SEQ ID NO: 1169884 - DNA, 22 bp, Artificial Sequence
  chemically synthesized
attgatgcttatgaaaatttta

SEQ ID NO: 1169885 - DNA, 22 bp, Artificial Sequence
  chemically synthesized
tattgatgcttatgaaaatttt

SEQ ID NO: 1169886 - DNA, 22 bp, Artificial Sequence
  chemically synthesized
ttattgatgcttatgaaaattt

SEQ ID NO: 1169887 - DNA, 22 bp, Artificial Sequence
  chemically synthesized
tttattgatgcttatgaaaatt

SEQ ID NO: 1169888 - DNA, 22 bp, Artificial Sequence
  chemically synthesized
ttttattgatgcttatgaaaat

SEQ ID NO: 1169889 - DNA, 22 bp, Artificial Sequence
  chemically synthesized
ataataaaattttcataagcat

SEQ ID NO: 1169890 - DNA, 22 bp, Artificial Sequence
  chemically synthesized
taataaaattttcataagcatc

SEQ ID NO: 1169891 - DNA, 22 bp, Artificial Sequence
  chemically synthesized
agaaagtttttttattgatgct

SEQ ID NO: 1169892 - DNA, 22 bp, Artificial Sequence
  chemically synthesized
tgagaaagtttttttattgatg

SEQ ID NO: 1169893 - DNA, 22 bp, Artificial Sequence
  chemically synthesized
ctgagaaagtttttttattgat

SEQ ID NO: 1169894 - DNA, 22 bp, Artificial Sequence
  chemically synthesized
tcataagcatcaataaaaaaac

SEQ ID NO: 1169895 - DNA, 22 bp, Artificial Sequence
  chemically synthesized
cataagcatcaataaaaaaact

SEQ ID NO: 1169896 - DNA, 22 bp, Artificial Sequence
  chemically synthesized
ataagcatcaataaaaaaactt

SEQ ID NO: 1169897 - DNA, 22 bp, Artificial Sequence
  chemically synthesized
ataaatttctgagaaagttttt

SEQ ID NO: 1169898 - DNA, 22 bp, Artificial Sequence
  chemically synthesized
atgtgccatctaataaatttct

SEQ ID NO: 1169899 - DNA, 22 bp, Artificial Sequence
  chemically synthesized
catgtgccatctaataaatttc

SEQ ID NO: 1169900 - DNA, 22 bp, Artificial Sequence
  chemically synthesized
tcatgtgccatctaataaattt

SEQ ID NO: 1169901 - DNA, 22 bp, Artificial Sequence
  chemically synthesized
tctcagaaatttattagatggc

SEQ ID NO: 1169902 - DNA, 22 bp, Artificial Sequence
  chemically synthesized
ctcagaaatttattagatggca

SEQ ID NO: 1169903 - DNA, 22 bp, Artificial Sequence
  chemically synthesized
tcagaaatttattagatggcac

SEQ ID NO: 1169904 - DNA, 22 bp, Artificial Sequence
  chemically synthesized
gacgtctttcatgtgccatcta

SEQ ID NO: 1169905 - DNA, 22 bp, Artificial Sequence
  chemically synthesized
agaaatttattagatggcacat

SEQ ID NO: 1169906 - DNA, 22 bp, Artificial Sequence
  chemically synthesized
ggctagacgtctttcatgtgcc

SEQ ID NO: 1169907 - DNA, 22 bp, Artificial Sequence
  chemically synthesized
attagatggcacatgaaagacg

SEQ ID NO: 1169908 - DNA, 22 bp, Artificial Sequence
  chemically synthesized
ttagatggcacatgaaagacgt

SEQ ID NO: 1169909 - DNA, 22 bp, Artificial Sequence
  chemically synthesized
gatggcacatgaaagacgtcta

SEQ ID NO: 1169910 - DNA, 22 bp, Artificial Sequence
  chemically synthesized
tatgaaacagtaagaacaaaga

SEQ ID NO: 1169911 - DNA, 22 bp, Artificial Sequence
  chemically synthesized
gcctagtgatttctttgttctt

SEQ ID NO: 1169912 - DNA, 22 bp, Artificial Sequence
  chemically synthesized
gtgatttctttgttcttactgt

SEQ ID NO: 1169913 - DNA, 22 bp, Artificial Sequence
  chemically synthesized
taagaattatatgaaacagtaa

SEQ ID NO: 1169914 - DNA, 22 bp, Artificial Sequence
  chemically synthesized
gtaagaattatatgaaacagta

SEQ ID NO: 1169915 - DNA, 22 bp, Artificial Sequence
  chemically synthesized
ctttgttcttactgtttcatat

SEQ ID NO: 1169916 - DNA, 22 bp, Artificial Sequence
  chemically synthesized
tttgttcttactgtttcatata

SEQ ID NO: 1169917 - DNA, 22 bp, Artificial Sequence
  chemically synthesized
tgttcttactgtttcatataat

SEQ ID NO: 1169918 - DNA, 22 bp, Artificial Sequence
  chemically synthesized
gttcttactgtttcatataatt

SEQ ID NO: 1169919 - DNA, 22 bp, Artificial Sequence
  chemically synthesized
ttcttactgtttcatataattc

SEQ ID NO: 1169920 - DNA, 22 bp, Artificial Sequence
  chemically synthesized
gggtgtttgtaagaattatatg

SEQ ID NO: 1169921 - DNA, 22 bp, Artificial Sequence
  chemically synthesized
agggtgtttgtaagaattatat

SEQ ID NO: 1169922 - DNA, 22 bp, Artificial Sequence
  chemically synthesized
tagggtgtttgtaagaattata

SEQ ID NO: 1169923 - DNA, 22 bp, Artificial Sequence
  chemically synthesized
ttactgtttcatataattctta

SEQ ID NO: 1169924 - DNA, 22 bp, Artificial Sequence
  chemically synthesized
ttagggtgtttgtaagaattat

SEQ ID NO: 1169925 - DNA, 22 bp, Artificial Sequence
  chemically synthesized
actgtttcatataattcttaca

SEQ ID NO: 1169926 - DNA, 22 bp, Artificial Sequence
  chemically synthesized
ctgtttcatataattcttacaa

SEQ ID NO: 1169927 - DNA, 22 bp, Artificial Sequence
  chemically synthesized
tttcatataattcttacaaaca

SEQ ID NO: 1169928 - DNA, 22 bp, Artificial Sequence
  chemically synthesized
catataattcttacaaacaccc

SEQ ID NO: 1169929 - DNA, 22 bp, Artificial Sequence
  chemically synthesized
atataattcttacaaacaccct

SEQ ID NO: 1169930 - DNA, 22 bp, Artificial Sequence
  chemically synthesized
gaaataggtccccccttttagg

SEQ ID NO: 1169931 - DNA, 22 bp, Artificial Sequence
  chemically synthesized
ggaaataggtccccccttttag

SEQ ID NO: 1169932 - DNA, 22 bp, Artificial Sequence
  chemically synthesized
ttacaaacaccctaaaaggggg

SEQ ID NO: 1169933 - DNA, 22 bp, Artificial Sequence
  chemically synthesized
acaaacaccctaaaagggggga

SEQ ID NO: 1169934 - DNA, 22 bp, Artificial Sequence
  chemically synthesized
caaacaccctaaaaggggggac

SEQ ID NO: 1169935 - DNA, 22 bp, Artificial Sequence
  chemically synthesized
atcttggaaataggtcccccct

SEQ ID NO: 1169936 - DNA, 22 bp, Artificial Sequence
  chemically synthesized
atcctcatcttggaaataggtc

SEQ ID NO: 1169937 - DNA, 22 bp, Artificial Sequence
  chemically synthesized
ctcatcctcatcttggaaatag

SEQ ID NO: 1169938 - DNA, 22 bp, Artificial Sequence
  chemically synthesized
aaaggggggacctatttccaag

SEQ ID NO: 1169939 - DNA, 22 bp, Artificial Sequence
  chemically synthesized
cctcatcctcatcttggaaata

SEQ ID NO: 1169940 - DNA, 22 bp, Artificial Sequence
  chemically synthesized
gatttcctcatcctcatcttgg

SEQ ID NO: 1169941 - DNA, 22 bp, Artificial Sequence
  chemically synthesized
ggatttcctcatcctcatcttg

SEQ ID NO: 1169942 - DNA, 22 bp, Artificial Sequence
  chemically synthesized
tttccaagatgaggatgaggaa

SEQ ID NO: 1169943 - DNA, 22 bp, Artificial Sequence
  chemically synthesized
ccaagatgaggatgaggaaatc

SEQ ID NO: 1169944 - DNA, 22 bp, Artificial Sequence
  chemically synthesized
caagatgaggatgaggaaatcc

SEQ ID NO: 1169945 - DNA, 22 bp, Artificial Sequence
  chemically synthesized
ataggtgtgacttggatttcct

SEQ ID NO: 1169946 - DNA, 22 bp, Artificial Sequence
  chemically synthesized
ccacacctcataggtgtgactt

SEQ ID NO: 1169947 - DNA, 22 bp, Artificial Sequence
  chemically synthesized
ctcccacacctcataggtgtga

SEQ ID NO: 1169948 - DNA, 22 bp, Artificial Sequence
  chemically synthesized
cctcccacacctcataggtgtg

SEQ ID NO: 1169949 - DNA, 22 bp, Artificial Sequence
  chemically synthesized
tcctcccacacctcataggtgt

SEQ ID NO: 1169950 - DNA, 22 bp, Artificial Sequence
  chemically synthesized
ttcctcccacacctcataggtg

SEQ ID NO: 1169951 - DNA, 22 bp, Artificial Sequence
  chemically synthesized
ggtatcccatttttcctcccac

SEQ ID NO: 1169952 - DNA, 22 bp, Artificial Sequence
  chemically synthesized
ctgggtatcccatttttcctcc

SEQ ID NO: 1169953 - DNA, 22 bp, Artificial Sequence
  chemically synthesized
actgggtatcccatttttcctc

SEQ ID NO: 1169954 - DNA, 22 bp, Artificial Sequence
  chemically synthesized
tgaggtgtgggaggaaaaatgg

SEQ ID NO: 1169955 - DNA, 22 bp, Artificial Sequence
  chemically synthesized
tttactgggtatcccatttttc

SEQ ID NO: 1169956 - DNA, 22 bp, Artificial Sequence
  chemically synthesized
gtttactgggtatcccattttt

SEQ ID NO: 1169957 - DNA, 22 bp, Artificial Sequence
  chemically synthesized
tcagccaaggaatgtcggtttg

SEQ ID NO: 1169958 - DNA, 22 bp, Artificial Sequence
  chemically synthesized
tgtcagccaaggaatgtcggtt

SEQ ID NO: 1169959 - DNA, 22 bp, Artificial Sequence
  chemically synthesized
atgaatctctgtcagccaagga

SEQ ID NO: 1169960 - DNA, 22 bp, Artificial Sequence
  chemically synthesized
catgaatctctgtcagccaagg

SEQ ID NO: 1169961 - DNA, 22 bp, Artificial Sequence
  chemically synthesized
gacttcatgaatctctgtcagc

SEQ ID NO: 1169962 - DNA, 22 bp, Artificial Sequence
  chemically synthesized
tggacttcatgaatctctgtca

SEQ ID NO: 1169963 - DNA, 22 bp, Artificial Sequence
  chemically synthesized
tctggacttcatgaatctctgt

SEQ ID NO: 1169964 - DNA, 22 bp, Artificial Sequence
  chemically synthesized
ctctggacttcatgaatctctg

SEQ ID NO: 1169965 - DNA, 22 bp, Artificial Sequence
  chemically synthesized
ttctctggacttcatgaatctc

SEQ ID NO: 1169966 - DNA, 22 bp, Artificial Sequence
  chemically synthesized
cttggctgacagagattcatga

SEQ ID NO: 1169967 - DNA, 22 bp, Artificial Sequence
  chemically synthesized
cttctctggacttcatgaatct

SEQ ID NO: 1169968 - DNA, 22 bp, Artificial Sequence
  chemically synthesized
ggctgacagagattcatgaagt

SEQ ID NO: 1169969 - DNA, 22 bp, Artificial Sequence
  chemically synthesized
gctgacagagattcatgaagtc

SEQ ID NO: 1169970 - DNA, 22 bp, Artificial Sequence
  chemically synthesized
atccttcttctctggacttcat

SEQ ID NO: 1169971 - DNA, 22 bp, Artificial Sequence
  chemically synthesized
acagagattcatgaagtccaga

SEQ ID NO: 1169972 - DNA, 22 bp, Artificial Sequence
  chemically synthesized
tgttcatccttcttctctggac

SEQ ID NO: 1169973 - DNA, 22 bp, Artificial Sequence
  chemically synthesized
ttatgttcatccttcttctctg

SEQ ID NO: 1169974 - DNA, 22 bp, Artificial Sequence
  chemically synthesized
atgaagtccagagaagaaggat

SEQ ID NO: 1169975 - DNA, 22 bp, Artificial Sequence
  chemically synthesized
aaacatccaccaaacagtacag

SEQ ID NO: 1169976 - DNA, 22 bp, Artificial Sequence
  chemically synthesized
ttgaaacatccaccaaacagta

SEQ ID NO: 1169977 - DNA, 22 bp, Artificial Sequence
  chemically synthesized
aaattattgaaacatccaccaa

SEQ ID NO: 1169978 - DNA, 22 bp, Artificial Sequence
  chemically synthesized
aaaattattgaaacatccacca

SEQ ID NO: 1169979 - DNA, 22 bp, Artificial Sequence
  chemically synthesized
taaaattattgaaacatccacc

SEQ ID NO: 1169980 - DNA, 22 bp, Artificial Sequence
  chemically synthesized
ttaaaattattgaaacatccac

SEQ ID NO: 1169981 - DNA, 22 bp, Artificial Sequence
  chemically synthesized
tgtactgtttggtggatgtttc

SEQ ID NO: 1169982 - DNA, 22 bp, Artificial Sequence
  chemically synthesized
tactgtttggtggatgtttcaa

SEQ ID NO: 1169983 - DNA, 22 bp, Artificial Sequence
  chemically synthesized
acttttaaaattattgaaacat

SEQ ID NO: 1169984 - DNA, 22 bp, Artificial Sequence
  chemically synthesized
tttggtggatgtttcaataatt

SEQ ID NO: 1169985 - DNA, 22 bp, Artificial Sequence
  chemically synthesized
ggtggatgtttcaataatttta

SEQ ID NO: 1169986 - DNA, 22 bp, Artificial Sequence
  chemically synthesized
gtggatgtttcaataattttaa

SEQ ID NO: 1169987 - DNA, 22 bp, Artificial Sequence
  chemically synthesized
caaccaaatactgacttttaaa

SEQ ID NO: 1169988 - DNA, 22 bp, Artificial Sequence
  chemically synthesized
caataattttaaaagtcagtat

SEQ ID NO: 1169989 - DNA, 22 bp, Artificial Sequence
  chemically synthesized
aataattttaaaagtcagtatt

SEQ ID NO: 1169990 - DNA, 22 bp, Artificial Sequence
  chemically synthesized
atatgaattccaaccaaatact

SEQ ID NO: 1169991 - DNA, 22 bp, Artificial Sequence
  chemically synthesized
taaaagtcagtatttggttgga

SEQ ID NO: 1169992 - DNA, 22 bp, Artificial Sequence
  chemically synthesized
aaaagtcagtatttggttggaa

SEQ ID NO: 1169993 - DNA, 22 bp, Artificial Sequence
  chemically synthesized
aaagtcagtatttggttggaat

SEQ ID NO: 1169994 - DNA, 22 bp, Artificial Sequence
  chemically synthesized
ccaactcatatgaattccaacc

SEQ ID NO: 1169995 - DNA, 22 bp, Artificial Sequence
  chemically synthesized
aattaccaactcatatgaattc

SEQ ID NO: 1169996 - DNA, 22 bp, Artificial Sequence
  chemically synthesized
caattaccaactcatatgaatt

SEQ ID NO: 1169997 - DNA, 22 bp, Artificial Sequence
  chemically synthesized
gtttcaattaccaactcatatg

SEQ ID NO: 1169998 - DNA, 22 bp, Artificial Sequence
  chemically synthesized
ggttggaattcatatgagttgg

SEQ ID NO: 1169999 - DNA, 22 bp, Artificial Sequence
  chemically synthesized
gttggaattcatatgagttggt

SEQ ID NO: 1170000 - DNA, 22 bp, Artificial Sequence
  chemically synthesized
gaattcatatgagttggtaatt

SEQ ID NO: 1170001 - DNA, 22 bp, Artificial Sequence
  chemically synthesized
caaaatctcgtttcaattacca

SEQ ID NO: 1170002 - DNA, 22 bp, Artificial Sequence
  chemically synthesized
acaaaatctcgtttcaattacc

SEQ ID NO: 1170003 - DNA, 22 bp, Artificial Sequence
  chemically synthesized
tacaaaatctcgtttcaattac

SEQ ID NO: 1170004 - DNA, 22 bp, Artificial Sequence
  chemically synthesized
ttacaaaatctcgtttcaatta

SEQ ID NO: 1170005 - DNA, 22 bp, Artificial Sequence
  chemically synthesized
atatgagttggtaattgaaacg

SEQ ID NO: 1170006 - DNA, 22 bp, Artificial Sequence
  chemically synthesized
gtacttttacaaaatctcgttt

SEQ ID NO: 1170007 - DNA, 22 bp, Artificial Sequence
  chemically synthesized
agtacttttacaaaatctcgtt

SEQ ID NO: 1170008 - DNA, 22 bp, Artificial Sequence
  chemically synthesized
gtaattgaaacgagattttgta

SEQ ID NO: 1170009 - DNA, 22 bp, Artificial Sequence
  chemically synthesized
aatttagtacttttacaaaatc

SEQ ID NO: 1170010 - DNA, 22 bp, Artificial Sequence
  chemically synthesized
aattaaatttagtacttttaca

SEQ ID NO: 1170011 - DNA, 22 bp, Artificial Sequence
  chemically synthesized
aaacgagattttgtaaaagtac

SEQ ID NO: 1170012 - DNA, 22 bp, Artificial Sequence
  chemically synthesized
aaattaaatttagtacttttac

SEQ ID NO: 1170013 - DNA, 22 bp, Artificial Sequence
  chemically synthesized
taaattaaatttagtactttta

SEQ ID NO: 1170014 - DNA, 22 bp, Artificial Sequence
  chemically synthesized
ttttaaattaaatttagtactt

SEQ ID NO: 1170015 - DNA, 22 bp, Artificial Sequence
  chemically synthesized
tcctattttaaattaaatttag

SEQ ID NO: 1170016 - DNA, 22 bp, Artificial Sequence
  chemically synthesized
tgtaaaagtactaaatttaatt

SEQ ID NO: 1170017 - DNA, 22 bp, Artificial Sequence
  chemically synthesized
gtaaaagtactaaatttaattt

SEQ ID NO: 1170018 - DNA, 22 bp, Artificial Sequence
  chemically synthesized
taaaagtactaaatttaattta

SEQ ID NO: 1170019 - DNA, 22 bp, Artificial Sequence
  chemically synthesized
taactatcctattttaaattaa

SEQ ID NO: 1170020 - DNA, 22 bp, Artificial Sequence
  chemically synthesized
gtaactatcctattttaaatta

SEQ ID NO: 1170021 - DNA, 22 bp, Artificial Sequence
  chemically synthesized
tgtaactatcctattttaaatt

SEQ ID NO: 1170022 - DNA, 22 bp, Artificial Sequence
  chemically synthesized
aatttaatttaaaataggatag

SEQ ID NO: 1170023 - DNA, 22 bp, Artificial Sequence
  chemically synthesized
agacattttgtaactatcctat

SEQ ID NO: 1170024 - DNA, 22 bp, Artificial Sequence
  chemically synthesized
tgagacattttgtaactatcct

SEQ ID NO: 1170025 - DNA, 22 bp, Artificial Sequence
  chemically synthesized
ctgagacattttgtaactatcc

SEQ ID NO: 1170026 - DNA, 22 bp, Artificial Sequence
  chemically synthesized
aatttaaaataggatagttaca

SEQ ID NO: 1170027 - DNA, 22 bp, Artificial Sequence
  chemically synthesized
atttaaaataggatagttacaa

SEQ ID NO: 1170028 - DNA, 22 bp, Artificial Sequence
  chemically synthesized
gtcttctgagacattttgtaac

SEQ ID NO: 1170029 - DNA, 22 bp, Artificial Sequence
  chemically synthesized
aaaataggatagttacaaaatg

SEQ ID NO: 1170030 - DNA, 22 bp, Artificial Sequence
  chemically synthesized
ggtcttctgagacattttgtaa

SEQ ID NO: 1170031 - DNA, 22 bp, Artificial Sequence
  chemically synthesized
aaataggatagttacaaaatgt

SEQ ID NO: 1170032 - DNA, 22 bp, Artificial Sequence
  chemically synthesized
tttggtcttctgagacattttg

SEQ ID NO: 1170033 - DNA, 22 bp, Artificial Sequence
  chemically synthesized
atttggtcttctgagacatttt

SEQ ID NO: 1170034 - DNA, 22 bp, Artificial Sequence
  chemically synthesized
agaatttatttggtcttctgag

SEQ ID NO: 1170035 - DNA, 22 bp, Artificial Sequence
  chemically synthesized
caaaatgtctcagaagaccaaa

SEQ ID NO: 1170036 - DNA, 22 bp, Artificial Sequence
  chemically synthesized
agaagaccaaataaattcttaa

SEQ ID NO: 1170037 - DNA, 22 bp, Artificial Sequence
  chemically synthesized
aggaaaataacattaagaattt

SEQ ID NO: 1170038 - DNA, 22 bp, Artificial Sequence
  chemically synthesized
ggattaaggaaaataacattaa

SEQ ID NO: 1170039 - DNA, 22 bp, Artificial Sequence
  chemically synthesized
aggattaaggaaaataacatta

SEQ ID NO: 1170040 - DNA, 22 bp, Artificial Sequence
  chemically synthesized
aacttaggattaaggaaaataa

SEQ ID NO: 1170041 - DNA, 22 bp, Artificial Sequence
  chemically synthesized
ttaaacttaggattaaggaaaa

SEQ ID NO: 1170042 - DNA, 22 bp, Artificial Sequence
  chemically synthesized
ttaatgttattttccttaatcc

SEQ ID NO: 1170043 - DNA, 22 bp, Artificial Sequence
  chemically synthesized
aatgttattttccttaatccta

SEQ ID NO: 1170044 - DNA, 22 bp, Artificial Sequence
  chemically synthesized
atgttattttccttaatcctaa

SEQ ID NO: 1170045 - DNA, 22 bp, Artificial Sequence
  chemically synthesized
ataaaattgttaaacttaggat

SEQ ID NO: 1170046 - DNA, 22 bp, Artificial Sequence
  chemically synthesized
ttttccttaatcctaagtttaa

SEQ ID NO: 1170047 - DNA, 22 bp, Artificial Sequence
  chemically synthesized
tccttaatcctaagtttaacaa

SEQ ID NO: 1170048 - DNA, 22 bp, Artificial Sequence
  chemically synthesized
ccttaatcctaagtttaacaat

SEQ ID NO: 1170049 - DNA, 22 bp, Artificial Sequence
  chemically synthesized
aaaattaataaaattgttaaac

SEQ ID NO: 1170050 - DNA, 22 bp, Artificial Sequence
  chemically synthesized
cttaatcctaagtttaacaatt

SEQ ID NO: 1170051 - DNA, 22 bp, Artificial Sequence
  chemically synthesized
gaaaattaataaaattgttaaa

SEQ ID NO: 1170052 - DNA, 22 bp, Artificial Sequence
  chemically synthesized
aatcctaagtttaacaatttta

SEQ ID NO: 1170053 - DNA, 22 bp, Artificial Sequence
  chemically synthesized
atcctaagtttaacaattttat

SEQ ID NO: 1170054 - DNA, 22 bp, Artificial Sequence
  chemically synthesized
agtttaacaattttattaattt

SEQ ID NO: 1170055 - DNA, 22 bp, Artificial Sequence
  chemically synthesized
catgagacgtatttgaaaatta

SEQ ID NO: 1170056 - DNA, 22 bp, Artificial Sequence
  chemically synthesized
aacaattttattaattttcaaa

SEQ ID NO: 1170057 - DNA, 22 bp, Artificial Sequence
  chemically synthesized
ccatgagacgtatttgaaaatt

SEQ ID NO: 1170058 - DNA, 22 bp, Artificial Sequence
  chemically synthesized
acaattttattaattttcaaat

SEQ ID NO: 1170059 - DNA, 22 bp, Artificial Sequence
  chemically synthesized
tccatgagacgtatttgaaaat

SEQ ID NO: 1170060 - DNA, 22 bp, Artificial Sequence
  chemically synthesized
ttccatgagacgtatttgaaaa

SEQ ID NO: 1170061 - DNA, 22 bp, Artificial Sequence
  chemically synthesized
tattaattttcaaatacgtctc

SEQ ID NO: 1170062 - DNA, 22 bp, Artificial Sequence
  chemically synthesized
gtgtttttccatgagacgtatt

SEQ ID NO: 1170063 - DNA, 22 bp, Artificial Sequence
  chemically synthesized
attaattttcaaatacgtctca

SEQ ID NO: 1170064 - DNA, 22 bp, Artificial Sequence
  chemically synthesized
ggtgtttttccatgagacgtat

SEQ ID NO: 1170065 - DNA, 22 bp, Artificial Sequence
  chemically synthesized
ttaattttcaaatacgtctcat

SEQ ID NO: 1170066 - DNA, 22 bp, Artificial Sequence
  chemically synthesized
attttcaaatacgtctcatgga

SEQ ID NO: 1170067 - DNA, 22 bp, Artificial Sequence
  chemically synthesized
tcaaatacgtctcatggaaaaa

SEQ ID NO: 1170068 - DNA, 22 bp, Artificial Sequence
  chemically synthesized
caaatacgtctcatggaaaaac

SEQ ID NO: 1170069 - DNA, 22 bp, Artificial Sequence
  chemically synthesized
aaatacgtctcatggaaaaaca

SEQ ID NO: 1170070 - DNA, 22 bp, Artificial Sequence
  chemically synthesized
aaataaataagacttggtgttt

SEQ ID NO: 1170071 - DNA, 22 bp, Artificial Sequence
  chemically synthesized
attaaaataaataagacttggt

SEQ ID NO: 1170072 - DNA, 22 bp, Artificial Sequence
  chemically synthesized
atggaaaaacaccaagtcttat

SEQ ID NO: 1170073 - DNA, 22 bp, Artificial Sequence
  chemically synthesized
taaatgactgattaaaataaat

SEQ ID NO: 1170074 - DNA, 22 bp, Artificial Sequence
  chemically synthesized
ataaatgactgattaaaataaa

SEQ ID NO: 1170075 - DNA, 22 bp, Artificial Sequence
  chemically synthesized
tttataaatgactgattaaaat

SEQ ID NO: 1170076 - DNA, 22 bp, Artificial Sequence
  chemically synthesized
ctatttataaatgactgattaa

SEQ ID NO: 1170077 - DNA, 22 bp, Artificial Sequence
  chemically synthesized
cctatttataaatgactgatta

SEQ ID NO: 1170078 - DNA, 22 bp, Artificial Sequence
  chemically synthesized
tcctatttataaatgactgatt

SEQ ID NO: 1170079 - DNA, 22 bp, Artificial Sequence
  chemically synthesized
ttcctatttataaatgactgat

SEQ ID NO: 1170080 - DNA, 22 bp, Artificial Sequence
  chemically synthesized
tttcctatttataaatgactga

SEQ ID NO: 1170081 - DNA, 22 bp, Artificial Sequence
  chemically synthesized
atttattttaatcagtcattta

SEQ ID NO: 1170082 - DNA, 22 bp, Artificial Sequence
  chemically synthesized
ttttcctatttataaatgactg

SEQ ID NO: 1170083 - DNA, 22 bp, Artificial Sequence
  chemically synthesized
tttattttaatcagtcatttat

SEQ ID NO: 1170084 - DNA, 22 bp, Artificial Sequence
  chemically synthesized
attttaatcagtcatttataaa

SEQ ID NO: 1170085 - DNA, 22 bp, Artificial Sequence
  chemically synthesized
ttttaatcagtcatttataaat

SEQ ID NO: 1170086 - DNA, 22 bp, Artificial Sequence
  chemically synthesized
taatcagtcatttataaatagg

SEQ ID NO: 1170087 - DNA, 22 bp, Artificial Sequence
  chemically synthesized
aatcagtcatttataaatagga

SEQ ID NO: 1170088 - DNA, 22 bp, Artificial Sequence
  chemically synthesized
atcagtcatttataaataggaa

SEQ ID NO: 1170089 - DNA, 22 bp, Artificial Sequence
  chemically synthesized
ataaataggaaaaaaatgattc

SEQ ID NO: 1170090 - DNA, 22 bp, Artificial Sequence
  chemically synthesized
aaagtatccagtgaatcatttt

SEQ ID NO: 1170091 - DNA, 22 bp, Artificial Sequence
  chemically synthesized
taaataggaaaaaaatgattca

SEQ ID NO: 1170092 - DNA, 22 bp, Artificial Sequence
  chemically synthesized
aaaagtatccagtgaatcattt

SEQ ID NO: 1170093 - DNA, 22 bp, Artificial Sequence
  chemically synthesized
taaaagtatccagtgaatcatt

SEQ ID NO: 1170094 - DNA, 22 bp, Artificial Sequence
  chemically synthesized
cattttaaaagtatccagtgaa

SEQ ID NO: 1170095 - DNA, 22 bp, Artificial Sequence
  chemically synthesized
gcattttaaaagtatccagtga

SEQ ID NO: 1170096 - DNA, 22 bp, Artificial Sequence
  chemically synthesized
tgcattttaaaagtatccagtg

SEQ ID NO: 1170097 - DNA, 22 bp, Artificial Sequence
  chemically synthesized
ttttgcattttaaaagtatcca

SEQ ID NO: 1170098 - DNA, 22 bp, Artificial Sequence
  chemically synthesized
aattattttgcattttaaaagt

SEQ ID NO: 1170099 - DNA, 22 bp, Artificial Sequence
  chemically synthesized
tgaattattttgcattttaaaa

SEQ ID NO: 1170100 - DNA, 22 bp, Artificial Sequence
  chemically synthesized
ctgaattattttgcattttaaa

SEQ ID NO: 1170101 - DNA, 22 bp, Artificial Sequence
  chemically synthesized
actggatacttttaaaatgcaa

SEQ ID NO: 1170102 - DNA, 22 bp, Artificial Sequence
  chemically synthesized
cttctgaattattttgcatttt

SEQ ID NO: 1170103 - DNA, 22 bp, Artificial Sequence
  chemically synthesized
acttctgaattattttgcattt

SEQ ID NO: 1170104 - DNA, 22 bp, Artificial Sequence
  chemically synthesized
gatacttttaaaatgcaaaata

SEQ ID NO: 1170105 - DNA, 22 bp, Artificial Sequence
  chemically synthesized
ttaaaatgcaaaataattcaga

SEQ ID NO: 1170106 - DNA, 22 bp, Artificial Sequence
  chemically synthesized
aagcagtttacttctgaattat

SEQ ID NO: 1170107 - DNA, 22 bp, Artificial Sequence
  chemically synthesized
taaaatgcaaaataattcagaa

SEQ ID NO: 1170108 - DNA, 22 bp, Artificial Sequence
  chemically synthesized
aaaatgcaaaataattcagaag

SEQ ID NO: 1170109 - DNA, 22 bp, Artificial Sequence
  chemically synthesized
aaatgcaaaataattcagaagt

SEQ ID NO: 1170110 - DNA, 22 bp, Artificial Sequence
  chemically synthesized
tctaaagcagtttacttctgaa

SEQ ID NO: 1170111 - DNA, 22 bp, Artificial Sequence
  chemically synthesized
gtctaaagcagtttacttctga

SEQ ID NO: 1170112 - DNA, 22 bp, Artificial Sequence
  chemically synthesized
agaagtaaactgctttagacaa

SEQ ID NO: 1170113 - DNA, 22 bp, Artificial Sequence
  chemically synthesized
gtatgtaaaaaccacttgtcta

SEQ ID NO: 1170114 - DNA, 22 bp, Artificial Sequence
  chemically synthesized
ggtatgtaaaaaccacttgtct

SEQ ID NO: 1170115 - DNA, 22 bp, Artificial Sequence
  chemically synthesized
tggtatgtaaaaaccacttgtc

SEQ ID NO: 1170116 - DNA, 22 bp, Artificial Sequence
  chemically synthesized
ttggtatgtaaaaaccacttgt

SEQ ID NO: 1170117 - DNA, 22 bp, Artificial Sequence
  chemically synthesized
tttggtatgtaaaaaccacttg

SEQ ID NO: 1170118 - DNA, 22 bp, Artificial Sequence
  chemically synthesized
ttttggtatgtaaaaaccactt

SEQ ID NO: 1170119 - DNA, 22 bp, Artificial Sequence
  chemically synthesized
ctttagacaagtggtttttaca

SEQ ID NO: 1170120 - DNA, 22 bp, Artificial Sequence
  chemically synthesized
atttttttggtatgtaaaaacc

SEQ ID NO: 1170121 - DNA, 22 bp, Artificial Sequence
  chemically synthesized
gatttttttggtatgtaaaaac

SEQ ID NO: 1170122 - DNA, 22 bp, Artificial Sequence
  chemically synthesized
tgatttttttggtatgtaaaaa

SEQ ID NO: 1170123 - DNA, 22 bp, Artificial Sequence
  chemically synthesized
tagacaagtggtttttacatac

SEQ ID NO: 1170124 - DNA, 22 bp, Artificial Sequence
  chemically synthesized
agacaagtggtttttacatacc

SEQ ID NO: 1170125 - DNA, 22 bp, Artificial Sequence
  chemically synthesized
gacaagtggtttttacatacca

SEQ ID NO: 1170126 - DNA, 22 bp, Artificial Sequence
  chemically synthesized
ttttgatttttttggtatgtaa

SEQ ID NO: 1170127 - DNA, 22 bp, Artificial Sequence
  chemically synthesized
gttttgatttttttggtatgta

SEQ ID NO: 1170128 - DNA, 22 bp, Artificial Sequence
  chemically synthesized
tgttttgatttttttggtatgt

SEQ ID NO: 1170129 - DNA, 22 bp, Artificial Sequence
  chemically synthesized
ttacataccaaaaaaatcaaaa

SEQ ID NO: 1170130 - DNA, 22 bp, Artificial Sequence
  chemically synthesized
tacataccaaaaaaatcaaaac

SEQ ID NO: 1170131 - DNA, 22 bp, Artificial Sequence
  chemically synthesized
acataccaaaaaaatcaaaaca

SEQ ID NO: 1170132 - DNA, 22 bp, Artificial Sequence
  chemically synthesized
cataccaaaaaaatcaaaacaa

SEQ ID NO: 1170133 - DNA, 22 bp, Artificial Sequence
  chemically synthesized
acgagatatgtgtattttgttt

SEQ ID NO: 1170134 - DNA, 22 bp, Artificial Sequence
  chemically synthesized
cacgagatatgtgtattttgtt

SEQ ID NO: 1170135 - DNA, 22 bp, Artificial Sequence
  chemically synthesized
tcacgagatatgtgtattttgt

SEQ ID NO: 1170136 - DNA, 22 bp, Artificial Sequence
  chemically synthesized
aaataataagttttcacgagat

SEQ ID NO: 1170137 - DNA, 22 bp, Artificial Sequence
  chemically synthesized
gaaataataagttttcacgaga

SEQ ID NO: 1170138 - DNA, 22 bp, Artificial Sequence
  chemically synthesized
gtgaaaacttattatttcaaat

SEQ ID NO: 1170139 - DNA, 22 bp, Artificial Sequence
  chemically synthesized
agtgcagtatatgtcaatttga

SEQ ID NO: 1170140 - DNA, 22 bp, Artificial Sequence
  chemically synthesized
aagtgcagtatatgtcaatttg

SEQ ID NO: 1170141 - DNA, 22 bp, Artificial Sequence
  chemically synthesized
tttaagtgcagtatatgtcaat

SEQ ID NO: 1170142 - DNA, 22 bp, Artificial Sequence
  chemically synthesized
attatttcaaattgacatatac

SEQ ID NO: 1170143 - DNA, 22 bp, Artificial Sequence
  chemically synthesized
ttatttcaaattgacatatact

SEQ ID NO: 1170144 - DNA, 22 bp, Artificial Sequence
  chemically synthesized
tttcaaattgacatatactgca

SEQ ID NO: 1170145 - DNA, 22 bp, Artificial Sequence
  chemically synthesized
caaattgacatatactgcactt

SEQ ID NO: 1170146 - DNA, 22 bp, Artificial Sequence
  chemically synthesized
aaattgacatatactgcactta

SEQ ID NO: 1170147 - DNA, 22 bp, Artificial Sequence
  chemically synthesized
gaggaatattatttaagtgcag

SEQ ID NO: 1170148 - DNA, 22 bp, Artificial Sequence
  chemically synthesized
tagaggaatattatttaagtgc

SEQ ID NO: 1170149 - DNA, 22 bp, Artificial Sequence
  chemically synthesized
acatatactgcacttaaataat

SEQ ID NO: 1170150 - DNA, 22 bp, Artificial Sequence
  chemically synthesized
cggtcattctagaggaatatta

SEQ ID NO: 1170151 - DNA, 22 bp, Artificial Sequence
  chemically synthesized
cacttaaataatattcctctag

SEQ ID NO: 1170152 - DNA, 22 bp, Artificial Sequence
  chemically synthesized
tggactacggtcattctagagg

SEQ ID NO: 1170153 - DNA, 22 bp, Artificial Sequence
  chemically synthesized
aaataatattcctctagaatga

SEQ ID NO: 1170154 - DNA, 22 bp, Artificial Sequence
  chemically synthesized
tatggactacggtcattctaga

SEQ ID NO: 1170155 - DNA, 22 bp, Artificial Sequence
  chemically synthesized
aataatattcctctagaatgac

SEQ ID NO: 1170156 - DNA, 22 bp, Artificial Sequence
  chemically synthesized
caaactctatggactacggtca

SEQ ID NO: 1170157 - DNA, 22 bp, Artificial Sequence
  chemically synthesized
ctctagaatgaccgtagtccat

SEQ ID NO: 1170158 - DNA, 22 bp, Artificial Sequence
  chemically synthesized
tagaatgaccgtagtccataga

SEQ ID NO: 1170159 - DNA, 22 bp, Artificial Sequence
  chemically synthesized
gaatgaccgtagtccatagagt

SEQ ID NO: 1170160 - DNA, 22 bp, Artificial Sequence
  chemically synthesized
tatatgcaattacaaactctat

SEQ ID NO: 1170161 - DNA, 22 bp, Artificial Sequence
  chemically synthesized
gtatatgcaattacaaactcta

SEQ ID NO: 1170162 - DNA, 22 bp, Artificial Sequence
  chemically synthesized
atttgtatatgcaattacaaac

SEQ ID NO: 1170163 - DNA, 22 bp, Artificial Sequence
  chemically synthesized
acaattaatttgtatatgcaat

SEQ ID NO: 1170164 - DNA, 22 bp, Artificial Sequence
  chemically synthesized
atagctcacaattaatttgtat

SEQ ID NO: 1170165 - DNA, 22 bp, Artificial Sequence
  chemically synthesized
gtaattgcatatacaaattaat

SEQ ID NO: 1170166 - DNA, 22 bp, Artificial Sequence
  chemically synthesized
taattgcatatacaaattaatt

SEQ ID NO: 1170167 - DNA, 22 bp, Artificial Sequence
  chemically synthesized
ctcatagctcacaattaatttg

SEQ ID NO: 1170168 - DNA, 22 bp, Artificial Sequence
  chemically synthesized
tcctcatagctcacaattaatt

SEQ ID NO: 1170169 - DNA, 22 bp, Artificial Sequence
  chemically synthesized
catatacaaattaattgtgagc

SEQ ID NO: 1170170 - DNA, 22 bp, Artificial Sequence
  chemically synthesized
ggttctcctcatagctcacaat

SEQ ID NO: 1170171 - DNA, 22 bp, Artificial Sequence
  chemically synthesized
aggttctcctcatagctcacaa

SEQ ID NO: 1170172 - DNA, 22 bp, Artificial Sequence
  chemically synthesized
tgtttaggttctcctcatagct

SEQ ID NO: 1170173 - DNA, 22 bp, Artificial Sequence
  chemically synthesized
atgtttaggttctcctcatagc

SEQ ID NO: 1170174 - DNA, 22 bp, Artificial Sequence
  chemically synthesized
attgtgagctatgaggagaacc

SEQ ID NO: 1170175 - DNA, 22 bp, Artificial Sequence
  chemically synthesized
tgagctatgaggagaacctaaa

SEQ ID NO: 1170176 - DNA, 22 bp, Artificial Sequence
  chemically synthesized
catgggaatatttatgtttagg

SEQ ID NO: 1170177 - DNA, 22 bp, Artificial Sequence
  chemically synthesized
tgaggagaacctaaacataaat

SEQ ID NO: 1170178 - DNA, 22 bp, Artificial Sequence
  chemically synthesized
caaaacgggctacatgggaata

SEQ ID NO: 1170179 - DNA, 22 bp, Artificial Sequence
  chemically synthesized
aacataaatattcccatgtagc

SEQ ID NO: 1170180 - DNA, 22 bp, Artificial Sequence
  chemically synthesized
ccatgtagcccgttttggaatt

SEQ ID NO: 1170181 - DNA, 22 bp, Artificial Sequence
  chemically synthesized
taaatgatgagaaaaaaagcaa

SEQ ID NO: 1170182 - DNA, 22 bp, Artificial Sequence
  chemically synthesized
tggaattttgctttttttctca

SEQ ID NO: 1170183 - DNA, 22 bp, Artificial Sequence
  chemically synthesized
ggaattttgctttttttctcat

SEQ ID NO: 1170184 - DNA, 22 bp, Artificial Sequence
  chemically synthesized
gaattttgctttttttctcatc

SEQ ID NO: 1170185 - DNA, 22 bp, Artificial Sequence
  chemically synthesized
agaatattataaatgatgagaa

SEQ ID NO: 1170186 - DNA, 22 bp, Artificial Sequence
  chemically synthesized
tgctttttttctcatcatttat

SEQ ID NO: 1170187 - DNA, 22 bp, Artificial Sequence
  chemically synthesized
gctttttttctcatcatttata

SEQ ID NO: 1170188 - DNA, 22 bp, Artificial Sequence
  chemically synthesized
ctttttttctcatcatttataa

SEQ ID NO: 1170189 - DNA, 22 bp, Artificial Sequence
  chemically synthesized
tttttctcatcatttataatat

SEQ ID NO: 1170190 - DNA, 22 bp, Artificial Sequence
  chemically synthesized
ttttctcatcatttataatatt

SEQ ID NO: 1170191 - DNA, 22 bp, Artificial Sequence
  chemically synthesized
tttctcatcatttataatattc

SEQ ID NO: 1170192 - DNA, 22 bp, Artificial Sequence
  chemically synthesized
ttctcatcatttataatattct

SEQ ID NO: 1170193 - DNA, 22 bp, Artificial Sequence
  chemically synthesized
tctcatcatttataatattctt

SEQ ID NO: 1170194 - DNA, 22 bp, Artificial Sequence
  chemically synthesized
ctcatcatttataatattctta

SEQ ID NO: 1170195 - DNA, 22 bp, Artificial Sequence
  chemically synthesized
tcatcatttataatattcttag

SEQ ID NO: 1170196 - DNA, 22 bp, Artificial Sequence
  chemically synthesized
atcatttataatattcttagct

SEQ ID NO: 1170197 - DNA, 22 bp, Artificial Sequence
  chemically synthesized
tggaataaatgagtacatagct

SEQ ID NO: 1170198 - DNA, 22 bp, Artificial Sequence
  chemically synthesized
ataatattcttagctatgtact

SEQ ID NO: 1170199 - DNA, 22 bp, Artificial Sequence
  chemically synthesized
gtggaataaatgagtacatagc

SEQ ID NO: 1170200 - DNA, 22 bp, Artificial Sequence
  chemically synthesized
taatattcttagctatgtactc

SEQ ID NO: 1170201 - DNA, 22 bp, Artificial Sequence
  chemically synthesized
ttagctatgtactcatttattc

SEQ ID NO: 1170202 - DNA, 22 bp, Artificial Sequence
  chemically synthesized
agctatgtactcatttattcca

SEQ ID NO: 1170203 - DNA, 22 bp, Artificial Sequence
  chemically synthesized
catatagacttgtggaataaat

SEQ ID NO: 1170204 - DNA, 22 bp, Artificial Sequence
  chemically synthesized
gctatgtactcatttattccac

SEQ ID NO: 1170205 - DNA, 22 bp, Artificial Sequence
  chemically synthesized
acatatagacttgtggaataaa

SEQ ID NO: 1170206 - DNA, 22 bp, Artificial Sequence
  chemically synthesized
tacatatagacttgtggaataa

SEQ ID NO: 1170207 - DNA, 22 bp, Artificial Sequence
  chemically synthesized
tttacatatagacttgtggaat

SEQ ID NO: 1170208 - DNA, 22 bp, Artificial Sequence
  chemically synthesized
tgtactcatttattccacaagt

SEQ ID NO: 1170209 - DNA, 22 bp, Artificial Sequence
  chemically synthesized
ctttacatatagacttgtggaa

SEQ ID NO: 1170210 - DNA, 22 bp, Artificial Sequence
  chemically synthesized
atttctttacatatagacttgt

SEQ ID NO: 1170211 - DNA, 22 bp, Artificial Sequence
  chemically synthesized
taatttctttacatatagactt

SEQ ID NO: 1170212 - DNA, 22 bp, Artificial Sequence
  chemically synthesized
atttattccacaagtctatatg

SEQ ID NO: 1170213 - DNA, 22 bp, Artificial Sequence
  chemically synthesized
ctaatttctttacatatagact

SEQ ID NO: 1170214 - DNA, 22 bp, Artificial Sequence
  chemically synthesized
attccacaagtctatatgtaaa

SEQ ID NO: 1170215 - DNA, 22 bp, Artificial Sequence
  chemically synthesized
acttctaatttctttacatata

SEQ ID NO: 1170216 - DNA, 22 bp, Artificial Sequence
  chemically synthesized
ttccacaagtctatatgtaaag

SEQ ID NO: 1170217 - DNA, 22 bp, Artificial Sequence
  chemically synthesized
cacaagtctatatgtaaagaaa

SEQ ID NO: 1170218 - DNA, 22 bp, Artificial Sequence
  chemically synthesized
tgctaacttctaatttctttac

SEQ ID NO: 1170219 - DNA, 22 bp, Artificial Sequence
  chemically synthesized
gtgctaacttctaatttcttta

SEQ ID NO: 1170220 - DNA, 22 bp, Artificial Sequence
  chemically synthesized
ttgtgctaacttctaatttctt

SEQ ID NO: 1170221 - DNA, 22 bp, Artificial Sequence
  chemically synthesized
tatgtaaagaaattagaagtta

SEQ ID NO: 1170222 - DNA, 22 bp, Artificial Sequence
  chemically synthesized
gggacatctcttgtgctaactt

SEQ ID NO: 1170223 - DNA, 22 bp, Artificial Sequence
  chemically synthesized
ggggacatctcttgtgctaact

SEQ ID NO: 1170224 - DNA, 22 bp, Artificial Sequence
  chemically synthesized
tggggacatctcttgtgctaac

SEQ ID NO: 1170225 - DNA, 22 bp, Artificial Sequence
  chemically synthesized
tattttggggacatctcttgtg

SEQ ID NO: 1170226 - DNA, 22 bp, Artificial Sequence
  chemically synthesized
tatattttggggacatctcttg

SEQ ID NO: 1170227 - DNA, 22 bp, Artificial Sequence
  chemically synthesized
ctatattttggggacatctctt

SEQ ID NO: 1170228 - DNA, 22 bp, Artificial Sequence
  chemically synthesized
gaagttagcacaagagatgtcc

SEQ ID NO: 1170229 - DNA, 22 bp, Artificial Sequence
  chemically synthesized
gcacaagagatgtccccaaaat

SEQ ID NO: 1170230 - DNA, 22 bp, Artificial Sequence
  chemically synthesized
gtgtaagtgtagataagtttct

SEQ ID NO: 1170231 - DNA, 22 bp, Artificial Sequence
  chemically synthesized
aaattagtgtaagtgtagataa

SEQ ID NO: 1170232 - DNA, 22 bp, Artificial Sequence
  chemically synthesized
actgaaattagtgtaagtgtag

SEQ ID NO: 1170233 - DNA, 22 bp, Artificial Sequence
  chemically synthesized
cactgaaattagtgtaagtgta

SEQ ID NO: 1170234 - DNA, 22 bp, Artificial Sequence
  chemically synthesized
tcactgaaattagtgtaagtgt

SEQ ID NO: 1170235 - DNA, 22 bp, Artificial Sequence
  chemically synthesized
atctacacttacactaatttca

SEQ ID NO: 1170236 - DNA, 22 bp, Artificial Sequence
  chemically synthesized
tctacacttacactaatttcag

SEQ ID NO: 1170237 - DNA, 22 bp, Artificial Sequence
  chemically synthesized
cacttacactaatttcagtgaa

SEQ ID NO: 1170238 - DNA, 22 bp, Artificial Sequence
  chemically synthesized
acactaatttcagtgaaaatct

SEQ ID NO: 1170239 - DNA, 22 bp, Artificial Sequence
  chemically synthesized
cactaatttcagtgaaaatctt

SEQ ID NO: 1170240 - DNA, 22 bp, Artificial Sequence
  chemically synthesized
atttcagtgaaaatcttattct

SEQ ID NO: 1170241 - DNA, 22 bp, Artificial Sequence
  chemically synthesized
gatcaaataacaggaagaataa

SEQ ID NO: 1170242 - DNA, 22 bp, Artificial Sequence
  chemically synthesized
cagtgaaaatcttattcttcct

SEQ ID NO: 1170243 - DNA, 22 bp, Artificial Sequence
  chemically synthesized
ggatcaaataacaggaagaata

SEQ ID NO: 1170244 - DNA, 22 bp, Artificial Sequence
  chemically synthesized
agtgaaaatcttattcttcctg

SEQ ID NO: 1170245 - DNA, 22 bp, Artificial Sequence
  chemically synthesized
aggagtcttggatcaaataaca

SEQ ID NO: 1170246 - DNA, 22 bp, Artificial Sequence
  chemically synthesized
attcttcctgttatttgatcca

SEQ ID NO: 1170247 - DNA, 22 bp, Artificial Sequence
  chemically synthesized
ttcttcctgttatttgatccaa

SEQ ID NO: 1170248 - DNA, 22 bp, Artificial Sequence
  chemically synthesized
aggttaaggagtcttggatcaa

SEQ ID NO: 1170249 - DNA, 22 bp, Artificial Sequence
  chemically synthesized
aaggttaaggagtcttggatca

SEQ ID NO: 1170250 - DNA, 22 bp, Artificial Sequence
  chemically synthesized
ttcctgttatttgatccaagac

SEQ ID NO: 1170251 - DNA, 22 bp, Artificial Sequence
  chemically synthesized
cctgttatttgatccaagactc

SEQ ID NO: 1170252 - DNA, 22 bp, Artificial Sequence
  chemically synthesized
ctgttatttgatccaagactcc

SEQ ID NO: 1170253 - DNA, 22 bp, Artificial Sequence
  chemically synthesized
ttatttgatccaagactcctta

SEQ ID NO: 1170254 - DNA, 22 bp, Artificial Sequence
  chemically synthesized
tttgatccaagactccttaacc

SEQ ID NO: 1170255 - DNA, 22 bp, Artificial Sequence
  chemically synthesized
gatccaagactccttaacctta

SEQ ID NO: 1170256 - DNA, 22 bp, Artificial Sequence
  chemically synthesized
cagaaaaaagcttaaggttaag

SEQ ID NO: 1170257 - DNA, 22 bp, Artificial Sequence
  chemically synthesized
atccaagactccttaaccttaa

SEQ ID NO: 1170258 - DNA, 22 bp, Artificial Sequence
  chemically synthesized
acagaaaaaagcttaaggttaa

SEQ ID NO: 1170259 - DNA, 22 bp, Artificial Sequence
  chemically synthesized
tacagaaaaaagcttaaggtta

SEQ ID NO: 1170260 - DNA, 22 bp, Artificial Sequence
  chemically synthesized
gccctttacagaaaaaagctta

SEQ ID NO: 1170261 - DNA, 22 bp, Artificial Sequence
  chemically synthesized
cttaaccttaagcttttttctg

SEQ ID NO: 1170262 - DNA, 22 bp, Artificial Sequence
  chemically synthesized
tctagccctttacagaaaaaag

SEQ ID NO: 1170263 - DNA, 22 bp, Artificial Sequence
  chemically synthesized
aaccttaagcttttttctgtaa

SEQ ID NO: 1170264 - DNA, 22 bp, Artificial Sequence
  chemically synthesized
ttatctagccctttacagaaaa

SEQ ID NO: 1170265 - DNA, 22 bp, Artificial Sequence
  chemically synthesized
accttaagcttttttctgtaaa

SEQ ID NO: 1170266 - DNA, 22 bp, Artificial Sequence
  chemically synthesized
aagcttttttctgtaaagggct

SEQ ID NO: 1170267 - DNA, 22 bp, Artificial Sequence
  chemically synthesized
agcttttttctgtaaagggcta

SEQ ID NO: 1170268 - DNA, 22 bp, Artificial Sequence
  chemically synthesized
aagatacctattatctagccct

SEQ ID NO: 1170269 - DNA, 22 bp, Artificial Sequence
  chemically synthesized
ttttctgtaaagggctagataa

SEQ ID NO: 1170270 - DNA, 22 bp, Artificial Sequence
  chemically synthesized
tttctgtaaagggctagataat

SEQ ID NO: 1170271 - DNA, 22 bp, Artificial Sequence
  chemically synthesized
ttctgtaaagggctagataata

SEQ ID NO: 1170272 - DNA, 22 bp, Artificial Sequence
  chemically synthesized
tctgtaaagggctagataatag

SEQ ID NO: 1170273 - DNA, 22 bp, Artificial Sequence
  chemically synthesized
ctgtaaagggctagataatagg

SEQ ID NO: 1170274 - DNA, 22 bp, Artificial Sequence
  chemically synthesized
tgtaaagggctagataataggt

SEQ ID NO: 1170275 - DNA, 22 bp, Artificial Sequence
  chemically synthesized
caaaattgaagatacctattat

SEQ ID NO: 1170276 - DNA, 22 bp, Artificial Sequence
  chemically synthesized
taaagggctagataataggtat

SEQ ID NO: 1170277 - DNA, 22 bp, Artificial Sequence
  chemically synthesized
gtggtctgcaaaattgaagata

SEQ ID NO: 1170278 - DNA, 22 bp, Artificial Sequence
  chemically synthesized
agtggtctgcaaaattgaagat

SEQ ID NO: 1170279 - DNA, 22 bp, Artificial Sequence
  chemically synthesized
tagtggtctgcaaaattgaaga

SEQ ID NO: 1170280 - DNA, 22 bp, Artificial Sequence
  chemically synthesized
gataataggtatcttcaatttt

SEQ ID NO: 1170281 - DNA, 22 bp, Artificial Sequence
  chemically synthesized
gtctttagtggtctgcaaaatt

SEQ ID NO: 1170282 - DNA, 22 bp, Artificial Sequence
  chemically synthesized
ggggcatctggtctttagtggt

SEQ ID NO: 1170283 - DNA, 22 bp, Artificial Sequence
  chemically synthesized
caattttgcagaccactaaaga

SEQ ID NO: 1170284 - DNA, 22 bp, Artificial Sequence
  chemically synthesized
aattttgcagaccactaaagac

SEQ ID NO: 1170285 - DNA, 22 bp, Artificial Sequence
  chemically synthesized
agttgggggcatctggtcttta

SEQ ID NO: 1170286 - DNA, 22 bp, Artificial Sequence
  chemically synthesized
tgcagaccactaaagaccagat

SEQ ID NO: 1170287 - DNA, 22 bp, Artificial Sequence
  chemically synthesized
gcagaccactaaagaccagatg

SEQ ID NO: 1170288 - DNA, 22 bp, Artificial Sequence
  chemically synthesized
cagaccactaaagaccagatgc

SEQ ID NO: 1170289 - DNA, 22 bp, Artificial Sequence
  chemically synthesized
aagaccagatgcccccaactca

SEQ ID NO: 1170290 - DNA, 22 bp, Artificial Sequence
  chemically synthesized
cagtgacagagctgagttgggg

SEQ ID NO: 1170291 - DNA, 22 bp, Artificial Sequence
  chemically synthesized
gcagtgacagagctgagttggg

SEQ ID NO: 1170292 - DNA, 22 bp, Artificial Sequence
  chemically synthesized
caatttgcagtgacagagctga

SEQ ID NO: 1170293 - DNA, 22 bp, Artificial Sequence
  chemically synthesized
gggctacaatttgcagtgacag

SEQ ID NO: 1170294 - DNA, 22 bp, Artificial Sequence
  chemically synthesized
ggggctacaatttgcagtgaca

SEQ ID NO: 1170295 - DNA, 22 bp, Artificial Sequence
  chemically synthesized
tggggctacaatttgcagtgac

SEQ ID NO: 1170296 - DNA, 22 bp, Artificial Sequence
  chemically synthesized
agctctgtcactgcaaattgta

SEQ ID NO: 1170297 - DNA, 22 bp, Artificial Sequence
  chemically synthesized
cagatgctttggggctacaatt

SEQ ID NO: 1170298 - DNA, 22 bp, Artificial Sequence
  chemically synthesized
tgtcactgcaaattgtagcccc

SEQ ID NO: 1170299 - DNA, 22 bp, Artificial Sequence
  chemically synthesized
tcactgcaaattgtagccccaa

SEQ ID NO: 1170300 - DNA, 22 bp, Artificial Sequence
  chemically synthesized
tctccagatgctttggggctac

SEQ ID NO: 1170301 - DNA, 22 bp, Artificial Sequence
  chemically synthesized
caaattgtagccccaaagcatc

SEQ ID NO: 1170302 - DNA, 22 bp, Artificial Sequence
  chemically synthesized
atgtattgtctccagatgcttt

SEQ ID NO: 1170303 - DNA, 22 bp, Artificial Sequence
  chemically synthesized
aatgtattgtctccagatgctt

SEQ ID NO: 1170304 - DNA, 22 bp, Artificial Sequence
  chemically synthesized
tagccccaaagcatctggagac

SEQ ID NO: 1170305 - DNA, 22 bp, Artificial Sequence
  chemically synthesized
acttaatgtattgtctccagat

SEQ ID NO: 1170306 - DNA, 22 bp, Artificial Sequence
  chemically synthesized
ttcacttaatgtattgtctcca

SEQ ID NO: 1170307 - DNA, 22 bp, Artificial Sequence
  chemically synthesized
attcacttaatgtattgtctcc

SEQ ID NO: 1170308 - DNA, 22 bp, Artificial Sequence
  chemically synthesized
gagacaatacattaagtgaata

SEQ ID NO: 1170309 - DNA, 22 bp, Artificial Sequence
  chemically synthesized
gaacacatccatgtttattcac

SEQ ID NO: 1170310 - DNA, 22 bp, Artificial Sequence
  chemically synthesized
ttggaacacatccatgtttatt

SEQ ID NO: 1170311 - DNA, 22 bp, Artificial Sequence
  chemically synthesized
attggaacacatccatgtttat

SEQ ID NO: 1170312 - DNA, 22 bp, Artificial Sequence
  chemically synthesized
tattggaacacatccatgttta

SEQ ID NO: 1170313 - DNA, 22 bp, Artificial Sequence
  chemically synthesized
agtgaataaacatggatgtgtt

SEQ ID NO: 1170314 - DNA, 22 bp, Artificial Sequence
  chemically synthesized
taaataaagttttattggaaca

SEQ ID NO: 1170315 - DNA, 22 bp, Artificial Sequence
  chemically synthesized
gtaaataaagttttattggaac

SEQ ID NO: 1170316 - DNA, 22 bp, Artificial Sequence
  chemically synthesized
tgtaaataaagttttattggaa

SEQ ID NO: 1170317 - DNA, 22 bp, Artificial Sequence
  chemically synthesized
ttgtaaataaagttttattgga

SEQ ID NO: 1170318 - DNA, 22 bp, Artificial Sequence
  chemically synthesized
atttttgtaaataaagttttat

SEQ ID NO: 1170319 - DNA, 22 bp, Artificial Sequence
  chemically synthesized
cctgatttttgtaaataaagtt

SEQ ID NO: 1170320 - DNA, 22 bp, Artificial Sequence
  chemically synthesized
ctacctgatttttgtaaataaa

SEQ ID NO: 1170321 - DNA, 22 bp, Artificial Sequence
  chemically synthesized
gctacctgatttttgtaaataa

SEQ ID NO: 1170322 - DNA, 22 bp, Artificial Sequence
  chemically synthesized
caataaaactttatttacaaaa

SEQ ID NO: 1170323 - DNA, 22 bp, Artificial Sequence
  chemically synthesized
tatttacaaaaatcaggtagca

SEQ ID NO: 1170324 - DNA, 22 bp, Artificial Sequence
  chemically synthesized
atttacaaaaatcaggtagcaa

SEQ ID NO: 1170325 - DNA, 22 bp, Artificial Sequence
  chemically synthesized
tttacaaaaatcaggtagcaag

SEQ ID NO: 1170326 - DNA, 22 bp, Artificial Sequence
  chemically synthesized
agggtgaaaatagacttgctac

SEQ ID NO: 1170327 - DNA, 22 bp, Artificial Sequence
  chemically synthesized
acaaaaatcaggtagcaagtct

SEQ ID NO: 1170328 - DNA, 22 bp, Artificial Sequence
  chemically synthesized
caaaaatcaggtagcaagtcta

SEQ ID NO: 1170329 - DNA, 22 bp, Artificial Sequence
  chemically synthesized
tggcctgagggtgaaaatagac

SEQ ID NO: 1170330 - DNA, 22 bp, Artificial Sequence
  chemically synthesized
ttttcaccctcaggccatagat

SEQ ID NO: 1170331 - DNA, 22 bp, Artificial Sequence
  chemically synthesized
tcaccctcaggccatagattgc

SEQ ID NO: 1170332 - DNA, 22 bp, Artificial Sequence
  chemically synthesized
caccctcaggccatagattgct

SEQ ID NO: 1170333 - DNA, 22 bp, Artificial Sequence
  chemically synthesized
accctcaggccatagattgcta

SEQ ID NO: 1170334 - DNA, 22 bp, Artificial Sequence
  chemically synthesized
atcatcaggagatagcaatcta

SEQ ID NO: 1170335 - DNA, 22 bp, Artificial Sequence
  chemically synthesized
catcatcaggagatagcaatct

SEQ ID NO: 1170336 - DNA, 22 bp, Artificial Sequence
  chemically synthesized
aggccatagattgctatctcct

SEQ ID NO: 1170337 - DNA, 22 bp, Artificial Sequence
  chemically synthesized
aatgtgggaagcaatttcatca

SEQ ID NO: 1170338 - DNA, 22 bp, Artificial Sequence
  chemically synthesized
ctatctcctgatgatgaaattg

SEQ ID NO: 1170339 - DNA, 22 bp, Artificial Sequence
  chemically synthesized
aaatgtgggaagcaatttcatc

SEQ ID NO: 1170340 - DNA, 22 bp, Artificial Sequence
  chemically synthesized
tctcctgatgatgaaattgctt

SEQ ID NO: 1170341 - DNA, 22 bp, Artificial Sequence
  chemically synthesized
gtttaaatgtgggaagcaattt

SEQ ID NO: 1170342 - DNA, 22 bp, Artificial Sequence
  chemically synthesized
ctgatgatgaaattgcttccca

SEQ ID NO: 1170343 - DNA, 22 bp, Artificial Sequence
  chemically synthesized
atgatgaaattgcttcccacat

SEQ ID NO: 1170344 - DNA, 22 bp, Artificial Sequence
  chemically synthesized
agagaaattagtttaaatgtgg

SEQ ID NO: 1170345 - DNA, 22 bp, Artificial Sequence
  chemically synthesized
cttcccacatttaaactaattt

SEQ ID NO: 1170346 - DNA, 22 bp, Artificial Sequence
  chemically synthesized
cccacatttaaactaatttctc

SEQ ID NO: 1170347 - DNA, 22 bp, Artificial Sequence
  chemically synthesized
ccacatttaaactaatttctct

SEQ ID NO: 1170348 - DNA, 22 bp, Artificial Sequence
  chemically synthesized
aaactaatttctctgaacttct

SEQ ID NO: 1170349 - DNA, 22 bp, Artificial Sequence
  chemically synthesized
aactaatttctctgaacttctc

SEQ ID NO: 1170350 - DNA, 22 bp, Artificial Sequence
  chemically synthesized
atttctctgaacttctcactgt

SEQ ID NO: 1170351 - DNA, 22 bp, Artificial Sequence
  chemically synthesized
ctctgaacttctcactgttgat

SEQ ID NO: 1170352 - DNA, 22 bp, Artificial Sequence
  chemically synthesized
tctgaacttctcactgttgatt

SEQ ID NO: 1170353 - DNA, 22 bp, Artificial Sequence
  chemically synthesized
tgaacttctcactgttgattat

SEQ ID NO: 1170354 - DNA, 22 bp, Artificial Sequence
  chemically synthesized
gagagaggaaagataatcaaca

SEQ ID NO: 1170355 - DNA, 22 bp, Artificial Sequence
  chemically synthesized
aacttctcactgttgattatct

SEQ ID NO: 1170356 - DNA, 22 bp, Artificial Sequence
  chemically synthesized
ctcactgttgattatctttcct

SEQ ID NO: 1170357 - DNA, 22 bp, Artificial Sequence
  chemically synthesized
tcactgttgattatctttcctc

SEQ ID NO: 1170358 - DNA, 22 bp, Artificial Sequence
  chemically synthesized
actgttgattatctttcctctc

SEQ ID NO: 1170359 - DNA, 22 bp, Artificial Sequence
  chemically synthesized
ttgattatctttcctctctcca

SEQ ID NO: 1170360 - DNA, 22 bp, Artificial Sequence
  chemically synthesized
gagggggagagattggagagag

SEQ ID NO: 1170361 - DNA, 22 bp, Artificial Sequence
  chemically synthesized
attatctttcctctctccaatc

SEQ ID NO: 1170362 - DNA, 22 bp, Artificial Sequence
  chemically synthesized
tctttcctctctccaatctctc

SEQ ID NO: 1170363 - DNA, 22 bp, Artificial Sequence
  chemically synthesized
tcctctctccaatctctccccc

SEQ ID NO: 1170364 - DNA, 22 bp, Artificial Sequence
  chemically synthesized
cctctctccaatctctccccct

SEQ ID NO: 1170365 - DNA, 22 bp, Artificial Sequence
  chemically synthesized
ctctctccaatctctccccctc

SEQ ID NO: 1170366 - DNA, 22 bp, Artificial Sequence
  chemically synthesized
tctccaatctctccccctccaa

SEQ ID NO: 1170367 - DNA, 22 bp, Artificial Sequence
  chemically synthesized
tccaatctctccccctccaatt

SEQ ID NO: 1170368 - DNA, 22 bp, Artificial Sequence
  chemically synthesized
caatctctccccctccaattga

SEQ ID NO: 1170369 - DNA, 22 bp, Artificial Sequence
  chemically synthesized
tccccctccaattgattctcat

SEQ ID NO: 1170370 - DNA, 22 bp, Artificial Sequence
  chemically synthesized
cccctccaattgattctcattg

SEQ ID NO: 1170371 - DNA, 22 bp, Artificial Sequence
  chemically synthesized
caattgattctcattgggtcac

SEQ ID NO: 1170372 - DNA, 22 bp, Artificial Sequence
  chemically synthesized
attctcattgggtcactttccc

SEQ ID NO: 1170373 - DNA, 22 bp, Artificial Sequence
  chemically synthesized
gacatgcaatagagtgggaaag

SEQ ID NO: 1170374 - DNA, 22 bp, Artificial Sequence
  chemically synthesized
tcattgggtcactttcccactc

SEQ ID NO: 1170375 - DNA, 22 bp, Artificial Sequence
  chemically synthesized
ggacatgcaatagagtgggaaa

SEQ ID NO: 1170376 - DNA, 22 bp, Artificial Sequence
  chemically synthesized
attgggtcactttcccactcta

SEQ ID NO: 1170377 - DNA, 22 bp, Artificial Sequence
  chemically synthesized
gcttggacatgcaatagagtgg

SEQ ID NO: 1170378 - DNA, 22 bp, Artificial Sequence
  chemically synthesized
ggtcactttcccactctattgc

SEQ ID NO: 1170379 - DNA, 22 bp, Artificial Sequence
  chemically synthesized
tcccactctattgcatgtccaa

SEQ ID NO: 1170380 - DNA, 22 bp, Artificial Sequence
  chemically synthesized
cccactctattgcatgtccaag

SEQ ID NO: 1170381 - DNA, 22 bp, Artificial Sequence
  chemically synthesized
agagatggctagcttggacatg

SEQ ID NO: 1170382 - DNA, 22 bp, Artificial Sequence
  chemically synthesized
ccactctattgcatgtccaagc

SEQ ID NO: 1170383 - DNA, 22 bp, Artificial Sequence
  chemically synthesized
cagagatggctagcttggacat

SEQ ID NO: 1170384 - DNA, 22 bp, Artificial Sequence
  chemically synthesized
tattgcatgtccaagctagcca

SEQ ID NO: 1170385 - DNA, 22 bp, Artificial Sequence
  chemically synthesized
ttgcatgtccaagctagccatc

SEQ ID NO: 1170386 - DNA, 22 bp, Artificial Sequence
  chemically synthesized
catgtccaagctagccatctct

SEQ ID NO: 1170387 - DNA, 22 bp, Artificial Sequence
  chemically synthesized
gccatctctgaaatctcactgc

SEQ ID NO: 1170388 - DNA, 22 bp, Artificial Sequence
  chemically synthesized
tgaaatctcactgccctccccc

SEQ ID NO: 1170389 - DNA, 22 bp, Artificial Sequence
  chemically synthesized
aaatctcactgccctccccctg

SEQ ID NO: 1170390 - DNA, 22 bp, Artificial Sequence
  chemically synthesized
actgccctccccctgccctacc

SEQ ID NO: 1170391 - DNA, 22 bp, Artificial Sequence
  chemically synthesized
tatacagcaatggaggtagggc

SEQ ID NO: 1170392 - DNA, 22 bp, Artificial Sequence
  chemically synthesized
ccctccccctgccctacctcca

SEQ ID NO: 1170393 - DNA, 22 bp, Artificial Sequence
  chemically synthesized
ttatatacagcaatggaggtag

SEQ ID NO: 1170394 - DNA, 22 bp, Artificial Sequence
  chemically synthesized
cccctgccctacctccattgct

SEQ ID NO: 1170395 - DNA, 22 bp, Artificial Sequence
  chemically synthesized
agacattgttatatacagcaat

SEQ ID NO: 1170396 - DNA, 22 bp, Artificial Sequence
  chemically synthesized
gagacattgttatatacagcaa

SEQ ID NO: 1170397 - DNA, 22 bp, Artificial Sequence
  chemically synthesized
ccctacctccattgctgtatat

SEQ ID NO: 1170398 - DNA, 22 bp, Artificial Sequence
  chemically synthesized
tgagacattgttatatacagca

SEQ ID NO: 1170399 - DNA, 22 bp, Artificial Sequence
  chemically synthesized
tttgagacattgttatatacag

SEQ ID NO: 1170400 - DNA, 22 bp, Artificial Sequence
  chemically synthesized
ctttgagacattgttatataca

SEQ ID NO: 1170401 - DNA, 22 bp, Artificial Sequence
  chemically synthesized
cctccattgctgtatataacaa

SEQ ID NO: 1170402 - DNA, 22 bp, Artificial Sequence
  chemically synthesized
cattgctgtatataacaatgtc

SEQ ID NO: 1170403 - DNA, 22 bp, Artificial Sequence
  chemically synthesized
ctgtatataacaatgtctcaaa

SEQ ID NO: 1170404 - DNA, 22 bp, Artificial Sequence
  chemically synthesized
tgcagcatgatttctttgagac

SEQ ID NO: 1170405 - DNA, 22 bp, Artificial Sequence
  chemically synthesized
tatataacaatgtctcaaagaa

SEQ ID NO: 1170406 - DNA, 22 bp, Artificial Sequence
  chemically synthesized
atgcagcatgatttctttgaga

SEQ ID NO: 1170407 - DNA, 22 bp, Artificial Sequence
  chemically synthesized
tatgcagcatgatttctttgag

SEQ ID NO: 1170408 - DNA, 22 bp, Artificial Sequence
  chemically synthesized
gttttatgcagcatgatttctt

SEQ ID NO: 1170409 - DNA, 22 bp, Artificial Sequence
  chemically synthesized
aaagaaatcatgctgcataaaa

SEQ ID NO: 1170410 - DNA, 22 bp, Artificial Sequence
  chemically synthesized
ccgaatgcggccactggtttta

SEQ ID NO: 1170411 - DNA, 22 bp, Artificial Sequence
  chemically synthesized
cccgaatgcggccactggtttt

SEQ ID NO: 1170412 - DNA, 22 bp, Artificial Sequence
  chemically synthesized
aagtttcccgaatgcggccact

SEQ ID NO: 1170413 - DNA, 22 bp, Artificial Sequence
  chemically synthesized
aaagtttcccgaatgcggccac

SEQ ID NO: 1170414 - DNA, 22 bp, Artificial Sequence
  chemically synthesized
cataaaaccagtggccgcattc

SEQ ID NO: 1170415 - DNA, 22 bp, Artificial Sequence
  chemically synthesized
caaagtgaggccgacttaaagt

SEQ ID NO: 1170416 - DNA, 22 bp, Artificial Sequence
  chemically synthesized
ctccaaagtgaggccgacttaa

SEQ ID NO: 1170417 - DNA, 22 bp, Artificial Sequence
  chemically synthesized
actccaaagtgaggccgactta

SEQ ID NO: 1170418 - DNA, 22 bp, Artificial Sequence
  chemically synthesized
tactccaaagtgaggccgactt

SEQ ID NO: 1170419 - DNA, 22 bp, Artificial Sequence
  chemically synthesized
gggaaactttaagtcggcctca

SEQ ID NO: 1170420 - DNA, 22 bp, Artificial Sequence
  chemically synthesized
ttttactccaaagtgaggccga

SEQ ID NO: 1170421 - DNA, 22 bp, Artificial Sequence
  chemically synthesized
attttactccaaagtgaggccg

SEQ ID NO: 1170422 - DNA, 22 bp, Artificial Sequence
  chemically synthesized
atgtttattttactccaaagtg

SEQ ID NO: 1170423 - DNA, 22 bp, Artificial Sequence
  chemically synthesized
taagtcggcctcactttggagt

SEQ ID NO: 1170424 - DNA, 22 bp, Artificial Sequence
  chemically synthesized
aagtcggcctcactttggagta

SEQ ID NO: 1170425 - DNA, 22 bp, Artificial Sequence
  chemically synthesized
agtcggcctcactttggagtaa

SEQ ID NO: 1170426 - DNA, 22 bp, Artificial Sequence
  chemically synthesized
acctcatgtttattttactcca

SEQ ID NO: 1170427 - DNA, 22 bp, Artificial Sequence
  chemically synthesized
gacctcatgtttattttactcc

SEQ ID NO: 1170428 - DNA, 22 bp, Artificial Sequence
  chemically synthesized
aatttgacctcatgtttatttt

SEQ ID NO: 1170429 - DNA, 22 bp, Artificial Sequence
  chemically synthesized
actttggagtaaaataaacatg

SEQ ID NO: 1170430 - DNA, 22 bp, Artificial Sequence
  chemically synthesized
tggagtaaaataaacatgaggt

SEQ ID NO: 1170431 - DNA, 22 bp, Artificial Sequence
  chemically synthesized
ggagtaaaataaacatgaggtc

SEQ ID NO: 1170432 - DNA, 22 bp, Artificial Sequence
  chemically synthesized
gagtaaaataaacatgaggtca

SEQ ID NO: 1170433 - DNA, 22 bp, Artificial Sequence
  chemically synthesized
cagaacctgaatttgacctcat

SEQ ID NO: 1170434 - DNA, 22 bp, Artificial Sequence
  chemically synthesized
taaattccagaacctgaatttg

SEQ ID NO: 1170435 - DNA, 22 bp, Artificial Sequence
  chemically synthesized
cctataaattccagaacctgaa

SEQ ID NO: 1170436 - DNA, 22 bp, Artificial Sequence
  chemically synthesized
aagtacacactacctataaatt

SEQ ID NO: 1170437 - DNA, 22 bp, Artificial Sequence
  chemically synthesized
aggttctggaatttataggtag

SEQ ID NO: 1170438 - DNA, 22 bp, Artificial Sequence
  chemically synthesized
ccaagttcaagtacacactacc

SEQ ID NO: 1170439 - DNA, 22 bp, Artificial Sequence
  chemically synthesized
tggaatttataggtagtgtgta

SEQ ID NO: 1170440 - DNA, 22 bp, Artificial Sequence
  chemically synthesized
gccaagttcaagtacacactac

SEQ ID NO: 1170441 - DNA, 22 bp, Artificial Sequence
  chemically synthesized
tgccaagttcaagtacacacta

SEQ ID NO: 1170442 - DNA, 22 bp, Artificial Sequence
  chemically synthesized
gaatttataggtagtgtgtact

SEQ ID NO: 1170443 - DNA, 22 bp, Artificial Sequence
  chemically synthesized
ataggtagtgtgtacttgaact

SEQ ID NO: 1170444 - DNA, 22 bp, Artificial Sequence
  chemically synthesized
taggtagtgtgtacttgaactt

SEQ ID NO: 1170445 - DNA, 22 bp, Artificial Sequence
  chemically synthesized
aaaaactttgccaagttcaagt

SEQ ID NO: 1170446 - DNA, 22 bp, Artificial Sequence
  chemically synthesized
gaacttggcaaagttttttaat

SEQ ID NO: 1170447 - DNA, 22 bp, Artificial Sequence
  chemically synthesized
aacttggcaaagttttttaatt

SEQ ID NO: 1170448 - DNA, 22 bp, Artificial Sequence
  chemically synthesized
ggcaaagttttttaatttcaca

SEQ ID NO: 1170449 - DNA, 22 bp, Artificial Sequence
  chemically synthesized
gcaaagttttttaatttcacac

SEQ ID NO: 1170450 - DNA, 22 bp, Artificial Sequence
  chemically synthesized
aggtgtgtaccaagagtgtgaa

SEQ ID NO: 1170451 - DNA, 22 bp, Artificial Sequence
  chemically synthesized
caggtgtgtaccaagagtgtga

SEQ ID NO: 1170452 - DNA, 22 bp, Artificial Sequence
  chemically synthesized
tcaggtgtgtaccaagagtgtg

SEQ ID NO: 1170453 - DNA, 22 bp, Artificial Sequence
  chemically synthesized
ttttcaggtgtgtaccaagagt

SEQ ID NO: 1170454 - DNA, 22 bp, Artificial Sequence
  chemically synthesized
tttaatttcacactcttggtac

SEQ ID NO: 1170455 - DNA, 22 bp, Artificial Sequence
  chemically synthesized
ttaatttcacactcttggtaca

SEQ ID NO: 1170456 - DNA, 22 bp, Artificial Sequence
  chemically synthesized
taatttcacactcttggtacac

SEQ ID NO: 1170457 - DNA, 22 bp, Artificial Sequence
  chemically synthesized
aatttcacactcttggtacaca

SEQ ID NO: 1170458 - DNA, 22 bp, Artificial Sequence
  chemically synthesized
atttcacactcttggtacacac

SEQ ID NO: 1170459 - DNA, 22 bp, Artificial Sequence
  chemically synthesized
cacactcttggtacacacctga

SEQ ID NO: 1170460 - DNA, 22 bp, Artificial Sequence
  chemically synthesized
acactcttggtacacacctgaa

SEQ ID NO: 1170461 - DNA, 22 bp, Artificial Sequence
  chemically synthesized
gtatcatatctattttcaggtg

SEQ ID NO: 1170462 - DNA, 22 bp, Artificial Sequence
  chemically synthesized
ttggtacacacctgaaaataga

SEQ ID NO: 1170463 - DNA, 22 bp, Artificial Sequence
  chemically synthesized
aattagtatcatatctattttc

SEQ ID NO: 1170464 - DNA, 22 bp, Artificial Sequence
  chemically synthesized
ggtacacacctgaaaatagata

SEQ ID NO: 1170465 - DNA, 22 bp, Artificial Sequence
  chemically synthesized
gtacacacctgaaaatagatat

SEQ ID NO: 1170466 - DNA, 22 bp, Artificial Sequence
  chemically synthesized
taaattagtatcatatctattt

SEQ ID NO: 1170467 - DNA, 22 bp, Artificial Sequence
  chemically synthesized
ccctctaaattagtatcatatc

SEQ ID NO: 1170468 - DNA, 22 bp, Artificial Sequence
  chemically synthesized
aaaatagatatgatactaattt

SEQ ID NO: 1170469 - DNA, 22 bp, Artificial Sequence
  chemically synthesized
caattaccctctaaattagtat

SEQ ID NO: 1170470 - DNA, 22 bp, Artificial Sequence
  chemically synthesized
acaattaccctctaaattagta

SEQ ID NO: 1170471 - DNA, 22 bp, Artificial Sequence
  chemically synthesized
tgagccttacaattaccctcta

SEQ ID NO: 1170472 - DNA, 22 bp, Artificial Sequence
  chemically synthesized
tctgtgagccttacaattaccc

SEQ ID NO: 1170473 - DNA, 22 bp, Artificial Sequence
  chemically synthesized
atttagagggtaattgtaaggc

SEQ ID NO: 1170474 - DNA, 22 bp, Artificial Sequence
  chemically synthesized
tatgttgtctgtgagccttaca

SEQ ID NO: 1170475 - DNA, 22 bp, Artificial Sequence
  chemically synthesized
agagggtaattgtaaggctcac

SEQ ID NO: 1170476 - DNA, 22 bp, Artificial Sequence
  chemically synthesized
gagggtaattgtaaggctcaca

SEQ ID NO: 1170477 - DNA, 22 bp, Artificial Sequence
  chemically synthesized
taaggctcacagacaacataca

SEQ ID NO: 1170478 - DNA, 22 bp, Artificial Sequence
  chemically synthesized
aatgtcaatacaatcgctgtat

SEQ ID NO: 1170479 - DNA, 22 bp, Artificial Sequence
  chemically synthesized
acagacaacatacagcgattgt

SEQ ID NO: 1170480 - DNA, 22 bp, Artificial Sequence
  chemically synthesized
aatggcaaagggtgatgctgaa

SEQ ID NO: 1170481 - DNA, 22 bp, Artificial Sequence
  chemically synthesized
tattgacattcagcatcaccct

SEQ ID NO: 1170482 - DNA, 22 bp, Artificial Sequence
  chemically synthesized
acattcagcatcaccctttgcc

SEQ ID NO: 1170483 - DNA, 22 bp, Artificial Sequence
  chemically synthesized
taaaagttgaatggcaaagggt

SEQ ID NO: 1170484 - DNA, 22 bp, Artificial Sequence
  chemically synthesized
ataaaagttgaatggcaaaggg

SEQ ID NO: 1170485 - DNA, 22 bp, Artificial Sequence
  chemically synthesized
tataaaagttgaatggcaaagg

SEQ ID NO: 1170486 - DNA, 22 bp, Artificial Sequence
  chemically synthesized
agcatcaccctttgccattcaa

SEQ ID NO: 1170487 - DNA, 22 bp, Artificial Sequence
  chemically synthesized
tgccattcaacttttataaaat

SEQ ID NO: 1170488 - DNA, 22 bp, Artificial Sequence
  chemically synthesized
gccattcaacttttataaaatc

SEQ ID NO: 1170489 - DNA, 22 bp, Artificial Sequence
  chemically synthesized
ccattcaacttttataaaatca

SEQ ID NO: 1170490 - DNA, 22 bp, Artificial Sequence
  chemically synthesized
aacttttataaaatcactttca

SEQ ID NO: 1170491 - DNA, 22 bp, Artificial Sequence
  chemically synthesized
ttataaaatcactttcactgcc

SEQ ID NO: 1170492 - DNA, 22 bp, Artificial Sequence
  chemically synthesized
tataaaatcactttcactgcct

SEQ ID NO: 1170493 - DNA, 22 bp, Artificial Sequence
  chemically synthesized
ataaaatcactttcactgcctc

SEQ ID NO: 1170494 - DNA, 22 bp, Artificial Sequence
  chemically synthesized
aataaaaacaatgaggcagtga

SEQ ID NO: 1170495 - DNA, 22 bp, Artificial Sequence
  chemically synthesized
taaaatcactttcactgcctca

SEQ ID NO: 1170496 - DNA, 22 bp, Artificial Sequence
  chemically synthesized
cactaaataaaaacaatgaggc

SEQ ID NO: 1170497 - DNA, 22 bp, Artificial Sequence
  chemically synthesized
ggttgcactaaataaaaacaat

SEQ ID NO: 1170498 - DNA, 22 bp, Artificial Sequence
  chemically synthesized
tcactgcctcattgtttttatt

SEQ ID NO: 1170499 - DNA, 22 bp, Artificial Sequence
  chemically synthesized
tgggttgcactaaataaaaaca

SEQ ID NO: 1170500 - DNA, 22 bp, Artificial Sequence
  chemically synthesized
cactgcctcattgtttttattt

SEQ ID NO: 1170501 - DNA, 22 bp, Artificial Sequence
  chemically synthesized
actgcctcattgtttttattta

SEQ ID NO: 1170502 - DNA, 22 bp, Artificial Sequence
  chemically synthesized
ttctgggttgcactaaataaaa

SEQ ID NO: 1170503 - DNA, 22 bp, Artificial Sequence
  chemically synthesized
tattctgggttgcactaaataa

SEQ ID NO: 1170504 - DNA, 22 bp, Artificial Sequence
  chemically synthesized
cctcattgtttttatttagtgc

SEQ ID NO: 1170505 - DNA, 22 bp, Artificial Sequence
  chemically synthesized
tctattctgggttgcactaaat

SEQ ID NO: 1170506 - DNA, 22 bp, Artificial Sequence
  chemically synthesized
attgtttttatttagtgcaacc

SEQ ID NO: 1170507 - DNA, 22 bp, Artificial Sequence
  chemically synthesized
gttctctattctgggttgcact

SEQ ID NO: 1170508 - DNA, 22 bp, Artificial Sequence
  chemically synthesized
tttttatttagtgcaacccaga

SEQ ID NO: 1170509 - DNA, 22 bp, Artificial Sequence
  chemically synthesized
ttagttctctattctgggttgc

SEQ ID NO: 1170510 - DNA, 22 bp, Artificial Sequence
  chemically synthesized
ttatttagtgcaacccagaata

SEQ ID NO: 1170511 - DNA, 22 bp, Artificial Sequence
  chemically synthesized
ttgttagttctctattctgggt

SEQ ID NO: 1170512 - DNA, 22 bp, Artificial Sequence
  chemically synthesized
tatttagtgcaacccagaatag

SEQ ID NO: 1170513 - DNA, 22 bp, Artificial Sequence
  chemically synthesized
atttagtgcaacccagaataga

SEQ ID NO: 1170514 - DNA, 22 bp, Artificial Sequence
  chemically synthesized
tttagtgcaacccagaatagag

SEQ ID NO: 1170515 - DNA, 22 bp, Artificial Sequence
  chemically synthesized
ttgttgttagttctctattctg

SEQ ID NO: 1170516 - DNA, 22 bp, Artificial Sequence
  chemically synthesized
attgttgttagttctctattct

SEQ ID NO: 1170517 - DNA, 22 bp, Artificial Sequence
  chemically synthesized
tattgttgttagttctctattc

SEQ ID NO: 1170518 - DNA, 22 bp, Artificial Sequence
  chemically synthesized
agtgcaacccagaatagagaac

SEQ ID NO: 1170519 - DNA, 22 bp, Artificial Sequence
  chemically synthesized
gtgcaacccagaatagagaact

SEQ ID NO: 1170520 - DNA, 22 bp, Artificial Sequence
  chemically synthesized
tttattgttgttagttctctat

SEQ ID NO: 1170521 - DNA, 22 bp, Artificial Sequence
  chemically synthesized
ctctttattgttgttagttctc

SEQ ID NO: 1170522 - DNA, 22 bp, Artificial Sequence
  chemically synthesized
aaccaaactcctctttattgtt

SEQ ID NO: 1170523 - DNA, 22 bp, Artificial Sequence
  chemically synthesized
attgaaccaaactcctctttat

SEQ ID NO: 1170524 - DNA, 22 bp, Artificial Sequence
  chemically synthesized
acaacaataaagaggagtttgg

SEQ ID NO: 1170525 - DNA, 22 bp, Artificial Sequence
  chemically synthesized
aaatctaattgaaccaaactcc

SEQ ID NO: 1170526 - DNA, 22 bp, Artificial Sequence
  chemically synthesized
caacctaaaatctaattgaacc

SEQ ID NO: 1170527 - DNA, 22 bp, Artificial Sequence
  chemically synthesized
acaacctaaaatctaattgaac

SEQ ID NO: 1170528 - DNA, 22 bp, Artificial Sequence
  chemically synthesized
tacaacctaaaatctaattgaa

SEQ ID NO: 1170529 - DNA, 22 bp, Artificial Sequence
  chemically synthesized
ttacaacctaaaatctaattga

SEQ ID NO: 1170530 - DNA, 22 bp, Artificial Sequence
  chemically synthesized
ggttcaattagattttaggttg

SEQ ID NO: 1170531 - DNA, 22 bp, Artificial Sequence
  chemically synthesized
gttcaattagattttaggttgt

SEQ ID NO: 1170532 - DNA, 22 bp, Artificial Sequence
  chemically synthesized
gtagaatatttttacaacctaa

SEQ ID NO: 1170533 - DNA, 22 bp, Artificial Sequence
  chemically synthesized
agtagaatatttttacaaccta

SEQ ID NO: 1170534 - DNA, 22 bp, Artificial Sequence
  chemically synthesized
aattagattttaggttgtaaaa

SEQ ID NO: 1170535 - DNA, 22 bp, Artificial Sequence
  chemically synthesized
gattttaggttgtaaaaatatt

SEQ ID NO: 1170536 - DNA, 22 bp, Artificial Sequence
  chemically synthesized
taggttgtaaaaatattctact

SEQ ID NO: 1170537 - DNA, 22 bp, Artificial Sequence
  chemically synthesized
aggttgtaaaaatattctacta

SEQ ID NO: 1170538 - DNA, 22 bp, Artificial Sequence
  chemically synthesized
ggttgtaaaaatattctactaa

SEQ ID NO: 1170539 - DNA, 22 bp, Artificial Sequence
  chemically synthesized
gaaaagatgtgtcaatttagta

SEQ ID NO: 1170540 - DNA, 22 bp, Artificial Sequence
  chemically synthesized
taaaaatattctactaaattga

SEQ ID NO: 1170541 - DNA, 22 bp, Artificial Sequence
  chemically synthesized
gttagaaaagatgtgtcaattt

SEQ ID NO: 1170542 - DNA, 22 bp, Artificial Sequence
  chemically synthesized
cctagttagaaaagatgtgtca

SEQ ID NO: 1170543 - DNA, 22 bp, Artificial Sequence
  chemically synthesized
acctagttagaaaagatgtgtc

SEQ ID NO: 1170544 - DNA, 22 bp, Artificial Sequence
  chemically synthesized
tactaaattgacacatcttttc

SEQ ID NO: 1170545 - DNA, 22 bp, Artificial Sequence
  chemically synthesized
ctaaattgacacatcttttcta

SEQ ID NO: 1170546 - DNA, 22 bp, Artificial Sequence
  chemically synthesized
aattgacacatcttttctaact

SEQ ID NO: 1170547 - DNA, 22 bp, Artificial Sequence
  chemically synthesized
gagaaaatttacctagttagaa

SEQ ID NO: 1170548 - DNA, 22 bp, Artificial Sequence
  chemically synthesized
ggagaaaatttacctagttaga

SEQ ID NO: 1170549 - DNA, 22 bp, Artificial Sequence
  chemically synthesized
acacatcttttctaactaggta

SEQ ID NO: 1170550 - DNA, 22 bp, Artificial Sequence
  chemically synthesized
atgtccttggagaaaatttacc

SEQ ID NO: 1170551 - DNA, 22 bp, Artificial Sequence
  chemically synthesized
ttctaactaggtaaattttctc

SEQ ID NO: 1170552 - DNA, 22 bp, Artificial Sequence
  chemically synthesized
tctaactaggtaaattttctcc

SEQ ID NO: 1170553 - DNA, 22 bp, Artificial Sequence
  chemically synthesized
ctaactaggtaaattttctcca

SEQ ID NO: 1170554 - DNA, 22 bp, Artificial Sequence
  chemically synthesized
taactaggtaaattttctccaa

SEQ ID NO: 1170555 - DNA, 22 bp, Artificial Sequence
  chemically synthesized
actaggtaaattttctccaagg

SEQ ID NO: 1170556 - DNA, 22 bp, Artificial Sequence
  chemically synthesized
ggtaaattttctccaaggacat

SEQ ID NO: 1170557 - DNA, 22 bp, Artificial Sequence
  chemically synthesized
aggaggtgaatatagctaatgt

SEQ ID NO: 1170558 - DNA, 22 bp, Artificial Sequence
  chemically synthesized
tctccaaggacattagctatat

SEQ ID NO: 1170559 - DNA, 22 bp, Artificial Sequence
  chemically synthesized
ctccaaggacattagctatatt

SEQ ID NO: 1170560 - DNA, 22 bp, Artificial Sequence
  chemically synthesized
tccaaggacattagctatattc

SEQ ID NO: 1170561 - DNA, 22 bp, Artificial Sequence
  chemically synthesized
caaggacattagctatattcac

SEQ ID NO: 1170562 - DNA, 22 bp, Artificial Sequence
  chemically synthesized
gtgtatgttaaggaggtgaata

SEQ ID NO: 1170563 - DNA, 22 bp, Artificial Sequence
  chemically synthesized
gctatattcacctccttaacat

SEQ ID NO: 1170564 - DNA, 22 bp, Artificial Sequence
  chemically synthesized
tattcacctccttaacatacac

SEQ ID NO: 1170565 - DNA, 22 bp, Artificial Sequence
  chemically synthesized
acctccttaacatacaccagtt

SEQ ID NO: 1170566 - DNA, 22 bp, Artificial Sequence
  chemically synthesized
cttaacatacaccagttgcttg

SEQ ID NO: 1170567 - DNA, 22 bp, Artificial Sequence
  chemically synthesized
aacatacaccagttgcttggtt

SEQ ID NO: 1170568 - DNA, 22 bp, Artificial Sequence
  chemically synthesized
acatacaccagttgcttggttt

SEQ ID NO: 1170569 - DNA, 22 bp, Artificial Sequence
  chemically synthesized
cttggtttatcccgttaccttt

SEQ ID NO: 1170570 - DNA, 22 bp, Artificial Sequence
  chemically synthesized
gtgatatatgtgaaaggtaacg

SEQ ID NO: 1170571 - DNA, 22 bp, Artificial Sequence
  chemically synthesized
agtgatatatgtgaaaggtaac

SEQ ID NO: 1170572 - DNA, 22 bp, Artificial Sequence
  chemically synthesized
ggtttatcccgttacctttcac

SEQ ID NO: 1170573 - DNA, 22 bp, Artificial Sequence
  chemically synthesized
gtttatcccgttacctttcaca

SEQ ID NO: 1170574 - DNA, 22 bp, Artificial Sequence
  chemically synthesized
atcccgttacctttcacatata

SEQ ID NO: 1170575 - DNA, 22 bp, Artificial Sequence
  chemically synthesized
tcccgttacctttcacatatat

SEQ ID NO: 1170576 - DNA, 22 bp, Artificial Sequence
  chemically synthesized
cctttcacatatatcactaaat

SEQ ID NO: 1170577 - DNA, 22 bp, Artificial Sequence
  chemically synthesized
tcacatatatcactaaattctg

SEQ ID NO: 1170578 - DNA, 22 bp, Artificial Sequence
  chemically synthesized
cacatatatcactaaattctgt

SEQ ID NO: 1170579 - DNA, 22 bp, Artificial Sequence
  chemically synthesized
acatatatcactaaattctgtg

SEQ ID NO: 1170580 - DNA, 22 bp, Artificial Sequence
  chemically synthesized
aattctgtgtgctttctcttta

SEQ ID NO: 1170581 - DNA, 22 bp, Artificial Sequence
  chemically synthesized
tgtgtgctttctctttatttat

SEQ ID NO: 1170582 - DNA, 22 bp, Artificial Sequence
  chemically synthesized
tgtgctttctctttatttatgt

SEQ ID NO: 1170583 - DNA, 22 bp, Artificial Sequence
  chemically synthesized
tctctttatttatgttacatac

SEQ ID NO: 1170584 - DNA, 22 bp, Artificial Sequence
  chemically synthesized
ctctttatttatgttacatacc

SEQ ID NO: 1170585 - DNA, 22 bp, Artificial Sequence
  chemically synthesized
tctttatttatgttacatacct

SEQ ID NO: 1170586 - DNA, 22 bp, Artificial Sequence
  chemically synthesized
tttatttatgttacataccttt

SEQ ID NO: 1170587 - DNA, 22 bp, Artificial Sequence
  chemically synthesized
tatttatgttacatacctttgt

SEQ ID NO: 1170588 - DNA, 22 bp, Artificial Sequence
  chemically synthesized
atttatgttacatacctttgtc

SEQ ID NO: 1170589 - DNA, 22 bp, Artificial Sequence
  chemically synthesized
tttatgttacatacctttgtct

SEQ ID NO: 1170590 - DNA, 22 bp, Artificial Sequence
  chemically synthesized
atgttacatacctttgtctctt

SEQ ID NO: 1170591 - DNA, 22 bp, Artificial Sequence
  chemically synthesized
aggaataaggaaaagagacaaa

SEQ ID NO: 1170592 - DNA, 22 bp, Artificial Sequence
  chemically synthesized
tgttacatacctttgtctcttt

SEQ ID NO: 1170593 - DNA, 22 bp, Artificial Sequence
  chemically synthesized
aaggaataaggaaaagagacaa

SEQ ID NO: 1170594 - DNA, 22 bp, Artificial Sequence
  chemically synthesized
tttaaggaataaggaaaagaga

SEQ ID NO: 1170595 - DNA, 22 bp, Artificial Sequence
  chemically synthesized
gtttaaggaataaggaaaagag

SEQ ID NO: 1170596 - DNA, 22 bp, Artificial Sequence
  chemically synthesized
catacctttgtctcttttcctt

SEQ ID NO: 1170597 - DNA, 22 bp, Artificial Sequence
  chemically synthesized
tgtttaaggaataaggaaaaga

SEQ ID NO: 1170598 - DNA, 22 bp, Artificial Sequence
  chemically synthesized
tgtctcttttccttattcctta

SEQ ID NO: 1170599 - DNA, 22 bp, Artificial Sequence
  chemically synthesized
gtctcttttccttattccttaa

SEQ ID NO: 1170600 - DNA, 22 bp, Artificial Sequence
  chemically synthesized
tctcttttccttattccttaaa

SEQ ID NO: 1170601 - DNA, 22 bp, Artificial Sequence
  chemically synthesized
ttttccttattccttaaacaaa

SEQ ID NO: 1170602 - DNA, 22 bp, Artificial Sequence
  chemically synthesized
ttccttattccttaaacaaaga

SEQ ID NO: 1170603 - DNA, 22 bp, Artificial Sequence
  chemically synthesized
tccttattccttaaacaaagat

SEQ ID NO: 1170604 - DNA, 22 bp, Artificial Sequence
  chemically synthesized
ccttattccttaaacaaagatg

SEQ ID NO: 1170605 - DNA, 22 bp, Artificial Sequence
  chemically synthesized
cttattccttaaacaaagatgt

SEQ ID NO: 1170606 - DNA, 22 bp, Artificial Sequence
  chemically synthesized
tgaaggatataccacatctttg

SEQ ID NO: 1170607 - DNA, 22 bp, Artificial Sequence
  chemically synthesized
atgaaggatataccacatcttt

SEQ ID NO: 1170608 - DNA, 22 bp, Artificial Sequence
  chemically synthesized
attccttaaacaaagatgtggt

SEQ ID NO: 1170609 - DNA, 22 bp, Artificial Sequence
  chemically synthesized
ttccttaaacaaagatgtggta

SEQ ID NO: 1170610 - DNA, 22 bp, Artificial Sequence
  chemically synthesized
ccttatgaaggatataccacat

SEQ ID NO: 1170611 - DNA, 22 bp, Artificial Sequence
  chemically synthesized
cttaaacaaagatgtggtatat

SEQ ID NO: 1170612 - DNA, 22 bp, Artificial Sequence
  chemically synthesized
tcccttatgaaggatataccac

SEQ ID NO: 1170613 - DNA, 22 bp, Artificial Sequence
  chemically synthesized
aaacaaagatgtggtatatcct

SEQ ID NO: 1170614 - DNA, 22 bp, Artificial Sequence
  chemically synthesized
tctcccttatgaaggatatacc

SEQ ID NO: 1170615 - DNA, 22 bp, Artificial Sequence
  chemically synthesized
aacaaagatgtggtatatcctt

SEQ ID NO: 1170616 - DNA, 22 bp, Artificial Sequence
  chemically synthesized
ctctcccttatgaaggatatac

SEQ ID NO: 1170617 - DNA, 22 bp, Artificial Sequence
  chemically synthesized
ccccatagggatttctctccct

SEQ ID NO: 1170618 - DNA, 22 bp, Artificial Sequence
  chemically synthesized
gttcccccatagggatttctct

SEQ ID NO: 1170619 - DNA, 22 bp, Artificial Sequence
  chemically synthesized
cataagggagagaaatccctat

SEQ ID NO: 1170620 - DNA, 22 bp, Artificial Sequence
  chemically synthesized
ataagggagagaaatccctatg

SEQ ID NO: 1170621 - DNA, 22 bp, Artificial Sequence
  chemically synthesized
cccattagttcccccataggga

SEQ ID NO: 1170622 - DNA, 22 bp, Artificial Sequence
  chemically synthesized
tgggggaactaatgggtagctt

SEQ ID NO: 1170623 - DNA, 22 bp, Artificial Sequence
  chemically synthesized
atgggtagcttcctgtctctac

SEQ ID NO: 1170624 - DNA, 22 bp, Artificial Sequence
  chemically synthesized
tagatgcccaagaagtagagac

SEQ ID NO: 1170625 - DNA, 22 bp, Artificial Sequence
  chemically synthesized
cctgtctctacttcttgggcat

SEQ ID NO: 1170626 - DNA, 22 bp, Artificial Sequence
  chemically synthesized
ctgtctctacttcttgggcatc

SEQ ID NO: 1170627 - DNA, 22 bp, Artificial Sequence
  chemically synthesized
tctctacttcttgggcatctat

SEQ ID NO: 1170628 - DNA, 22 bp, Artificial Sequence
  chemically synthesized
tcccacagaagcactatagatg

SEQ ID NO: 1170629 - DNA, 22 bp, Artificial Sequence
  chemically synthesized
tacttcttgggcatctatagtg

SEQ ID NO: 1170630 - DNA, 22 bp, Artificial Sequence
  chemically synthesized
cttcttgggcatctatagtgct

SEQ ID NO: 1170631 - DNA, 22 bp, Artificial Sequence
  chemically synthesized
cttgggcatctatagtgcttct

SEQ ID NO: 1170632 - DNA, 22 bp, Artificial Sequence
  chemically synthesized
ttgggcatctatagtgcttctg

SEQ ID NO: 1170633 - DNA, 22 bp, Artificial Sequence
  chemically synthesized
gggcatctatagtgcttctgtg

SEQ ID NO: 1170634 - DNA, 22 bp, Artificial Sequence
  chemically synthesized
ggcatctatagtgcttctgtgg

SEQ ID NO: 1170635 - DNA, 22 bp, Artificial Sequence
  chemically synthesized
ataatgaaactatcccacagaa

SEQ ID NO: 1170636 - DNA, 22 bp, Artificial Sequence
  chemically synthesized
aataatgaaactatcccacaga

SEQ ID NO: 1170637 - DNA, 22 bp, Artificial Sequence
  chemically synthesized
taataatgaaactatcccacag

SEQ ID NO: 1170638 - DNA, 22 bp, Artificial Sequence
  chemically synthesized
tagtgcttctgtgggatagttt

SEQ ID NO: 1170639 - DNA, 22 bp, Artificial Sequence
  chemically synthesized
attttaataatgaaactatccc

SEQ ID NO: 1170640 - DNA, 22 bp, Artificial Sequence
  chemically synthesized
cctaattttaataatgaaacta

SEQ ID NO: 1170641 - DNA, 22 bp, Artificial Sequence
  chemically synthesized
ccctaattttaataatgaaact

SEQ ID NO: 1170642 - DNA, 22 bp, Artificial Sequence
  chemically synthesized
ctgtgggatagtttcattatta

SEQ ID NO: 1170643 - DNA, 22 bp, Artificial Sequence
  chemically synthesized
tttccctaattttaataatgaa

SEQ ID NO: 1170644 - DNA, 22 bp, Artificial Sequence
  chemically synthesized
tgtgggatagtttcattattaa

SEQ ID NO: 1170645 - DNA, 22 bp, Artificial Sequence
  chemically synthesized
tgggatagtttcattattaaaa

SEQ ID NO: 1170646 - DNA, 22 bp, Artificial Sequence
  chemically synthesized
tattatttccctaattttaata

SEQ ID NO: 1170647 - DNA, 22 bp, Artificial Sequence
  chemically synthesized
atattatttccctaattttaat

SEQ ID NO: 1170648 - DNA, 22 bp, Artificial Sequence
  chemically synthesized
tttatattatttccctaatttt

SEQ ID NO: 1170649 - DNA, 22 bp, Artificial Sequence
  chemically synthesized
gttatttatattatttccctaa

SEQ ID NO: 1170650 - DNA, 22 bp, Artificial Sequence
  chemically synthesized
cattattaaaattagggaaata

SEQ ID NO: 1170651 - DNA, 22 bp, Artificial Sequence
  chemically synthesized
attattaaaattagggaaataa

SEQ ID NO: 1170652 - DNA, 22 bp, Artificial Sequence
  chemically synthesized
actagttatttatattatttcc

SEQ ID NO: 1170653 - DNA, 22 bp, Artificial Sequence
  chemically synthesized
ttaaaattagggaaataatata

SEQ ID NO: 1170654 - DNA, 22 bp, Artificial Sequence
  chemically synthesized
gctcactagttatttatattat

SEQ ID NO: 1170655 - DNA, 22 bp, Artificial Sequence
  chemically synthesized
aaattagggaaataatataaat

SEQ ID NO: 1170656 - DNA, 22 bp, Artificial Sequence
  chemically synthesized
attagctcactagttatttata

SEQ ID NO: 1170657 - DNA, 22 bp, Artificial Sequence
  chemically synthesized
gggaaataatataaataactag

SEQ ID NO: 1170658 - DNA, 22 bp, Artificial Sequence
  chemically synthesized
ctaattagctcactagttattt

SEQ ID NO: 1170659 - DNA, 22 bp, Artificial Sequence
  chemically synthesized
cctaattagctcactagttatt

SEQ ID NO: 1170660 - DNA, 22 bp, Artificial Sequence
  chemically synthesized
tcttcctaattagctcactagt

SEQ ID NO: 1170661 - DNA, 22 bp, Artificial Sequence
  chemically synthesized
taattgtcttcctaattagctc

SEQ ID NO: 1170662 - DNA, 22 bp, Artificial Sequence
  chemically synthesized
ataattgtcttcctaattagct

SEQ ID NO: 1170663 - DNA, 22 bp, Artificial Sequence
  chemically synthesized
gtgagctaattaggaagacaat

SEQ ID NO: 1170664 - DNA, 22 bp, Artificial Sequence
  chemically synthesized
cacaatcacacccttataattg

SEQ ID NO: 1170665 - DNA, 22 bp, Artificial Sequence
  chemically synthesized
ccacaatcacacccttataatt

SEQ ID NO: 1170666 - DNA, 22 bp, Artificial Sequence
  chemically synthesized
attaggaagacaattataaggg

SEQ ID NO: 1170667 - DNA, 22 bp, Artificial Sequence
  chemically synthesized
ggaagacaattataagggtgtg

SEQ ID NO: 1170668 - DNA, 22 bp, Artificial Sequence
  chemically synthesized
cccatttccacaatcacaccct

SEQ ID NO: 1170669 - DNA, 22 bp, Artificial Sequence
  chemically synthesized
ccccatttccacaatcacaccc

SEQ ID NO: 1170670 - DNA, 22 bp, Artificial Sequence
  chemically synthesized
taagggtgtgattgtggaaatg

SEQ ID NO: 1170671 - DNA, 22 bp, Artificial Sequence
  chemically synthesized
ataaaagaacttccccatttcc

SEQ ID NO: 1170672 - DNA, 22 bp, Artificial Sequence
  chemically synthesized
tcataaaagaacttccccattt

SEQ ID NO: 1170673 - DNA, 22 bp, Artificial Sequence
  chemically synthesized
tggaaatggggaagttctttta

SEQ ID NO: 1170674 - DNA, 22 bp, Artificial Sequence
  chemically synthesized
catcacctctcataaaagaact

SEQ ID NO: 1170675 - DNA, 22 bp, Artificial Sequence
  chemically synthesized
cgagatgctacatcacctctca

SEQ ID NO: 1170676 - DNA, 22 bp, Artificial Sequence
  chemically synthesized
ccgagatgctacatcacctctc

SEQ ID NO: 1170677 - DNA, 22 bp, Artificial Sequence
  chemically synthesized
ttttatgagaggtgatgtagca

SEQ ID NO: 1170678 - DNA, 22 bp, Artificial Sequence
  chemically synthesized
ttatgagaggtgatgtagcatc

SEQ ID NO: 1170679 - DNA, 22 bp, Artificial Sequence
  chemically synthesized
tatgagaggtgatgtagcatct

SEQ ID NO: 1170680 - DNA, 22 bp, Artificial Sequence
  chemically synthesized
atgagaggtgatgtagcatctc

SEQ ID NO: 1170681 - DNA, 22 bp, Artificial Sequence
  chemically synthesized
tgagaggtgatgtagcatctcg

SEQ ID NO: 1170682 - DNA, 22 bp, Artificial Sequence
  chemically synthesized
tcgtgaggcttccgagatgcta

SEQ ID NO: 1170683 - DNA, 22 bp, Artificial Sequence
  chemically synthesized
ctgtcgtgaggcttccgagatg

SEQ ID NO: 1170684 - DNA, 22 bp, Artificial Sequence
  chemically synthesized
tctactgtcgtgaggcttccga

SEQ ID NO: 1170685 - DNA, 22 bp, Artificial Sequence
  chemically synthesized
ggaagcctcacgacagtagaca

SEQ ID NO: 1170686 - DNA, 22 bp, Artificial Sequence
  chemically synthesized
aacaaaataaactgtctactgt

SEQ ID NO: 1170687 - DNA, 22 bp, Artificial Sequence
  chemically synthesized
acgacagtagacagtttatttt

SEQ ID NO: 1170688 - DNA, 22 bp, Artificial Sequence
  chemically synthesized
tatgtcaggtgctgaacaaaat

SEQ ID NO: 1170689 - DNA, 22 bp, Artificial Sequence
  chemically synthesized
tactgtatgtcaggtgctgaac

SEQ ID NO: 1170690 - DNA, 22 bp, Artificial Sequence
  chemically synthesized
attttgttcagcacctgacata

SEQ ID NO: 1170691 - DNA, 22 bp, Artificial Sequence
  chemically synthesized
ttttgttcagcacctgacatac

SEQ ID NO: 1170692 - DNA, 22 bp, Artificial Sequence
  chemically synthesized
tgttcagcacctgacatacagt

SEQ ID NO: 1170693 - DNA, 22 bp, Artificial Sequence
  chemically synthesized
gttcagcacctgacatacagta

SEQ ID NO: 1170694 - DNA, 22 bp, Artificial Sequence
  chemically synthesized
ttcagcacctgacatacagtat

SEQ ID NO: 1170695 - DNA, 22 bp, Artificial Sequence
  chemically synthesized
agcacctgacatacagtataac

SEQ ID NO: 1170696 - DNA, 22 bp, Artificial Sequence
  chemically synthesized
aacaaacatatagtatgttata

SEQ ID NO: 1170697 - DNA, 22 bp, Artificial Sequence
  chemically synthesized
acatacagtataacatactata

SEQ ID NO: 1170698 - DNA, 22 bp, Artificial Sequence
  chemically synthesized
tattcaacaaacatatagtatg

SEQ ID NO: 1170699 - DNA, 22 bp, Artificial Sequence
  chemically synthesized
ttgtattcaacaaacatatagt

SEQ ID NO: 1170700 - DNA, 22 bp, Artificial Sequence
  chemically synthesized
agagacacattattgtattcaa

SEQ ID NO: 1170701 - DNA, 22 bp, Artificial Sequence
  chemically synthesized
tatgtttgttgaatacaataat

SEQ ID NO: 1170702 - DNA, 22 bp, Artificial Sequence
  chemically synthesized
gttgaatacaataatgtgtctc

SEQ ID NO: 1170703 - DNA, 22 bp, Artificial Sequence
  chemically synthesized
ttgaatacaataatgtgtctct

SEQ ID NO: 1170704 - DNA, 22 bp, Artificial Sequence
  chemically synthesized
catgtcatatgctaagagacac

SEQ ID NO: 1170705 - DNA, 22 bp, Artificial Sequence
  chemically synthesized
aatacaataatgtgtctcttag

SEQ ID NO: 1170706 - DNA, 22 bp, Artificial Sequence
  chemically synthesized
ttacatgtcatatgctaagaga

SEQ ID NO: 1170707 - DNA, 22 bp, Artificial Sequence
  chemically synthesized
ttagcatatgacatgtaacaat

SEQ ID NO: 1170708 - DNA, 22 bp, Artificial Sequence
  chemically synthesized
agcatatgacatgtaacaatat

SEQ ID NO: 1170709 - DNA, 22 bp, Artificial Sequence
  chemically synthesized
gcatatgacatgtaacaatatt

SEQ ID NO: 1170710 - DNA, 22 bp, Artificial Sequence
  chemically synthesized
atatcagtataaggtaaaatgg

SEQ ID NO: 1170711 - DNA, 22 bp, Artificial Sequence
  chemically synthesized
cattttaccttatactgatatg

SEQ ID NO: 1170712 - DNA, 22 bp, Artificial Sequence
  chemically synthesized
ggaaaaaaaatgtcctcatatc

SEQ ID NO: 1170713 - DNA, 22 bp, Artificial Sequence
  chemically synthesized
taccttatactgatatgaggac

SEQ ID NO: 1170714 - DNA, 22 bp, Artificial Sequence
  chemically synthesized
aggaaaaaaaatgtcctcatat

SEQ ID NO: 1170715 - DNA, 22 bp, Artificial Sequence
  chemically synthesized
accttatactgatatgaggaca

SEQ ID NO: 1170716 - DNA, 22 bp, Artificial Sequence
  chemically synthesized
ccttatactgatatgaggacat

SEQ ID NO: 1170717 - DNA, 22 bp, Artificial Sequence
  chemically synthesized
ttaggaaaaaaaatgtcctcat

SEQ ID NO: 1170718 - DNA, 22 bp, Artificial Sequence
  chemically synthesized
tcttaggaaaaaaaatgtcctc

SEQ ID NO: 1170719 - DNA, 22 bp, Artificial Sequence
  chemically synthesized
atactgatatgaggacattttt

SEQ ID NO: 1170720 - DNA, 22 bp, Artificial Sequence
  chemically synthesized
tactgatatgaggacatttttt

SEQ ID NO: 1170721 - DNA, 22 bp, Artificial Sequence
  chemically synthesized
attctcttaggaaaaaaaatgt

SEQ ID NO: 1170722 - DNA, 22 bp, Artificial Sequence
  chemically synthesized
atatgaggacattttttttcct

SEQ ID NO: 1170723 - DNA, 22 bp, Artificial Sequence
  chemically synthesized
gtctaattctcttaggaaaaaa

SEQ ID NO: 1170724 - DNA, 22 bp, Artificial Sequence
  chemically synthesized
ggtctaattctcttaggaaaaa

SEQ ID NO: 1170725 - DNA, 22 bp, Artificial Sequence
  chemically synthesized
tttttcctaagagaattagacc

SEQ ID NO: 1170726 - DNA, 22 bp, Artificial Sequence
  chemically synthesized
ttttcctaagagaattagacca

SEQ ID NO: 1170727 - DNA, 22 bp, Artificial Sequence
  chemically synthesized
tttcctaagagaattagaccaa

SEQ ID NO: 1170728 - DNA, 22 bp, Artificial Sequence
  chemically synthesized
ttcctaagagaattagaccaag

SEQ ID NO: 1170729 - DNA, 22 bp, Artificial Sequence
  chemically synthesized
tcctaagagaattagaccaagg

SEQ ID NO: 1170730 - DNA, 22 bp, Artificial Sequence
  chemically synthesized
cctaagagaattagaccaaggc

SEQ ID NO: 1170731 - DNA, 22 bp, Artificial Sequence
  chemically synthesized
tcatggaaagatgccttggtct

SEQ ID NO: 1170732 - DNA, 22 bp, Artificial Sequence
  chemically synthesized
ctaagagaattagaccaaggca

SEQ ID NO: 1170733 - DNA, 22 bp, Artificial Sequence
  chemically synthesized
tgtcatggaaagatgccttggt

SEQ ID NO: 1170734 - DNA, 22 bp, Artificial Sequence
  chemically synthesized
agagaattagaccaaggcatct

SEQ ID NO: 1170735 - DNA, 22 bp, Artificial Sequence
  chemically synthesized
ctctgtcatggaaagatgcctt

SEQ ID NO: 1170736 - DNA, 22 bp, Artificial Sequence
  chemically synthesized
tccctgctctgtcatggaaaga

SEQ ID NO: 1170737 - DNA, 22 bp, Artificial Sequence
  chemically synthesized
gtccctgctctgtcatggaaag

SEQ ID NO: 1170738 - DNA, 22 bp, Artificial Sequence
  chemically synthesized
gaccaaggcatctttccatgac

SEQ ID NO: 1170739 - DNA, 22 bp, Artificial Sequence
  chemically synthesized
ttgtccctgctctgtcatggaa

SEQ ID NO: 1170740 - DNA, 22 bp, Artificial Sequence
  chemically synthesized
cttgtccctgctctgtcatgga

SEQ ID NO: 1170741 - DNA, 22 bp, Artificial Sequence
  chemically synthesized
tgtcatttcttgtccctgctct

SEQ ID NO: 1170742 - DNA, 22 bp, Artificial Sequence
  chemically synthesized
gtgtcatttcttgtccctgctc

SEQ ID NO: 1170743 - DNA, 22 bp, Artificial Sequence
  chemically synthesized
tccatgacagagcagggacaag

SEQ ID NO: 1170744 - DNA, 22 bp, Artificial Sequence
  chemically synthesized
ccatgacagagcagggacaaga

SEQ ID NO: 1170745 - DNA, 22 bp, Artificial Sequence
  chemically synthesized
catgacagagcagggacaagaa

SEQ ID NO: 1170746 - DNA, 22 bp, Artificial Sequence
  chemically synthesized
aagaaggcagtaagtgaaataa

SEQ ID NO: 1170747 - DNA, 22 bp, Artificial Sequence
  chemically synthesized
cacttgtttatttcacttactg

SEQ ID NO: 1170748 - DNA, 22 bp, Artificial Sequence
  chemically synthesized
cattgaagaaggcagtaagtga

SEQ ID NO: 1170749 - DNA, 22 bp, Artificial Sequence
  chemically synthesized
gtttatttcacttactgccttc

SEQ ID NO: 1170750 - DNA, 22 bp, Artificial Sequence
  chemically synthesized
tttatttcacttactgccttct

SEQ ID NO: 1170751 - DNA, 22 bp, Artificial Sequence
  chemically synthesized
atttcacttactgccttcttca

SEQ ID NO: 1170752 - DNA, 22 bp, Artificial Sequence
  chemically synthesized
tttcacttactgccttcttcaa

SEQ ID NO: 1170753 - DNA, 22 bp, Artificial Sequence
  chemically synthesized
cacttactgccttcttcaatgc

SEQ ID NO: 1170754 - DNA, 22 bp, Artificial Sequence
  chemically synthesized
acttactgccttcttcaatgca

SEQ ID NO: 1170755 - DNA, 22 bp, Artificial Sequence
  chemically synthesized
actgccttcttcaatgcagtgt

SEQ ID NO: 1170756 - DNA, 22 bp, Artificial Sequence
  chemically synthesized
ctgccttcttcaatgcagtgtt

SEQ ID NO: 1170757 - DNA, 22 bp, Artificial Sequence
  chemically synthesized
aatagggaagccaacactgcat

SEQ ID NO: 1170758 - DNA, 22 bp, Artificial Sequence
  chemically synthesized
gaatagggaagccaacactgca

SEQ ID NO: 1170759 - DNA, 22 bp, Artificial Sequence
  chemically synthesized
ccttcttcaatgcagtgttggc

SEQ ID NO: 1170760 - DNA, 22 bp, Artificial Sequence
  chemically synthesized
cttgaatagggaagccaacact

SEQ ID NO: 1170761 - DNA, 22 bp, Artificial Sequence
  chemically synthesized
ccttgaatagggaagccaacac

SEQ ID NO: 1170762 - DNA, 22 bp, Artificial Sequence
  chemically synthesized
tccttgaatagggaagccaaca

SEQ ID NO: 1170763 - DNA, 22 bp, Artificial Sequence
  chemically synthesized
cttcaatgcagtgttggcttcc

SEQ ID NO: 1170764 - DNA, 22 bp, Artificial Sequence
  chemically synthesized
ttcaatgcagtgttggcttccc

SEQ ID NO: 1170765 - DNA, 22 bp, Artificial Sequence
  chemically synthesized
tttccttgaatagggaagccaa

SEQ ID NO: 1170766 - DNA, 22 bp, Artificial Sequence
  chemically synthesized
caatgcagtgttggcttcccta

SEQ ID NO: 1170767 - DNA, 22 bp, Artificial Sequence
  chemically synthesized
aatgcagtgttggcttccctat

SEQ ID NO: 1170768 - DNA, 22 bp, Artificial Sequence
  chemically synthesized
caagaatctctttccttgaata

SEQ ID NO: 1170769 - DNA, 22 bp, Artificial Sequence
  chemically synthesized
gcttccctattcaaggaaagag

SEQ ID NO: 1170770 - DNA, 22 bp, Artificial Sequence
  chemically synthesized
ccctattcaaggaaagagattc

SEQ ID NO: 1170771 - DNA, 22 bp, Artificial Sequence
  chemically synthesized
cctattcaaggaaagagattct

SEQ ID NO: 1170772 - DNA, 22 bp, Artificial Sequence
  chemically synthesized
ttcaaggaaagagattcttgga

SEQ ID NO: 1170773 - DNA, 22 bp, Artificial Sequence
  chemically synthesized
aaggaaagagattcttggaatc

SEQ ID NO: 1170774 - DNA, 22 bp, Artificial Sequence
  chemically synthesized
aataggaaaggaataggaagag

SEQ ID NO: 1170775 - DNA, 22 bp, Artificial Sequence
  chemically synthesized
gaataggaaaggaataggaaga

SEQ ID NO: 1170776 - DNA, 22 bp, Artificial Sequence
  chemically synthesized
cttgaataggaaaggaatagga

SEQ ID NO: 1170777 - DNA, 22 bp, Artificial Sequence
  chemically synthesized
ttggaatctcttcctattcctt

SEQ ID NO: 1170778 - DNA, 22 bp, Artificial Sequence
  chemically synthesized
ccttgaataggaaaggaatagg

SEQ ID NO: 1170779 - DNA, 22 bp, Artificial Sequence
  chemically synthesized
tccttgaataggaaaggaatag

SEQ ID NO: 1170780 - DNA, 22 bp, Artificial Sequence
  chemically synthesized
ggaatctcttcctattcctttc

SEQ ID NO: 1170781 - DNA, 22 bp, Artificial Sequence
  chemically synthesized
gaatctcttcctattcctttcc

SEQ ID NO: 1170782 - DNA, 22 bp, Artificial Sequence
  chemically synthesized
aagacctttccttgaataggaa

SEQ ID NO: 1170783 - DNA, 22 bp, Artificial Sequence
  chemically synthesized
ttcctattcctttcctattcaa

SEQ ID NO: 1170784 - DNA, 22 bp, Artificial Sequence
  chemically synthesized
tgaagacctttccttgaatagg

SEQ ID NO: 1170785 - DNA, 22 bp, Artificial Sequence
  chemically synthesized
cctattcctttcctattcaagg

SEQ ID NO: 1170786 - DNA, 22 bp, Artificial Sequence
  chemically synthesized
ctattcctttcctattcaagga

SEQ ID NO: 1170787 - DNA, 22 bp, Artificial Sequence
  chemically synthesized
ttcctttcctattcaaggaaag

SEQ ID NO: 1170788 - DNA, 22 bp, Artificial Sequence
  chemically synthesized
ctttcctattcaaggaaaggtc

SEQ ID NO: 1170789 - DNA, 22 bp, Artificial Sequence
  chemically synthesized
tcctattcaaggaaaggtcttc

SEQ ID NO: 1170790 - DNA, 22 bp, Artificial Sequence
  chemically synthesized
cctattcaaggaaaggtcttca

SEQ ID NO: 1170791 - DNA, 22 bp, Artificial Sequence
  chemically synthesized
ctattcaaggaaaggtcttcag

SEQ ID NO: 1170792 - DNA, 22 bp, Artificial Sequence
  chemically synthesized
aaatggcaggctctgaagacct

SEQ ID NO: 1170793 - DNA, 22 bp, Artificial Sequence
  chemically synthesized
gaaatggcaggctctgaagacc

SEQ ID NO: 1170794 - DNA, 22 bp, Artificial Sequence
  chemically synthesized
tgaaatggcaggctctgaagac

SEQ ID NO: 1170795 - DNA, 22 bp, Artificial Sequence
  chemically synthesized
ttcaaggaaaggtcttcagagc

SEQ ID NO: 1170796 - DNA, 22 bp, Artificial Sequence
  chemically synthesized
tttgaaatggcaggctctgaag

SEQ ID NO: 1170797 - DNA, 22 bp, Artificial Sequence
  chemically synthesized
aaggaaaggtcttcagagcctg

SEQ ID NO: 1170798 - DNA, 22 bp, Artificial Sequence
  chemically synthesized
ataccattctttgaaatggcag

SEQ ID NO: 1170799 - DNA, 22 bp, Artificial Sequence
  chemically synthesized
cagagcctgccatttcaaagaa

SEQ ID NO: 1170800 - DNA, 22 bp, Artificial Sequence
  chemically synthesized
agagcctgccatttcaaagaat

SEQ ID NO: 1170801 - DNA, 22 bp, Artificial Sequence
  chemically synthesized
ccaagaattaataccattcttt

SEQ ID NO: 1170802 - DNA, 22 bp, Artificial Sequence
  chemically synthesized
cccaagaattaataccattctt

SEQ ID NO: 1170803 - DNA, 22 bp, Artificial Sequence
  chemically synthesized
ccatttcaaagaatggtattaa

SEQ ID NO: 1170804 - DNA, 22 bp, Artificial Sequence
  chemically synthesized
caaagaatggtattaattcttg

SEQ ID NO: 1170805 - DNA, 22 bp, Artificial Sequence
  chemically synthesized
ccagagtcttcccaagaattaa

SEQ ID NO: 1170806 - DNA, 22 bp, Artificial Sequence
  chemically synthesized
aaagaatggtattaattcttgg

SEQ ID NO: 1170807 - DNA, 22 bp, Artificial Sequence
  chemically synthesized
atgaaatctaccagagtcttcc

SEQ ID NO: 1170808 - DNA, 22 bp, Artificial Sequence
  chemically synthesized
attcttgggaagactctggtag

SEQ ID NO: 1170809 - DNA, 22 bp, Artificial Sequence
  chemically synthesized
ttgggaagactctggtagattt

SEQ ID NO: 1170810 - DNA, 22 bp, Artificial Sequence
  chemically synthesized
caggtgttaatgaaatctacca

SEQ ID NO: 1170811 - DNA, 22 bp, Artificial Sequence
  chemically synthesized
gcaggtgttaatgaaatctacc

SEQ ID NO: 1170812 - DNA, 22 bp, Artificial Sequence
  chemically synthesized
gggaagactctggtagatttca

SEQ ID NO: 1170813 - DNA, 22 bp, Artificial Sequence
  chemically synthesized
ggaagactctggtagatttcat

SEQ ID NO: 1170814 - DNA, 22 bp, Artificial Sequence
  chemically synthesized
tggtagatttcattaacacctg

SEQ ID NO: 1170815 - DNA, 22 bp, Artificial Sequence
  chemically synthesized
gtagatttcattaacacctgca

SEQ ID NO: 1170816 - DNA, 22 bp, Artificial Sequence
  chemically synthesized
aggcagagggtggaatttgcag

SEQ ID NO: 1170817 - DNA, 22 bp, Artificial Sequence
  chemically synthesized
gaggcagagggtggaatttgca

SEQ ID NO: 1170818 - DNA, 22 bp, Artificial Sequence
  chemically synthesized
cattaacacctgcaaattccac

SEQ ID NO: 1170819 - DNA, 22 bp, Artificial Sequence
  chemically synthesized
attaacacctgcaaattccacc

SEQ ID NO: 1170820 - DNA, 22 bp, Artificial Sequence
  chemically synthesized
cttgaggcagagggtggaattt

SEQ ID NO: 1170821 - DNA, 22 bp, Artificial Sequence
  chemically synthesized
ccttgaggcagagggtggaatt

SEQ ID NO: 1170822 - DNA, 22 bp, Artificial Sequence
  chemically synthesized
tccttgaggcagagggtggaat

SEQ ID NO: 1170823 - DNA, 22 bp, Artificial Sequence
  chemically synthesized
acacctgcaaattccaccctct

SEQ ID NO: 1170824 - DNA, 22 bp, Artificial Sequence
  chemically synthesized
ctttccttgaggcagagggtgg

SEQ ID NO: 1170825 - DNA, 22 bp, Artificial Sequence
  chemically synthesized
ttactttccttgaggcagaggg

SEQ ID NO: 1170826 - DNA, 22 bp, Artificial Sequence
  chemically synthesized
attactttccttgaggcagagg

SEQ ID NO: 1170827 - DNA, 22 bp, Artificial Sequence
  chemically synthesized
tattactttccttgaggcagag

SEQ ID NO: 1170828 - DNA, 22 bp, Artificial Sequence
  chemically synthesized
caaattccaccctctgcctcaa

SEQ ID NO: 1170829 - DNA, 22 bp, Artificial Sequence
  chemically synthesized
ttattactttccttgaggcaga

SEQ ID NO: 1170830 - DNA, 22 bp, Artificial Sequence
  chemically synthesized
caccctctgcctcaaggaaagt

SEQ ID NO: 1170831 - DNA, 22 bp, Artificial Sequence
  chemically synthesized
tgcctcaaggaaagtaataaaa

SEQ ID NO: 1170832 - DNA, 22 bp, Artificial Sequence
  chemically synthesized
cctcaaggaaagtaataaaagt

SEQ ID NO: 1170833 - DNA, 22 bp, Artificial Sequence
  chemically synthesized
aaggaaagtaataaaagtcctc

SEQ ID NO: 1170834 - DNA, 22 bp, Artificial Sequence
  chemically synthesized
agccaacaggatagaggacttt

SEQ ID NO: 1170835 - DNA, 22 bp, Artificial Sequence
  chemically synthesized
cagccaacaggatagaggactt

SEQ ID NO: 1170836 - DNA, 22 bp, Artificial Sequence
  chemically synthesized
tcagccaacaggatagaggact

SEQ ID NO: 1170837 - DNA, 22 bp, Artificial Sequence
  chemically synthesized
ctttcagccaacaggatagagg

SEQ ID NO: 1170838 - DNA, 22 bp, Artificial Sequence
  chemically synthesized
cactgctttcagccaacaggat

SEQ ID NO: 1170839 - DNA, 22 bp, Artificial Sequence
  chemically synthesized
ccactgctttcagccaacagga

SEQ ID NO: 1170840 - DNA, 22 bp, Artificial Sequence
  chemically synthesized
tccactgctttcagccaacagg

SEQ ID NO: 1170841 - DNA, 22 bp, Artificial Sequence
  chemically synthesized
aagaactttccactgctttcag

SEQ ID NO: 1170842 - DNA, 22 bp, Artificial Sequence
  chemically synthesized
tatcctgttggctgaaagcagt

SEQ ID NO: 1170843 - DNA, 22 bp, Artificial Sequence
  chemically synthesized
tcctgttggctgaaagcagtgg

SEQ ID NO: 1170844 - DNA, 22 bp, Artificial Sequence
  chemically synthesized
ttggctgaaagcagtggaaagt

SEQ ID NO: 1170845 - DNA, 22 bp, Artificial Sequence
  chemically synthesized
gctgaaagcagtggaaagttct

SEQ ID NO: 1170846 - DNA, 22 bp, Artificial Sequence
  chemically synthesized
aaagcagtggaaagttcttcaa

SEQ ID NO: 1170847 - DNA, 22 bp, Artificial Sequence
  chemically synthesized
ggagccaatgataaaattgaag

SEQ ID NO: 1170848 - DNA, 22 bp, Artificial Sequence
  chemically synthesized
ttaggagccaatgataaaattg

SEQ ID NO: 1170849 - DNA, 22 bp, Artificial Sequence
  chemically synthesized
ctattaggagccaatgataaaa

SEQ ID NO: 1170850 - DNA, 22 bp, Artificial Sequence
  chemically synthesized
ctcctattaggagccaatgata

SEQ ID NO: 1170851 - DNA, 22 bp, Artificial Sequence
  chemically synthesized
ttcaattttatcattggctcct

SEQ ID NO: 1170852 - DNA, 22 bp, Artificial Sequence
  chemically synthesized
caattttatcattggctcctaa

SEQ ID NO: 1170853 - DNA, 22 bp, Artificial Sequence
  chemically synthesized
aattttatcattggctcctaat

SEQ ID NO: 1170854 - DNA, 22 bp, Artificial Sequence
  chemically synthesized
aagcatgattactcctattagg

SEQ ID NO: 1170855 - DNA, 22 bp, Artificial Sequence
  chemically synthesized
tatcattggctcctaataggag

SEQ ID NO: 1170856 - DNA, 22 bp, Artificial Sequence
  chemically synthesized
atcattggctcctaataggagt

SEQ ID NO: 1170857 - DNA, 22 bp, Artificial Sequence
  chemically synthesized
tcattggctcctaataggagta

SEQ ID NO: 1170858 - DNA, 22 bp, Artificial Sequence
  chemically synthesized
gctcctaataggagtaatcatg

SEQ ID NO: 1170859 - DNA, 22 bp, Artificial Sequence
  chemically synthesized
ctaataggagtaatcatgcttc

SEQ ID NO: 1170860 - DNA, 22 bp, Artificial Sequence
  chemically synthesized
ataggagtaatcatgcttcagg

SEQ ID NO: 1170861 - DNA, 22 bp, Artificial Sequence
  chemically synthesized
tgggacacagagatacagaccc

SEQ ID NO: 1170862 - DNA, 22 bp, Artificial Sequence
  chemically synthesized
tctatgggacacagagatacag

SEQ ID NO: 1170863 - DNA, 22 bp, Artificial Sequence
  chemically synthesized
gttgtctatgggacacagagat

SEQ ID NO: 1170864 - DNA, 22 bp, Artificial Sequence
  chemically synthesized
agttgtctatgggacacagaga

SEQ ID NO: 1170865 - DNA, 22 bp, Artificial Sequence
  chemically synthesized
cagggtctgtatctctgtgtcc

SEQ ID NO: 1170866 - DNA, 22 bp, Artificial Sequence
  chemically synthesized
tagttgtctatgggacacagag

SEQ ID NO: 1170867 - DNA, 22 bp, Artificial Sequence
  chemically synthesized
agggtctgtatctctgtgtccc

SEQ ID NO: 1170868 - DNA, 22 bp, Artificial Sequence
  chemically synthesized
tatctctgtgtcccatagacaa

SEQ ID NO: 1170869 - DNA, 22 bp, Artificial Sequence
  chemically synthesized
agatcaaaagctttagttgtct

SEQ ID NO: 1170870 - DNA, 22 bp, Artificial Sequence
  chemically synthesized
tgtgtcccatagacaactaaag

SEQ ID NO: 1170871 - DNA, 22 bp, Artificial Sequence
  chemically synthesized
tgtcccatagacaactaaagct

SEQ ID NO: 1170872 - DNA, 22 bp, Artificial Sequence
  chemically synthesized
tgaaccctaagatcaaaagctt

SEQ ID NO: 1170873 - DNA, 22 bp, Artificial Sequence
  chemically synthesized
tatgaaccctaagatcaaaagc

SEQ ID NO: 1170874 - DNA, 22 bp, Artificial Sequence
  chemically synthesized
agttctatgaaccctaagatca

SEQ ID NO: 1170875 - DNA, 22 bp, Artificial Sequence
  chemically synthesized
tcagttctatgaaccctaagat

SEQ ID NO: 1170876 - DNA, 22 bp, Artificial Sequence
  chemically synthesized
ctcagttctatgaaccctaaga

SEQ ID NO: 1170877 - DNA, 22 bp, Artificial Sequence
  chemically synthesized
aagcttttgatcttagggttca

SEQ ID NO: 1170878 - DNA, 22 bp, Artificial Sequence
  chemically synthesized
ttctcagttctatgaaccctaa

SEQ ID NO: 1170879 - DNA, 22 bp, Artificial Sequence
  chemically synthesized
cgttcttctcagttctatgaac

SEQ ID NO: 1170880 - DNA, 22 bp, Artificial Sequence
  chemically synthesized
ttgatcttagggttcatagaac

SEQ ID NO: 1170881 - DNA, 22 bp, Artificial Sequence
  chemically synthesized
tgatcttagggttcatagaact

SEQ ID NO: 1170882 - DNA, 22 bp, Artificial Sequence
  chemically synthesized
gatcttagggttcatagaactg

SEQ ID NO: 1170883 - DNA, 22 bp, Artificial Sequence
  chemically synthesized
ctgcgttcttctcagttctatg

SEQ ID NO: 1170884 - DNA, 22 bp, Artificial Sequence
  chemically synthesized
atcttagggttcatagaactga

SEQ ID NO: 1170885 - DNA, 22 bp, Artificial Sequence
  chemically synthesized
actgcgttcttctcagttctat

SEQ ID NO: 1170886 - DNA, 22 bp, Artificial Sequence
  chemically synthesized
agggttcatagaactgagaaga

SEQ ID NO: 1170887 - DNA, 22 bp, Artificial Sequence
  chemically synthesized
gggttcatagaactgagaagaa

SEQ ID NO: 1170888 - DNA, 22 bp, Artificial Sequence
  chemically synthesized
atagaactgagaagaacgcagt

SEQ ID NO: 1170889 - DNA, 22 bp, Artificial Sequence
  chemically synthesized
aaatgcaaaagacttactgcgt

SEQ ID NO: 1170890 - DNA, 22 bp, Artificial Sequence
  chemically synthesized
tgaaatgcaaaagacttactgc

SEQ ID NO: 1170891 - DNA, 22 bp, Artificial Sequence
  chemically synthesized
ctgaaatgcaaaagacttactg

SEQ ID NO: 1170892 - DNA, 22 bp, Artificial Sequence
  chemically synthesized
tctgaaatgcaaaagacttact

SEQ ID NO: 1170893 - DNA, 22 bp, Artificial Sequence
  chemically synthesized
ttctgaaatgcaaaagacttac

SEQ ID NO: 1170894 - DNA, 22 bp, Artificial Sequence
  chemically synthesized
agaagaacgcagtaagtctttt

SEQ ID NO: 1170895 - DNA, 22 bp, Artificial Sequence
  chemically synthesized
tttttctgaaatgcaaaagact

SEQ ID NO: 1170896 - DNA, 22 bp, Artificial Sequence
  chemically synthesized
atttttctgaaatgcaaaagac

SEQ ID NO: 1170897 - DNA, 22 bp, Artificial Sequence
  chemically synthesized
tatttttctgaaatgcaaaaga

SEQ ID NO: 1170898 - DNA, 22 bp, Artificial Sequence
  chemically synthesized
ttatttttctgaaatgcaaaag

SEQ ID NO: 1170899 - DNA, 22 bp, Artificial Sequence
  chemically synthesized
atacttttatttttctgaaatg

SEQ ID NO: 1170900 - DNA, 22 bp, Artificial Sequence
  chemically synthesized
catacttttatttttctgaaat

SEQ ID NO: 1170901 - DNA, 22 bp, Artificial Sequence
  chemically synthesized
ttgcatttcagaaaaataaaag

SEQ ID NO: 1170902 - DNA, 22 bp, Artificial Sequence
  chemically synthesized
tgcatttcagaaaaataaaagt

SEQ ID NO: 1170903 - DNA, 22 bp, Artificial Sequence
  chemically synthesized
gcatttcagaaaaataaaagta

SEQ ID NO: 1170904 - DNA, 22 bp, Artificial Sequence
  chemically synthesized
catttcagaaaaataaaagtat

SEQ ID NO: 1170905 - DNA, 22 bp, Artificial Sequence
  chemically synthesized
tcaaaaggtttcatacttttat

SEQ ID NO: 1170906 - DNA, 22 bp, Artificial Sequence
  chemically synthesized
atcaaaaggtttcatactttta

SEQ ID NO: 1170907 - DNA, 22 bp, Artificial Sequence
  chemically synthesized
cagaaaaataaaagtatgaaac

SEQ ID NO: 1170908 - DNA, 22 bp, Artificial Sequence
  chemically synthesized
agaaaaataaaagtatgaaacc

SEQ ID NO: 1170909 - DNA, 22 bp, Artificial Sequence
  chemically synthesized
gtataacaagagatggaaactt

SEQ ID NO: 1170910 - DNA, 22 bp, Artificial Sequence
  chemically synthesized
ttgataagtttccatctcttgt

SEQ ID NO: 1170911 - DNA, 22 bp, Artificial Sequence
  chemically synthesized
tgataagtttccatctcttgtt

SEQ ID NO: 1170912 - DNA, 22 bp, Artificial Sequence
  chemically synthesized
gataagtttccatctcttgtta

SEQ ID NO: 1170913 - DNA, 22 bp, Artificial Sequence
  chemically synthesized
ataagtttccatctcttgttat

SEQ ID NO: 1170914 - DNA, 22 bp, Artificial Sequence
  chemically synthesized
ccatctcttgttatactaacat

SEQ ID NO: 1170915 - DNA, 22 bp, Artificial Sequence
  chemically synthesized
catctcttgttatactaacatt

SEQ ID NO: 1170916 - DNA, 22 bp, Artificial Sequence
  chemically synthesized
aaaatatgagaagtaatgttag

SEQ ID NO: 1170917 - DNA, 22 bp, Artificial Sequence
  chemically synthesized
gaaaatatgagaagtaatgtta

SEQ ID NO: 1170918 - DNA, 22 bp, Artificial Sequence
  chemically synthesized
ttgttatactaacattacttct

SEQ ID NO: 1170919 - DNA, 22 bp, Artificial Sequence
  chemically synthesized
cttgaaaatatgagaagtaatg

SEQ ID NO: 1170920 - DNA, 22 bp, Artificial Sequence
  chemically synthesized
acttgaaaatatgagaagtaat

SEQ ID NO: 1170921 - DNA, 22 bp, Artificial Sequence
  chemically synthesized
gttatactaacattacttctca

SEQ ID NO: 1170922 - DNA, 22 bp, Artificial Sequence
  chemically synthesized
tacttgaaaatatgagaagtaa

SEQ ID NO: 1170923 - DNA, 22 bp, Artificial Sequence
  chemically synthesized
ttatactaacattacttctcat

SEQ ID NO: 1170924 - DNA, 22 bp, Artificial Sequence
  chemically synthesized
ttacttgaaaatatgagaagta

SEQ ID NO: 1170925 - DNA, 22 bp, Artificial Sequence
  chemically synthesized
tttacttgaaaatatgagaagt

SEQ ID NO: 1170926 - DNA, 22 bp, Artificial Sequence
  chemically synthesized
ttttacttgaaaatatgagaag

SEQ ID NO: 1170927 - DNA, 22 bp, Artificial Sequence
  chemically synthesized
tactaacattacttctcatatt

SEQ ID NO: 1170928 - DNA, 22 bp, Artificial Sequence
  chemically synthesized
tttttacttgaaaatatgagaa

SEQ ID NO: 1170929 - DNA, 22 bp, Artificial Sequence
  chemically synthesized
ttttttacttgaaaatatgaga

SEQ ID NO: 1170930 - DNA, 22 bp, Artificial Sequence
  chemically synthesized
tttttttacttgaaaatatgag

SEQ ID NO: 1170931 - DNA, 22 bp, Artificial Sequence
  chemically synthesized
acattacttctcatattttcaa

SEQ ID NO: 1170932 - DNA, 22 bp, Artificial Sequence
  chemically synthesized
agttttttttttacttgaaaat

SEQ ID NO: 1170933 - DNA, 22 bp, Artificial Sequence
  chemically synthesized
gagttttttttttacttgaaaa

SEQ ID NO: 1170934 - DNA, 22 bp, Artificial Sequence
  chemically synthesized
tgagttttttttttacttgaaa

SEQ ID NO: 1170935 - DNA, 22 bp, Artificial Sequence
  chemically synthesized
cttctcatattttcaagtaaaa

SEQ ID NO: 1170936 - DNA, 22 bp, Artificial Sequence
  chemically synthesized
attttgagttttttttttactt

SEQ ID NO: 1170937 - DNA, 22 bp, Artificial Sequence
  chemically synthesized
ctcatattttcaagtaaaaaaa

SEQ ID NO: 1170938 - DNA, 22 bp, Artificial Sequence
  chemically synthesized
tcatattttcaagtaaaaaaaa

SEQ ID NO: 1170939 - DNA, 22 bp, Artificial Sequence
  chemically synthesized
atattttcaagtaaaaaaaaaa

SEQ ID NO: 1170940 - DNA, 22 bp, Artificial Sequence
  chemically synthesized
tcaagtaaaaaaaaaactcaaa

SEQ ID NO: 1170941 - DNA, 22 bp, Artificial Sequence
  chemically synthesized
gcccaccctgattttgagtttt

SEQ ID NO: 1170942 - DNA, 22 bp, Artificial Sequence
  chemically synthesized
caagtaaaaaaaaaactcaaaa

SEQ ID NO: 1170943 - DNA, 22 bp, Artificial Sequence
  chemically synthesized
agcccaccctgattttgagttt

SEQ ID NO: 1170944 - DNA, 22 bp, Artificial Sequence
  chemically synthesized
aagtaaaaaaaaaactcaaaat

SEQ ID NO: 1170945 - DNA, 22 bp, Artificial Sequence
  chemically synthesized
tcacttagcccaccctgatttt

SEQ ID NO: 1170946 - DNA, 22 bp, Artificial Sequence
  chemically synthesized
atcacttagcccaccctgattt

SEQ ID NO: 1170947 - DNA, 22 bp, Artificial Sequence
  chemically synthesized
ttatcacttagcccaccctgat

SEQ ID NO: 1170948 - DNA, 22 bp, Artificial Sequence
  chemically synthesized
ctcttatcacttagcccaccct

SEQ ID NO: 1170949 - DNA, 22 bp, Artificial Sequence
  chemically synthesized
aaaatcagggtgggctaagtga

SEQ ID NO: 1170950 - DNA, 22 bp, Artificial Sequence
  chemically synthesized
accaaatcagaagtgattgctc

SEQ ID NO: 1170951 - DNA, 22 bp, Artificial Sequence
  chemically synthesized
caccaaatcagaagtgattgct

SEQ ID NO: 1170952 - DNA, 22 bp, Artificial Sequence
  chemically synthesized
agtgataagagcaatcacttct

SEQ ID NO: 1170953 - DNA, 22 bp, Artificial Sequence
  chemically synthesized
gtatcttcaccaaatcagaagt

SEQ ID NO: 1170954 - DNA, 22 bp, Artificial Sequence
  chemically synthesized
tagtatcttcaccaaatcagaa

SEQ ID NO: 1170955 - DNA, 22 bp, Artificial Sequence
  chemically synthesized
ctagtatcttcaccaaatcaga

SEQ ID NO: 1170956 - DNA, 22 bp, Artificial Sequence
  chemically synthesized
ttctagtatcttcaccaaatca

SEQ ID NO: 1170957 - DNA, 22 bp, Artificial Sequence
  chemically synthesized
atcctcttctagtatcttcacc

SEQ ID NO: 1170958 - DNA, 22 bp, Artificial Sequence
  chemically synthesized
aatcctcttctagtatcttcac

SEQ ID NO: 1170959 - DNA, 22 bp, Artificial Sequence
  chemically synthesized
taatcctcttctagtatcttca

SEQ ID NO: 1170960 - DNA, 22 bp, Artificial Sequence
  chemically synthesized
ctgatttggtgaagatactaga

SEQ ID NO: 1170961 - DNA, 22 bp, Artificial Sequence
  chemically synthesized
tgatttggtgaagatactagaa

SEQ ID NO: 1170962 - DNA, 22 bp, Artificial Sequence
  chemically synthesized
atttggtgaagatactagaaga

SEQ ID NO: 1170963 - DNA, 22 bp, Artificial Sequence
  chemically synthesized
ggtgaagatactagaagaggat

SEQ ID NO: 1170964 - DNA, 22 bp, Artificial Sequence
  chemically synthesized
gtgaagatactagaagaggatt

SEQ ID NO: 1170965 - DNA, 22 bp, Artificial Sequence
  chemically synthesized
tacatatcctttaatcctcttc

SEQ ID NO: 1170966 - DNA, 22 bp, Artificial Sequence
  chemically synthesized
gaagaggattaaaggatatgta

SEQ ID NO: 1170967 - DNA, 22 bp, Artificial Sequence
  chemically synthesized
gtaatatacacatatctgtaca

SEQ ID NO: 1170968 - DNA, 22 bp, Artificial Sequence
  chemically synthesized
aaggatatgtacagatatgtgt

SEQ ID NO: 1170969 - DNA, 22 bp, Artificial Sequence
  chemically synthesized
agttggtaatatacacatatct

SEQ ID NO: 1170970 - DNA, 22 bp, Artificial Sequence
  chemically synthesized
ctcagttggtaatatacacata

SEQ ID NO: 1170971 - DNA, 22 bp, Artificial Sequence
  chemically synthesized
cctcagttggtaatatacacat

SEQ ID NO: 1170972 - DNA, 22 bp, Artificial Sequence
  chemically synthesized
catttcctcagttggtaatata

SEQ ID NO: 1170973 - DNA, 22 bp, Artificial Sequence
  chemically synthesized
ccatttcctcagttggtaatat

SEQ ID NO: 1170974 - DNA, 22 bp, Artificial Sequence
  chemically synthesized
atgcttccatttcctcagttgg

SEQ ID NO: 1170975 - DNA, 22 bp, Artificial Sequence
  chemically synthesized
ctcatgcttccatttcctcagt

SEQ ID NO: 1170976 - DNA, 22 bp, Artificial Sequence
  chemically synthesized
tgctcatgcttccatttcctca

SEQ ID NO: 1170977 - DNA, 22 bp, Artificial Sequence
  chemically synthesized
ctgctcatgcttccatttcctc

SEQ ID NO: 1170978 - DNA, 22 bp, Artificial Sequence
  chemically synthesized
tctgctcatgcttccatttcct

SEQ ID NO: 1170979 - DNA, 22 bp, Artificial Sequence
  chemically synthesized
ttctgctcatgcttccatttcc

SEQ ID NO: 1170980 - DNA, 22 bp, Artificial Sequence
  chemically synthesized
ccaactgaggaaatggaagcat

SEQ ID NO: 1170981 - DNA, 22 bp, Artificial Sequence
  chemically synthesized
gcttttctgctcatgcttccat

SEQ ID NO: 1170982 - DNA, 22 bp, Artificial Sequence
  chemically synthesized
cgcttttctgctcatgcttcca

SEQ ID NO: 1170983 - DNA, 22 bp, Artificial Sequence
  chemically synthesized
tttcgcttttctgctcatgctt

SEQ ID NO: 1170984 - DNA, 22 bp, Artificial Sequence
  chemically synthesized
tgtttcgcttttctgctcatgc

SEQ ID NO: 1170985 - DNA, 22 bp, Artificial Sequence
  chemically synthesized
aggaaatggaagcatgagcaga

SEQ ID NO: 1170986 - DNA, 22 bp, Artificial Sequence
  chemically synthesized
gggttctgtttcgcttttctgc

SEQ ID NO: 1170987 - DNA, 22 bp, Artificial Sequence
  chemically synthesized
agggttctgtttcgcttttctg

SEQ ID NO: 1170988 - DNA, 22 bp, Artificial Sequence
  chemically synthesized
acttagggttctgtttcgcttt

SEQ ID NO: 1170989 - DNA, 22 bp, Artificial Sequence
  chemically synthesized
acctcacttagggttctgtttc

SEQ ID NO: 1170990 - DNA, 22 bp, Artificial Sequence
  chemically synthesized
tgttcacctcacttagggttct

SEQ ID NO: 1170991 - DNA, 22 bp, Artificial Sequence
  chemically synthesized
tatgttcacctcacttagggtt

SEQ ID NO: 1170992 - DNA, 22 bp, Artificial Sequence
  chemically synthesized
ctatgttcacctcacttagggt

SEQ ID NO: 1170993 - DNA, 22 bp, Artificial Sequence
  chemically synthesized
tctatgttcacctcacttaggg

SEQ ID NO: 1170994 - DNA, 22 bp, Artificial Sequence
  chemically synthesized
ctttctatgttcacctcactta

SEQ ID NO: 1170995 - DNA, 22 bp, Artificial Sequence
  chemically synthesized
actttctatgttcacctcactt

SEQ ID NO: 1170996 - DNA, 22 bp, Artificial Sequence
  chemically synthesized
ggacgtttactttctatgttca

SEQ ID NO: 1170997 - DNA, 22 bp, Artificial Sequence
  chemically synthesized
aggacgtttactttctatgttc

SEQ ID NO: 1170998 - DNA, 22 bp, Artificial Sequence
  chemically synthesized
taggacgtttactttctatgtt

SEQ ID NO: 1170999 - DNA, 22 bp, Artificial Sequence
  chemically synthesized
agtgaggtgaacatagaaagta

SEQ ID NO: 1171000 - DNA, 22 bp, Artificial Sequence
  chemically synthesized
tgactttaggacgtttactttc

SEQ ID NO: 1171001 - DNA, 22 bp, Artificial Sequence
  chemically synthesized
atgactttaggacgtttacttt

SEQ ID NO: 1171002 - DNA, 22 bp, Artificial Sequence
  chemically synthesized
tttatgactttaggacgtttac

SEQ ID NO: 1171003 - DNA, 22 bp, Artificial Sequence
  chemically synthesized
tgtttatgactttaggacgttt

SEQ ID NO: 1171004 - DNA, 22 bp, Artificial Sequence
  chemically synthesized
tctctgtttatgactttaggac

SEQ ID NO: 1171005 - DNA, 22 bp, Artificial Sequence
  chemically synthesized
gtctctgtttatgactttagga

SEQ ID NO: 1171006 - DNA, 22 bp, Artificial Sequence
  chemically synthesized
tgtctctgtttatgactttagg

SEQ ID NO: 1171007 - DNA, 22 bp, Artificial Sequence
  chemically synthesized
agtgaggttttgtctctgttta

SEQ ID NO: 1171008 - DNA, 22 bp, Artificial Sequence
  chemically synthesized
cagtgaggttttgtctctgttt

SEQ ID NO: 1171009 - DNA, 22 bp, Artificial Sequence
  chemically synthesized
tcagtgaggttttgtctctgtt

SEQ ID NO: 1171010 - DNA, 22 bp, Artificial Sequence
  chemically synthesized
aagtcataaacagagacaaaac

SEQ ID NO: 1171011 - DNA, 22 bp, Artificial Sequence
  chemically synthesized
taagtgaaaactttcagtgagg

SEQ ID NO: 1171012 - DNA, 22 bp, Artificial Sequence
  chemically synthesized
aaaatattataagtgaaaactt

SEQ ID NO: 1171013 - DNA, 22 bp, Artificial Sequence
  chemically synthesized
aaaaatattataagtgaaaact

SEQ ID NO: 1171014 - DNA, 22 bp, Artificial Sequence
  chemically synthesized
tttaaaaatattataagtgaaa

SEQ ID NO: 1171015 - DNA, 22 bp, Artificial Sequence
  chemically synthesized
actgaaagttttcacttataat

SEQ ID NO: 1171016 - DNA, 22 bp, Artificial Sequence
  chemically synthesized
aaagttttcacttataatattt

SEQ ID NO: 1171017 - DNA, 22 bp, Artificial Sequence
  chemically synthesized
tcacttataatatttttaaaca

SEQ ID NO: 1171018 - DNA, 22 bp, Artificial Sequence
  chemically synthesized
cacttataatatttttaaacag

SEQ ID NO: 1171019 - DNA, 22 bp, Artificial Sequence
  chemically synthesized
acttataatatttttaaacaga

SEQ ID NO: 1171020 - DNA, 22 bp, Artificial Sequence
  chemically synthesized
ataatatttttaaacagatttg

SEQ ID NO: 1171021 - DNA, 22 bp, Artificial Sequence
  chemically synthesized
taatatttttaaacagatttga

SEQ ID NO: 1171022 - DNA, 22 bp, Artificial Sequence
  chemically synthesized
ttaaacagatttgacatttctt

SEQ ID NO: 1171023 - DNA, 22 bp, Artificial Sequence
  chemically synthesized
taaacagatttgacatttcttt

SEQ ID NO: 1171024 - DNA, 22 bp, Artificial Sequence
  chemically synthesized
aaacagatttgacatttctttc

SEQ ID NO: 1171025 - DNA, 22 bp, Artificial Sequence
  chemically synthesized
aacagatttgacatttctttcc

SEQ ID NO: 1171026 - DNA, 22 bp, Artificial Sequence
  chemically synthesized
cagaaaataaatggaaagaaat

SEQ ID NO: 1171027 - DNA, 22 bp, Artificial Sequence
  chemically synthesized
tacctacagaaaataaatggaa

SEQ ID NO: 1171028 - DNA, 22 bp, Artificial Sequence
  chemically synthesized
tatacctacagaaaataaatgg

SEQ ID NO: 1171029 - DNA, 22 bp, Artificial Sequence
  chemically synthesized
gacatttctttccatttatttt

SEQ ID NO: 1171030 - DNA, 22 bp, Artificial Sequence
  chemically synthesized
acatttctttccatttattttc

SEQ ID NO: 1171031 - DNA, 22 bp, Artificial Sequence
  chemically synthesized
ctttccatttattttctgtagg

SEQ ID NO: 1171032 - DNA, 22 bp, Artificial Sequence
  chemically synthesized
tttccatttattttctgtaggt

SEQ ID NO: 1171033 - DNA, 22 bp, Artificial Sequence
  chemically synthesized
taaaatattctatacctacaga

SEQ ID NO: 1171034 - DNA, 22 bp, Artificial Sequence
  chemically synthesized
tccatttattttctgtaggtat

SEQ ID NO: 1171035 - DNA, 22 bp, Artificial Sequence
  chemically synthesized
ccatttattttctgtaggtata

SEQ ID NO: 1171036 - DNA, 22 bp, Artificial Sequence
  chemically synthesized
catttattttctgtaggtatag

SEQ ID NO: 1171037 - DNA, 22 bp, Artificial Sequence
  chemically synthesized
attttctgtaggtatagaatat

SEQ ID NO: 1171038 - DNA, 22 bp, Artificial Sequence
  chemically synthesized
ttttctgtaggtatagaatatt

SEQ ID NO: 1171039 - DNA, 22 bp, Artificial Sequence
  chemically synthesized
tctgtaggtatagaatatttta

SEQ ID NO: 1171040 - DNA, 22 bp, Artificial Sequence
  chemically synthesized
ctgtaggtatagaatattttat

SEQ ID NO: 1171041 - DNA, 22 bp, Artificial Sequence
  chemically synthesized
tgtaggtatagaatattttata

SEQ ID NO: 1171042 - DNA, 22 bp, Artificial Sequence
  chemically synthesized
taaataggtcagttataaaata

SEQ ID NO: 1171043 - DNA, 22 bp, Artificial Sequence
  chemically synthesized
taggtatagaatattttataac

SEQ ID NO: 1171044 - DNA, 22 bp, Artificial Sequence
  chemically synthesized
gtggtagtcccattataaatag

SEQ ID NO: 1171045 - DNA, 22 bp, Artificial Sequence
  chemically synthesized
ggtggtagtcccattataaata

SEQ ID NO: 1171046 - DNA, 22 bp, Artificial Sequence
  chemically synthesized
tataactgacctatttataatg

SEQ ID NO: 1171047 - DNA, 22 bp, Artificial Sequence
  chemically synthesized
ataactgacctatttataatgg

SEQ ID NO: 1171048 - DNA, 22 bp, Artificial Sequence
  chemically synthesized
taactgacctatttataatggg

SEQ ID NO: 1171049 - DNA, 22 bp, Artificial Sequence
  chemically synthesized
acctatttataatgggactacc

SEQ ID NO: 1171050 - DNA, 22 bp, Artificial Sequence
  chemically synthesized
aaaatggatatttggtggtagt

SEQ ID NO: 1171051 - DNA, 22 bp, Artificial Sequence
  chemically synthesized
tttataatgggactaccaccaa

SEQ ID NO: 1171052 - DNA, 22 bp, Artificial Sequence
  chemically synthesized
aaaaatggatatttggtggtag

SEQ ID NO: 1171053 - DNA, 22 bp, Artificial Sequence
  chemically synthesized
taaaaatggatatttggtggta

SEQ ID NO: 1171054 - DNA, 22 bp, Artificial Sequence
  chemically synthesized
ataatgggactaccaccaaata

SEQ ID NO: 1171055 - DNA, 22 bp, Artificial Sequence
  chemically synthesized
taatgggactaccaccaaatat

SEQ ID NO: 1171056 - DNA, 22 bp, Artificial Sequence
  chemically synthesized
ccaccaaatatccatttttaaa

SEQ ID NO: 1171057 - DNA, 22 bp, Artificial Sequence
  chemically synthesized
tggagagagcattttaaaaatg

SEQ ID NO: 1171058 - DNA, 22 bp, Artificial Sequence
  chemically synthesized
atgctatggagagagcatttta

SEQ ID NO: 1171059 - DNA, 22 bp, Artificial Sequence
  chemically synthesized
taagacattcatgctatggaga

SEQ ID NO: 1171060 - DNA, 22 bp, Artificial Sequence
  chemically synthesized
ttaaaatgctctctccatagca

SEQ ID NO: 1171061 - DNA, 22 bp, Artificial Sequence
  chemically synthesized
ataagacattcatgctatggag

SEQ ID NO: 1171062 - DNA, 22 bp, Artificial Sequence
  chemically synthesized
taaaatgctctctccatagcat

SEQ ID NO: 1171063 - DNA, 22 bp, Artificial Sequence
  chemically synthesized
tataagacattcatgctatgga

SEQ ID NO: 1171064 - DNA, 22 bp, Artificial Sequence
  chemically synthesized
aaaatgctctctccatagcatg

SEQ ID NO: 1171065 - DNA, 22 bp, Artificial Sequence
  chemically synthesized
aaatgctctctccatagcatga

SEQ ID NO: 1171066 - DNA, 22 bp, Artificial Sequence
  chemically synthesized
gattttataagacattcatgct

SEQ ID NO: 1171067 - DNA, 22 bp, Artificial Sequence
  chemically synthesized
tctccatagcatgaatgtctta

SEQ ID NO: 1171068 - DNA, 22 bp, Artificial Sequence
  chemically synthesized
tccatagcatgaatgtcttata

SEQ ID NO: 1171069 - DNA, 22 bp, Artificial Sequence
  chemically synthesized
catagcatgaatgtcttataaa

SEQ ID NO: 1171070 - DNA, 22 bp, Artificial Sequence
  chemically synthesized
agaaagagactagattttataa

SEQ ID NO: 1171071 - DNA, 22 bp, Artificial Sequence
  chemically synthesized
acaatattaagaaagagactag

SEQ ID NO: 1171072 - DNA, 22 bp, Artificial Sequence
  chemically synthesized
ataaaatctagtctctttctta

SEQ ID NO: 1171073 - DNA, 22 bp, Artificial Sequence
  chemically synthesized
tattaacaatattaagaaagag

SEQ ID NO: 1171074 - DNA, 22 bp, Artificial Sequence
  chemically synthesized
taaaatctagtctctttcttaa

SEQ ID NO: 1171075 - DNA, 22 bp, Artificial Sequence
  chemically synthesized
tgtattaacaatattaagaaag

SEQ ID NO: 1171076 - DNA, 22 bp, Artificial Sequence
  chemically synthesized
ctgtattaacaatattaagaaa

SEQ ID NO: 1171077 - DNA, 22 bp, Artificial Sequence
  chemically synthesized
gtctctttcttaatattgttaa

SEQ ID NO: 1171078 - DNA, 22 bp, Artificial Sequence
  chemically synthesized
tttcttaatattgttaatacag

SEQ ID NO: 1171079 - DNA, 22 bp, Artificial Sequence
  chemically synthesized
aaggagaagcttctgtattaac

SEQ ID NO: 1171080 - DNA, 22 bp, Artificial Sequence
  chemically synthesized
gaaggagaagcttctgtattaa

SEQ ID NO: 1171081 - DNA, 22 bp, Artificial Sequence
  chemically synthesized
tcttaatattgttaatacagaa

SEQ ID NO: 1171082 - DNA, 22 bp, Artificial Sequence
  chemically synthesized
tgaaggagaagcttctgtatta

SEQ ID NO: 1171083 - DNA, 22 bp, Artificial Sequence
  chemically synthesized
cttaatattgttaatacagaag

SEQ ID NO: 1171084 - DNA, 22 bp, Artificial Sequence
  chemically synthesized
ttaatattgttaatacagaagc

SEQ ID NO: 1171085 - DNA, 22 bp, Artificial Sequence
  chemically synthesized
aatattgttaatacagaagctt

SEQ ID NO: 1171086 - DNA, 22 bp, Artificial Sequence
  chemically synthesized
atattgttaatacagaagcttc

SEQ ID NO: 1171087 - DNA, 22 bp, Artificial Sequence
  chemically synthesized
aatctttgaaggagaagcttct

SEQ ID NO: 1171088 - DNA, 22 bp, Artificial Sequence
  chemically synthesized
caatctttgaaggagaagcttc

SEQ ID NO: 1171089 - DNA, 22 bp, Artificial Sequence
  chemically synthesized
ttaatacagaagcttctccttc

SEQ ID NO: 1171090 - DNA, 22 bp, Artificial Sequence
  chemically synthesized
atacagaagcttctccttcaaa

SEQ ID NO: 1171091 - DNA, 22 bp, Artificial Sequence
  chemically synthesized
ctccttcaaagattgaaggttt

SEQ ID NO: 1171092 - DNA, 22 bp, Artificial Sequence
  chemically synthesized
tccttcaaagattgaaggtttt

SEQ ID NO: 1171093 - DNA, 22 bp, Artificial Sequence
  chemically synthesized
caaaagcagaaaaaaaccttca

SEQ ID NO: 1171094 - DNA, 22 bp, Artificial Sequence
  chemically synthesized
ccaaaagcagaaaaaaaccttc

SEQ ID NO: 1171095 - DNA, 22 bp, Artificial Sequence
  chemically synthesized
cttcaaagattgaaggtttttt

SEQ ID NO: 1171096 - DNA, 22 bp, Artificial Sequence
  chemically synthesized
tttccaaaagcagaaaaaaacc

SEQ ID NO: 1171097 - DNA, 22 bp, Artificial Sequence
  chemically synthesized
caaagattgaaggtttttttct

SEQ ID NO: 1171098 - DNA, 22 bp, Artificial Sequence
  chemically synthesized
aaagattgaaggtttttttctg

SEQ ID NO: 1171099 - DNA, 22 bp, Artificial Sequence
  chemically synthesized
aaattatttccaaaagcagaaa

SEQ ID NO: 1171100 - DNA, 22 bp, Artificial Sequence
  chemically synthesized
tcaaattatttccaaaagcaga

SEQ ID NO: 1171101 - DNA, 22 bp, Artificial Sequence
  chemically synthesized
ctcaaattatttccaaaagcag

SEQ ID NO: 1171102 - DNA, 22 bp, Artificial Sequence
  chemically synthesized
aaggtttttttctgcttttgga

SEQ ID NO: 1171103 - DNA, 22 bp, Artificial Sequence
  chemically synthesized
tttctcaaattatttccaaaag

SEQ ID NO: 1171104 - DNA, 22 bp, Artificial Sequence
  chemically synthesized
ttttctgcttttggaaataatt

SEQ ID NO: 1171105 - DNA, 22 bp, Artificial Sequence
  chemically synthesized
tgttatttctcaaattatttcc

SEQ ID NO: 1171106 - DNA, 22 bp, Artificial Sequence
  chemically synthesized
tttctgcttttggaaataattt

SEQ ID NO: 1171107 - DNA, 22 bp, Artificial Sequence
  chemically synthesized
ttctgcttttggaaataatttg

SEQ ID NO: 1171108 - DNA, 22 bp, Artificial Sequence
  chemically synthesized
tctgcttttggaaataatttga

SEQ ID NO: 1171109 - DNA, 22 bp, Artificial Sequence
  chemically synthesized
ctgcttttggaaataatttgag

SEQ ID NO: 1171110 - DNA, 22 bp, Artificial Sequence
  chemically synthesized
tgcttttggaaataatttgaga

SEQ ID NO: 1171111 - DNA, 22 bp, Artificial Sequence
  chemically synthesized
cttttggaaataatttgagaaa

SEQ ID NO: 1171112 - DNA, 22 bp, Artificial Sequence
  chemically synthesized
tgagtactatgttatttctcaa

SEQ ID NO: 1171113 - DNA, 22 bp, Artificial Sequence
  chemically synthesized
ttggaaataatttgagaaataa

SEQ ID NO: 1171114 - DNA, 22 bp, Artificial Sequence
  chemically synthesized
tggaaataatttgagaaataac

SEQ ID NO: 1171115 - DNA, 22 bp, Artificial Sequence
  chemically synthesized
ggaaataatttgagaaataaca

SEQ ID NO: 1171116 - DNA, 22 bp, Artificial Sequence
  chemically synthesized
gaaataatttgagaaataacat

SEQ ID NO: 1171117 - DNA, 22 bp, Artificial Sequence
  chemically synthesized
gcaagtggctgtgagtactatg

SEQ ID NO: 1171118 - DNA, 22 bp, Artificial Sequence
  chemically synthesized
gagaaataacatagtactcaca

SEQ ID NO: 1171119 - DNA, 22 bp, Artificial Sequence
  chemically synthesized
agaaataacatagtactcacag

SEQ ID NO: 1171120 - DNA, 22 bp, Artificial Sequence
  chemically synthesized
aggttggcaagtggctgtgagt

SEQ ID NO: 1171121 - DNA, 22 bp, Artificial Sequence
  chemically synthesized
caggttggcaagtggctgtgag

SEQ ID NO: 1171122 - DNA, 22 bp, Artificial Sequence
  chemically synthesized
tcaggttggcaagtggctgtga

SEQ ID NO: 1171123 - DNA, 22 bp, Artificial Sequence
  chemically synthesized
aacattttcaggttggcaagtg

SEQ ID NO: 1171124 - DNA, 22 bp, Artificial Sequence
  chemically synthesized
acagccacttgccaacctgaaa

SEQ ID NO: 1171125 - DNA, 22 bp, Artificial Sequence
  chemically synthesized
cataaatgctgaacattttcag

SEQ ID NO: 1171126 - DNA, 22 bp, Artificial Sequence
  chemically synthesized
gccaacctgaaaatgttcagca

SEQ ID NO: 1171127 - DNA, 22 bp, Artificial Sequence
  chemically synthesized
ccaacctgaaaatgttcagcat

SEQ ID NO: 1171128 - DNA, 22 bp, Artificial Sequence
  chemically synthesized
aaaatgttcagcatttatgtaa

SEQ ID NO: 1171129 - DNA, 22 bp, Artificial Sequence
  chemically synthesized
aaaaggtcaagtgttacataaa

SEQ ID NO: 1171130 - DNA, 22 bp, Artificial Sequence
  chemically synthesized
gaaaaggtcaagtgttacataa

SEQ ID NO: 1171131 - DNA, 22 bp, Artificial Sequence
  chemically synthesized
tgaaaaggtcaagtgttacata

SEQ ID NO: 1171132 - DNA, 22 bp, Artificial Sequence
  chemically synthesized
ttgaaaaggtcaagtgttacat

SEQ ID NO: 1171133 - DNA, 22 bp, Artificial Sequence
  chemically synthesized
tttttgaaaaggtcaagtgtta

SEQ ID NO: 1171134 - DNA, 22 bp, Artificial Sequence
  chemically synthesized
atttttgaaaaggtcaagtgtt

SEQ ID NO: 1171135 - DNA, 22 bp, Artificial Sequence
  chemically synthesized
agcatttatgtaacacttgacc

SEQ ID NO: 1171136 - DNA, 22 bp, Artificial Sequence
  chemically synthesized
tatttttgaaaaggtcaagtgt

SEQ ID NO: 1171137 - DNA, 22 bp, Artificial Sequence
  chemically synthesized
atgtaacacttgaccttttcaa

SEQ ID NO: 1171138 - DNA, 22 bp, Artificial Sequence
  chemically synthesized
tgtactttatttttgaaaaggt

SEQ ID NO: 1171139 - DNA, 22 bp, Artificial Sequence
  chemically synthesized
tgtaacacttgaccttttcaaa

SEQ ID NO: 1171140 - DNA, 22 bp, Artificial Sequence
  chemically synthesized
agttatgtactttatttttgaa

SEQ ID NO: 1171141 - DNA, 22 bp, Artificial Sequence
  chemically synthesized
gaccttttcaaaaataaagtac

SEQ ID NO: 1171142 - DNA, 22 bp, Artificial Sequence
  chemically synthesized
accttttcaaaaataaagtaca

SEQ ID NO: 1171143 - DNA, 22 bp, Artificial Sequence
  chemically synthesized
aaaagattgagttatgtacttt

SEQ ID NO: 1171144 - DNA, 22 bp, Artificial Sequence
  chemically synthesized
ttcaaaaataaagtacataact

SEQ ID NO: 1171145 - DNA, 22 bp, Artificial Sequence
  chemically synthesized
tcaaaaataaagtacataactc

SEQ ID NO: 1171146 - DNA, 22 bp, Artificial Sequence
  chemically synthesized
caaaaataaagtacataactca

SEQ ID NO: 1171147 - DNA, 22 bp, Artificial Sequence
  chemically synthesized
aaaaataaagtacataactcaa

SEQ ID NO: 1171148 - DNA, 22 bp, Artificial Sequence
  chemically synthesized
atggcaaagtagttgaaaagat

SEQ ID NO: 1171149 - DNA, 22 bp, Artificial Sequence
  chemically synthesized
gacatctcatggcaaagtagtt

SEQ ID NO: 1171150 - DNA, 22 bp, Artificial Sequence
  chemically synthesized
tggacatctcatggcaaagtag

SEQ ID NO: 1171151 - DNA, 22 bp, Artificial Sequence
  chemically synthesized
aatcttttcaactactttgcca

SEQ ID NO: 1171152 - DNA, 22 bp, Artificial Sequence
  chemically synthesized
ttcaactactttgccatgagat

SEQ ID NO: 1171153 - DNA, 22 bp, Artificial Sequence
  chemically synthesized
tcaactactttgccatgagatg

SEQ ID NO: 1171154 - DNA, 22 bp, Artificial Sequence
  chemically synthesized
caactactttgccatgagatgt

SEQ ID NO: 1171155 - DNA, 22 bp, Artificial Sequence
  chemically synthesized
aactactttgccatgagatgtc

SEQ ID NO: 1171156 - DNA, 22 bp, Artificial Sequence
  chemically synthesized
cacagaaatgttctggacatct

SEQ ID NO: 1171157 - DNA, 22 bp, Artificial Sequence
  chemically synthesized
ctttgccatgagatgtccagaa

SEQ ID NO: 1171158 - DNA, 22 bp, Artificial Sequence
  chemically synthesized
ctacacagaaatgttctggaca

SEQ ID NO: 1171159 - DNA, 22 bp, Artificial Sequence
  chemically synthesized
actacacagaaatgttctggac

SEQ ID NO: 1171160 - DNA, 22 bp, Artificial Sequence
  chemically synthesized
tgccatgagatgtccagaacat

SEQ ID NO: 1171161 - DNA, 22 bp, Artificial Sequence
  chemically synthesized
tactacacagaaatgttctgga

SEQ ID NO: 1171162 - DNA, 22 bp, Artificial Sequence
  chemically synthesized
gccatgagatgtccagaacatt

SEQ ID NO: 1171163 - DNA, 22 bp, Artificial Sequence
  chemically synthesized
ccatgagatgtccagaacattt

SEQ ID NO: 1171164 - DNA, 22 bp, Artificial Sequence
  chemically synthesized
ttttactacacagaaatgttct

SEQ ID NO: 1171165 - DNA, 22 bp, Artificial Sequence
  chemically synthesized
ggaaatctattttactacacag

SEQ ID NO: 1171166 - DNA, 22 bp, Artificial Sequence
  chemically synthesized
ctgtgtagtaaaatagatttcc

SEQ ID NO: 1171167 - DNA, 22 bp, Artificial Sequence
  chemically synthesized
tgtgtagtaaaatagatttcct

SEQ ID NO: 1171168 - DNA, 22 bp, Artificial Sequence
  chemically synthesized
tgtagtaaaatagatttcctag

SEQ ID NO: 1171169 - DNA, 22 bp, Artificial Sequence
  chemically synthesized
tcagcaaaatcagagtaaccta

SEQ ID NO: 1171170 - DNA, 22 bp, Artificial Sequence
  chemically synthesized
gtcagcaaaatcagagtaacct

SEQ ID NO: 1171171 - DNA, 22 bp, Artificial Sequence
  chemically synthesized
tgtcagcaaaatcagagtaacc

SEQ ID NO: 1171172 - DNA, 22 bp, Artificial Sequence
  chemically synthesized
aaatctttgtcagcaaaatcag

SEQ ID NO: 1171173 - DNA, 22 bp, Artificial Sequence
  chemically synthesized
cctaggttactctgattttgct

SEQ ID NO: 1171174 - DNA, 22 bp, Artificial Sequence
  chemically synthesized
aaaatctttgtcagcaaaatca

SEQ ID NO: 1171175 - DNA, 22 bp, Artificial Sequence
  chemically synthesized
ctaggttactctgattttgctg

SEQ ID NO: 1171176 - DNA, 22 bp, Artificial Sequence
  chemically synthesized
ggttactctgattttgctgaca

SEQ ID NO: 1171177 - DNA, 22 bp, Artificial Sequence
  chemically synthesized
ctctgattttgctgacaaagat

SEQ ID NO: 1171178 - DNA, 22 bp, Artificial Sequence
  chemically synthesized
tgattttgctgacaaagatttt

SEQ ID NO: 1171179 - DNA, 22 bp, Artificial Sequence
  chemically synthesized
attttgctgacaaagattttaa

SEQ ID NO: 1171180 - DNA, 22 bp, Artificial Sequence
  chemically synthesized
agtagtagaatacttaaaatct

SEQ ID NO: 1171181 - DNA, 22 bp, Artificial Sequence
  chemically synthesized
aagtagtagaatacttaaaatc

SEQ ID NO: 1171182 - DNA, 22 bp, Artificial Sequence
  chemically synthesized
tgctgacaaagattttaagtat

SEQ ID NO: 1171183 - DNA, 22 bp, Artificial Sequence
  chemically synthesized
gctgacaaagattttaagtatt

SEQ ID NO: 1171184 - DNA, 22 bp, Artificial Sequence
  chemically synthesized
ctgacaaagattttaagtattc

SEQ ID NO: 1171185 - DNA, 22 bp, Artificial Sequence
  chemically synthesized
tcttaagtagtagaatacttaa

SEQ ID NO: 1171186 - DNA, 22 bp, Artificial Sequence
  chemically synthesized
acaaagattttaagtattctac

SEQ ID NO: 1171187 - DNA, 22 bp, Artificial Sequence
  chemically synthesized
tgttatcttaagtagtagaata

SEQ ID NO: 1171188 - DNA, 22 bp, Artificial Sequence
  chemically synthesized
tagattatgttatcttaagtag

SEQ ID NO: 1171189 - DNA, 22 bp, Artificial Sequence
  chemically synthesized
taagtattctactacttaagat

SEQ ID NO: 1171190 - DNA, 22 bp, Artificial Sequence
  chemically synthesized
atagattatgttatcttaagta

SEQ ID NO: 1171191 - DNA, 22 bp, Artificial Sequence
  chemically synthesized
aagtattctactacttaagata

SEQ ID NO: 1171192 - DNA, 22 bp, Artificial Sequence
  chemically synthesized
agtattctactacttaagataa

SEQ ID NO: 1171193 - DNA, 22 bp, Artificial Sequence
  chemically synthesized
tactacttaagataacataatc

SEQ ID NO: 1171194 - DNA, 22 bp, Artificial Sequence
  chemically synthesized
aagtgtgtttatagattatgtt

SEQ ID NO: 1171195 - DNA, 22 bp, Artificial Sequence
  chemically synthesized
ctacttaagataacataatcta

SEQ ID NO: 1171196 - DNA, 22 bp, Artificial Sequence
  chemically synthesized
cttaagataacataatctataa

SEQ ID NO: 1171197 - DNA, 22 bp, Artificial Sequence
  chemically synthesized
aagataacataatctataaaca

SEQ ID NO: 1171198 - DNA, 22 bp, Artificial Sequence
  chemically synthesized
agataacataatctataaacac

SEQ ID NO: 1171199 - DNA, 22 bp, Artificial Sequence
  chemically synthesized
tgaacactaaagtgtgtttata

SEQ ID NO: 1171200 - DNA, 22 bp, Artificial Sequence
  chemically synthesized
tgtctatgaacactaaagtgtg

SEQ ID NO: 1171201 - DNA, 22 bp, Artificial Sequence
  chemically synthesized
ctatgtctatgaacactaaagt

SEQ ID NO: 1171202 - DNA, 22 bp, Artificial Sequence
  chemically synthesized
taaacacactttagtgttcata

SEQ ID NO: 1171203 - DNA, 22 bp, Artificial Sequence
  chemically synthesized
atgtgctgctatgtctatgaac

SEQ ID NO: 1171204 - DNA, 22 bp, Artificial Sequence
  chemically synthesized
gatgtgctgctatgtctatgaa

SEQ ID NO: 1171205 - DNA, 22 bp, Artificial Sequence
  chemically synthesized
ttgatgtgctgctatgtctatg

SEQ ID NO: 1171206 - DNA, 22 bp, Artificial Sequence
  chemically synthesized
tagtgttcatagacatagcagc

SEQ ID NO: 1171207 - DNA, 22 bp, Artificial Sequence
  chemically synthesized
agtgttcatagacatagcagca

SEQ ID NO: 1171208 - DNA, 22 bp, Artificial Sequence
  chemically synthesized
gtgctcttgatgtgctgctatg

SEQ ID NO: 1171209 - DNA, 22 bp, Artificial Sequence
  chemically synthesized
gtgttcatagacatagcagcac

SEQ ID NO: 1171210 - DNA, 22 bp, Artificial Sequence
  chemically synthesized
ggtgctcttgatgtgctgctat

SEQ ID NO: 1171211 - DNA, 22 bp, Artificial Sequence
  chemically synthesized
tggtgctcttgatgtgctgcta

SEQ ID NO: 1171212 - DNA, 22 bp, Artificial Sequence
  chemically synthesized
ttggtgctcttgatgtgctgct

SEQ ID NO: 1171213 - DNA, 22 bp, Artificial Sequence
  chemically synthesized
atagacatagcagcacatcaag

SEQ ID NO: 1171214 - DNA, 22 bp, Artificial Sequence
  chemically synthesized
gcgtttttggtgctcttgatgt

SEQ ID NO: 1171215 - DNA, 22 bp, Artificial Sequence
  chemically synthesized
ttagcgtttttggtgctcttga

SEQ ID NO: 1171216 - DNA, 22 bp, Artificial Sequence
  chemically synthesized
attagcgtttttggtgctcttg

SEQ ID NO: 1171217 - DNA, 22 bp, Artificial Sequence
  chemically synthesized
tttattagcgtttttggtgctc

SEQ ID NO: 1171218 - DNA, 22 bp, Artificial Sequence
  chemically synthesized
atttattagcgtttttggtgct

SEQ ID NO: 1171219 - DNA, 22 bp, Artificial Sequence
  chemically synthesized
ttatttattagcgtttttggtg

SEQ ID NO: 1171220 - DNA, 22 bp, Artificial Sequence
  chemically synthesized
tcttatttattagcgtttttgg

SEQ ID NO: 1171221 - DNA, 22 bp, Artificial Sequence
  chemically synthesized
tctcttatttattagcgttttt

SEQ ID NO: 1171222 - DNA, 22 bp, Artificial Sequence
  chemically synthesized
ataaataagagagaggcctgac

SEQ ID NO: 1171223 - DNA, 22 bp, Artificial Sequence
  chemically synthesized
ataggatgcataatgtcaggcc

SEQ ID NO: 1171224 - DNA, 22 bp, Artificial Sequence
  chemically synthesized
aataggatgcataatgtcaggc

SEQ ID NO: 1171225 - DNA, 22 bp, Artificial Sequence
  chemically synthesized
acattatgcatcctattaagga

SEQ ID NO: 1171226 - DNA, 22 bp, Artificial Sequence
  chemically synthesized
tggaaaatcagagatccttaat

SEQ ID NO: 1171227 - DNA, 22 bp, Artificial Sequence
  chemically synthesized
tgtggaaaatcagagatcctta

SEQ ID NO: 1171228 - DNA, 22 bp, Artificial Sequence
  chemically synthesized
ctgtggaaaatcagagatcctt

SEQ ID NO: 1171229 - DNA, 22 bp, Artificial Sequence
  chemically synthesized
tgcatcctattaaggatctctg

SEQ ID NO: 1171230 - DNA, 22 bp, Artificial Sequence
  chemically synthesized
atatcttctgtggaaaatcaga

SEQ ID NO: 1171231 - DNA, 22 bp, Artificial Sequence
  chemically synthesized
gatatcttctgtggaaaatcag

SEQ ID NO: 1171232 - DNA, 22 bp, Artificial Sequence
  chemically synthesized
ttaaggatctctgattttccac

SEQ ID NO: 1171233 - DNA, 22 bp, Artificial Sequence
  chemically synthesized
aggatctctgattttccacaga

SEQ ID NO: 1171234 - DNA, 22 bp, Artificial Sequence
  chemically synthesized
tgattttccacagaagatatca

SEQ ID NO: 1171235 - DNA, 22 bp, Artificial Sequence
  chemically synthesized
attttccacagaagatatcaag

SEQ ID NO: 1171236 - DNA, 22 bp, Artificial Sequence
  chemically synthesized
atgtaatatatggtacttgata

SEQ ID NO: 1171237 - DNA, 22 bp, Artificial Sequence
  chemically synthesized
tccacagaagatatcaagtacc

SEQ ID NO: 1171238 - DNA, 22 bp, Artificial Sequence
  chemically synthesized
gatgtaatatatggtacttgat

SEQ ID NO: 1171239 - DNA, 22 bp, Artificial Sequence
  chemically synthesized
ccacagaagatatcaagtacca

SEQ ID NO: 1171240 - DNA, 22 bp, Artificial Sequence
  chemically synthesized
cacagaagatatcaagtaccat

SEQ ID NO: 1171241 - DNA, 22 bp, Artificial Sequence
  chemically synthesized
agataatttgatgtaatatatg

SEQ ID NO: 1171242 - DNA, 22 bp, Artificial Sequence
  chemically synthesized
cagataatttgatgtaatatat

SEQ ID NO: 1171243 - DNA, 22 bp, Artificial Sequence
  chemically synthesized
tcagataatttgatgtaatata

SEQ ID NO: 1171244 - DNA, 22 bp, Artificial Sequence
  chemically synthesized
atatacaggttttcagataatt

SEQ ID NO: 1171245 - DNA, 22 bp, Artificial Sequence
  chemically synthesized
aatatacaggttttcagataat

SEQ ID NO: 1171246 - DNA, 22 bp, Artificial Sequence
  chemically synthesized
taatatacaggttttcagataa

SEQ ID NO: 1171247 - DNA, 22 bp, Artificial Sequence
  chemically synthesized
ttaatatacaggttttcagata

SEQ ID NO: 1171248 - DNA, 22 bp, Artificial Sequence
  chemically synthesized
catcaaattatctgaaaacctg

SEQ ID NO: 1171249 - DNA, 22 bp, Artificial Sequence
  chemically synthesized
ccaatttttaatatacaggttt

SEQ ID NO: 1171250 - DNA, 22 bp, Artificial Sequence
  chemically synthesized
accaatttttaatatacaggtt

SEQ ID NO: 1171251 - DNA, 22 bp, Artificial Sequence
  chemically synthesized
taccaatttttaatatacaggt

SEQ ID NO: 1171252 - DNA, 22 bp, Artificial Sequence
  chemically synthesized
tctgaaaacctgtatattaaaa

SEQ ID NO: 1171253 - DNA, 22 bp, Artificial Sequence
  chemically synthesized
aaaacctgtatattaaaaattg

SEQ ID NO: 1171254 - DNA, 22 bp, Artificial Sequence
  chemically synthesized
agaaagaaataaactttaccaa

SEQ ID NO: 1171255 - DNA, 22 bp, Artificial Sequence
  chemically synthesized
tatattaaaaattggtaaagtt

SEQ ID NO: 1171256 - DNA, 22 bp, Artificial Sequence
  chemically synthesized
agaattaagaaagaaataaact

SEQ ID NO: 1171257 - DNA, 22 bp, Artificial Sequence
  chemically synthesized
aaaattggtaaagtttatttct

SEQ ID NO: 1171258 - DNA, 22 bp, Artificial Sequence
  chemically synthesized
aagaattaagaaagaaataaac

SEQ ID NO: 1171259 - DNA, 22 bp, Artificial Sequence
  chemically synthesized
tttaagaattaagaaagaaata

SEQ ID NO: 1171260 - DNA, 22 bp, Artificial Sequence
  chemically synthesized
atttaagaattaagaaagaaat

SEQ ID NO: 1171261 - DNA, 22 bp, Artificial Sequence
  chemically synthesized
gtaaagtttatttctttcttaa

SEQ ID NO: 1171262 - DNA, 22 bp, Artificial Sequence
  chemically synthesized
acaggcttatttaagaattaag

SEQ ID NO: 1171263 - DNA, 22 bp, Artificial Sequence
  chemically synthesized
cacaggcttatttaagaattaa

SEQ ID NO: 1171264 - DNA, 22 bp, Artificial Sequence
  chemically synthesized
ttcacaggcttatttaagaatt

SEQ ID NO: 1171265 - DNA, 22 bp, Artificial Sequence
  chemically synthesized
atttctttcttaattcttaaat

SEQ ID NO: 1171266 - DNA, 22 bp, Artificial Sequence
  chemically synthesized
tttctttcttaattcttaaata

SEQ ID NO: 1171267 - DNA, 22 bp, Artificial Sequence
  chemically synthesized
ctttcttaattcttaaataagc

SEQ ID NO: 1171268 - DNA, 22 bp, Artificial Sequence
  chemically synthesized
tttcttaattcttaaataagcc

SEQ ID NO: 1171269 - DNA, 22 bp, Artificial Sequence
  chemically synthesized
tcttaattcttaaataagcctg

SEQ ID NO: 1171270 - DNA, 22 bp, Artificial Sequence
  chemically synthesized
cttaattcttaaataagcctgt

SEQ ID NO: 1171271 - DNA, 22 bp, Artificial Sequence
  chemically synthesized
taatgtctcttcacaggcttat

SEQ ID NO: 1171272 - DNA, 22 bp, Artificial Sequence
  chemically synthesized
ttaattcttaaataagcctgtg

SEQ ID NO: 1171273 - DNA, 22 bp, Artificial Sequence
  chemically synthesized
aattcttaaataagcctgtgaa

SEQ ID NO: 1171274 - DNA, 22 bp, Artificial Sequence
  chemically synthesized
attcttaaataagcctgtgaag

SEQ ID NO: 1171275 - DNA, 22 bp, Artificial Sequence
  chemically synthesized
ttaaataagcctgtgaagagac

SEQ ID NO: 1171276 - DNA, 22 bp, Artificial Sequence
  chemically synthesized
aaataagcctgtgaagagacat

SEQ ID NO: 1171277 - DNA, 22 bp, Artificial Sequence
  chemically synthesized
aataagcctgtgaagagacatt

SEQ ID NO: 1171278 - DNA, 22 bp, Artificial Sequence
  chemically synthesized
gaaggacatattataatgtctc

SEQ ID NO: 1171279 - DNA, 22 bp, Artificial Sequence
  chemically synthesized
tagaaggacatattataatgtc

SEQ ID NO: 1171280 - DNA, 22 bp, Artificial Sequence
  chemically synthesized
tgaagagacattataatatgtc

SEQ ID NO: 1171281 - DNA, 22 bp, Artificial Sequence
  chemically synthesized
gggttctagaaggacatattat

SEQ ID NO: 1171282 - DNA, 22 bp, Artificial Sequence
  chemically synthesized
taatatgtccttctagaacccc

SEQ ID NO: 1171283 - DNA, 22 bp, Artificial Sequence
  chemically synthesized
ggagatacacacgatgaactgg

SEQ ID NO: 1171284 - DNA, 22 bp, Artificial Sequence
  chemically synthesized
aggagatacacacgatgaactg

SEQ ID NO: 1171285 - DNA, 22 bp, Artificial Sequence
  chemically synthesized
ctagaaccccagttcatcgtgt

SEQ ID NO: 1171286 - DNA, 22 bp, Artificial Sequence
  chemically synthesized
tagaaccccagttcatcgtgtg

SEQ ID NO: 1171287 - DNA, 22 bp, Artificial Sequence
  chemically synthesized
gaaccccagttcatcgtgtgta

SEQ ID NO: 1171288 - DNA, 22 bp, Artificial Sequence
  chemically synthesized
atcgtgtgtatctcctaagtgg

SEQ ID NO: 1171289 - DNA, 22 bp, Artificial Sequence
  chemically synthesized
cacagtggatagcacccactta

SEQ ID NO: 1171290 - DNA, 22 bp, Artificial Sequence
  chemically synthesized
ctaagtgggtgctatccactgt

SEQ ID NO: 1171291 - DNA, 22 bp, Artificial Sequence
  chemically synthesized
aagcacagtctacacagtggat

SEQ ID NO: 1171292 - DNA, 22 bp, Artificial Sequence
  chemically synthesized
aaagcacagtctacacagtgga

SEQ ID NO: 1171293 - DNA, 22 bp, Artificial Sequence
  chemically synthesized
agtgggtgctatccactgtgta

SEQ ID NO: 1171294 - DNA, 22 bp, Artificial Sequence
  chemically synthesized
taatttaaagcacagtctacac

SEQ ID NO: 1171295 - DNA, 22 bp, Artificial Sequence
  chemically synthesized
tccactgtgtagactgtgcttt

SEQ ID NO: 1171296 - DNA, 22 bp, Artificial Sequence
  chemically synthesized
tgtagactgtgctttaaattat

SEQ ID NO: 1171297 - DNA, 22 bp, Artificial Sequence
  chemically synthesized
gatgatgaagacagcattataa

SEQ ID NO: 1171298 - DNA, 22 bp, Artificial Sequence
  chemically synthesized
agatgatgaagacagcattata

SEQ ID NO: 1171299 - DNA, 22 bp, Artificial Sequence
  chemically synthesized
tgctttaaattataatgctgtc

SEQ ID NO: 1171300 - DNA, 22 bp, Artificial Sequence
  chemically synthesized
taaattataatgctgtcttcat

SEQ ID NO: 1171301 - DNA, 22 bp, Artificial Sequence
  chemically synthesized
aaattataatgctgtcttcatc

SEQ ID NO: 1171302 - DNA, 22 bp, Artificial Sequence
  chemically synthesized
aattataatgctgtcttcatca

SEQ ID NO: 1171303 - DNA, 22 bp, Artificial Sequence
  chemically synthesized
aaagaatttagatgatgaagac

SEQ ID NO: 1171304 - DNA, 22 bp, Artificial Sequence
  chemically synthesized
taaaagaatttagatgatgaag

SEQ ID NO: 1171305 - DNA, 22 bp, Artificial Sequence
  chemically synthesized
taatgctgtcttcatcatctaa

SEQ ID NO: 1171306 - DNA, 22 bp, Artificial Sequence
  chemically synthesized
tcttcatcatctaaattctttt

SEQ ID NO: 1171307 - DNA, 22 bp, Artificial Sequence
  chemically synthesized
gtggtaaattctaaaagaattt

SEQ ID NO: 1171308 - DNA, 22 bp, Artificial Sequence
  chemically synthesized
tggtggtaaattctaaaagaat

SEQ ID NO: 1171309 - DNA, 22 bp, Artificial Sequence
  chemically synthesized
catcatctaaattcttttagaa

SEQ ID NO: 1171310 - DNA, 22 bp, Artificial Sequence
  chemically synthesized
atcatctaaattcttttagaat

SEQ ID NO: 1171311 - DNA, 22 bp, Artificial Sequence
  chemically synthesized
agttctggtggtaaattctaaa

SEQ ID NO: 1171312 - DNA, 22 bp, Artificial Sequence
  chemically synthesized
cagttctggtggtaaattctaa

SEQ ID NO: 1171313 - DNA, 22 bp, Artificial Sequence
  chemically synthesized
aattcttttagaatttaccacc

SEQ ID NO: 1171314 - DNA, 22 bp, Artificial Sequence
  chemically synthesized
tacttcagttctggtggtaaat

SEQ ID NO: 1171315 - DNA, 22 bp, Artificial Sequence
  chemically synthesized
actatacttcagttctggtggt

SEQ ID NO: 1171316 - DNA, 22 bp, Artificial Sequence
  chemically synthesized
ttttagaatttaccaccagaac

SEQ ID NO: 1171317 - DNA, 22 bp, Artificial Sequence
  chemically synthesized
ttagaatttaccaccagaactg

SEQ ID NO: 1171318 - DNA, 22 bp, Artificial Sequence
  chemically synthesized
tagaatttaccaccagaactga

SEQ ID NO: 1171319 - DNA, 22 bp, Artificial Sequence
  chemically synthesized
attcactatacttcagttctgg

SEQ ID NO: 1171320 - DNA, 22 bp, Artificial Sequence
  chemically synthesized
agaatttaccaccagaactgaa

SEQ ID NO: 1171321 - DNA, 22 bp, Artificial Sequence
  chemically synthesized
aattcactatacttcagttctg

SEQ ID NO: 1171322 - DNA, 22 bp, Artificial Sequence
  chemically synthesized
gaatttaccaccagaactgaag

SEQ ID NO: 1171323 - DNA, 22 bp, Artificial Sequence
  chemically synthesized
accaccagaactgaagtatagt

SEQ ID NO: 1171324 - DNA, 22 bp, Artificial Sequence
  chemically synthesized
ccaccagaactgaagtatagtg

SEQ ID NO: 1171325 - DNA, 22 bp, Artificial Sequence
  chemically synthesized
acaaatggtaaacacttaattc

SEQ ID NO: 1171326 - DNA, 22 bp, Artificial Sequence
  chemically synthesized
aagtatagtgaattaagtgttt

SEQ ID NO: 1171327 - DNA, 22 bp, Artificial Sequence
  chemically synthesized
caccatccctcacaaatggtaa

SEQ ID NO: 1171328 - DNA, 22 bp, Artificial Sequence
  chemically synthesized
acaccatccctcacaaatggta

SEQ ID NO: 1171329 - DNA, 22 bp, Artificial Sequence
  chemically synthesized
agtgtttaccatttgtgaggga

SEQ ID NO: 1171330 - DNA, 22 bp, Artificial Sequence
  chemically synthesized
gtggagtgcttacaccatccct

SEQ ID NO: 1171331 - DNA, 22 bp, Artificial Sequence
  chemically synthesized
agtggagtgcttacaccatccc

SEQ ID NO: 1171332 - DNA, 22 bp, Artificial Sequence
  chemically synthesized
accatttgtgagggatggtgta

SEQ ID NO: 1171333 - DNA, 22 bp, Artificial Sequence
  chemically synthesized
ccatttgtgagggatggtgtaa

SEQ ID NO: 1171334 - DNA, 22 bp, Artificial Sequence
  chemically synthesized
gtgagggatggtgtaagcactc

SEQ ID NO: 1171335 - DNA, 22 bp, Artificial Sequence
  chemically synthesized
gatgatttagtggagtgcttac

SEQ ID NO: 1171336 - DNA, 22 bp, Artificial Sequence
  chemically synthesized
tgagggatggtgtaagcactcc

SEQ ID NO: 1171337 - DNA, 22 bp, Artificial Sequence
  chemically synthesized
aattagatgatttagtggagtg

SEQ ID NO: 1171338 - DNA, 22 bp, Artificial Sequence
  chemically synthesized
tgaggttaaattagatgattta

SEQ ID NO: 1171339 - DNA, 22 bp, Artificial Sequence
  chemically synthesized
tgttgtgaggttaaattagatg

SEQ ID NO: 1171340 - DNA, 22 bp, Artificial Sequence
  chemically synthesized
atgttgtgaggttaaattagat

SEQ ID NO: 1171341 - DNA, 22 bp, Artificial Sequence
  chemically synthesized
cactaaatcatctaatttaacc

SEQ ID NO: 1171342 - DNA, 22 bp, Artificial Sequence
  chemically synthesized
aatcatctaatttaacctcaca

SEQ ID NO: 1171343 - DNA, 22 bp, Artificial Sequence
  chemically synthesized
atttaacctcacaacataaggg

SEQ ID NO: 1171344 - DNA, 22 bp, Artificial Sequence
  chemically synthesized
aacctcacaacataagggatga

SEQ ID NO: 1171345 - DNA, 22 bp, Artificial Sequence
  chemically synthesized
acctcacaacataagggatgat

SEQ ID NO: 1171346 - DNA, 22 bp, Artificial Sequence
  chemically synthesized
acaacataagggatgattattg

SEQ ID NO: 1171347 - DNA, 22 bp, Artificial Sequence
  chemically synthesized
atagtaaaatgtagacaataat

SEQ ID NO: 1171348 - DNA, 22 bp, Artificial Sequence
  chemically synthesized
ctcatagtaaaatgtagacaat

SEQ ID NO: 1171349 - DNA, 22 bp, Artificial Sequence
  chemically synthesized
ttgtctacattttactatgagg

SEQ ID NO: 1171350 - DNA, 22 bp, Artificial Sequence
  chemically synthesized
tgaatcaggtctcctcatagta

SEQ ID NO: 1171351 - DNA, 22 bp, Artificial Sequence
  chemically synthesized
atgaatcaggtctcctcatagt

SEQ ID NO: 1171352 - DNA, 22 bp, Artificial Sequence
  chemically synthesized
tatgaatcaggtctcctcatag

SEQ ID NO: 1171353 - DNA, 22 bp, Artificial Sequence
  chemically synthesized
tctacattttactatgaggaga

SEQ ID NO: 1171354 - DNA, 22 bp, Artificial Sequence
  chemically synthesized
cattttactatgaggagacctg

SEQ ID NO: 1171355 - DNA, 22 bp, Artificial Sequence
  chemically synthesized
acctttatgaatcaggtctcct

SEQ ID NO: 1171356 - DNA, 22 bp, Artificial Sequence
  chemically synthesized
taacctttatgaatcaggtctc

SEQ ID NO: 1171357 - DNA, 22 bp, Artificial Sequence
  chemically synthesized
ctaacctttatgaatcaggtct

SEQ ID NO: 1171358 - DNA, 22 bp, Artificial Sequence
  chemically synthesized
tactatgaggagacctgattca

SEQ ID NO: 1171359 - DNA, 22 bp, Artificial Sequence
  chemically synthesized
actatgaggagacctgattcat

SEQ ID NO: 1171360 - DNA, 22 bp, Artificial Sequence
  chemically synthesized
ctatgaggagacctgattcata

SEQ ID NO: 1171361 - DNA, 22 bp, Artificial Sequence
  chemically synthesized
tgaggagacctgattcataaag

SEQ ID NO: 1171362 - DNA, 22 bp, Artificial Sequence
  chemically synthesized
ggcaagtttctaacctttatga

SEQ ID NO: 1171363 - DNA, 22 bp, Artificial Sequence
  chemically synthesized
gggcaagtttctaacctttatg

SEQ ID NO: 1171364 - DNA, 22 bp, Artificial Sequence
  chemically synthesized
gaccttgggcaagtttctaacc

SEQ ID NO: 1171365 - DNA, 22 bp, Artificial Sequence
  chemically synthesized
cgaccttgggcaagtttctaac

SEQ ID NO: 1171366 - DNA, 22 bp, Artificial Sequence
  chemically synthesized
attcataaaggttagaaacttg

SEQ ID NO: 1171367 - DNA, 22 bp, Artificial Sequence
  chemically synthesized
ttcgaccttgggcaagtttcta

SEQ ID NO: 1171368 - DNA, 22 bp, Artificial Sequence
  chemically synthesized
ataaaggttagaaacttgccca

SEQ ID NO: 1171369 - DNA, 22 bp, Artificial Sequence
  chemically synthesized
gctcttcgaccttgggcaagtt

SEQ ID NO: 1171370 - DNA, 22 bp, Artificial Sequence
  chemically synthesized
ttagctcttcgaccttgggcaa

SEQ ID NO: 1171371 - DNA, 22 bp, Artificial Sequence
  chemically synthesized
attagctcttcgaccttgggca

SEQ ID NO: 1171372 - DNA, 22 bp, Artificial Sequence
  chemically synthesized
tattagctcttcgaccttgggc

SEQ ID NO: 1171373 - DNA, 22 bp, Artificial Sequence
  chemically synthesized
ttattagctcttcgaccttggg

SEQ ID NO: 1171374 - DNA, 22 bp, Artificial Sequence
  chemically synthesized
tttattagctcttcgaccttgg

SEQ ID NO: 1171375 - DNA, 22 bp, Artificial Sequence
  chemically synthesized
gaaacttgcccaaggtcgaaga

SEQ ID NO: 1171376 - DNA, 22 bp, Artificial Sequence
  chemically synthesized
ctttttattagctcttcgacct

SEQ ID NO: 1171377 - DNA, 22 bp, Artificial Sequence
  chemically synthesized
tgctttttattagctcttcgac

SEQ ID NO: 1171378 - DNA, 22 bp, Artificial Sequence
  chemically synthesized
gcccaaggtcgaagagctaata

SEQ ID NO: 1171379 - DNA, 22 bp, Artificial Sequence
  chemically synthesized
cccaaggtcgaagagctaataa

SEQ ID NO: 1171380 - DNA, 22 bp, Artificial Sequence
  chemically synthesized
ccatctctgctttttattagct

SEQ ID NO: 1171381 - DNA, 22 bp, Artificial Sequence
  chemically synthesized
agttcccatctctgctttttat

SEQ ID NO: 1171382 - DNA, 22 bp, Artificial Sequence
  chemically synthesized
aattcagttcccatctctgctt

SEQ ID NO: 1171383 - DNA, 22 bp, Artificial Sequence
  chemically synthesized
ataaaaagcagagatgggaact

SEQ ID NO: 1171384 - DNA, 22 bp, Artificial Sequence
  chemically synthesized
gtgagacagatactgaattcag

SEQ ID NO: 1171385 - DNA, 22 bp, Artificial Sequence
  chemically synthesized
cgtgagacagatactgaattca

SEQ ID NO: 1171386 - DNA, 22 bp, Artificial Sequence
  chemically synthesized
aggatttcgtgagacagatact

SEQ ID NO: 1171387 - DNA, 22 bp, Artificial Sequence
  chemically synthesized
atattcaggatttcgtgagaca

SEQ ID NO: 1171388 - DNA, 22 bp, Artificial Sequence
  chemically synthesized
aattcagtatctgtctcacgaa

SEQ ID NO: 1171389 - DNA, 22 bp, Artificial Sequence
  chemically synthesized
agtatctgtctcacgaaatcct

SEQ ID NO: 1171390 - DNA, 22 bp, Artificial Sequence
  chemically synthesized
gcaacaagttaatattcaggat

SEQ ID NO: 1171391 - DNA, 22 bp, Artificial Sequence
  chemically synthesized
tctcacgaaatcctgaatatta

SEQ ID NO: 1171392 - DNA, 22 bp, Artificial Sequence
  chemically synthesized
acgaaatcctgaatattaactt

SEQ ID NO: 1171393 - DNA, 22 bp, Artificial Sequence
  chemically synthesized
caaaaaagtctggcaacaagtt

SEQ ID NO: 1171394 - DNA, 22 bp, Artificial Sequence
  chemically synthesized
ttacaaaaaagtctggcaacaa

SEQ ID NO: 1171395 - DNA, 22 bp, Artificial Sequence
  chemically synthesized
aatattaacttgttgccagact

SEQ ID NO: 1171396 - DNA, 22 bp, Artificial Sequence
  chemically synthesized
agttattacaaaaaagtctggc

SEQ ID NO: 1171397 - DNA, 22 bp, Artificial Sequence
  chemically synthesized
gagttattacaaaaaagtctgg

SEQ ID NO: 1171398 - DNA, 22 bp, Artificial Sequence
  chemically synthesized
acttgttgccagacttttttgt

SEQ ID NO: 1171399 - DNA, 22 bp, Artificial Sequence
  chemically synthesized
cccttgagttattacaaaaaag

SEQ ID NO: 1171400 - DNA, 22 bp, Artificial Sequence
  chemically synthesized
ccccttgagttattacaaaaaa

SEQ ID NO: 1171401 - DNA, 22 bp, Artificial Sequence
  chemically synthesized
gttgccagacttttttgtaata

SEQ ID NO: 1171402 - DNA, 22 bp, Artificial Sequence
  chemically synthesized
ttccccttgagttattacaaaa

SEQ ID NO: 1171403 - DNA, 22 bp, Artificial Sequence
  chemically synthesized
ttgccagacttttttgtaataa

SEQ ID NO: 1171404 - DNA, 22 bp, Artificial Sequence
  chemically synthesized
cttccccttgagttattacaaa

SEQ ID NO: 1171405 - DNA, 22 bp, Artificial Sequence
  chemically synthesized
ccagacttttttgtaataactc

SEQ ID NO: 1171406 - DNA, 22 bp, Artificial Sequence
  chemically synthesized
ggaaatgtttcttccccttgag

SEQ ID NO: 1171407 - DNA, 22 bp, Artificial Sequence
  chemically synthesized
ttttgtaataactcaaggggaa

SEQ ID NO: 1171408 - DNA, 22 bp, Artificial Sequence
  chemically synthesized
tttgtaataactcaaggggaag

SEQ ID NO: 1171409 - DNA, 22 bp, Artificial Sequence
  chemically synthesized
tgggaaatgtttcttccccttg

SEQ ID NO: 1171410 - DNA, 22 bp, Artificial Sequence
  chemically synthesized
ttgtaataactcaaggggaaga

SEQ ID NO: 1171411 - DNA, 22 bp, Artificial Sequence
  chemically synthesized
tgtaataactcaaggggaagaa

SEQ ID NO: 1171412 - DNA, 22 bp, Artificial Sequence
  chemically synthesized
gtaataactcaaggggaagaaa

SEQ ID NO: 1171413 - DNA, 22 bp, Artificial Sequence
  chemically synthesized
taataactcaaggggaagaaac

SEQ ID NO: 1171414 - DNA, 22 bp, Artificial Sequence
  chemically synthesized
tctctgggaaatgtttcttccc

SEQ ID NO: 1171415 - DNA, 22 bp, Artificial Sequence
  chemically synthesized
gctatctctgggaaatgtttct

SEQ ID NO: 1171416 - DNA, 22 bp, Artificial Sequence
  chemically synthesized
aaggggaagaaacatttcccag

SEQ ID NO: 1171417 - DNA, 22 bp, Artificial Sequence
  chemically synthesized
taaatctagctatctctgggaa

SEQ ID NO: 1171418 - DNA, 22 bp, Artificial Sequence
  chemically synthesized
ataaatctagctatctctggga

SEQ ID NO: 1171419 - DNA, 22 bp, Artificial Sequence
  chemically synthesized
tataaatctagctatctctggg

SEQ ID NO: 1171420 - DNA, 22 bp, Artificial Sequence
  chemically synthesized
aattttataaatctagctatct

SEQ ID NO: 1171421 - DNA, 22 bp, Artificial Sequence
  chemically synthesized
aattaaattttataaatctagc

SEQ ID NO: 1171422 - DNA, 22 bp, Artificial Sequence
  chemically synthesized
aaattaaattttataaatctag

SEQ ID NO: 1171423 - DNA, 22 bp, Artificial Sequence
  chemically synthesized
cccagagatagctagatttata

SEQ ID NO: 1171424 - DNA, 22 bp, Artificial Sequence
  chemically synthesized
taaattaaattttataaatcta

SEQ ID NO: 1171425 - DNA, 22 bp, Artificial Sequence
  chemically synthesized
ccagagatagctagatttataa

SEQ ID NO: 1171426 - DNA, 22 bp, Artificial Sequence
  chemically synthesized
ttaaattaaattttataaatct

SEQ ID NO: 1171427 - DNA, 22 bp, Artificial Sequence
  chemically synthesized
atttttaaattaaattttataa

SEQ ID NO: 1171428 - DNA, 22 bp, Artificial Sequence
  chemically synthesized
gatttttaaattaaattttata

SEQ ID NO: 1171429 - DNA, 22 bp, Artificial Sequence
  chemically synthesized
tgatttttaaattaaattttat

SEQ ID NO: 1171430 - DNA, 22 bp, Artificial Sequence
  chemically synthesized
tattttgatttttaaattaaat

SEQ ID NO: 1171431 - DNA, 22 bp, Artificial Sequence
  chemically synthesized
gatttataaaatttaatttaaa

SEQ ID NO: 1171432 - DNA, 22 bp, Artificial Sequence
  chemically synthesized
ttatattttgatttttaaatta

SEQ ID NO: 1171433 - DNA, 22 bp, Artificial Sequence
  chemically synthesized
ataaaatttaatttaaaaatca

SEQ ID NO: 1171434 - DNA, 22 bp, Artificial Sequence
  chemically synthesized
taaaatttaatttaaaaatcaa

SEQ ID NO: 1171435 - DNA, 22 bp, Artificial Sequence
  chemically synthesized
aatttaaaaatcaaaatataat

SEQ ID NO: 1171436 - DNA, 22 bp, Artificial Sequence
  chemically synthesized
atttaaaaatcaaaatataata

SEQ ID NO: 1171437 - DNA, 22 bp, Artificial Sequence
  chemically synthesized
aaaaatcaaaatataataatgt

SEQ ID NO: 1171438 - DNA, 22 bp, Artificial Sequence
  chemically synthesized
aaaatcaaaatataataatgtg

SEQ ID NO: 1171439 - DNA, 22 bp, Artificial Sequence
  chemically synthesized
acataaaatataacacattatt

SEQ ID NO: 1171440 - DNA, 22 bp, Artificial Sequence
  chemically synthesized
gaatgatcacattcacataaaa

SEQ ID NO: 1171441 - DNA, 22 bp, Artificial Sequence
  chemically synthesized
agaatgatcacattcacataaa

SEQ ID NO: 1171442 - DNA, 22 bp, Artificial Sequence
  chemically synthesized
tattttatgtgaatgtgatcat

SEQ ID NO: 1171443 - DNA, 22 bp, Artificial Sequence
  chemically synthesized
tatgtgaatgtgatcattctaa

SEQ ID NO: 1171444 - DNA, 22 bp, Artificial Sequence
  chemically synthesized
atgtgaatgtgatcattctaag

SEQ ID NO: 1171445 - DNA, 22 bp, Artificial Sequence
  chemically synthesized
tgtgaatgtgatcattctaagt

SEQ ID NO: 1171446 - DNA, 22 bp, Artificial Sequence
  chemically synthesized
tgagtgtatgagagacttagaa

SEQ ID NO: 1171447 - DNA, 22 bp, Artificial Sequence
  chemically synthesized
tgtgagtgtatgagagacttag

SEQ ID NO: 1171448 - DNA, 22 bp, Artificial Sequence
  chemically synthesized
tccacaattctgtgagtgtatg

SEQ ID NO: 1171449 - DNA, 22 bp, Artificial Sequence
  chemically synthesized
taagtctctcatacactcacag

SEQ ID NO: 1171450 - DNA, 22 bp, Artificial Sequence
  chemically synthesized
agtctctcatacactcacagaa

SEQ ID NO: 1171451 - DNA, 22 bp, Artificial Sequence
  chemically synthesized
tcatacactcacagaattgtgg

SEQ ID NO: 1171452 - DNA, 22 bp, Artificial Sequence
  chemically synthesized
atacactcacagaattgtggat

SEQ ID NO: 1171453 - DNA, 22 bp, Artificial Sequence
  chemically synthesized
gatgaatcaaagaaatctatcc

SEQ ID NO: 1171454 - DNA, 22 bp, Artificial Sequence
  chemically synthesized
acagaattgtggatagatttct

SEQ ID NO: 1171455 - DNA, 22 bp, Artificial Sequence
  chemically synthesized
tggatagatttctttgattcat

SEQ ID NO: 1171456 - DNA, 22 bp, Artificial Sequence
  chemically synthesized
agggtgaaaaagactggatgaa

SEQ ID NO: 1171457 - DNA, 22 bp, Artificial Sequence
  chemically synthesized
taagggtgaaaaagactggatg

SEQ ID NO: 1171458 - DNA, 22 bp, Artificial Sequence
  chemically synthesized
ctaagggtgaaaaagactggat

SEQ ID NO: 1171459 - DNA, 22 bp, Artificial Sequence
  chemically synthesized
ctttgattcatccagtcttttt

SEQ ID NO: 1171460 - DNA, 22 bp, Artificial Sequence
  chemically synthesized
tttgattcatccagtctttttc

SEQ ID NO: 1171461 - DNA, 22 bp, Artificial Sequence
  chemically synthesized
tgattcatccagtctttttcac

SEQ ID NO: 1171462 - DNA, 22 bp, Artificial Sequence
  chemically synthesized
gattcatccagtctttttcacc

SEQ ID NO: 1171463 - DNA, 22 bp, Artificial Sequence
  chemically synthesized
attcatccagtctttttcaccc

SEQ ID NO: 1171464 - DNA, 22 bp, Artificial Sequence
  chemically synthesized
atccagtctttttcacccttag

SEQ ID NO: 1171465 - DNA, 22 bp, Artificial Sequence
  chemically synthesized
gtcacagaaatttctaagggtg

SEQ ID NO: 1171466 - DNA, 22 bp, Artificial Sequence
  chemically synthesized
tttcacccttagaaatttctgt

SEQ ID NO: 1171467 - DNA, 22 bp, Artificial Sequence
  chemically synthesized
ttcacccttagaaatttctgtg

SEQ ID NO: 1171468 - DNA, 22 bp, Artificial Sequence
  chemically synthesized
tcacccttagaaatttctgtga

SEQ ID NO: 1171469 - DNA, 22 bp, Artificial Sequence
  chemically synthesized
cacccttagaaatttctgtgac

SEQ ID NO: 1171470 - DNA, 22 bp, Artificial Sequence
  chemically synthesized
acccttagaaatttctgtgacc

SEQ ID NO: 1171471 - DNA, 22 bp, Artificial Sequence
  chemically synthesized
taaacatataaaattggtcaca

SEQ ID NO: 1171472 - DNA, 22 bp, Artificial Sequence
  chemically synthesized
agaaatttctgtgaccaatttt

SEQ ID NO: 1171473 - DNA, 22 bp, Artificial Sequence
  chemically synthesized
gaaatttctgtgaccaatttta

SEQ ID NO: 1171474 - DNA, 22 bp, Artificial Sequence
  chemically synthesized
ctgtgaccaattttatatgttt

SEQ ID NO: 1171475 - DNA, 22 bp, Artificial Sequence
  chemically synthesized
tgtgaccaattttatatgttta

SEQ ID NO: 1171476 - DNA, 22 bp, Artificial Sequence
  chemically synthesized
tgaccaattttatatgtttata

SEQ ID NO: 1171477 - DNA, 22 bp, Artificial Sequence
  chemically synthesized
tatgccatatacaatcatatta

SEQ ID NO: 1171478 - DNA, 22 bp, Artificial Sequence
  chemically synthesized
tatatgtttataatatgattgt

SEQ ID NO: 1171479 - DNA, 22 bp, Artificial Sequence
  chemically synthesized
atatgtttataatatgattgta

SEQ ID NO: 1171480 - DNA, 22 bp, Artificial Sequence
  chemically synthesized
tatgtttataatatgattgtat

SEQ ID NO: 1171481 - DNA, 22 bp, Artificial Sequence
  chemically synthesized
ataatatgattgtatatggcat

SEQ ID NO: 1171482 - DNA, 22 bp, Artificial Sequence
  chemically synthesized
taatatgattgtatatggcata

SEQ ID NO: 1171483 - DNA, 22 bp, Artificial Sequence
  chemically synthesized
gaatgcaaaaattatatgccat

SEQ ID NO: 1171484 - DNA, 22 bp, Artificial Sequence
  chemically synthesized
agaatgcaaaaattatatgcca

SEQ ID NO: 1171485 - DNA, 22 bp, Artificial Sequence
  chemically synthesized
tttagaatgcaaaaattatatg

SEQ ID NO: 1171486 - DNA, 22 bp, Artificial Sequence
  chemically synthesized
tctgtttagaatgcaaaaatta

SEQ ID NO: 1171487 - DNA, 22 bp, Artificial Sequence
  chemically synthesized
tatatggcatataatttttgca

SEQ ID NO: 1171488 - DNA, 22 bp, Artificial Sequence
  chemically synthesized
tatagacaagctatctgtttag

SEQ ID NO: 1171489 - DNA, 22 bp, Artificial Sequence
  chemically synthesized
atatagacaagctatctgttta

SEQ ID NO: 1171490 - DNA, 22 bp, Artificial Sequence
  chemically synthesized
tatatagacaagctatctgttt

SEQ ID NO: 1171491 - DNA, 22 bp, Artificial Sequence
  chemically synthesized
ttatatagacaagctatctgtt

SEQ ID NO: 1171492 - DNA, 22 bp, Artificial Sequence
  chemically synthesized
ttgcattctaaacagatagctt

SEQ ID NO: 1171493 - DNA, 22 bp, Artificial Sequence
  chemically synthesized
tgcattctaaacagatagcttg

SEQ ID NO: 1171494 - DNA, 22 bp, Artificial Sequence
  chemically synthesized
tttttatatagacaagctatct

SEQ ID NO: 1171495 - DNA, 22 bp, Artificial Sequence
  chemically synthesized
gcattctaaacagatagcttgt

SEQ ID NO: 1171496 - DNA, 22 bp, Artificial Sequence
  chemically synthesized
atttttatatagacaagctatc

SEQ ID NO: 1171497 - DNA, 22 bp, Artificial Sequence
  chemically synthesized
cattctaaacagatagcttgtc

SEQ ID NO: 1171498 - DNA, 22 bp, Artificial Sequence
  chemically synthesized
tatttttatatagacaagctat

SEQ ID NO: 1171499 - DNA, 22 bp, Artificial Sequence
  chemically synthesized
ttatttttatatagacaagcta

SEQ ID NO: 1171500 - DNA, 22 bp, Artificial Sequence
  chemically synthesized
tttatttttatatagacaagct

SEQ ID NO: 1171501 - DNA, 22 bp, Artificial Sequence
  chemically synthesized
taaacagatagcttgtctatat

SEQ ID NO: 1171502 - DNA, 22 bp, Artificial Sequence
  chemically synthesized
attttttatttttatatagaca

SEQ ID NO: 1171503 - DNA, 22 bp, Artificial Sequence
  chemically synthesized
aacagatagcttgtctatataa

SEQ ID NO: 1171504 - DNA, 22 bp, Artificial Sequence
  chemically synthesized
tggtagttcattttttattttt

SEQ ID NO: 1171505 - DNA, 22 bp, Artificial Sequence
  chemically synthesized
atggtagttcattttttatttt

SEQ ID NO: 1171506 - DNA, 22 bp, Artificial Sequence
  chemically synthesized
gtctatataaaaataaaaaatg

SEQ ID NO: 1171507 - DNA, 22 bp, Artificial Sequence
  chemically synthesized
tctatataaaaataaaaaatga

SEQ ID NO: 1171508 - DNA, 22 bp, Artificial Sequence
  chemically synthesized
tataaaaataaaaaatgaacta

SEQ ID NO: 1171509 - DNA, 22 bp, Artificial Sequence
  chemically synthesized
atgaaacttatggtagttcatt

SEQ ID NO: 1171510 - DNA, 22 bp, Artificial Sequence
  chemically synthesized
tgctaatgaaacttatggtagt

SEQ ID NO: 1171511 - DNA, 22 bp, Artificial Sequence
  chemically synthesized
aggcattgtgctaatgaaactt

SEQ ID NO: 1171512 - DNA, 22 bp, Artificial Sequence
  chemically synthesized
aaggcattgtgctaatgaaact

SEQ ID NO: 1171513 - DNA, 22 bp, Artificial Sequence
  chemically synthesized
taaggcattgtgctaatgaaac

SEQ ID NO: 1171514 - DNA, 22 bp, Artificial Sequence
  chemically synthesized
ccataagtttcattagcacaat

SEQ ID NO: 1171515 - DNA, 22 bp, Artificial Sequence
  chemically synthesized
cattagcacaatgccttaaaat

SEQ ID NO: 1171516 - DNA, 22 bp, Artificial Sequence
  chemically synthesized
aaatgtgagtaaattttaaggc

SEQ ID NO: 1171517 - DNA, 22 bp, Artificial Sequence
  chemically synthesized
attagcacaatgccttaaaatt

SEQ ID NO: 1171518 - DNA, 22 bp, Artificial Sequence
  chemically synthesized
aaaatgtgagtaaattttaagg

SEQ ID NO: 1171519 - DNA, 22 bp, Artificial Sequence
  chemically synthesized
gcacaatgccttaaaatttact

SEQ ID NO: 1171520 - DNA, 22 bp, Artificial Sequence
  chemically synthesized
aaatttaaaatgtgagtaaatt

SEQ ID NO: 1171521 - DNA, 22 bp, Artificial Sequence
  chemically synthesized
aaaatttaaaatgtgagtaaat

SEQ ID NO: 1171522 - DNA, 22 bp, Artificial Sequence
  chemically synthesized
atttaaaatttaaaatgtgagt

SEQ ID NO: 1171523 - DNA, 22 bp, Artificial Sequence
  chemically synthesized
aaaatttactcacattttaaat

SEQ ID NO: 1171524 - DNA, 22 bp, Artificial Sequence
  chemically synthesized
aaatttactcacattttaaatt

SEQ ID NO: 1171525 - DNA, 22 bp, Artificial Sequence
  chemically synthesized
tgtactgatttaaaatttaaaa

SEQ ID NO: 1171526 - DNA, 22 bp, Artificial Sequence
  chemically synthesized
atgtactgatttaaaatttaaa

SEQ ID NO: 1171527 - DNA, 22 bp, Artificial Sequence
  chemically synthesized
tatgtactgatttaaaatttaa

SEQ ID NO: 1171528 - DNA, 22 bp, Artificial Sequence
  chemically synthesized
actcacattttaaattttaaat

SEQ ID NO: 1171529 - DNA, 22 bp, Artificial Sequence
  chemically synthesized
ctcacattttaaattttaaatc

SEQ ID NO: 1171530 - DNA, 22 bp, Artificial Sequence
  chemically synthesized
tattttatgtactgatttaaaa

SEQ ID NO: 1171531 - DNA, 22 bp, Artificial Sequence
  chemically synthesized
acattttaaattttaaatcagt

SEQ ID NO: 1171532 - DNA, 22 bp, Artificial Sequence
  chemically synthesized
tatctatattttatgtactgat

SEQ ID NO: 1171533 - DNA, 22 bp, Artificial Sequence
  chemically synthesized
taaattttaaatcagtacataa

SEQ ID NO: 1171534 - DNA, 22 bp, Artificial Sequence
  chemically synthesized
aaattttaaatcagtacataaa

SEQ ID NO: 1171535 - DNA, 22 bp, Artificial Sequence
  chemically synthesized
aattttaaatcagtacataaaa

SEQ ID NO: 1171536 - DNA, 22 bp, Artificial Sequence
  chemically synthesized
attgtatctatattttatgtac

SEQ ID NO: 1171537 - DNA, 22 bp, Artificial Sequence
  chemically synthesized
cattgtatctatattttatgta

SEQ ID NO: 1171538 - DNA, 22 bp, Artificial Sequence
  chemically synthesized
taaatcagtacataaaatatag

SEQ ID NO: 1171539 - DNA, 22 bp, Artificial Sequence
  chemically synthesized
aaatcagtacataaaatataga

SEQ ID NO: 1171540 - DNA, 22 bp, Artificial Sequence
  chemically synthesized
aatcagtacataaaatatagat

SEQ ID NO: 1171541 - DNA, 22 bp, Artificial Sequence
  chemically synthesized
catatttcattgtatctatatt

SEQ ID NO: 1171542 - DNA, 22 bp, Artificial Sequence
  chemically synthesized
ctgcatatttcattgtatctat

SEQ ID NO: 1171543 - DNA, 22 bp, Artificial Sequence
  chemically synthesized
gctgcatatttcattgtatcta

SEQ ID NO: 1171544 - DNA, 22 bp, Artificial Sequence
  chemically synthesized
tataccaacaaaatcccagtaa

SEQ ID NO: 1171545 - DNA, 22 bp, Artificial Sequence
  chemically synthesized
gggtatgattatataccaacaa

SEQ ID NO: 1171546 - DNA, 22 bp, Artificial Sequence
  chemically synthesized
cgggtatgattatataccaaca

SEQ ID NO: 1171547 - DNA, 22 bp, Artificial Sequence
  chemically synthesized
ctgggattttgttggtatataa

SEQ ID NO: 1171548 - DNA, 22 bp, Artificial Sequence
  chemically synthesized
ggattttgttggtatataatca

SEQ ID NO: 1171549 - DNA, 22 bp, Artificial Sequence
  chemically synthesized
acaggtttcgggtatgattata

SEQ ID NO: 1171550 - DNA, 22 bp, Artificial Sequence
  chemically synthesized
gacaggtttcgggtatgattat

SEQ ID NO: 1171551 - DNA, 22 bp, Artificial Sequence
  chemically synthesized
tgacaggtttcgggtatgatta

SEQ ID NO: 1171552 - DNA, 22 bp, Artificial Sequence
  chemically synthesized
tgttggtatataatcatacccg

SEQ ID NO: 1171553 - DNA, 22 bp, Artificial Sequence
  chemically synthesized
gttggtatataatcatacccga

SEQ ID NO: 1171554 - DNA, 22 bp, Artificial Sequence
  chemically synthesized
ttggtatataatcatacccgaa

SEQ ID NO: 1171555 - DNA, 22 bp, Artificial Sequence
  chemically synthesized
agttttgacaggtttcgggtat

SEQ ID NO: 1171556 - DNA, 22 bp, Artificial Sequence
  chemically synthesized
aagttttgacaggtttcgggta

SEQ ID NO: 1171557 - DNA, 22 bp, Artificial Sequence
  chemically synthesized
gtatataatcatacccgaaacc

SEQ ID NO: 1171558 - DNA, 22 bp, Artificial Sequence
  chemically synthesized
taagttttgacaggtttcgggt

SEQ ID NO: 1171559 - DNA, 22 bp, Artificial Sequence
  chemically synthesized
aaatgtaccaatgggtgtgttt

SEQ ID NO: 1171560 - DNA, 22 bp, Artificial Sequence
  chemically synthesized
tcaaaacttaaaacacacccat

SEQ ID NO: 1171561 - DNA, 22 bp, Artificial Sequence
  chemically synthesized
aaaacacacccattggtacatt

SEQ ID NO: 1171562 - DNA, 22 bp, Artificial Sequence
  chemically synthesized
aaacacacccattggtacattt

SEQ ID NO: 1171563 - DNA, 22 bp, Artificial Sequence
  chemically synthesized
caaagtagaacaaataagttga

SEQ ID NO: 1171564 - DNA, 22 bp, Artificial Sequence
  chemically synthesized
ccaaagtagaacaaataagttg

SEQ ID NO: 1171565 - DNA, 22 bp, Artificial Sequence
  chemically synthesized
tccaaagtagaacaaataagtt

SEQ ID NO: 1171566 - DNA, 22 bp, Artificial Sequence
  chemically synthesized
gtacatttcaacttatttgttc

SEQ ID NO: 1171567 - DNA, 22 bp, Artificial Sequence
  chemically synthesized
ctttccaaagtagaacaaataa

SEQ ID NO: 1171568 - DNA, 22 bp, Artificial Sequence
  chemically synthesized
tgctttccaaagtagaacaaat

SEQ ID NO: 1171569 - DNA, 22 bp, Artificial Sequence
  chemically synthesized
ctgctttccaaagtagaacaaa

SEQ ID NO: 1171570 - DNA, 22 bp, Artificial Sequence
  chemically synthesized
caacttatttgttctactttgg

SEQ ID NO: 1171571 - DNA, 22 bp, Artificial Sequence
  chemically synthesized
catttctgctttccaaagtaga

SEQ ID NO: 1171572 - DNA, 22 bp, Artificial Sequence
  chemically synthesized
aacttatttgttctactttgga

SEQ ID NO: 1171573 - DNA, 22 bp, Artificial Sequence
  chemically synthesized
ccatttctgctttccaaagtag

SEQ ID NO: 1171574 - DNA, 22 bp, Artificial Sequence
  chemically synthesized
tccatttctgctttccaaagta

SEQ ID NO: 1171575 - DNA, 22 bp, Artificial Sequence
  chemically synthesized
tttccatttctgctttccaaag

SEQ ID NO: 1171576 - DNA, 22 bp, Artificial Sequence
  chemically synthesized
ctttccatttctgctttccaaa

SEQ ID NO: 1171577 - DNA, 22 bp, Artificial Sequence
  chemically synthesized
atttgttctactttggaaagca

SEQ ID NO: 1171578 - DNA, 22 bp, Artificial Sequence
  chemically synthesized
tttgttctactttggaaagcag

SEQ ID NO: 1171579 - DNA, 22 bp, Artificial Sequence
  chemically synthesized
tttctttccatttctgctttcc

SEQ ID NO: 1171580 - DNA, 22 bp, Artificial Sequence
  chemically synthesized
gttctactttggaaagcagaaa

SEQ ID NO: 1171581 - DNA, 22 bp, Artificial Sequence
  chemically synthesized
tgtttctttccatttctgcttt

SEQ ID NO: 1171582 - DNA, 22 bp, Artificial Sequence
  chemically synthesized
ttctactttggaaagcagaaat

SEQ ID NO: 1171583 - DNA, 22 bp, Artificial Sequence
  chemically synthesized
ttctgtttctttccatttctgc

SEQ ID NO: 1171584 - DNA, 22 bp, Artificial Sequence
  chemically synthesized
tactttggaaagcagaaatgga

SEQ ID NO: 1171585 - DNA, 22 bp, Artificial Sequence
  chemically synthesized
attctgtttctttccatttctg

SEQ ID NO: 1171586 - DNA, 22 bp, Artificial Sequence
  chemically synthesized
ctttggaaagcagaaatggaaa

SEQ ID NO: 1171587 - DNA, 22 bp, Artificial Sequence
  chemically synthesized
tttattctgtttctttccattt

SEQ ID NO: 1171588 - DNA, 22 bp, Artificial Sequence
  chemically synthesized
tggaaagcagaaatggaaagaa

SEQ ID NO: 1171589 - DNA, 22 bp, Artificial Sequence
  chemically synthesized
tgtttattctgtttctttccat

SEQ ID NO: 1171590 - DNA, 22 bp, Artificial Sequence
  chemically synthesized
ggaaagcagaaatggaaagaaa

SEQ ID NO: 1171591 - DNA, 22 bp, Artificial Sequence
  chemically synthesized
ctgtttattctgtttctttcca

SEQ ID NO: 1171592 - DNA, 22 bp, Artificial Sequence
  chemically synthesized
gaaagcagaaatggaaagaaac

SEQ ID NO: 1171593 - DNA, 22 bp, Artificial Sequence
  chemically synthesized
tgtgacaaaaaggtatttctgt

SEQ ID NO: 1171594 - DNA, 22 bp, Artificial Sequence
  chemically synthesized
actatgtgacaaaaaggtattt

SEQ ID NO: 1171595 - DNA, 22 bp, Artificial Sequence
  chemically synthesized
tctcactatgtgacaaaaaggt

SEQ ID NO: 1171596 - DNA, 22 bp, Artificial Sequence
  chemically synthesized
attatctcactatgtgacaaaa

SEQ ID NO: 1171597 - DNA, 22 bp, Artificial Sequence
  chemically synthesized
aacatagtattgattatctcac

SEQ ID NO: 1171598 - DNA, 22 bp, Artificial Sequence
  chemically synthesized
tttgtcacatagtgagataatc

SEQ ID NO: 1171599 - DNA, 22 bp, Artificial Sequence
  chemically synthesized
aaacatagtattgattatctca

SEQ ID NO: 1171600 - DNA, 22 bp, Artificial Sequence
  chemically synthesized
ttgtcacatagtgagataatca

SEQ ID NO: 1171601 - DNA, 22 bp, Artificial Sequence
  chemically synthesized
taaacatagtattgattatctc

SEQ ID NO: 1171602 - DNA, 22 bp, Artificial Sequence
  chemically synthesized
tgtcacatagtgagataatcaa

SEQ ID NO: 1171603 - DNA, 22 bp, Artificial Sequence
  chemically synthesized
ttaaacatagtattgattatct

SEQ ID NO: 1171604 - DNA, 22 bp, Artificial Sequence
  chemically synthesized
gtcacatagtgagataatcaat

SEQ ID NO: 1171605 - DNA, 22 bp, Artificial Sequence
  chemically synthesized
tcacatagtgagataatcaata

SEQ ID NO: 1171606 - DNA, 22 bp, Artificial Sequence
  chemically synthesized
tttttaaacatagtattgatta

SEQ ID NO: 1171607 - DNA, 22 bp, Artificial Sequence
  chemically synthesized
gtttttaaacatagtattgatt

SEQ ID NO: 1171608 - DNA, 22 bp, Artificial Sequence
  chemically synthesized
tgtttttaaacatagtattgat

SEQ ID NO: 1171609 - DNA, 22 bp, Artificial Sequence
  chemically synthesized
aaaatataaagaaactttgttt

SEQ ID NO: 1171610 - DNA, 22 bp, Artificial Sequence
  chemically synthesized
gaaaatataaagaaactttgtt

SEQ ID NO: 1171611 - DNA, 22 bp, Artificial Sequence
  chemically synthesized
tgaaaatataaagaaactttgt

SEQ ID NO: 1171612 - DNA, 22 bp, Artificial Sequence
  chemically synthesized
tgtttaaaaacaaagtttcttt

SEQ ID NO: 1171613 - DNA, 22 bp, Artificial Sequence
  chemically synthesized
ttttgaaaatataaagaaactt

SEQ ID NO: 1171614 - DNA, 22 bp, Artificial Sequence
  chemically synthesized
aaaaacaaagtttctttatatt

SEQ ID NO: 1171615 - DNA, 22 bp, Artificial Sequence
  chemically synthesized
aaaacaaagtttctttatattt

SEQ ID NO: 1171616 - DNA, 22 bp, Artificial Sequence
  chemically synthesized
gaggctattttgaaaatataaa

SEQ ID NO: 1171617 - DNA, 22 bp, Artificial Sequence
  chemically synthesized
cactagaggctattttgaaaat

SEQ ID NO: 1171618 - DNA, 22 bp, Artificial Sequence
  chemically synthesized
attccactagaggctattttga

SEQ ID NO: 1171619 - DNA, 22 bp, Artificial Sequence
  chemically synthesized
ctttatattttcaaaatagcct

SEQ ID NO: 1171620 - DNA, 22 bp, Artificial Sequence
  chemically synthesized
tttatattttcaaaatagcctc

SEQ ID NO: 1171621 - DNA, 22 bp, Artificial Sequence
  chemically synthesized
tatattttcaaaatagcctcta

SEQ ID NO: 1171622 - DNA, 22 bp, Artificial Sequence
  chemically synthesized
atattttcaaaatagcctctag

SEQ ID NO: 1171623 - DNA, 22 bp, Artificial Sequence
  chemically synthesized
tattttcaaaatagcctctagt

SEQ ID NO: 1171624 - DNA, 22 bp, Artificial Sequence
  chemically synthesized
tcaaaatagcctctagtggaat

SEQ ID NO: 1171625 - DNA, 22 bp, Artificial Sequence
  chemically synthesized
caaaatagcctctagtggaatc

SEQ ID NO: 1171626 - DNA, 22 bp, Artificial Sequence
  chemically synthesized
aaaatagcctctagtggaatca

SEQ ID NO: 1171627 - DNA, 22 bp, Artificial Sequence
  chemically synthesized
tgcaaatcaagaatatggtagc

SEQ ID NO: 1171628 - DNA, 22 bp, Artificial Sequence
  chemically synthesized
tagtggaatcagctaccatatt

SEQ ID NO: 1171629 - DNA, 22 bp, Artificial Sequence
  chemically synthesized
gtggaatcagctaccatattct

SEQ ID NO: 1171630 - DNA, 22 bp, Artificial Sequence
  chemically synthesized
taagtattatgcaaatcaagaa

SEQ ID NO: 1171631 - DNA, 22 bp, Artificial Sequence
  chemically synthesized
ataagtattatgcaaatcaaga

SEQ ID NO: 1171632 - DNA, 22 bp, Artificial Sequence
  chemically synthesized
ccatattcttgatttgcataat

SEQ ID NO: 1171633 - DNA, 22 bp, Artificial Sequence
  chemically synthesized
taggaaatttataagtattatg

SEQ ID NO: 1171634 - DNA, 22 bp, Artificial Sequence
  chemically synthesized
gtaggaaatttataagtattat

SEQ ID NO: 1171635 - DNA, 22 bp, Artificial Sequence
  chemically synthesized
ttgatttgcataatacttataa

SEQ ID NO: 1171636 - DNA, 22 bp, Artificial Sequence
  chemically synthesized
gatttgcataatacttataaat

SEQ ID NO: 1171637 - DNA, 22 bp, Artificial Sequence
  chemically synthesized
agtttgtaggaaatttataagt

SEQ ID NO: 1171638 - DNA, 22 bp, Artificial Sequence
  chemically synthesized
atttgcataatacttataaatt

SEQ ID NO: 1171639 - DNA, 22 bp, Artificial Sequence
  chemically synthesized
gcataatacttataaatttcct

SEQ ID NO: 1171640 - DNA, 22 bp, Artificial Sequence
  chemically synthesized
cataatacttataaatttccta

SEQ ID NO: 1171641 - DNA, 22 bp, Artificial Sequence
  chemically synthesized
ataaatttcctacaaactcagt

SEQ ID NO: 1171642 - DNA, 22 bp, Artificial Sequence
  chemically synthesized
taaatttcctacaaactcagta

SEQ ID NO: 1171643 - DNA, 22 bp, Artificial Sequence
  chemically synthesized
caaatagaatatgtactgagtt

SEQ ID NO: 1171644 - DNA, 22 bp, Artificial Sequence
  chemically synthesized
ccaaatagaatatgtactgagt

SEQ ID NO: 1171645 - DNA, 22 bp, Artificial Sequence
  chemically synthesized
cctacaaactcagtacatattc

SEQ ID NO: 1171646 - DNA, 22 bp, Artificial Sequence
  chemically synthesized
ctacaaactcagtacatattct

SEQ ID NO: 1171647 - DNA, 22 bp, Artificial Sequence
  chemically synthesized
caaactcagtacatattctatt

SEQ ID NO: 1171648 - DNA, 22 bp, Artificial Sequence
  chemically synthesized
tatataaaaacttccaaataga

SEQ ID NO: 1171649 - DNA, 22 bp, Artificial Sequence
  chemically synthesized
agtacatattctatttggaagt

SEQ ID NO: 1171650 - DNA, 22 bp, Artificial Sequence
  chemically synthesized
tatttggaagtttttatatata

SEQ ID NO: 1171651 - DNA, 22 bp, Artificial Sequence
  chemically synthesized
tttggaagtttttatatatagg

SEQ ID NO: 1171652 - DNA, 22 bp, Artificial Sequence
  chemically synthesized
gtgtaatataaagcctatatat

SEQ ID NO: 1171653 - DNA, 22 bp, Artificial Sequence
  chemically synthesized
agtgtaatataaagcctatata

SEQ ID NO: 1171654 - DNA, 22 bp, Artificial Sequence
  chemically synthesized
ggaagtttttatatataggctt

SEQ ID NO: 1171655 - DNA, 22 bp, Artificial Sequence
  chemically synthesized
tagtgtaatataaagcctatat

SEQ ID NO: 1171656 - DNA, 22 bp, Artificial Sequence
  chemically synthesized
gaagtttttatatataggcttt

SEQ ID NO: 1171657 - DNA, 22 bp, Artificial Sequence
  chemically synthesized
ttagtgtaatataaagcctata

SEQ ID NO: 1171658 - DNA, 22 bp, Artificial Sequence
  chemically synthesized
tttagtgtaatataaagcctat

SEQ ID NO: 1171659 - DNA, 22 bp, Artificial Sequence
  chemically synthesized
ttatatataggctttatattac

SEQ ID NO: 1171660 - DNA, 22 bp, Artificial Sequence
  chemically synthesized
tatatataggctttatattaca

SEQ ID NO: 1171661 - DNA, 22 bp, Artificial Sequence
  chemically synthesized
atatataggctttatattacac

SEQ ID NO: 1171662 - DNA, 22 bp, Artificial Sequence
  chemically synthesized
atgacctttttagtgtaatata

SEQ ID NO: 1171663 - DNA, 22 bp, Artificial Sequence
  chemically synthesized
tatataggctttatattacact

SEQ ID NO: 1171664 - DNA, 22 bp, Artificial Sequence
  chemically synthesized
gatgacctttttagtgtaatat

SEQ ID NO: 1171665 - DNA, 22 bp, Artificial Sequence
  chemically synthesized
tatattacactaaaaaggtcat

SEQ ID NO: 1171666 - DNA, 22 bp, Artificial Sequence
  chemically synthesized
atattacactaaaaaggtcatc

SEQ ID NO: 1171667 - DNA, 22 bp, Artificial Sequence
  chemically synthesized
tattacactaaaaaggtcatca

SEQ ID NO: 1171668 - DNA, 22 bp, Artificial Sequence
  chemically synthesized
cactaaaaaggtcatcaaatta

SEQ ID NO: 1171669 - DNA, 22 bp, Artificial Sequence
  chemically synthesized
tggacgtggcaataatttgatg

SEQ ID NO: 1171670 - DNA, 22 bp, Artificial Sequence
  chemically synthesized
atggacgtggcaataatttgat

SEQ ID NO: 1171671 - DNA, 22 bp, Artificial Sequence
  chemically synthesized
aaaaggtcatcaaattattgcc

SEQ ID NO: 1171672 - DNA, 22 bp, Artificial Sequence
  chemically synthesized
atttatggacgtggcaataatt

SEQ ID NO: 1171673 - DNA, 22 bp, Artificial Sequence
  chemically synthesized
aatttatggacgtggcaataat

SEQ ID NO: 1171674 - DNA, 22 bp, Artificial Sequence
  chemically synthesized
taatttatggacgtggcaataa

SEQ ID NO: 1171675 - DNA, 22 bp, Artificial Sequence
  chemically synthesized
acatattttaatttatggacgt

SEQ ID NO: 1171676 - DNA, 22 bp, Artificial Sequence
  chemically synthesized
aacatattttaatttatggacg

SEQ ID NO: 1171677 - DNA, 22 bp, Artificial Sequence
  chemically synthesized
ttgccacgtccataaattaaaa

SEQ ID NO: 1171678 - DNA, 22 bp, Artificial Sequence
  chemically synthesized
gagtttaacatattttaattta

SEQ ID NO: 1171679 - DNA, 22 bp, Artificial Sequence
  chemically synthesized
ggagtttaacatattttaattt

SEQ ID NO: 1171680 - DNA, 22 bp, Artificial Sequence
  chemically synthesized
ccacgtccataaattaaaatat

SEQ ID NO: 1171681 - DNA, 22 bp, Artificial Sequence
  chemically synthesized
atatttggagtttaacatattt

SEQ ID NO: 1171682 - DNA, 22 bp, Artificial Sequence
  chemically synthesized
catatttggagtttaacatatt

SEQ ID NO: 1171683 - DNA, 22 bp, Artificial Sequence
  chemically synthesized
tcatatttggagtttaacatat

SEQ ID NO: 1171684 - DNA, 22 bp, Artificial Sequence
  chemically synthesized
ccgtactttcatatttggagtt

SEQ ID NO: 1171685 - DNA, 22 bp, Artificial Sequence
  chemically synthesized
aaatatgttaaactccaaatat

SEQ ID NO: 1171686 - DNA, 22 bp, Artificial Sequence
  chemically synthesized
aagagctgccgtactttcatat

SEQ ID NO: 1171687 - DNA, 22 bp, Artificial Sequence
  chemically synthesized
gaagagctgccgtactttcata

SEQ ID NO: 1171688 - DNA, 22 bp, Artificial Sequence
  chemically synthesized
tgaagagctgccgtactttcat

SEQ ID NO: 1171689 - DNA, 22 bp, Artificial Sequence
  chemically synthesized
ttgaagagctgccgtactttca

SEQ ID NO: 1171690 - DNA, 22 bp, Artificial Sequence
  chemically synthesized
aactccaaatatgaaagtacgg

SEQ ID NO: 1171691 - DNA, 22 bp, Artificial Sequence
  chemically synthesized
caaatatgaaagtacggcagct

SEQ ID NO: 1171692 - DNA, 22 bp, Artificial Sequence
  chemically synthesized
aggtttttgaagagctgccgta

SEQ ID NO: 1171693 - DNA, 22 bp, Artificial Sequence
  chemically synthesized
tgttaaggtttttgaagagctg

SEQ ID NO: 1171694 - DNA, 22 bp, Artificial Sequence
  chemically synthesized
atgttaaggtttttgaagagct

SEQ ID NO: 1171695 - DNA, 22 bp, Artificial Sequence
  chemically synthesized
tatgttaaggtttttgaagagc

SEQ ID NO: 1171696 - DNA, 22 bp, Artificial Sequence
  chemically synthesized
cctttatgttaaggtttttgaa

SEQ ID NO: 1171697 - DNA, 22 bp, Artificial Sequence
  chemically synthesized
acctttatgttaaggtttttga

SEQ ID NO: 1171698 - DNA, 22 bp, Artificial Sequence
  chemically synthesized
atttacctttatgttaaggttt

SEQ ID NO: 1171699 - DNA, 22 bp, Artificial Sequence
  chemically synthesized
aatttacctttatgttaaggtt

SEQ ID NO: 1171700 - DNA, 22 bp, Artificial Sequence
  chemically synthesized
taatttacctttatgttaaggt

SEQ ID NO: 1171701 - DNA, 22 bp, Artificial Sequence
  chemically synthesized
ttcaaaaaccttaacataaagg

SEQ ID NO: 1171702 - DNA, 22 bp, Artificial Sequence
  chemically synthesized
caaaaaccttaacataaaggta

SEQ ID NO: 1171703 - DNA, 22 bp, Artificial Sequence
  chemically synthesized
aaaaaccttaacataaaggtaa

SEQ ID NO: 1171704 - DNA, 22 bp, Artificial Sequence
  chemically synthesized
cataattttaatttacctttat

SEQ ID NO: 1171705 - DNA, 22 bp, Artificial Sequence
  chemically synthesized
gcataattttaatttaccttta

SEQ ID NO: 1171706 - DNA, 22 bp, Artificial Sequence
  chemically synthesized
aatttgcataattttaatttac

SEQ ID NO: 1171707 - DNA, 22 bp, Artificial Sequence
  chemically synthesized
aacataaaggtaaattaaaatt

SEQ ID NO: 1171708 - DNA, 22 bp, Artificial Sequence
  chemically synthesized
ctcaatttgcataattttaatt

SEQ ID NO: 1171709 - DNA, 22 bp, Artificial Sequence
  chemically synthesized
acataaaggtaaattaaaatta

SEQ ID NO: 1171710 - DNA, 22 bp, Artificial Sequence
  chemically synthesized
tactcaatttgcataattttaa

SEQ ID NO: 1171711 - DNA, 22 bp, Artificial Sequence
  chemically synthesized
ctactcaatttgcataatttta

SEQ ID NO: 1171712 - DNA, 22 bp, Artificial Sequence
  chemically synthesized
tctactcaatttgcataatttt

SEQ ID NO: 1171713 - DNA, 22 bp, Artificial Sequence
  chemically synthesized
catgagttttctactcaatttg

SEQ ID NO: 1171714 - DNA, 22 bp, Artificial Sequence
  chemically synthesized
tgcatgagttttctactcaatt

SEQ ID NO: 1171715 - DNA, 22 bp, Artificial Sequence
  chemically synthesized
ctgcatgagttttctactcaat

SEQ ID NO: 1171716 - DNA, 22 bp, Artificial Sequence
  chemically synthesized
aaattatgcaaattgagtagaa

SEQ ID NO: 1171717 - DNA, 22 bp, Artificial Sequence
  chemically synthesized
cagtttctgcatgagttttcta

SEQ ID NO: 1171718 - DNA, 22 bp, Artificial Sequence
  chemically synthesized
tgcaaattgagtagaaaactca

SEQ ID NO: 1171719 - DNA, 22 bp, Artificial Sequence
  chemically synthesized
acagtttctgcatgagttttct

SEQ ID NO: 1171720 - DNA, 22 bp, Artificial Sequence
  chemically synthesized
cagatttacagtttctgcatga

SEQ ID NO: 1171721 - DNA, 22 bp, Artificial Sequence
  chemically synthesized
agtagaaaactcatgcagaaac

SEQ ID NO: 1171722 - DNA, 22 bp, Artificial Sequence
  chemically synthesized
ttccagatttacagtttctgca

SEQ ID NO: 1171723 - DNA, 22 bp, Artificial Sequence
  chemically synthesized
cctattccagatttacagtttc

SEQ ID NO: 1171724 - DNA, 22 bp, Artificial Sequence
  chemically synthesized
ccctattccagatttacagttt

SEQ ID NO: 1171725 - DNA, 22 bp, Artificial Sequence
  chemically synthesized
atgcagaaactgtaaatctgga

SEQ ID NO: 1171726 - DNA, 22 bp, Artificial Sequence
  chemically synthesized
aatggcttccctattccagatt

SEQ ID NO: 1171727 - DNA, 22 bp, Artificial Sequence
  chemically synthesized
aaatggcttccctattccagat

SEQ ID NO: 1171728 - DNA, 22 bp, Artificial Sequence
  chemically synthesized
ccttaaatggcttccctattcc

SEQ ID NO: 1171729 - DNA, 22 bp, Artificial Sequence
  chemically synthesized
accttaaatggcttccctattc

SEQ ID NO: 1171730 - DNA, 22 bp, Artificial Sequence
  chemically synthesized
taccttaaatggcttccctatt

SEQ ID NO: 1171731 - DNA, 22 bp, Artificial Sequence
  chemically synthesized
ttaccttaaatggcttccctat

SEQ ID NO: 1171732 - DNA, 22 bp, Artificial Sequence
  chemically synthesized
taaatctggaatagggaagcca

SEQ ID NO: 1171733 - DNA, 22 bp, Artificial Sequence
  chemically synthesized
ttttaccttaaatggcttccct

SEQ ID NO: 1171734 - DNA, 22 bp, Artificial Sequence
  chemically synthesized
tcttttaccttaaatggcttcc

SEQ ID NO: 1171735 - DNA, 22 bp, Artificial Sequence
  chemically synthesized
ctcttttaccttaaatggcttc

SEQ ID NO: 1171736 - DNA, 22 bp, Artificial Sequence
  chemically synthesized
gaatagggaagccatttaaggt

SEQ ID NO: 1171737 - DNA, 22 bp, Artificial Sequence
  chemically synthesized
tgacgatttctcttttacctta

SEQ ID NO: 1171738 - DNA, 22 bp, Artificial Sequence
  chemically synthesized
gtgacgatttctcttttacctt

SEQ ID NO: 1171739 - DNA, 22 bp, Artificial Sequence
  chemically synthesized
agcatacttgtgacgatttctc

SEQ ID NO: 1171740 - DNA, 22 bp, Artificial Sequence
  chemically synthesized
taagcatacttgtgacgatttc

SEQ ID NO: 1171741 - DNA, 22 bp, Artificial Sequence
  chemically synthesized
aaggtaaaagagaaatcgtcac

SEQ ID NO: 1171742 - DNA, 22 bp, Artificial Sequence
  chemically synthesized
aggtaaaagagaaatcgtcaca

SEQ ID NO: 1171743 - DNA, 22 bp, Artificial Sequence
  chemically synthesized
aatcaggaaattctaagcatac

SEQ ID NO: 1171744 - DNA, 22 bp, Artificial Sequence
  chemically synthesized
taaatcaggaaattctaagcat

SEQ ID NO: 1171745 - DNA, 22 bp, Artificial Sequence
  chemically synthesized
ctaaatcaggaaattctaagca

SEQ ID NO: 1171746 - DNA, 22 bp, Artificial Sequence
  chemically synthesized
tttctaaatcaggaaattctaa

SEQ ID NO: 1171747 - DNA, 22 bp, Artificial Sequence
  chemically synthesized
tcccactatttctaaatcagga

SEQ ID NO: 1171748 - DNA, 22 bp, Artificial Sequence
  chemically synthesized
gtcccactatttctaaatcagg

SEQ ID NO: 1171749 - DNA, 22 bp, Artificial Sequence
  chemically synthesized
tgtcccactatttctaaatcag

SEQ ID NO: 1171750 - DNA, 22 bp, Artificial Sequence
  chemically synthesized
agaatttcctgatttagaaata

SEQ ID NO: 1171751 - DNA, 22 bp, Artificial Sequence
  chemically synthesized
gaatttcctgatttagaaatag

SEQ ID NO: 1171752 - DNA, 22 bp, Artificial Sequence
  chemically synthesized
tattttgtcccactatttctaa

SEQ ID NO: 1171753 - DNA, 22 bp, Artificial Sequence
  chemically synthesized
cctgatttagaaatagtgggac

SEQ ID NO: 1171754 - DNA, 22 bp, Artificial Sequence
  chemically synthesized
ctgatttagaaatagtgggaca

SEQ ID NO: 1171755 - DNA, 22 bp, Artificial Sequence
  chemically synthesized
atttagaaatagtgggacaaaa

SEQ ID NO: 1171756 - DNA, 22 bp, Artificial Sequence
  chemically synthesized
ataggtaggattgtattttgtc

SEQ ID NO: 1171757 - DNA, 22 bp, Artificial Sequence
  chemically synthesized
agaaatagtgggacaaaataca

SEQ ID NO: 1171758 - DNA, 22 bp, Artificial Sequence
  chemically synthesized
gataggtaggattgtattttgt

SEQ ID NO: 1171759 - DNA, 22 bp, Artificial Sequence
  chemically synthesized
gaaatagtgggacaaaatacaa

SEQ ID NO: 1171760 - DNA, 22 bp, Artificial Sequence
  chemically synthesized
aaaagcttgataggtaggattg

SEQ ID NO: 1171761 - DNA, 22 bp, Artificial Sequence
  chemically synthesized
tctgaaaagcttgataggtagg

SEQ ID NO: 1171762 - DNA, 22 bp, Artificial Sequence
  chemically synthesized
ttatctgaaaagcttgataggt

SEQ ID NO: 1171763 - DNA, 22 bp, Artificial Sequence
  chemically synthesized
ggcacaatgttattatctgaaa

SEQ ID NO: 1171764 - DNA, 22 bp, Artificial Sequence
  chemically synthesized
cctatcaagcttttcagataat

SEQ ID NO: 1171765 - DNA, 22 bp, Artificial Sequence
  chemically synthesized
tcaagcttttcagataataaca

SEQ ID NO: 1171766 - DNA, 22 bp, Artificial Sequence
  chemically synthesized
aggcctaggcacaatgttatta

SEQ ID NO: 1171767 - DNA, 22 bp, Artificial Sequence
  chemically synthesized
caggcctaggcacaatgttatt

SEQ ID NO: 1171768 - DNA, 22 bp, Artificial Sequence
  chemically synthesized
tcaggcctaggcacaatgttat

SEQ ID NO: 1171769 - DNA, 22 bp, Artificial Sequence
  chemically synthesized
ttcagataataacattgtgcct

SEQ ID NO: 1171770 - DNA, 22 bp, Artificial Sequence
  chemically synthesized
tcagataataacattgtgccta

SEQ ID NO: 1171771 - DNA, 22 bp, Artificial Sequence
  chemically synthesized
cagataataacattgtgcctag

SEQ ID NO: 1171772 - DNA, 22 bp, Artificial Sequence
  chemically synthesized
agataataacattgtgcctagg

SEQ ID NO: 1171773 - DNA, 22 bp, Artificial Sequence
  chemically synthesized
tgcctaggcctgaaagtacatg

SEQ ID NO: 1171774 - DNA, 22 bp, Artificial Sequence
  chemically synthesized
aaacaaatgtcatgcatgtact

SEQ ID NO: 1171775 - DNA, 22 bp, Artificial Sequence
  chemically synthesized
caaacaaatgtcatgcatgtac

SEQ ID NO: 1171776 - DNA, 22 bp, Artificial Sequence
  chemically synthesized
tcaaacaaatgtcatgcatgta

SEQ ID NO: 1171777 - DNA, 22 bp, Artificial Sequence
  chemically synthesized
ggcctgaaagtacatgcatgac

SEQ ID NO: 1171778 - DNA, 22 bp, Artificial Sequence
  chemically synthesized
aaagtacatgcatgacatttgt

SEQ ID NO: 1171779 - DNA, 22 bp, Artificial Sequence
  chemically synthesized
caaggcaatcacaatcctttca

SEQ ID NO: 1171780 - DNA, 22 bp, Artificial Sequence
  chemically synthesized
acaaggcaatcacaatcctttc

SEQ ID NO: 1171781 - DNA, 22 bp, Artificial Sequence
  chemically synthesized
gtttgaaaggattgtgattgcc

SEQ ID NO: 1171782 - DNA, 22 bp, Artificial Sequence
  chemically synthesized
tttgaaaggattgtgattgcct

SEQ ID NO: 1171783 - DNA, 22 bp, Artificial Sequence
  chemically synthesized
gaaaggattgtgattgccttgt

SEQ ID NO: 1171784 - DNA, 22 bp, Artificial Sequence
  chemically synthesized
taaaagaagtttacaaggcaat

SEQ ID NO: 1171785 - DNA, 22 bp, Artificial Sequence
  chemically synthesized
aaaggattgtgattgccttgta

SEQ ID NO: 1171786 - DNA, 22 bp, Artificial Sequence
  chemically synthesized
gtaaaagaagtttacaaggcaa

SEQ ID NO: 1171787 - DNA, 22 bp, Artificial Sequence
  chemically synthesized
ataaatttgtaaaagaagttta

SEQ ID NO: 1171788 - DNA, 22 bp, Artificial Sequence
  chemically synthesized
tgattgccttgtaaacttcttt

SEQ ID NO: 1171789 - DNA, 22 bp, Artificial Sequence
  chemically synthesized
ccttgtaaacttcttttacaaa

SEQ ID NO: 1171790 - DNA, 22 bp, Artificial Sequence
  chemically synthesized
gtaaacttcttttacaaattta

SEQ ID NO: 1171791 - DNA, 22 bp, Artificial Sequence
  chemically synthesized
taaacttcttttacaaatttat

SEQ ID NO: 1171792 - DNA, 22 bp, Artificial Sequence
  chemically synthesized
cttttacaaatttattaacacg

SEQ ID NO: 1171793 - DNA, 22 bp, Artificial Sequence
  chemically synthesized
tacggaacaacccgtgttaata

SEQ ID NO: 1171794 - DNA, 22 bp, Artificial Sequence
  chemically synthesized
ttttacaaatttattaacacgg

SEQ ID NO: 1171795 - DNA, 22 bp, Artificial Sequence
  chemically synthesized
ttacaaatttattaacacgggt

SEQ ID NO: 1171796 - DNA, 22 bp, Artificial Sequence
  chemically synthesized
tacaaatttattaacacgggtt

SEQ ID NO: 1171797 - DNA, 22 bp, Artificial Sequence
  chemically synthesized
acaaatttattaacacgggttg

SEQ ID NO: 1171798 - DNA, 22 bp, Artificial Sequence
  chemically synthesized
caaatttattaacacgggttgt

SEQ ID NO: 1171799 - DNA, 22 bp, Artificial Sequence
  chemically synthesized
gccaactatacggaacaacccg

SEQ ID NO: 1171800 - DNA, 22 bp, Artificial Sequence
  chemically synthesized
attaacacgggttgttccgtat

SEQ ID NO: 1171801 - DNA, 22 bp, Artificial Sequence
  chemically synthesized
ttaacacgggttgttccgtata

SEQ ID NO: 1171802 - DNA, 22 bp, Artificial Sequence
  chemically synthesized
acacgggttgttccgtatagtt

SEQ ID NO: 1171803 - DNA, 22 bp, Artificial Sequence
  chemically synthesized
ttccgtatagttggccaacatt

SEQ ID NO: 1171804 - DNA, 22 bp, Artificial Sequence
  chemically synthesized
cgtatagttggccaacattgct

SEQ ID NO: 1171805 - DNA, 22 bp, Artificial Sequence
  chemically synthesized
tagggcagtggaagaaataagc

SEQ ID NO: 1171806 - DNA, 22 bp, Artificial Sequence
  chemically synthesized
gccaacattgcttatttcttcc

SEQ ID NO: 1171807 - DNA, 22 bp, Artificial Sequence
  chemically synthesized
ttgtagggcagtggaagaaata

SEQ ID NO: 1171808 - DNA, 22 bp, Artificial Sequence
  chemically synthesized
tggttgttgtagggcagtggaa

SEQ ID NO: 1171809 - DNA, 22 bp, Artificial Sequence
  chemically synthesized
atggttgttgtagggcagtgga

SEQ ID NO: 1171810 - DNA, 22 bp, Artificial Sequence
  chemically synthesized
cttatttcttccactgccctac

SEQ ID NO: 1171811 - DNA, 22 bp, Artificial Sequence
  chemically synthesized
atttcttccactgccctacaac

SEQ ID NO: 1171812 - DNA, 22 bp, Artificial Sequence
  chemically synthesized
tttcttccactgccctacaaca

SEQ ID NO: 1171813 - DNA, 22 bp, Artificial Sequence
  chemically synthesized
ggagtttatggttgttgtaggg

SEQ ID NO: 1171814 - DNA, 22 bp, Artificial Sequence
  chemically synthesized
cttccactgccctacaacaacc

SEQ ID NO: 1171815 - DNA, 22 bp, Artificial Sequence
  chemically synthesized
ttccactgccctacaacaacca

SEQ ID NO: 1171816 - DNA, 22 bp, Artificial Sequence
  chemically synthesized
ccactgccctacaacaaccata

SEQ ID NO: 1171817 - DNA, 22 bp, Artificial Sequence
  chemically synthesized
cactgccctacaacaaccataa

SEQ ID NO: 1171818 - DNA, 22 bp, Artificial Sequence
  chemically synthesized
ccctacaacaaccataaactcc

SEQ ID NO: 1171819 - DNA, 22 bp, Artificial Sequence
  chemically synthesized
ccagaataattgggagtttatg

SEQ ID NO: 1171820 - DNA, 22 bp, Artificial Sequence
  chemically synthesized
ctcccagaataattgggagttt

SEQ ID NO: 1171821 - DNA, 22 bp, Artificial Sequence
  chemically synthesized
caacaaccataaactcccaatt

SEQ ID NO: 1171822 - DNA, 22 bp, Artificial Sequence
  chemically synthesized
ataaactactcccagaataatt

SEQ ID NO: 1171823 - DNA, 22 bp, Artificial Sequence
  chemically synthesized
tgataaactactcccagaataa

SEQ ID NO: 1171824 - DNA, 22 bp, Artificial Sequence
  chemically synthesized
tactctgataaactactcccag

SEQ ID NO: 1171825 - DNA, 22 bp, Artificial Sequence
  chemically synthesized
ccaattattctgggagtagttt

SEQ ID NO: 1171826 - DNA, 22 bp, Artificial Sequence
  chemically synthesized
ttctgggagtagtttatcagag

SEQ ID NO: 1171827 - DNA, 22 bp, Artificial Sequence
  chemically synthesized
cagataatctgtactctgataa

SEQ ID NO: 1171828 - DNA, 22 bp, Artificial Sequence
  chemically synthesized
tgggagtagtttatcagagtac

SEQ ID NO: 1171829 - DNA, 22 bp, Artificial Sequence
  chemically synthesized
ggagtagtttatcagagtacag

SEQ ID NO: 1171830 - DNA, 22 bp, Artificial Sequence
  chemically synthesized
atcagagtacagattatctgga

SEQ ID NO: 1171831 - DNA, 22 bp, Artificial Sequence
  chemically synthesized
tcagagtacagattatctggag

SEQ ID NO: 1171832 - DNA, 22 bp, Artificial Sequence
  chemically synthesized
tctggaggtgttatttctcttt

SEQ ID NO: 1171833 - DNA, 22 bp, Artificial Sequence
  chemically synthesized
tgaaaggccaaatgaaagagaa

SEQ ID NO: 1171834 - DNA, 22 bp, Artificial Sequence
  chemically synthesized
gaggtgttatttctctttcatt

SEQ ID NO: 1171835 - DNA, 22 bp, Artificial Sequence
  chemically synthesized
atgagctgtgaaaggccaaatg

SEQ ID NO: 1171836 - DNA, 22 bp, Artificial Sequence
  chemically synthesized
tttctctttcatttggcctttc

SEQ ID NO: 1171837 - DNA, 22 bp, Artificial Sequence
  chemically synthesized
ctctttcatttggcctttcaca

SEQ ID NO: 1171838 - DNA, 22 bp, Artificial Sequence
  chemically synthesized
tctttcatttggcctttcacag

SEQ ID NO: 1171839 - DNA, 22 bp, Artificial Sequence
  chemically synthesized
aggtactaatgagctgtgaaag

SEQ ID NO: 1171840 - DNA, 22 bp, Artificial Sequence
  chemically synthesized
tttcatttggcctttcacagct

SEQ ID NO: 1171841 - DNA, 22 bp, Artificial Sequence
  chemically synthesized
tcatttggcctttcacagctca

SEQ ID NO: 1171842 - DNA, 22 bp, Artificial Sequence
  chemically synthesized
ttgaggtactaatgagctgtga

SEQ ID NO: 1171843 - DNA, 22 bp, Artificial Sequence
  chemically synthesized
catttggcctttcacagctcat

SEQ ID NO: 1171844 - DNA, 22 bp, Artificial Sequence
  chemically synthesized
gttgaggtactaatgagctgtg

SEQ ID NO: 1171845 - DNA, 22 bp, Artificial Sequence
  chemically synthesized
atttggcctttcacagctcatt

SEQ ID NO: 1171846 - DNA, 22 bp, Artificial Sequence
  chemically synthesized
ttgttgaggtactaatgagctg

SEQ ID NO: 1171847 - DNA, 22 bp, Artificial Sequence
  chemically synthesized
cttgttgaggtactaatgagct

SEQ ID NO: 1171848 - DNA, 22 bp, Artificial Sequence
  chemically synthesized
tcttgttgaggtactaatgagc

SEQ ID NO: 1171849 - DNA, 22 bp, Artificial Sequence
  chemically synthesized
ggcctttcacagctcattagta

SEQ ID NO: 1171850 - DNA, 22 bp, Artificial Sequence
  chemically synthesized
gcctttcacagctcattagtac

SEQ ID NO: 1171851 - DNA, 22 bp, Artificial Sequence
  chemically synthesized
actttcttgttgaggtactaat

SEQ ID NO: 1171852 - DNA, 22 bp, Artificial Sequence
  chemically synthesized
aactttcttgttgaggtactaa

SEQ ID NO: 1171853 - DNA, 22 bp, Artificial Sequence
  chemically synthesized
tcacagctcattagtacctcaa

SEQ ID NO: 1171854 - DNA, 22 bp, Artificial Sequence
  chemically synthesized
cacagctcattagtacctcaac

SEQ ID NO: 1171855 - DNA, 22 bp, Artificial Sequence
  chemically synthesized
acagctcattagtacctcaaca

SEQ ID NO: 1171856 - DNA, 22 bp, Artificial Sequence
  chemically synthesized
ccttaactttcttgttgaggta

SEQ ID NO: 1171857 - DNA, 22 bp, Artificial Sequence
  chemically synthesized
gccttaactttcttgttgaggt

SEQ ID NO: 1171858 - DNA, 22 bp, Artificial Sequence
  chemically synthesized
tgccttaactttcttgttgagg

SEQ ID NO: 1171859 - DNA, 22 bp, Artificial Sequence
  chemically synthesized
attagtacctcaacaagaaagt

SEQ ID NO: 1171860 - DNA, 22 bp, Artificial Sequence
  chemically synthesized
catcctttgccttaactttctt

SEQ ID NO: 1171861 - DNA, 22 bp, Artificial Sequence
  chemically synthesized
ccatcctttgccttaactttct

SEQ ID NO: 1171862 - DNA, 22 bp, Artificial Sequence
  chemically synthesized
gtacctcaacaagaaagttaag

SEQ ID NO: 1171863 - DNA, 22 bp, Artificial Sequence
  chemically synthesized
tccatcctttgccttaactttc

SEQ ID NO: 1171864 - DNA, 22 bp, Artificial Sequence
  chemically synthesized
aacaagaaagttaaggcaaagg

SEQ ID NO: 1171865 - DNA, 22 bp, Artificial Sequence
  chemically synthesized
cagcctttccatcctttgcctt

SEQ ID NO: 1171866 - DNA, 22 bp, Artificial Sequence
  chemically synthesized
tgcagcctttccatcctttgcc

SEQ ID NO: 1171867 - DNA, 22 bp, Artificial Sequence
  chemically synthesized
gaaattctgcagcctttccatc

SEQ ID NO: 1171868 - DNA, 22 bp, Artificial Sequence
  chemically synthesized
agaaattctgcagcctttccat

SEQ ID NO: 1171869 - DNA, 22 bp, Artificial Sequence
  chemically synthesized
aggcaaaggatggaaaggctgc

SEQ ID NO: 1171870 - DNA, 22 bp, Artificial Sequence
  chemically synthesized
tttagaaattctgcagcctttc

SEQ ID NO: 1171871 - DNA, 22 bp, Artificial Sequence
  chemically synthesized
gtttagaaattctgcagccttt

SEQ ID NO: 1171872 - DNA, 22 bp, Artificial Sequence
  chemically synthesized
tttgtttagaaattctgcagcc

SEQ ID NO: 1171873 - DNA, 22 bp, Artificial Sequence
  chemically synthesized
atttgtttagaaattctgcagc

SEQ ID NO: 1171874 - DNA, 22 bp, Artificial Sequence
  chemically synthesized
acaaggagcaaatttatttgtt

SEQ ID NO: 1171875 - DNA, 22 bp, Artificial Sequence
  chemically synthesized
cagaatttctaaacaaataaat

SEQ ID NO: 1171876 - DNA, 22 bp, Artificial Sequence
  chemically synthesized
ctgacaaggagcaaatttattt

SEQ ID NO: 1171877 - DNA, 22 bp, Artificial Sequence
  chemically synthesized
ctaaacaaataaatttgctcct

SEQ ID NO: 1171878 - DNA, 22 bp, Artificial Sequence
  chemically synthesized
taaacaaataaatttgctcctt

SEQ ID NO: 1171879 - DNA, 22 bp, Artificial Sequence
  chemically synthesized
aacaaataaatttgctccttgt

SEQ ID NO: 1171880 - DNA, 22 bp, Artificial Sequence
  chemically synthesized
tatatgctgctgacaaggagca

SEQ ID NO: 1171881 - DNA, 22 bp, Artificial Sequence
  chemically synthesized
tgtatatgctgctgacaaggag

SEQ ID NO: 1171882 - DNA, 22 bp, Artificial Sequence
  chemically synthesized
ttctgtatatgctgctgacaag

SEQ ID NO: 1171883 - DNA, 22 bp, Artificial Sequence
  chemically synthesized
aatgctgttctgtatatgctgc

SEQ ID NO: 1171884 - DNA, 22 bp, Artificial Sequence
  chemically synthesized
gctccttgtcagcagcatatac

SEQ ID NO: 1171885 - DNA, 22 bp, Artificial Sequence
  chemically synthesized
ctccttgtcagcagcatataca

SEQ ID NO: 1171886 - DNA, 22 bp, Artificial Sequence
  chemically synthesized
taaatgctgttctgtatatgct

SEQ ID NO: 1171887 - DNA, 22 bp, Artificial Sequence
  chemically synthesized
cttgtcagcagcatatacagaa

SEQ ID NO: 1171888 - DNA, 22 bp, Artificial Sequence
  chemically synthesized
gtcagcagcatatacagaacag

SEQ ID NO: 1171889 - DNA, 22 bp, Artificial Sequence
  chemically synthesized
tcagcagcatatacagaacagc

SEQ ID NO: 1171890 - DNA, 22 bp, Artificial Sequence
  chemically synthesized
tgtgatatctctaaatgctgtt

SEQ ID NO: 1171891 - DNA, 22 bp, Artificial Sequence
  chemically synthesized
gtgtgatatctctaaatgctgt

SEQ ID NO: 1171892 - DNA, 22 bp, Artificial Sequence
  chemically synthesized
tgtgtgatatctctaaatgctg

SEQ ID NO: 1171893 - DNA, 22 bp, Artificial Sequence
  chemically synthesized
ttttgtgtgatatctctaaatg

SEQ ID NO: 1171894 - DNA, 22 bp, Artificial Sequence
  chemically synthesized
gttattttgtgtgatatctcta

SEQ ID NO: 1171895 - DNA, 22 bp, Artificial Sequence
  chemically synthesized
agttattttgtgtgatatctct

SEQ ID NO: 1171896 - DNA, 22 bp, Artificial Sequence
  chemically synthesized
tagttattttgtgtgatatctc

SEQ ID NO: 1171897 - DNA, 22 bp, Artificial Sequence
  chemically synthesized
tcccattttagttattttgtgt

SEQ ID NO: 1171898 - DNA, 22 bp, Artificial Sequence
  chemically synthesized
atcccattttagttattttgtg

SEQ ID NO: 1171899 - DNA, 22 bp, Artificial Sequence
  chemically synthesized
agagatatcacacaaaataact

SEQ ID NO: 1171900 - DNA, 22 bp, Artificial Sequence
  chemically synthesized
gagatatcacacaaaataacta

SEQ ID NO: 1171901 - DNA, 22 bp, Artificial Sequence
  chemically synthesized
tttatcccattttagttatttt

SEQ ID NO: 1171902 - DNA, 22 bp, Artificial Sequence
  chemically synthesized
gtttatcccattttagttattt

SEQ ID NO: 1171903 - DNA, 22 bp, Artificial Sequence
  chemically synthesized
tgtttatcccattttagttatt

SEQ ID NO: 1171904 - DNA, 22 bp, Artificial Sequence
  chemically synthesized
aatatctttgtttatcccattt

SEQ ID NO: 1171905 - DNA, 22 bp, Artificial Sequence
  chemically synthesized
aaatgggataaacaaagatatt

SEQ ID NO: 1171906 - DNA, 22 bp, Artificial Sequence
  chemically synthesized
ccacagtatacattaaatatct

SEQ ID NO: 1171907 - DNA, 22 bp, Artificial Sequence
  chemically synthesized
aaggaaaattgccacagtatac

SEQ ID NO: 1171908 - DNA, 22 bp, Artificial Sequence
  chemically synthesized
aatgtatactgtggcaattttc

SEQ ID NO: 1171909 - DNA, 22 bp, Artificial Sequence
  chemically synthesized
atgtatactgtggcaattttcc

SEQ ID NO: 1171910 - DNA, 22 bp, Artificial Sequence
  chemically synthesized
tggcaattttccttgagtgatt

SEQ ID NO: 1171911 - DNA, 22 bp, Artificial Sequence
  chemically synthesized
acagtacagagggaaaaatcac

SEQ ID NO: 1171912 - DNA, 22 bp, Artificial Sequence
  chemically synthesized
gacagtacagagggaaaaatca

SEQ ID NO: 1171913 - DNA, 22 bp, Artificial Sequence
  chemically synthesized
tgacagtacagagggaaaaatc

SEQ ID NO: 1171914 - DNA, 22 bp, Artificial Sequence
  chemically synthesized
ttgacagtacagagggaaaaat

SEQ ID NO: 1171915 - DNA, 22 bp, Artificial Sequence
  chemically synthesized
tccttgagtgatttttccctct

SEQ ID NO: 1171916 - DNA, 22 bp, Artificial Sequence
  chemically synthesized
ccttgagtgatttttccctctg

SEQ ID NO: 1171917 - DNA, 22 bp, Artificial Sequence
  chemically synthesized
cttgagtgatttttccctctgt

SEQ ID NO: 1171918 - DNA, 22 bp, Artificial Sequence
  chemically synthesized
gagtgatttttccctctgtact

SEQ ID NO: 1171919 - DNA, 22 bp, Artificial Sequence
  chemically synthesized
agtgatttttccctctgtactg

SEQ ID NO: 1171920 - DNA, 22 bp, Artificial Sequence
  chemically synthesized
agtcaatatttttgacagtaca

SEQ ID NO: 1171921 - DNA, 22 bp, Artificial Sequence
  chemically synthesized
ttccctctgtactgtcaaaaat

SEQ ID NO: 1171922 - DNA, 22 bp, Artificial Sequence
  chemically synthesized
tccctctgtactgtcaaaaata

SEQ ID NO: 1171923 - DNA, 22 bp, Artificial Sequence
  chemically synthesized
ccctctgtactgtcaaaaatat

SEQ ID NO: 1171924 - DNA, 22 bp, Artificial Sequence
  chemically synthesized
cctctgtactgtcaaaaatatt

SEQ ID NO: 1171925 - DNA, 22 bp, Artificial Sequence
  chemically synthesized
cagtcaattcagtcaatatttt

SEQ ID NO: 1171926 - DNA, 22 bp, Artificial Sequence
  chemically synthesized
tgtactgtcaaaaatattgact

SEQ ID NO: 1171927 - DNA, 22 bp, Artificial Sequence
  chemically synthesized
tactgtcaaaaatattgactga

SEQ ID NO: 1171928 - DNA, 22 bp, Artificial Sequence
  chemically synthesized
tcaaaaatattgactgaattga

SEQ ID NO: 1171929 - DNA, 22 bp, Artificial Sequence
  chemically synthesized
gatgccaaaacctacagtcaat

SEQ ID NO: 1171930 - DNA, 22 bp, Artificial Sequence
  chemically synthesized
ttggatgccaaaacctacagtc

SEQ ID NO: 1171931 - DNA, 22 bp, Artificial Sequence
  chemically synthesized
actgaattgactgtaggttttg

SEQ ID NO: 1171932 - DNA, 22 bp, Artificial Sequence
  chemically synthesized
aggtctgttggatgccaaaacc

SEQ ID NO: 1171933 - DNA, 22 bp, Artificial Sequence
  chemically synthesized
aattgactgtaggttttggcat

SEQ ID NO: 1171934 - DNA, 22 bp, Artificial Sequence
  chemically synthesized
gaggtctgttggatgccaaaac

SEQ ID NO: 1171935 - DNA, 22 bp, Artificial Sequence
  chemically synthesized
tgaggtctgttggatgccaaaa

SEQ ID NO: 1171936 - DNA, 22 bp, Artificial Sequence
  chemically synthesized
actgtaggttttggcatccaac

SEQ ID NO: 1171937 - DNA, 22 bp, Artificial Sequence
  chemically synthesized
taggttttggcatccaacagac

SEQ ID NO: 1171938 - DNA, 22 bp, Artificial Sequence
  chemically synthesized
aaaacaaaggactttgaggtct

SEQ ID NO: 1171939 - DNA, 22 bp, Artificial Sequence
  chemically synthesized
tggcatccaacagacctcaaag

SEQ ID NO: 1171940 - DNA, 22 bp, Artificial Sequence
  chemically synthesized
ggcatccaacagacctcaaagt

SEQ ID NO: 1171941 - DNA, 22 bp, Artificial Sequence
  chemically synthesized
gcatccaacagacctcaaagtc

SEQ ID NO: 1171942 - DNA, 22 bp, Artificial Sequence
  chemically synthesized
catgctaaaaacaaaggacttt

SEQ ID NO: 1171943 - DNA, 22 bp, Artificial Sequence
  chemically synthesized
aaagtcctttgtttttagcatg

SEQ ID NO: 1171944 - DNA, 22 bp, Artificial Sequence
  chemically synthesized
aagatggtcaattacatgctaa

SEQ ID NO: 1171945 - DNA, 22 bp, Artificial Sequence
  chemically synthesized
tgtttttagcatgtaattgacc

SEQ ID NO: 1171946 - DNA, 22 bp, Artificial Sequence
  chemically synthesized
gtttttagcatgtaattgacca

SEQ ID NO: 1171947 - DNA, 22 bp, Artificial Sequence
  chemically synthesized
tttttagcatgtaattgaccat

SEQ ID NO: 1171948 - DNA, 22 bp, Artificial Sequence
  chemically synthesized
ttagcatgtaattgaccatctt

SEQ ID NO: 1171949 - DNA, 22 bp, Artificial Sequence
  chemically synthesized
tagcatgtaattgaccatcttt

SEQ ID NO: 1171950 - DNA, 22 bp, Artificial Sequence
  chemically synthesized
agcatgtaattgaccatcttta

SEQ ID NO: 1171951 - DNA, 22 bp, Artificial Sequence
  chemically synthesized
gcatgtaattgaccatctttag

SEQ ID NO: 1171952 - DNA, 22 bp, Artificial Sequence
  chemically synthesized
aatggcaggtgatatcgctaaa

SEQ ID NO: 1171953 - DNA, 22 bp, Artificial Sequence
  chemically synthesized
ctcaatggcaggtgatatcgct

SEQ ID NO: 1171954 - DNA, 22 bp, Artificial Sequence
  chemically synthesized
accatctttagcgatatcacct

SEQ ID NO: 1171955 - DNA, 22 bp, Artificial Sequence
  chemically synthesized
tagcgatatcacctgccattga

SEQ ID NO: 1171956 - DNA, 22 bp, Artificial Sequence
  chemically synthesized
agcgatatcacctgccattgag

SEQ ID NO: 1171957 - DNA, 22 bp, Artificial Sequence
  chemically synthesized
gcgatatcacctgccattgagt

SEQ ID NO: 1171958 - DNA, 22 bp, Artificial Sequence
  chemically synthesized
gcaacaaatgtaatgcattact

SEQ ID NO: 1171959 - DNA, 22 bp, Artificial Sequence
  chemically synthesized
ccattgagtaatgcattacatt

SEQ ID NO: 1171960 - DNA, 22 bp, Artificial Sequence
  chemically synthesized
agtaatgcattacatttgttgc

SEQ ID NO: 1171961 - DNA, 22 bp, Artificial Sequence
  chemically synthesized
aaaaatagtcaatatattggca

SEQ ID NO: 1171962 - DNA, 22 bp, Artificial Sequence
  chemically synthesized
catttgttgccaatatattgac

SEQ ID NO: 1171963 - DNA, 22 bp, Artificial Sequence
  chemically synthesized
acattgaaaaatagtcaatata

SEQ ID NO: 1171964 - DNA, 22 bp, Artificial Sequence
  chemically synthesized
cacattgaaaaatagtcaatat

SEQ ID NO: 1171965 - DNA, 22 bp, Artificial Sequence
  chemically synthesized
gttgccaatatattgactattt

SEQ ID NO: 1171966 - DNA, 22 bp, Artificial Sequence
  chemically synthesized
ttgccaatatattgactatttt

SEQ ID NO: 1171967 - DNA, 22 bp, Artificial Sequence
  chemically synthesized
tcttcacattgaaaaatagtca

SEQ ID NO: 1171968 - DNA, 22 bp, Artificial Sequence
  chemically synthesized
gtcttcacattgaaaaatagtc

SEQ ID NO: 1171969 - DNA, 22 bp, Artificial Sequence
  chemically synthesized
tgtcttcacattgaaaaatagt

SEQ ID NO: 1171970 - DNA, 22 bp, Artificial Sequence
  chemically synthesized
ccaatatattgactatttttca

SEQ ID NO: 1171971 - DNA, 22 bp, Artificial Sequence
  chemically synthesized
ttgtcttcacattgaaaaatag

SEQ ID NO: 1171972 - DNA, 22 bp, Artificial Sequence
  chemically synthesized
agtttttgtcttcacattgaaa

SEQ ID NO: 1171973 - DNA, 22 bp, Artificial Sequence
  chemically synthesized
cagtttttgtcttcacattgaa

SEQ ID NO: 1171974 - DNA, 22 bp, Artificial Sequence
  chemically synthesized
tcagtttttgtcttcacattga

SEQ ID NO: 1171975 - DNA, 22 bp, Artificial Sequence
  chemically synthesized
actatttttcaatgtgaagaca

SEQ ID NO: 1171976 - DNA, 22 bp, Artificial Sequence
  chemically synthesized
gttttcagtttttgtcttcaca

SEQ ID NO: 1171977 - DNA, 22 bp, Artificial Sequence
  chemically synthesized
ggttttcagtttttgtcttcac

SEQ ID NO: 1171978 - DNA, 22 bp, Artificial Sequence
  chemically synthesized
tttttcaatgtgaagacaaaaa

SEQ ID NO: 1171979 - DNA, 22 bp, Artificial Sequence
  chemically synthesized
ttcaatgtgaagacaaaaactg

SEQ ID NO: 1171980 - DNA, 22 bp, Artificial Sequence
  chemically synthesized
tcaatgtgaagacaaaaactga

SEQ ID NO: 1171981 - DNA, 22 bp, Artificial Sequence
  chemically synthesized
caaatttggttttcagtttttg

SEQ ID NO: 1171982 - DNA, 22 bp, Artificial Sequence
  chemically synthesized
caatgtgaagacaaaaactgaa

SEQ ID NO: 1171983 - DNA, 22 bp, Artificial Sequence
  chemically synthesized
gcaaatttggttttcagttttt

SEQ ID NO: 1171984 - DNA, 22 bp, Artificial Sequence
  chemically synthesized
aatgtgaagacaaaaactgaaa

SEQ ID NO: 1171985 - DNA, 22 bp, Artificial Sequence
  chemically synthesized
tgcaaatttggttttcagtttt

SEQ ID NO: 1171986 - DNA, 22 bp, Artificial Sequence
  chemically synthesized
ctttgcaaatttggttttcagt

SEQ ID NO: 1171987 - DNA, 22 bp, Artificial Sequence
  chemically synthesized
cctttgcaaatttggttttcag

SEQ ID NO: 1171988 - DNA, 22 bp, Artificial Sequence
  chemically synthesized
tcatcaatcttcctttgcaaat

SEQ ID NO: 1171989 - DNA, 22 bp, Artificial Sequence
  chemically synthesized
aaaaccaaatttgcaaaggaag

SEQ ID NO: 1171990 - DNA, 22 bp, Artificial Sequence
  chemically synthesized
aagattatcatcaatcttcctt

SEQ ID NO: 1171991 - DNA, 22 bp, Artificial Sequence
  chemically synthesized
cactcaagattatcatcaatct

SEQ ID NO: 1171992 - DNA, 22 bp, Artificial Sequence
  chemically synthesized
gcaaaggaagattgatgataat

SEQ ID NO: 1171993 - DNA, 22 bp, Artificial Sequence
  chemically synthesized
caaaggaagattgatgataatc

SEQ ID NO: 1171994 - DNA, 22 bp, Artificial Sequence
  chemically synthesized
gtagactccactcaagattatc

SEQ ID NO: 1171995 - DNA, 22 bp, Artificial Sequence
  chemically synthesized
tagtagactccactcaagatta

SEQ ID NO: 1171996 - DNA, 22 bp, Artificial Sequence
  chemically synthesized
ctagtagactccactcaagatt

SEQ ID NO: 1171997 - DNA, 22 bp, Artificial Sequence
  chemically synthesized
tctagtagactccactcaagat

SEQ ID NO: 1171998 - DNA, 22 bp, Artificial Sequence
  chemically synthesized
atgataatcttgagtggagtct

SEQ ID NO: 1171999 - DNA, 22 bp, Artificial Sequence
  chemically synthesized
aaatcaaacaagctttctagta

SEQ ID NO: 1172000 - DNA, 22 bp, Artificial Sequence
  chemically synthesized
gagtggagtctactagaaagct

SEQ ID NO: 1172001 - DNA, 22 bp, Artificial Sequence
  chemically synthesized
agtggagtctactagaaagctt

SEQ ID NO: 1172002 - DNA, 22 bp, Artificial Sequence
  chemically synthesized
gcaagcctaaaatcaaacaagc

SEQ ID NO: 1172003 - DNA, 22 bp, Artificial Sequence
  chemically synthesized
ctagaaagcttgtttgatttta

SEQ ID NO: 1172004 - DNA, 22 bp, Artificial Sequence
  chemically synthesized
gaaagcttgtttgattttaggc

SEQ ID NO: 1172005 - DNA, 22 bp, Artificial Sequence
  chemically synthesized
gtttgattttaggcttgccaat

SEQ ID NO: 1172006 - DNA, 22 bp, Artificial Sequence
  chemically synthesized
tttgattttaggcttgccaatg

SEQ ID NO: 1172007 - DNA, 22 bp, Artificial Sequence
  chemically synthesized
atggcatcgaatgcattggcaa

SEQ ID NO: 1172008 - DNA, 22 bp, Artificial Sequence
  chemically synthesized
gattttaggcttgccaatgcat

SEQ ID NO: 1172009 - DNA, 22 bp, Artificial Sequence
  chemically synthesized
attttaggcttgccaatgcatt

SEQ ID NO: 1172010 - DNA, 22 bp, Artificial Sequence
  chemically synthesized
tgctgatggcatcgaatgcatt

SEQ ID NO: 1172011 - DNA, 22 bp, Artificial Sequence
  chemically synthesized
taggcttgccaatgcattcgat

SEQ ID NO: 1172012 - DNA, 22 bp, Artificial Sequence
  chemically synthesized
aggcttgccaatgcattcgatg

SEQ ID NO: 1172013 - DNA, 22 bp, Artificial Sequence
  chemically synthesized
ggcttgccaatgcattcgatgc

SEQ ID NO: 1172014 - DNA, 22 bp, Artificial Sequence
  chemically synthesized
gccaatgcattcgatgccatca

SEQ ID NO: 1172015 - DNA, 22 bp, Artificial Sequence
  chemically synthesized
ccaatgcattcgatgccatcag

SEQ ID NO: 1172016 - DNA, 22 bp, Artificial Sequence
  chemically synthesized
gatgccatcagcacagggatat

SEQ ID NO: 1172017 - DNA, 22 bp, Artificial Sequence
  chemically synthesized
aaggcaaggatagatatccctg

SEQ ID NO: 1172018 - DNA, 22 bp, Artificial Sequence
  chemically synthesized
ctcaaggcaaggatagatatcc

SEQ ID NO: 1172019 - DNA, 22 bp, Artificial Sequence
  chemically synthesized
tcctcaaggcaaggatagatat

SEQ ID NO: 1172020 - DNA, 22 bp, Artificial Sequence
  chemically synthesized
ctcctcaaggcaaggatagata

SEQ ID NO: 1172021 - DNA, 22 bp, Artificial Sequence
  chemically synthesized
tttctcctcaaggcaaggatag

SEQ ID NO: 1172022 - DNA, 22 bp, Artificial Sequence
  chemically synthesized
atttctcctcaaggcaaggata

SEQ ID NO: 1172023 - DNA, 22 bp, Artificial Sequence
  chemically synthesized
ccttatttctcctcaaggcaag

SEQ ID NO: 1172024 - DNA, 22 bp, Artificial Sequence
  chemically synthesized
attcccttatttctcctcaagg

SEQ ID NO: 1172025 - DNA, 22 bp, Artificial Sequence
  chemically synthesized
tgattcccttatttctcctcaa

SEQ ID NO: 1172026 - DNA, 22 bp, Artificial Sequence
  chemically synthesized
ctgattcccttatttctcctca

SEQ ID NO: 1172027 - DNA, 22 bp, Artificial Sequence
  chemically synthesized
tctgattcccttatttctcctc

SEQ ID NO: 1172028 - DNA, 22 bp, Artificial Sequence
  chemically synthesized
tccttgccttgaggagaaataa

SEQ ID NO: 1172029 - DNA, 22 bp, Artificial Sequence
  chemically synthesized
attttctgattcccttatttct

SEQ ID NO: 1172030 - DNA, 22 bp, Artificial Sequence
  chemically synthesized
aattttctgattcccttatttc

SEQ ID NO: 1172031 - DNA, 22 bp, Artificial Sequence
  chemically synthesized
gccttgaggagaaataagggaa

SEQ ID NO: 1172032 - DNA, 22 bp, Artificial Sequence
  chemically synthesized
ccttgaggagaaataagggaat

SEQ ID NO: 1172033 - DNA, 22 bp, Artificial Sequence
  chemically synthesized
gaggagaaataagggaatcaga

SEQ ID NO: 1172034 - DNA, 22 bp, Artificial Sequence
  chemically synthesized
aggagaaataagggaatcagaa

SEQ ID NO: 1172035 - DNA, 22 bp, Artificial Sequence
  chemically synthesized
aaagagccttaattttctgatt

SEQ ID NO: 1172036 - DNA, 22 bp, Artificial Sequence
  chemically synthesized
atgagtagatactaaaagagcc

SEQ ID NO: 1172037 - DNA, 22 bp, Artificial Sequence
  chemically synthesized
taatgagtagatactaaaagag

SEQ ID NO: 1172038 - DNA, 22 bp, Artificial Sequence
  chemically synthesized
aggctcttttagtatctactca

SEQ ID NO: 1172039 - DNA, 22 bp, Artificial Sequence
  chemically synthesized
ttttagtatctactcattagag

SEQ ID NO: 1172040 - DNA, 22 bp, Artificial Sequence
  chemically synthesized
aggatatatcacctctaatgag

SEQ ID NO: 1172041 - DNA, 22 bp, Artificial Sequence
  chemically synthesized
ttagtatctactcattagaggt

SEQ ID NO: 1172042 - DNA, 22 bp, Artificial Sequence
  chemically synthesized
tagtatctactcattagaggtg

SEQ ID NO: 1172043 - DNA, 22 bp, Artificial Sequence
  chemically synthesized
agtatctactcattagaggtga

SEQ ID NO: 1172044 - DNA, 22 bp, Artificial Sequence
  chemically synthesized
gtatctactcattagaggtgat

SEQ ID NO: 1172045 - DNA, 22 bp, Artificial Sequence
  chemically synthesized
atgattaaggatatatcacctc

SEQ ID NO: 1172046 - DNA, 22 bp, Artificial Sequence
  chemically synthesized
catgattaaggatatatcacct

SEQ ID NO: 1172047 - DNA, 22 bp, Artificial Sequence
  chemically synthesized
tcatgattaaggatatatcacc

SEQ ID NO: 1172048 - DNA, 22 bp, Artificial Sequence
  chemically synthesized
ctcattagaggtgatatatcct

SEQ ID NO: 1172049 - DNA, 22 bp, Artificial Sequence
  chemically synthesized
ttttcatgattaaggatatatc

SEQ ID NO: 1172050 - DNA, 22 bp, Artificial Sequence
  chemically synthesized
attagaggtgatatatccttaa

SEQ ID NO: 1172051 - DNA, 22 bp, Artificial Sequence
  chemically synthesized
ttattttcatgattaaggatat

SEQ ID NO: 1172052 - DNA, 22 bp, Artificial Sequence
  chemically synthesized
gaggtgatatatccttaatcat

SEQ ID NO: 1172053 - DNA, 22 bp, Artificial Sequence
  chemically synthesized
aatcatgaaaataataatgtgt

SEQ ID NO: 1172054 - DNA, 22 bp, Artificial Sequence
  chemically synthesized
atcatgaaaataataatgtgtt

SEQ ID NO: 1172055 - DNA, 22 bp, Artificial Sequence
  chemically synthesized
aaaagcaaaataataatggata

SEQ ID NO: 1172056 - DNA, 22 bp, Artificial Sequence
  chemically synthesized
ttaaaaagcaaaataataatgg

SEQ ID NO: 1172057 - DNA, 22 bp, Artificial Sequence
  chemically synthesized
attaaaaagcaaaataataatg

SEQ ID NO: 1172058 - DNA, 22 bp, Artificial Sequence
  chemically synthesized
ttattaaaaagcaaaataataa

SEQ ID NO: 1172059 - DNA, 22 bp, Artificial Sequence
  chemically synthesized
cattcttattaaaaagcaaaat

SEQ ID NO: 1172060 - DNA, 22 bp, Artificial Sequence
  chemically synthesized
tatccattattattttgctttt

SEQ ID NO: 1172061 - DNA, 22 bp, Artificial Sequence
  chemically synthesized
acattcttattaaaaagcaaaa

SEQ ID NO: 1172062 - DNA, 22 bp, Artificial Sequence
  chemically synthesized
ttattttgctttttaataagaa

SEQ ID NO: 1172063 - DNA, 22 bp, Artificial Sequence
  chemically synthesized
tggatatcttacattcttatta

SEQ ID NO: 1172064 - DNA, 22 bp, Artificial Sequence
  chemically synthesized
ttttgctttttaataagaatgt

SEQ ID NO: 1172065 - DNA, 22 bp, Artificial Sequence
  chemically synthesized
attatggatatcttacattctt

SEQ ID NO: 1172066 - DNA, 22 bp, Artificial Sequence
  chemically synthesized
tgctttttaataagaatgtaag

SEQ ID NO: 1172067 - DNA, 22 bp, Artificial Sequence
  chemically synthesized
gctttttaataagaatgtaaga

SEQ ID NO: 1172068 - DNA, 22 bp, Artificial Sequence
  chemically synthesized
ctttttaataagaatgtaagat

SEQ ID NO: 1172069 - DNA, 22 bp, Artificial Sequence
  chemically synthesized
tttaataagaatgtaagatatc

SEQ ID NO: 1172070 - DNA, 22 bp, Artificial Sequence
  chemically synthesized
ttaataagaatgtaagatatcc

SEQ ID NO: 1172071 - DNA, 22 bp, Artificial Sequence
  chemically synthesized
ccaattgattatggatatctta

SEQ ID NO: 1172072 - DNA, 22 bp, Artificial Sequence
  chemically synthesized
taataagaatgtaagatatcca

SEQ ID NO: 1172073 - DNA, 22 bp, Artificial Sequence
  chemically synthesized
accaattgattatggatatctt

SEQ ID NO: 1172074 - DNA, 22 bp, Artificial Sequence
  chemically synthesized
aataagaatgtaagatatccat

SEQ ID NO: 1172075 - DNA, 22 bp, Artificial Sequence
  chemically synthesized
ataagaatgtaagatatccata

SEQ ID NO: 1172076 - DNA, 22 bp, Artificial Sequence
  chemically synthesized
gacaaagataagtttaccaatt

SEQ ID NO: 1172077 - DNA, 22 bp, Artificial Sequence
  chemically synthesized
ccagtagataggctagacaaag

SEQ ID NO: 1172078 - DNA, 22 bp, Artificial Sequence
  chemically synthesized
gtaaacttatctttgtctagcc

SEQ ID NO: 1172079 - DNA, 22 bp, Artificial Sequence
  chemically synthesized
aattgccagtagataggctaga

SEQ ID NO: 1172080 - DNA, 22 bp, Artificial Sequence
  chemically synthesized
ttcaattgccagtagataggct

SEQ ID NO: 1172081 - DNA, 22 bp, Artificial Sequence
  chemically synthesized
gttcaattgccagtagataggc

SEQ ID NO: 1172082 - DNA, 22 bp, Artificial Sequence
  chemically synthesized
atctttgtctagcctatctact

SEQ ID NO: 1172083 - DNA, 22 bp, Artificial Sequence
  chemically synthesized
tctttgtctagcctatctactg

SEQ ID NO: 1172084 - DNA, 22 bp, Artificial Sequence
  chemically synthesized
tttgttcaattgccagtagata

SEQ ID NO: 1172085 - DNA, 22 bp, Artificial Sequence
  chemically synthesized
tgtctagcctatctactggcaa

SEQ ID NO: 1172086 - DNA, 22 bp, Artificial Sequence
  chemically synthesized
ttatttgttcaattgccagtag

SEQ ID NO: 1172087 - DNA, 22 bp, Artificial Sequence
  chemically synthesized
gtctagcctatctactggcaat

SEQ ID NO: 1172088 - DNA, 22 bp, Artificial Sequence
  chemically synthesized
attatttgttcaattgccagta

SEQ ID NO: 1172089 - DNA, 22 bp, Artificial Sequence
  chemically synthesized
tctagcctatctactggcaatt

SEQ ID NO: 1172090 - DNA, 22 bp, Artificial Sequence
  chemically synthesized
tattatttgttcaattgccagt

SEQ ID NO: 1172091 - DNA, 22 bp, Artificial Sequence
  chemically synthesized
ttattatttgttcaattgccag

SEQ ID NO: 1172092 - DNA, 22 bp, Artificial Sequence
  chemically synthesized
tttattatttgttcaattgcca

SEQ ID NO: 1172093 - DNA, 22 bp, Artificial Sequence
  chemically synthesized
ttttattatttgttcaattgcc

SEQ ID NO: 1172094 - DNA, 22 bp, Artificial Sequence
  chemically synthesized
gcctatctactggcaattgaac

SEQ ID NO: 1172095 - DNA, 22 bp, Artificial Sequence
  chemically synthesized
tctactggcaattgaacaaata

SEQ ID NO: 1172096 - DNA, 22 bp, Artificial Sequence
  chemically synthesized
aagtttttttattatttgttca

SEQ ID NO: 1172097 - DNA, 22 bp, Artificial Sequence
  chemically synthesized
gaagtttttttattatttgttc

SEQ ID NO: 1172098 - DNA, 22 bp, Artificial Sequence
  chemically synthesized
ctggcaattgaacaaataataa

SEQ ID NO: 1172099 - DNA, 22 bp, Artificial Sequence
  chemically synthesized
tttgaagtttttttattatttg

SEQ ID NO: 1172100 - DNA, 22 bp, Artificial Sequence
  chemically synthesized
gcaattgaacaaataataaaaa

SEQ ID NO: 1172101 - DNA, 22 bp, Artificial Sequence
  chemically synthesized
tctatttgaagtttttttatta

SEQ ID NO: 1172102 - DNA, 22 bp, Artificial Sequence
  chemically synthesized
aacaaataataaaaaaacttca

SEQ ID NO: 1172103 - DNA, 22 bp, Artificial Sequence
  chemically synthesized
taaaaaattatctatttgaagt

SEQ ID NO: 1172104 - DNA, 22 bp, Artificial Sequence
  chemically synthesized
gtaaaaaattatctatttgaag

SEQ ID NO: 1172105 - DNA, 22 bp, Artificial Sequence
  chemically synthesized
tgtaaaaaattatctatttgaa

SEQ ID NO: 1172106 - DNA, 22 bp, Artificial Sequence
  chemically synthesized
aaataattttgtaaaaaattat

SEQ ID NO: 1172107 - DNA, 22 bp, Artificial Sequence
  chemically synthesized
caaatagataattttttacaaa

SEQ ID NO: 1172108 - DNA, 22 bp, Artificial Sequence
  chemically synthesized
aaatagataattttttacaaaa

SEQ ID NO: 1172109 - DNA, 22 bp, Artificial Sequence
  chemically synthesized
taattaaaataattttgtaaaa

SEQ ID NO: 1172110 - DNA, 22 bp, Artificial Sequence
  chemically synthesized
gcaagtctgtaattaaaataat

SEQ ID NO: 1172111 - DNA, 22 bp, Artificial Sequence
  chemically synthesized
tttacaaaattattttaattac

SEQ ID NO: 1172112 - DNA, 22 bp, Artificial Sequence
  chemically synthesized
cctggcaagtctgtaattaaaa

SEQ ID NO: 1172113 - DNA, 22 bp, Artificial Sequence
  chemically synthesized
ttacaaaattattttaattaca

SEQ ID NO: 1172114 - DNA, 22 bp, Artificial Sequence
  chemically synthesized
tacaaaattattttaattacag

SEQ ID NO: 1172115 - DNA, 22 bp, Artificial Sequence
  chemically synthesized
tacctggcaagtctgtaattaa

SEQ ID NO: 1172116 - DNA, 22 bp, Artificial Sequence
  chemically synthesized
acaaaattattttaattacaga

SEQ ID NO: 1172117 - DNA, 22 bp, Artificial Sequence
  chemically synthesized
ctacctggcaagtctgtaatta

SEQ ID NO: 1172118 - DNA, 22 bp, Artificial Sequence
  chemically synthesized
caaaattattttaattacagac

SEQ ID NO: 1172119 - DNA, 22 bp, Artificial Sequence
  chemically synthesized
ttctacctggcaagtctgtaat

SEQ ID NO: 1172120 - DNA, 22 bp, Artificial Sequence
  chemically synthesized
ctcttctacctggcaagtctgt

SEQ ID NO: 1172121 - DNA, 22 bp, Artificial Sequence
  chemically synthesized
ttttaattacagacttgccagg

SEQ ID NO: 1172122 - DNA, 22 bp, Artificial Sequence
  chemically synthesized
gttgctcttctacctggcaagt

SEQ ID NO: 1172123 - DNA, 22 bp, Artificial Sequence
  chemically synthesized
taattacagacttgccaggtag

SEQ ID NO: 1172124 - DNA, 22 bp, Artificial Sequence
  chemically synthesized
ttagttgctcttctacctggca

SEQ ID NO: 1172125 - DNA, 22 bp, Artificial Sequence
  chemically synthesized
aattacagacttgccaggtaga

SEQ ID NO: 1172126 - DNA, 22 bp, Artificial Sequence
  chemically synthesized
gttagttgctcttctacctggc

SEQ ID NO: 1172127 - DNA, 22 bp, Artificial Sequence
  chemically synthesized
attacagacttgccaggtagaa

SEQ ID NO: 1172128 - DNA, 22 bp, Artificial Sequence
  chemically synthesized
tgttagttgctcttctacctgg

SEQ ID NO: 1172129 - DNA, 22 bp, Artificial Sequence
  chemically synthesized
ttgttagttgctcttctacctg

SEQ ID NO: 1172130 - DNA, 22 bp, Artificial Sequence
  chemically synthesized
ttttgttagttgctcttctacc

SEQ ID NO: 1172131 - DNA, 22 bp, Artificial Sequence
  chemically synthesized
cagacttgccaggtagaagagc

SEQ ID NO: 1172132 - DNA, 22 bp, Artificial Sequence
  chemically synthesized
gccaggtagaagagcaactaac

SEQ ID NO: 1172133 - DNA, 22 bp, Artificial Sequence
  chemically synthesized
ccaggtagaagagcaactaaca

SEQ ID NO: 1172134 - DNA, 22 bp, Artificial Sequence
  chemically synthesized
aatgtataaaggctcttttgtt

SEQ ID NO: 1172135 - DNA, 22 bp, Artificial Sequence
  chemically synthesized
tgatgtattgaatgtataaagg

SEQ ID NO: 1172136 - DNA, 22 bp, Artificial Sequence
  chemically synthesized
acaaaagagcctttatacattc

SEQ ID NO: 1172137 - DNA, 22 bp, Artificial Sequence
  chemically synthesized
tatacattcaatacatcataac

SEQ ID NO: 1172138 - DNA, 22 bp, Artificial Sequence
  chemically synthesized
atacattcaatacatcataact

SEQ ID NO: 1172139 - DNA, 22 bp, Artificial Sequence
  chemically synthesized
taaaataaatgaagttatgatg

SEQ ID NO: 1172140 - DNA, 22 bp, Artificial Sequence
  chemically synthesized
tacattcaatacatcataactt

SEQ ID NO: 1172141 - DNA, 22 bp, Artificial Sequence
  chemically synthesized
tataaaataaatgaagttatga

SEQ ID NO: 1172142 - DNA, 22 bp, Artificial Sequence
  chemically synthesized
tctataaaataaatgaagttat

SEQ ID NO: 1172143 - DNA, 22 bp, Artificial Sequence
  chemically synthesized
ctctataaaataaatgaagtta

SEQ ID NO: 1172144 - DNA, 22 bp, Artificial Sequence
  chemically synthesized
ttctctataaaataaatgaagt

SEQ ID NO: 1172145 - DNA, 22 bp, Artificial Sequence
  chemically synthesized
aatacatcataacttcatttat

SEQ ID NO: 1172146 - DNA, 22 bp, Artificial Sequence
  chemically synthesized
aagctcttctctataaaataaa

SEQ ID NO: 1172147 - DNA, 22 bp, Artificial Sequence
  chemically synthesized
caagctcttctctataaaataa

SEQ ID NO: 1172148 - DNA, 22 bp, Artificial Sequence
  chemically synthesized
tcaagctcttctctataaaata

SEQ ID NO: 1172149 - DNA, 22 bp, Artificial Sequence
  chemically synthesized
catttattttatagagaagagc

SEQ ID NO: 1172150 - DNA, 22 bp, Artificial Sequence
  chemically synthesized
atttattttatagagaagagct

SEQ ID NO: 1172151 - DNA, 22 bp, Artificial Sequence
  chemically synthesized
catatgattttcaagctcttct

SEQ ID NO: 1172152 - DNA, 22 bp, Artificial Sequence
  chemically synthesized
attttatagagaagagcttgaa

SEQ ID NO: 1172153 - DNA, 22 bp, Artificial Sequence
  chemically synthesized
ttttatagagaagagcttgaaa

SEQ ID NO: 1172154 - DNA, 22 bp, Artificial Sequence
  chemically synthesized
tatagagaagagcttgaaaatc

SEQ ID NO: 1172155 - DNA, 22 bp, Artificial Sequence
  chemically synthesized
atagagaagagcttgaaaatca

SEQ ID NO: 1172156 - DNA, 22 bp, Artificial Sequence
  chemically synthesized
tagagaagagcttgaaaatcat

SEQ ID NO: 1172157 - DNA, 22 bp, Artificial Sequence
  chemically synthesized
agtgacagagccagaattccat

SEQ ID NO: 1172158 - DNA, 22 bp, Artificial Sequence
  chemically synthesized
gaaaatcatatggaattctggc

SEQ ID NO: 1172159 - DNA, 22 bp, Artificial Sequence
  chemically synthesized
aaaatcatatggaattctggct

SEQ ID NO: 1172160 - DNA, 22 bp, Artificial Sequence
  chemically synthesized
tactaagtgacagagccagaat

SEQ ID NO: 1172161 - DNA, 22 bp, Artificial Sequence
  chemically synthesized
gtactaagtgacagagccagaa

SEQ ID NO: 1172162 - DNA, 22 bp, Artificial Sequence
  chemically synthesized
tttgtactaagtgacagagcca

SEQ ID NO: 1172163 - DNA, 22 bp, Artificial Sequence
  chemically synthesized
aagcaacactatttgtactaag

SEQ ID NO: 1172164 - DNA, 22 bp, Artificial Sequence
  chemically synthesized
tggctctgtcacttagtacaaa

SEQ ID NO: 1172165 - DNA, 22 bp, Artificial Sequence
  chemically synthesized
gctctgtcacttagtacaaata

SEQ ID NO: 1172166 - DNA, 22 bp, Artificial Sequence
  chemically synthesized
ttaaagcaacactatttgtact

SEQ ID NO: 1172167 - DNA, 22 bp, Artificial Sequence
  chemically synthesized
gttaaagcaacactatttgtac

SEQ ID NO: 1172168 - DNA, 22 bp, Artificial Sequence
  chemically synthesized
tgtcacttagtacaaatagtgt

SEQ ID NO: 1172169 - DNA, 22 bp, Artificial Sequence
  chemically synthesized
tcacttagtacaaatagtgttg

SEQ ID NO: 1172170 - DNA, 22 bp, Artificial Sequence
  chemically synthesized
ataaatatttgttaaagcaaca

SEQ ID NO: 1172171 - DNA, 22 bp, Artificial Sequence
  chemically synthesized
agtacaaatagtgttgctttaa

SEQ ID NO: 1172172 - DNA, 22 bp, Artificial Sequence
  chemically synthesized
aataaatatttgttaaagcaac

SEQ ID NO: 1172173 - DNA, 22 bp, Artificial Sequence
  chemically synthesized
gtacaaatagtgttgctttaac

SEQ ID NO: 1172174 - DNA, 22 bp, Artificial Sequence
  chemically synthesized
cttaataaatatttgttaaagc

SEQ ID NO: 1172175 - DNA, 22 bp, Artificial Sequence
  chemically synthesized
tagttgcttaataaatatttgt

SEQ ID NO: 1172176 - DNA, 22 bp, Artificial Sequence
  chemically synthesized
gtagttgcttaataaatatttg

SEQ ID NO: 1172177 - DNA, 22 bp, Artificial Sequence
  chemically synthesized
tgtagttgcttaataaatattt

SEQ ID NO: 1172178 - DNA, 22 bp, Artificial Sequence
  chemically synthesized
ctttaacaaatatttattaagc

SEQ ID NO: 1172179 - DNA, 22 bp, Artificial Sequence
  chemically synthesized
gtcctttgtagttgcttaataa

SEQ ID NO: 1172180 - DNA, 22 bp, Artificial Sequence
  chemically synthesized
taacaaatatttattaagcaac

SEQ ID NO: 1172181 - DNA, 22 bp, Artificial Sequence
  chemically synthesized
aacaaatatttattaagcaact

SEQ ID NO: 1172182 - DNA, 22 bp, Artificial Sequence
  chemically synthesized
acaaatatttattaagcaacta

SEQ ID NO: 1172183 - DNA, 22 bp, Artificial Sequence
  chemically synthesized
aaatagtgcctggtcctttgta

SEQ ID NO: 1172184 - DNA, 22 bp, Artificial Sequence
  chemically synthesized
attaagcaactacaaaggacca

SEQ ID NO: 1172185 - DNA, 22 bp, Artificial Sequence
  chemically synthesized
ttaagcaactacaaaggaccag

SEQ ID NO: 1172186 - DNA, 22 bp, Artificial Sequence
  chemically synthesized
cctaaaatagtgcctggtcctt

SEQ ID NO: 1172187 - DNA, 22 bp, Artificial Sequence
  chemically synthesized
agcaactacaaaggaccaggca

SEQ ID NO: 1172188 - DNA, 22 bp, Artificial Sequence
  chemically synthesized
caaaggaccaggcactatttta

SEQ ID NO: 1172189 - DNA, 22 bp, Artificial Sequence
  chemically synthesized
tatcatcattgcctaaaatagt

SEQ ID NO: 1172190 - DNA, 22 bp, Artificial Sequence
  chemically synthesized
tatatggctatatcatcattgc

SEQ ID NO: 1172191 - DNA, 22 bp, Artificial Sequence
  chemically synthesized
gtatatggctatatcatcattg

SEQ ID NO: 1172192 - DNA, 22 bp, Artificial Sequence
  chemically synthesized
tgtatatggctatatcatcatt

SEQ ID NO: 1172193 - DNA, 22 bp, Artificial Sequence
  chemically synthesized
ttttgtatatggctatatcatc

SEQ ID NO: 1172194 - DNA, 22 bp, Artificial Sequence
  chemically synthesized
ttttaggcaatgatgatatagc

SEQ ID NO: 1172195 - DNA, 22 bp, Artificial Sequence
  chemically synthesized
taggcaatgatgatatagccat

SEQ ID NO: 1172196 - DNA, 22 bp, Artificial Sequence
  chemically synthesized
tctgttttgtatatggctatat

SEQ ID NO: 1172197 - DNA, 22 bp, Artificial Sequence
  chemically synthesized
aggcaatgatgatatagccata

SEQ ID NO: 1172198 - DNA, 22 bp, Artificial Sequence
  chemically synthesized
ggcaatgatgatatagccatat

SEQ ID NO: 1172199 - DNA, 22 bp, Artificial Sequence
  chemically synthesized
tgtctgttttgtatatggctat

SEQ ID NO: 1172200 - DNA, 22 bp, Artificial Sequence
  chemically synthesized
ctgtctgttttgtatatggcta

SEQ ID NO: 1172201 - DNA, 22 bp, Artificial Sequence
  chemically synthesized
gatttctgtctgttttgtatat

SEQ ID NO: 1172202 - DNA, 22 bp, Artificial Sequence
  chemically synthesized
agatttctgtctgttttgtata

SEQ ID NO: 1172203 - DNA, 22 bp, Artificial Sequence
  chemically synthesized
aatgagaacttagatttctgtc

SEQ ID NO: 1172204 - DNA, 22 bp, Artificial Sequence
  chemically synthesized
actgaatgagaacttagatttc

SEQ ID NO: 1172205 - DNA, 22 bp, Artificial Sequence
  chemically synthesized
agtgacatgattcactgaatga

SEQ ID NO: 1172206 - DNA, 22 bp, Artificial Sequence
  chemically synthesized
cagtgacatgattcactgaatg

SEQ ID NO: 1172207 - DNA, 22 bp, Artificial Sequence
  chemically synthesized
agttctcattcagtgaatcatg

SEQ ID NO: 1172208 - DNA, 22 bp, Artificial Sequence
  chemically synthesized
gcatgccttcagtgacatgatt

SEQ ID NO: 1172209 - DNA, 22 bp, Artificial Sequence
  chemically synthesized
tcattcagtgaatcatgtcact

SEQ ID NO: 1172210 - DNA, 22 bp, Artificial Sequence
  chemically synthesized
attcagtgaatcatgtcactga

SEQ ID NO: 1172211 - DNA, 22 bp, Artificial Sequence
  chemically synthesized
attagcatgccttcagtgacat

SEQ ID NO: 1172212 - DNA, 22 bp, Artificial Sequence
  chemically synthesized
gattagcatgccttcagtgaca

SEQ ID NO: 1172213 - DNA, 22 bp, Artificial Sequence
  chemically synthesized
ttgattagcatgccttcagtga

SEQ ID NO: 1172214 - DNA, 22 bp, Artificial Sequence
  chemically synthesized
agtgaatcatgtcactgaaggc

SEQ ID NO: 1172215 - DNA, 22 bp, Artificial Sequence
  chemically synthesized
tcttgattagcatgccttcagt

SEQ ID NO: 1172216 - DNA, 22 bp, Artificial Sequence
  chemically synthesized
ctcttgattagcatgccttcag

SEQ ID NO: 1172217 - DNA, 22 bp, Artificial Sequence
  chemically synthesized
tttctcttgattagcatgcctt

SEQ ID NO: 1172218 - DNA, 22 bp, Artificial Sequence
  chemically synthesized
atttctcttgattagcatgcct

SEQ ID NO: 1172219 - DNA, 22 bp, Artificial Sequence
  chemically synthesized
cttatttctcttgattagcatg

SEQ ID NO: 1172220 - DNA, 22 bp, Artificial Sequence
  chemically synthesized
acttatttctcttgattagcat

SEQ ID NO: 1172221 - DNA, 22 bp, Artificial Sequence
  chemically synthesized
tacttatttctcttgattagca

SEQ ID NO: 1172222 - DNA, 22 bp, Artificial Sequence
  chemically synthesized
ttttacttatttctcttgatta

SEQ ID NO: 1172223 - DNA, 22 bp, Artificial Sequence
  chemically synthesized
tattttacttatttctcttgat

SEQ ID NO: 1172224 - DNA, 22 bp, Artificial Sequence
  chemically synthesized
aaggcatgctaatcaagagaaa

SEQ ID NO: 1172225 - DNA, 22 bp, Artificial Sequence
  chemically synthesized
ctattttacttatttctcttga

SEQ ID NO: 1172226 - DNA, 22 bp, Artificial Sequence
  chemically synthesized
catccttctattttacttattt

SEQ ID NO: 1172227 - DNA, 22 bp, Artificial Sequence
  chemically synthesized
acatccttctattttacttatt

SEQ ID NO: 1172228 - DNA, 22 bp, Artificial Sequence
  chemically synthesized
atcaagagaaataagtaaaata

SEQ ID NO: 1172229 - DNA, 22 bp, Artificial Sequence
  chemically synthesized
cataacacttacatccttctat

SEQ ID NO: 1172230 - DNA, 22 bp, Artificial Sequence
  chemically synthesized
tccataacacttacatccttct

SEQ ID NO: 1172231 - DNA, 22 bp, Artificial Sequence
  chemically synthesized
ctccataacacttacatccttc

SEQ ID NO: 1172232 - DNA, 22 bp, Artificial Sequence
  chemically synthesized
tctccataacacttacatcctt

SEQ ID NO: 1172233 - DNA, 22 bp, Artificial Sequence
  chemically synthesized
ttctccataacacttacatcct

SEQ ID NO: 1172234 - DNA, 22 bp, Artificial Sequence
  chemically synthesized
cttttctccataacacttacat

SEQ ID NO: 1172235 - DNA, 22 bp, Artificial Sequence
  chemically synthesized
ccttttctccataacacttaca

SEQ ID NO: 1172236 - DNA, 22 bp, Artificial Sequence
  chemically synthesized
cttccttttctccataacactt

SEQ ID NO: 1172237 - DNA, 22 bp, Artificial Sequence
  chemically synthesized
gcttccttttctccataacact

SEQ ID NO: 1172238 - DNA, 22 bp, Artificial Sequence
  chemically synthesized
cttgcttccttttctccataac

SEQ ID NO: 1172239 - DNA, 22 bp, Artificial Sequence
  chemically synthesized
ccttgcttccttttctccataa

SEQ ID NO: 1172240 - DNA, 22 bp, Artificial Sequence
  chemically synthesized
cccttccttgcttccttttctc

SEQ ID NO: 1172241 - DNA, 22 bp, Artificial Sequence
  chemically synthesized
aattccccttccttgcttcctt

SEQ ID NO: 1172242 - DNA, 22 bp, Artificial Sequence
  chemically synthesized
caattccccttccttgcttcct

SEQ ID NO: 1172243 - DNA, 22 bp, Artificial Sequence
  chemically synthesized
tcaattccccttccttgcttcc

SEQ ID NO: 1172244 - DNA, 22 bp, Artificial Sequence
  chemically synthesized
tggagaaaaggaagcaaggaag

SEQ ID NO: 1172245 - DNA, 22 bp, Artificial Sequence
  chemically synthesized
gtactttcaattccccttcctt

SEQ ID NO: 1172246 - DNA, 22 bp, Artificial Sequence
  chemically synthesized
cctagtactttcaattcccctt

SEQ ID NO: 1172247 - DNA, 22 bp, Artificial Sequence
  chemically synthesized
ccctagtactttcaattcccct

SEQ ID NO: 1172248 - DNA, 22 bp, Artificial Sequence
  chemically synthesized
tccctagtactttcaattcccc

SEQ ID NO: 1172249 - DNA, 22 bp, Artificial Sequence
  chemically synthesized
aatgatattttccctagtactt

SEQ ID NO: 1172250 - DNA, 22 bp, Artificial Sequence
  chemically synthesized
tcaatgatattttccctagtac

SEQ ID NO: 1172251 - DNA, 22 bp, Artificial Sequence
  chemically synthesized
ctcaatgatattttccctagta

SEQ ID NO: 1172252 - DNA, 22 bp, Artificial Sequence
  chemically synthesized
tctcaatgatattttccctagt

SEQ ID NO: 1172253 - DNA, 22 bp, Artificial Sequence
  chemically synthesized
ttctcaatgatattttccctag

SEQ ID NO: 1172254 - DNA, 22 bp, Artificial Sequence
  chemically synthesized
tttctcaatgatattttcccta

SEQ ID NO: 1172255 - DNA, 22 bp, Artificial Sequence
  chemically synthesized
aaagtactagggaaaatatcat

SEQ ID NO: 1172256 - DNA, 22 bp, Artificial Sequence
  chemically synthesized
aatctttttctcaatgatattt

SEQ ID NO: 1172257 - DNA, 22 bp, Artificial Sequence
  chemically synthesized
aaatctttttctcaatgatatt

SEQ ID NO: 1172258 - DNA, 22 bp, Artificial Sequence
  chemically synthesized
taaatctttttctcaatgatat

SEQ ID NO: 1172259 - DNA, 22 bp, Artificial Sequence
  chemically synthesized
gggaaaatatcattgagaaaaa

SEQ ID NO: 1172260 - DNA, 22 bp, Artificial Sequence
  chemically synthesized
atatctttaaatctttttctca

SEQ ID NO: 1172261 - DNA, 22 bp, Artificial Sequence
  chemically synthesized
tcatatctttaaatctttttct

SEQ ID NO: 1172262 - DNA, 22 bp, Artificial Sequence
  chemically synthesized
tctcatatctttaaatcttttt

SEQ ID NO: 1172263 - DNA, 22 bp, Artificial Sequence
  chemically synthesized
ctctctcatatctttaaatctt

SEQ ID NO: 1172264 - DNA, 22 bp, Artificial Sequence
  chemically synthesized
actctctcatatctttaaatct

SEQ ID NO: 1172265 - DNA, 22 bp, Artificial Sequence
  chemically synthesized
agaaaaagatttaaagatatga

SEQ ID NO: 1172266 - DNA, 22 bp, Artificial Sequence
  chemically synthesized
acatgacttactctctcatatc

SEQ ID NO: 1172267 - DNA, 22 bp, Artificial Sequence
  chemically synthesized
aaagatatgagagagtaagtca

SEQ ID NO: 1172268 - DNA, 22 bp, Artificial Sequence
  chemically synthesized
cacatactcacatgacttactc

SEQ ID NO: 1172269 - DNA, 22 bp, Artificial Sequence
  chemically synthesized
aagatatgagagagtaagtcat

SEQ ID NO: 1172270 - DNA, 22 bp, Artificial Sequence
  chemically synthesized
ctccacatactcacatgactta

SEQ ID NO: 1172271 - DNA, 22 bp, Artificial Sequence
  chemically synthesized
cctccacatactcacatgactt

SEQ ID NO: 1172272 - DNA, 22 bp, Artificial Sequence
  chemically synthesized
gaacacatttcctccacatact

SEQ ID NO: 1172273 - DNA, 22 bp, Artificial Sequence
  chemically synthesized
cctggaacacatttcctccaca

SEQ ID NO: 1172274 - DNA, 22 bp, Artificial Sequence
  chemically synthesized
tacctggaacacatttcctcca

SEQ ID NO: 1172275 - DNA, 22 bp, Artificial Sequence
  chemically synthesized
caccgcagtcatagatgcctct

SEQ ID NO: 1172276 - DNA, 22 bp, Artificial Sequence
  chemically synthesized
attccaccgcagtcatagatgc

SEQ ID NO: 1172277 - DNA, 22 bp, Artificial Sequence
  chemically synthesized
tcattccaccgcagtcatagat

SEQ ID NO: 1172278 - DNA, 22 bp, Artificial Sequence
  chemically synthesized
caggtagaggcatctatgactg

SEQ ID NO: 1172279 - DNA, 22 bp, Artificial Sequence
  chemically synthesized
ccgtctctcattccaccgcagt

SEQ ID NO: 1172280 - DNA, 22 bp, Artificial Sequence
  chemically synthesized
ttaccgtctctcattccaccgc

SEQ ID NO: 1172281 - DNA, 22 bp, Artificial Sequence
  chemically synthesized
tgactgcggtggaatgagagac

SEQ ID NO: 1172282 - DNA, 22 bp, Artificial Sequence
  chemically synthesized
caccgttgttaccgtctctcat

SEQ ID NO: 1172283 - DNA, 22 bp, Artificial Sequence
  chemically synthesized
ccaccgttgttaccgtctctca

SEQ ID NO: 1172284 - DNA, 22 bp, Artificial Sequence
  chemically synthesized
tccaccgttgttaccgtctctc

SEQ ID NO: 1172285 - DNA, 22 bp, Artificial Sequence
  chemically synthesized
ttccaccgttgttaccgtctct

SEQ ID NO: 1172286 - DNA, 22 bp, Artificial Sequence
  chemically synthesized
cggtggaatgagagacggtaac

SEQ ID NO: 1172287 - DNA, 22 bp, Artificial Sequence
  chemically synthesized
cttttccaccgttgttaccgtc

SEQ ID NO: 1172288 - DNA, 22 bp, Artificial Sequence
  chemically synthesized
ccttttccaccgttgttaccgt

SEQ ID NO: 1172289 - DNA, 22 bp, Artificial Sequence
  chemically synthesized
gcttccttttccaccgttgtta

SEQ ID NO: 1172290 - DNA, 22 bp, Artificial Sequence
  chemically synthesized
tggcttccttttccaccgttgt

SEQ ID NO: 1172291 - DNA, 22 bp, Artificial Sequence
  chemically synthesized
tctggcttccttttccaccgtt

SEQ ID NO: 1172292 - DNA, 22 bp, Artificial Sequence
  chemically synthesized
ctctggcttccttttccaccgt

SEQ ID NO: 1172293 - DNA, 22 bp, Artificial Sequence
  chemically synthesized
ttctctggcttccttttccacc

SEQ ID NO: 1172294 - DNA, 22 bp, Artificial Sequence
  chemically synthesized
cttctctggcttccttttccac

SEQ ID NO: 1172295 - DNA, 22 bp, Artificial Sequence
  chemically synthesized
tgtttcttctctggcttccttt

SEQ ID NO: 1172296 - DNA, 22 bp, Artificial Sequence
  chemically synthesized
tatgtttcttctctggcttcct

SEQ ID NO: 1172297 - DNA, 22 bp, Artificial Sequence
  chemically synthesized
tctatgtttcttctctggcttc

SEQ ID NO: 1172298 - DNA, 22 bp, Artificial Sequence
  chemically synthesized
ctctatgtttcttctctggctt

SEQ ID NO: 1172299 - DNA, 22 bp, Artificial Sequence
  chemically synthesized
tctctatgtttcttctctggct

SEQ ID NO: 1172300 - DNA, 22 bp, Artificial Sequence
  chemically synthesized
ctttctctatgtttcttctctg

SEQ ID NO: 1172301 - DNA, 22 bp, Artificial Sequence
  chemically synthesized
ctcctttctctatgtttcttct

SEQ ID NO: 1172302 - DNA, 22 bp, Artificial Sequence
  chemically synthesized
taagcccatgcacaatcacctc

SEQ ID NO: 1172303 - DNA, 22 bp, Artificial Sequence
  chemically synthesized
ataagcccatgcacaatcacct

SEQ ID NO: 1172304 - DNA, 22 bp, Artificial Sequence
  chemically synthesized
tataagcccatgcacaatcacc

SEQ ID NO: 1172305 - DNA, 22 bp, Artificial Sequence
  chemically synthesized
ttttataagcccatgcacaatc

SEQ ID NO: 1172306 - DNA, 22 bp, Artificial Sequence
  chemically synthesized
ctgttttataagcccatgcaca

SEQ ID NO: 1172307 - DNA, 22 bp, Artificial Sequence
  chemically synthesized
tgcatgggcttataaaacagca

SEQ ID NO: 1172308 - DNA, 22 bp, Artificial Sequence
  chemically synthesized
agtaaaatgcagtcctgctgtt

SEQ ID NO: 1172309 - DNA, 22 bp, Artificial Sequence
  chemically synthesized
ataaaacagcaggactgcattt

SEQ ID NO: 1172310 - DNA, 22 bp, Artificial Sequence
  chemically synthesized
taaaacagcaggactgcatttt

SEQ ID NO: 1172311 - DNA, 22 bp, Artificial Sequence
  chemically synthesized
ccagacattcagtaaaatgcag

SEQ ID NO: 1172312 - DNA, 22 bp, Artificial Sequence
  chemically synthesized
gccagacattcagtaaaatgca

SEQ ID NO: 1172313 - DNA, 22 bp, Artificial Sequence
  chemically synthesized
ccatgccttgccagacattcag

SEQ ID NO: 1172314 - DNA, 22 bp, Artificial Sequence
  chemically synthesized
cccatgccttgccagacattca

SEQ ID NO: 1172315 - DNA, 22 bp, Artificial Sequence
  chemically synthesized
cattttactgaatgtctggcaa

SEQ ID NO: 1172316 - DNA, 22 bp, Artificial Sequence
  chemically synthesized
aaaaccttcccatgccttgcca

SEQ ID NO: 1172317 - DNA, 22 bp, Artificial Sequence
  chemically synthesized
tactgaatgtctggcaaggcat

SEQ ID NO: 1172318 - DNA, 22 bp, Artificial Sequence
  chemically synthesized
actgaatgtctggcaaggcatg

SEQ ID NO: 1172319 - DNA, 22 bp, Artificial Sequence
  chemically synthesized
ctgaatgtctggcaaggcatgg

SEQ ID NO: 1172320 - DNA, 22 bp, Artificial Sequence
  chemically synthesized
ctgaaaaccttcccatgccttg

SEQ ID NO: 1172321 - DNA, 22 bp, Artificial Sequence
  chemically synthesized
tgctgaaaaccttcccatgcct

SEQ ID NO: 1172322 - DNA, 22 bp, Artificial Sequence
  chemically synthesized
aatgtctggcaaggcatgggaa

SEQ ID NO: 1172323 - DNA, 22 bp, Artificial Sequence
  chemically synthesized
ctgctgaaaaccttcccatgcc

SEQ ID NO: 1172324 - DNA, 22 bp, Artificial Sequence
  chemically synthesized
ttctgctgaaaaccttcccatg

SEQ ID NO: 1172325 - DNA, 22 bp, Artificial Sequence
  chemically synthesized
gcaaggcatgggaaggttttca

SEQ ID NO: 1172326 - DNA, 22 bp, Artificial Sequence
  chemically synthesized
tcagcagaagagtgatgtgatt

SEQ ID NO: 1172327 - DNA, 22 bp, Artificial Sequence
  chemically synthesized
aaacgtaaggcaaatcacatca

SEQ ID NO: 1172328 - DNA, 22 bp, Artificial Sequence
  chemically synthesized
cagcagaagagtgatgtgattt

SEQ ID NO: 1172329 - DNA, 22 bp, Artificial Sequence
  chemically synthesized
agcagaagagtgatgtgatttg

SEQ ID NO: 1172330 - DNA, 22 bp, Artificial Sequence
  chemically synthesized
ttaaaacgtaaggcaaatcaca

SEQ ID NO: 1172331 - DNA, 22 bp, Artificial Sequence
  chemically synthesized
gttaaaacgtaaggcaaatcac

SEQ ID NO: 1172332 - DNA, 22 bp, Artificial Sequence
  chemically synthesized
ccagatggtcttgttaaaacgt

SEQ ID NO: 1172333 - DNA, 22 bp, Artificial Sequence
  chemically synthesized
tctgccagatggtcttgttaaa

SEQ ID NO: 1172334 - DNA, 22 bp, Artificial Sequence
  chemically synthesized
gtctgccagatggtcttgttaa

SEQ ID NO: 1172335 - DNA, 22 bp, Artificial Sequence
  chemically synthesized
tgtctgccagatggtcttgtta

SEQ ID NO: 1172336 - DNA, 22 bp, Artificial Sequence
  chemically synthesized
gccttacgttttaacaagacca

SEQ ID NO: 1172337 - DNA, 22 bp, Artificial Sequence
  chemically synthesized
ccttacgttttaacaagaccat

SEQ ID NO: 1172338 - DNA, 22 bp, Artificial Sequence
  chemically synthesized
acgttttaacaagaccatctgg

SEQ ID NO: 1172339 - DNA, 22 bp, Artificial Sequence
  chemically synthesized
cgttttaacaagaccatctggc

SEQ ID NO: 1172340 - DNA, 22 bp, Artificial Sequence
  chemically synthesized
taatccattttgtctgccagat

SEQ ID NO: 1172341 - DNA, 22 bp, Artificial Sequence
  chemically synthesized
taacaagaccatctggcagaca

SEQ ID NO: 1172342 - DNA, 22 bp, Artificial Sequence
  chemically synthesized
aacaagaccatctggcagacaa

SEQ ID NO: 1172343 - DNA, 22 bp, Artificial Sequence
  chemically synthesized
acaagaccatctggcagacaaa

SEQ ID NO: 1172344 - DNA, 22 bp, Artificial Sequence
  chemically synthesized
cctgtaatccattttgtctgcc

SEQ ID NO: 1172345 - DNA, 22 bp, Artificial Sequence
  chemically synthesized
acctgtaatccattttgtctgc

SEQ ID NO: 1172346 - DNA, 22 bp, Artificial Sequence
  chemically synthesized
ccttacctgtaatccattttgt

SEQ ID NO: 1172347 - DNA, 22 bp, Artificial Sequence
  chemically synthesized
gccttacctgtaatccattttg

SEQ ID NO: 1172348 - DNA, 22 bp, Artificial Sequence
  chemically synthesized
gccttgccttacctgtaatcca

SEQ ID NO: 1172349 - DNA, 22 bp, Artificial Sequence
  chemically synthesized
ggccttgccttacctgtaatcc

SEQ ID NO: 1172350 - DNA, 22 bp, Artificial Sequence
  chemically synthesized
gcagacaaaatggattacaggt

SEQ ID NO: 1172351 - DNA, 22 bp, Artificial Sequence
  chemically synthesized
tggccttgccttacctgtaatc

SEQ ID NO: 1172352 - DNA, 22 bp, Artificial Sequence
  chemically synthesized
ctttggccttgccttacctgta

SEQ ID NO: 1172353 - DNA, 22 bp, Artificial Sequence
  chemically synthesized
cctgctttggccttgccttacc

SEQ ID NO: 1172354 - DNA, 22 bp, Artificial Sequence
  chemically synthesized
caggtaaggcaaggccaaagca

SEQ ID NO: 1172355 - DNA, 22 bp, Artificial Sequence
  chemically synthesized
aacaagcctgcctgctttggcc

SEQ ID NO: 1172356 - DNA, 22 bp, Artificial Sequence
  chemically synthesized
aaacaagcctgcctgctttggc

SEQ ID NO: 1172357 - DNA, 22 bp, Artificial Sequence
  chemically synthesized
taaacaagcctgcctgctttgg

SEQ ID NO: 1172358 - DNA, 22 bp, Artificial Sequence
  chemically synthesized
ttaaacaagcctgcctgctttg

SEQ ID NO: 1172359 - DNA, 22 bp, Artificial Sequence
  chemically synthesized
gtgaaatagccttttaaacaag

SEQ ID NO: 1172360 - DNA, 22 bp, Artificial Sequence
  chemically synthesized
aattagtgaaatagccttttaa

SEQ ID NO: 1172361 - DNA, 22 bp, Artificial Sequence
  chemically synthesized
gtctaaattagtgaaatagcct

SEQ ID NO: 1172362 - DNA, 22 bp, Artificial Sequence
  chemically synthesized
tggtctaaattagtgaaatagc

SEQ ID NO: 1172363 - DNA, 22 bp, Artificial Sequence
  chemically synthesized
gtttaaaaggctatttcactaa

SEQ ID NO: 1172364 - DNA, 22 bp, Artificial Sequence
  chemically synthesized
tttaaaaggctatttcactaat

SEQ ID NO: 1172365 - DNA, 22 bp, Artificial Sequence
  chemically synthesized
aaaaggctatttcactaattta

SEQ ID NO: 1172366 - DNA, 22 bp, Artificial Sequence
  chemically synthesized
aaaggctatttcactaatttag

SEQ ID NO: 1172367 - DNA, 22 bp, Artificial Sequence
  chemically synthesized
tttcactaatttagaccagagg

SEQ ID NO: 1172368 - DNA, 22 bp, Artificial Sequence
  chemically synthesized
cactaatttagaccagaggtga

SEQ ID NO: 1172369 - DNA, 22 bp, Artificial Sequence
  chemically synthesized
actaatttagaccagaggtgat

SEQ ID NO: 1172370 - DNA, 22 bp, Artificial Sequence
  chemically synthesized
catggccaccaccatcacctct

SEQ ID NO: 1172371 - DNA, 22 bp, Artificial Sequence
  chemically synthesized
acatggccaccaccatcacctc

SEQ ID NO: 1172372 - DNA, 22 bp, Artificial Sequence
  chemically synthesized
atttagaccagaggtgatggtg

SEQ ID NO: 1172373 - DNA, 22 bp, Artificial Sequence
  chemically synthesized
cttacatggccaccaccatcac

SEQ ID NO: 1172374 - DNA, 22 bp, Artificial Sequence
  chemically synthesized
agaccagaggtgatggtggtgg

SEQ ID NO: 1172375 - DNA, 22 bp, Artificial Sequence
  chemically synthesized
gaccagaggtgatggtggtggc

SEQ ID NO: 1172376 - DNA, 22 bp, Artificial Sequence
  chemically synthesized
actacttacatggccaccacca

SEQ ID NO: 1172377 - DNA, 22 bp, Artificial Sequence
  chemically synthesized
tgactacttacatggccaccac

SEQ ID NO: 1172378 - DNA, 22 bp, Artificial Sequence
  chemically synthesized
ctgactacttacatggccacca

SEQ ID NO: 1172379 - DNA, 22 bp, Artificial Sequence
  chemically synthesized
atcacttctgactacttacatg

SEQ ID NO: 1172380 - DNA, 22 bp, Artificial Sequence
  chemically synthesized
accaggtatatatccagaatct

SEQ ID NO: 1172381 - DNA, 22 bp, Artificial Sequence
  chemically synthesized
aaccaggtatatatccagaatc

SEQ ID NO: 1172382 - DNA, 22 bp, Artificial Sequence
  chemically synthesized
tgccaggtccaccttaaccagg

SEQ ID NO: 1172383 - DNA, 22 bp, Artificial Sequence
  chemically synthesized
tggatatatacctggttaaggt

SEQ ID NO: 1172384 - DNA, 22 bp, Artificial Sequence
  chemically synthesized
gatatatacctggttaaggtgg

SEQ ID NO: 1172385 - DNA, 22 bp, Artificial Sequence
  chemically synthesized
gttaaggtggacctggcatagg

SEQ ID NO: 1172386 - DNA, 22 bp, Artificial Sequence
  chemically synthesized
aggtggacctggcataggtttt

SEQ ID NO: 1172387 - DNA, 22 bp, Artificial Sequence
  chemically synthesized
aaaaaaaaaaaaaaaaaaaaac

SEQ ID NO: 1172388 - DNA, 22 bp, Artificial Sequence
  chemically synthesized
gcataggttttttttttttttt

SEQ ID NO: 1172389 - DNA, 22 bp, Artificial Sequence
  chemically synthesized
catctcaaaaaaaaaaaaaaaa

SEQ ID NO: 1172390 - DNA, 22 bp, Artificial Sequence
  chemically synthesized
ttttttttttttttttttgaga

SEQ ID NO: 1172391 - DNA, 22 bp, Artificial Sequence
  chemically synthesized
tttttttttttttttttgagat

SEQ ID NO: 1172392 - DNA, 22 bp, Artificial Sequence
  chemically synthesized
ttttttttttttttttgagatg

SEQ ID NO: 1172393 - DNA, 22 bp, Artificial Sequence
  chemically synthesized
tttttttttttttttgagatgg

SEQ ID NO: 1172394 - DNA, 22 bp, Artificial Sequence
  chemically synthesized
ttttttttttttttgagatgga

SEQ ID NO: 1172395 - DNA, 22 bp, Artificial Sequence
  chemically synthesized
tttttttttttttgagatggag

SEQ ID NO: 1172396 - DNA, 22 bp, Artificial Sequence
  chemically synthesized
ttttttttttttgagatggagt

SEQ ID NO: 1172397 - DNA, 22 bp, Artificial Sequence
  chemically synthesized
tttttttttttgagatggagtc

SEQ ID NO: 1172398 - DNA, 22 bp, Artificial Sequence
  chemically synthesized
ttttttttttgagatggagtct

SEQ ID NO: 1172399 - DNA, 22 bp, Artificial Sequence
  chemically synthesized
ggtgacagagcgagactccatc

SEQ ID NO: 1172400 - DNA, 22 bp, Artificial Sequence
  chemically synthesized
tttttttttgagatggagtctc

SEQ ID NO: 1172401 - DNA, 22 bp, Artificial Sequence
  chemically synthesized
ttttttttgagatggagtctcg

SEQ ID NO: 1172402 - DNA, 22 bp, Artificial Sequence
  chemically synthesized
tttttttgagatggagtctcgc

SEQ ID NO: 1172403 - DNA, 22 bp, Artificial Sequence
  chemically synthesized
ttttttgagatggagtctcgct

SEQ ID NO: 1172404 - DNA, 22 bp, Artificial Sequence
  chemically synthesized
tttttgagatggagtctcgctc

SEQ ID NO: 1172405 - DNA, 22 bp, Artificial Sequence
  chemically synthesized
ttttgagatggagtctcgctct

SEQ ID NO: 1172406 - DNA, 22 bp, Artificial Sequence
  chemically synthesized
tttgagatggagtctcgctctg

SEQ ID NO: 1172407 - DNA, 22 bp, Artificial Sequence
  chemically synthesized
cagcctgggtgacagagcgaga

SEQ ID NO: 1172408 - DNA, 22 bp, Artificial Sequence
  chemically synthesized
ttgagatggagtctcgctctgt

SEQ ID NO: 1172409 - DNA, 22 bp, Artificial Sequence
  chemically synthesized
tgagatggagtctcgctctgtc

SEQ ID NO: 1172410 - DNA, 22 bp, Artificial Sequence
  chemically synthesized
gagatggagtctcgctctgtca

SEQ ID NO: 1172411 - DNA, 22 bp, Artificial Sequence
  chemically synthesized
agatggagtctcgctctgtcac

SEQ ID NO: 1172412 - DNA, 22 bp, Artificial Sequence
  chemically synthesized
cactccagcctgggtgacagag

SEQ ID NO: 1172413 - DNA, 22 bp, Artificial Sequence
  chemically synthesized
ctgcactccagcctgggtgaca

SEQ ID NO: 1172414 - DNA, 22 bp, Artificial Sequence
  chemically synthesized
gctctgtcacccaggctggagt

SEQ ID NO: 1172415 - DNA, 22 bp, Artificial Sequence
  chemically synthesized
tgtcacccaggctggagtgcag

SEQ ID NO: 1172416 - DNA, 22 bp, Artificial Sequence
  chemically synthesized
tcacccaggctggagtgcagta

SEQ ID NO: 1172417 - DNA, 22 bp, Artificial Sequence
  chemically synthesized
tagtgagcggatatcgcgctac

SEQ ID NO: 1172418 - DNA, 22 bp, Artificial Sequence
  chemically synthesized
gtagtgagcggatatcgcgcta

SEQ ID NO: 1172419 - DNA, 22 bp, Artificial Sequence
  chemically synthesized
gagtgcagtagcgcgatatccg

SEQ ID NO: 1172420 - DNA, 22 bp, Artificial Sequence
  chemically synthesized
actacaagctccgcctcccggg

SEQ ID NO: 1172421 - DNA, 22 bp, Artificial Sequence
  chemically synthesized
caagctccgcctcccgggttca

SEQ ID NO: 1172422 - DNA, 22 bp, Artificial Sequence
  chemically synthesized
aggcaggagaatggcgtgaacc

SEQ ID NO: 1172423 - DNA, 22 bp, Artificial Sequence
  chemically synthesized
cgcctcccgggttcacgccatt

SEQ ID NO: 1172424 - DNA, 22 bp, Artificial Sequence
  chemically synthesized
ccgggttcacgccattctcctg

SEQ ID NO: 1172425 - DNA, 22 bp, Artificial Sequence
  chemically synthesized
gggaggctgaggcaggagaatg

SEQ ID NO: 1172426 - DNA, 22 bp, Artificial Sequence
  chemically synthesized
ctcgggaggctgaggcaggaga

SEQ ID NO: 1172427 - DNA, 22 bp, Artificial Sequence
  chemically synthesized
acgccattctcctgcctcagcc

SEQ ID NO: 1172428 - DNA, 22 bp, Artificial Sequence
  chemically synthesized
tagtcccagctactcgggaggc

SEQ ID NO: 1172429 - DNA, 22 bp, Artificial Sequence
  chemically synthesized
tcctgcctcagcctcccgagta

SEQ ID NO: 1172430 - DNA, 22 bp, Artificial Sequence
  chemically synthesized
ctgcctcagcctcccgagtagc

SEQ ID NO: 1172431 - DNA, 22 bp, Artificial Sequence
  chemically synthesized
cctcagcctcccgagtagctgg

SEQ ID NO: 1172432 - DNA, 22 bp, Artificial Sequence
  chemically synthesized
agcctcccgagtagctgggact

SEQ ID NO: 1172433 - DNA, 22 bp, Artificial Sequence
  chemically synthesized
ccgagtagctgggactacaggc

SEQ ID NO: 1172434 - DNA, 22 bp, Artificial Sequence
  chemically synthesized
ccggccgtggtggcaggtgcct

SEQ ID NO: 1172435 - DNA, 22 bp, Artificial Sequence
  chemically synthesized
gccggccgtggtggcaggtgcc

SEQ ID NO: 1172436 - DNA, 22 bp, Artificial Sequence
  chemically synthesized
ggactacaggcacctgccacca

SEQ ID NO: 1172437 - DNA, 22 bp, Artificial Sequence
  chemically synthesized
caggcacctgccaccacggccg

SEQ ID NO: 1172438 - DNA, 22 bp, Artificial Sequence
  chemically synthesized
aaaatacaaaaaatttgccggc

SEQ ID NO: 1172439 - DNA, 22 bp, Artificial Sequence
  chemically synthesized
ctaaaaatacaaaaaatttgcc

SEQ ID NO: 1172440 - DNA, 22 bp, Artificial Sequence
  chemically synthesized
ccaccacggccggcaaattttt

SEQ ID NO: 1172441 - DNA, 22 bp, Artificial Sequence
  chemically synthesized
tactaaaaatacaaaaaatttg

SEQ ID NO: 1172442 - DNA, 22 bp, Artificial Sequence
  chemically synthesized
tttgtatttttagtagagacgg

SEQ ID NO: 1172443 - DNA, 22 bp, Artificial Sequence
  chemically synthesized
ttgtatttttagtagagacggg

SEQ ID NO: 1172444 - DNA, 22 bp, Artificial Sequence
  chemically synthesized
acacggtgaaaccccgtctcta

SEQ ID NO: 1172445 - DNA, 22 bp, Artificial Sequence
  chemically synthesized
tgtatttttagtagagacgggg

SEQ ID NO: 1172446 - DNA, 22 bp, Artificial Sequence
  chemically synthesized
gtatttttagtagagacggggt

SEQ ID NO: 1172447 - DNA, 22 bp, Artificial Sequence
  chemically synthesized
tatttttagtagagacggggtt

SEQ ID NO: 1172448 - DNA, 22 bp, Artificial Sequence
  chemically synthesized
gctaacacggtgaaaccccgtc

SEQ ID NO: 1172449 - DNA, 22 bp, Artificial Sequence
  chemically synthesized
ttagtagagacggggtttcacc

SEQ ID NO: 1172450 - DNA, 22 bp, Artificial Sequence
  chemically synthesized
tagtagagacggggtttcaccg

SEQ ID NO: 1172451 - DNA, 22 bp, Artificial Sequence
  chemically synthesized
agtagagacggggtttcaccgt

SEQ ID NO: 1172452 - DNA, 22 bp, Artificial Sequence
  chemically synthesized
gtagagacggggtttcaccgtg

SEQ ID NO: 1172453 - DNA, 22 bp, Artificial Sequence
  chemically synthesized
caccgtgttagccaggatggtc

SEQ ID NO: 1172454 - DNA, 22 bp, Artificial Sequence
  chemically synthesized
accgtgttagccaggatggtct

SEQ ID NO: 1172455 - DNA, 22 bp, Artificial Sequence
  chemically synthesized
gccaggatggtctcgatctcct

SEQ ID NO: 1172456 - DNA, 22 bp, Artificial Sequence
  chemically synthesized
gatctcctgacctcgtgatccg

SEQ ID NO: 1172457 - DNA, 22 bp, Artificial Sequence
  chemically synthesized
agaggccgaggcgggcggatca

SEQ ID NO: 1172458 - DNA, 22 bp, Artificial Sequence
  chemically synthesized
gagaggccgaggcgggcggatc

SEQ ID NO: 1172459 - DNA, 22 bp, Artificial Sequence
  chemically synthesized
tgagaggccgaggcgggcggat

SEQ ID NO: 1172460 - DNA, 22 bp, Artificial Sequence
  chemically synthesized
ctgacctcgtgatccgcccgcc

SEQ ID NO: 1172461 - DNA, 22 bp, Artificial Sequence
  chemically synthesized
acctcgtgatccgcccgcctcg

SEQ ID NO: 1172462 - DNA, 22 bp, Artificial Sequence
  chemically synthesized
gtgatccgcccgcctcggcctc

SEQ ID NO: 1172463 - DNA, 22 bp, Artificial Sequence
  chemically synthesized
taatcccagcactttgagaggc

SEQ ID NO: 1172464 - DNA, 22 bp, Artificial Sequence
  chemically synthesized
acgcctgtaatcccagcacttt

SEQ ID NO: 1172465 - DNA, 22 bp, Artificial Sequence
  chemically synthesized
ggcctctcaaagtgctgggatt

SEQ ID NO: 1172466 - DNA, 22 bp, Artificial Sequence
  chemically synthesized
tcaaagtgctgggattacaggc

SEQ ID NO: 1172467 - DNA, 22 bp, Artificial Sequence
  chemically synthesized
aaagtgctgggattacaggcgt

SEQ ID NO: 1172468 - DNA, 22 bp, Artificial Sequence
  chemically synthesized
gccggatgcggtggctcacgcc

SEQ ID NO: 1172469 - DNA, 22 bp, Artificial Sequence
  chemically synthesized
ggccggatgcggtggctcacgc

SEQ ID NO: 1172470 - DNA, 22 bp, Artificial Sequence
  chemically synthesized
ggattacaggcgtgagccaccg

SEQ ID NO: 1172471 - DNA, 22 bp, Artificial Sequence
  chemically synthesized
caggcgtgagccaccgcatccg

SEQ ID NO: 1172472 - DNA, 22 bp, Artificial Sequence
  chemically synthesized
tgccaggtttggccggatgcgg

SEQ ID NO: 1172473 - DNA, 22 bp, Artificial Sequence
  chemically synthesized
gaaaactatgccaggtttggcc

SEQ ID NO: 1172474 - DNA, 22 bp, Artificial Sequence
  chemically synthesized
attagaaaactatgccaggttt

SEQ ID NO: 1172475 - DNA, 22 bp, Artificial Sequence
  chemically synthesized
ttgattagaaaactatgccagg

SEQ ID NO: 1172476 - DNA, 22 bp, Artificial Sequence
  chemically synthesized
atgttgttgattagaaaactat

SEQ ID NO: 1172477 - DNA, 22 bp, Artificial Sequence
  chemically synthesized
acacctgatgttgttgattaga

SEQ ID NO: 1172478 - DNA, 22 bp, Artificial Sequence
  chemically synthesized
tcacacctgatgttgttgatta

SEQ ID NO: 1172479 - DNA, 22 bp, Artificial Sequence
  chemically synthesized
gcatagttttctaatcaacaac

SEQ ID NO: 1172480 - DNA, 22 bp, Artificial Sequence
  chemically synthesized
ctcacacctgatgttgttgatt

SEQ ID NO: 1172481 - DNA, 22 bp, Artificial Sequence
  chemically synthesized
tctcacacctgatgttgttgat

SEQ ID NO: 1172482 - DNA, 22 bp, Artificial Sequence
  chemically synthesized
tttctcacacctgatgttgttg

SEQ ID NO: 1172483 - DNA, 22 bp, Artificial Sequence
  chemically synthesized
ttctttctcacacctgatgttg

SEQ ID NO: 1172484 - DNA, 22 bp, Artificial Sequence
  chemically synthesized
gttctttctcacacctgatgtt

SEQ ID NO: 1172485 - DNA, 22 bp, Artificial Sequence
  chemically synthesized
tctaatcaacaacatcaggtgt

SEQ ID NO: 1172486 - DNA, 22 bp, Artificial Sequence
  chemically synthesized
ctaatcaacaacatcaggtgtg

SEQ ID NO: 1172487 - DNA, 22 bp, Artificial Sequence
  chemically synthesized
taatcaacaacatcaggtgtga

SEQ ID NO: 1172488 - DNA, 22 bp, Artificial Sequence
  chemically synthesized
gtcttgttctttctcacacctg

SEQ ID NO: 1172489 - DNA, 22 bp, Artificial Sequence
  chemically synthesized
atcaacaacatcaggtgtgaga

SEQ ID NO: 1172490 - DNA, 22 bp, Artificial Sequence
  chemically synthesized
agtcttgttctttctcacacct

SEQ ID NO: 1172491 - DNA, 22 bp, Artificial Sequence
  chemically synthesized
agtcaaacttagtcttgttctt

SEQ ID NO: 1172492 - DNA, 22 bp, Artificial Sequence
  chemically synthesized
gagtcaaacttagtcttgttct

SEQ ID NO: 1172493 - DNA, 22 bp, Artificial Sequence
  chemically synthesized
tgagtcaaacttagtcttgttc

SEQ ID NO: 1172494 - DNA, 22 bp, Artificial Sequence
  chemically synthesized
ccccaaatgaacatctttgagt

SEQ ID NO: 1172495 - DNA, 22 bp, Artificial Sequence
  chemically synthesized
agtttgactcaaagatgttcat

SEQ ID NO: 1172496 - DNA, 22 bp, Artificial Sequence
  chemically synthesized
cagttgccccaaatgaacatct

SEQ ID NO: 1172497 - DNA, 22 bp, Artificial Sequence
  chemically synthesized
ccagttgccccaaatgaacatc

SEQ ID NO: 1172498 - DNA, 22 bp, Artificial Sequence
  chemically synthesized
gactcaaagatgttcatttggg

SEQ ID NO: 1172499 - DNA, 22 bp, Artificial Sequence
  chemically synthesized
actcaaagatgttcatttgggg

SEQ ID NO: 1172500 - DNA, 22 bp, Artificial Sequence
  chemically synthesized
tagccttccagttgccccaaat

SEQ ID NO: 1172501 - DNA, 22 bp, Artificial Sequence
  chemically synthesized
aaagatgttcatttggggcaac

SEQ ID NO: 1172502 - DNA, 22 bp, Artificial Sequence
  chemically synthesized
actatagccttccagttgcccc

SEQ ID NO: 1172503 - DNA, 22 bp, Artificial Sequence
  chemically synthesized
cactatagccttccagttgccc

SEQ ID NO: 1172504 - DNA, 22 bp, Artificial Sequence
  chemically synthesized
atttggggcaactggaaggcta

SEQ ID NO: 1172505 - DNA, 22 bp, Artificial Sequence
  chemically synthesized
ggggcaactggaaggctatagt

SEQ ID NO: 1172506 - DNA, 22 bp, Artificial Sequence
  chemically synthesized
gggcaactggaaggctatagtg

SEQ ID NO: 1172507 - DNA, 22 bp, Artificial Sequence
  chemically synthesized
tgtcagtaaggtttcactatag

SEQ ID NO: 1172508 - DNA, 22 bp, Artificial Sequence
  chemically synthesized
ctgtgtcagtaaggtttcacta

SEQ ID NO: 1172509 - DNA, 22 bp, Artificial Sequence
  chemically synthesized
cctgtgtcagtaaggtttcact

SEQ ID NO: 1172510 - DNA, 22 bp, Artificial Sequence
  chemically synthesized
tcctgtgtcagtaaggtttcac

SEQ ID NO: 1172511 - DNA, 22 bp, Artificial Sequence
  chemically synthesized
ttcctgtgtcagtaaggtttca

SEQ ID NO: 1172512 - DNA, 22 bp, Artificial Sequence
  chemically synthesized
gaaggctatagtgaaaccttac

SEQ ID NO: 1172513 - DNA, 22 bp, Artificial Sequence
  chemically synthesized
tagtgaaaccttactgacacag

SEQ ID NO: 1172514 - DNA, 22 bp, Artificial Sequence
  chemically synthesized
gtcaatagtttttcctgtgtca

SEQ ID NO: 1172515 - DNA, 22 bp, Artificial Sequence
  chemically synthesized
cgtcaatagtttttcctgtgtc

SEQ ID NO: 1172516 - DNA, 22 bp, Artificial Sequence
  chemically synthesized
cttcgtcaatagtttttcctgt

SEQ ID NO: 1172517 - DNA, 22 bp, Artificial Sequence
  chemically synthesized
actgacacaggaaaaactattg

SEQ ID NO: 1172518 - DNA, 22 bp, Artificial Sequence
  chemically synthesized
ctgacacaggaaaaactattga

SEQ ID NO: 1172519 - DNA, 22 bp, Artificial Sequence
  chemically synthesized
acacaggaaaaactattgacga

SEQ ID NO: 1172520 - DNA, 22 bp, Artificial Sequence
  chemically synthesized
acacccacatctgcttcgtcaa

SEQ ID NO: 1172521 - DNA, 22 bp, Artificial Sequence
  chemically synthesized
ctaacacccacatctgcttcgt

SEQ ID NO: 1172522 - DNA, 22 bp, Artificial Sequence
  chemically synthesized
actaacacccacatctgcttcg

SEQ ID NO: 1172523 - DNA, 22 bp, Artificial Sequence
  chemically synthesized
aatttactaacacccacatctg

SEQ ID NO: 1172524 - DNA, 22 bp, Artificial Sequence
  chemically synthesized
ttgacgaagcagatgtgggtgt

SEQ ID NO: 1172525 - DNA, 22 bp, Artificial Sequence
  chemically synthesized
acgaagcagatgtgggtgttag

SEQ ID NO: 1172526 - DNA, 22 bp, Artificial Sequence
  chemically synthesized
tgtaaaactaaatttactaaca

SEQ ID NO: 1172527 - DNA, 22 bp, Artificial Sequence
  chemically synthesized
ccctatgtaaaactaaatttac

SEQ ID NO: 1172528 - DNA, 22 bp, Artificial Sequence
  chemically synthesized
accctatgtaaaactaaattta

SEQ ID NO: 1172529 - DNA, 22 bp, Artificial Sequence
  chemically synthesized
aaatttaccctatgtaaaacta

SEQ ID NO: 1172530 - DNA, 22 bp, Artificial Sequence
  chemically synthesized
gtaaatttagttttacataggg

SEQ ID NO: 1172531 - DNA, 22 bp, Artificial Sequence
  chemically synthesized
gtcaattcaaatttaccctatg

SEQ ID NO: 1172532 - DNA, 22 bp, Artificial Sequence
  chemically synthesized
ctagtcaattcaaatttaccct

SEQ ID NO: 1172533 - DNA, 22 bp, Artificial Sequence
  chemically synthesized
agttttacatagggtaaatttg

SEQ ID NO: 1172534 - DNA, 22 bp, Artificial Sequence
  chemically synthesized
gttttacatagggtaaatttga

SEQ ID NO: 1172535 - DNA, 22 bp, Artificial Sequence
  chemically synthesized
tacatagggtaaatttgaattg

SEQ ID NO: 1172536 - DNA, 22 bp, Artificial Sequence
  chemically synthesized
tacattcctagtcaattcaaat

SEQ ID NO: 1172537 - DNA, 22 bp, Artificial Sequence
  chemically synthesized
acatagggtaaatttgaattga

SEQ ID NO: 1172538 - DNA, 22 bp, Artificial Sequence
  chemically synthesized
atacattcctagtcaattcaaa

SEQ ID NO: 1172539 - DNA, 22 bp, Artificial Sequence
  chemically synthesized
catagggtaaatttgaattgac

SEQ ID NO: 1172540 - DNA, 22 bp, Artificial Sequence
  chemically synthesized
tatacattcctagtcaattcaa

SEQ ID NO: 1172541 - DNA, 22 bp, Artificial Sequence
  chemically synthesized
ttatacattcctagtcaattca

SEQ ID NO: 1172542 - DNA, 22 bp, Artificial Sequence
  chemically synthesized
tttatacattcctagtcaattc

SEQ ID NO: 1172543 - DNA, 22 bp, Artificial Sequence
  chemically synthesized
gaattgactaggaatgtataaa

SEQ ID NO: 1172544 - DNA, 22 bp, Artificial Sequence
  chemically synthesized
gatacacaactttttatacatt

SEQ ID NO: 1172545 - DNA, 22 bp, Artificial Sequence
  chemically synthesized
aattgactaggaatgtataaaa

SEQ ID NO: 1172546 - DNA, 22 bp, Artificial Sequence
  chemically synthesized
agatacacaactttttatacat

SEQ ID NO: 1172547 - DNA, 22 bp, Artificial Sequence
  chemically synthesized
actaggaatgtataaaaagttg

SEQ ID NO: 1172548 - DNA, 22 bp, Artificial Sequence
  chemically synthesized
caaacttagatacacaactttt

SEQ ID NO: 1172549 - DNA, 22 bp, Artificial Sequence
  chemically synthesized
ggaatgtataaaaagttgtgta

SEQ ID NO: 1172550 - DNA, 22 bp, Artificial Sequence
  chemically synthesized
ccaaactccaaacttagataca

SEQ ID NO: 1172551 - DNA, 22 bp, Artificial Sequence
  chemically synthesized
tgccaaactccaaacttagata

SEQ ID NO: 1172552 - DNA, 22 bp, Artificial Sequence
  chemically synthesized
ctgccaaactccaaacttagat

SEQ ID NO: 1172553 - DNA, 22 bp, Artificial Sequence
  chemically synthesized
tctgccaaactccaaacttaga

SEQ ID NO: 1172554 - DNA, 22 bp, Artificial Sequence
  chemically synthesized
agagctttctgccaaactccaa

SEQ ID NO: 1172555 - DNA, 22 bp, Artificial Sequence
  chemically synthesized
tgtatctaagtttggagtttgg

SEQ ID NO: 1172556 - DNA, 22 bp, Artificial Sequence
  chemically synthesized
agtttggagtttggcagaaagc

SEQ ID NO: 1172557 - DNA, 22 bp, Artificial Sequence
  chemically synthesized
cccccagctcagagctttctgc

SEQ ID NO: 1172558 - DNA, 22 bp, Artificial Sequence
  chemically synthesized
acccccagctcagagctttctg

SEQ ID NO: 1172559 - DNA, 22 bp, Artificial Sequence
  chemically synthesized
ggagtttggcagaaagctctga

SEQ ID NO: 1172560 - DNA, 22 bp, Artificial Sequence
  chemically synthesized
gagtttggcagaaagctctgag

SEQ ID NO: 1172561 - DNA, 22 bp, Artificial Sequence
  chemically synthesized
ccaatgtttacccccagctcag

SEQ ID NO: 1172562 - DNA, 22 bp, Artificial Sequence
  chemically synthesized
ggcagaaagctctgagctgggg

SEQ ID NO: 1172563 - DNA, 22 bp, Artificial Sequence
  chemically synthesized
gcagaaagctctgagctggggg

SEQ ID NO: 1172564 - DNA, 22 bp, Artificial Sequence
  chemically synthesized
atgcctcccaatgtttaccccc

SEQ ID NO: 1172565 - DNA, 22 bp, Artificial Sequence
  chemically synthesized
tgagctgggggtaaacattggg

SEQ ID NO: 1172566 - DNA, 22 bp, Artificial Sequence
  chemically synthesized
taagttgatgcctcccaatgtt

SEQ ID NO: 1172567 - DNA, 22 bp, Artificial Sequence
  chemically synthesized
agctgggggtaaacattgggag

SEQ ID NO: 1172568 - DNA, 22 bp, Artificial Sequence
  chemically synthesized
tctgtaagttgatgcctcccaa

SEQ ID NO: 1172569 - DNA, 22 bp, Artificial Sequence
  chemically synthesized
ggggtaaacattgggaggcatc

SEQ ID NO: 1172570 - DNA, 22 bp, Artificial Sequence
  chemically synthesized
gcatcaaatactgtctgtaagt

SEQ ID NO: 1172571 - DNA, 22 bp, Artificial Sequence
  chemically synthesized
ggaggcatcaacttacagacag

SEQ ID NO: 1172572 - DNA, 22 bp, Artificial Sequence
  chemically synthesized
ctggcatcaaatactgtctgta

SEQ ID NO: 1172573 - DNA, 22 bp, Artificial Sequence
  chemically synthesized
gcctcctggcatcaaatactgt

SEQ ID NO: 1172574 - DNA, 22 bp, Artificial Sequence
  chemically synthesized
tctagcctcctggcatcaaata

SEQ ID NO: 1172575 - DNA, 22 bp, Artificial Sequence
  chemically synthesized
atctagcctcctggcatcaaat

SEQ ID NO: 1172576 - DNA, 22 bp, Artificial Sequence
  chemically synthesized
acagacagtatttgatgccagg

SEQ ID NO: 1172577 - DNA, 22 bp, Artificial Sequence
  chemically synthesized
cagacagtatttgatgccagga

SEQ ID NO: 1172578 - DNA, 22 bp, Artificial Sequence
  chemically synthesized
gatgatcttatctagcctcctg

SEQ ID NO: 1172579 - DNA, 22 bp, Artificial Sequence
  chemically synthesized
tcgatgatcttatctagcctcc

SEQ ID NO: 1172580 - DNA, 22 bp, Artificial Sequence
  chemically synthesized
ctcgatgatcttatctagcctc

SEQ ID NO: 1172581 - DNA, 22 bp, Artificial Sequence
  chemically synthesized
tctcgatgatcttatctagcct

SEQ ID NO: 1172582 - DNA, 22 bp, Artificial Sequence
  chemically synthesized
gatgccaggaggctagataaga

SEQ ID NO: 1172583 - DNA, 22 bp, Artificial Sequence
  chemically synthesized
atgccaggaggctagataagat

SEQ ID NO: 1172584 - DNA, 22 bp, Artificial Sequence
  chemically synthesized
attttctcgatgatcttatcta

SEQ ID NO: 1172585 - DNA, 22 bp, Artificial Sequence
  chemically synthesized
gaccacattcattttctcgatg

SEQ ID NO: 1172586 - DNA, 22 bp, Artificial Sequence
  chemically synthesized
agaccacattcattttctcgat

SEQ ID NO: 1172587 - DNA, 22 bp, Artificial Sequence
  chemically synthesized
ttagaccacattcattttctcg

SEQ ID NO: 1172588 - DNA, 22 bp, Artificial Sequence
  chemically synthesized
gataagatcatcgagaaaatga

SEQ ID NO: 1172589 - DNA, 22 bp, Artificial Sequence
  chemically synthesized
gttcttagaccacattcatttt

SEQ ID NO: 1172590 - DNA, 22 bp, Artificial Sequence
  chemically synthesized
atatgacagtaaccaggggttg

SEQ ID NO: 1172591 - DNA, 22 bp, Artificial Sequence
  chemically synthesized
ctgatatgacagtaaccagggg

SEQ ID NO: 1172592 - DNA, 22 bp, Artificial Sequence
  chemically synthesized
agaaccaacccctggttactgt

SEQ ID NO: 1172593 - DNA, 22 bp, Artificial Sequence
  chemically synthesized
cccatcaacacaaattcctgat

SEQ ID NO: 1172594 - DNA, 22 bp, Artificial Sequence
  chemically synthesized
gttactgtcatatcaggaattt

SEQ ID NO: 1172595 - DNA, 22 bp, Artificial Sequence
  chemically synthesized
ccccatcaacacaaattcctga

SEQ ID NO: 1172596 - DNA, 22 bp, Artificial Sequence
  chemically synthesized
ttccccatcaacacaaattcct

SEQ ID NO: 1172597 - DNA, 22 bp, Artificial Sequence
  chemically synthesized
ctgtcatatcaggaatttgtgt

SEQ ID NO: 1172598 - DNA, 22 bp, Artificial Sequence
  chemically synthesized
gttcttccccatcaacacaaat

SEQ ID NO: 1172599 - DNA, 22 bp, Artificial Sequence
  chemically synthesized
tcatatcaggaatttgtgttga

SEQ ID NO: 1172600 - DNA, 22 bp, Artificial Sequence
  chemically synthesized
ctggttcttccccatcaacaca

SEQ ID NO: 1172601 - DNA, 22 bp, Artificial Sequence
  chemically synthesized
gctggttcttccccatcaacac

SEQ ID NO: 1172602 - DNA, 22 bp, Artificial Sequence
  chemically synthesized
atttgctggttcttccccatca

SEQ ID NO: 1172603 - DNA, 22 bp, Artificial Sequence
  chemically synthesized
aatttgctggttcttccccatc

SEQ ID NO: 1172604 - DNA, 22 bp, Artificial Sequence
  chemically synthesized
taatttgctggttcttccccat

SEQ ID NO: 1172605 - DNA, 22 bp, Artificial Sequence
  chemically synthesized
attttaatttgctggttcttcc

SEQ ID NO: 1172606 - DNA, 22 bp, Artificial Sequence
  chemically synthesized
gattttaatttgctggttcttc

SEQ ID NO: 1172607 - DNA, 22 bp, Artificial Sequence
  chemically synthesized
gtgttgatggggaagaaccagc

SEQ ID NO: 1172608 - DNA, 22 bp, Artificial Sequence
  chemically synthesized
tgattttaatttgctggttctt

SEQ ID NO: 1172609 - DNA, 22 bp, Artificial Sequence
  chemically synthesized
tgttgatggggaagaaccagca

SEQ ID NO: 1172610 - DNA, 22 bp, Artificial Sequence
  chemically synthesized
ctttgattttaatttgctggtt

SEQ ID NO: 1172611 - DNA, 22 bp, Artificial Sequence
  chemically synthesized
atggggaagaaccagcaaatta

SEQ ID NO: 1172612 - DNA, 22 bp, Artificial Sequence
  chemically synthesized
gcatctgctttgattttaattt

SEQ ID NO: 1172613 - DNA, 22 bp, Artificial Sequence
  chemically synthesized
tagcatctgctttgattttaat

SEQ ID NO: 1172614 - DNA, 22 bp, Artificial Sequence
  chemically synthesized
ctagcatctgctttgattttaa

SEQ ID NO: 1172615 - DNA, 22 bp, Artificial Sequence
  chemically synthesized
tctagcatctgctttgatttta

SEQ ID NO: 1172616 - DNA, 22 bp, Artificial Sequence
  chemically synthesized
ttctagcatctgctttgatttt

SEQ ID NO: 1172617 - DNA, 22 bp, Artificial Sequence
  chemically synthesized
tttttctagcatctgctttgat

SEQ ID NO: 1172618 - DNA, 22 bp, Artificial Sequence
  chemically synthesized
ctgtttttctagcatctgcttt

SEQ ID NO: 1172619 - DNA, 22 bp, Artificial Sequence
  chemically synthesized
cctgtttttctagcatctgctt

SEQ ID NO: 1172620 - DNA, 22 bp, Artificial Sequence
  chemically synthesized
ttcctgtttttctagcatctgc

SEQ ID NO: 1172621 - DNA, 22 bp, Artificial Sequence
  chemically synthesized
cttcctgtttttctagcatctg

SEQ ID NO: 1172622 - DNA, 22 bp, Artificial Sequence
  chemically synthesized
tcttcctgtttttctagcatct

SEQ ID NO: 1172623 - DNA, 22 bp, Artificial Sequence
  chemically synthesized
aaatcaaagcagatgctagaaa

SEQ ID NO: 1172624 - DNA, 22 bp, Artificial Sequence
  chemically synthesized
caggttttcttcctgtttttct

SEQ ID NO: 1172625 - DNA, 22 bp, Artificial Sequence
  chemically synthesized
gaaaaacaggaagaaaacctgg

SEQ ID NO: 1172626 - DNA, 22 bp, Artificial Sequence
  chemically synthesized
aggcaccacacattccaggttt

SEQ ID NO: 1172627 - DNA, 22 bp, Artificial Sequence
  chemically synthesized
taaggcaccacacattccaggt

SEQ ID NO: 1172628 - DNA, 22 bp, Artificial Sequence
  chemically synthesized
ctaaggcaccacacattccagg

SEQ ID NO: 1172629 - DNA, 22 bp, Artificial Sequence
  chemically synthesized
atttctaaggcaccacacattc

SEQ ID NO: 1172630 - DNA, 22 bp, Artificial Sequence
  chemically synthesized
gatttctaaggcaccacacatt

SEQ ID NO: 1172631 - DNA, 22 bp, Artificial Sequence
  chemically synthesized
tgatttctaaggcaccacacat

SEQ ID NO: 1172632 - DNA, 22 bp, Artificial Sequence
  chemically synthesized
tttgatttctaaggcaccacac

SEQ ID NO: 1172633 - DNA, 22 bp, Artificial Sequence
  chemically synthesized
ccctctttgatttctaaggcac

SEQ ID NO: 1172634 - DNA, 22 bp, Artificial Sequence
  chemically synthesized
cccctctttgatttctaaggca

SEQ ID NO: 1172635 - DNA, 22 bp, Artificial Sequence
  chemically synthesized
tcccctctttgatttctaaggc

SEQ ID NO: 1172636 - DNA, 22 bp, Artificial Sequence
  chemically synthesized
gaatgtgtggtgccttagaaat

SEQ ID NO: 1172637 - DNA, 22 bp, Artificial Sequence
  chemically synthesized
ctttcccctctttgatttctaa

SEQ ID NO: 1172638 - DNA, 22 bp, Artificial Sequence
  chemically synthesized
actttcccctctttgatttcta

SEQ ID NO: 1172639 - DNA, 22 bp, Artificial Sequence
  chemically synthesized
agacatgcatttactttcccct

SEQ ID NO: 1172640 - DNA, 22 bp, Artificial Sequence
  chemically synthesized
agaaatcaaagaggggaaagta

SEQ ID NO: 1172641 - DNA, 22 bp, Artificial Sequence
  chemically synthesized
gagacatgcatttactttcccc

SEQ ID NO: 1172642 - DNA, 22 bp, Artificial Sequence
  chemically synthesized
gaaatcaaagaggggaaagtaa

SEQ ID NO: 1172643 - DNA, 22 bp, Artificial Sequence
  chemically synthesized
agtaaatgtaggaggatttgag

SEQ ID NO: 1172644 - DNA, 22 bp, Artificial Sequence
  chemically synthesized
aagtaaatgtaggaggatttga

SEQ ID NO: 1172645 - DNA, 22 bp, Artificial Sequence
  chemically synthesized
agtaacttaagtaaatgtagga

SEQ ID NO: 1172646 - DNA, 22 bp, Artificial Sequence
  chemically synthesized
aattaagtaacttaagtaaatg

SEQ ID NO: 1172647 - DNA, 22 bp, Artificial Sequence
  chemically synthesized
aaatcctcctacatttacttaa

SEQ ID NO: 1172648 - DNA, 22 bp, Artificial Sequence
  chemically synthesized
cctaaattaagtaacttaagta

SEQ ID NO: 1172649 - DNA, 22 bp, Artificial Sequence
  chemically synthesized
ctacatttacttaagttactta

SEQ ID NO: 1172650 - DNA, 22 bp, Artificial Sequence
  chemically synthesized
catttacttaagttacttaatt

SEQ ID NO: 1172651 - DNA, 22 bp, Artificial Sequence
  chemically synthesized
tatgtactacctaaattaagta

SEQ ID NO: 1172652 - DNA, 22 bp, Artificial Sequence
  chemically synthesized
atatgtactacctaaattaagt

SEQ ID NO: 1172653 - DNA, 22 bp, Artificial Sequence
  chemically synthesized
acttaagttacttaatttaggt

SEQ ID NO: 1172654 - DNA, 22 bp, Artificial Sequence
  chemically synthesized
cttatatgtactacctaaatta

SEQ ID NO: 1172655 - DNA, 22 bp, Artificial Sequence
  chemically synthesized
cttaagttacttaatttaggta

SEQ ID NO: 1172656 - DNA, 22 bp, Artificial Sequence
  chemically synthesized
aagttacttaatttaggtagta

SEQ ID NO: 1172657 - DNA, 22 bp, Artificial Sequence
  chemically synthesized
agttacttaatttaggtagtac

SEQ ID NO: 1172658 - DNA, 22 bp, Artificial Sequence
  chemically synthesized
cttaatttaggtagtacatata

SEQ ID NO: 1172659 - DNA, 22 bp, Artificial Sequence
  chemically synthesized
aatttaggtagtacatataagg

SEQ ID NO: 1172660 - DNA, 22 bp, Artificial Sequence
  chemically synthesized
atttaggtagtacatataagga

SEQ ID NO: 1172661 - DNA, 22 bp, Artificial Sequence
  chemically synthesized
gccacaatgtgagattccttat

SEQ ID NO: 1172662 - DNA, 22 bp, Artificial Sequence
  chemically synthesized
aggtagtacatataaggaatct

SEQ ID NO: 1172663 - DNA, 22 bp, Artificial Sequence
  chemically synthesized
ggtagtacatataaggaatctc

SEQ ID NO: 1172664 - DNA, 22 bp, Artificial Sequence
  chemically synthesized
cagtatgctagccacaatgtga

SEQ ID NO: 1172665 - DNA, 22 bp, Artificial Sequence
  chemically synthesized
acagtatgctagccacaatgtg

SEQ ID NO: 1172666 - DNA, 22 bp, Artificial Sequence
  chemically synthesized
tacagtatgctagccacaatgt

SEQ ID NO: 1172667 - DNA, 22 bp, Artificial Sequence
  chemically synthesized
ttacagtatgctagccacaatg

SEQ ID NO: 1172668 - DNA, 22 bp, Artificial Sequence
  chemically synthesized
agtttttacagtatgctagcca

SEQ ID NO: 1172669 - DNA, 22 bp, Artificial Sequence
  chemically synthesized
ttaagtttttacagtatgctag

SEQ ID NO: 1172670 - DNA, 22 bp, Artificial Sequence
  chemically synthesized
attaagtttttacagtatgcta

SEQ ID NO: 1172671 - DNA, 22 bp, Artificial Sequence
  chemically synthesized
acattgtggctagcatactgta

SEQ ID NO: 1172672 - DNA, 22 bp, Artificial Sequence
  chemically synthesized
tggctagcatactgtaaaaact

SEQ ID NO: 1172673 - DNA, 22 bp, Artificial Sequence
  chemically synthesized
aacaaacatttattaagttttt

SEQ ID NO: 1172674 - DNA, 22 bp, Artificial Sequence
  chemically synthesized
gcatactgtaaaaacttaataa

SEQ ID NO: 1172675 - DNA, 22 bp, Artificial Sequence
  chemically synthesized
ttcaacaaacatttattaagtt

SEQ ID NO: 1172676 - DNA, 22 bp, Artificial Sequence
  chemically synthesized
gttcaacaaacatttattaagt

SEQ ID NO: 1172677 - DNA, 22 bp, Artificial Sequence
  chemically synthesized
taaaaacttaataaatgtttgt

SEQ ID NO: 1172678 - DNA, 22 bp, Artificial Sequence
  chemically synthesized
aataaatgtttgttgaacaaat

SEQ ID NO: 1172679 - DNA, 22 bp, Artificial Sequence
  chemically synthesized
ataaatgtttgttgaacaaatt

SEQ ID NO: 1172680 - DNA, 22 bp, Artificial Sequence
  chemically synthesized
tgaaatgacacataatttgttc

SEQ ID NO: 1172681 - DNA, 22 bp, Artificial Sequence
  chemically synthesized
ggttatgaaatgacacataatt

SEQ ID NO: 1172682 - DNA, 22 bp, Artificial Sequence
  chemically synthesized
gttgaacaaattatgtgtcatt

SEQ ID NO: 1172683 - DNA, 22 bp, Artificial Sequence
  chemically synthesized
gttgggttatgaaatgacacat

SEQ ID NO: 1172684 - DNA, 22 bp, Artificial Sequence
  chemically synthesized
ttgaacaaattatgtgtcattt

SEQ ID NO: 1172685 - DNA, 22 bp, Artificial Sequence
  chemically synthesized
aacaaattatgtgtcatttcat

SEQ ID NO: 1172686 - DNA, 22 bp, Artificial Sequence
  chemically synthesized
atatatgttggttgggttatga

SEQ ID NO: 1172687 - DNA, 22 bp, Artificial Sequence
  chemically synthesized
tgtgtcatttcataacccaacc

SEQ ID NO: 1172688 - DNA, 22 bp, Artificial Sequence
  chemically synthesized
cataacccaaccaacatatatc

SEQ ID NO: 1172689 - DNA, 22 bp, Artificial Sequence
  chemically synthesized
ataacccaaccaacatatatca

SEQ ID NO: 1172690 - DNA, 22 bp, Artificial Sequence
  chemically synthesized
catatatcacaaccagtatcct

SEQ ID NO: 1172691 - DNA, 22 bp, Artificial Sequence
  chemically synthesized
tgcatatatcacaaccagtatc

SEQ ID NO: 1172692 - DNA, 22 bp, Artificial Sequence
  chemically synthesized
ccaaatgtattctgcatatatc

SEQ ID NO: 1172693 - DNA, 22 bp, Artificial Sequence
  chemically synthesized
aattgccaaatgtattctgcat

SEQ ID NO: 1172694 - DNA, 22 bp, Artificial Sequence
  chemically synthesized
gttgtgatatatgcagaataca

SEQ ID NO: 1172695 - DNA, 22 bp, Artificial Sequence
  chemically synthesized
tgatatatgcagaatacatttg

SEQ ID NO: 1172696 - DNA, 22 bp, Artificial Sequence
  chemically synthesized
gtaacactcaattgccaaatgt

SEQ ID NO: 1172697 - DNA, 22 bp, Artificial Sequence
  chemically synthesized
ataatatattggtaacactcaa

SEQ ID NO: 1172698 - DNA, 22 bp, Artificial Sequence
  chemically synthesized
gataatatattggtaacactca

SEQ ID NO: 1172699 - DNA, 22 bp, Artificial Sequence
  chemically synthesized
ggcaattgagtgttaccaatat

SEQ ID NO: 1172700 - DNA, 22 bp, Artificial Sequence
  chemically synthesized
gcaattgagtgttaccaatata

SEQ ID NO: 1172701 - DNA, 22 bp, Artificial Sequence
  chemically synthesized
gcatgtttgataatatattggt

SEQ ID NO: 1172702 - DNA, 22 bp, Artificial Sequence
  chemically synthesized
tagcatgtttgataatatattg

SEQ ID NO: 1172703 - DNA, 22 bp, Artificial Sequence
  chemically synthesized
tctagcatgtttgataatatat

SEQ ID NO: 1172704 - DNA, 22 bp, Artificial Sequence
  chemically synthesized
ctctagcatgtttgataatata

SEQ ID NO: 1172705 - DNA, 22 bp, Artificial Sequence
  chemically synthesized
agtgttaccaatatattatcaa

SEQ ID NO: 1172706 - DNA, 22 bp, Artificial Sequence
  chemically synthesized
cacttctctagcatgtttgata

SEQ ID NO: 1172707 - DNA, 22 bp, Artificial Sequence
  chemically synthesized
ccaatatattatcaaacatgct

SEQ ID NO: 1172708 - DNA, 22 bp, Artificial Sequence
  chemically synthesized
ggtacactacacttctctagca

SEQ ID NO: 1172709 - DNA, 22 bp, Artificial Sequence
  chemically synthesized
tcggtacactacacttctctag

SEQ ID NO: 1172710 - DNA, 22 bp, Artificial Sequence
  chemically synthesized
tcaaacatgctagagaagtgta

SEQ ID NO: 1172711 - DNA, 22 bp, Artificial Sequence
  chemically synthesized
attctcggtacactacacttct

SEQ ID NO: 1172712 - DNA, 22 bp, Artificial Sequence
  chemically synthesized
aattctcggtacactacacttc

SEQ ID NO: 1172713 - DNA, 22 bp, Artificial Sequence
  chemically synthesized
ttaattctcggtacactacact

SEQ ID NO: 1172714 - DNA, 22 bp, Artificial Sequence
  chemically synthesized
gagaagtgtagtgtaccgagaa

SEQ ID NO: 1172715 - DNA, 22 bp, Artificial Sequence
  chemically synthesized
cacagcccatattcttaattct

SEQ ID NO: 1172716 - DNA, 22 bp, Artificial Sequence
  chemically synthesized
attccacagcccatattcttaa

SEQ ID NO: 1172717 - DNA, 22 bp, Artificial Sequence
  chemically synthesized
gattccacagcccatattctta

SEQ ID NO: 1172718 - DNA, 22 bp, Artificial Sequence
  chemically synthesized
tgattccacagcccatattctt

SEQ ID NO: 1172719 - DNA, 22 bp, Artificial Sequence
  chemically synthesized
gatattttgattccacagccca

SEQ ID NO: 1172720 - DNA, 22 bp, Artificial Sequence
  chemically synthesized
agaatatgggctgtggaatcaa

SEQ ID NO: 1172721 - DNA, 22 bp, Artificial Sequence
  chemically synthesized
agtctagatattttgattccac

SEQ ID NO: 1172722 - DNA, 22 bp, Artificial Sequence
  chemically synthesized
gagtctagatattttgattcca

SEQ ID NO: 1172723 - DNA, 22 bp, Artificial Sequence
  chemically synthesized
tggaatcaaaatatctagactc

SEQ ID NO: 1172724 - DNA, 22 bp, Artificial Sequence
  chemically synthesized
agtggtacagaaaagaatttga

SEQ ID NO: 1172725 - DNA, 22 bp, Artificial Sequence
  chemically synthesized
aggttcagtggtacagaaaaga

SEQ ID NO: 1172726 - DNA, 22 bp, Artificial Sequence
  chemically synthesized
gactcaaattcttttctgtacc

SEQ ID NO: 1172727 - DNA, 22 bp, Artificial Sequence
  chemically synthesized
aaattcttttctgtaccactga

SEQ ID NO: 1172728 - DNA, 22 bp, Artificial Sequence
  chemically synthesized
ttttctgtaccactgaacctta

SEQ ID NO: 1172729 - DNA, 22 bp, Artificial Sequence
  chemically synthesized
agacgagaacactaaggttcag

SEQ ID NO: 1172730 - DNA, 22 bp, Artificial Sequence
  chemically synthesized
cagacgagaacactaaggttca

SEQ ID NO: 1172731 - DNA, 22 bp, Artificial Sequence
  chemically synthesized
ttctgtaccactgaaccttagt

SEQ ID NO: 1172732 - DNA, 22 bp, Artificial Sequence
  chemically synthesized
tcagacgagaacactaaggttc

SEQ ID NO: 1172733 - DNA, 22 bp, Artificial Sequence
  chemically synthesized
tctgtaccactgaaccttagtg

SEQ ID NO: 1172734 - DNA, 22 bp, Artificial Sequence
  chemically synthesized
ctgtaccactgaaccttagtgt

SEQ ID NO: 1172735 - DNA, 22 bp, Artificial Sequence
  chemically synthesized
tgtaccactgaaccttagtgtt

SEQ ID NO: 1172736 - DNA, 22 bp, Artificial Sequence
  chemically synthesized
taccactgaaccttagtgttct

SEQ ID NO: 1172737 - DNA, 22 bp, Artificial Sequence
  chemically synthesized
ccattttcagacgagaacacta

SEQ ID NO: 1172738 - DNA, 22 bp, Artificial Sequence
  chemically synthesized
ttcccattttcagacgagaaca

SEQ ID NO: 1172739 - DNA, 22 bp, Artificial Sequence
  chemically synthesized
ttattcccattttcagacgaga

SEQ ID NO: 1172740 - DNA, 22 bp, Artificial Sequence
  chemically synthesized
aaccttagtgttctcgtctgaa

SEQ ID NO: 1172741 - DNA, 22 bp, Artificial Sequence
  chemically synthesized
gttattcccattttcagacgag

SEQ ID NO: 1172742 - DNA, 22 bp, Artificial Sequence
  chemically synthesized
ttgttattcccattttcagacg

SEQ ID NO: 1172743 - DNA, 22 bp, Artificial Sequence
  chemically synthesized
agtgttctcgtctgaaaatggg

SEQ ID NO: 1172744 - DNA, 22 bp, Artificial Sequence
  chemically synthesized
gtgttctcgtctgaaaatggga

SEQ ID NO: 1172745 - DNA, 22 bp, Artificial Sequence
  chemically synthesized
tattcttgttattcccattttc

SEQ ID NO: 1172746 - DNA, 22 bp, Artificial Sequence
  chemically synthesized
atattcttgttattcccatttt

SEQ ID NO: 1172747 - DNA, 22 bp, Artificial Sequence
  chemically synthesized
tcgtctgaaaatgggaataaca

SEQ ID NO: 1172748 - DNA, 22 bp, Artificial Sequence
  chemically synthesized
gtctgaaaatgggaataacaag

SEQ ID NO: 1172749 - DNA, 22 bp, Artificial Sequence
  chemically synthesized
ggagtttatattcttgttattc

SEQ ID NO: 1172750 - DNA, 22 bp, Artificial Sequence
  chemically synthesized
aaaatgggaataacaagaatat

SEQ ID NO: 1172751 - DNA, 22 bp, Artificial Sequence
  chemically synthesized
ccaacattaggagtttatattc

SEQ ID NO: 1172752 - DNA, 22 bp, Artificial Sequence
  chemically synthesized
accaacattaggagtttatatt

SEQ ID NO: 1172753 - DNA, 22 bp, Artificial Sequence
  chemically synthesized
gcttaccaacattaggagttta

SEQ ID NO: 1172754 - DNA, 22 bp, Artificial Sequence
  chemically synthesized
agcttaccaacattaggagttt

SEQ ID NO: 1172755 - DNA, 22 bp, Artificial Sequence
  chemically synthesized
acttagcttaccaacattagga

SEQ ID NO: 1172756 - DNA, 22 bp, Artificial Sequence
  chemically synthesized
aacttagcttaccaacattagg

SEQ ID NO: 1172757 - DNA, 22 bp, Artificial Sequence
  chemically synthesized
acatgtttaacttagcttacca

SEQ ID NO: 1172758 - DNA, 22 bp, Artificial Sequence
  chemically synthesized
ttaacatgtttaacttagctta

SEQ ID NO: 1172759 - DNA, 22 bp, Artificial Sequence
  chemically synthesized
ctaatgttggtaagctaagtta

SEQ ID NO: 1172760 - DNA, 22 bp, Artificial Sequence
  chemically synthesized
atgttggtaagctaagttaaac

SEQ ID NO: 1172761 - DNA, 22 bp, Artificial Sequence
  chemically synthesized
gtaagctaagttaaacatgtta

SEQ ID NO: 1172762 - DNA, 22 bp, Artificial Sequence
  chemically synthesized
tatgtatattattaacatgttt

SEQ ID NO: 1172763 - DNA, 22 bp, Artificial Sequence
  chemically synthesized
catgctgtatgtatattattaa

SEQ ID NO: 1172764 - DNA, 22 bp, Artificial Sequence
  chemically synthesized
agttaaacatgttaataatata

SEQ ID NO: 1172765 - DNA, 22 bp, Artificial Sequence
  chemically synthesized
ccatgctgtatgtatattatta

SEQ ID NO: 1172766 - DNA, 22 bp, Artificial Sequence
  chemically synthesized
ttccatgctgtatgtatattat

SEQ ID NO: 1172767 - DNA, 22 bp, Artificial Sequence
  chemically synthesized
aacatgttaataatatacatac

SEQ ID NO: 1172768 - DNA, 22 bp, Artificial Sequence
  chemically synthesized
ataatatacatacagcatggaa

SEQ ID NO: 1172769 - DNA, 22 bp, Artificial Sequence
  chemically synthesized
aagaccaggttcttccatgctg

SEQ ID NO: 1172770 - DNA, 22 bp, Artificial Sequence
  chemically synthesized
ctgaagaccaggttcttccatg

SEQ ID NO: 1172771 - DNA, 22 bp, Artificial Sequence
  chemically synthesized
actgaagaccaggttcttccat

SEQ ID NO: 1172772 - DNA, 22 bp, Artificial Sequence
  chemically synthesized
aggatttactgaagaccaggtt

SEQ ID NO: 1172773 - DNA, 22 bp, Artificial Sequence
  chemically synthesized
ttgaggatttactgaagaccag

SEQ ID NO: 1172774 - DNA, 22 bp, Artificial Sequence
  chemically synthesized
gttgaggatttactgaagacca

SEQ ID NO: 1172775 - DNA, 22 bp, Artificial Sequence
  chemically synthesized
gtcttcagtaaatcctcaacaa

SEQ ID NO: 1172776 - DNA, 22 bp, Artificial Sequence
  chemically synthesized
gcacaataacaaaatttgttga

SEQ ID NO: 1172777 - DNA, 22 bp, Artificial Sequence
  chemically synthesized
cagtaaatcctcaacaaatttt

SEQ ID NO: 1172778 - DNA, 22 bp, Artificial Sequence
  chemically synthesized
agtaaatcctcaacaaattttg

SEQ ID NO: 1172779 - DNA, 22 bp, Artificial Sequence
  chemically synthesized
attggcacaataacaaaatttg

SEQ ID NO: 1172780 - DNA, 22 bp, Artificial Sequence
  chemically synthesized
aattggcacaataacaaaattt

SEQ ID NO: 1172781 - DNA, 22 bp, Artificial Sequence
  chemically synthesized
aacaaattttgttattgtgcca

SEQ ID NO: 1172782 - DNA, 22 bp, Artificial Sequence
  chemically synthesized
agtgtgccttaattggcacaat

SEQ ID NO: 1172783 - DNA, 22 bp, Artificial Sequence
  chemically synthesized
aagtgtgccttaattggcacaa

SEQ ID NO: 1172784 - DNA, 22 bp, Artificial Sequence
  chemically synthesized
ttaagtgtgccttaattggcac

SEQ ID NO: 1172785 - DNA, 22 bp, Artificial Sequence
  chemically synthesized
cttaagtgtgccttaattggca

SEQ ID NO: 1172786 - DNA, 22 bp, Artificial Sequence
  chemically synthesized
cttcttaagtgtgccttaattg

SEQ ID NO: 1172787 - DNA, 22 bp, Artificial Sequence
  chemically synthesized
tgttattgtgccaattaaggca

SEQ ID NO: 1172788 - DNA, 22 bp, Artificial Sequence
  chemically synthesized
gttattgtgccaattaaggcac

SEQ ID NO: 1172789 - DNA, 22 bp, Artificial Sequence
  chemically synthesized
ttattgtgccaattaaggcaca

SEQ ID NO: 1172790 - DNA, 22 bp, Artificial Sequence
  chemically synthesized
ttgtgccaattaaggcacactt

SEQ ID NO: 1172791 - DNA, 22 bp, Artificial Sequence
  chemically synthesized
tgccaattaaggcacacttaag

SEQ ID NO: 1172792 - DNA, 22 bp, Artificial Sequence
  chemically synthesized
aatacataagacattgcttctt

SEQ ID NO: 1172793 - DNA, 22 bp, Artificial Sequence
  chemically synthesized
aggcacacttaagaagcaatgt

SEQ ID NO: 1172794 - DNA, 22 bp, Artificial Sequence
  chemically synthesized
attgaatacataagacattgct

SEQ ID NO: 1172795 - DNA, 22 bp, Artificial Sequence
  chemically synthesized
gtattaattgaatacataagac

SEQ ID NO: 1172796 - DNA, 22 bp, Artificial Sequence
  chemically synthesized
agtattaattgaatacataaga

SEQ ID NO: 1172797 - DNA, 22 bp, Artificial Sequence
  chemically synthesized
aagaagcaatgtcttatgtatt

SEQ ID NO: 1172798 - DNA, 22 bp, Artificial Sequence
  chemically synthesized
tagtattaattgaatacataag

SEQ ID NO: 1172799 - DNA, 22 bp, Artificial Sequence
  chemically synthesized
agaagcaatgtcttatgtattc

SEQ ID NO: 1172800 - DNA, 22 bp, Artificial Sequence
  chemically synthesized
attttagtattaattgaataca

SEQ ID NO: 1172801 - DNA, 22 bp, Artificial Sequence
  chemically synthesized
atgtattcaattaatactaaaa

SEQ ID NO: 1172802 - DNA, 22 bp, Artificial Sequence
  chemically synthesized
tgtattcaattaatactaaaat

SEQ ID NO: 1172803 - DNA, 22 bp, Artificial Sequence
  chemically synthesized
aattaatactaaaatgagcaca

SEQ ID NO: 1172804 - DNA, 22 bp, Artificial Sequence
  chemically synthesized
atactaaaatgagcacatattg

SEQ ID NO: 1172805 - DNA, 22 bp, Artificial Sequence
  chemically synthesized
atacatgaatccacaatatgtg

SEQ ID NO: 1172806 - DNA, 22 bp, Artificial Sequence
  chemically synthesized
aaatgagcacatattgtggatt

SEQ ID NO: 1172807 - DNA, 22 bp, Artificial Sequence
  chemically synthesized
atacatagttgatacatgaatc

SEQ ID NO: 1172808 - DNA, 22 bp, Artificial Sequence
  chemically synthesized
tggattcatgtatcaactatgt

SEQ ID NO: 1172809 - DNA, 22 bp, Artificial Sequence
  chemically synthesized
agtgagtgattaatacatagtt

SEQ ID NO: 1172810 - DNA, 22 bp, Artificial Sequence
  chemically synthesized
atgtatcaactatgtattaatc

SEQ ID NO: 1172811 - DNA, 22 bp, Artificial Sequence
  chemically synthesized
tgatctaagtgagtgattaata

SEQ ID NO: 1172812 - DNA, 22 bp, Artificial Sequence
  chemically synthesized
tatccattgtgatctaagtgag

SEQ ID NO: 1172813 - DNA, 22 bp, Artificial Sequence
  chemically synthesized
tgtattaatcactcacttagat

SEQ ID NO: 1172814 - DNA, 22 bp, Artificial Sequence
  chemically synthesized
atatccattgtgatctaagtga

SEQ ID NO: 1172815 - DNA, 22 bp, Artificial Sequence
  chemically synthesized
tatatccattgtgatctaagtg

SEQ ID NO: 1172816 - DNA, 22 bp, Artificial Sequence
  chemically synthesized
tttatatccattgtgatctaag

SEQ ID NO: 1172817 - DNA, 22 bp, Artificial Sequence
  chemically synthesized
ttctttatatccattgtgatct

SEQ ID NO: 1172818 - DNA, 22 bp, Artificial Sequence
  chemically synthesized
atcactcacttagatcacaatg

SEQ ID NO: 1172819 - DNA, 22 bp, Artificial Sequence
  chemically synthesized
attctttatatccattgtgatc

SEQ ID NO: 1172820 - DNA, 22 bp, Artificial Sequence
  chemically synthesized
tattctttatatccattgtgat

SEQ ID NO: 1172821 - DNA, 22 bp, Artificial Sequence
  chemically synthesized
ttattctttatatccattgtga

SEQ ID NO: 1172822 - DNA, 22 bp, Artificial Sequence
  chemically synthesized
ttttattctttatatccattgt

SEQ ID NO: 1172823 - DNA, 22 bp, Artificial Sequence
  chemically synthesized
acttagatcacaatggatataa

SEQ ID NO: 1172824 - DNA, 22 bp, Artificial Sequence
  chemically synthesized
agatcacaatggatataaagaa

SEQ ID NO: 1172825 - DNA, 22 bp, Artificial Sequence
  chemically synthesized
gatcacaatggatataaagaat

SEQ ID NO: 1172826 - DNA, 22 bp, Artificial Sequence
  chemically synthesized
agggcagctcttttattcttta

SEQ ID NO: 1172827 - DNA, 22 bp, Artificial Sequence
  chemically synthesized
gagggcagctcttttattcttt

SEQ ID NO: 1172828 - DNA, 22 bp, Artificial Sequence
  chemically synthesized
cttgagggcagctcttttattc

SEQ ID NO: 1172829 - DNA, 22 bp, Artificial Sequence
  chemically synthesized
ccttgagggcagctcttttatt

SEQ ID NO: 1172830 - DNA, 22 bp, Artificial Sequence
  chemically synthesized
tgatttccttgagggcagctct

SEQ ID NO: 1172831 - DNA, 22 bp, Artificial Sequence
  chemically synthesized
gactatgatttccttgagggca

SEQ ID NO: 1172832 - DNA, 22 bp, Artificial Sequence
  chemically synthesized
cactggactatgatttccttga

SEQ ID NO: 1172833 - DNA, 22 bp, Artificial Sequence
  chemically synthesized
ctccactggactatgatttcct

SEQ ID NO: 1172834 - DNA, 22 bp, Artificial Sequence
  chemically synthesized
cctccactggactatgatttcc

SEQ ID NO: 1172835 - DNA, 22 bp, Artificial Sequence
  chemically synthesized
ccctcaaggaaatcatagtcca

SEQ ID NO: 1172836 - DNA, 22 bp, Artificial Sequence
  chemically synthesized
taggtttcctccactggactat

SEQ ID NO: 1172837 - DNA, 22 bp, Artificial Sequence
  chemically synthesized
gtaggtttcctccactggacta

SEQ ID NO: 1172838 - DNA, 22 bp, Artificial Sequence
  chemically synthesized
aaggaaatcatagtccagtgga

SEQ ID NO: 1172839 - DNA, 22 bp, Artificial Sequence
  chemically synthesized
cttgtaggtttcctccactgga

SEQ ID NO: 1172840 - DNA, 22 bp, Artificial Sequence
  chemically synthesized
acttgtaggtttcctccactgg

SEQ ID NO: 1172841 - DNA, 22 bp, Artificial Sequence
  chemically synthesized
cttacttgtaggtttcctccac

SEQ ID NO: 1172842 - DNA, 22 bp, Artificial Sequence
  chemically synthesized
gcttacttgtaggtttcctcca

SEQ ID NO: 1172843 - DNA, 22 bp, Artificial Sequence
  chemically synthesized
tgcttacttgtaggtttcctcc

SEQ ID NO: 1172844 - DNA, 22 bp, Artificial Sequence
  chemically synthesized
ttgcttacttgtaggtttcctc

SEQ ID NO: 1172845 - DNA, 22 bp, Artificial Sequence
  chemically synthesized
tttgcttacttgtaggtttcct

SEQ ID NO: 1172846 - DNA, 22 bp, Artificial Sequence
  chemically synthesized
tgagagcacatatattttttgc

SEQ ID NO: 1172847 - DNA, 22 bp, Artificial Sequence
  chemically synthesized
atgagagcacatatattttttg

SEQ ID NO: 1172848 - DNA, 22 bp, Artificial Sequence
  chemically synthesized
ttatgagagcacatatattttt

SEQ ID NO: 1172849 - DNA, 22 bp, Artificial Sequence
  chemically synthesized
caagtaagcaaaaaatatatgt

SEQ ID NO: 1172850 - DNA, 22 bp, Artificial Sequence
  chemically synthesized
gacgtgttcttatgagagcaca

SEQ ID NO: 1172851 - DNA, 22 bp, Artificial Sequence
  chemically synthesized
ggacgtgttcttatgagagcac

SEQ ID NO: 1172852 - DNA, 22 bp, Artificial Sequence
  chemically synthesized
ttggacgtgttcttatgagagc

SEQ ID NO: 1172853 - DNA, 22 bp, Artificial Sequence
  chemically synthesized
cttggacgtgttcttatgagag

SEQ ID NO: 1172854 - DNA, 22 bp, Artificial Sequence
  chemically synthesized
ttcttggacgtgttcttatgag

SEQ ID NO: 1172855 - DNA, 22 bp, Artificial Sequence
  chemically synthesized
cttcttggacgtgttcttatga

SEQ ID NO: 1172856 - DNA, 22 bp, Artificial Sequence
  chemically synthesized
catttcttcttggacgtgttct

SEQ ID NO: 1172857 - DNA, 22 bp, Artificial Sequence
  chemically synthesized
ccatttcttcttggacgtgttc

SEQ ID NO: 1172858 - DNA, 22 bp, Artificial Sequence
  chemically synthesized
tcataagaacacgtccaagaag

SEQ ID NO: 1172859 - DNA, 22 bp, Artificial Sequence
  chemically synthesized
aatgcttccatttcttcttgga

SEQ ID NO: 1172860 - DNA, 22 bp, Artificial Sequence
  chemically synthesized
ataagaacacgtccaagaagaa

SEQ ID NO: 1172861 - DNA, 22 bp, Artificial Sequence
  chemically synthesized
caatgcttccatttcttcttgg

SEQ ID NO: 1172862 - DNA, 22 bp, Artificial Sequence
  chemically synthesized
tcaatgcttccatttcttcttg

SEQ ID NO: 1172863 - DNA, 22 bp, Artificial Sequence
  chemically synthesized
ttcaatgcttccatttcttctt

SEQ ID NO: 1172864 - DNA, 22 bp, Artificial Sequence
  chemically synthesized
ccttttcaatgcttccatttct

SEQ ID NO: 1172865 - DNA, 22 bp, Artificial Sequence
  chemically synthesized
cccttttcaatgcttccatttc

SEQ ID NO: 1172866 - DNA, 22 bp, Artificial Sequence
  chemically synthesized
gcttcccttttcaatgcttcca

SEQ ID NO: 1172867 - DNA, 22 bp, Artificial Sequence
  chemically synthesized
cgcttcccttttcaatgcttcc

SEQ ID NO: 1172868 - DNA, 22 bp, Artificial Sequence
  chemically synthesized
atatttcgcttcccttttcaat

SEQ ID NO: 1172869 - DNA, 22 bp, Artificial Sequence
  chemically synthesized
agttcatatttcgcttcccttt

SEQ ID NO: 1172870 - DNA, 22 bp, Artificial Sequence
  chemically synthesized
tcagttcatatttcgcttccct

SEQ ID NO: 1172871 - DNA, 22 bp, Artificial Sequence
  chemically synthesized
ctcagttcatatttcgcttccc

SEQ ID NO: 1172872 - DNA, 22 bp, Artificial Sequence
  chemically synthesized
cttctcagttcatatttcgctt

SEQ ID NO: 1172873 - DNA, 22 bp, Artificial Sequence
  chemically synthesized
ctacttctcagttcatatttcg

SEQ ID NO: 1172874 - DNA, 22 bp, Artificial Sequence
  chemically synthesized
aaaagggaagcgaaatatgaac

SEQ ID NO: 1172875 - DNA, 22 bp, Artificial Sequence
  chemically synthesized
gtagtgtgtaaaaattcctact

SEQ ID NO: 1172876 - DNA, 22 bp, Artificial Sequence
  chemically synthesized
agtagtgtgtaaaaattcctac

SEQ ID NO: 1172877 - DNA, 22 bp, Artificial Sequence
  chemically synthesized
agaagtaggaatttttacacac

SEQ ID NO: 1172878 - DNA, 22 bp, Artificial Sequence
  chemically synthesized
acaaggtcttagtagtgtgtaa

SEQ ID NO: 1172879 - DNA, 22 bp, Artificial Sequence
  chemically synthesized
gacaaggtcttagtagtgtgta

SEQ ID NO: 1172880 - DNA, 22 bp, Artificial Sequence
  chemically synthesized
acttgacaaggtcttagtagtg

SEQ ID NO: 1172881 - DNA, 22 bp, Artificial Sequence
  chemically synthesized
ttacacactactaagaccttgt

SEQ ID NO: 1172882 - DNA, 22 bp, Artificial Sequence
  chemically synthesized
tacacactactaagaccttgtc

SEQ ID NO: 1172883 - DNA, 22 bp, Artificial Sequence
  chemically synthesized
acacactactaagaccttgtca

SEQ ID NO: 1172884 - DNA, 22 bp, Artificial Sequence
  chemically synthesized
cacactactaagaccttgtcaa

SEQ ID NO: 1172885 - DNA, 22 bp, Artificial Sequence
  chemically synthesized
ctaagaccttgtcaagttagtg

SEQ ID NO: 1172886 - DNA, 22 bp, Artificial Sequence
  chemically synthesized
agaccttgtcaagttagtgtct

SEQ ID NO: 1172887 - DNA, 22 bp, Artificial Sequence
  chemically synthesized
gtcaagttagtgtcttccctta

SEQ ID NO: 1172888 - DNA, 22 bp, Artificial Sequence
  chemically synthesized
gacatggcgccataagggaaga

SEQ ID NO: 1172889 - DNA, 22 bp, Artificial Sequence
  chemically synthesized
tcaagttagtgtcttcccttat

SEQ ID NO: 1172890 - DNA, 22 bp, Artificial Sequence
  chemically synthesized
gtgtcttcccttatggcgccat

SEQ ID NO: 1172891 - DNA, 22 bp, Artificial Sequence
  chemically synthesized
agtgtattagacatggcgccat

SEQ ID NO: 1172892 - DNA, 22 bp, Artificial Sequence
  chemically synthesized
cccttatggcgccatgtctaat

SEQ ID NO: 1172893 - DNA, 22 bp, Artificial Sequence
  chemically synthesized
ccttatggcgccatgtctaata

SEQ ID NO: 1172894 - DNA, 22 bp, Artificial Sequence
  chemically synthesized
atggcgccatgtctaatacact

SEQ ID NO: 1172895 - DNA, 22 bp, Artificial Sequence
  chemically synthesized
tggcgccatgtctaatacactc

SEQ ID NO: 1172896 - DNA, 22 bp, Artificial Sequence
  chemically synthesized
atgaaacaacgctgagtgtatt

SEQ ID NO: 1172897 - DNA, 22 bp, Artificial Sequence
  chemically synthesized
atacactcagcgttgtttcatc

SEQ ID NO: 1172898 - DNA, 22 bp, Artificial Sequence
  chemically synthesized
ccgggaaaacacgttgatgaaa

SEQ ID NO: 1172899 - DNA, 22 bp, Artificial Sequence
  chemically synthesized
agcgttgtttcatcaacgtgtt

SEQ ID NO: 1172900 - DNA, 22 bp, Artificial Sequence
  chemically synthesized
tttcatcaacgtgttttcccgg

SEQ ID NO: 1172901 - DNA, 22 bp, Artificial Sequence
  chemically synthesized
ccccaaaagattaccgggaaaa

SEQ ID NO: 1172902 - DNA, 22 bp, Artificial Sequence
  chemically synthesized
catcaacgtgttttcccggtaa

SEQ ID NO: 1172903 - DNA, 22 bp, Artificial Sequence
  chemically synthesized
atcaacgtgttttcccggtaat

SEQ ID NO: 1172904 - DNA, 22 bp, Artificial Sequence
  chemically synthesized
tcaattcccccaaaagattacc

SEQ ID NO: 1172905 - DNA, 22 bp, Artificial Sequence
  chemically synthesized
actgtcaattcccccaaaagat

SEQ ID NO: 1172906 - DNA, 22 bp, Artificial Sequence
  chemically synthesized
gactgtcaattcccccaaaaga

SEQ ID NO: 1172907 - DNA, 22 bp, Artificial Sequence
  chemically synthesized
tcccggtaatcttttgggggaa

SEQ ID NO: 1172908 - DNA, 22 bp, Artificial Sequence
  chemically synthesized
cccggtaatcttttgggggaat

SEQ ID NO: 1172909 - DNA, 22 bp, Artificial Sequence
  chemically synthesized
ccggtaatcttttgggggaatt

SEQ ID NO: 1172910 - DNA, 22 bp, Artificial Sequence
  chemically synthesized
atggtttgactgtcaattcccc

SEQ ID NO: 1172911 - DNA, 22 bp, Artificial Sequence
  chemically synthesized
ttgggggaattgacagtcaaac

SEQ ID NO: 1172912 - DNA, 22 bp, Artificial Sequence
  chemically synthesized
tgggggaattgacagtcaaacc

SEQ ID NO: 1172913 - DNA, 22 bp, Artificial Sequence
  chemically synthesized
gggggaattgacagtcaaacca

SEQ ID NO: 1172914 - DNA, 22 bp, Artificial Sequence
  chemically synthesized
ggggaattgacagtcaaaccat

SEQ ID NO: 1172915 - DNA, 22 bp, Artificial Sequence
  chemically synthesized
acagtcaaaccatgaacattgg

SEQ ID NO: 1172916 - DNA, 22 bp, Artificial Sequence
  chemically synthesized
ataaatataaatgtagtaccaa

SEQ ID NO: 1172917 - DNA, 22 bp, Artificial Sequence
  chemically synthesized
cataaatataaatgtagtacca

SEQ ID NO: 1172918 - DNA, 22 bp, Artificial Sequence
  chemically synthesized
tcataaatataaatgtagtacc

SEQ ID NO: 1172919 - DNA, 22 bp, Artificial Sequence
  chemically synthesized
gtactacatttatatttatgaa

SEQ ID NO: 1172920 - DNA, 22 bp, Artificial Sequence
  chemically synthesized
catccagaatgatctttcataa

SEQ ID NO: 1172921 - DNA, 22 bp, Artificial Sequence
  chemically synthesized
catttatatttatgaaagatca

SEQ ID NO: 1172922 - DNA, 22 bp, Artificial Sequence
  chemically synthesized
cacactgcatccagaatgatct

SEQ ID NO: 1172923 - DNA, 22 bp, Artificial Sequence
  chemically synthesized
atatttatgaaagatcattctg

SEQ ID NO: 1172924 - DNA, 22 bp, Artificial Sequence
  chemically synthesized
tatttatgaaagatcattctgg

SEQ ID NO: 1172925 - DNA, 22 bp, Artificial Sequence
  chemically synthesized
tccacactgcatccagaatgat

SEQ ID NO: 1172926 - DNA, 22 bp, Artificial Sequence
  chemically synthesized
atgaaagatcattctggatgca

SEQ ID NO: 1172927 - DNA, 22 bp, Artificial Sequence
  chemically synthesized
tgaaagatcattctggatgcag

SEQ ID NO: 1172928 - DNA, 22 bp, Artificial Sequence
  chemically synthesized
catagatcattctccacactgc

SEQ ID NO: 1172929 - DNA, 22 bp, Artificial Sequence
  chemically synthesized
ccatagatcattctccacactg

SEQ ID NO: 1172930 - DNA, 22 bp, Artificial Sequence
  chemically synthesized
atcttccatagatcattctcca

SEQ ID NO: 1172931 - DNA, 22 bp, Artificial Sequence
  chemically synthesized
tggatgcagtgtggagaatgat

SEQ ID NO: 1172932 - DNA, 22 bp, Artificial Sequence
  chemically synthesized
gatgcagtgtggagaatgatct

SEQ ID NO: 1172933 - DNA, 22 bp, Artificial Sequence
  chemically synthesized
ccctcatcttccatagatcatt

SEQ ID NO: 1172934 - DNA, 22 bp, Artificial Sequence
  chemically synthesized
ctgccctcatcttccatagatc

SEQ ID NO: 1172935 - DNA, 22 bp, Artificial Sequence
  chemically synthesized
gctgccctcatcttccatagat

SEQ ID NO: 1172936 - DNA, 22 bp, Artificial Sequence
  chemically synthesized
gtcttgctgccctcatcttcca

SEQ ID NO: 1172937 - DNA, 22 bp, Artificial Sequence
  chemically synthesized
actggtcttgctgccctcatct

SEQ ID NO: 1172938 - DNA, 22 bp, Artificial Sequence
  chemically synthesized
tggaagatgagggcagcaagac

SEQ ID NO: 1172939 - DNA, 22 bp, Artificial Sequence
  chemically synthesized
gatatctaactggtcttgctgc

SEQ ID NO: 1172940 - DNA, 22 bp, Artificial Sequence
  chemically synthesized
actggatatctaactggtcttg

SEQ ID NO: 1172941 - DNA, 22 bp, Artificial Sequence
  chemically synthesized
tcattcactggatatctaactg

SEQ ID NO: 1172942 - DNA, 22 bp, Artificial Sequence
  chemically synthesized
catactgtcattcactggatat

SEQ ID NO: 1172943 - DNA, 22 bp, Artificial Sequence
  chemically synthesized
ttacatactgtcattcactgga

SEQ ID NO: 1172944 - DNA, 22 bp, Artificial Sequence
  chemically synthesized
actattacatactgtcattcac

SEQ ID NO: 1172945 - DNA, 22 bp, Artificial Sequence
  chemically synthesized
tgactattacatactgtcattc

SEQ ID NO: 1172946 - DNA, 22 bp, Artificial Sequence
  chemically synthesized
gatatccagtgaatgacagtat

SEQ ID NO: 1172947 - DNA, 22 bp, Artificial Sequence
  chemically synthesized
tggcagcagtcaggttctgact

SEQ ID NO: 1172948 - DNA, 22 bp, Artificial Sequence
  chemically synthesized
atggcagcagtcaggttctgac

SEQ ID NO: 1172949 - DNA, 22 bp, Artificial Sequence
  chemically synthesized
ttatggcagcagtcaggttctg

SEQ ID NO: 1172950 - DNA, 22 bp, Artificial Sequence
  chemically synthesized
agttcttatggcagcagtcagg

SEQ ID NO: 1172951 - DNA, 22 bp, Artificial Sequence
  chemically synthesized
gagttcttatggcagcagtcag

SEQ ID NO: 1172952 - DNA, 22 bp, Artificial Sequence
  chemically synthesized
ttgagttcttatggcagcagtc

SEQ ID NO: 1172953 - DNA, 22 bp, Artificial Sequence
  chemically synthesized
aacagttcttgagttcttatgg

SEQ ID NO: 1172954 - DNA, 22 bp, Artificial Sequence
  chemically synthesized
caacagttcttgagttcttatg

SEQ ID NO: 1172955 - DNA, 22 bp, Artificial Sequence
  chemically synthesized
tcaacagttcttgagttcttat

SEQ ID NO: 1172956 - DNA, 22 bp, Artificial Sequence
  chemically synthesized
ttcaacagttcttgagttctta

SEQ ID NO: 1172957 - DNA, 22 bp, Artificial Sequence
  chemically synthesized
tttcaacagttcttgagttctt

SEQ ID NO: 1172958 - DNA, 22 bp, Artificial Sequence
  chemically synthesized
actgctgccataagaactcaag

SEQ ID NO: 1172959 - DNA, 22 bp, Artificial Sequence
  chemically synthesized
attttttcaacagttcttgagt

SEQ ID NO: 1172960 - DNA, 22 bp, Artificial Sequence
  chemically synthesized
ctgccataagaactcaagaact

SEQ ID NO: 1172961 - DNA, 22 bp, Artificial Sequence
  chemically synthesized
ccataagaactcaagaactgtt

SEQ ID NO: 1172962 - DNA, 22 bp, Artificial Sequence
  chemically synthesized
atcaattcattttttcaacagt

SEQ ID NO: 1172963 - DNA, 22 bp, Artificial Sequence
  chemically synthesized
aagaactgttgaaaaaatgaat

SEQ ID NO: 1172964 - DNA, 22 bp, Artificial Sequence
  chemically synthesized
agtatatatctcatcaattcat

SEQ ID NO: 1172965 - DNA, 22 bp, Artificial Sequence
  chemically synthesized
ttgaaaaaatgaattgatgaga

SEQ ID NO: 1172966 - DNA, 22 bp, Artificial Sequence
  chemically synthesized
aaaaaatgaattgatgagatat

SEQ ID NO: 1172967 - DNA, 22 bp, Artificial Sequence
  chemically synthesized
aagtcctcagtatatatctcat

SEQ ID NO: 1172968 - DNA, 22 bp, Artificial Sequence
  chemically synthesized
ttgaagtcctcagtatatatct

SEQ ID NO: 1172969 - DNA, 22 bp, Artificial Sequence
  chemically synthesized
gttgaagtcctcagtatatatc

SEQ ID NO: 1172970 - DNA, 22 bp, Artificial Sequence
  chemically synthesized
tgttgaagtcctcagtatatat

SEQ ID NO: 1172971 - DNA, 22 bp, Artificial Sequence
  chemically synthesized
ttttgttgaagtcctcagtata

SEQ ID NO: 1172972 - DNA, 22 bp, Artificial Sequence
  chemically synthesized
tgttttgttgaagtcctcagta

SEQ ID NO: 1172973 - DNA, 22 bp, Artificial Sequence
  chemically synthesized
ctgttttgttgaagtcctcagt

SEQ ID NO: 1172974 - DNA, 22 bp, Artificial Sequence
  chemically synthesized
atgagatatatactgaggactt

SEQ ID NO: 1172975 - DNA, 22 bp, Artificial Sequence
  chemically synthesized
cttctgttttgttgaagtcctc

SEQ ID NO: 1172976 - DNA, 22 bp, Artificial Sequence
  chemically synthesized
cctacttctgttttgttgaagt

SEQ ID NO: 1172977 - DNA, 22 bp, Artificial Sequence
  chemically synthesized
ccctacttctgttttgttgaag

SEQ ID NO: 1172978 - DNA, 22 bp, Artificial Sequence
  chemically synthesized
tccctacttctgttttgttgaa

SEQ ID NO: 1172979 - DNA, 22 bp, Artificial Sequence
  chemically synthesized
tttccctacttctgttttgttg

SEQ ID NO: 1172980 - DNA, 22 bp, Artificial Sequence
  chemically synthesized
aggacttcaacaaaacagaagt

SEQ ID NO: 1172981 - DNA, 22 bp, Artificial Sequence
  chemically synthesized
cccctctttccctacttctgtt

SEQ ID NO: 1172982 - DNA, 22 bp, Artificial Sequence
  chemically synthesized
caacaaaacagaagtagggaaa

SEQ ID NO: 1172983 - DNA, 22 bp, Artificial Sequence
  chemically synthesized
aacaaaacagaagtagggaaag

SEQ ID NO: 1172984 - DNA, 22 bp, Artificial Sequence
  chemically synthesized
tcatctccccctctttccctac

SEQ ID NO: 1172985 - DNA, 22 bp, Artificial Sequence
  chemically synthesized
agatcatatatgtcagaagtct

SEQ ID NO: 1172986 - DNA, 22 bp, Artificial Sequence
  chemically synthesized
taagatcatatatgtcagaagt

SEQ ID NO: 1172987 - DNA, 22 bp, Artificial Sequence
  chemically synthesized
ctgacatatatgatcttagagt

SEQ ID NO: 1172988 - DNA, 22 bp, Artificial Sequence
  chemically synthesized
tgacatatatgatcttagagtg

SEQ ID NO: 1172989 - DNA, 22 bp, Artificial Sequence
  chemically synthesized
acatatatgatcttagagtgta

SEQ ID NO: 1172990 - DNA, 22 bp, Artificial Sequence
  chemically synthesized
tagtgcccacgtccaatacact

SEQ ID NO: 1172991 - DNA, 22 bp, Artificial Sequence
  chemically synthesized
atagtgcccacgtccaatacac

SEQ ID NO: 1172992 - DNA, 22 bp, Artificial Sequence
  chemically synthesized
tcatatttatagtgcccacgtc

SEQ ID NO: 1172993 - DNA, 22 bp, Artificial Sequence
  chemically synthesized
agagtgtattggacgtgggcac

SEQ ID NO: 1172994 - DNA, 22 bp, Artificial Sequence
  chemically synthesized
gtcatatttatagtgcccacgt

SEQ ID NO: 1172995 - DNA, 22 bp, Artificial Sequence
  chemically synthesized
gagtgtattggacgtgggcact

SEQ ID NO: 1172996 - DNA, 22 bp, Artificial Sequence
  chemically synthesized
tccttgtcatatttatagtgcc

SEQ ID NO: 1172997 - DNA, 22 bp, Artificial Sequence
  chemically synthesized
tactgtccttgtcatatttata

SEQ ID NO: 1172998 - DNA, 22 bp, Artificial Sequence
  chemically synthesized
gacgtgggcactataaatatga

SEQ ID NO: 1172999 - DNA, 22 bp, Artificial Sequence
  chemically synthesized
aacaactgtactgtccttgtca

SEQ ID NO: 1173000 - DNA, 22 bp, Artificial Sequence
  chemically synthesized
tcaacaactgtactgtccttgt

SEQ ID NO: 1173001 - DNA, 22 bp, Artificial Sequence
  chemically synthesized
taaatatgacaaggacagtaca

SEQ ID NO: 1173002 - DNA, 22 bp, Artificial Sequence
  chemically synthesized
ggaatcattctcaacaactgta

SEQ ID NO: 1173003 - DNA, 22 bp, Artificial Sequence
  chemically synthesized
ttgagaatgattcctaggtgtc

SEQ ID NO: 1173004 - DNA, 22 bp, Artificial Sequence
  chemically synthesized
agaatgattcctaggtgtcttt

SEQ ID NO: 1173005 - DNA, 22 bp, Artificial Sequence
  chemically synthesized
aagtataataataaaaaaagac

SEQ ID NO: 1173006 - DNA, 22 bp, Artificial Sequence
  chemically synthesized
gaagtataataataaaaaaaga

SEQ ID NO: 1173007 - DNA, 22 bp, Artificial Sequence
  chemically synthesized
ctaggtgtctttttttattatt

SEQ ID NO: 1173008 - DNA, 22 bp, Artificial Sequence
  chemically synthesized
ggtgtctttttttattattata

SEQ ID NO: 1173009 - DNA, 22 bp, Artificial Sequence
  chemically synthesized
tttttattattatacttcaagt

SEQ ID NO: 1173010 - DNA, 22 bp, Artificial Sequence
  chemically synthesized
ttttattattatacttcaagtt

SEQ ID NO: 1173011 - DNA, 22 bp, Artificial Sequence
  chemically synthesized
tttattattatacttcaagttc

SEQ ID NO: 1173012 - DNA, 22 bp, Artificial Sequence
  chemically synthesized
ttattattatacttcaagttct

SEQ ID NO: 1173013 - DNA, 22 bp, Artificial Sequence
  chemically synthesized
cacatgtatcccagaacttgaa

SEQ ID NO: 1173014 - DNA, 22 bp, Artificial Sequence
  chemically synthesized
tattattatacttcaagttctg

SEQ ID NO: 1173015 - DNA, 22 bp, Artificial Sequence
  chemically synthesized
attattatacttcaagttctgg

SEQ ID NO: 1173016 - DNA, 22 bp, Artificial Sequence
  chemically synthesized
tgcacatgtatcccagaacttg

SEQ ID NO: 1173017 - DNA, 22 bp, Artificial Sequence
  chemically synthesized
ttattatacttcaagttctggg

SEQ ID NO: 1173018 - DNA, 22 bp, Artificial Sequence
  chemically synthesized
ttatacttcaagttctgggata

SEQ ID NO: 1173019 - DNA, 22 bp, Artificial Sequence
  chemically synthesized
tacttcaagttctgggatacat

SEQ ID NO: 1173020 - DNA, 22 bp, Artificial Sequence
  chemically synthesized
cacgttctgcacatgtatccca

SEQ ID NO: 1173021 - DNA, 22 bp, Artificial Sequence
  chemically synthesized
caagttctgggatacatgtgca

SEQ ID NO: 1173022 - DNA, 22 bp, Artificial Sequence
  chemically synthesized
aagttctgggatacatgtgcag

SEQ ID NO: 1173023 - DNA, 22 bp, Artificial Sequence
  chemically synthesized
tgggatacatgtgcagaacgtg

SEQ ID NO: 1173024 - DNA, 22 bp, Artificial Sequence
  chemically synthesized
tgtaacaaacctgcacgttctg

SEQ ID NO: 1173025 - DNA, 22 bp, Artificial Sequence
  chemically synthesized
ggatacatgtgcagaacgtgca

SEQ ID NO: 1173026 - DNA, 22 bp, Artificial Sequence
  chemically synthesized
atgtaacaaacctgcacgttct

SEQ ID NO: 1173027 - DNA, 22 bp, Artificial Sequence
  chemically synthesized
tagcacatgtatatttatgtaa

SEQ ID NO: 1173028 - DNA, 22 bp, Artificial Sequence
  chemically synthesized
gttacataaatatacatgtgct

SEQ ID NO: 1173029 - DNA, 22 bp, Artificial Sequence
  chemically synthesized
ttacataaatatacatgtgcta

SEQ ID NO: 1173030 - DNA, 22 bp, Artificial Sequence
  chemically synthesized
cataaatatacatgtgctatag

SEQ ID NO: 1173031 - DNA, 22 bp, Artificial Sequence
  chemically synthesized
atgggtgcagcaaaccactata

SEQ ID NO: 1173032 - DNA, 22 bp, Artificial Sequence
  chemically synthesized
gatgacgggttgatgggtgcag

SEQ ID NO: 1173033 - DNA, 22 bp, Artificial Sequence
  chemically synthesized
tagtggtttgctgcacccatca

SEQ ID NO: 1173034 - DNA, 22 bp, Artificial Sequence
  chemically synthesized
aaacctggatgacgggttgatg

SEQ ID NO: 1173035 - DNA, 22 bp, Artificial Sequence
  chemically synthesized
aaaacctggatgacgggttgat

SEQ ID NO: 1173036 - DNA, 22 bp, Artificial Sequence
  chemically synthesized
gctgcacccatcaacccgtcat

SEQ ID NO: 1173037 - DNA, 22 bp, Artificial Sequence
  chemically synthesized
ctgcacccatcaacccgtcatc

SEQ ID NO: 1173038 - DNA, 22 bp, Artificial Sequence
  chemically synthesized
cacccatcaacccgtcatccag

SEQ ID NO: 1173039 - DNA, 22 bp, Artificial Sequence
  chemically synthesized
atgcatgcagggcttaaaacct

SEQ ID NO: 1173040 - DNA, 22 bp, Artificial Sequence
  chemically synthesized
ggataaatacctaatgcatgca

SEQ ID NO: 1173041 - DNA, 22 bp, Artificial Sequence
  chemically synthesized
taagccctgcatgcattaggta

SEQ ID NO: 1173042 - DNA, 22 bp, Artificial Sequence
  chemically synthesized
aagccctgcatgcattaggtat

SEQ ID NO: 1173043 - DNA, 22 bp, Artificial Sequence
  chemically synthesized
agccctgcatgcattaggtatt

SEQ ID NO: 1173044 - DNA, 22 bp, Artificial Sequence
  chemically synthesized
catgcattaggtatttatccta

SEQ ID NO: 1173045 - DNA, 22 bp, Artificial Sequence
  chemically synthesized
ggtatttatcctaatgctctcc

SEQ ID NO: 1173046 - DNA, 22 bp, Artificial Sequence
  chemically synthesized
atcctaatgctctccctaccct

SEQ ID NO: 1173047 - DNA, 22 bp, Artificial Sequence
  chemically synthesized
tcctaatgctctccctaccctt

SEQ ID NO: 1173048 - DNA, 22 bp, Artificial Sequence
  chemically synthesized
ggagtggagggcaagggtaggg

SEQ ID NO: 1173049 - DNA, 22 bp, Artificial Sequence
  chemically synthesized
tctgggagtggagggcaagggt

SEQ ID NO: 1173050 - DNA, 22 bp, Artificial Sequence
  chemically synthesized
atgctctccctacccttgccct

SEQ ID NO: 1173051 - DNA, 22 bp, Artificial Sequence
  chemically synthesized
tccctacccttgccctccactc

SEQ ID NO: 1173052 - DNA, 22 bp, Artificial Sequence
  chemically synthesized
cctacccttgccctccactccc

SEQ ID NO: 1173053 - DNA, 22 bp, Artificial Sequence
  chemically synthesized
cccttgccctccactcccagac

SEQ ID NO: 1173054 - DNA, 22 bp, Artificial Sequence
  chemically synthesized
gccctccactcccagacaggcg

SEQ ID NO: 1173055 - DNA, 22 bp, Artificial Sequence
  chemically synthesized
ccctccactcccagacaggcga

SEQ ID NO: 1173056 - DNA, 22 bp, Artificial Sequence
  chemically synthesized
cactcccagacaggcgatggtg

SEQ ID NO: 1173057 - DNA, 22 bp, Artificial Sequence
  chemically synthesized
ccagacaggcgatggtgtgtga

SEQ ID NO: 1173058 - DNA, 22 bp, Artificial Sequence
  chemically synthesized
aacaatgagaacacatggacac

SEQ ID NO: 1173059 - DNA, 22 bp, Artificial Sequence
  chemically synthesized
ccctccctgtgtccatgtgttc

SEQ ID NO: 1173060 - DNA, 22 bp, Artificial Sequence
  chemically synthesized
cctgtgtccatgtgttctcatt

SEQ ID NO: 1173061 - DNA, 22 bp, Artificial Sequence
  chemically synthesized
tgtccatgtgttctcattgttc

SEQ ID NO: 1173062 - DNA, 22 bp, Artificial Sequence
  chemically synthesized
ataagtgggagttgaacaatga

SEQ ID NO: 1173063 - DNA, 22 bp, Artificial Sequence
  chemically synthesized
actcataagtgggagttgaaca

SEQ ID NO: 1173064 - DNA, 22 bp, Artificial Sequence
  chemically synthesized
tcactcataagtgggagttgaa

SEQ ID NO: 1173065 - DNA, 22 bp, Artificial Sequence
  chemically synthesized
tcattgttcaactcccacttat

SEQ ID NO: 1173066 - DNA, 22 bp, Artificial Sequence
  chemically synthesized
attgttcaactcccacttatga

SEQ ID NO: 1173067 - DNA, 22 bp, Artificial Sequence
  chemically synthesized
ttcaactcccacttatgagtga

SEQ ID NO: 1173068 - DNA, 22 bp, Artificial Sequence
  chemically synthesized
aactcccacttatgagtgagaa

SEQ ID NO: 1173069 - DNA, 22 bp, Artificial Sequence
  chemically synthesized
ccacttatgagtgagaacatgc

SEQ ID NO: 1173070 - DNA, 22 bp, Artificial Sequence
  chemically synthesized
atgagtgagaacatgcggtatt

SEQ ID NO: 1173071 - DNA, 22 bp, Artificial Sequence
  chemically synthesized
tgagtgagaacatgcggtattt

SEQ ID NO: 1173072 - DNA, 22 bp, Artificial Sequence
  chemically synthesized
acccaggaacagaaaaccaaat

SEQ ID NO: 1173073 - DNA, 22 bp, Artificial Sequence
  chemically synthesized
agcaaactaacccaggaacaga

SEQ ID NO: 1173074 - DNA, 22 bp, Artificial Sequence
  chemically synthesized
taagcaaactaacccaggaaca

SEQ ID NO: 1173075 - DNA, 22 bp, Artificial Sequence
  chemically synthesized
ggttttctgttcctgggttagt

SEQ ID NO: 1173076 - DNA, 22 bp, Artificial Sequence
  chemically synthesized
gttttctgttcctgggttagtt

SEQ ID NO: 1173077 - DNA, 22 bp, Artificial Sequence
  chemically synthesized
tctgttcctgggttagtttgct

SEQ ID NO: 1173078 - DNA, 22 bp, Artificial Sequence
  chemically synthesized
ctgttcctgggttagtttgctt

SEQ ID NO: 1173079 - DNA, 22 bp, Artificial Sequence
  chemically synthesized
tgttcctgggttagtttgctta

SEQ ID NO: 1173080 - DNA, 22 bp, Artificial Sequence
  chemically synthesized
gaaaccatcattctaagcaaac

SEQ ID NO: 1173081 - DNA, 22 bp, Artificial Sequence
  chemically synthesized
ttcctgggttagtttgcttaga

SEQ ID NO: 1173082 - DNA, 22 bp, Artificial Sequence
  chemically synthesized
ctgggttagtttgcttagaatg

SEQ ID NO: 1173083 - DNA, 22 bp, Artificial Sequence
  chemically synthesized
ggttagtttgcttagaatgatg

SEQ ID NO: 1173084 - DNA, 22 bp, Artificial Sequence
  chemically synthesized
gtttgcttagaatgatggtttc

SEQ ID NO: 1173085 - DNA, 22 bp, Artificial Sequence
  chemically synthesized
gcttagaatgatggtttccagc

SEQ ID NO: 1173086 - DNA, 22 bp, Artificial Sequence
  chemically synthesized
cttagaatgatggtttccagct

SEQ ID NO: 1173087 - DNA, 22 bp, Artificial Sequence
  chemically synthesized
agaatgatggtttccagctcca

SEQ ID NO: 1173088 - DNA, 22 bp, Artificial Sequence
  chemically synthesized
cagggacatggatggagctgga

SEQ ID NO: 1173089 - DNA, 22 bp, Artificial Sequence
  chemically synthesized
gaatgatggtttccagctccat

SEQ ID NO: 1173090 - DNA, 22 bp, Artificial Sequence
  chemically synthesized
gcagggacatggatggagctgg

SEQ ID NO: 1173091 - DNA, 22 bp, Artificial Sequence
  chemically synthesized
tgcagggacatggatggagctg

SEQ ID NO: 1173092 - DNA, 22 bp, Artificial Sequence
  chemically synthesized
tcctttgcagggacatggatgg

SEQ ID NO: 1173093 - DNA, 22 bp, Artificial Sequence
  chemically synthesized
gtcctttgcagggacatggatg

SEQ ID NO: 1173094 - DNA, 22 bp, Artificial Sequence
  chemically synthesized
ttgtcctttgcagggacatgga

SEQ ID NO: 1173095 - DNA, 22 bp, Artificial Sequence
  chemically synthesized
ccagctccatccatgtccctgc

SEQ ID NO: 1173096 - DNA, 22 bp, Artificial Sequence
  chemically synthesized
cagctccatccatgtccctgca

SEQ ID NO: 1173097 - DNA, 22 bp, Artificial Sequence
  chemically synthesized
catccatgtccctgcaaaggac

SEQ ID NO: 1173098 - DNA, 22 bp, Artificial Sequence
  chemically synthesized
caaaggacaagaactcattcta

SEQ ID NO: 1173099 - DNA, 22 bp, Artificial Sequence
  chemically synthesized
tgcgaccataaaatagaatgag

SEQ ID NO: 1173100 - DNA, 22 bp, Artificial Sequence
  chemically synthesized
attctattttatggtcgcatag

SEQ ID NO: 1173101 - DNA, 22 bp, Artificial Sequence
  chemically synthesized
tattttatggtcgcatagtatt

SEQ ID NO: 1173102 - DNA, 22 bp, Artificial Sequence
  chemically synthesized
ttttatggtcgcatagtattcc

SEQ ID NO: 1173103 - DNA, 22 bp, Artificial Sequence
  chemically synthesized
tatggtcgcatagtattccatg

SEQ ID NO: 1173104 - DNA, 22 bp, Artificial Sequence
  chemically synthesized
atggtcgcatagtattccatgt

SEQ ID NO: 1173105 - DNA, 22 bp, Artificial Sequence
  chemically synthesized
tggtcgcatagtattccatgta

SEQ ID NO: 1173106 - DNA, 22 bp, Artificial Sequence
  chemically synthesized
gataaagaaaatgtggcacata

SEQ ID NO: 1173107 - DNA, 22 bp, Artificial Sequence
  chemically synthesized
catgtatatgtgccacattttc

SEQ ID NO: 1173108 - DNA, 22 bp, Artificial Sequence
  chemically synthesized
ccatcaatgatagactggataa

SEQ ID NO: 1173109 - DNA, 22 bp, Artificial Sequence
  chemically synthesized
accattcccatcaatgatagac

SEQ ID NO: 1173110 - DNA, 22 bp, Artificial Sequence
  chemically synthesized
tctttatccagtctatcattga

SEQ ID NO: 1173111 - DNA, 22 bp, Artificial Sequence
  chemically synthesized
ctttatccagtctatcattgat

SEQ ID NO: 1173112 - DNA, 22 bp, Artificial Sequence
  chemically synthesized
ctgaccattcccatcaatgata

SEQ ID NO: 1173113 - DNA, 22 bp, Artificial Sequence
  chemically synthesized
tttatccagtctatcattgatg

SEQ ID NO: 1173114 - DNA, 22 bp, Artificial Sequence
  chemically synthesized
tatccagtctatcattgatggg

SEQ ID NO: 1173115 - DNA, 22 bp, Artificial Sequence
  chemically synthesized
atccagtctatcattgatggga

SEQ ID NO: 1173116 - DNA, 22 bp, Artificial Sequence
  chemically synthesized
tccagtctatcattgatgggaa

SEQ ID NO: 1173117 - DNA, 22 bp, Artificial Sequence
  chemically synthesized
gaactcctgaccattcccatca

SEQ ID NO: 1173118 - DNA, 22 bp, Artificial Sequence
  chemically synthesized
gtctcgaactcctgaccattcc

SEQ ID NO: 1173119 - DNA, 22 bp, Artificial Sequence
  chemically synthesized
tcattgatgggaatggtcagga

SEQ ID NO: 1173120 - DNA, 22 bp, Artificial Sequence
  chemically synthesized
atgggaatggtcaggagttcga

SEQ ID NO: 1173121 - DNA, 22 bp, Artificial Sequence
  chemically synthesized
gccatgctggtctcgaactcct

SEQ ID NO: 1173122 - DNA, 22 bp, Artificial Sequence
  chemically synthesized
accatgttggccatgctggtct

SEQ ID NO: 1173123 - DNA, 22 bp, Artificial Sequence
  chemically synthesized
caccatgttggccatgctggtc

SEQ ID NO: 1173124 - DNA, 22 bp, Artificial Sequence
  chemically synthesized
gagaccagcatggccaacatgg

SEQ ID NO: 1173125 - DNA, 22 bp, Artificial Sequence
  chemically synthesized
gtagagacagggtttcaccatg

SEQ ID NO: 1173126 - DNA, 22 bp, Artificial Sequence
  chemically synthesized
agtagagacagggtttcaccat

SEQ ID NO: 1173127 - DNA, 22 bp, Artificial Sequence
  chemically synthesized
tagtagagacagggtttcacca

SEQ ID NO: 1173128 - DNA, 22 bp, Artificial Sequence
  chemically synthesized
ttttagtagagacagggtttca

SEQ ID NO: 1173129 - DNA, 22 bp, Artificial Sequence
  chemically synthesized
ttattttagtagagacagggtt

SEQ ID NO: 1173130 - DNA, 22 bp, Artificial Sequence
  chemically synthesized
gttattttagtagagacagggt

SEQ ID NO: 1173131 - DNA, 22 bp, Artificial Sequence
  chemically synthesized
tgttattttagtagagacaggg

SEQ ID NO: 1173132 - DNA, 22 bp, Artificial Sequence
  chemically synthesized
ttgttattttagtagagacagg

SEQ ID NO: 1173133 - DNA, 22 bp, Artificial Sequence
  chemically synthesized
atttttgttattttagtagaga

SEQ ID NO: 1173134 - DNA, 22 bp, Artificial Sequence
  chemically synthesized
gctaatttttgttattttagta

SEQ ID NO: 1173135 - DNA, 22 bp, Artificial Sequence
  chemically synthesized
tctctactaaaataacaaaaat

SEQ ID NO: 1173136 - DNA, 22 bp, Artificial Sequence
  chemically synthesized
tactaaaataacaaaaattagc

SEQ ID NO: 1173137 - DNA, 22 bp, Artificial Sequence
  chemically synthesized
ctaaaataacaaaaattagcca

SEQ ID NO: 1173138 - DNA, 22 bp, Artificial Sequence
  chemically synthesized
aaataacaaaaattagccaggc

SEQ ID NO: 1173139 - DNA, 22 bp, Artificial Sequence
  chemically synthesized
caggcacccaccaccacgcctg

SEQ ID NO: 1173140 - DNA, 22 bp, Artificial Sequence
  chemically synthesized
gccaggcgtggtggtgggtgcc

SEQ ID NO: 1173141 - DNA, 22 bp, Artificial Sequence
  chemically synthesized
ccaagtagatgggactacaggc

SEQ ID NO: 1173142 - DNA, 22 bp, Artificial Sequence
  chemically synthesized
agcctcccaagtagatgggact

SEQ ID NO: 1173143 - DNA, 22 bp, Artificial Sequence
  chemically synthesized
ctcagcctcccaagtagatggg

SEQ ID NO: 1173144 - DNA, 22 bp, Artificial Sequence
  chemically synthesized
cctcagcctcccaagtagatgg

SEQ ID NO: 1173145 - DNA, 22 bp, Artificial Sequence
  chemically synthesized
cttcctcagcctcccaagtaga

SEQ ID NO: 1173146 - DNA, 22 bp, Artificial Sequence
  chemically synthesized
tacttcctcagcctcccaagta

SEQ ID NO: 1173147 - DNA, 22 bp, Artificial Sequence
  chemically synthesized
tagtcccatctacttgggaggc

SEQ ID NO: 1173148 - DNA, 22 bp, Artificial Sequence
  chemically synthesized
aacgattctacttcctcagcct

SEQ ID NO: 1173149 - DNA, 22 bp, Artificial Sequence
  chemically synthesized
cttgggaggctgaggaagtaga

SEQ ID NO: 1173150 - DNA, 22 bp, Artificial Sequence
  chemically synthesized
ccaggttcaacgattctacttc

SEQ ID NO: 1173151 - DNA, 22 bp, Artificial Sequence
  chemically synthesized
gggaggctgaggaagtagaatc

SEQ ID NO: 1173152 - DNA, 22 bp, Artificial Sequence
  chemically synthesized
ggaggctgaggaagtagaatcg

SEQ ID NO: 1173153 - DNA, 22 bp, Artificial Sequence
  chemically synthesized
cctcccaggttcaacgattcta

SEQ ID NO: 1173154 - DNA, 22 bp, Artificial Sequence
  chemically synthesized
aggaagtagaatcgttgaacct

SEQ ID NO: 1173155 - DNA, 22 bp, Artificial Sequence
  chemically synthesized
cacccctgcctcccaggttcaa

SEQ ID NO: 1173156 - DNA, 22 bp, Artificial Sequence
  chemically synthesized
actgcacccctgcctcccaggt

SEQ ID NO: 1173157 - DNA, 22 bp, Artificial Sequence
  chemically synthesized
agctcactgcacccctgcctcc

SEQ ID NO: 1173158 - DNA, 22 bp, Artificial Sequence
  chemically synthesized
cagctcactgcacccctgcctc

SEQ ID NO: 1173159 - DNA, 22 bp, Artificial Sequence
  chemically synthesized
aacctgggaggcaggggtgcag

SEQ ID NO: 1173160 - DNA, 22 bp, Artificial Sequence
  chemically synthesized
acccaatttcagctcactgcac

SEQ ID NO: 1173161 - DNA, 22 bp, Artificial Sequence
  chemically synthesized
ggaggcaggggtgcagtgagct

SEQ ID NO: 1173162 - DNA, 22 bp, Artificial Sequence
  chemically synthesized
attgacccaatttcagctcact

SEQ ID NO: 1173163 - DNA, 22 bp, Artificial Sequence
  chemically synthesized
gagttcattgacccaatttcag

SEQ ID NO: 1173164 - DNA, 22 bp, Artificial Sequence
  chemically synthesized
cccaggttagagttcattgacc

SEQ ID NO: 1173165 - DNA, 22 bp, Artificial Sequence
  chemically synthesized
ttgcccaggttagagttcattg

SEQ ID NO: 1173166 - DNA, 22 bp, Artificial Sequence
  chemically synthesized
tgttgcccaggttagagttcat

SEQ ID NO: 1173167 - DNA, 22 bp, Artificial Sequence
  chemically synthesized
aaattgggtcaatgaactctaa

SEQ ID NO: 1173168 - DNA, 22 bp, Artificial Sequence
  chemically synthesized
ctctgttgcccaggttagagtt

SEQ ID NO: 1173169 - DNA, 22 bp, Artificial Sequence
  chemically synthesized
ttgctctgttgcccaggttaga

SEQ ID NO: 1173170 - DNA, 22 bp, Artificial Sequence
  chemically synthesized
ggtcaatgaactctaacctggg

SEQ ID NO: 1173171 - DNA, 22 bp, Artificial Sequence
  chemically synthesized
gagacagattattgctctgttg

SEQ ID NO: 1173172 - DNA, 22 bp, Artificial Sequence
  chemically synthesized
ggagacagattattgctctgtt

SEQ ID NO: 1173173 - DNA, 22 bp, Artificial Sequence
  chemically synthesized
tggagacagattattgctctgt

SEQ ID NO: 1173174 - DNA, 22 bp, Artificial Sequence
  chemically synthesized
taacctgggcaacagagcaata

SEQ ID NO: 1173175 - DNA, 22 bp, Artificial Sequence
  chemically synthesized
ttggagacagattattgctctg

SEQ ID NO: 1173176 - DNA, 22 bp, Artificial Sequence
  chemically synthesized
tttggagacagattattgctct

SEQ ID NO: 1173177 - DNA, 22 bp, Artificial Sequence
  chemically synthesized
acctgggcaacagagcaataat

SEQ ID NO: 1173178 - DNA, 22 bp, Artificial Sequence
  chemically synthesized
ttttggagacagattattgctc

SEQ ID NO: 1173179 - DNA, 22 bp, Artificial Sequence
  chemically synthesized
tttttggagacagattattgct

SEQ ID NO: 1173180 - DNA, 22 bp, Artificial Sequence
  chemically synthesized
ttttttggagacagattattgc

SEQ ID NO: 1173181 - DNA, 22 bp, Artificial Sequence
  chemically synthesized
tttttttggagacagattattg

SEQ ID NO: 1173182 - DNA, 22 bp, Artificial Sequence
  chemically synthesized
ttttttttggagacagattatt

SEQ ID NO: 1173183 - DNA, 22 bp, Artificial Sequence
  chemically synthesized
ggcaacagagcaataatctgtc

SEQ ID NO: 1173184 - DNA, 22 bp, Artificial Sequence
  chemically synthesized
tttttttttggagacagattat

SEQ ID NO: 1173185 - DNA, 22 bp, Artificial Sequence
  chemically synthesized
ttttttttttggagacagatta

SEQ ID NO: 1173186 - DNA, 22 bp, Artificial Sequence
  chemically synthesized
tttttttttttttggagacaga

SEQ ID NO: 1173187 - DNA, 22 bp, Artificial Sequence
  chemically synthesized
ctgtttttttttttttggagac

SEQ ID NO: 1173188 - DNA, 22 bp, Artificial Sequence
  chemically synthesized
gctgtttttttttttttggaga

SEQ ID NO: 1173189 - DNA, 22 bp, Artificial Sequence
  chemically synthesized
cttgctgtttttttttttttgg

SEQ ID NO: 1173190 - DNA, 22 bp, Artificial Sequence
  chemically synthesized
gcttgctgtttttttttttttg

SEQ ID NO: 1173191 - DNA, 22 bp, Artificial Sequence
  chemically synthesized
tgcttgctgttttttttttttt

SEQ ID NO: 1173192 - DNA, 22 bp, Artificial Sequence
  chemically synthesized
tctttgcttgctgttttttttt

SEQ ID NO: 1173193 - DNA, 22 bp, Artificial Sequence
  chemically synthesized
gtctttgcttgctgtttttttt

SEQ ID NO: 1173194 - DNA, 22 bp, Artificial Sequence
  chemically synthesized
tgtctttgcttgctgttttttt

SEQ ID NO: 1173195 - DNA, 22 bp, Artificial Sequence
  chemically synthesized
tctccaaaaaaaaaaaaacagc

SEQ ID NO: 1173196 - DNA, 22 bp, Artificial Sequence
  chemically synthesized
ctttgtctttgcttgctgtttt

SEQ ID NO: 1173197 - DNA, 22 bp, Artificial Sequence
  chemically synthesized
gctttgtctttgcttgctgttt

SEQ ID NO: 1173198 - DNA, 22 bp, Artificial Sequence
  chemically synthesized
caaaaaaaaaaaaacagcaagc

SEQ ID NO: 1173199 - DNA, 22 bp, Artificial Sequence
  chemically synthesized
acaaaaccttgctttgtctttg

SEQ ID NO: 1173200 - DNA, 22 bp, Artificial Sequence
  chemically synthesized
cctcacaaaaccttgctttgtc

SEQ ID NO: 1173201 - DNA, 22 bp, Artificial Sequence
  chemically synthesized
gcctcacaaaaccttgctttgt

SEQ ID NO: 1173202 - DNA, 22 bp, Artificial Sequence
  chemically synthesized
cttgcctcacaaaaccttgctt

SEQ ID NO: 1173203 - DNA, 22 bp, Artificial Sequence
  chemically synthesized
aattccttgcctcacaaaacct

SEQ ID NO: 1173204 - DNA, 22 bp, Artificial Sequence
  chemically synthesized
gaattccttgcctcacaaaacc

SEQ ID NO: 1173205 - DNA, 22 bp, Artificial Sequence
  chemically synthesized
tgaattccttgcctcacaaaac

SEQ ID NO: 1173206 - DNA, 22 bp, Artificial Sequence
  chemically synthesized
tgtgaggcaaggaattcaaaac

SEQ ID NO: 1173207 - DNA, 22 bp, Artificial Sequence
  chemically synthesized
ggtcatatggtggttttgaatt

SEQ ID NO: 1173208 - DNA, 22 bp, Artificial Sequence
  chemically synthesized
gtgaggcaaggaattcaaaacc

SEQ ID NO: 1173209 - DNA, 22 bp, Artificial Sequence
  chemically synthesized
gggtcatatggtggttttgaat

SEQ ID NO: 1173210 - DNA, 22 bp, Artificial Sequence
  chemically synthesized
tgaggcaaggaattcaaaacca

SEQ ID NO: 1173211 - DNA, 22 bp, Artificial Sequence
  chemically synthesized
ttgggtcatatggtggttttga

SEQ ID NO: 1173212 - DNA, 22 bp, Artificial Sequence
  chemically synthesized
aaaaccaccatatgacccaaga

SEQ ID NO: 1173213 - DNA, 22 bp, Artificial Sequence
  chemically synthesized
tgtatatgcccagaaggaggga

SEQ ID NO: 1173214 - DNA, 22 bp, Artificial Sequence
  chemically synthesized
gtgtatatgcccagaaggaggg

SEQ ID NO: 1173215 - DNA, 22 bp, Artificial Sequence
  chemically synthesized
tgtgtatatgcccagaaggagg

SEQ ID NO: 1173216 - DNA, 22 bp, Artificial Sequence
  chemically synthesized
ctttgtgtatatgcccagaagg

SEQ ID NO: 1173217 - DNA, 22 bp, Artificial Sequence
  chemically synthesized
cctttgtgtatatgcccagaag

SEQ ID NO: 1173218 - DNA, 22 bp, Artificial Sequence
  chemically synthesized
tcctttgtgtatatgcccagaa

SEQ ID NO: 1173219 - DNA, 22 bp, Artificial Sequence
  chemically synthesized
ttcctttgtgtatatgcccaga

SEQ ID NO: 1173220 - DNA, 22 bp, Artificial Sequence
  chemically synthesized
tttcctttgtgtatatgcccag

SEQ ID NO: 1173221 - DNA, 22 bp, Artificial Sequence
  chemically synthesized
ttttttcctttgtgtatatgcc

SEQ ID NO: 1173222 - DNA, 22 bp, Artificial Sequence
  chemically synthesized
tgttattttttcctttgtgtat

SEQ ID NO: 1173223 - DNA, 22 bp, Artificial Sequence
  chemically synthesized
cttctgggcatatacacaaagg

SEQ ID NO: 1173224 - DNA, 22 bp, Artificial Sequence
  chemically synthesized
ctgggcatatacacaaaggaaa

SEQ ID NO: 1173225 - DNA, 22 bp, Artificial Sequence
  chemically synthesized
tgggcatatacacaaaggaaaa

SEQ ID NO: 1173226 - DNA, 22 bp, Artificial Sequence
  chemically synthesized
ggcatatacacaaaggaaaaaa

SEQ ID NO: 1173227 - DNA, 22 bp, Artificial Sequence
  chemically synthesized
caaggttgtgttattttttcct

SEQ ID NO: 1173228 - DNA, 22 bp, Artificial Sequence
  chemically synthesized
acaaggttgtgttattttttcc

SEQ ID NO: 1173229 - DNA, 22 bp, Artificial Sequence
  chemically synthesized
tacaaggttgtgttattttttc

SEQ ID NO: 1173230 - DNA, 22 bp, Artificial Sequence
  chemically synthesized
aatgagcatagaagcccggata

SEQ ID NO: 1173231 - DNA, 22 bp, Artificial Sequence
  chemically synthesized
caatgagcatagaagcccggat

SEQ ID NO: 1173232 - DNA, 22 bp, Artificial Sequence
  chemically synthesized
gtaaagatatccgggcttctat

SEQ ID NO: 1173233 - DNA, 22 bp, Artificial Sequence
  chemically synthesized
taaagatatccgggcttctatg

SEQ ID NO: 1173234 - DNA, 22 bp, Artificial Sequence
  chemically synthesized
tgaacaatgcttcaatgagcat

SEQ ID NO: 1173235 - DNA, 22 bp, Artificial Sequence
  chemically synthesized
ctgtgaacaatgcttcaatgag

SEQ ID NO: 1173236 - DNA, 22 bp, Artificial Sequence
  chemically synthesized
gctactgtgaacaatgcttcaa

SEQ ID NO: 1173237 - DNA, 22 bp, Artificial Sequence
  chemically synthesized
ggctactgtgaacaatgcttca

SEQ ID NO: 1173238 - DNA, 22 bp, Artificial Sequence
  chemically synthesized
ctatgctcattgaagcattgtt

SEQ ID NO: 1173239 - DNA, 22 bp, Artificial Sequence
  chemically synthesized
tatgctcattgaagcattgttc

SEQ ID NO: 1173240 - DNA, 22 bp, Artificial Sequence
  chemically synthesized
tgctcattgaagcattgttcac

SEQ ID NO: 1173241 - DNA, 22 bp, Artificial Sequence
  chemically synthesized
catatcttggctactgtgaaca

SEQ ID NO: 1173242 - DNA, 22 bp, Artificial Sequence
  chemically synthesized
ccatatcttggctactgtgaac

SEQ ID NO: 1173243 - DNA, 22 bp, Artificial Sequence
  chemically synthesized
attgaagcattgttcacagtag

SEQ ID NO: 1173244 - DNA, 22 bp, Artificial Sequence
  chemically synthesized
tttccatatcttggctactgtg

SEQ ID NO: 1173245 - DNA, 22 bp, Artificial Sequence
  chemically synthesized
aagcattgttcacagtagccaa

SEQ ID NO: 1173246 - DNA, 22 bp, Artificial Sequence
  chemically synthesized
aacgttgtttccatatcttggc

SEQ ID NO: 1173247 - DNA, 22 bp, Artificial Sequence
  chemically synthesized
aaacgttgtttccatatcttgg

SEQ ID NO: 1173248 - DNA, 22 bp, Artificial Sequence
  chemically synthesized
ttcacagtagccaagatatgga

SEQ ID NO: 1173249 - DNA, 22 bp, Artificial Sequence
  chemically synthesized
acagtagccaagatatggaaac

SEQ ID NO: 1173250 - DNA, 22 bp, Artificial Sequence
  chemically synthesized
tccatggatacttaaacgttgt

SEQ ID NO: 1173251 - DNA, 22 bp, Artificial Sequence
  chemically synthesized
atccatggatacttaaacgttg

SEQ ID NO: 1173252 - DNA, 22 bp, Artificial Sequence
  chemically synthesized
atcatttatccatggatactta

SEQ ID NO: 1173253 - DNA, 22 bp, Artificial Sequence
  chemically synthesized
aatcatttatccatggatactt

SEQ ID NO: 1173254 - DNA, 22 bp, Artificial Sequence
  chemically synthesized
taatcatttatccatggatact

SEQ ID NO: 1173255 - DNA, 22 bp, Artificial Sequence
  chemically synthesized
aagtatccatggataaatgatt

SEQ ID NO: 1173256 - DNA, 22 bp, Artificial Sequence
  chemically synthesized
agtatccatggataaatgatta

SEQ ID NO: 1173257 - DNA, 22 bp, Artificial Sequence
  chemically synthesized
catatatgccataatgtcttta

SEQ ID NO: 1173258 - DNA, 22 bp, Artificial Sequence
  chemically synthesized
aattgcatatatgccataatgt

SEQ ID NO: 1173259 - DNA, 22 bp, Artificial Sequence
  chemically synthesized
aagacattatggcatatatgca

SEQ ID NO: 1173260 - DNA, 22 bp, Artificial Sequence
  chemically synthesized
aataatattcaattgcatatat

SEQ ID NO: 1173261 - DNA, 22 bp, Artificial Sequence
  chemically synthesized
aggactgaataatattcaattg

SEQ ID NO: 1173262 - DNA, 22 bp, Artificial Sequence
  chemically synthesized
tggcatatatgcaattgaatat

SEQ ID NO: 1173263 - DNA, 22 bp, Artificial Sequence
  chemically synthesized
aaggactgaataatattcaatt

SEQ ID NO: 1173264 - DNA, 22 bp, Artificial Sequence
  chemically synthesized
taaggactgaataatattcaat

SEQ ID NO: 1173265 - DNA, 22 bp, Artificial Sequence
  chemically synthesized
ttaaggactgaataatattcaa

SEQ ID NO: 1173266 - DNA, 22 bp, Artificial Sequence
  chemically synthesized
tttaaggactgaataatattca

SEQ ID NO: 1173267 - DNA, 22 bp, Artificial Sequence
  chemically synthesized
ttttaaggactgaataatattc

SEQ ID NO: 1173268 - DNA, 22 bp, Artificial Sequence
  chemically synthesized
tttttaaggactgaataatatt

SEQ ID NO: 1173269 - DNA, 22 bp, Artificial Sequence
  chemically synthesized
tttttttaaggactgaataata

SEQ ID NO: 1173270 - DNA, 22 bp, Artificial Sequence
  chemically synthesized
attctttttttaaggactgaat

SEQ ID NO: 1173271 - DNA, 22 bp, Artificial Sequence
  chemically synthesized
cattctttttttaaggactgaa

SEQ ID NO: 1173272 - DNA, 22 bp, Artificial Sequence
  chemically synthesized
aatattattcagtccttaaaaa

SEQ ID NO: 1173273 - DNA, 22 bp, Artificial Sequence
  chemically synthesized
ttcagtccttaaaaaaagaatg

SEQ ID NO: 1173274 - DNA, 22 bp, Artificial Sequence
  chemically synthesized
agtccttaaaaaaagaatgaaa

SEQ ID NO: 1173275 - DNA, 22 bp, Artificial Sequence
  chemically synthesized
tagcaaatggcaagatttcatt

SEQ ID NO: 1173276 - DNA, 22 bp, Artificial Sequence
  chemically synthesized
aaaaaaagaatgaaatcttgcc

SEQ ID NO: 1173277 - DNA, 22 bp, Artificial Sequence
  chemically synthesized
aaaaaagaatgaaatcttgcca

SEQ ID NO: 1173278 - DNA, 22 bp, Artificial Sequence
  chemically synthesized
atccatgttgtagcaaatggca

SEQ ID NO: 1173279 - DNA, 22 bp, Artificial Sequence
  chemically synthesized
ggctcatccatgttgtagcaaa

SEQ ID NO: 1173280 - DNA, 22 bp, Artificial Sequence
  chemically synthesized
taggctcatccatgttgtagca

SEQ ID NO: 1173281 - DNA, 22 bp, Artificial Sequence
  chemically synthesized
gccatttgctacaacatggatg

SEQ ID NO: 1173282 - DNA, 22 bp, Artificial Sequence
  chemically synthesized
ccatttgctacaacatggatga

SEQ ID NO: 1173283 - DNA, 22 bp, Artificial Sequence
  chemically synthesized
gctacaacatggatgagcctag

SEQ ID NO: 1173284 - DNA, 22 bp, Artificial Sequence
  chemically synthesized
gtgtaatgtattctaggctcat

SEQ ID NO: 1173285 - DNA, 22 bp, Artificial Sequence
  chemically synthesized
ctacaacatggatgagcctaga

SEQ ID NO: 1173286 - DNA, 22 bp, Artificial Sequence
  chemically synthesized
agtgtaatgtattctaggctca

SEQ ID NO: 1173287 - DNA, 22 bp, Artificial Sequence
  chemically synthesized
ttagtgtaatgtattctaggct

SEQ ID NO: 1173288 - DNA, 22 bp, Artificial Sequence
  chemically synthesized
caacatggatgagcctagaata

SEQ ID NO: 1173289 - DNA, 22 bp, Artificial Sequence
  chemically synthesized
aattcttagtgtaatgtattct

SEQ ID NO: 1173290 - DNA, 22 bp, Artificial Sequence
  chemically synthesized
aaattcttagtgtaatgtattc

SEQ ID NO: 1173291 - DNA, 22 bp, Artificial Sequence
  chemically synthesized
gaatacattacactaagaattt

SEQ ID NO: 1173292 - DNA, 22 bp, Artificial Sequence
  chemically synthesized
atgtcatccaaggtttaaattc

SEQ ID NO: 1173293 - DNA, 22 bp, Artificial Sequence
  chemically synthesized
attgatgtcatccaaggtttaa

SEQ ID NO: 1173294 - DNA, 22 bp, Artificial Sequence
  chemically synthesized
cactaagaatttaaaccttgga

SEQ ID NO: 1173295 - DNA, 22 bp, Artificial Sequence
  chemically synthesized
gagctcattgatgtcatccaag

SEQ ID NO: 1173296 - DNA, 22 bp, Artificial Sequence
  chemically synthesized
agaatttaaaccttggatgaca

SEQ ID NO: 1173297 - DNA, 22 bp, Artificial Sequence
  chemically synthesized
tagagctcattgatgtcatcca

SEQ ID NO: 1173298 - DNA, 22 bp, Artificial Sequence
  chemically synthesized
aaaccttggatgacatcaatga

SEQ ID NO: 1173299 - DNA, 22 bp, Artificial Sequence
  chemically synthesized
aaccttggatgacatcaatgag

SEQ ID NO: 1173300 - DNA, 22 bp, Artificial Sequence
  chemically synthesized
ggatgacatcaatgagctctag

SEQ ID NO: 1173301 - DNA, 22 bp, Artificial Sequence
  chemically synthesized
gatgacatcaatgagctctaga

SEQ ID NO: 1173302 - DNA, 22 bp, Artificial Sequence
  chemically synthesized
cgcatgaggagttctagagctc

SEQ ID NO: 1173303 - DNA, 22 bp, Artificial Sequence
  chemically synthesized
tacgcatgaggagttctagagc

SEQ ID NO: 1173304 - DNA, 22 bp, Artificial Sequence
  chemically synthesized
ctacgcatgaggagttctagag

SEQ ID NO: 1173305 - DNA, 22 bp, Artificial Sequence
  chemically synthesized
tagaactcctcatgcgtagaaa

SEQ ID NO: 1173306 - DNA, 22 bp, Artificial Sequence
  chemically synthesized
gaactcctcatgcgtagaaatc

SEQ ID NO: 1173307 - DNA, 22 bp, Artificial Sequence
  chemically synthesized
aaagtcaaatgtagggtgattt

SEQ ID NO: 1173308 - DNA, 22 bp, Artificial Sequence
  chemically synthesized
ctcatgcgtagaaatcacccta

SEQ ID NO: 1173309 - DNA, 22 bp, Artificial Sequence
  chemically synthesized
atgcgtagaaatcaccctacat

SEQ ID NO: 1173310 - DNA, 22 bp, Artificial Sequence
  chemically synthesized
aataaactgaaagtcaaatgta

SEQ ID NO: 1173311 - DNA, 22 bp, Artificial Sequence
  chemically synthesized
ttaaataaactgaaagtcaaat

SEQ ID NO: 1173312 - DNA, 22 bp, Artificial Sequence
  chemically synthesized
cctgttaaataaactgaaagtc

SEQ ID NO: 1173313 - DNA, 22 bp, Artificial Sequence
  chemically synthesized
ttacctgttaaataaactgaaa

SEQ ID NO: 1173314 - DNA, 22 bp, Artificial Sequence
  chemically synthesized
catttgactttcagtttattta

SEQ ID NO: 1173315 - DNA, 22 bp, Artificial Sequence
  chemically synthesized
gactttcagtttatttaacagg

SEQ ID NO: 1173316 - DNA, 22 bp, Artificial Sequence
  chemically synthesized
actttcagtttatttaacaggt

SEQ ID NO: 1173317 - DNA, 22 bp, Artificial Sequence
  chemically synthesized
tcagtttatttaacaggtaaca

SEQ ID NO: 1173318 - DNA, 22 bp, Artificial Sequence
  chemically synthesized
cagtttatttaacaggtaacaa

SEQ ID NO: 1173319 - DNA, 22 bp, Artificial Sequence
  chemically synthesized
agtttatttaacaggtaacaac

SEQ ID NO: 1173320 - DNA, 22 bp, Artificial Sequence
  chemically synthesized
atttaacaggtaacaacttctg

SEQ ID NO: 1173321 - DNA, 22 bp, Artificial Sequence
  chemically synthesized
tttaacaggtaacaacttctgg

SEQ ID NO: 1173322 - DNA, 22 bp, Artificial Sequence
  chemically synthesized
cgggccagtaataaccagaagt

SEQ ID NO: 1173323 - DNA, 22 bp, Artificial Sequence
  chemically synthesized
aacaggtaacaacttctggtta

SEQ ID NO: 1173324 - DNA, 22 bp, Artificial Sequence
  chemically synthesized
ccgggccagtaataaccagaag

SEQ ID NO: 1173325 - DNA, 22 bp, Artificial Sequence
  chemically synthesized
acaggtaacaacttctggttat

SEQ ID NO: 1173326 - DNA, 22 bp, Artificial Sequence
  chemically synthesized
caaacgtcttccgggccagtaa

SEQ ID NO: 1173327 - DNA, 22 bp, Artificial Sequence
  chemically synthesized
ctacaaacgtcttccgggccag

SEQ ID NO: 1173328 - DNA, 22 bp, Artificial Sequence
  chemically synthesized
actacaaacgtcttccgggcca

SEQ ID NO: 1173329 - DNA, 22 bp, Artificial Sequence
  chemically synthesized
ctggttattactggcccggaag

SEQ ID NO: 1173330 - DNA, 22 bp, Artificial Sequence
  chemically synthesized
tggttattactggcccggaaga

SEQ ID NO: 1173331 - DNA, 22 bp, Artificial Sequence
  chemically synthesized
tttactacaaacgtcttccggg

SEQ ID NO: 1173332 - DNA, 22 bp, Artificial Sequence
  chemically synthesized
gttattactggcccggaagacg

SEQ ID NO: 1173333 - DNA, 22 bp, Artificial Sequence
  chemically synthesized
tgtttactacaaacgtcttccg

SEQ ID NO: 1173334 - DNA, 22 bp, Artificial Sequence
  chemically synthesized
ctgtttactacaaacgtcttcc

SEQ ID NO: 1173335 - DNA, 22 bp, Artificial Sequence
  chemically synthesized
ttactggcccggaagacgtttg

SEQ ID NO: 1173336 - DNA, 22 bp, Artificial Sequence
  chemically synthesized
ttctgtttactacaaacgtctt

SEQ ID NO: 1173337 - DNA, 22 bp, Artificial Sequence
  chemically synthesized
ctggcccggaagacgtttgtag

SEQ ID NO: 1173338 - DNA, 22 bp, Artificial Sequence
  chemically synthesized
tctcttctgtttactacaaacg

SEQ ID NO: 1173339 - DNA, 22 bp, Artificial Sequence
  chemically synthesized
gcccggaagacgtttgtagtaa

SEQ ID NO: 1173340 - DNA, 22 bp, Artificial Sequence
  chemically synthesized
gtagtaaacagaagagacaact

SEQ ID NO: 1173341 - DNA, 22 bp, Artificial Sequence
  chemically synthesized
tagtaaacagaagagacaactg

SEQ ID NO: 1173342 - DNA, 22 bp, Artificial Sequence
  chemically synthesized
catgaggacagagacagttgtc

SEQ ID NO: 1173343 - DNA, 22 bp, Artificial Sequence
  chemically synthesized
tctctgtcctcatggaactcac

SEQ ID NO: 1173344 - DNA, 22 bp, Artificial Sequence
  chemically synthesized
tgtcctcatggaactcacactt

SEQ ID NO: 1173345 - DNA, 22 bp, Artificial Sequence
  chemically synthesized
tataatcacacaaaagtgtgag

SEQ ID NO: 1173346 - DNA, 22 bp, Artificial Sequence
  chemically synthesized
tcctcatggaactcacactttt

SEQ ID NO: 1173347 - DNA, 22 bp, Artificial Sequence
  chemically synthesized
gtataatcacacaaaagtgtga

SEQ ID NO: 1173348 - DNA, 22 bp, Artificial Sequence
  chemically synthesized
cttgtataatcacacaaaagtg

SEQ ID NO: 1173349 - DNA, 22 bp, Artificial Sequence
  chemically synthesized
atggaactcacacttttgtgtg

SEQ ID NO: 1173350 - DNA, 22 bp, Artificial Sequence
  chemically synthesized
ttgcttgtataatcacacaaaa

SEQ ID NO: 1173351 - DNA, 22 bp, Artificial Sequence
  chemically synthesized
attgcttgtataatcacacaaa

SEQ ID NO: 1173352 - DNA, 22 bp, Artificial Sequence
  chemically synthesized
tttattgcttgtataatcacac

SEQ ID NO: 1173353 - DNA, 22 bp, Artificial Sequence
  chemically synthesized
atttattgcttgtataatcaca

SEQ ID NO: 1173354 - DNA, 22 bp, Artificial Sequence
  chemically synthesized
acacttttgtgtgattatacaa

SEQ ID NO: 1173355 - DNA, 22 bp, Artificial Sequence
  chemically synthesized
tttatttattgcttgtataatc

SEQ ID NO: 1173356 - DNA, 22 bp, Artificial Sequence
  chemically synthesized
atttatttattgcttgtataat

SEQ ID NO: 1173357 - DNA, 22 bp, Artificial Sequence
  chemically synthesized
ttgtgtgattatacaagcaata

SEQ ID NO: 1173358 - DNA, 22 bp, Artificial Sequence
  chemically synthesized
tgtgtgattatacaagcaataa

SEQ ID NO: 1173359 - DNA, 22 bp, Artificial Sequence
  chemically synthesized
gtgtgattatacaagcaataaa

SEQ ID NO: 1173360 - DNA, 22 bp, Artificial Sequence
  chemically synthesized
tgtgattatacaagcaataaat

SEQ ID NO: 1173361 - DNA, 22 bp, Artificial Sequence
  chemically synthesized
aatataatttatttatttattg

SEQ ID NO: 1173362 - DNA, 22 bp, Artificial Sequence
  chemically synthesized
ttcaatataatttatttattta

SEQ ID NO: 1173363 - DNA, 22 bp, Artificial Sequence
  chemically synthesized
gttcaatataatttatttattt

SEQ ID NO: 1173364 - DNA, 22 bp, Artificial Sequence
  chemically synthesized
tgttcaatataatttatttatt

SEQ ID NO: 1173365 - DNA, 22 bp, Artificial Sequence
  chemically synthesized
tacaagcaataaataaataaat

SEQ ID NO: 1173366 - DNA, 22 bp, Artificial Sequence
  chemically synthesized
ttgttcaatataatttatttat

SEQ ID NO: 1173367 - DNA, 22 bp, Artificial Sequence
  chemically synthesized
tttgttcaatataatttattta

SEQ ID NO: 1173368 - DNA, 22 bp, Artificial Sequence
  chemically synthesized
ttttgttcaatataatttattt

SEQ ID NO: 1173369 - DNA, 22 bp, Artificial Sequence
  chemically synthesized
tttttgttcaatataatttatt

SEQ ID NO: 1173370 - DNA, 22 bp, Artificial Sequence
  chemically synthesized
ttttttgttcaatataatttat

SEQ ID NO: 1173371 - DNA, 22 bp, Artificial Sequence
  chemically synthesized
gaacaaacttttttttgttcaa

SEQ ID NO: 1173372 - DNA, 22 bp, Artificial Sequence
  chemically synthesized
ggaacaaacttttttttgttca

SEQ ID NO: 1173373 - DNA, 22 bp, Artificial Sequence
  chemically synthesized
tattgaacaaaaaaaagtttgt

SEQ ID NO: 1173374 - DNA, 22 bp, Artificial Sequence
  chemically synthesized
caaatataatttggaacaaact

SEQ ID NO: 1173375 - DNA, 22 bp, Artificial Sequence
  chemically synthesized
aacaaaaaaaagtttgttccaa

SEQ ID NO: 1173376 - DNA, 22 bp, Artificial Sequence
  chemically synthesized
ataaagtggctgcaaatataat

SEQ ID NO: 1173377 - DNA, 22 bp, Artificial Sequence
  chemically synthesized
ttcataaagtggctgcaaatat

SEQ ID NO: 1173378 - DNA, 22 bp, Artificial Sequence
  chemically synthesized
attcataaagtggctgcaaata

SEQ ID NO: 1173379 - DNA, 22 bp, Artificial Sequence
  chemically synthesized
gttccaaattatatttgcagcc

SEQ ID NO: 1173380 - DNA, 22 bp, Artificial Sequence
  chemically synthesized
ttccaaattatatttgcagcca

SEQ ID NO: 1173381 - DNA, 22 bp, Artificial Sequence
  chemically synthesized
caaattatatttgcagccactt

SEQ ID NO: 1173382 - DNA, 22 bp, Artificial Sequence
  chemically synthesized
aacaatttattcataaagtggc

SEQ ID NO: 1173383 - DNA, 22 bp, Artificial Sequence
  chemically synthesized
tatttgcagccactttatgaat

SEQ ID NO: 1173384 - DNA, 22 bp, Artificial Sequence
  chemically synthesized
agctcaacaatttattcataaa

SEQ ID NO: 1173385 - DNA, 22 bp, Artificial Sequence
  chemically synthesized
gcagccactttatgaataaatt

SEQ ID NO: 1173386 - DNA, 22 bp, Artificial Sequence
  chemically synthesized
cagccactttatgaataaattg

SEQ ID NO: 1173387 - DNA, 22 bp, Artificial Sequence
  chemically synthesized
tatgaataaattgttgagctta

SEQ ID NO: 1173388 - DNA, 22 bp, Artificial Sequence
  chemically synthesized
atgaataaattgttgagcttag

SEQ ID NO: 1173389 - DNA, 22 bp, Artificial Sequence
  chemically synthesized
tgaataaattgttgagcttagt

SEQ ID NO: 1173390 - DNA, 22 bp, Artificial Sequence
  chemically synthesized
tcgtgtcacacagcactaagct

SEQ ID NO: 1173391 - DNA, 22 bp, Artificial Sequence
  chemically synthesized
atcgtgtcacacagcactaagc

SEQ ID NO: 1173392 - DNA, 22 bp, Artificial Sequence
  chemically synthesized
caatttatcgtgtcacacagca

SEQ ID NO: 1173393 - DNA, 22 bp, Artificial Sequence
  chemically synthesized
ttgagcttagtgctgtgtgaca

SEQ ID NO: 1173394 - DNA, 22 bp, Artificial Sequence
  chemically synthesized
agcttagtgctgtgtgacacga

SEQ ID NO: 1173395 - DNA, 22 bp, Artificial Sequence
  chemically synthesized
atcctccaatttatcgtgtcac

SEQ ID NO: 1173396 - DNA, 22 bp, Artificial Sequence
  chemically synthesized
aatcctccaatttatcgtgtca

SEQ ID NO: 1173397 - DNA, 22 bp, Artificial Sequence
  chemically synthesized
ttaatcctccaatttatcgtgt

SEQ ID NO: 1173398 - DNA, 22 bp, Artificial Sequence
  chemically synthesized
agtgctgtgtgacacgataaat

SEQ ID NO: 1173399 - DNA, 22 bp, Artificial Sequence
  chemically synthesized
cttaatcctccaatttatcgtg

SEQ ID NO: 1173400 - DNA, 22 bp, Artificial Sequence
  chemically synthesized
gtgctgtgtgacacgataaatt

SEQ ID NO: 1173401 - DNA, 22 bp, Artificial Sequence
  chemically synthesized
tgtgacacgataaattggagga

SEQ ID NO: 1173402 - DNA, 22 bp, Artificial Sequence
  chemically synthesized
atgcatttcttaatcctccaat

SEQ ID NO: 1173403 - DNA, 22 bp, Artificial Sequence
  chemically synthesized
aatgcatttcttaatcctccaa

SEQ ID NO: 1173404 - DNA, 22 bp, Artificial Sequence
  chemically synthesized
cttaatgcatttcttaatcctc

SEQ ID NO: 1173405 - DNA, 22 bp, Artificial Sequence
  chemically synthesized
gtgttgcttaatgcatttctta

SEQ ID NO: 1173406 - DNA, 22 bp, Artificial Sequence
  chemically synthesized
ttggtgttgcttaatgcatttc

SEQ ID NO: 1173407 - DNA, 22 bp, Artificial Sequence
  chemically synthesized
gttggtgttgcttaatgcattt

SEQ ID NO: 1173408 - DNA, 22 bp, Artificial Sequence
  chemically synthesized
gaggattaagaaatgcattaag

SEQ ID NO: 1173409 - DNA, 22 bp, Artificial Sequence
  chemically synthesized
ccttgttggtgttgcttaatgc

SEQ ID NO: 1173410 - DNA, 22 bp, Artificial Sequence
  chemically synthesized
tactcccttgttggtgttgctt

SEQ ID NO: 1173411 - DNA, 22 bp, Artificial Sequence
  chemically synthesized
agaaatgcattaagcaacacca

SEQ ID NO: 1173412 - DNA, 22 bp, Artificial Sequence
  chemically synthesized
gtactcccttgttggtgttgct

SEQ ID NO: 1173413 - DNA, 22 bp, Artificial Sequence
  chemically synthesized
agcaacaccaacaagggagtac

SEQ ID NO: 1173414 - DNA, 22 bp, Artificial Sequence
  chemically synthesized
aatataatatttgtactccctt

SEQ ID NO: 1173415 - DNA, 22 bp, Artificial Sequence
  chemically synthesized
aggtccaatgaaatatgatggt

SEQ ID NO: 1173416 - DNA, 22 bp, Artificial Sequence
  chemically synthesized
aaggtccaatgaaatatgatgg

SEQ ID NO: 1173417 - DNA, 22 bp, Artificial Sequence
  chemically synthesized
tatttaaccatcatatttcatt

SEQ ID NO: 1173418 - DNA, 22 bp, Artificial Sequence
  chemically synthesized
aaccatcatatttcattggacc

SEQ ID NO: 1173419 - DNA, 22 bp, Artificial Sequence
  chemically synthesized
accatcatatttcattggacct

SEQ ID NO: 1173420 - DNA, 22 bp, Artificial Sequence
  chemically synthesized
gaagaatggcacttaaggtcca

SEQ ID NO: 1173421 - DNA, 22 bp, Artificial Sequence
  chemically synthesized
cattggaccttaagtgccattc

SEQ ID NO: 1173422 - DNA, 22 bp, Artificial Sequence
  chemically synthesized
attggaccttaagtgccattct

SEQ ID NO: 1173423 - DNA, 22 bp, Artificial Sequence
  chemically synthesized
cataaaactagaagaatggcac

SEQ ID NO: 1173424 - DNA, 22 bp, Artificial Sequence
  chemically synthesized
ctccataaaactagaagaatgg

SEQ ID NO: 1173425 - DNA, 22 bp, Artificial Sequence
  chemically synthesized
gaccttaagtgccattcttcta

SEQ ID NO: 1173426 - DNA, 22 bp, Artificial Sequence
  chemically synthesized
cctccataaaactagaagaatg

SEQ ID NO: 1173427 - DNA, 22 bp, Artificial Sequence
  chemically synthesized
aagtgccattcttctagtttta

SEQ ID NO: 1173428 - DNA, 22 bp, Artificial Sequence
  chemically synthesized
agtgccattcttctagttttat

SEQ ID NO: 1173429 - DNA, 22 bp, Artificial Sequence
  chemically synthesized
atacatttcctccataaaacta

SEQ ID NO: 1173430 - DNA, 22 bp, Artificial Sequence
  chemically synthesized
ttctagttttatggaggaaatg

SEQ ID NO: 1173431 - DNA, 22 bp, Artificial Sequence
  chemically synthesized
tcatgtcctaatacatttcctc

SEQ ID NO: 1173432 - DNA, 22 bp, Artificial Sequence
  chemically synthesized
ctagttttatggaggaaatgta

SEQ ID NO: 1173433 - DNA, 22 bp, Artificial Sequence
  chemically synthesized
tagttttatggaggaaatgtat

SEQ ID NO: 1173434 - DNA, 22 bp, Artificial Sequence
  chemically synthesized
gttttatggaggaaatgtatta

SEQ ID NO: 1173435 - DNA, 22 bp, Artificial Sequence
  chemically synthesized
tatggaggaaatgtattaggac

SEQ ID NO: 1173436 - DNA, 22 bp, Artificial Sequence
  chemically synthesized
gatgattatcatgtcctaatac

SEQ ID NO: 1173437 - DNA, 22 bp, Artificial Sequence
  chemically synthesized
atggaggaaatgtattaggaca

SEQ ID NO: 1173438 - DNA, 22 bp, Artificial Sequence
  chemically synthesized
tggaggaaatgtattaggacat

SEQ ID NO: 1173439 - DNA, 22 bp, Artificial Sequence
  chemically synthesized
gtgcagtattagatgattatca

SEQ ID NO: 1173440 - DNA, 22 bp, Artificial Sequence
  chemically synthesized
agtgcagtattagatgattatc

SEQ ID NO: 1173441 - DNA, 22 bp, Artificial Sequence
  chemically synthesized
ggacatgataatcatctaatac

SEQ ID NO: 1173442 - DNA, 22 bp, Artificial Sequence
  chemically synthesized
caatatttagtgcagtattaga

SEQ ID NO: 1173443 - DNA, 22 bp, Artificial Sequence
  chemically synthesized
agtaacagtaaactacaatatt

SEQ ID NO: 1173444 - DNA, 22 bp, Artificial Sequence
  chemically synthesized
atactgcactaaatattgtagt

SEQ ID NO: 1173445 - DNA, 22 bp, Artificial Sequence
  chemically synthesized
cagtaacagtaaactacaatat

SEQ ID NO: 1173446 - DNA, 22 bp, Artificial Sequence
  chemically synthesized
tcagtaacagtaaactacaata

SEQ ID NO: 1173447 - DNA, 22 bp, Artificial Sequence
  chemically synthesized
cactaaatattgtagtttactg

SEQ ID NO: 1173448 - DNA, 22 bp, Artificial Sequence
  chemically synthesized
tgctttcagtaacagtaaacta

SEQ ID NO: 1173449 - DNA, 22 bp, Artificial Sequence
  chemically synthesized
atgctttcagtaacagtaaact

SEQ ID NO: 1173450 - DNA, 22 bp, Artificial Sequence
  chemically synthesized
aatattgtagtttactgttact

SEQ ID NO: 1173451 - DNA, 22 bp, Artificial Sequence
  chemically synthesized
catcttatgctttcagtaacag

SEQ ID NO: 1173452 - DNA, 22 bp, Artificial Sequence
  chemically synthesized
ccatcttatgctttcagtaaca

SEQ ID NO: 1173453 - DNA, 22 bp, Artificial Sequence
  chemically synthesized
tagtttactgttactgaaagca

SEQ ID NO: 1173454 - DNA, 22 bp, Artificial Sequence
  chemically synthesized
ggatttccatcttatgctttca

SEQ ID NO: 1173455 - DNA, 22 bp, Artificial Sequence
  chemically synthesized
actgttactgaaagcataagat

SEQ ID NO: 1173456 - DNA, 22 bp, Artificial Sequence
  chemically synthesized
ctgttactgaaagcataagatg

SEQ ID NO: 1173457 - DNA, 22 bp, Artificial Sequence
  chemically synthesized
acccctaggatttccatcttat

SEQ ID NO: 1173458 - DNA, 22 bp, Artificial Sequence
  chemically synthesized
ttactgaaagcataagatggaa

SEQ ID NO: 1173459 - DNA, 22 bp, Artificial Sequence
  chemically synthesized
ctgaaagcataagatggaaatc

SEQ ID NO: 1173460 - DNA, 22 bp, Artificial Sequence
  chemically synthesized
aaagcataagatggaaatccta

SEQ ID NO: 1173461 - DNA, 22 bp, Artificial Sequence
  chemically synthesized
tcacataatgttgacccctagg

SEQ ID NO: 1173462 - DNA, 22 bp, Artificial Sequence
  chemically synthesized
tgtcacataatgttgaccccta

SEQ ID NO: 1173463 - DNA, 22 bp, Artificial Sequence
  chemically synthesized
ctgtcacataatgttgacccct

SEQ ID NO: 1173464 - DNA, 22 bp, Artificial Sequence
  chemically synthesized
tctgtcacataatgttgacccc

SEQ ID NO: 1173465 - DNA, 22 bp, Artificial Sequence
  chemically synthesized
ttctgtcacataatgttgaccc

SEQ ID NO: 1173466 - DNA, 22 bp, Artificial Sequence
  chemically synthesized
ggggtcaacattatgtgacaga

SEQ ID NO: 1173467 - DNA, 22 bp, Artificial Sequence
  chemically synthesized
tacatgtgatcttttctgtcac

SEQ ID NO: 1173468 - DNA, 22 bp, Artificial Sequence
  chemically synthesized
tgtgacagaaaagatcacatgt

SEQ ID NO: 1173469 - DNA, 22 bp, Artificial Sequence
  chemically synthesized
gtcttttctacattttgtctat

SEQ ID NO: 1173470 - DNA, 22 bp, Artificial Sequence
  chemically synthesized
tcttttctacattttgtctatt

SEQ ID NO: 1173471 - DNA, 22 bp, Artificial Sequence
  chemically synthesized
ttctacattttgtctatttgac

SEQ ID NO: 1173472 - DNA, 22 bp, Artificial Sequence
  chemically synthesized
tctacattttgtctatttgaca

SEQ ID NO: 1173473 - DNA, 22 bp, Artificial Sequence
  chemically synthesized
ctacattttgtctatttgacac

SEQ ID NO: 1173474 - DNA, 22 bp, Artificial Sequence
  chemically synthesized
tacattttgtctatttgacact

SEQ ID NO: 1173475 - DNA, 22 bp, Artificial Sequence
  chemically synthesized
cattttgtctatttgacactgg

SEQ ID NO: 1173476 - DNA, 22 bp, Artificial Sequence
  chemically synthesized
tgtctatttgacactgggtcgg

SEQ ID NO: 1173477 - DNA, 22 bp, Artificial Sequence
  chemically synthesized
gtctatttgacactgggtcggc

SEQ ID NO: 1173478 - DNA, 22 bp, Artificial Sequence
  chemically synthesized
agcgaaggtgtagccgacccag

SEQ ID NO: 1173479 - DNA, 22 bp, Artificial Sequence
  chemically synthesized
tctatttgacactgggtcggct

SEQ ID NO: 1173480 - DNA, 22 bp, Artificial Sequence
  chemically synthesized
aagcgaaggtgtagccgaccca

SEQ ID NO: 1173481 - DNA, 22 bp, Artificial Sequence
  chemically synthesized
taagcgaaggtgtagccgaccc

SEQ ID NO: 1173482 - DNA, 22 bp, Artificial Sequence
  chemically synthesized
ttaagcgaaggtgtagccgacc

SEQ ID NO: 1173483 - DNA, 22 bp, Artificial Sequence
  chemically synthesized
tttgacactgggtcggctacac

SEQ ID NO: 1173484 - DNA, 22 bp, Artificial Sequence
  chemically synthesized
gacactgggtcggctacacctt

SEQ ID NO: 1173485 - DNA, 22 bp, Artificial Sequence
  chemically synthesized
acactgggtcggctacaccttc

SEQ ID NO: 1173486 - DNA, 22 bp, Artificial Sequence
  chemically synthesized
ggtcggctacaccttcgcttaa

SEQ ID NO: 1173487 - DNA, 22 bp, Artificial Sequence
  chemically synthesized
caccttcgcttaaaagttctca

SEQ ID NO: 1173488 - DNA, 22 bp, Artificial Sequence
  chemically synthesized
cgcttaaaagttctcaccattc

SEQ ID NO: 1173489 - DNA, 22 bp, Artificial Sequence
  chemically synthesized
gcttaaaagttctcaccattct

SEQ ID NO: 1173490 - DNA, 22 bp, Artificial Sequence
  chemically synthesized
aaaagttctcaccattctctgc

SEQ ID NO: 1173491 - DNA, 22 bp, Artificial Sequence
  chemically synthesized
aaagttctcaccattctctgct

SEQ ID NO: 1173492 - DNA, 22 bp, Artificial Sequence
  chemically synthesized
tcaccattctctgcttttgtgt

SEQ ID NO: 1173493 - DNA, 22 bp, Artificial Sequence
  chemically synthesized
accattctctgcttttgtgttt

SEQ ID NO: 1173494 - DNA, 22 bp, Artificial Sequence
  chemically synthesized
gaaaaaaaaaaaaaaaaaacac

SEQ ID NO: 1173495 - DNA, 22 bp, Artificial Sequence
  chemically synthesized
tctgcttttgtgtttttttttt

SEQ ID NO: 1173496 - DNA, 22 bp, Artificial Sequence
  chemically synthesized
tgcttttgtgtttttttttttt

SEQ ID NO: 1173497 - DNA, 22 bp, Artificial Sequence
  chemically synthesized
cttttgtgtttttttttttttt

SEQ ID NO: 1173498 - DNA, 22 bp, Artificial Sequence
  chemically synthesized
ttgtgttttttttttttttttt

SEQ ID NO: 1173499 - DNA, 22 bp, Artificial Sequence
  chemically synthesized
tgtgtttttttttttttttttt

SEQ ID NO: 1173500 - DNA, 22 bp, Artificial Sequence
  chemically synthesized
gtgttttttttttttttttttc

SEQ ID NO: 1173501 - DNA, 22 bp, Artificial Sequence
  chemically synthesized
agtagaaaactggaaaaaaaaa

SEQ ID NO: 1173502 - DNA, 22 bp, Artificial Sequence
  chemically synthesized
tgttttttttttttttttttcc

SEQ ID NO: 1173503 - DNA, 22 bp, Artificial Sequence
  chemically synthesized
gagtagaaaactggaaaaaaaa

SEQ ID NO: 1173504 - DNA, 22 bp, Artificial Sequence
  chemically synthesized
acttgagtagaaaactggaaaa

SEQ ID NO: 1173505 - DNA, 22 bp, Artificial Sequence
  chemically synthesized
tttttttttttttttccagttt

SEQ ID NO: 1173506 - DNA, 22 bp, Artificial Sequence
  chemically synthesized
ttttttttttttttccagtttt

SEQ ID NO: 1173507 - DNA, 22 bp, Artificial Sequence
  chemically synthesized
tttttttttttttccagttttc

SEQ ID NO: 1173508 - DNA, 22 bp, Artificial Sequence
  chemically synthesized
ttttttttttttccagttttct

SEQ ID NO: 1173509 - DNA, 22 bp, Artificial Sequence
  chemically synthesized
tctgacttgagtagaaaactgg

SEQ ID NO: 1173510 - DNA, 22 bp, Artificial Sequence
  chemically synthesized
tttttttttttccagttttcta

SEQ ID NO: 1173511 - DNA, 22 bp, Artificial Sequence
  chemically synthesized
ttttttttttccagttttctac

SEQ ID NO: 1173512 - DNA, 22 bp, Artificial Sequence
  chemically synthesized
tttttttttccagttttctact

SEQ ID NO: 1173513 - DNA, 22 bp, Artificial Sequence
  chemically synthesized
ttttttttccagttttctactc

SEQ ID NO: 1173514 - DNA, 22 bp, Artificial Sequence
  chemically synthesized
tttttttccagttttctactca

SEQ ID NO: 1173515 - DNA, 22 bp, Artificial Sequence
  chemically synthesized
ttttttccagttttctactcaa

SEQ ID NO: 1173516 - DNA, 22 bp, Artificial Sequence
  chemically synthesized
ccattatctgacttgagtagaa

SEQ ID NO: 1173517 - DNA, 22 bp, Artificial Sequence
  chemically synthesized
tttttccagttttctactcaag

SEQ ID NO: 1173518 - DNA, 22 bp, Artificial Sequence
  chemically synthesized
accattatctgacttgagtaga

SEQ ID NO: 1173519 - DNA, 22 bp, Artificial Sequence
  chemically synthesized
ttttccagttttctactcaagt

SEQ ID NO: 1173520 - DNA, 22 bp, Artificial Sequence
  chemically synthesized
tttccagttttctactcaagtc

SEQ ID NO: 1173521 - DNA, 22 bp, Artificial Sequence
  chemically synthesized
ttccagttttctactcaagtca

SEQ ID NO: 1173522 - DNA, 22 bp, Artificial Sequence
  chemically synthesized
tccagttttctactcaagtcag

SEQ ID NO: 1173523 - DNA, 22 bp, Artificial Sequence
  chemically synthesized
ccagttttctactcaagtcaga

SEQ ID NO: 1173524 - DNA, 22 bp, Artificial Sequence
  chemically synthesized
gatttaccattatctgacttga

SEQ ID NO: 1173525 - DNA, 22 bp, Artificial Sequence
  chemically synthesized
cagttttctactcaagtcagat

SEQ ID NO: 1173526 - DNA, 22 bp, Artificial Sequence
  chemically synthesized
tctactcaagtcagataatggt

SEQ ID NO: 1173527 - DNA, 22 bp, Artificial Sequence
  chemically synthesized
ctactcaagtcagataatggta

SEQ ID NO: 1173528 - DNA, 22 bp, Artificial Sequence
  chemically synthesized
tactcaagtcagataatggtaa

SEQ ID NO: 1173529 - DNA, 22 bp, Artificial Sequence
  chemically synthesized
ctcaagtcagataatggtaaat

SEQ ID NO: 1173530 - DNA, 22 bp, Artificial Sequence
  chemically synthesized
aagtcagataatggtaaatcta

SEQ ID NO: 1173531 - DNA, 22 bp, Artificial Sequence
  chemically synthesized
atcaagatgcaattagatttac

SEQ ID NO: 1173532 - DNA, 22 bp, Artificial Sequence
  chemically synthesized
agtagctcatcaagatgcaatt

SEQ ID NO: 1173533 - DNA, 22 bp, Artificial Sequence
  chemically synthesized
aagtagctcatcaagatgcaat

SEQ ID NO: 1173534 - DNA, 22 bp, Artificial Sequence
  chemically synthesized
taagtagctcatcaagatgcaa

SEQ ID NO: 1173535 - DNA, 22 bp, Artificial Sequence
  chemically synthesized
ttaagtagctcatcaagatgca

SEQ ID NO: 1173536 - DNA, 22 bp, Artificial Sequence
  chemically synthesized
agggtatttttaagtagctcat

SEQ ID NO: 1173537 - DNA, 22 bp, Artificial Sequence
  chemically synthesized
attgcatcttgatgagctactt

SEQ ID NO: 1173538 - DNA, 22 bp, Artificial Sequence
  chemically synthesized
aagggtatttttaagtagctca

SEQ ID NO: 1173539 - DNA, 22 bp, Artificial Sequence
  chemically synthesized
catcttgatgagctacttaaaa

SEQ ID NO: 1173540 - DNA, 22 bp, Artificial Sequence
  chemically synthesized
gatgagctacttaaaaataccc

SEQ ID NO: 1173541 - DNA, 22 bp, Artificial Sequence
  chemically synthesized
atgagctacttaaaaataccct

SEQ ID NO: 1173542 - DNA, 22 bp, Artificial Sequence
  chemically synthesized
cttaaaaatacccttaaggctg

SEQ ID NO: 1173543 - DNA, 22 bp, Artificial Sequence
  chemically synthesized
aaaaatacccttaaggctgggc

SEQ ID NO: 1173544 - DNA, 22 bp, Artificial Sequence
  chemically synthesized
aaaatacccttaaggctgggca

SEQ ID NO: 1173545 - DNA, 22 bp, Artificial Sequence
  chemically synthesized
caggcatgagccacagtgccca

SEQ ID NO: 1173546 - DNA, 22 bp, Artificial Sequence
  chemically synthesized
ggattacaggcatgagccacag

SEQ ID NO: 1173547 - DNA, 22 bp, Artificial Sequence
  chemically synthesized
aaggctgggcactgtggctcat

SEQ ID NO: 1173548 - DNA, 22 bp, Artificial Sequence
  chemically synthesized
aggctgggcactgtggctcatg

SEQ ID NO: 1173549 - DNA, 22 bp, Artificial Sequence
  chemically synthesized
ggcactgtggctcatgcctgta

SEQ ID NO: 1173550 - DNA, 22 bp, Artificial Sequence
  chemically synthesized
ccaaagtgctgggattacaggc

SEQ ID NO: 1173551 - DNA, 22 bp, Artificial Sequence
  chemically synthesized
tggctcatgcctgtaatcccag

SEQ ID NO: 1173552 - DNA, 22 bp, Artificial Sequence
  chemically synthesized
ggcctcccaaagtgctgggatt

SEQ ID NO: 1173553 - DNA, 22 bp, Artificial Sequence
  chemically synthesized
atgcctgtaatcccagcacttt

SEQ ID NO: 1173554 - DNA, 22 bp, Artificial Sequence
  chemically synthesized
taatcccagcactttgggaggc

SEQ ID NO: 1173555 - DNA, 22 bp, Artificial Sequence
  chemically synthesized
ggtgatccgcccgcctcggcct

SEQ ID NO: 1173556 - DNA, 22 bp, Artificial Sequence
  chemically synthesized
aggtgatccgcccgcctcggcc

SEQ ID NO: 1173557 - DNA, 22 bp, Artificial Sequence
  chemically synthesized
accttaggtgatccgcccgcct

SEQ ID NO: 1173558 - DNA, 22 bp, Artificial Sequence
  chemically synthesized
tgggaggccgaggcgggcggat

SEQ ID NO: 1173559 - DNA, 22 bp, Artificial Sequence
  chemically synthesized
gggaggccgaggcgggcggatc

SEQ ID NO: 1173560 - DNA, 22 bp, Artificial Sequence
  chemically synthesized
ctgaccttaggtgatccgcccg

SEQ ID NO: 1173561 - DNA, 22 bp, Artificial Sequence
  chemically synthesized
ggaggccgaggcgggcggatca

SEQ ID NO: 1173562 - DNA, 22 bp, Artificial Sequence
  chemically synthesized
aactcctgaccttaggtgatcc

SEQ ID NO: 1173563 - DNA, 22 bp, Artificial Sequence
  chemically synthesized
gaactcctgaccttaggtgatc

SEQ ID NO: 1173564 - DNA, 22 bp, Artificial Sequence
  chemically synthesized
gtcttgaactcctgaccttagg

SEQ ID NO: 1173565 - DNA, 22 bp, Artificial Sequence
  chemically synthesized
gccaggctggtcttgaactcct

SEQ ID NO: 1173566 - DNA, 22 bp, Artificial Sequence
  chemically synthesized
tgttggccaggctggtcttgaa

SEQ ID NO: 1173567 - DNA, 22 bp, Artificial Sequence
  chemically synthesized
aggtcaggagttcaagaccagc

SEQ ID NO: 1173568 - DNA, 22 bp, Artificial Sequence
  chemically synthesized
ctatgttggccaggctggtctt

SEQ ID NO: 1173569 - DNA, 22 bp, Artificial Sequence
  chemically synthesized
gctatgttggccaggctggtct

SEQ ID NO: 1173570 - DNA, 22 bp, Artificial Sequence
  chemically synthesized
tgctatgttggccaggctggtc

SEQ ID NO: 1173571 - DNA, 22 bp, Artificial Sequence
  chemically synthesized
aagaccagcctggccaacatag

SEQ ID NO: 1173572 - DNA, 22 bp, Artificial Sequence
  chemically synthesized
aatagtgacaaggttttgctat

SEQ ID NO: 1173573 - DNA, 22 bp, Artificial Sequence
  chemically synthesized
aaatagtgacaaggttttgcta

SEQ ID NO: 1173574 - DNA, 22 bp, Artificial Sequence
  chemically synthesized
taaatagtgacaaggttttgct

SEQ ID NO: 1173575 - DNA, 22 bp, Artificial Sequence
  chemically synthesized
ttaaatagtgacaaggttttgc

SEQ ID NO: 1173576 - DNA, 22 bp, Artificial Sequence
  chemically synthesized
tttaaatagtgacaaggttttg

SEQ ID NO: 1173577 - DNA, 22 bp, Artificial Sequence
  chemically synthesized
ttttaaatagtgacaaggtttt

SEQ ID NO: 1173578 - DNA, 22 bp, Artificial Sequence
  chemically synthesized
gccaacatagcaaaaccttgtc

SEQ ID NO: 1173579 - DNA, 22 bp, Artificial Sequence
  chemically synthesized
tttttaaatagtgacaaggttt

SEQ ID NO: 1173580 - DNA, 22 bp, Artificial Sequence
  chemically synthesized
ttttttaaatagtgacaaggtt

SEQ ID NO: 1173581 - DNA, 22 bp, Artificial Sequence
  chemically synthesized
tttttttaaatagtgacaaggt

SEQ ID NO: 1173582 - DNA, 22 bp, Artificial Sequence
  chemically synthesized
ttttttttaaatagtgacaagg

SEQ ID NO: 1173583 - DNA, 22 bp, Artificial Sequence
  chemically synthesized
tttttttttaaatagtgacaag

SEQ ID NO: 1173584 - DNA, 22 bp, Artificial Sequence
  chemically synthesized
ttttttttttaaatagtgacaa

SEQ ID NO: 1173585 - DNA, 22 bp, Artificial Sequence
  chemically synthesized
tatttttttttttttaaatagt

SEQ ID NO: 1173586 - DNA, 22 bp, Artificial Sequence
  chemically synthesized
gtatttttttttttttaaatag

SEQ ID NO: 1173587 - DNA, 22 bp, Artificial Sequence
  chemically synthesized
tgtatttttttttttttaaata

SEQ ID NO: 1173588 - DNA, 22 bp, Artificial Sequence
  chemically synthesized
ttgtatttttttttttttaaat

SEQ ID NO: 1173589 - DNA, 22 bp, Artificial Sequence
  chemically synthesized
atttttgtattttttttttttt

SEQ ID NO: 1173590 - DNA, 22 bp, Artificial Sequence
  chemically synthesized
gtcactatttaaaaaaaaaaaa

SEQ ID NO: 1173591 - DNA, 22 bp, Artificial Sequence
  chemically synthesized
tcactatttaaaaaaaaaaaaa

SEQ ID NO: 1173592 - DNA, 22 bp, Artificial Sequence
  chemically synthesized
tttaaaaaaaaaaaaatacaaa

SEQ ID NO: 1173593 - DNA, 22 bp, Artificial Sequence
  chemically synthesized
aaaaaaaaaaaaatacaaaaat

SEQ ID NO: 1173594 - DNA, 22 bp, Artificial Sequence
  chemically synthesized
aaaaaaaaaaaatacaaaaatt

SEQ ID NO: 1173595 - DNA, 22 bp, Artificial Sequence
  chemically synthesized
ccaccatgcccgactaattttt

SEQ ID NO: 1173596 - DNA, 22 bp, Artificial Sequence
  chemically synthesized
caggcacctgccaccatgcccg

SEQ ID NO: 1173597 - DNA, 22 bp, Artificial Sequence
  chemically synthesized
ggattacaggcacctgccacca

SEQ ID NO: 1173598 - DNA, 22 bp, Artificial Sequence
  chemically synthesized
gtcgggcatggtggcaggtgcc

SEQ ID NO: 1173599 - DNA, 22 bp, Artificial Sequence
  chemically synthesized
gtagctgggattacaggcacct

SEQ ID NO: 1173600 - DNA, 22 bp, Artificial Sequence
  chemically synthesized
actagtagctgggattacaggc

SEQ ID NO: 1173601 - DNA, 22 bp, Artificial Sequence
  chemically synthesized
gcctcactagtagctgggatta

SEQ ID NO: 1173602 - DNA, 22 bp, Artificial Sequence
  chemically synthesized
agcctcactagtagctgggatt

SEQ ID NO: 1173603 - DNA, 22 bp, Artificial Sequence
  chemically synthesized
ccttagcctcactagtagctgg

SEQ ID NO: 1173604 - DNA, 22 bp, Artificial Sequence
  chemically synthesized
tgccttagcctcactagtagct

SEQ ID NO: 1173605 - DNA, 22 bp, Artificial Sequence
  chemically synthesized
ctgccttagcctcactagtagc

SEQ ID NO: 1173606 - DNA, 22 bp, Artificial Sequence
  chemically synthesized
ttctgccttagcctcactagta

SEQ ID NO: 1173607 - DNA, 22 bp, Artificial Sequence
  chemically synthesized
taatcccagctactagtgaggc

SEQ ID NO: 1173608 - DNA, 22 bp, Artificial Sequence
  chemically synthesized
aagcgattcttctgccttagcc

SEQ ID NO: 1173609 - DNA, 22 bp, Artificial Sequence
  chemically synthesized
ctagtgaggctaaggcagaaga

SEQ ID NO: 1173610 - DNA, 22 bp, Artificial Sequence
  chemically synthesized
ggctcaagcgattcttctgcct

SEQ ID NO: 1173611 - DNA, 22 bp, Artificial Sequence
  chemically synthesized
gtgaggctaaggcagaagaatc

SEQ ID NO: 1173612 - DNA, 22 bp, Artificial Sequence
  chemically synthesized
ctgggctcaagcgattcttctg

SEQ ID NO: 1173613 - DNA, 22 bp, Artificial Sequence
  chemically synthesized
cgcctcctgggctcaagcgatt

SEQ ID NO: 1173614 - DNA, 22 bp, Artificial Sequence
  chemically synthesized
aggcagaagaatcgcttgagcc

SEQ ID NO: 1173615 - DNA, 22 bp, Artificial Sequence
  chemically synthesized
caacctccgcctcctgggctca

SEQ ID NO: 1173616 - DNA, 22 bp, Artificial Sequence
  chemically synthesized
actgcaacctccgcctcctggg

SEQ ID NO: 1173617 - DNA, 22 bp, Artificial Sequence
  chemically synthesized
ggctcactgcaacctccgcctc

SEQ ID NO: 1173618 - DNA, 22 bp, Artificial Sequence
  chemically synthesized
gagcccaggaggcggaggttgc

SEQ ID NO: 1173619 - DNA, 22 bp, Artificial Sequence
  chemically synthesized
agcccaggaggcggaggttgca

SEQ ID NO: 1173620 - DNA, 22 bp, Artificial Sequence
  chemically synthesized
gcatgcagtggcacaatctcgg

SEQ ID NO: 1173621 - DNA, 22 bp, Artificial Sequence
  chemically synthesized
cagtgagccgagattgtgccac

SEQ ID NO: 1173622 - DNA, 22 bp, Artificial Sequence
  chemically synthesized
tcgccaggctggcatgcagtgg

SEQ ID NO: 1173623 - DNA, 22 bp, Artificial Sequence
  chemically synthesized
tgtcgccaggctggcatgcagt

SEQ ID NO: 1173624 - DNA, 22 bp, Artificial Sequence
  chemically synthesized
cctctgtcgccaggctggcatg

SEQ ID NO: 1173625 - DNA, 22 bp, Artificial Sequence
  chemically synthesized
tgccactgcatgccagcctggc

SEQ ID NO: 1173626 - DNA, 22 bp, Artificial Sequence
  chemically synthesized
catgccagcctggcgacagagg

SEQ ID NO: 1173627 - DNA, 22 bp, Artificial Sequence
  chemically synthesized
ccgagatggagtctccctctgt

SEQ ID NO: 1173628 - DNA, 22 bp, Artificial Sequence
  chemically synthesized
cccgagatggagtctccctctg

SEQ ID NO: 1173629 - DNA, 22 bp, Artificial Sequence
  chemically synthesized
tcccgagatggagtctccctct

SEQ ID NO: 1173630 - DNA, 22 bp, Artificial Sequence
  chemically synthesized
ttcccgagatggagtctccctc

SEQ ID NO: 1173631 - DNA, 22 bp, Artificial Sequence
  chemically synthesized
tttcccgagatggagtctccct

SEQ ID NO: 1173632 - DNA, 22 bp, Artificial Sequence
  chemically synthesized
ttttcccgagatggagtctccc

SEQ ID NO: 1173633 - DNA, 22 bp, Artificial Sequence
  chemically synthesized
tttttcccgagatggagtctcc

SEQ ID NO: 1173634 - DNA, 22 bp, Artificial Sequence
  chemically synthesized
ttttttcccgagatggagtctc

SEQ ID NO: 1173635 - DNA, 22 bp, Artificial Sequence
  chemically synthesized
tttttttcccgagatggagtct

SEQ ID NO: 1173636 - DNA, 22 bp, Artificial Sequence
  chemically synthesized
gcgacagagggagactccatct

SEQ ID NO: 1173637 - DNA, 22 bp, Artificial Sequence
  chemically synthesized
ttttttttcccgagatggagtc

SEQ ID NO: 1173638 - DNA, 22 bp, Artificial Sequence
  chemically synthesized
tttttttttcccgagatggagt

SEQ ID NO: 1173639 - DNA, 22 bp, Artificial Sequence
  chemically synthesized
ttttttttttcccgagatggag

SEQ ID NO: 1173640 - DNA, 22 bp, Artificial Sequence
  chemically synthesized
agtgtacttttttttttttccc

SEQ ID NO: 1173641 - DNA, 22 bp, Artificial Sequence
  chemically synthesized
aagtgtacttttttttttttcc

SEQ ID NO: 1173642 - DNA, 22 bp, Artificial Sequence
  chemically synthesized
catctcgggaaaaaaaaaaaag

SEQ ID NO: 1173643 - DNA, 22 bp, Artificial Sequence
  chemically synthesized
gggaaaaaaaaaaaagtacact

SEQ ID NO: 1173644 - DNA, 22 bp, Artificial Sequence
  chemically synthesized
agatgaaatgtatgtcatttaa

SEQ ID NO: 1173645 - DNA, 22 bp, Artificial Sequence
  chemically synthesized
tgagatgaaatgtatgtcattt

SEQ ID NO: 1173646 - DNA, 22 bp, Artificial Sequence
  chemically synthesized
ggctctgagatgaaatgtatgt

SEQ ID NO: 1173647 - DNA, 22 bp, Artificial Sequence
  chemically synthesized
aggctctgagatgaaatgtatg

SEQ ID NO: 1173648 - DNA, 22 bp, Artificial Sequence
  chemically synthesized
tacttaggctctgagatgaaat

SEQ ID NO: 1173649 - DNA, 22 bp, Artificial Sequence
  chemically synthesized
aaatgacatacatttcatctca

SEQ ID NO: 1173650 - DNA, 22 bp, Artificial Sequence
  chemically synthesized
aatgacatacatttcatctcag

SEQ ID NO: 1173651 - DNA, 22 bp, Artificial Sequence
  chemically synthesized
aaattatacttaggctctgaga

SEQ ID NO: 1173652 - DNA, 22 bp, Artificial Sequence
  chemically synthesized
caaattatacttaggctctgag

SEQ ID NO: 1173653 - DNA, 22 bp, Artificial Sequence
  chemically synthesized
aaatgcttcaaattatacttag

SEQ ID NO: 1173654 - DNA, 22 bp, Artificial Sequence
  chemically synthesized
catctcagagcctaagtataat

SEQ ID NO: 1173655 - DNA, 22 bp, Artificial Sequence
  chemically synthesized
gaaatgcttcaaattatactta

SEQ ID NO: 1173656 - DNA, 22 bp, Artificial Sequence
  chemically synthesized
atctcagagcctaagtataatt

SEQ ID NO: 1173657 - DNA, 22 bp, Artificial Sequence
  chemically synthesized
agagcctaagtataatttgaag

SEQ ID NO: 1173658 - DNA, 22 bp, Artificial Sequence
  chemically synthesized
agtataatttgaagcatttcaa

SEQ ID NO: 1173659 - DNA, 22 bp, Artificial Sequence
  chemically synthesized
ataagcaaatgggccagcaatt

SEQ ID NO: 1173660 - DNA, 22 bp, Artificial Sequence
  chemically synthesized
gaagcatttcaaattgctggcc

SEQ ID NO: 1173661 - DNA, 22 bp, Artificial Sequence
  chemically synthesized
gataagcaaatgggccagcaat

SEQ ID NO: 1173662 - DNA, 22 bp, Artificial Sequence
  chemically synthesized
aagcatttcaaattgctggccc

SEQ ID NO: 1173663 - DNA, 22 bp, Artificial Sequence
  chemically synthesized
caaattgctggcccatttgctt

SEQ ID NO: 1173664 - DNA, 22 bp, Artificial Sequence
  chemically synthesized
aaattgctggcccatttgctta

SEQ ID NO: 1173665 - DNA, 22 bp, Artificial Sequence
  chemically synthesized
ctggcccatttgcttatcaaat

SEQ ID NO: 1173666 - DNA, 22 bp, Artificial Sequence
  chemically synthesized
aaaaatataacaagatttgata

SEQ ID NO: 1173667 - DNA, 22 bp, Artificial Sequence
  chemically synthesized
gcccatttgcttatcaaatctt

SEQ ID NO: 1173668 - DNA, 22 bp, Artificial Sequence
  chemically synthesized
gcttatcaaatcttgttatatt

SEQ ID NO: 1173669 - DNA, 22 bp, Artificial Sequence
  chemically synthesized
cttatcaaatcttgttatattt

SEQ ID NO: 1173670 - DNA, 22 bp, Artificial Sequence
  chemically synthesized
atcaaatcttgttatatttttg

SEQ ID NO: 1173671 - DNA, 22 bp, Artificial Sequence
  chemically synthesized
tcaaatcttgttatatttttga

SEQ ID NO: 1173672 - DNA, 22 bp, Artificial Sequence
  chemically synthesized
acaatgaaatgtgattcaaaaa

SEQ ID NO: 1173673 - DNA, 22 bp, Artificial Sequence
  chemically synthesized
aacaatgaaatgtgattcaaaa

SEQ ID NO: 1173674 - DNA, 22 bp, Artificial Sequence
  chemically synthesized
gttatatttttgaatcacattt

SEQ ID NO: 1173675 - DNA, 22 bp, Artificial Sequence
  chemically synthesized
ttatatttttgaatcacatttc

SEQ ID NO: 1173676 - DNA, 22 bp, Artificial Sequence
  chemically synthesized
tatttttgaatcacatttcatt

SEQ ID NO: 1173677 - DNA, 22 bp, Artificial Sequence
  chemically synthesized
agggtgtttaacaatgaaatgt

SEQ ID NO: 1173678 - DNA, 22 bp, Artificial Sequence
  chemically synthesized
ttgaatcacatttcattgttaa

SEQ ID NO: 1173679 - DNA, 22 bp, Artificial Sequence
  chemically synthesized
tgaatcacatttcattgttaaa

SEQ ID NO: 1173680 - DNA, 22 bp, Artificial Sequence
  chemically synthesized
gaatcacatttcattgttaaac

SEQ ID NO: 1173681 - DNA, 22 bp, Artificial Sequence
  chemically synthesized
aatcacatttcattgttaaaca

SEQ ID NO: 1173682 - DNA, 22 bp, Artificial Sequence
  chemically synthesized
cattgttaaacaccctcagtgt

SEQ ID NO: 1173683 - DNA, 22 bp, Artificial Sequence
  chemically synthesized
attgttaaacaccctcagtgta

SEQ ID NO: 1173684 - DNA, 22 bp, Artificial Sequence
  chemically synthesized
ttaaacaccctcagtgtataca

SEQ ID NO: 1173685 - DNA, 22 bp, Artificial Sequence
  chemically synthesized
aacaccctcagtgtatacactc

SEQ ID NO: 1173686 - DNA, 22 bp, Artificial Sequence
  chemically synthesized
ataggcatagggacatatgagt

SEQ ID NO: 1173687 - DNA, 22 bp, Artificial Sequence
  chemically synthesized
agtgtatacactcatatgtccc

SEQ ID NO: 1173688 - DNA, 22 bp, Artificial Sequence
  chemically synthesized
agtccacaaagttgataggcat

SEQ ID NO: 1173689 - DNA, 22 bp, Artificial Sequence
  chemically synthesized
atatgtccctatgcctatcaac

SEQ ID NO: 1173690 - DNA, 22 bp, Artificial Sequence
  chemically synthesized
tctcagtccacaaagttgatag

SEQ ID NO: 1173691 - DNA, 22 bp, Artificial Sequence
  chemically synthesized
gtctcagtccacaaagttgata

SEQ ID NO: 1173692 - DNA, 22 bp, Artificial Sequence
  chemically synthesized
ttgtctcagtccacaaagttga

SEQ ID NO: 1173693 - DNA, 22 bp, Artificial Sequence
  chemically synthesized
tgcctatcaactttgtggactg

SEQ ID NO: 1173694 - DNA, 22 bp, Artificial Sequence
  chemically synthesized
tcaactttgtggactgagacaa

SEQ ID NO: 1173695 - DNA, 22 bp, Artificial Sequence
  chemically synthesized
aggtaaaaaaaatattcttgtc

SEQ ID NO: 1173696 - DNA, 22 bp, Artificial Sequence
  chemically synthesized
gaggtaaaaaaaatattcttgt

SEQ ID NO: 1173697 - DNA, 22 bp, Artificial Sequence
  chemically synthesized
tgtggactgagacaagaatatt

SEQ ID NO: 1173698 - DNA, 22 bp, Artificial Sequence
  chemically synthesized
gtggactgagacaagaatattt

SEQ ID NO: 1173699 - DNA, 22 bp, Artificial Sequence
  chemically synthesized
tggactgagacaagaatatttt

SEQ ID NO: 1173700 - DNA, 22 bp, Artificial Sequence
  chemically synthesized
cacttgaggtaaaaaaaatatt

SEQ ID NO: 1173701 - DNA, 22 bp, Artificial Sequence
  chemically synthesized
acacttgaggtaaaaaaaatat

SEQ ID NO: 1173702 - DNA, 22 bp, Artificial Sequence
  chemically synthesized
ttacacttgaggtaaaaaaaat

SEQ ID NO: 1173703 - DNA, 22 bp, Artificial Sequence
  chemically synthesized
agacaagaatattttttttacc

SEQ ID NO: 1173704 - DNA, 22 bp, Artificial Sequence
  chemically synthesized
cattcttacacttgaggtaaaa

SEQ ID NO: 1173705 - DNA, 22 bp, Artificial Sequence
  chemically synthesized
atagtgattacattcttacact

SEQ ID NO: 1173706 - DNA, 22 bp, Artificial Sequence
  chemically synthesized
tttttacctcaagtgtaagaat

SEQ ID NO: 1173707 - DNA, 22 bp, Artificial Sequence
  chemically synthesized
gatagtgattacattcttacac

SEQ ID NO: 1173708 - DNA, 22 bp, Artificial Sequence
  chemically synthesized
ttttacctcaagtgtaagaatg

SEQ ID NO: 1173709 - DNA, 22 bp, Artificial Sequence
  chemically synthesized
tgatagtgattacattcttaca

SEQ ID NO: 1173710 - DNA, 22 bp, Artificial Sequence
  chemically synthesized
tttacctcaagtgtaagaatgt

SEQ ID NO: 1173711 - DNA, 22 bp, Artificial Sequence
  chemically synthesized
ttacctcaagtgtaagaatgta

SEQ ID NO: 1173712 - DNA, 22 bp, Artificial Sequence
  chemically synthesized
tacctcaagtgtaagaatgtaa

SEQ ID NO: 1173713 - DNA, 22 bp, Artificial Sequence
  chemically synthesized
acctcaagtgtaagaatgtaat

SEQ ID NO: 1173714 - DNA, 22 bp, Artificial Sequence
  chemically synthesized
cctcaagtgtaagaatgtaatc

SEQ ID NO: 1173715 - DNA, 22 bp, Artificial Sequence
  chemically synthesized
agttttgatagtgattacattc

SEQ ID NO: 1173716 - DNA, 22 bp, Artificial Sequence
  chemically synthesized
aagtgtaagaatgtaatcacta

SEQ ID NO: 1173717 - DNA, 22 bp, Artificial Sequence
  chemically synthesized
gaaaaacatcagtaaatagtct

SEQ ID NO: 1173718 - DNA, 22 bp, Artificial Sequence
  chemically synthesized
agaaaaacatcagtaaatagtc

SEQ ID NO: 1173719 - DNA, 22 bp, Artificial Sequence
  chemically synthesized
tcaaaactcagactatttactg

SEQ ID NO: 1173720 - DNA, 22 bp, Artificial Sequence
  chemically synthesized
catttagaaaaacatcagtaaa

SEQ ID NO: 1173721 - DNA, 22 bp, Artificial Sequence
  chemically synthesized
ttccatttagaaaaacatcagt

SEQ ID NO: 1173722 - DNA, 22 bp, Artificial Sequence
  chemically synthesized
agactatttactgatgtttttc

SEQ ID NO: 1173723 - DNA, 22 bp, Artificial Sequence
  chemically synthesized
tttactgatgtttttctaaatg

SEQ ID NO: 1173724 - DNA, 22 bp, Artificial Sequence
  chemically synthesized
actgatgtttttctaaatggaa

SEQ ID NO: 1173725 - DNA, 22 bp, Artificial Sequence
  chemically synthesized
ctgatgtttttctaaatggaat

SEQ ID NO: 1173726 - DNA, 22 bp, Artificial Sequence
  chemically synthesized
atgtttttctaaatggaatagt

SEQ ID NO: 1173727 - DNA, 22 bp, Artificial Sequence
  chemically synthesized
aataatgcaacagactattcca

SEQ ID NO: 1173728 - DNA, 22 bp, Artificial Sequence
  chemically synthesized
ttctaaatggaatagtctgttg

SEQ ID NO: 1173729 - DNA, 22 bp, Artificial Sequence
  chemically synthesized
tctaaatggaatagtctgttgc

SEQ ID NO: 1173730 - DNA, 22 bp, Artificial Sequence
  chemically synthesized
ctaaatggaatagtctgttgca

SEQ ID NO: 1173731 - DNA, 22 bp, Artificial Sequence
  chemically synthesized
atgactgaataatgcaacagac

SEQ ID NO: 1173732 - DNA, 22 bp, Artificial Sequence
  chemically synthesized
taaatggaatagtctgttgcat

SEQ ID NO: 1173733 - DNA, 22 bp, Artificial Sequence
  chemically synthesized
tcatgactgaataatgcaacag

SEQ ID NO: 1173734 - DNA, 22 bp, Artificial Sequence
  chemically synthesized
aatggaatagtctgttgcatta

SEQ ID NO: 1173735 - DNA, 22 bp, Artificial Sequence
  chemically synthesized
ctcatgactgaataatgcaaca

SEQ ID NO: 1173736 - DNA, 22 bp, Artificial Sequence
  chemically synthesized
ttgcattattcagtcatgagaa

SEQ ID NO: 1173737 - DNA, 22 bp, Artificial Sequence
  chemically synthesized
tcaaaaacatgatttctcatga

SEQ ID NO: 1173738 - DNA, 22 bp, Artificial Sequence
  chemically synthesized
cattattcagtcatgagaaatc

SEQ ID NO: 1173739 - DNA, 22 bp, Artificial Sequence
  chemically synthesized
ttcagtcatgagaaatcatgtt

SEQ ID NO: 1173740 - DNA, 22 bp, Artificial Sequence
  chemically synthesized
agtcatgagaaatcatgttttt

SEQ ID NO: 1173741 - DNA, 22 bp, Artificial Sequence
  chemically synthesized
agaaacaagccctgtcaaaaac

SEQ ID NO: 1173742 - DNA, 22 bp, Artificial Sequence
  chemically synthesized
gagaaacaagccctgtcaaaaa

SEQ ID NO: 1173743 - DNA, 22 bp, Artificial Sequence
  chemically synthesized
agccaacttgagaaacaagccc

SEQ ID NO: 1173744 - DNA, 22 bp, Artificial Sequence
  chemically synthesized
aagccaacttgagaaacaagcc

SEQ ID NO: 1173745 - DNA, 22 bp, Artificial Sequence
  chemically synthesized
taagccaacttgagaaacaagc

SEQ ID NO: 1173746 - DNA, 22 bp, Artificial Sequence
  chemically synthesized
ttaagccaacttgagaaacaag

SEQ ID NO: 1173747 - DNA, 22 bp, Artificial Sequence
  chemically synthesized
ttgacagggcttgtttctcaag

SEQ ID NO: 1173748 - DNA, 22 bp, Artificial Sequence
  chemically synthesized
tgacagggcttgtttctcaagt

SEQ ID NO: 1173749 - DNA, 22 bp, Artificial Sequence
  chemically synthesized
gacagggcttgtttctcaagtt

SEQ ID NO: 1173750 - DNA, 22 bp, Artificial Sequence
  chemically synthesized
acagggcttgtttctcaagttg

SEQ ID NO: 1173751 - DNA, 22 bp, Artificial Sequence
  chemically synthesized
gtttctcaagttggcttaaaag

SEQ ID NO: 1173752 - DNA, 22 bp, Artificial Sequence
  chemically synthesized
tttctcaagttggcttaaaagg

SEQ ID NO: 1173753 - DNA, 22 bp, Artificial Sequence
  chemically synthesized
ctcaagttggcttaaaaggttc

SEQ ID NO: 1173754 - DNA, 22 bp, Artificial Sequence
  chemically synthesized
tcaagttggcttaaaaggttcc

SEQ ID NO: 1173755 - DNA, 22 bp, Artificial Sequence
  chemically synthesized
aagttggcttaaaaggttcctt

SEQ ID NO: 1173756 - DNA, 22 bp, Artificial Sequence
  chemically synthesized
gcttaaaaggttccttcgcatc

SEQ ID NO: 1173757 - DNA, 22 bp, Artificial Sequence
  chemically synthesized
aaaaggttccttcgcatctctg

SEQ ID NO: 1173758 - DNA, 22 bp, Artificial Sequence
  chemically synthesized
aaaggttccttcgcatctctgc

SEQ ID NO: 1173759 - DNA, 22 bp, Artificial Sequence
  chemically synthesized
cagcaatgtgtgaataatgcag

SEQ ID NO: 1173760 - DNA, 22 bp, Artificial Sequence
  chemically synthesized
cttcgcatctctgcattattca

SEQ ID NO: 1173761 - DNA, 22 bp, Artificial Sequence
  chemically synthesized
tacagcaatgtgtgaataatgc

SEQ ID NO: 1173762 - DNA, 22 bp, Artificial Sequence
  chemically synthesized
ctacagcaatgtgtgaataatg

SEQ ID NO: 1173763 - DNA, 22 bp, Artificial Sequence
  chemically synthesized
cgcatctctgcattattcacac

SEQ ID NO: 1173764 - DNA, 22 bp, Artificial Sequence
  chemically synthesized
gcatctctgcattattcacaca

SEQ ID NO: 1173765 - DNA, 22 bp, Artificial Sequence
  chemically synthesized
gcaccttctacagcaatgtgtg

SEQ ID NO: 1173766 - DNA, 22 bp, Artificial Sequence
  chemically synthesized
agcaccttctacagcaatgtgt

SEQ ID NO: 1173767 - DNA, 22 bp, Artificial Sequence
  chemically synthesized
tagcaccttctacagcaatgtg

SEQ ID NO: 1173768 - DNA, 22 bp, Artificial Sequence
  chemically synthesized
tgcattattcacacattgctgt

SEQ ID NO: 1173769 - DNA, 22 bp, Artificial Sequence
  chemically synthesized
ttagcaccttctacagcaatgt

SEQ ID NO: 1173770 - DNA, 22 bp, Artificial Sequence
  chemically synthesized
cattattcacacattgctgtag

SEQ ID NO: 1173771 - DNA, 22 bp, Artificial Sequence
  chemically synthesized
ttcacacattgctgtagaaggt

SEQ ID NO: 1173772 - DNA, 22 bp, Artificial Sequence
  chemically synthesized
acacattgctgtagaaggtgct

SEQ ID NO: 1173773 - DNA, 22 bp, Artificial Sequence
  chemically synthesized
atgccaagtttttagcaccttc

SEQ ID NO: 1173774 - DNA, 22 bp, Artificial Sequence
  chemically synthesized
ctgatgccaagtttttagcacc

SEQ ID NO: 1173775 - DNA, 22 bp, Artificial Sequence
  chemically synthesized
ctgtagaaggtgctaaaaactt

SEQ ID NO: 1173776 - DNA, 22 bp, Artificial Sequence
  chemically synthesized
tctcctgatgccaagtttttag

SEQ ID NO: 1173777 - DNA, 22 bp, Artificial Sequence
  chemically synthesized
tgtctcctgatgccaagttttt

SEQ ID NO: 1173778 - DNA, 22 bp, Artificial Sequence
  chemically synthesized
tagaaggtgctaaaaacttggc

SEQ ID NO: 1173779 - DNA, 22 bp, Artificial Sequence
  chemically synthesized
aaaacttggcatcaggagacag

SEQ ID NO: 1173780 - DNA, 22 bp, Artificial Sequence
  chemically synthesized
atcagtaggactctgtctcctg

SEQ ID NO: 1173781 - DNA, 22 bp, Artificial Sequence
  chemically synthesized
ctgatcagtaggactctgtctc

SEQ ID NO: 1173782 - DNA, 22 bp, Artificial Sequence
  chemically synthesized
ggcatcaggagacagagtccta

SEQ ID NO: 1173783 - DNA, 22 bp, Artificial Sequence
  chemically synthesized
gcatcaggagacagagtcctac

SEQ ID NO: 1173784 - DNA, 22 bp, Artificial Sequence
  chemically synthesized
atatgataacctgctgatcagt

SEQ ID NO: 1173785 - DNA, 22 bp, Artificial Sequence
  chemically synthesized
ttcatatgataacctgctgatc

SEQ ID NO: 1173786 - DNA, 22 bp, Artificial Sequence
  chemically synthesized
cactattcatatgataacctgc

SEQ ID NO: 1173787 - DNA, 22 bp, Artificial Sequence
  chemically synthesized
ctgatcagcaggttatcatatg

SEQ ID NO: 1173788 - DNA, 22 bp, Artificial Sequence
  chemically synthesized
gaattccactattcatatgata

SEQ ID NO: 1173789 - DNA, 22 bp, Artificial Sequence
  chemically synthesized
atcagcaggttatcatatgaat

SEQ ID NO: 1173790 - DNA, 22 bp, Artificial Sequence
  chemically synthesized
ctggaattccactattcatatg

SEQ ID NO: 1173791 - DNA, 22 bp, Artificial Sequence
  chemically synthesized
ctgctggaattccactattcat

SEQ ID NO: 1173792 - DNA, 22 bp, Artificial Sequence
  chemically synthesized
gctgctggaattccactattca

SEQ ID NO: 1173793 - DNA, 22 bp, Artificial Sequence
  chemically synthesized
tcatatgaatagtggaattcca

SEQ ID NO: 1173794 - DNA, 22 bp, Artificial Sequence
  chemically synthesized
aaacacttgctgctggaattcc

SEQ ID NO: 1173795 - DNA, 22 bp, Artificial Sequence
  chemically synthesized
aaaacacttgctgctggaattc

SEQ ID NO: 1173796 - DNA, 22 bp, Artificial Sequence
  chemically synthesized
taaaacacttgctgctggaatt

SEQ ID NO: 1173797 - DNA, 22 bp, Artificial Sequence
  chemically synthesized
ttttaaaacacttgctgctgga

SEQ ID NO: 1173798 - DNA, 22 bp, Artificial Sequence
  chemically synthesized
gttttaaaacacttgctgctgg

SEQ ID NO: 1173799 - DNA, 22 bp, Artificial Sequence
  chemically synthesized
tgttttaaaacacttgctgctg

SEQ ID NO: 1173800 - DNA, 22 bp, Artificial Sequence
  chemically synthesized
cagcagcaagtgttttaaaaca

SEQ ID NO: 1173801 - DNA, 22 bp, Artificial Sequence
  chemically synthesized
taaaacaaaatgccgcctgata

SEQ ID NO: 1173802 - DNA, 22 bp, Artificial Sequence
  chemically synthesized
aaaacaaaatgccgcctgatac

SEQ ID NO: 1173803 - DNA, 22 bp, Artificial Sequence
  chemically synthesized
aaacaaaatgccgcctgatact

SEQ ID NO: 1173804 - DNA, 22 bp, Artificial Sequence
  chemically synthesized
taaaacatgataaaataagtat

SEQ ID NO: 1173805 - DNA, 22 bp, Artificial Sequence
  chemically synthesized
ataaaacatgataaaataagta

SEQ ID NO: 1173806 - DNA, 22 bp, Artificial Sequence
  chemically synthesized
tataaaacatgataaaataagt

SEQ ID NO: 1173807 - DNA, 22 bp, Artificial Sequence
  chemically synthesized
attttataaaacatgataaaat

SEQ ID NO: 1173808 - DNA, 22 bp, Artificial Sequence
  chemically synthesized
gattttataaaacatgataaaa

SEQ ID NO: 1173809 - DNA, 22 bp, Artificial Sequence
  chemically synthesized
atacttattttatcatgtttta

SEQ ID NO: 1173810 - DNA, 22 bp, Artificial Sequence
  chemically synthesized
acatgatttgattttataaaac

SEQ ID NO: 1173811 - DNA, 22 bp, Artificial Sequence
  chemically synthesized
aacatgatttgattttataaaa

SEQ ID NO: 1173812 - DNA, 22 bp, Artificial Sequence
  chemically synthesized
attttatcatgttttataaaat

SEQ ID NO: 1173813 - DNA, 22 bp, Artificial Sequence
  chemically synthesized
ttttatcatgttttataaaatc

SEQ ID NO: 1173814 - DNA, 22 bp, Artificial Sequence
  chemically synthesized
tatcatgttttataaaatcaaa

SEQ ID NO: 1173815 - DNA, 22 bp, Artificial Sequence
  chemically synthesized
atcatgttttataaaatcaaat

SEQ ID NO: 1173816 - DNA, 22 bp, Artificial Sequence
  chemically synthesized
tcatgttttataaaatcaaatc

SEQ ID NO: 1173817 - DNA, 22 bp, Artificial Sequence
  chemically synthesized
gaacagtttaacatgatttgat

SEQ ID NO: 1173818 - DNA, 22 bp, Artificial Sequence
  chemically synthesized
tataaaatcaaatcatgttaaa

SEQ ID NO: 1173819 - DNA, 22 bp, Artificial Sequence
  chemically synthesized
ataaaatcaaatcatgttaaac

SEQ ID NO: 1173820 - DNA, 22 bp, Artificial Sequence
  chemically synthesized
taaaatcaaatcatgttaaact

SEQ ID NO: 1173821 - DNA, 22 bp, Artificial Sequence
  chemically synthesized
aactgttccagtgatgtcatgg

SEQ ID NO: 1173822 - DNA, 22 bp, Artificial Sequence
  chemically synthesized
ttccagtgatgtcatggtctct

SEQ ID NO: 1173823 - DNA, 22 bp, Artificial Sequence
  chemically synthesized
cagtgatgtcatggtctctgct

SEQ ID NO: 1173824 - DNA, 22 bp, Artificial Sequence
  chemically synthesized
tcagagagcaagatggcatagg

SEQ ID NO: 1173825 - DNA, 22 bp, Artificial Sequence
  chemically synthesized
atcagagagcaagatggcatag

SEQ ID NO: 1173826 - DNA, 22 bp, Artificial Sequence
  chemically synthesized
tgctctcttccctatgccatct

SEQ ID NO: 1173827 - DNA, 22 bp, Artificial Sequence
  chemically synthesized
tatcagagagcaagatggcata

SEQ ID NO: 1173828 - DNA, 22 bp, Artificial Sequence
  chemically synthesized
ctctcttccctatgccatcttg

SEQ ID NO: 1173829 - DNA, 22 bp, Artificial Sequence
  chemically synthesized
tcttccctatgccatcttgctc

SEQ ID NO: 1173830 - DNA, 22 bp, Artificial Sequence
  chemically synthesized
aagttttatcagagagcaagat

SEQ ID NO: 1173831 - DNA, 22 bp, Artificial Sequence
  chemically synthesized
ttccctatgccatcttgctctc

SEQ ID NO: 1173832 - DNA, 22 bp, Artificial Sequence
  chemically synthesized
ccctatgccatcttgctctctg

SEQ ID NO: 1173833 - DNA, 22 bp, Artificial Sequence
  chemically synthesized
cctatgccatcttgctctctga

SEQ ID NO: 1173834 - DNA, 22 bp, Artificial Sequence
  chemically synthesized
aagttcaagttttatcagagag

SEQ ID NO: 1173835 - DNA, 22 bp, Artificial Sequence
  chemically synthesized
caagttcaagttttatcagaga

SEQ ID NO: 1173836 - DNA, 22 bp, Artificial Sequence
  chemically synthesized
tgccatcttgctctctgataaa

SEQ ID NO: 1173837 - DNA, 22 bp, Artificial Sequence
  chemically synthesized
tcaagttcaagttttatcagag

SEQ ID NO: 1173838 - DNA, 22 bp, Artificial Sequence
  chemically synthesized
gctctctgataaaacttgaact

SEQ ID NO: 1173839 - DNA, 22 bp, Artificial Sequence
  chemically synthesized
ctctctgataaaacttgaactt

SEQ ID NO: 1173840 - DNA, 22 bp, Artificial Sequence
  chemically synthesized
tctgataaaacttgaacttgaa

SEQ ID NO: 1173841 - DNA, 22 bp, Artificial Sequence
  chemically synthesized
tgataaaacttgaacttgaaag

SEQ ID NO: 1173842 - DNA, 22 bp, Artificial Sequence
  chemically synthesized
aaaaaaaaaaatctttcaagtt

SEQ ID NO: 1173843 - DNA, 22 bp, Artificial Sequence
  chemically synthesized
ataaaacttgaacttgaaagat

SEQ ID NO: 1173844 - DNA, 22 bp, Artificial Sequence
  chemically synthesized
attaaaaaaaaaaaatctttca

SEQ ID NO: 1173845 - DNA, 22 bp, Artificial Sequence
  chemically synthesized
cattaaaaaaaaaaaatctttc

SEQ ID NO: 1173846 - DNA, 22 bp, Artificial Sequence
  chemically synthesized
ccttcattaaaaaaaaaaaatc

SEQ ID NO: 1173847 - DNA, 22 bp, Artificial Sequence
  chemically synthesized
gaacttgaaagatttttttttt

SEQ ID NO: 1173848 - DNA, 22 bp, Artificial Sequence
  chemically synthesized
aacttgaaagattttttttttt

SEQ ID NO: 1173849 - DNA, 22 bp, Artificial Sequence
  chemically synthesized
ctcccttcattaaaaaaaaaaa

SEQ ID NO: 1173850 - DNA, 22 bp, Artificial Sequence
  chemically synthesized
cctcccttcattaaaaaaaaaa

SEQ ID NO: 1173851 - DNA, 22 bp, Artificial Sequence
  chemically synthesized
tcctcccttcattaaaaaaaaa

SEQ ID NO: 1173852 - DNA, 22 bp, Artificial Sequence
  chemically synthesized
gaaagattttttttttttaatg

SEQ ID NO: 1173853 - DNA, 22 bp, Artificial Sequence
  chemically synthesized
aaagattttttttttttaatga

SEQ ID NO: 1173854 - DNA, 22 bp, Artificial Sequence
  chemically synthesized
tattttcctcccttcattaaaa

SEQ ID NO: 1173855 - DNA, 22 bp, Artificial Sequence
  chemically synthesized
tgtattttcctcccttcattaa

SEQ ID NO: 1173856 - DNA, 22 bp, Artificial Sequence
  chemically synthesized
tttttttttaatgaagggagga

SEQ ID NO: 1173857 - DNA, 22 bp, Artificial Sequence
  chemically synthesized
ttttttttaatgaagggaggaa

SEQ ID NO: 1173858 - DNA, 22 bp, Artificial Sequence
  chemically synthesized
tttttttaatgaagggaggaaa

SEQ ID NO: 1173859 - DNA, 22 bp, Artificial Sequence
  chemically synthesized
ttttttaatgaagggaggaaaa

SEQ ID NO: 1173860 - DNA, 22 bp, Artificial Sequence
  chemically synthesized
tttttaatgaagggaggaaaat

SEQ ID NO: 1173861 - DNA, 22 bp, Artificial Sequence
  chemically synthesized
ttttaatgaagggaggaaaata

SEQ ID NO: 1173862 - DNA, 22 bp, Artificial Sequence
  chemically synthesized
tttaatgaagggaggaaaatac

SEQ ID NO: 1173863 - DNA, 22 bp, Artificial Sequence
  chemically synthesized
ttaatgaagggaggaaaataca

SEQ ID NO: 1173864 - DNA, 22 bp, Artificial Sequence
  chemically synthesized
taatgaagggaggaaaatacag

SEQ ID NO: 1173865 - DNA, 22 bp, Artificial Sequence
  chemically synthesized
aatgaagggaggaaaatacaga

SEQ ID NO: 1173866 - DNA, 22 bp, Artificial Sequence
  chemically synthesized
aatgccgtagtctctgtatttt

SEQ ID NO: 1173867 - DNA, 22 bp, Artificial Sequence
  chemically synthesized
atgaagggaggaaaatacagag

SEQ ID NO: 1173868 - DNA, 22 bp, Artificial Sequence
  chemically synthesized
caatgccgtagtctctgtattt

SEQ ID NO: 1173869 - DNA, 22 bp, Artificial Sequence
  chemically synthesized
ttcaatgccgtagtctctgtat

SEQ ID NO: 1173870 - DNA, 22 bp, Artificial Sequence
  chemically synthesized
tcttcaatgccgtagtctctgt

SEQ ID NO: 1173871 - DNA, 22 bp, Artificial Sequence
  chemically synthesized
attctcttcaatgccgtagtct

SEQ ID NO: 1173872 - DNA, 22 bp, Artificial Sequence
  chemically synthesized
aattctcttcaatgccgtagtc

SEQ ID NO: 1173873 - DNA, 22 bp, Artificial Sequence
  chemically synthesized
cttaattctcttcaatgccgta

SEQ ID NO: 1173874 - DNA, 22 bp, Artificial Sequence
  chemically synthesized
ctacttaattctcttcaatgcc

SEQ ID NO: 1173875 - DNA, 22 bp, Artificial Sequence
  chemically synthesized
attcctacttaattctcttcaa

SEQ ID NO: 1173876 - DNA, 22 bp, Artificial Sequence
  chemically synthesized
gtattgattcctacttaattct

SEQ ID NO: 1173877 - DNA, 22 bp, Artificial Sequence
  chemically synthesized
cggcattgaagagaattaagta

SEQ ID NO: 1173878 - DNA, 22 bp, Artificial Sequence
  chemically synthesized
ttagtattgattcctacttaat

SEQ ID NO: 1173879 - DNA, 22 bp, Artificial Sequence
  chemically synthesized
ttattagtattgattcctactt

SEQ ID NO: 1173880 - DNA, 22 bp, Artificial Sequence
  chemically synthesized
aagagaattaagtaggaatcaa

SEQ ID NO: 1173881 - DNA, 22 bp, Artificial Sequence
  chemically synthesized
gtaagtgattattattagtatt

SEQ ID NO: 1173882 - DNA, 22 bp, Artificial Sequence
  chemically synthesized
agtaagtgattattattagtat

SEQ ID NO: 1173883 - DNA, 22 bp, Artificial Sequence
  chemically synthesized
agtaggaatcaatactaataat

SEQ ID NO: 1173884 - DNA, 22 bp, Artificial Sequence
  chemically synthesized
tagtaagtgattattattagta

SEQ ID NO: 1173885 - DNA, 22 bp, Artificial Sequence
  chemically synthesized
ttagtaagtgattattattagt

SEQ ID NO: 1173886 - DNA, 22 bp, Artificial Sequence
  chemically synthesized
ccatttttagtaagtgattatt

SEQ ID NO: 1173887 - DNA, 22 bp, Artificial Sequence
  chemically synthesized
acatactcccatttttagtaag

SEQ ID NO: 1173888 - DNA, 22 bp, Artificial Sequence
  chemically synthesized
ataataatcacttactaaaaat

SEQ ID NO: 1173889 - DNA, 22 bp, Artificial Sequence
  chemically synthesized
actaacatactcccatttttag

SEQ ID NO: 1173890 - DNA, 22 bp, Artificial Sequence
  chemically synthesized
aactaacatactcccattttta

SEQ ID NO: 1173891 - DNA, 22 bp, Artificial Sequence
  chemically synthesized
gtatttaactaacatactccca

SEQ ID NO: 1173892 - DNA, 22 bp, Artificial Sequence
  chemically synthesized
actaaaaatgggagtatgttag

SEQ ID NO: 1173893 - DNA, 22 bp, Artificial Sequence
  chemically synthesized
ctaaaaatgggagtatgttagt

SEQ ID NO: 1173894 - DNA, 22 bp, Artificial Sequence
  chemically synthesized
aaaatgggagtatgttagttaa

SEQ ID NO: 1173895 - DNA, 22 bp, Artificial Sequence
  chemically synthesized
atcccattagtatttaactaac

SEQ ID NO: 1173896 - DNA, 22 bp, Artificial Sequence
  chemically synthesized
aatcccattagtatttaactaa

SEQ ID NO: 1173897 - DNA, 22 bp, Artificial Sequence
  chemically synthesized
taatcccattagtatttaacta

SEQ ID NO: 1173898 - DNA, 22 bp, Artificial Sequence
  chemically synthesized
gataagaagttttaatcccatt

SEQ ID NO: 1173899 - DNA, 22 bp, Artificial Sequence
  chemically synthesized
cgataagaagttttaatcccat

SEQ ID NO: 1173900 - DNA, 22 bp, Artificial Sequence
  chemically synthesized
gttaaatactaatgggattaaa

SEQ ID NO: 1173901 - DNA, 22 bp, Artificial Sequence
  chemically synthesized
aatactaatgggattaaaactt

SEQ ID NO: 1173902 - DNA, 22 bp, Artificial Sequence
  chemically synthesized
atgggattaaaacttcttatcg

SEQ ID NO: 1173903 - DNA, 22 bp, Artificial Sequence
  chemically synthesized
agcatacagcttcgataagaag

SEQ ID NO: 1173904 - DNA, 22 bp, Artificial Sequence
  chemically synthesized
aaacttcttatcgaagctgtat

SEQ ID NO: 1173905 - DNA, 22 bp, Artificial Sequence
  chemically synthesized
cttatcgaagctgtatgctgaa

SEQ ID NO: 1173906 - DNA, 22 bp, Artificial Sequence
  chemically synthesized
ttatcgaagctgtatgctgaat

SEQ ID NO: 1173907 - DNA, 22 bp, Artificial Sequence
  chemically synthesized
atcgaagctgtatgctgaatgt

SEQ ID NO: 1173908 - DNA, 22 bp, Artificial Sequence
  chemically synthesized
tcgaagctgtatgctgaatgtt

SEQ ID NO: 1173909 - DNA, 22 bp, Artificial Sequence
  chemically synthesized
tatgctgaatgttcattacatt

SEQ ID NO: 1173910 - DNA, 22 bp, Artificial Sequence
  chemically synthesized
aatgttcattacatttttctgg

SEQ ID NO: 1173911 - DNA, 22 bp, Artificial Sequence
  chemically synthesized
aggacaaaaatgtccagaaaaa

SEQ ID NO: 1173912 - DNA, 22 bp, Artificial Sequence
  chemically synthesized
caggacaaaaatgtccagaaaa

SEQ ID NO: 1173913 - DNA, 22 bp, Artificial Sequence
  chemically synthesized
tcaggacaaaaatgtccagaaa

SEQ ID NO: 1173914 - DNA, 22 bp, Artificial Sequence
  chemically synthesized
ttcaggacaaaaatgtccagaa

SEQ ID NO: 1173915 - DNA, 22 bp, Artificial Sequence
  chemically synthesized
attacatttttctggacatttt

SEQ ID NO: 1173916 - DNA, 22 bp, Artificial Sequence
  chemically synthesized
atttttcaggacaaaaatgtcc

SEQ ID NO: 1173917 - DNA, 22 bp, Artificial Sequence
  chemically synthesized
catttttctggacatttttgtc

SEQ ID NO: 1173918 - DNA, 22 bp, Artificial Sequence
  chemically synthesized
ttctggacatttttgtcctgaa

SEQ ID NO: 1173919 - DNA, 22 bp, Artificial Sequence
  chemically synthesized
tctggacatttttgtcctgaaa

SEQ ID NO: 1173920 - DNA, 22 bp, Artificial Sequence
  chemically synthesized
taaatgttgatttttcaggaca

SEQ ID NO: 1173921 - DNA, 22 bp, Artificial Sequence
  chemically synthesized
ctggacatttttgtcctgaaaa

SEQ ID NO: 1173922 - DNA, 22 bp, Artificial Sequence
  chemically synthesized
tggacatttttgtcctgaaaaa

SEQ ID NO: 1173923 - DNA, 22 bp, Artificial Sequence
  chemically synthesized
gacatttttgtcctgaaaaatc

SEQ ID NO: 1173924 - DNA, 22 bp, Artificial Sequence
  chemically synthesized
ttgtcctgaaaaatcaacattt

SEQ ID NO: 1173925 - DNA, 22 bp, Artificial Sequence
  chemically synthesized
tgtcctgaaaaatcaacattta

SEQ ID NO: 1173926 - DNA, 22 bp, Artificial Sequence
  chemically synthesized
gtcctgaaaaatcaacatttat

SEQ ID NO: 1173927 - DNA, 22 bp, Artificial Sequence
  chemically synthesized
tcctgaaaaatcaacatttata

SEQ ID NO: 1173928 - DNA, 22 bp, Artificial Sequence
  chemically synthesized
aaaaatcaacatttataggttg

SEQ ID NO: 1173929 - DNA, 22 bp, Artificial Sequence
  chemically synthesized
tataaaatatgtggtatcaacc

SEQ ID NO: 1173930 - DNA, 22 bp, Artificial Sequence
  chemically synthesized
ataggttgataccacatatttt

SEQ ID NO: 1173931 - DNA, 22 bp, Artificial Sequence
  chemically synthesized
taggttgataccacatatttta

SEQ ID NO: 1173932 - DNA, 22 bp, Artificial Sequence
  chemically synthesized
ataccacatattttatatagca

SEQ ID NO: 1173933 - DNA, 22 bp, Artificial Sequence
  chemically synthesized
tgtataacatacaatgtgctat

SEQ ID NO: 1173934 - DNA, 22 bp, Artificial Sequence
  chemically synthesized
ctgtgtataacatacaatgtgc

SEQ ID NO: 1173935 - DNA, 22 bp, Artificial Sequence
  chemically synthesized
tatatagcacattgtatgttat

SEQ ID NO: 1173936 - DNA, 22 bp, Artificial Sequence
  chemically synthesized
atatagcacattgtatgttata

SEQ ID NO: 1173937 - DNA, 22 bp, Artificial Sequence
  chemically synthesized
tatagcacattgtatgttatac

SEQ ID NO: 1173938 - DNA, 22 bp, Artificial Sequence
  chemically synthesized
cagtacaccgtaaattcctgtg

SEQ ID NO: 1173939 - DNA, 22 bp, Artificial Sequence
  chemically synthesized
tatgttatacacaggaatttac

SEQ ID NO: 1173940 - DNA, 22 bp, Artificial Sequence
  chemically synthesized
tacacaggaatttacggtgtac

SEQ ID NO: 1173941 - DNA, 22 bp, Artificial Sequence
  chemically synthesized
tggtaggaatctacagtacacc

SEQ ID NO: 1173942 - DNA, 22 bp, Artificial Sequence
  chemically synthesized
tgtggtaggaatctacagtaca

SEQ ID NO: 1173943 - DNA, 22 bp, Artificial Sequence
  chemically synthesized
acggtgtactgtagattcctac

SEQ ID NO: 1173944 - DNA, 22 bp, Artificial Sequence
  chemically synthesized
cggtgtactgtagattcctacc

SEQ ID NO: 1173945 - DNA, 22 bp, Artificial Sequence
  chemically synthesized
atgatacactctgtggtaggaa

SEQ ID NO: 1173946 - DNA, 22 bp, Artificial Sequence
  chemically synthesized
gatgatacactctgtggtagga

SEQ ID NO: 1173947 - DNA, 22 bp, Artificial Sequence
  chemically synthesized
tgatgatacactctgtggtagg

SEQ ID NO: 1173948 - DNA, 22 bp, Artificial Sequence
  chemically synthesized
attttgatgatacactctgtgg

SEQ ID NO: 1173949 - DNA, 22 bp, Artificial Sequence
  chemically synthesized
tagattcctaccacagagtgta

SEQ ID NO: 1173950 - DNA, 22 bp, Artificial Sequence
  chemically synthesized
ctaattttgatgatacactctg

SEQ ID NO: 1173951 - DNA, 22 bp, Artificial Sequence
  chemically synthesized
ctaccacagagtgtatcatcaa

SEQ ID NO: 1173952 - DNA, 22 bp, Artificial Sequence
  chemically synthesized
ataaactcctaattttgatgat

SEQ ID NO: 1173953 - DNA, 22 bp, Artificial Sequence
  chemically synthesized
ccacagagtgtatcatcaaaat

SEQ ID NO: 1173954 - DNA, 22 bp, Artificial Sequence
  chemically synthesized
tgataaactcctaattttgatg

SEQ ID NO: 1173955 - DNA, 22 bp, Artificial Sequence
  chemically synthesized
agagttctgataaactcctaat

SEQ ID NO: 1173956 - DNA, 22 bp, Artificial Sequence
  chemically synthesized
ggagagaattaagagttctgat

SEQ ID NO: 1173957 - DNA, 22 bp, Artificial Sequence
  chemically synthesized
ggagtttatcagaactcttaat

SEQ ID NO: 1173958 - DNA, 22 bp, Artificial Sequence
  chemically synthesized
agattgggagagaattaagagt

SEQ ID NO: 1173959 - DNA, 22 bp, Artificial Sequence
  chemically synthesized
cagattgggagagaattaagag

SEQ ID NO: 1173960 - DNA, 22 bp, Artificial Sequence
  chemically synthesized
atcagaactcttaattctctcc

SEQ ID NO: 1173961 - DNA, 22 bp, Artificial Sequence
  chemically synthesized
tcagaactcttaattctctccc

SEQ ID NO: 1173962 - DNA, 22 bp, Artificial Sequence
  chemically synthesized
atatttcagattgggagagaat

SEQ ID NO: 1173963 - DNA, 22 bp, Artificial Sequence
  chemically synthesized
ttaattctctcccaatctgaaa

SEQ ID NO: 1173964 - DNA, 22 bp, Artificial Sequence
  chemically synthesized
aattctctcccaatctgaaata

SEQ ID NO: 1173965 - DNA, 22 bp, Artificial Sequence
  chemically synthesized
attctctcccaatctgaaatat

SEQ ID NO: 1173966 - DNA, 22 bp, Artificial Sequence
  chemically synthesized
tctcccaatctgaaatattaac

SEQ ID NO: 1173967 - DNA, 22 bp, Artificial Sequence
  chemically synthesized
atagaagaatgatgttaatatt

SEQ ID NO: 1173968 - DNA, 22 bp, Artificial Sequence
  chemically synthesized
tcccaatctgaaatattaacat

SEQ ID NO: 1173969 - DNA, 22 bp, Artificial Sequence
  chemically synthesized
ccaatctgaaatattaacatca

SEQ ID NO: 1173970 - DNA, 22 bp, Artificial Sequence
  chemically synthesized
aaatattaacatcattcttcta

SEQ ID NO: 1173971 - DNA, 22 bp, Artificial Sequence
  chemically synthesized
acatcattcttctatgaactat

SEQ ID NO: 1173972 - DNA, 22 bp, Artificial Sequence
  chemically synthesized
ttctatgaactatcccatctcc

SEQ ID NO: 1173973 - DNA, 22 bp, Artificial Sequence
  chemically synthesized
ctatgaactatcccatctcctc

SEQ ID NO: 1173974 - DNA, 22 bp, Artificial Sequence
  chemically synthesized
tatgaactatcccatctcctcc

SEQ ID NO: 1173975 - DNA, 22 bp, Artificial Sequence
  chemically synthesized
tgaactatcccatctcctcctt

SEQ ID NO: 1173976 - DNA, 22 bp, Artificial Sequence
  chemically synthesized
agtgatgaaagtaaggaggaga

SEQ ID NO: 1173977 - DNA, 22 bp, Artificial Sequence
  chemically synthesized
aggttcagtgatgaaagtaagg

SEQ ID NO: 1173978 - DNA, 22 bp, Artificial Sequence
  chemically synthesized
tcccatctcctccttactttca

SEQ ID NO: 1173979 - DNA, 22 bp, Artificial Sequence
  chemically synthesized
tgaggttcagtgatgaaagtaa

SEQ ID NO: 1173980 - DNA, 22 bp, Artificial Sequence
  chemically synthesized
ctccttactttcatcactgaac

SEQ ID NO: 1173981 - DNA, 22 bp, Artificial Sequence
  chemically synthesized
atcaattctgaggttcagtgat

SEQ ID NO: 1173982 - DNA, 22 bp, Artificial Sequence
  chemically synthesized
aatcaattctgaggttcagtga

SEQ ID NO: 1173983 - DNA, 22 bp, Artificial Sequence
  chemically synthesized
cttactttcatcactgaacctc

SEQ ID NO: 1173984 - DNA, 22 bp, Artificial Sequence
  chemically synthesized
actttcatcactgaacctcaga

SEQ ID NO: 1173985 - DNA, 22 bp, Artificial Sequence
  chemically synthesized
ctttcatcactgaacctcagaa

SEQ ID NO: 1173986 - DNA, 22 bp, Artificial Sequence
  chemically synthesized
tcatcactgaacctcagaattg

SEQ ID NO: 1173987 - DNA, 22 bp, Artificial Sequence
  chemically synthesized
catcactgaacctcagaattga

SEQ ID NO: 1173988 - DNA, 22 bp, Artificial Sequence
  chemically synthesized
atcactgaacctcagaattgat

SEQ ID NO: 1173989 - DNA, 22 bp, Artificial Sequence
  chemically synthesized
gaaggaggaaagtttaatcaat

SEQ ID NO: 1173990 - DNA, 22 bp, Artificial Sequence
  chemically synthesized
aacctcagaattgattaaactt

SEQ ID NO: 1173991 - DNA, 22 bp, Artificial Sequence
  chemically synthesized
agaattgattaaactttcctcc

SEQ ID NO: 1173992 - DNA, 22 bp, Artificial Sequence
  chemically synthesized
tgggaaactggaaggaggaaag

SEQ ID NO: 1173993 - DNA, 22 bp, Artificial Sequence
  chemically synthesized
attatgggaaactggaaggagg

SEQ ID NO: 1173994 - DNA, 22 bp, Artificial Sequence
  chemically synthesized
attaaactttcctccttccagt

SEQ ID NO: 1173995 - DNA, 22 bp, Artificial Sequence
  chemically synthesized
aactttcctccttccagtttcc

SEQ ID NO: 1173996 - DNA, 22 bp, Artificial Sequence
  chemically synthesized
cggctgattatgggaaactgga

SEQ ID NO: 1173997 - DNA, 22 bp, Artificial Sequence
  chemically synthesized
tcctccttccagtttcccataa

SEQ ID NO: 1173998 - DNA, 22 bp, Artificial Sequence
  chemically synthesized
cctccttccagtttcccataat

SEQ ID NO: 1173999 - DNA, 22 bp, Artificial Sequence
  chemically synthesized
ctccttccagtttcccataatc

SEQ ID NO: 1174000 - DNA, 22 bp, Artificial Sequence
  chemically synthesized
cttccagtttcccataatcagc

SEQ ID NO: 1174001 - DNA, 22 bp, Artificial Sequence
  chemically synthesized
ccagtttcccataatcagccgt

SEQ ID NO: 1174002 - DNA, 22 bp, Artificial Sequence
  chemically synthesized
cagtttcccataatcagccgta

SEQ ID NO: 1174003 - DNA, 22 bp, Artificial Sequence
  chemically synthesized
cccataatcagccgtaattcta

SEQ ID NO: 1174004 - DNA, 22 bp, Artificial Sequence
  chemically synthesized
ccataatcagccgtaattctat

SEQ ID NO: 1174005 - DNA, 22 bp, Artificial Sequence
  chemically synthesized
agtataagtgtggaaaacaaga

SEQ ID NO: 1174006 - DNA, 22 bp, Artificial Sequence
  chemically synthesized
tatgtattatttcttgttttcc

SEQ ID NO: 1174007 - DNA, 22 bp, Artificial Sequence
  chemically synthesized
aagtataagtgtggaaaacaag

SEQ ID NO: 1174008 - DNA, 22 bp, Artificial Sequence
  chemically synthesized
taagtataagtgtggaaaacaa

SEQ ID NO: 1174009 - DNA, 22 bp, Artificial Sequence
  chemically synthesized
tgtattatttcttgttttccac

SEQ ID NO: 1174010 - DNA, 22 bp, Artificial Sequence
  chemically synthesized
ttaagtataagtgtggaaaaca

SEQ ID NO: 1174011 - DNA, 22 bp, Artificial Sequence
  chemically synthesized
tttcttgttttccacacttata

SEQ ID NO: 1174012 - DNA, 22 bp, Artificial Sequence
  chemically synthesized
cttgttttccacacttatactt

SEQ ID NO: 1174013 - DNA, 22 bp, Artificial Sequence
  chemically synthesized
ttgttttccacacttatactta

SEQ ID NO: 1174014 - DNA, 22 bp, Artificial Sequence
  chemically synthesized
tgagagggatttttaagtataa

SEQ ID NO: 1174015 - DNA, 22 bp, Artificial Sequence
  chemically synthesized
gttttccacacttatacttaaa

SEQ ID NO: 1174016 - DNA, 22 bp, Artificial Sequence
  chemically synthesized
ttttccacacttatacttaaaa

SEQ ID NO: 1174017 - DNA, 22 bp, Artificial Sequence
  chemically synthesized
tccacacttatacttaaaaatc

SEQ ID NO: 1174018 - DNA, 22 bp, Artificial Sequence
  chemically synthesized
ccacacttatacttaaaaatcc

SEQ ID NO: 1174019 - DNA, 22 bp, Artificial Sequence
  chemically synthesized
cacacttatacttaaaaatccc

SEQ ID NO: 1174020 - DNA, 22 bp, Artificial Sequence
  chemically synthesized
tgtgctgtgagagggattttta

SEQ ID NO: 1174021 - DNA, 22 bp, Artificial Sequence
  chemically synthesized
gtgtgctgtgagagggattttt

SEQ ID NO: 1174022 - DNA, 22 bp, Artificial Sequence
  chemically synthesized
atacttaaaaatccctctcaca

SEQ ID NO: 1174023 - DNA, 22 bp, Artificial Sequence
  chemically synthesized
tacttaaaaatccctctcacag

SEQ ID NO: 1174024 - DNA, 22 bp, Artificial Sequence
  chemically synthesized
gaagtatacttgtgtgctgtga

SEQ ID NO: 1174025 - DNA, 22 bp, Artificial Sequence
  chemically synthesized
aaaaatccctctcacagcacac

SEQ ID NO: 1174026 - DNA, 22 bp, Artificial Sequence
  chemically synthesized
agaagtatacttgtgtgctgtg

SEQ ID NO: 1174027 - DNA, 22 bp, Artificial Sequence
  chemically synthesized
aaaatccctctcacagcacaca

SEQ ID NO: 1174028 - DNA, 22 bp, Artificial Sequence
  chemically synthesized
tagaagtatacttgtgtgctgt

SEQ ID NO: 1174029 - DNA, 22 bp, Artificial Sequence
  chemically synthesized
ttttagaagtatacttgtgtgc

SEQ ID NO: 1174030 - DNA, 22 bp, Artificial Sequence
  chemically synthesized
ctgttttagaagtatacttgtg

SEQ ID NO: 1174031 - DNA, 22 bp, Artificial Sequence
  chemically synthesized
tcacagcacacaagtatacttc

SEQ ID NO: 1174032 - DNA, 22 bp, Artificial Sequence
  chemically synthesized
acagcacacaagtatacttcta

SEQ ID NO: 1174033 - DNA, 22 bp, Artificial Sequence
  chemically synthesized
gatctactgttttagaagtata

SEQ ID NO: 1174034 - DNA, 22 bp, Artificial Sequence
  chemically synthesized
ctaaaacagtagatccagttgc

SEQ ID NO: 1174035 - DNA, 22 bp, Artificial Sequence
  chemically synthesized
taaaacagtagatccagttgcc

SEQ ID NO: 1174036 - DNA, 22 bp, Artificial Sequence
  chemically synthesized
aaacagtagatccagttgccct

SEQ ID NO: 1174037 - DNA, 22 bp, Artificial Sequence
  chemically synthesized
aggaggatgcaggtaggggaag

SEQ ID NO: 1174038 - DNA, 22 bp, Artificial Sequence
  chemically synthesized
cccttcccctacctgcatcctc

SEQ ID NO: 1174039 - DNA, 22 bp, Artificial Sequence
  chemically synthesized
caaatgaattgaggaggatgca

SEQ ID NO: 1174040 - DNA, 22 bp, Artificial Sequence
  chemically synthesized
cccctacctgcatcctcctcaa

SEQ ID NO: 1174041 - DNA, 22 bp, Artificial Sequence
  chemically synthesized
ccctacctgcatcctcctcaat

SEQ ID NO: 1174042 - DNA, 22 bp, Artificial Sequence
  chemically synthesized
cctgcatcctcctcaattcatt

SEQ ID NO: 1174043 - DNA, 22 bp, Artificial Sequence
  chemically synthesized
aacagtgctgcaaatgaattga

SEQ ID NO: 1174044 - DNA, 22 bp, Artificial Sequence
  chemically synthesized
catcctcctcaattcatttgca

SEQ ID NO: 1174045 - DNA, 22 bp, Artificial Sequence
  chemically synthesized
tgttaaacagtgctgcaaatga

SEQ ID NO: 1174046 - DNA, 22 bp, Artificial Sequence
  chemically synthesized
ctcaattcatttgcagcactgt

SEQ ID NO: 1174047 - DNA, 22 bp, Artificial Sequence
  chemically synthesized
aattcatttgcagcactgttta

SEQ ID NO: 1174048 - DNA, 22 bp, Artificial Sequence
  chemically synthesized
aagaaggtagttatgttaaaca

SEQ ID NO: 1174049 - DNA, 22 bp, Artificial Sequence
  chemically synthesized
atttgcagcactgtttaacata

SEQ ID NO: 1174050 - DNA, 22 bp, Artificial Sequence
  chemically synthesized
aaagaaggtagttatgttaaac

SEQ ID NO: 1174051 - DNA, 22 bp, Artificial Sequence
  chemically synthesized
taaagaaggtagttatgttaaa

SEQ ID NO: 1174052 - DNA, 22 bp, Artificial Sequence
  chemically synthesized
gcagcactgtttaacataacta

SEQ ID NO: 1174053 - DNA, 22 bp, Artificial Sequence
  chemically synthesized
cagcactgtttaacataactac

SEQ ID NO: 1174054 - DNA, 22 bp, Artificial Sequence
  chemically synthesized
aaaagactttaaagaaggtagt

SEQ ID NO: 1174055 - DNA, 22 bp, Artificial Sequence
  chemically synthesized
aaaaagactttaaagaaggtag

SEQ ID NO: 1174056 - DNA, 22 bp, Artificial Sequence
  chemically synthesized
tttaacataactaccttcttta

SEQ ID NO: 1174057 - DNA, 22 bp, Artificial Sequence
  chemically synthesized
aacataactaccttctttaaag

SEQ ID NO: 1174058 - DNA, 22 bp, Artificial Sequence
  chemically synthesized
acataactaccttctttaaagt

SEQ ID NO: 1174059 - DNA, 22 bp, Artificial Sequence
  chemically synthesized
ccttctttaaagtctttttaaa

SEQ ID NO: 1174060 - DNA, 22 bp, Artificial Sequence
  chemically synthesized
ctttaaagtctttttaaatatc

SEQ ID NO: 1174061 - DNA, 22 bp, Artificial Sequence
  chemically synthesized
tttaaagtctttttaaatatct

SEQ ID NO: 1174062 - DNA, 22 bp, Artificial Sequence
  chemically synthesized
taaagtctttttaaatatctgt

SEQ ID NO: 1174063 - DNA, 22 bp, Artificial Sequence
  chemically synthesized
aaagtctttttaaatatctgtt

SEQ ID NO: 1174064 - DNA, 22 bp, Artificial Sequence
  chemically synthesized
aagtctttttaaatatctgtta

SEQ ID NO: 1174065 - DNA, 22 bp, Artificial Sequence
  chemically synthesized
ggaaagtaccatcacataacag

SEQ ID NO: 1174066 - DNA, 22 bp, Artificial Sequence
  chemically synthesized
aggaaagtaccatcacataaca

SEQ ID NO: 1174067 - DNA, 22 bp, Artificial Sequence
  chemically synthesized
tttaaatatctgttatgtgatg

SEQ ID NO: 1174068 - DNA, 22 bp, Artificial Sequence
  chemically synthesized
ttaaatatctgttatgtgatgg

SEQ ID NO: 1174069 - DNA, 22 bp, Artificial Sequence
  chemically synthesized
cttaggaaagtaccatcacata

SEQ ID NO: 1174070 - DNA, 22 bp, Artificial Sequence
  chemically synthesized
taaatatctgttatgtgatggt

SEQ ID NO: 1174071 - DNA, 22 bp, Artificial Sequence
  chemically synthesized
ccttaggaaagtaccatcacat

SEQ ID NO: 1174072 - DNA, 22 bp, Artificial Sequence
  chemically synthesized
aaatatctgttatgtgatggta

SEQ ID NO: 1174073 - DNA, 22 bp, Artificial Sequence
  chemically synthesized
aatatctgttatgtgatggtac

SEQ ID NO: 1174074 - DNA, 22 bp, Artificial Sequence
  chemically synthesized
agagtttccttaggaaagtacc

SEQ ID NO: 1174075 - DNA, 22 bp, Artificial Sequence
  chemically synthesized
aagagtttccttaggaaagtac

SEQ ID NO: 1174076 - DNA, 22 bp, Artificial Sequence
  chemically synthesized
ttatgtgatggtactttcctaa

SEQ ID NO: 1174077 - DNA, 22 bp, Artificial Sequence
  chemically synthesized
tgtgatggtactttcctaagga

SEQ ID NO: 1174078 - DNA, 22 bp, Artificial Sequence
  chemically synthesized
ggtacgatttaagagtttcctt

SEQ ID NO: 1174079 - DNA, 22 bp, Artificial Sequence
  chemically synthesized
tcctaaggaaactcttaaatcg

SEQ ID NO: 1174080 - DNA, 22 bp, Artificial Sequence
  chemically synthesized
cctaaggaaactcttaaatcgt

SEQ ID NO: 1174081 - DNA, 22 bp, Artificial Sequence
  chemically synthesized
ctaaggaaactcttaaatcgta

SEQ ID NO: 1174082 - DNA, 22 bp, Artificial Sequence
  chemically synthesized
aggaaactcttaaatcgtacct

SEQ ID NO: 1174083 - DNA, 22 bp, Artificial Sequence
  chemically synthesized
gaggtgggagacatagttaggt

SEQ ID NO: 1174084 - DNA, 22 bp, Artificial Sequence
  chemically synthesized
ttaaatcgtacctaactatgtc

SEQ ID NO: 1174085 - DNA, 22 bp, Artificial Sequence
  chemically synthesized
aaatcgtacctaactatgtctc

SEQ ID NO: 1174086 - DNA, 22 bp, Artificial Sequence
  chemically synthesized
aatcgtacctaactatgtctcc

SEQ ID NO: 1174087 - DNA, 22 bp, Artificial Sequence
  chemically synthesized
tagggaactagaggtgggagac

SEQ ID NO: 1174088 - DNA, 22 bp, Artificial Sequence
  chemically synthesized
tctgtagggaactagaggtggg

SEQ ID NO: 1174089 - DNA, 22 bp, Artificial Sequence
  chemically synthesized
actatgtctcccacctctagtt

SEQ ID NO: 1174090 - DNA, 22 bp, Artificial Sequence
  chemically synthesized
tctatctgtagggaactagagg

SEQ ID NO: 1174091 - DNA, 22 bp, Artificial Sequence
  chemically synthesized
tgtctcccacctctagttccct

SEQ ID NO: 1174092 - DNA, 22 bp, Artificial Sequence
  chemically synthesized
ccacctctagttccctacagat

SEQ ID NO: 1174093 - DNA, 22 bp, Artificial Sequence
  chemically synthesized
atcgatctatctatctgtaggg

SEQ ID NO: 1174094 - DNA, 22 bp, Artificial Sequence
  chemically synthesized
ttgatcgatctatctatctgta

SEQ ID NO: 1174095 - DNA, 22 bp, Artificial Sequence
  chemically synthesized
gttgatcgatctatctatctgt

SEQ ID NO: 1174096 - DNA, 22 bp, Artificial Sequence
  chemically synthesized
tgttgatcgatctatctatctg

SEQ ID NO: 1174097 - DNA, 22 bp, Artificial Sequence
  chemically synthesized
tagttccctacagatagataga

SEQ ID NO: 1174098 - DNA, 22 bp, Artificial Sequence
  chemically synthesized
ttttgttgatcgatctatctat

SEQ ID NO: 1174099 - DNA, 22 bp, Artificial Sequence
  chemically synthesized
gttccctacagatagatagatc

SEQ ID NO: 1174100 - DNA, 22 bp, Artificial Sequence
  chemically synthesized
attgttttgttgatcgatctat

SEQ ID NO: 1174101 - DNA, 22 bp, Artificial Sequence
  chemically synthesized
cctacagatagatagatcgatc

SEQ ID NO: 1174102 - DNA, 22 bp, Artificial Sequence
  chemically synthesized
attgattgttttgttgatcgat

SEQ ID NO: 1174103 - DNA, 22 bp, Artificial Sequence
  chemically synthesized
cagatagatagatcgatcaaca

SEQ ID NO: 1174104 - DNA, 22 bp, Artificial Sequence
  chemically synthesized
gattgattgttttgttgatcga

SEQ ID NO: 1174105 - DNA, 22 bp, Artificial Sequence
  chemically synthesized
aaggacagaatatttgattgat

SEQ ID NO: 1174106 - DNA, 22 bp, Artificial Sequence
  chemically synthesized
aagaggttcaaggacagaatat

SEQ ID NO: 1174107 - DNA, 22 bp, Artificial Sequence
  chemically synthesized
gaagaggttcaaggacagaata

SEQ ID NO: 1174108 - DNA, 22 bp, Artificial Sequence
  chemically synthesized
tgtccttgaacctcttcaaatt

SEQ ID NO: 1174109 - DNA, 22 bp, Artificial Sequence
  chemically synthesized
tccttgaacctcttcaaatttg

SEQ ID NO: 1174110 - DNA, 22 bp, Artificial Sequence
  chemically synthesized
gaacctcttcaaatttgattgt

SEQ ID NO: 1174111 - DNA, 22 bp, Artificial Sequence
  chemically synthesized
aacctcttcaaatttgattgta

SEQ ID NO: 1174112 - DNA, 22 bp, Artificial Sequence
  chemically synthesized
acagagaaaaaaagtacaatca

SEQ ID NO: 1174113 - DNA, 22 bp, Artificial Sequence
  chemically synthesized
cacagagaaaaaaagtacaatc

SEQ ID NO: 1174114 - DNA, 22 bp, Artificial Sequence
  chemically synthesized
ttcaaatttgattgtacttttt

SEQ ID NO: 1174115 - DNA, 22 bp, Artificial Sequence
  chemically synthesized
caaatttgattgtacttttttt

SEQ ID NO: 1174116 - DNA, 22 bp, Artificial Sequence
  chemically synthesized
aaatttgattgtactttttttc

SEQ ID NO: 1174117 - DNA, 22 bp, Artificial Sequence
  chemically synthesized
gattgtactttttttctctgtg

SEQ ID NO: 1174118 - DNA, 22 bp, Artificial Sequence
  chemically synthesized
attgtactttttttctctgtga

SEQ ID NO: 1174119 - DNA, 22 bp, Artificial Sequence
  chemically synthesized
tactttttttctctgtgaaatt

SEQ ID NO: 1174120 - DNA, 22 bp, Artificial Sequence
  chemically synthesized
tttttctctgtgaaatttcatg

SEQ ID NO: 1174121 - DNA, 22 bp, Artificial Sequence
  chemically synthesized
ttttctctgtgaaatttcatgt

SEQ ID NO: 1174122 - DNA, 22 bp, Artificial Sequence
  chemically synthesized
tttctctgtgaaatttcatgta

SEQ ID NO: 1174123 - DNA, 22 bp, Artificial Sequence
  chemically synthesized
ttctctgtgaaatttcatgtac

SEQ ID NO: 1174124 - DNA, 22 bp, Artificial Sequence
  chemically synthesized
tctctgtgaaatttcatgtact

SEQ ID NO: 1174125 - DNA, 22 bp, Artificial Sequence
  chemically synthesized
ctctgtgaaatttcatgtactt

SEQ ID NO: 1174126 - DNA, 22 bp, Artificial Sequence
  chemically synthesized
tctgtgaaatttcatgtacttt

SEQ ID NO: 1174127 - DNA, 22 bp, Artificial Sequence
  chemically synthesized
tgtgaaatttcatgtacttttt

SEQ ID NO: 1174128 - DNA, 22 bp, Artificial Sequence
  chemically synthesized
tgaaatttcatgtactttttgg

SEQ ID NO: 1174129 - DNA, 22 bp, Artificial Sequence
  chemically synthesized
catgtactttttgggattactc

SEQ ID NO: 1174130 - DNA, 22 bp, Artificial Sequence
  chemically synthesized
atgtactttttgggattactct

SEQ ID NO: 1174131 - DNA, 22 bp, Artificial Sequence
  chemically synthesized
gggtggagagagataacagagt

SEQ ID NO: 1174132 - DNA, 22 bp, Artificial Sequence
  chemically synthesized
tttgggattactctgttatctc

SEQ ID NO: 1174133 - DNA, 22 bp, Artificial Sequence
  chemically synthesized
ttgggattactctgttatctct

SEQ ID NO: 1174134 - DNA, 22 bp, Artificial Sequence
  chemically synthesized
tgggattactctgttatctctc

SEQ ID NO: 1174135 - DNA, 22 bp, Artificial Sequence
  chemically synthesized
gggattactctgttatctctct

SEQ ID NO: 1174136 - DNA, 22 bp, Artificial Sequence
  chemically synthesized
ggattactctgttatctctctc

SEQ ID NO: 1174137 - DNA, 22 bp, Artificial Sequence
  chemically synthesized
caggggctagggtggagagaga

SEQ ID NO: 1174138 - DNA, 22 bp, Artificial Sequence
  chemically synthesized
ctctgttatctctctccaccct

SEQ ID NO: 1174139 - DNA, 22 bp, Artificial Sequence
  chemically synthesized
tgttatctctctccaccctagc

SEQ ID NO: 1174140 - DNA, 22 bp, Artificial Sequence
  chemically synthesized
ttatctctctccaccctagccc

SEQ ID NO: 1174141 - DNA, 22 bp, Artificial Sequence
  chemically synthesized
tctctctccaccctagcccctg

SEQ ID NO: 1174142 - DNA, 22 bp, Artificial Sequence
  chemically synthesized
tctccaccctagcccctgcaat

SEQ ID NO: 1174143 - DNA, 22 bp, Artificial Sequence
  chemically synthesized
tccaccctagcccctgcaatgc

SEQ ID NO: 1174144 - DNA, 22 bp, Artificial Sequence
  chemically synthesized
caccctagcccctgcaatgcga

SEQ ID NO: 1174145 - DNA, 22 bp, Artificial Sequence
  chemically synthesized
agaccagtgatagaatcgcatt

SEQ ID NO: 1174146 - DNA, 22 bp, Artificial Sequence
  chemically synthesized
gcccctgcaatgcgattctatc

SEQ ID NO: 1174147 - DNA, 22 bp, Artificial Sequence
  chemically synthesized
caatgcgattctatcactggtc

SEQ ID NO: 1174148 - DNA, 22 bp, Artificial Sequence
  chemically synthesized
tcaacagatcagttaagaccag

SEQ ID NO: 1174149 - DNA, 22 bp, Artificial Sequence
  chemically synthesized
ttatcaacagatcagttaagac

SEQ ID NO: 1174150 - DNA, 22 bp, Artificial Sequence
  chemically synthesized
attatcaacagatcagttaaga

SEQ ID NO: 1174151 - DNA, 22 bp, Artificial Sequence
  chemically synthesized
tatcactggtcttaactgatct

SEQ ID NO: 1174152 - DNA, 22 bp, Artificial Sequence
  chemically synthesized
tcactggtcttaactgatctgt

SEQ ID NO: 1174153 - DNA, 22 bp, Artificial Sequence
  chemically synthesized
gtcttaactgatctgttgataa

SEQ ID NO: 1174154 - DNA, 22 bp, Artificial Sequence
  chemically synthesized
gaaatcagggtttattatcaac

SEQ ID NO: 1174155 - DNA, 22 bp, Artificial Sequence
  chemically synthesized
ggaaatcagggtttattatcaa

SEQ ID NO: 1174156 - DNA, 22 bp, Artificial Sequence
  chemically synthesized
aactgatctgttgataataaac

SEQ ID NO: 1174157 - DNA, 22 bp, Artificial Sequence
  chemically synthesized
actgatctgttgataataaacc

SEQ ID NO: 1174158 - DNA, 22 bp, Artificial Sequence
  chemically synthesized
tatttggaaatcagggtttatt

SEQ ID NO: 1174159 - DNA, 22 bp, Artificial Sequence
  chemically synthesized
atctgttgataataaaccctga

SEQ ID NO: 1174160 - DNA, 22 bp, Artificial Sequence
  chemically synthesized
actgtatttggaaatcagggtt

SEQ ID NO: 1174161 - DNA, 22 bp, Artificial Sequence
  chemically synthesized
ttgataataaaccctgatttcc

SEQ ID NO: 1174162 - DNA, 22 bp, Artificial Sequence
  chemically synthesized
ataataaaccctgatttccaaa

SEQ ID NO: 1174163 - DNA, 22 bp, Artificial Sequence
  chemically synthesized
cagaataagctaactgtatttg

SEQ ID NO: 1174164 - DNA, 22 bp, Artificial Sequence
  chemically synthesized
cctccagaataagctaactgta

SEQ ID NO: 1174165 - DNA, 22 bp, Artificial Sequence
  chemically synthesized
atttccaaatacagttagctta

SEQ ID NO: 1174166 - DNA, 22 bp, Artificial Sequence
  chemically synthesized
ccaaatacagttagcttattct

SEQ ID NO: 1174167 - DNA, 22 bp, Artificial Sequence
  chemically synthesized
caaatacagttagcttattctg

SEQ ID NO: 1174168 - DNA, 22 bp, Artificial Sequence
  chemically synthesized
aaagtgtcaaggttgcctccag

SEQ ID NO: 1174169 - DNA, 22 bp, Artificial Sequence
  chemically synthesized
gcttattctggaggcaaccttg

SEQ ID NO: 1174170 - DNA, 22 bp, Artificial Sequence
  chemically synthesized
agttgaaagtgtcaaggttgcc

SEQ ID NO: 1174171 - DNA, 22 bp, Artificial Sequence
  chemically synthesized
attctggaggcaaccttgacac

SEQ ID NO: 1174172 - DNA, 22 bp, Artificial Sequence
  chemically synthesized
ttctggaggcaaccttgacact

SEQ ID NO: 1174173 - DNA, 22 bp, Artificial Sequence
  chemically synthesized
tggaggcaaccttgacactttc

SEQ ID NO: 1174174 - DNA, 22 bp, Artificial Sequence
  chemically synthesized
gaggcaaccttgacactttcaa

SEQ ID NO: 1174175 - DNA, 22 bp, Artificial Sequence
  chemically synthesized
gacactttcaactcagcatggc

SEQ ID NO: 1174176 - DNA, 22 bp, Artificial Sequence
  chemically synthesized
acactttcaactcagcatggcc

SEQ ID NO: 1174177 - DNA, 22 bp, Artificial Sequence
  chemically synthesized
tcaactcagcatggcccttttt

SEQ ID NO: 1174178 - DNA, 22 bp, Artificial Sequence
  chemically synthesized
ccaaaaaaaaccaaaaagggcc

SEQ ID NO: 1174179 - DNA, 22 bp, Artificial Sequence
  chemically synthesized
caactcagcatggccctttttg

SEQ ID NO: 1174180 - DNA, 22 bp, Artificial Sequence
  chemically synthesized
aactcagcatggccctttttgg

SEQ ID NO: 1174181 - DNA, 22 bp, Artificial Sequence
  chemically synthesized
agcatggccctttttggttttt

SEQ ID NO: 1174182 - DNA, 22 bp, Artificial Sequence
  chemically synthesized
ggaaggattgccaaaaaaaacc

SEQ ID NO: 1174183 - DNA, 22 bp, Artificial Sequence
  chemically synthesized
aggaaggattgccaaaaaaaac

SEQ ID NO: 1174184 - DNA, 22 bp, Artificial Sequence
  chemically synthesized
taggaaggattgccaaaaaaaa

SEQ ID NO: 1174185 - DNA, 22 bp, Artificial Sequence
  chemically synthesized
cctttaggaaggattgccaaaa

SEQ ID NO: 1174186 - DNA, 22 bp, Artificial Sequence
  chemically synthesized
gcctttaggaaggattgccaaa

SEQ ID NO: 1174187 - DNA, 22 bp, Artificial Sequence
  chemically synthesized
tgcctttaggaaggattgccaa

SEQ ID NO: 1174188 - DNA, 22 bp, Artificial Sequence
  chemically synthesized
tttggttttttttggcaatcct

SEQ ID NO: 1174189 - DNA, 22 bp, Artificial Sequence
  chemically synthesized
ttggttttttttggcaatcctt

SEQ ID NO: 1174190 - DNA, 22 bp, Artificial Sequence
  chemically synthesized
tggttttttttggcaatccttc

SEQ ID NO: 1174191 - DNA, 22 bp, Artificial Sequence
  chemically synthesized
ggttttttttggcaatccttcc

SEQ ID NO: 1174192 - DNA, 22 bp, Artificial Sequence
  chemically synthesized
gttttttttggcaatccttcct

SEQ ID NO: 1174193 - DNA, 22 bp, Artificial Sequence
  chemically synthesized
tttttggcaatccttcctaaag

SEQ ID NO: 1174194 - DNA, 22 bp, Artificial Sequence
  chemically synthesized
ttttggcaatccttcctaaagg

SEQ ID NO: 1174195 - DNA, 22 bp, Artificial Sequence
  chemically synthesized
tttggcaatccttcctaaaggc

SEQ ID NO: 1174196 - DNA, 22 bp, Artificial Sequence
  chemically synthesized
ttggcaatccttcctaaaggca

SEQ ID NO: 1174197 - DNA, 22 bp, Artificial Sequence
  chemically synthesized
tggcaatccttcctaaaggcaa

SEQ ID NO: 1174198 - DNA, 22 bp, Artificial Sequence
  chemically synthesized
ggcaatccttcctaaaggcaaa

SEQ ID NO: 1174199 - DNA, 22 bp, Artificial Sequence
  chemically synthesized
gcaatccttcctaaaggcaaag

SEQ ID NO: 1174200 - DNA, 22 bp, Artificial Sequence
  chemically synthesized
aatggagaggcactttgccttt

SEQ ID NO: 1174201 - DNA, 22 bp, Artificial Sequence
  chemically synthesized
tgaagctgaatggagaggcact

SEQ ID NO: 1174202 - DNA, 22 bp, Artificial Sequence
  chemically synthesized
cctaaaggcaaagtgcctctcc

SEQ ID NO: 1174203 - DNA, 22 bp, Artificial Sequence
  chemically synthesized
atgaagctgaatggagaggcac

SEQ ID NO: 1174204 - DNA, 22 bp, Artificial Sequence
  chemically synthesized
ctaaaggcaaagtgcctctcca

SEQ ID NO: 1174205 - DNA, 22 bp, Artificial Sequence
  chemically synthesized
aaggcaaagtgcctctccattc

SEQ ID NO: 1174206 - DNA, 22 bp, Artificial Sequence
  chemically synthesized
ggacttatgaagctgaatggag

SEQ ID NO: 1174207 - DNA, 22 bp, Artificial Sequence
  chemically synthesized
aaccctgggacttatgaagctg

SEQ ID NO: 1174208 - DNA, 22 bp, Artificial Sequence
  chemically synthesized
caaccctgggacttatgaagct

SEQ ID NO: 1174209 - DNA, 22 bp, Artificial Sequence
  chemically synthesized
tccattcagcttcataagtccc

SEQ ID NO: 1174210 - DNA, 22 bp, Artificial Sequence
  chemically synthesized
cattcagcttcataagtcccag

SEQ ID NO: 1174211 - DNA, 22 bp, Artificial Sequence
  chemically synthesized
agcttcataagtcccagggttg

SEQ ID NO: 1174212 - DNA, 22 bp, Artificial Sequence
  chemically synthesized
cataagtcccagggttgaaaca

SEQ ID NO: 1174213 - DNA, 22 bp, Artificial Sequence
  chemically synthesized
ataagtcccagggttgaaacac

SEQ ID NO: 1174214 - DNA, 22 bp, Artificial Sequence
  chemically synthesized
aataacaagtcatgtgtttcaa

SEQ ID NO: 1174215 - DNA, 22 bp, Artificial Sequence
  chemically synthesized
gaataacaagtcatgtgtttca

SEQ ID NO: 1174216 - DNA, 22 bp, Artificial Sequence
  chemically synthesized
tgaataacaagtcatgtgtttc

SEQ ID NO: 1174217 - DNA, 22 bp, Artificial Sequence
  chemically synthesized
gcaggttttgaataacaagtca

SEQ ID NO: 1174218 - DNA, 22 bp, Artificial Sequence
  chemically synthesized
aaacacatgacttgttattcaa

SEQ ID NO: 1174219 - DNA, 22 bp, Artificial Sequence
  chemically synthesized
gttattcaaaacctgccaatgc

SEQ ID NO: 1174220 - DNA, 22 bp, Artificial Sequence
  chemically synthesized
ttattcaaaacctgccaatgcc

SEQ ID NO: 1174221 - DNA, 22 bp, Artificial Sequence
  chemically synthesized
ttcaaaacctgccaatgccctt

SEQ ID NO: 1174222 - DNA, 22 bp, Artificial Sequence
  chemically synthesized
agtaggcaagagaagggcattg

SEQ ID NO: 1174223 - DNA, 22 bp, Artificial Sequence
  chemically synthesized
aaaacctgccaatgcccttctc

SEQ ID NO: 1174224 - DNA, 22 bp, Artificial Sequence
  chemically synthesized
ttcagtaggcaagagaagggca

SEQ ID NO: 1174225 - DNA, 22 bp, Artificial Sequence
  chemically synthesized
attcagtaggcaagagaagggc

SEQ ID NO: 1174226 - DNA, 22 bp, Artificial Sequence
  chemically synthesized
tattcagtaggcaagagaaggg

SEQ ID NO: 1174227 - DNA, 22 bp, Artificial Sequence
  chemically synthesized
ccaatgcccttctcttgcctac

SEQ ID NO: 1174228 - DNA, 22 bp, Artificial Sequence
  chemically synthesized
aaggagatacattttattcagt

SEQ ID NO: 1174229 - DNA, 22 bp, Artificial Sequence
  chemically synthesized
ctcttgcctactgaataaaatg

SEQ ID NO: 1174230 - DNA, 22 bp, Artificial Sequence
  chemically synthesized
tcttgcctactgaataaaatgt

SEQ ID NO: 1174231 - DNA, 22 bp, Artificial Sequence
  chemically synthesized
ttgcctactgaataaaatgtat

SEQ ID NO: 1174232 - DNA, 22 bp, Artificial Sequence
  chemically synthesized
gcctactgaataaaatgtatct

SEQ ID NO: 1174233 - DNA, 22 bp, Artificial Sequence
  chemically synthesized
cctactgaataaaatgtatctc

SEQ ID NO: 1174234 - DNA, 22 bp, Artificial Sequence
  chemically synthesized
catatcatgctcaaggagatac

SEQ ID NO: 1174235 - DNA, 22 bp, Artificial Sequence
  chemically synthesized
ctgaataaaatgtatctccttg

SEQ ID NO: 1174236 - DNA, 22 bp, Artificial Sequence
  chemically synthesized
gcatatcatgctcaaggagata

SEQ ID NO: 1174237 - DNA, 22 bp, Artificial Sequence
  chemically synthesized
tgcatatcatgctcaaggagat

SEQ ID NO: 1174238 - DNA, 22 bp, Artificial Sequence
  chemically synthesized
aataaaatgtatctccttgagc

SEQ ID NO: 1174239 - DNA, 22 bp, Artificial Sequence
  chemically synthesized
tggaggattttgcatatcatgc

SEQ ID NO: 1174240 - DNA, 22 bp, Artificial Sequence
  chemically synthesized
cttgagcatgatatgcaaaatc

SEQ ID NO: 1174241 - DNA, 22 bp, Artificial Sequence
  chemically synthesized
gagcatgatatgcaaaatcctc

SEQ ID NO: 1174242 - DNA, 22 bp, Artificial Sequence
  chemically synthesized
agcatgatatgcaaaatcctcc

SEQ ID NO: 1174243 - DNA, 22 bp, Artificial Sequence
  chemically synthesized
aaggacacattgtggaggattt

SEQ ID NO: 1174244 - DNA, 22 bp, Artificial Sequence
  chemically synthesized
gaaaatgaggttgaaggacaca

SEQ ID NO: 1174245 - DNA, 22 bp, Artificial Sequence
  chemically synthesized
cacaatgtgtccttcaacctca

SEQ ID NO: 1174246 - DNA, 22 bp, Artificial Sequence
  chemically synthesized
caacctcattttccagccgcct

SEQ ID NO: 1174247 - DNA, 22 bp, Artificial Sequence
  chemically synthesized
aacctcattttccagccgcctc

SEQ ID NO: 1174248 - DNA, 22 bp, Artificial Sequence
  chemically synthesized
ggggaggaggagtaggagaggc

SEQ ID NO: 1174249 - DNA, 22 bp, Artificial Sequence
  chemically synthesized
attttccagccgcctctcctac

SEQ ID NO: 1174250 - DNA, 22 bp, Artificial Sequence
  chemically synthesized
tccagccgcctctcctactcct

SEQ ID NO: 1174251 - DNA, 22 bp, Artificial Sequence
  chemically synthesized
ccagccgcctctcctactcctc

SEQ ID NO: 1174252 - DNA, 22 bp, Artificial Sequence
  chemically synthesized
cagccgcctctcctactcctcc

SEQ ID NO: 1174253 - DNA, 22 bp, Artificial Sequence
  chemically synthesized
tcctactcctcctcccctaacc

SEQ ID NO: 1174254 - DNA, 22 bp, Artificial Sequence
  chemically synthesized
ctactcctcctcccctaaccat

SEQ ID NO: 1174255 - DNA, 22 bp, Artificial Sequence
  chemically synthesized
gtgtgtagggcatatggttagg

SEQ ID NO: 1174256 - DNA, 22 bp, Artificial Sequence
  chemically synthesized
cgtgtgtagggcatatggttag

SEQ ID NO: 1174257 - DNA, 22 bp, Artificial Sequence
  chemically synthesized
ctcctcctcccctaaccatatg

SEQ ID NO: 1174258 - DNA, 22 bp, Artificial Sequence
  chemically synthesized
ctcctcccctaaccatatgccc

SEQ ID NO: 1174259 - DNA, 22 bp, Artificial Sequence
  chemically synthesized
gtttcgtgtgtagggcatatgg

SEQ ID NO: 1174260 - DNA, 22 bp, Artificial Sequence
  chemically synthesized
ctcccctaaccatatgccctac

SEQ ID NO: 1174261 - DNA, 22 bp, Artificial Sequence
  chemically synthesized
ttcgtttcgtgtgtagggcata

SEQ ID NO: 1174262 - DNA, 22 bp, Artificial Sequence
  chemically synthesized
ccctaaccatatgccctacaca

SEQ ID NO: 1174263 - DNA, 22 bp, Artificial Sequence
  chemically synthesized
tgactgttcgtttcgtgtgtag

SEQ ID NO: 1174264 - DNA, 22 bp, Artificial Sequence
  chemically synthesized
gtgactgttcgtttcgtgtgta

SEQ ID NO: 1174265 - DNA, 22 bp, Artificial Sequence
  chemically synthesized
accatatgccctacacacgaaa

SEQ ID NO: 1174266 - DNA, 22 bp, Artificial Sequence
  chemically synthesized
tgtgactgttcgtttcgtgtgt

SEQ ID NO: 1174267 - DNA, 22 bp, Artificial Sequence
  chemically synthesized
attttgtgactgttcgtttcgt

SEQ ID NO: 1174268 - DNA, 22 bp, Artificial Sequence
  chemically synthesized
cacacgaaacgaacagtcacaa

SEQ ID NO: 1174269 - DNA, 22 bp, Artificial Sequence
  chemically synthesized
aatgagaaagaagcacgaatcg

SEQ ID NO: 1174270 - DNA, 22 bp, Artificial Sequence
  chemically synthesized
tggagctaaatgagaaagaagc

SEQ ID NO: 1174271 - DNA, 22 bp, Artificial Sequence
  chemically synthesized
gtggagctaaatgagaaagaag

SEQ ID NO: 1174272 - DNA, 22 bp, Artificial Sequence
  chemically synthesized
tgtggagctaaatgagaaagaa

SEQ ID NO: 1174273 - DNA, 22 bp, Artificial Sequence
  chemically synthesized
acgattcgtgcttctttctcat

SEQ ID NO: 1174274 - DNA, 22 bp, Artificial Sequence
  chemically synthesized
actttgtggagctaaatgagaa

SEQ ID NO: 1174275 - DNA, 22 bp, Artificial Sequence
  chemically synthesized
cactttgtggagctaaatgaga

SEQ ID NO: 1174276 - DNA, 22 bp, Artificial Sequence
  chemically synthesized
gtgcttctttctcatttagctc

SEQ ID NO: 1174277 - DNA, 22 bp, Artificial Sequence
  chemically synthesized
cttcactttgtggagctaaatg

SEQ ID NO: 1174278 - DNA, 22 bp, Artificial Sequence
  chemically synthesized
ctttctcatttagctccacaaa

SEQ ID NO: 1174279 - DNA, 22 bp, Artificial Sequence
  chemically synthesized
tttctcatttagctccacaaag

SEQ ID NO: 1174280 - DNA, 22 bp, Artificial Sequence
  chemically synthesized
tctcatttagctccacaaagtg

SEQ ID NO: 1174281 - DNA, 22 bp, Artificial Sequence
  chemically synthesized
ctcatttagctccacaaagtga

SEQ ID NO: 1174282 - DNA, 22 bp, Artificial Sequence
  chemically synthesized
tcatttagctccacaaagtgaa

SEQ ID NO: 1174283 - DNA, 22 bp, Artificial Sequence
  chemically synthesized
atttagctccacaaagtgaagt

SEQ ID NO: 1174284 - DNA, 22 bp, Artificial Sequence
  chemically synthesized
agctccacaaagtgaagtaata

SEQ ID NO: 1174285 - DNA, 22 bp, Artificial Sequence
  chemically synthesized
gctccacaaagtgaagtaatat

SEQ ID NO: 1174286 - DNA, 22 bp, Artificial Sequence
  chemically synthesized
cacaaagtgaagtaatatttct

SEQ ID NO: 1174287 - DNA, 22 bp, Artificial Sequence
  chemically synthesized
taaggagatcatcccatagaaa

SEQ ID NO: 1174288 - DNA, 22 bp, Artificial Sequence
  chemically synthesized
ataaggagatcatcccatagaa

SEQ ID NO: 1174289 - DNA, 22 bp, Artificial Sequence
  chemically synthesized
tataaggagatcatcccataga

SEQ ID NO: 1174290 - DNA, 22 bp, Artificial Sequence
  chemically synthesized
ttataaggagatcatcccatag

SEQ ID NO: 1174291 - DNA, 22 bp, Artificial Sequence
  chemically synthesized
ctatgggatgatctccttataa

SEQ ID NO: 1174292 - DNA, 22 bp, Artificial Sequence
  chemically synthesized
tatgggatgatctccttataaa

SEQ ID NO: 1174293 - DNA, 22 bp, Artificial Sequence
  chemically synthesized
tgggatgatctccttataaaaa

SEQ ID NO: 1174294 - DNA, 22 bp, Artificial Sequence
  chemically synthesized
atagtcaagtatgatttttata

SEQ ID NO: 1174295 - DNA, 22 bp, Artificial Sequence
  chemically synthesized
gatagtcaagtatgatttttat

SEQ ID NO: 1174296 - DNA, 22 bp, Artificial Sequence
  chemically synthesized
cttataaaaatcatacttgact

SEQ ID NO: 1174297 - DNA, 22 bp, Artificial Sequence
  chemically synthesized
ataaaaatcatacttgactatc

SEQ ID NO: 1174298 - DNA, 22 bp, Artificial Sequence
  chemically synthesized
taaaaatcatacttgactatca

SEQ ID NO: 1174299 - DNA, 22 bp, Artificial Sequence
  chemically synthesized
aatgatgagccttgatagtcaa

SEQ ID NO: 1174300 - DNA, 22 bp, Artificial Sequence
  chemically synthesized
gactatcaaggctcatcattca

SEQ ID NO: 1174301 - DNA, 22 bp, Artificial Sequence
  chemically synthesized
actatcaaggctcatcattcag

SEQ ID NO: 1174302 - DNA, 22 bp, Artificial Sequence
  chemically synthesized
tcaaggctcatcattcagttat

SEQ ID NO: 1174303 - DNA, 22 bp, Artificial Sequence
  chemically synthesized
gcaggtagcagaaggtataact

SEQ ID NO: 1174304 - DNA, 22 bp, Artificial Sequence
  chemically synthesized
agcaggtagcagaaggtataac

SEQ ID NO: 1174305 - DNA, 22 bp, Artificial Sequence
  chemically synthesized
atcattcagttataccttctgc

SEQ ID NO: 1174306 - DNA, 22 bp, Artificial Sequence
  chemically synthesized
gcttagcaggtagcagaaggta

SEQ ID NO: 1174307 - DNA, 22 bp, Artificial Sequence
  chemically synthesized
ggcttagcaggtagcagaaggt

SEQ ID NO: 1174308 - DNA, 22 bp, Artificial Sequence
  chemically synthesized
agttataccttctgctacctgc

SEQ ID NO: 1174309 - DNA, 22 bp, Artificial Sequence
  chemically synthesized
ataaatcttggcttagcaggta

SEQ ID NO: 1174310 - DNA, 22 bp, Artificial Sequence
  chemically synthesized
cataaatcttggcttagcaggt

SEQ ID NO: 1174311 - DNA, 22 bp, Artificial Sequence
  chemically synthesized
taccttctgctacctgctaagc

SEQ ID NO: 1174312 - DNA, 22 bp, Artificial Sequence
  chemically synthesized
tagcttcataaatcttggctta

SEQ ID NO: 1174313 - DNA, 22 bp, Artificial Sequence
  chemically synthesized
ctgctacctgctaagccaagat

SEQ ID NO: 1174314 - DNA, 22 bp, Artificial Sequence
  chemically synthesized
tgctacctgctaagccaagatt

SEQ ID NO: 1174315 - DNA, 22 bp, Artificial Sequence
  chemically synthesized
ctacctgctaagccaagattta

SEQ ID NO: 1174316 - DNA, 22 bp, Artificial Sequence
  chemically synthesized
cctgctaagccaagatttatga

SEQ ID NO: 1174317 - DNA, 22 bp, Artificial Sequence
  chemically synthesized
ctaagccaagatttatgaagct

SEQ ID NO: 1174318 - DNA, 22 bp, Artificial Sequence
  chemically synthesized
ggaccataaattatagcttcat

SEQ ID NO: 1174319 - DNA, 22 bp, Artificial Sequence
  chemically synthesized
agccaagatttatgaagctata

SEQ ID NO: 1174320 - DNA, 22 bp, Artificial Sequence
  chemically synthesized
tgggaccataaattatagcttc

SEQ ID NO: 1174321 - DNA, 22 bp, Artificial Sequence
  chemically synthesized
atgaagctataatttatggtcc

SEQ ID NO: 1174322 - DNA, 22 bp, Artificial Sequence
  chemically synthesized
tgaagctataatttatggtccc

SEQ ID NO: 1174323 - DNA, 22 bp, Artificial Sequence
  chemically synthesized
atataaatcctctgggaccata

SEQ ID NO: 1174324 - DNA, 22 bp, Artificial Sequence
  chemically synthesized
catataaatcctctgggaccat

SEQ ID NO: 1174325 - DNA, 22 bp, Artificial Sequence
  chemically synthesized
tcatataaatcctctgggacca

SEQ ID NO: 1174326 - DNA, 22 bp, Artificial Sequence
  chemically synthesized
ttcatataaatcctctgggacc

SEQ ID NO: 1174327 - DNA, 22 bp, Artificial Sequence
  chemically synthesized
taatttatggtcccagaggatt

SEQ ID NO: 1174328 - DNA, 22 bp, Artificial Sequence
  chemically synthesized
atggtcccagaggatttatatg

SEQ ID NO: 1174329 - DNA, 22 bp, Artificial Sequence
  chemically synthesized
tggtcccagaggatttatatga

SEQ ID NO: 1174330 - DNA, 22 bp, Artificial Sequence
  chemically synthesized
atatgaaaagttattatacttc

SEQ ID NO: 1174331 - DNA, 22 bp, Artificial Sequence
  chemically synthesized
tatgaaaagttattatacttcc

SEQ ID NO: 1174332 - DNA, 22 bp, Artificial Sequence
  chemically synthesized
agacacagtagagataggaagt

SEQ ID NO: 1174333 - DNA, 22 bp, Artificial Sequence
  chemically synthesized
aagacacagtagagataggaag

SEQ ID NO: 1174334 - DNA, 22 bp, Artificial Sequence
  chemically synthesized
taagacacagtagagataggaa

SEQ ID NO: 1174335 - DNA, 22 bp, Artificial Sequence
  chemically synthesized
ctttaagacacagtagagatag

SEQ ID NO: 1174336 - DNA, 22 bp, Artificial Sequence
  chemically synthesized
ttatacttcctatctctactgt

SEQ ID NO: 1174337 - DNA, 22 bp, Artificial Sequence
  chemically synthesized
tacttcctatctctactgtgtc

SEQ ID NO: 1174338 - DNA, 22 bp, Artificial Sequence
  chemically synthesized
cagctgctttaagacacagtag

SEQ ID NO: 1174339 - DNA, 22 bp, Artificial Sequence
  chemically synthesized
acagctgctttaagacacagta

SEQ ID NO: 1174340 - DNA, 22 bp, Artificial Sequence
  chemically synthesized
ttacagctgctttaagacacag

SEQ ID NO: 1174341 - DNA, 22 bp, Artificial Sequence
  chemically synthesized
cctatctctactgtgtcttaaa

SEQ ID NO: 1174342 - DNA, 22 bp, Artificial Sequence
  chemically synthesized
ctatctctactgtgtcttaaag

SEQ ID NO: 1174343 - DNA, 22 bp, Artificial Sequence
  chemically synthesized
tctctactgtgtcttaaagcag

SEQ ID NO: 1174344 - DNA, 22 bp, Artificial Sequence
  chemically synthesized
tactgtgtcttaaagcagctgt

SEQ ID NO: 1174345 - DNA, 22 bp, Artificial Sequence
  chemically synthesized
ctgtgtcttaaagcagctgtaa

SEQ ID NO: 1174346 - DNA, 22 bp, Artificial Sequence
  chemically synthesized
tgtcttaaagcagctgtaagag

SEQ ID NO: 1174347 - DNA, 22 bp, Artificial Sequence
  chemically synthesized
gagaggagacagacactcttac

SEQ ID NO: 1174348 - DNA, 22 bp, Artificial Sequence
  chemically synthesized
aaagcagctgtaagagtgtctg

SEQ ID NO: 1174349 - DNA, 22 bp, Artificial Sequence
  chemically synthesized
aagcagctgtaagagtgtctgt

SEQ ID NO: 1174350 - DNA, 22 bp, Artificial Sequence
  chemically synthesized
tgcactagagaggagacagaca

SEQ ID NO: 1174351 - DNA, 22 bp, Artificial Sequence
  chemically synthesized
atgcactagagaggagacagac

SEQ ID NO: 1174352 - DNA, 22 bp, Artificial Sequence
  chemically synthesized
tatgcactagagaggagacaga

SEQ ID NO: 1174353 - DNA, 22 bp, Artificial Sequence
  chemically synthesized
tttatgcactagagaggagaca

SEQ ID NO: 1174354 - DNA, 22 bp, Artificial Sequence
  chemically synthesized
taagagtgtctgtctcctctct

SEQ ID NO: 1174355 - DNA, 22 bp, Artificial Sequence
  chemically synthesized
aggttctttatgcactagagag

SEQ ID NO: 1174356 - DNA, 22 bp, Artificial Sequence
  chemically synthesized
tcctcaggttctttatgcacta

SEQ ID NO: 1174357 - DNA, 22 bp, Artificial Sequence
  chemically synthesized
gtcctcaggttctttatgcact

SEQ ID NO: 1174358 - DNA, 22 bp, Artificial Sequence
  chemically synthesized
tctcctctctagtgcataaaga

SEQ ID NO: 1174359 - DNA, 22 bp, Artificial Sequence
  chemically synthesized
acttgtcctcaggttctttatg

SEQ ID NO: 1174360 - DNA, 22 bp, Artificial Sequence
  chemically synthesized
gacttgtcctcaggttctttat

SEQ ID NO: 1174361 - DNA, 22 bp, Artificial Sequence
  chemically synthesized
ctctctagtgcataaagaacct

SEQ ID NO: 1174362 - DNA, 22 bp, Artificial Sequence
  chemically synthesized
cttgacttgtcctcaggttctt

SEQ ID NO: 1174363 - DNA, 22 bp, Artificial Sequence
  chemically synthesized
tctagtgcataaagaacctgag

SEQ ID NO: 1174364 - DNA, 22 bp, Artificial Sequence
  chemically synthesized
tagtgcataaagaacctgagga

SEQ ID NO: 1174365 - DNA, 22 bp, Artificial Sequence
  chemically synthesized
gtgcataaagaacctgaggaca

SEQ ID NO: 1174366 - DNA, 22 bp, Artificial Sequence
  chemically synthesized
ggtgttacttgacttgtcctca

SEQ ID NO: 1174367 - DNA, 22 bp, Artificial Sequence
  chemically synthesized
ctgggtgttacttgacttgtcc

SEQ ID NO: 1174368 - DNA, 22 bp, Artificial Sequence
  chemically synthesized
attactgggtgttacttgactt

SEQ ID NO: 1174369 - DNA, 22 bp, Artificial Sequence
  chemically synthesized
tgttaattactgggtgttactt

SEQ ID NO: 1174370 - DNA, 22 bp, Artificial Sequence
  chemically synthesized
gtgttaattactgggtgttact

SEQ ID NO: 1174371 - DNA, 22 bp, Artificial Sequence
  chemically synthesized
aggacaagtcaagtaacaccca

SEQ ID NO: 1174372 - DNA, 22 bp, Artificial Sequence
  chemically synthesized
atttgtgttaattactgggtgt

SEQ ID NO: 1174373 - DNA, 22 bp, Artificial Sequence
  chemically synthesized
atcatctaatttgtgttaatta

SEQ ID NO: 1174374 - DNA, 22 bp, Artificial Sequence
  chemically synthesized
ctgatcatctaatttgtgttaa

SEQ ID NO: 1174375 - DNA, 22 bp, Artificial Sequence
  chemically synthesized
actgatcatctaatttgtgtta

SEQ ID NO: 1174376 - DNA, 22 bp, Artificial Sequence
  chemically synthesized
tcaagtacttactgatcatcta

SEQ ID NO: 1174377 - DNA, 22 bp, Artificial Sequence
  chemically synthesized
acacaaattagatgatcagtaa

SEQ ID NO: 1174378 - DNA, 22 bp, Artificial Sequence
  chemically synthesized
atctgtcaagtacttactgatc

SEQ ID NO: 1174379 - DNA, 22 bp, Artificial Sequence
  chemically synthesized
aatctgtcaagtacttactgat

SEQ ID NO: 1174380 - DNA, 22 bp, Artificial Sequence
  chemically synthesized
gtaatttaatctgtcaagtact

SEQ ID NO: 1174381 - DNA, 22 bp, Artificial Sequence
  chemically synthesized
gatgatcagtaagtacttgaca

SEQ ID NO: 1174382 - DNA, 22 bp, Artificial Sequence
  chemically synthesized
gacagattaaattactagtgtt

SEQ ID NO: 1174383 - DNA, 22 bp, Artificial Sequence
  chemically synthesized
acagattaaattactagtgttt

SEQ ID NO: 1174384 - DNA, 22 bp, Artificial Sequence
  chemically synthesized
aattactagtgtttgaccttca

SEQ ID NO: 1174385 - DNA, 22 bp, Artificial Sequence
  chemically synthesized
ctagtgtttgaccttcacatat

SEQ ID NO: 1174386 - DNA, 22 bp, Artificial Sequence
  chemically synthesized
gtgtttgaccttcacatatgac

SEQ ID NO: 1174387 - DNA, 22 bp, Artificial Sequence
  chemically synthesized
aaatatacataatagtgtcata

SEQ ID NO: 1174388 - DNA, 22 bp, Artificial Sequence
  chemically synthesized
aaaatatacataatagtgtcat

SEQ ID NO: 1174389 - DNA, 22 bp, Artificial Sequence
  chemically synthesized
gaccttcacatatgacactatt

SEQ ID NO: 1174390 - DNA, 22 bp, Artificial Sequence
  chemically synthesized
taaaatatacataatagtgtca

SEQ ID NO: 1174391 - DNA, 22 bp, Artificial Sequence
  chemically synthesized
accttcacatatgacactatta

SEQ ID NO: 1174392 - DNA, 22 bp, Artificial Sequence
  chemically synthesized
ttaaaatatacataatagtgtc

SEQ ID NO: 1174393 - DNA, 22 bp, Artificial Sequence
  chemically synthesized
cacatatgacactattatgtat

SEQ ID NO: 1174394 - DNA, 22 bp, Artificial Sequence
  chemically synthesized
acatatgacactattatgtata

SEQ ID NO: 1174395 - DNA, 22 bp, Artificial Sequence
  chemically synthesized
atcaacagtgatacttttaaaa

SEQ ID NO: 1174396 - DNA, 22 bp, Artificial Sequence
  chemically synthesized
taatcaacagtgatacttttaa

SEQ ID NO: 1174397 - DNA, 22 bp, Artificial Sequence
  chemically synthesized
ttatgtatattttaaaagtatc

SEQ ID NO: 1174398 - DNA, 22 bp, Artificial Sequence
  chemically synthesized
ctaatcaacagtgatactttta

SEQ ID NO: 1174399 - DNA, 22 bp, Artificial Sequence
  chemically synthesized
tgtatattttaaaagtatcact

SEQ ID NO: 1174400 - DNA, 22 bp, Artificial Sequence
  chemically synthesized
tttctaatcaacagtgatactt

SEQ ID NO: 1174401 - DNA, 22 bp, Artificial Sequence
  chemically synthesized
atttctaatcaacagtgatact

SEQ ID NO: 1174402 - DNA, 22 bp, Artificial Sequence
  chemically synthesized
aaatttatttctaatcaacagt

SEQ ID NO: 1174403 - DNA, 22 bp, Artificial Sequence
  chemically synthesized
taaaagtatcactgttgattag

SEQ ID NO: 1174404 - DNA, 22 bp, Artificial Sequence
  chemically synthesized
aaaagtatcactgttgattaga

SEQ ID NO: 1174405 - DNA, 22 bp, Artificial Sequence
  chemically synthesized
aaagtatcactgttgattagaa

SEQ ID NO: 1174406 - DNA, 22 bp, Artificial Sequence
  chemically synthesized
tgttaaaatttatttctaatca

SEQ ID NO: 1174407 - DNA, 22 bp, Artificial Sequence
  chemically synthesized
gtgttaaaatttatttctaatc

SEQ ID NO: 1174408 - DNA, 22 bp, Artificial Sequence
  chemically synthesized
tgtgttaaaatttatttctaat

SEQ ID NO: 1174409 - DNA, 22 bp, Artificial Sequence
  chemically synthesized
gcctttgtgttaaaatttattt

SEQ ID NO: 1174410 - DNA, 22 bp, Artificial Sequence
  chemically synthesized
tggcctttgtgttaaaatttat

SEQ ID NO: 1174411 - DNA, 22 bp, Artificial Sequence
  chemically synthesized
ctggcctttgtgttaaaattta

SEQ ID NO: 1174412 - DNA, 22 bp, Artificial Sequence
  chemically synthesized
ttgattagaaataaattttaac

SEQ ID NO: 1174413 - DNA, 22 bp, Artificial Sequence
  chemically synthesized
attagaaataaattttaacaca

SEQ ID NO: 1174414 - DNA, 22 bp, Artificial Sequence
  chemically synthesized
tgtcttctggcctttgtgttaa

SEQ ID NO: 1174415 - DNA, 22 bp, Artificial Sequence
  chemically synthesized
gaaataaattttaacacaaagg

SEQ ID NO: 1174416 - DNA, 22 bp, Artificial Sequence
  chemically synthesized
agttatgtcttctggcctttgt

SEQ ID NO: 1174417 - DNA, 22 bp, Artificial Sequence
  chemically synthesized
taagttatgtcttctggccttt

SEQ ID NO: 1174418 - DNA, 22 bp, Artificial Sequence
  chemically synthesized
ctaagttatgtcttctggcctt

SEQ ID NO: 1174419 - DNA, 22 bp, Artificial Sequence
  chemically synthesized
taacacaaaggccagaagacat

SEQ ID NO: 1174420 - DNA, 22 bp, Artificial Sequence
  chemically synthesized
aacacaaaggccagaagacata

SEQ ID NO: 1174421 - DNA, 22 bp, Artificial Sequence
  chemically synthesized
tgatttctaagttatgtcttct

SEQ ID NO: 1174422 - DNA, 22 bp, Artificial Sequence
  chemically synthesized
acacaaaggccagaagacataa

SEQ ID NO: 1174423 - DNA, 22 bp, Artificial Sequence
  chemically synthesized
aacctatgatttctaagttatg

SEQ ID NO: 1174424 - DNA, 22 bp, Artificial Sequence
  chemically synthesized
ctaaacctatgatttctaagtt

SEQ ID NO: 1174425 - DNA, 22 bp, Artificial Sequence
  chemically synthesized
aattcctaaacctatgatttct

SEQ ID NO: 1174426 - DNA, 22 bp, Artificial Sequence
  chemically synthesized
gaattcctaaacctatgatttc

SEQ ID NO: 1174427 - DNA, 22 bp, Artificial Sequence
  chemically synthesized
ggcatcttgaattcctaaacct

SEQ ID NO: 1174428 - DNA, 22 bp, Artificial Sequence
  chemically synthesized
agaaatcataggtttaggaatt

SEQ ID NO: 1174429 - DNA, 22 bp, Artificial Sequence
  chemically synthesized
gaaatcataggtttaggaattc

SEQ ID NO: 1174430 - DNA, 22 bp, Artificial Sequence
  chemically synthesized
aggaattcaagatgcctaggtc

SEQ ID NO: 1174431 - DNA, 22 bp, Artificial Sequence
  chemically synthesized
ggaattcaagatgcctaggtct

SEQ ID NO: 1174432 - DNA, 22 bp, Artificial Sequence
  chemically synthesized
aagatgcctaggtctattttac

SEQ ID NO: 1174433 - DNA, 22 bp, Artificial Sequence
  chemically synthesized
gtaagaggcagagtaaaataga

SEQ ID NO: 1174434 - DNA, 22 bp, Artificial Sequence
  chemically synthesized
tgctagtaagaggcagagtaaa

SEQ ID NO: 1174435 - DNA, 22 bp, Artificial Sequence
  chemically synthesized
gtgctagtaagaggcagagtaa

SEQ ID NO: 1174436 - DNA, 22 bp, Artificial Sequence
  chemically synthesized
ggtctattttactctgcctctt

SEQ ID NO: 1174437 - DNA, 22 bp, Artificial Sequence
  chemically synthesized
ttttactctgcctcttactagc

SEQ ID NO: 1174438 - DNA, 22 bp, Artificial Sequence
  chemically synthesized
aagggtccttgtgctagtaaga

SEQ ID NO: 1174439 - DNA, 22 bp, Artificial Sequence
  chemically synthesized
tactctgcctcttactagcaca

SEQ ID NO: 1174440 - DNA, 22 bp, Artificial Sequence
  chemically synthesized
ctgaagggtccttgtgctagta

SEQ ID NO: 1174441 - DNA, 22 bp, Artificial Sequence
  chemically synthesized
actctgcctcttactagcacaa

SEQ ID NO: 1174442 - DNA, 22 bp, Artificial Sequence
  chemically synthesized
actgaagggtccttgtgctagt

SEQ ID NO: 1174443 - DNA, 22 bp, Artificial Sequence
  chemically synthesized
ctctgcctcttactagcacaag

SEQ ID NO: 1174444 - DNA, 22 bp, Artificial Sequence
  chemically synthesized
tgcctcttactagcacaaggac

SEQ ID NO: 1174445 - DNA, 22 bp, Artificial Sequence
  chemically synthesized
cctcttactagcacaaggaccc

SEQ ID NO: 1174446 - DNA, 22 bp, Artificial Sequence
  chemically synthesized
agacttactgaagggtccttgt

SEQ ID NO: 1174447 - DNA, 22 bp, Artificial Sequence
  chemically synthesized
ttactagcacaaggacccttca

SEQ ID NO: 1174448 - DNA, 22 bp, Artificial Sequence
  chemically synthesized
actagcacaaggacccttcagt

SEQ ID NO: 1174449 - DNA, 22 bp, Artificial Sequence
  chemically synthesized
agattaagacttactgaagggt

SEQ ID NO: 1174450 - DNA, 22 bp, Artificial Sequence
  chemically synthesized
ctagcacaaggacccttcagta

SEQ ID NO: 1174451 - DNA, 22 bp, Artificial Sequence
  chemically synthesized
gcacaaggacccttcagtaagt

SEQ ID NO: 1174452 - DNA, 22 bp, Artificial Sequence
  chemically synthesized
tacagattaagattaagactta

SEQ ID NO: 1174453 - DNA, 22 bp, Artificial Sequence
  chemically synthesized
ccactatacagattaagattaa

SEQ ID NO: 1174454 - DNA, 22 bp, Artificial Sequence
  chemically synthesized
cccactatacagattaagatta

SEQ ID NO: 1174455 - DNA, 22 bp, Artificial Sequence
  chemically synthesized
cagtaagtcttaatcttaatct

SEQ ID NO: 1174456 - DNA, 22 bp, Artificial Sequence
  chemically synthesized
agtaagtcttaatcttaatctg

SEQ ID NO: 1174457 - DNA, 22 bp, Artificial Sequence
  chemically synthesized
aatcttaatctgtatagtggga

SEQ ID NO: 1174458 - DNA, 22 bp, Artificial Sequence
  chemically synthesized
atcttaatctgtatagtgggaa

SEQ ID NO: 1174459 - DNA, 22 bp, Artificial Sequence
  chemically synthesized
ccaccaatcaagcttcccacta

SEQ ID NO: 1174460 - DNA, 22 bp, Artificial Sequence
  chemically synthesized
accaccaatcaagcttcccact

SEQ ID NO: 1174461 - DNA, 22 bp, Artificial Sequence
  chemically synthesized
aatctgtatagtgggaagcttg

SEQ ID NO: 1174462 - DNA, 22 bp, Artificial Sequence
  chemically synthesized
atctgtatagtgggaagcttga

SEQ ID NO: 1174463 - DNA, 22 bp, Artificial Sequence
  chemically synthesized
tgaggtttaccaccaatcaagc

SEQ ID NO: 1174464 - DNA, 22 bp, Artificial Sequence
  chemically synthesized
tatagtgggaagcttgattggt

SEQ ID NO: 1174465 - DNA, 22 bp, Artificial Sequence
  chemically synthesized
atgaggtttaccaccaatcaag

SEQ ID NO: 1174466 - DNA, 22 bp, Artificial Sequence
  chemically synthesized
aatggcaatatttatgaggttt

SEQ ID NO: 1174467 - DNA, 22 bp, Artificial Sequence
  chemically synthesized
gaatggcaatatttatgaggtt

SEQ ID NO: 1174468 - DNA, 22 bp, Artificial Sequence
  chemically synthesized
gattggtggtaaacctcataaa

SEQ ID NO: 1174469 - DNA, 22 bp, Artificial Sequence
  chemically synthesized
attggtggtaaacctcataaat

SEQ ID NO: 1174470 - DNA, 22 bp, Artificial Sequence
  chemically synthesized
cttgaatggcaatatttatgag

SEQ ID NO: 1174471 - DNA, 22 bp, Artificial Sequence
  chemically synthesized
gtggtaaacctcataaatattg

SEQ ID NO: 1174472 - DNA, 22 bp, Artificial Sequence
  chemically synthesized
ataaatattgccattcaagtaa

SEQ ID NO: 1174473 - DNA, 22 bp, Artificial Sequence
  chemically synthesized
ccattcaagtaactgccacatg

SEQ ID NO: 1174474 - DNA, 22 bp, Artificial Sequence
  chemically synthesized
caatatggcaggagcatgtggc

SEQ ID NO: 1174475 - DNA, 22 bp, Artificial Sequence
  chemically synthesized
acaatatggcaggagcatgtgg

SEQ ID NO: 1174476 - DNA, 22 bp, Artificial Sequence
  chemically synthesized
aagtaactgccacatgctcctg

SEQ ID NO: 1174477 - DNA, 22 bp, Artificial Sequence
  chemically synthesized
tacacttacaatatggcaggag

SEQ ID NO: 1174478 - DNA, 22 bp, Artificial Sequence
  chemically synthesized
attgtacacttacaatatggca

SEQ ID NO: 1174479 - DNA, 22 bp, Artificial Sequence
  chemically synthesized
ccacatgctcctgccatattgt

SEQ ID NO: 1174480 - DNA, 22 bp, Artificial Sequence
  chemically synthesized
ggtagcattcattgtacactta

SEQ ID NO: 1174481 - DNA, 22 bp, Artificial Sequence
  chemically synthesized
ctgccatattgtaagtgtacaa

SEQ ID NO: 1174482 - DNA, 22 bp, Artificial Sequence
  chemically synthesized
aggtagcattcattgtacactt

SEQ ID NO: 1174483 - DNA, 22 bp, Artificial Sequence
  chemically synthesized
ccatattgtaagtgtacaatga

SEQ ID NO: 1174484 - DNA, 22 bp, Artificial Sequence
  chemically synthesized
tgataatttaggtagcattcat

SEQ ID NO: 1174485 - DNA, 22 bp, Artificial Sequence
  chemically synthesized
atgataatttaggtagcattca

SEQ ID NO: 1174486 - DNA, 22 bp, Artificial Sequence
  chemically synthesized
taagtgtacaatgaatgctacc

SEQ ID NO: 1174487 - DNA, 22 bp, Artificial Sequence
  chemically synthesized
tatgataatttaggtagcattc

SEQ ID NO: 1174488 - DNA, 22 bp, Artificial Sequence
  chemically synthesized
ttttatgataatttaggtagca

SEQ ID NO: 1174489 - DNA, 22 bp, Artificial Sequence
  chemically synthesized
actgttttatgataatttaggt

SEQ ID NO: 1174490 - DNA, 22 bp, Artificial Sequence
  chemically synthesized
ttgactgttttatgataattta

SEQ ID NO: 1174491 - DNA, 22 bp, Artificial Sequence
  chemically synthesized
tcactgttgactgttttatgat

SEQ ID NO: 1174492 - DNA, 22 bp, Artificial Sequence
  chemically synthesized
cctaaattatcataaaacagtc

SEQ ID NO: 1174493 - DNA, 22 bp, Artificial Sequence
  chemically synthesized
aattatcataaaacagtcaaca

SEQ ID NO: 1174494 - DNA, 22 bp, Artificial Sequence
  chemically synthesized
tcataaaacagtcaacagtgat

SEQ ID NO: 1174495 - DNA, 22 bp, Artificial Sequence
  chemically synthesized
caaaaatcgtcacatatacatg

SEQ ID NO: 1174496 - DNA, 22 bp, Artificial Sequence
  chemically synthesized
gcaaaaatcgtcacatatacat

SEQ ID NO: 1174497 - DNA, 22 bp, Artificial Sequence
  chemically synthesized
caaatagaacaaggtttgcaaa

SEQ ID NO: 1174498 - DNA, 22 bp, Artificial Sequence
  chemically synthesized
aaattccaaatagaacaaggtt

SEQ ID NO: 1174499 - DNA, 22 bp, Artificial Sequence
  chemically synthesized
aaaattccaaatagaacaaggt

SEQ ID NO: 1174500 - DNA, 22 bp, Artificial Sequence
  chemically synthesized
ttaaaattccaaatagaacaag

SEQ ID NO: 1174501 - DNA, 22 bp, Artificial Sequence
  chemically synthesized
cttaaaattccaaatagaacaa

SEQ ID NO: 1174502 - DNA, 22 bp, Artificial Sequence
  chemically synthesized
tcttaaaattccaaatagaaca

SEQ ID NO: 1174503 - DNA, 22 bp, Artificial Sequence
  chemically synthesized
ttgcaaaccttgttctatttgg

SEQ ID NO: 1174504 - DNA, 22 bp, Artificial Sequence
  chemically synthesized
tgcaaaccttgttctatttgga

SEQ ID NO: 1174505 - DNA, 22 bp, Artificial Sequence
  chemically synthesized
ctttcttaaaattccaaataga

SEQ ID NO: 1174506 - DNA, 22 bp, Artificial Sequence
  chemically synthesized
gcaaaccttgttctatttggaa

SEQ ID NO: 1174507 - DNA, 22 bp, Artificial Sequence
  chemically synthesized
actttcttaaaattccaaatag

SEQ ID NO: 1174508 - DNA, 22 bp, Artificial Sequence
  chemically synthesized
caaaccttgttctatttggaat

SEQ ID NO: 1174509 - DNA, 22 bp, Artificial Sequence
  chemically synthesized
cttactttcttaaaattccaaa

SEQ ID NO: 1174510 - DNA, 22 bp, Artificial Sequence
  chemically synthesized
gttctatttggaattttaagaa

SEQ ID NO: 1174511 - DNA, 22 bp, Artificial Sequence
  chemically synthesized
atgttgcttactttcttaaaat

SEQ ID NO: 1174512 - DNA, 22 bp, Artificial Sequence
  chemically synthesized
ttctatttggaattttaagaaa

SEQ ID NO: 1174513 - DNA, 22 bp, Artificial Sequence
  chemically synthesized
catgttgcttactttcttaaaa

SEQ ID NO: 1174514 - DNA, 22 bp, Artificial Sequence
  chemically synthesized
tatttggaattttaagaaagta

SEQ ID NO: 1174515 - DNA, 22 bp, Artificial Sequence
  chemically synthesized
tttggaattttaagaaagtaag

SEQ ID NO: 1174516 - DNA, 22 bp, Artificial Sequence
  chemically synthesized
ggaattttaagaaagtaagcaa

SEQ ID NO: 1174517 - DNA, 22 bp, Artificial Sequence
  chemically synthesized
gaattttaagaaagtaagcaac

SEQ ID NO: 1174518 - DNA, 22 bp, Artificial Sequence
  chemically synthesized
aaccagtggtttcatgttgctt

SEQ ID NO: 1174519 - DNA, 22 bp, Artificial Sequence
  chemically synthesized
tcaaccagtggtttcatgttgc

SEQ ID NO: 1174520 - DNA, 22 bp, Artificial Sequence
  chemically synthesized
taagaaagtaagcaacatgaaa

SEQ ID NO: 1174521 - DNA, 22 bp, Artificial Sequence
  chemically synthesized
ctcaaccagtggtttcatgttg

SEQ ID NO: 1174522 - DNA, 22 bp, Artificial Sequence
  chemically synthesized
aagaaagtaagcaacatgaaac

SEQ ID NO: 1174523 - DNA, 22 bp, Artificial Sequence
  chemically synthesized
agaaagtaagcaacatgaaacc

SEQ ID NO: 1174524 - DNA, 22 bp, Artificial Sequence
  chemically synthesized
catcttctcaaccagtggtttc

SEQ ID NO: 1174525 - DNA, 22 bp, Artificial Sequence
  chemically synthesized
caaataattacatcttctcaac

SEQ ID NO: 1174526 - DNA, 22 bp, Artificial Sequence
  chemically synthesized
acaaataattacatcttctcaa

SEQ ID NO: 1174527 - DNA, 22 bp, Artificial Sequence
  chemically synthesized
tttacaaataattacatcttct

SEQ ID NO: 1174528 - DNA, 22 bp, Artificial Sequence
  chemically synthesized
gtttacaaataattacatcttc

SEQ ID NO: 1174529 - DNA, 22 bp, Artificial Sequence
  chemically synthesized
tgtttacaaataattacatctt

SEQ ID NO: 1174530 - DNA, 22 bp, Artificial Sequence
  chemically synthesized
gttgagaagatgtaattatttg

SEQ ID NO: 1174531 - DNA, 22 bp, Artificial Sequence
  chemically synthesized
agaagatgtaattatttgtaaa

SEQ ID NO: 1174532 - DNA, 22 bp, Artificial Sequence
  chemically synthesized
aaaataaaggtctttgtttaca

SEQ ID NO: 1174533 - DNA, 22 bp, Artificial Sequence
  chemically synthesized
ctaaaaataaaggtctttgttt

SEQ ID NO: 1174534 - DNA, 22 bp, Artificial Sequence
  chemically synthesized
actaaaaataaaggtctttgtt

SEQ ID NO: 1174535 - DNA, 22 bp, Artificial Sequence
  chemically synthesized
tactaaaaataaaggtctttgt

SEQ ID NO: 1174536 - DNA, 22 bp, Artificial Sequence
  chemically synthesized
tttgtaaacaaagacctttatt

SEQ ID NO: 1174537 - DNA, 22 bp, Artificial Sequence
  chemically synthesized
gtaaacaaagacctttattttt

SEQ ID NO: 1174538 - DNA, 22 bp, Artificial Sequence
  chemically synthesized
taaacaaagacctttattttta

SEQ ID NO: 1174539 - DNA, 22 bp, Artificial Sequence
  chemically synthesized
atgaatctttactaaaaataaa

SEQ ID NO: 1174540 - DNA, 22 bp, Artificial Sequence
  chemically synthesized
cactgatgaatctttactaaaa

SEQ ID NO: 1174541 - DNA, 22 bp, Artificial Sequence
  chemically synthesized
acaggttgcactgatgaatctt

SEQ ID NO: 1174542 - DNA, 22 bp, Artificial Sequence
  chemically synthesized
tatttttagtaaagattcatca

SEQ ID NO: 1174543 - DNA, 22 bp, Artificial Sequence
  chemically synthesized
atttttagtaaagattcatcag

SEQ ID NO: 1174544 - DNA, 22 bp, Artificial Sequence
  chemically synthesized
tgacaggttgcactgatgaatc

SEQ ID NO: 1174545 - DNA, 22 bp, Artificial Sequence
  chemically synthesized
tttttagtaaagattcatcagt

SEQ ID NO: 1174546 - DNA, 22 bp, Artificial Sequence
  chemically synthesized
ttagtaaagattcatcagtgca

SEQ ID NO: 1174547 - DNA, 22 bp, Artificial Sequence
  chemically synthesized
tagtaaagattcatcagtgcaa

SEQ ID NO: 1174548 - DNA, 22 bp, Artificial Sequence
  chemically synthesized
agtaaagattcatcagtgcaac

SEQ ID NO: 1174549 - DNA, 22 bp, Artificial Sequence
  chemically synthesized
gtaaagattcatcagtgcaacc

SEQ ID NO: 1174550 - DNA, 22 bp, Artificial Sequence
  chemically synthesized
aagtagaaaattctgacaggtt

SEQ ID NO: 1174551 - DNA, 22 bp, Artificial Sequence
  chemically synthesized
gaagtagaaaattctgacaggt

SEQ ID NO: 1174552 - DNA, 22 bp, Artificial Sequence
  chemically synthesized
atcagtgcaacctgtcagaatt

SEQ ID NO: 1174553 - DNA, 22 bp, Artificial Sequence
  chemically synthesized
aatcatttgaagtagaaaattc

SEQ ID NO: 1174554 - DNA, 22 bp, Artificial Sequence
  chemically synthesized
aaatcatttgaagtagaaaatt

SEQ ID NO: 1174555 - DNA, 22 bp, Artificial Sequence
  chemically synthesized
taaatcatttgaagtagaaaat

SEQ ID NO: 1174556 - DNA, 22 bp, Artificial Sequence
  chemically synthesized
ttaaatcatttgaagtagaaaa

SEQ ID NO: 1174557 - DNA, 22 bp, Artificial Sequence
  chemically synthesized
tttttaaatcatttgaagtaga

SEQ ID NO: 1174558 - DNA, 22 bp, Artificial Sequence
  chemically synthesized
atttttaaatcatttgaagtag

SEQ ID NO: 1174559 - DNA, 22 bp, Artificial Sequence
  chemically synthesized
tcagaattttctacttcaaatg

SEQ ID NO: 1174560 - DNA, 22 bp, Artificial Sequence
  chemically synthesized
aatcatttatttttaaatcatt

SEQ ID NO: 1174561 - DNA, 22 bp, Artificial Sequence
  chemically synthesized
gaatcatttatttttaaatcat

SEQ ID NO: 1174562 - DNA, 22 bp, Artificial Sequence
  chemically synthesized
tgaatcatttatttttaaatca

SEQ ID NO: 1174563 - DNA, 22 bp, Artificial Sequence
  chemically synthesized
tctacttcaaatgatttaaaaa

SEQ ID NO: 1174564 - DNA, 22 bp, Artificial Sequence
  chemically synthesized
ttgaatcatttatttttaaatc

SEQ ID NO: 1174565 - DNA, 22 bp, Artificial Sequence
  chemically synthesized
ctacttcaaatgatttaaaaat

SEQ ID NO: 1174566 - DNA, 22 bp, Artificial Sequence
  chemically synthesized
tacttcaaatgatttaaaaata

SEQ ID NO: 1174567 - DNA, 22 bp, Artificial Sequence
  chemically synthesized
cttcaaatgatttaaaaataaa

SEQ ID NO: 1174568 - DNA, 22 bp, Artificial Sequence
  chemically synthesized
tacttttgaatcatttattttt

SEQ ID NO: 1174569 - DNA, 22 bp, Artificial Sequence
  chemically synthesized
caaatgatttaaaaataaatga

SEQ ID NO: 1174570 - DNA, 22 bp, Artificial Sequence
  chemically synthesized
aaatgatttaaaaataaatgat

SEQ ID NO: 1174571 - DNA, 22 bp, Artificial Sequence
  chemically synthesized
aaaaataaatgattcaaaagta

SEQ ID NO: 1174572 - DNA, 22 bp, Artificial Sequence
  chemically synthesized
aaaataaatgattcaaaagtac

SEQ ID NO: 1174573 - DNA, 22 bp, Artificial Sequence
  chemically synthesized
ccatagcaggaaaaaaactgta

SEQ ID NO: 1174574 - DNA, 22 bp, Artificial Sequence
  chemically synthesized
ctgccatagcaggaaaaaaact

SEQ ID NO: 1174575 - DNA, 22 bp, Artificial Sequence
  chemically synthesized
aaaagtacagtttttttcctgc

SEQ ID NO: 1174576 - DNA, 22 bp, Artificial Sequence
  chemically synthesized
actactgccatagcaggaaaaa

SEQ ID NO: 1174577 - DNA, 22 bp, Artificial Sequence
  chemically synthesized
gtacagtgttcactactgccat

SEQ ID NO: 1174578 - DNA, 22 bp, Artificial Sequence
  chemically synthesized
ttttcctgctatggcagtagtg

SEQ ID NO: 1174579 - DNA, 22 bp, Artificial Sequence
  chemically synthesized
tttcctgctatggcagtagtga

SEQ ID NO: 1174580 - DNA, 22 bp, Artificial Sequence
  chemically synthesized
ttcctgctatggcagtagtgaa

SEQ ID NO: 1174581 - DNA, 22 bp, Artificial Sequence
  chemically synthesized
tcctgctatggcagtagtgaac

SEQ ID NO: 1174582 - DNA, 22 bp, Artificial Sequence
  chemically synthesized
cctgctatggcagtagtgaaca

SEQ ID NO: 1174583 - DNA, 22 bp, Artificial Sequence
  chemically synthesized
aaattagtacagtgttcactac

SEQ ID NO: 1174584 - DNA, 22 bp, Artificial Sequence
  chemically synthesized
ctgctatggcagtagtgaacac

SEQ ID NO: 1174585 - DNA, 22 bp, Artificial Sequence
  chemically synthesized
ttcaaattagtacagtgttcac

SEQ ID NO: 1174586 - DNA, 22 bp, Artificial Sequence
  chemically synthesized
ctatggcagtagtgaacactgt

SEQ ID NO: 1174587 - DNA, 22 bp, Artificial Sequence
  chemically synthesized
tggcagtagtgaacactgtact

SEQ ID NO: 1174588 - DNA, 22 bp, Artificial Sequence
  chemically synthesized
acagaatctgttcaaattagta

SEQ ID NO: 1174589 - DNA, 22 bp, Artificial Sequence
  chemically synthesized
gcattcacagaatctgttcaaa

SEQ ID NO: 1174590 - DNA, 22 bp, Artificial Sequence
  chemically synthesized
ggcattcacagaatctgttcaa

SEQ ID NO: 1174591 - DNA, 22 bp, Artificial Sequence
  chemically synthesized
tggcattcacagaatctgttca

SEQ ID NO: 1174592 - DNA, 22 bp, Artificial Sequence
  chemically synthesized
ttggcattcacagaatctgttc

SEQ ID NO: 1174593 - DNA, 22 bp, Artificial Sequence
  chemically synthesized
tactaatttgaacagattctgt

SEQ ID NO: 1174594 - DNA, 22 bp, Artificial Sequence
  chemically synthesized
atttgaacagattctgtgaatg

SEQ ID NO: 1174595 - DNA, 22 bp, Artificial Sequence
  chemically synthesized
caatgcttttggcattcacaga

SEQ ID NO: 1174596 - DNA, 22 bp, Artificial Sequence
  chemically synthesized
gaacagattctgtgaatgccaa

SEQ ID NO: 1174597 - DNA, 22 bp, Artificial Sequence
  chemically synthesized
aacagattctgtgaatgccaaa

SEQ ID NO: 1174598 - DNA, 22 bp, Artificial Sequence
  chemically synthesized
tcaacattacaatgcttttggc

SEQ ID NO: 1174599 - DNA, 22 bp, Artificial Sequence
  chemically synthesized
gtcaacattacaatgcttttgg

SEQ ID NO: 1174600 - DNA, 22 bp, Artificial Sequence
  chemically synthesized
tgtgaatgccaaaagcattgta

SEQ ID NO: 1174601 - DNA, 22 bp, Artificial Sequence
  chemically synthesized
tgaatgccaaaagcattgtaat

SEQ ID NO: 1174602 - DNA, 22 bp, Artificial Sequence
  chemically synthesized
gaagtacacatttgtcaacatt

SEQ ID NO: 1174603 - DNA, 22 bp, Artificial Sequence
  chemically synthesized
agaagtacacatttgtcaacat

SEQ ID NO: 1174604 - DNA, 22 bp, Artificial Sequence
  chemically synthesized
tttagaagtacacatttgtcaa

SEQ ID NO: 1174605 - DNA, 22 bp, Artificial Sequence
  chemically synthesized
actgtttagaagtacacatttg

SEQ ID NO: 1174606 - DNA, 22 bp, Artificial Sequence
  chemically synthesized
taatgttgacaaatgtgtactt

SEQ ID NO: 1174607 - DNA, 22 bp, Artificial Sequence
  chemically synthesized
acaaatgtgtacttctaaacag

SEQ ID NO: 1174608 - DNA, 22 bp, Artificial Sequence
  chemically synthesized
acacacacacacacatcctcac

SEQ ID NO: 1174609 - DNA, 22 bp, Artificial Sequence
  chemically synthesized
ctaaacagtgaggatgtgtgtg

SEQ ID NO: 1174610 - DNA, 22 bp, Artificial Sequence
  chemically synthesized
taaacagtgaggatgtgtgtgt

SEQ ID NO: 1174611 - DNA, 22 bp, Artificial Sequence
  chemically synthesized
ccactcacacacacacacacat

SEQ ID NO: 1174612 - DNA, 22 bp, Artificial Sequence
  chemically synthesized
aacagtgaggatgtgtgtgtgt

SEQ ID NO: 1174613 - DNA, 22 bp, Artificial Sequence
  chemically synthesized
tcccactcacacacacacacac

SEQ ID NO: 1174614 - DNA, 22 bp, Artificial Sequence
  chemically synthesized
ttctcccactcacacacacaca

SEQ ID NO: 1174615 - DNA, 22 bp, Artificial Sequence
  chemically synthesized
tatgtatattattctcccactc

SEQ ID NO: 1174616 - DNA, 22 bp, Artificial Sequence
  chemically synthesized
atatgtatattattctcccact

SEQ ID NO: 1174617 - DNA, 22 bp, Artificial Sequence
  chemically synthesized
tatatgtatattattctcccac

SEQ ID NO: 1174618 - DNA, 22 bp, Artificial Sequence
  chemically synthesized
gggaatgtactttatatgtata

SEQ ID NO: 1174619 - DNA, 22 bp, Artificial Sequence
  chemically synthesized
agcaaaccctggggaatgtact

SEQ ID NO: 1174620 - DNA, 22 bp, Artificial Sequence
  chemically synthesized
ggtcatcaaaacctaagcaaac

SEQ ID NO: 1174621 - DNA, 22 bp, Artificial Sequence
  chemically synthesized
ggttaggtcatcaaaacctaag

SEQ ID NO: 1174622 - DNA, 22 bp, Artificial Sequence
  chemically synthesized
cccagggtttgcttaggttttg

SEQ ID NO: 1174623 - DNA, 22 bp, Artificial Sequence
  chemically synthesized
gggttaggtcatcaaaacctaa

SEQ ID NO: 1174624 - DNA, 22 bp, Artificial Sequence
  chemically synthesized
tgggttaggtcatcaaaaccta

SEQ ID NO: 1174625 - DNA, 22 bp, Artificial Sequence
  chemically synthesized
cgatgctttgggttaggtcatc

SEQ ID NO: 1174626 - DNA, 22 bp, Artificial Sequence
  chemically synthesized
gcttaggttttgatgacctaac

SEQ ID NO: 1174627 - DNA, 22 bp, Artificial Sequence
  chemically synthesized
gcgatgctttgggttaggtcat

SEQ ID NO: 1174628 - DNA, 22 bp, Artificial Sequence
  chemically synthesized
cttaggttttgatgacctaacc

SEQ ID NO: 1174629 - DNA, 22 bp, Artificial Sequence
  chemically synthesized
tgcgatgctttgggttaggtca

SEQ ID NO: 1174630 - DNA, 22 bp, Artificial Sequence
  chemically synthesized
aggttttgatgacctaacccaa

SEQ ID NO: 1174631 - DNA, 22 bp, Artificial Sequence
  chemically synthesized
ggttttgatgacctaacccaaa

SEQ ID NO: 1174632 - DNA, 22 bp, Artificial Sequence
  chemically synthesized
tgatgacctaacccaaagcatc

SEQ ID NO: 1174633 - DNA, 22 bp, Artificial Sequence
  chemically synthesized
gtggatctttgcgatgctttgg

SEQ ID NO: 1174634 - DNA, 22 bp, Artificial Sequence
  chemically synthesized
gatgacctaacccaaagcatcg

SEQ ID NO: 1174635 - DNA, 22 bp, Artificial Sequence
  chemically synthesized
atgacctaacccaaagcatcgc

SEQ ID NO: 1174636 - DNA, 22 bp, Artificial Sequence
  chemically synthesized
tattggtggatctttgcgatgc

SEQ ID NO: 1174637 - DNA, 22 bp, Artificial Sequence
  chemically synthesized
acccaaagcatcgcaaagatcc

SEQ ID NO: 1174638 - DNA, 22 bp, Artificial Sequence
  chemically synthesized
tcatctatattggtggatcttt

SEQ ID NO: 1174639 - DNA, 22 bp, Artificial Sequence
  chemically synthesized
caacataaactgtcatctatat

SEQ ID NO: 1174640 - DNA, 22 bp, Artificial Sequence
  chemically synthesized
tgttccaacataaactgtcatc

SEQ ID NO: 1174641 - DNA, 22 bp, Artificial Sequence
  chemically synthesized
aattgtgttccaacataaactg

SEQ ID NO: 1174642 - DNA, 22 bp, Artificial Sequence
  chemically synthesized
aaattgtgttccaacataaact

SEQ ID NO: 1174643 - DNA, 22 bp, Artificial Sequence
  chemically synthesized
ttaaattgtgttccaacataaa

SEQ ID NO: 1174644 - DNA, 22 bp, Artificial Sequence
  chemically synthesized
agtatatattcttaaattgtgt

SEQ ID NO: 1174645 - DNA, 22 bp, Artificial Sequence
  chemically synthesized
atgttggaacacaatttaagaa

SEQ ID NO: 1174646 - DNA, 22 bp, Artificial Sequence
  chemically synthesized
tgttggaacacaatttaagaat

SEQ ID NO: 1174647 - DNA, 22 bp, Artificial Sequence
  chemically synthesized
tagctgagtatatattcttaaa

SEQ ID NO: 1174648 - DNA, 22 bp, Artificial Sequence
  chemically synthesized
gtagctgagtatatattcttaa

SEQ ID NO: 1174649 - DNA, 22 bp, Artificial Sequence
  chemically synthesized
gaacacaatttaagaatatata

SEQ ID NO: 1174650 - DNA, 22 bp, Artificial Sequence
  chemically synthesized
taccgacccacttgtagctgag

SEQ ID NO: 1174651 - DNA, 22 bp, Artificial Sequence
  chemically synthesized
aagaatatatactcagctacaa

SEQ ID NO: 1174652 - DNA, 22 bp, Artificial Sequence
  chemically synthesized
gtaccgacccacttgtagctga

SEQ ID NO: 1174653 - DNA, 22 bp, Artificial Sequence
  chemically synthesized
agaatatatactcagctacaag

SEQ ID NO: 1174654 - DNA, 22 bp, Artificial Sequence
  chemically synthesized
acaatttgtaccgacccacttg

SEQ ID NO: 1174655 - DNA, 22 bp, Artificial Sequence
  chemically synthesized
agctacaagtgggtcggtacaa

SEQ ID NO: 1174656 - DNA, 22 bp, Artificial Sequence
  chemically synthesized
agatattaacaatttgtaccga

SEQ ID NO: 1174657 - DNA, 22 bp, Artificial Sequence
  chemically synthesized
caagtgggtcggtacaaattgt

SEQ ID NO: 1174658 - DNA, 22 bp, Artificial Sequence
  chemically synthesized
acattgagatattaacaatttg

SEQ ID NO: 1174659 - DNA, 22 bp, Artificial Sequence
  chemically synthesized
atgagtagtattgacattgaga

SEQ ID NO: 1174660 - DNA, 22 bp, Artificial Sequence
  chemically synthesized
ctcatgagtagtattgacattg

SEQ ID NO: 1174661 - DNA, 22 bp, Artificial Sequence
  chemically synthesized
actcatgagtagtattgacatt

SEQ ID NO: 1174662 - DNA, 22 bp, Artificial Sequence
  chemically synthesized
ttaatatctcaatgtcaatact

SEQ ID NO: 1174663 - DNA, 22 bp, Artificial Sequence
  chemically synthesized
atatctcaatgtcaatactact

SEQ ID NO: 1174664 - DNA, 22 bp, Artificial Sequence
  chemically synthesized
gtggtaatttactcatgagtag

SEQ ID NO: 1174665 - DNA, 22 bp, Artificial Sequence
  chemically synthesized
ggtggtaatttactcatgagta

SEQ ID NO: 1174666 - DNA, 22 bp, Artificial Sequence
  chemically synthesized
aatgtcaatactactcatgagt

SEQ ID NO: 1174667 - DNA, 22 bp, Artificial Sequence
  chemically synthesized
tcttggtggtaatttactcatg

SEQ ID NO: 1174668 - DNA, 22 bp, Artificial Sequence
  chemically synthesized
ctcatgagtaaattaccaccaa

SEQ ID NO: 1174669 - DNA, 22 bp, Artificial Sequence
  chemically synthesized
atgagtaaattaccaccaagat

SEQ ID NO: 1174670 - DNA, 22 bp, Artificial Sequence
  chemically synthesized
ccaccaagataattatacatat

SEQ ID NO: 1174671 - DNA, 22 bp, Artificial Sequence
  chemically synthesized
aaagatccaaggtgagagatat

SEQ ID NO: 1174672 - DNA, 22 bp, Artificial Sequence
  chemically synthesized
tgaaagatccaaggtgagagat

SEQ ID NO: 1174673 - DNA, 22 bp, Artificial Sequence
  chemically synthesized
ctgaaagatccaaggtgagaga

SEQ ID NO: 1174674 - DNA, 22 bp, Artificial Sequence
  chemically synthesized
tacatatatctctcaccttgga

SEQ ID NO: 1174675 - DNA, 22 bp, Artificial Sequence
  chemically synthesized
ggccaaatttctgaaagatcca

SEQ ID NO: 1174676 - DNA, 22 bp, Artificial Sequence
  chemically synthesized
tcaccttggatctttcagaaat

SEQ ID NO: 1174677 - DNA, 22 bp, Artificial Sequence
  chemically synthesized
accttggatctttcagaaattt

SEQ ID NO: 1174678 - DNA, 22 bp, Artificial Sequence
  chemically synthesized
tataagtacctaggccaaattt

SEQ ID NO: 1174679 - DNA, 22 bp, Artificial Sequence
  chemically synthesized
ggatctttcagaaatttggcct

SEQ ID NO: 1174680 - DNA, 22 bp, Artificial Sequence
  chemically synthesized
gatctttcagaaatttggccta

SEQ ID NO: 1174681 - DNA, 22 bp, Artificial Sequence
  chemically synthesized
tcagaaatttggcctaggtact

SEQ ID NO: 1174682 - DNA, 22 bp, Artificial Sequence
  chemically synthesized
cagaaatttggcctaggtactt

SEQ ID NO: 1174683 - DNA, 22 bp, Artificial Sequence
  chemically synthesized
agaacattatataagtacctag

SEQ ID NO: 1174684 - DNA, 22 bp, Artificial Sequence
  chemically synthesized
agaaatttggcctaggtactta

SEQ ID NO: 1174685 - DNA, 22 bp, Artificial Sequence
  chemically synthesized
ttcagaacattatataagtacc

SEQ ID NO: 1174686 - DNA, 22 bp, Artificial Sequence
  chemically synthesized
ggcctaggtacttatataatgt

SEQ ID NO: 1174687 - DNA, 22 bp, Artificial Sequence
  chemically synthesized
gcctaggtacttatataatgtt

SEQ ID NO: 1174688 - DNA, 22 bp, Artificial Sequence
  chemically synthesized
ggtacttatataatgttctgaa

SEQ ID NO: 1174689 - DNA, 22 bp, Artificial Sequence
  chemically synthesized
atataatgttctgaataatgta

SEQ ID NO: 1174690 - DNA, 22 bp, Artificial Sequence
  chemically synthesized
tataatgttctgaataatgtat

SEQ ID NO: 1174691 - DNA, 22 bp, Artificial Sequence
  chemically synthesized
aataatggagagagatacatta

SEQ ID NO: 1174692 - DNA, 22 bp, Artificial Sequence
  chemically synthesized
ctaaataatggagagagataca

SEQ ID NO: 1174693 - DNA, 22 bp, Artificial Sequence
  chemically synthesized
actaaataatggagagagatac

SEQ ID NO: 1174694 - DNA, 22 bp, Artificial Sequence
  chemically synthesized
tgaataatgtatctctctccat

SEQ ID NO: 1174695 - DNA, 22 bp, Artificial Sequence
  chemically synthesized
aataatgtatctctctccatta

SEQ ID NO: 1174696 - DNA, 22 bp, Artificial Sequence
  chemically synthesized
acataatttactaaataatgga

SEQ ID NO: 1174697 - DNA, 22 bp, Artificial Sequence
  chemically synthesized
tgaatctgacataatttactaa

SEQ ID NO: 1174698 - DNA, 22 bp, Artificial Sequence
  chemically synthesized
atgaatctgacataatttacta

SEQ ID NO: 1174699 - DNA, 22 bp, Artificial Sequence
  chemically synthesized
tctccattatttagtaaattat

SEQ ID NO: 1174700 - DNA, 22 bp, Artificial Sequence
  chemically synthesized
tccattatttagtaaattatgt

SEQ ID NO: 1174701 - DNA, 22 bp, Artificial Sequence
  chemically synthesized
cattatttagtaaattatgtca

SEQ ID NO: 1174702 - DNA, 22 bp, Artificial Sequence
  chemically synthesized
tttagtaaattatgtcagattc

SEQ ID NO: 1174703 - DNA, 22 bp, Artificial Sequence
  chemically synthesized
agaaatgtttatgaatctgaca

SEQ ID NO: 1174704 - DNA, 22 bp, Artificial Sequence
  chemically synthesized
agtaaattatgtcagattcata

SEQ ID NO: 1174705 - DNA, 22 bp, Artificial Sequence
  chemically synthesized
gtaaattatgtcagattcataa

SEQ ID NO: 1174706 - DNA, 22 bp, Artificial Sequence
  chemically synthesized
gtaattgagaaatgtttatgaa

SEQ ID NO: 1174707 - DNA, 22 bp, Artificial Sequence
  chemically synthesized
tgtcagattcataaacatttct

SEQ ID NO: 1174708 - DNA, 22 bp, Artificial Sequence
  chemically synthesized
atgtctggtaattgagaaatgt

SEQ ID NO: 1174709 - DNA, 22 bp, Artificial Sequence
  chemically synthesized
gatgtctggtaattgagaaatg

SEQ ID NO: 1174710 - DNA, 22 bp, Artificial Sequence
  chemically synthesized
ataaacatttctcaattaccag

SEQ ID NO: 1174711 - DNA, 22 bp, Artificial Sequence
  chemically synthesized
aaaacagtttgatgtctggtaa

SEQ ID NO: 1174712 - DNA, 22 bp, Artificial Sequence
  chemically synthesized
ttgaaaacagtttgatgtctgg

SEQ ID NO: 1174713 - DNA, 22 bp, Artificial Sequence
  chemically synthesized
gttgaaaacagtttgatgtctg

SEQ ID NO: 1174714 - DNA, 22 bp, Artificial Sequence
  chemically synthesized
ctcaattaccagacatcaaact

SEQ ID NO: 1174715 - DNA, 22 bp, Artificial Sequence
  chemically synthesized
tcaattaccagacatcaaactg

SEQ ID NO: 1174716 - DNA, 22 bp, Artificial Sequence
  chemically synthesized
aattaccagacatcaaactgtt

SEQ ID NO: 1174717 - DNA, 22 bp, Artificial Sequence
  chemically synthesized
ccagacatcaaactgttttcaa

SEQ ID NO: 1174718 - DNA, 22 bp, Artificial Sequence
  chemically synthesized
gaataagaagtttgttgaaaac

SEQ ID NO: 1174719 - DNA, 22 bp, Artificial Sequence
  chemically synthesized
attggaataagaagtttgttga

SEQ ID NO: 1174720 - DNA, 22 bp, Artificial Sequence
  chemically synthesized
tagttaattggaataagaagtt

SEQ ID NO: 1174721 - DNA, 22 bp, Artificial Sequence
  chemically synthesized
ttttcaacaaacttcttattcc

SEQ ID NO: 1174722 - DNA, 22 bp, Artificial Sequence
  chemically synthesized
tcaacaaacttcttattccaat

SEQ ID NO: 1174723 - DNA, 22 bp, Artificial Sequence
  chemically synthesized
caacaaacttcttattccaatt

SEQ ID NO: 1174724 - DNA, 22 bp, Artificial Sequence
  chemically synthesized
aacaaacttcttattccaatta

SEQ ID NO: 1174725 - DNA, 22 bp, Artificial Sequence
  chemically synthesized
aaaatcgaagttatagttaatt

SEQ ID NO: 1174726 - DNA, 22 bp, Artificial Sequence
  chemically synthesized
aaaaatcgaagttatagttaat

SEQ ID NO: 1174727 - DNA, 22 bp, Artificial Sequence
  chemically synthesized
cttattccaattaactataact

SEQ ID NO: 1174728 - DNA, 22 bp, Artificial Sequence
  chemically synthesized
ttattccaattaactataactt

SEQ ID NO: 1174729 - DNA, 22 bp, Artificial Sequence
  chemically synthesized
attccaattaactataacttcg

SEQ ID NO: 1174730 - DNA, 22 bp, Artificial Sequence
  chemically synthesized
ttccaattaactataacttcga

SEQ ID NO: 1174731 - DNA, 22 bp, Artificial Sequence
  chemically synthesized
caattaactataacttcgattt

SEQ ID NO: 1174732 - DNA, 22 bp, Artificial Sequence
  chemically synthesized
actataacttcgatttttaaat

SEQ ID NO: 1174733 - DNA, 22 bp, Artificial Sequence
  chemically synthesized
taacttcgatttttaaatttat

SEQ ID NO: 1174734 - DNA, 22 bp, Artificial Sequence
  chemically synthesized
cgatttttaaatttatgtacat

SEQ ID NO: 1174735 - DNA, 22 bp, Artificial Sequence
  chemically synthesized
gatttttaaatttatgtacata

SEQ ID NO: 1174736 - DNA, 22 bp, Artificial Sequence
  chemically synthesized
agagtgtgtgtgtgtatgtaca

SEQ ID NO: 1174737 - DNA, 22 bp, Artificial Sequence
  chemically synthesized
tcagagtgtgtgtgtgtatgta

SEQ ID NO: 1174738 - DNA, 22 bp, Artificial Sequence
  chemically synthesized
ttaaatttatgtacatacacac

SEQ ID NO: 1174739 - DNA, 22 bp, Artificial Sequence
  chemically synthesized
ctcagagtgtgtgtgtgtatgt

SEQ ID NO: 1174740 - DNA, 22 bp, Artificial Sequence
  chemically synthesized
taaatttatgtacatacacaca

SEQ ID NO: 1174741 - DNA, 22 bp, Artificial Sequence
  chemically synthesized
tctcagagtgtgtgtgtgtatg

SEQ ID NO: 1174742 - DNA, 22 bp, Artificial Sequence
  chemically synthesized
aaatttatgtacatacacacac

SEQ ID NO: 1174743 - DNA, 22 bp, Artificial Sequence
  chemically synthesized
ttctcagagtgtgtgtgtgtat

SEQ ID NO: 1174744 - DNA, 22 bp, Artificial Sequence
  chemically synthesized
aatttatgtacatacacacaca

SEQ ID NO: 1174745 - DNA, 22 bp, Artificial Sequence
  chemically synthesized
tttctcagagtgtgtgtgtgta

SEQ ID NO: 1174746 - DNA, 22 bp, Artificial Sequence
  chemically synthesized
tttttctcagagtgtgtgtgtg

SEQ ID NO: 1174747 - DNA, 22 bp, Artificial Sequence
  chemically synthesized
atgtacatacacacacacactc

SEQ ID NO: 1174748 - DNA, 22 bp, Artificial Sequence
  chemically synthesized
tgtacatacacacacacactct

SEQ ID NO: 1174749 - DNA, 22 bp, Artificial Sequence
  chemically synthesized
tctctttttctcagagtgtgtg

SEQ ID NO: 1174750 - DNA, 22 bp, Artificial Sequence
  chemically synthesized
tgtctctttttctcagagtgtg

SEQ ID NO: 1174751 - DNA, 22 bp, Artificial Sequence
  chemically synthesized
gtgaactctgtctctttttctc

SEQ ID NO: 1174752 - DNA, 22 bp, Artificial Sequence
  chemically synthesized
tgagaaaaagagacagagttca

SEQ ID NO: 1174753 - DNA, 22 bp, Artificial Sequence
  chemically synthesized
agaaaaagagacagagttcacc

SEQ ID NO: 1174754 - DNA, 22 bp, Artificial Sequence
  chemically synthesized
aagataaatgggaacctggtga

SEQ ID NO: 1174755 - DNA, 22 bp, Artificial Sequence
  chemically synthesized
gaagataaatgggaacctggtg

SEQ ID NO: 1174756 - DNA, 22 bp, Artificial Sequence
  chemically synthesized
tgaagataaatgggaacctggt

SEQ ID NO: 1174757 - DNA, 22 bp, Artificial Sequence
  chemically synthesized
accaggttcccatttatcttca

SEQ ID NO: 1174758 - DNA, 22 bp, Artificial Sequence
  chemically synthesized
tatagggtcaattttgaagata

SEQ ID NO: 1174759 - DNA, 22 bp, Artificial Sequence
  chemically synthesized
atatagggtcaattttgaagat

SEQ ID NO: 1174760 - DNA, 22 bp, Artificial Sequence
  chemically synthesized
ccatttatcttcaaaattgacc

SEQ ID NO: 1174761 - DNA, 22 bp, Artificial Sequence
  chemically synthesized
aaataacatttatatagggtca

SEQ ID NO: 1174762 - DNA, 22 bp, Artificial Sequence
  chemically synthesized
atcttcaaaattgaccctatat

SEQ ID NO: 1174763 - DNA, 22 bp, Artificial Sequence
  chemically synthesized
aaaataacatttatatagggtc

SEQ ID NO: 1174764 - DNA, 22 bp, Artificial Sequence
  chemically synthesized
tcttcaaaattgaccctatata

SEQ ID NO: 1174765 - DNA, 22 bp, Artificial Sequence
  chemically synthesized
taaaataacatttatatagggt

SEQ ID NO: 1174766 - DNA, 22 bp, Artificial Sequence
  chemically synthesized
ttttaaaataacatttatatag

SEQ ID NO: 1174767 - DNA, 22 bp, Artificial Sequence
  chemically synthesized
caaaattgaccctatataaatg

SEQ ID NO: 1174768 - DNA, 22 bp, Artificial Sequence
  chemically synthesized
gttttaaaataacatttatata

SEQ ID NO: 1174769 - DNA, 22 bp, Artificial Sequence
  chemically synthesized
aaaattgaccctatataaatgt

SEQ ID NO: 1174770 - DNA, 22 bp, Artificial Sequence
  chemically synthesized
tgttttaaaataacatttatat

SEQ ID NO: 1174771 - DNA, 22 bp, Artificial Sequence
  chemically synthesized
ttgttttaaaataacatttata

SEQ ID NO: 1174772 - DNA, 22 bp, Artificial Sequence
  chemically synthesized
tcttttgttttaaaataacatt

SEQ ID NO: 1174773 - DNA, 22 bp, Artificial Sequence
  chemically synthesized
atcttttgttttaaaataacat

SEQ ID NO: 1174774 - DNA, 22 bp, Artificial Sequence
  chemically synthesized
accctatataaatgttatttta

SEQ ID NO: 1174775 - DNA, 22 bp, Artificial Sequence
  chemically synthesized
tatcttttgttttaaaataaca

SEQ ID NO: 1174776 - DNA, 22 bp, Artificial Sequence
  chemically synthesized
tataaatgttattttaaaacaa

SEQ ID NO: 1174777 - DNA, 22 bp, Artificial Sequence
  chemically synthesized
tggttttatcttttgttttaaa

SEQ ID NO: 1174778 - DNA, 22 bp, Artificial Sequence
  chemically synthesized
attatggttttatcttttgttt

SEQ ID NO: 1174779 - DNA, 22 bp, Artificial Sequence
  chemically synthesized
ttttaaaacaaaagataaaacc

SEQ ID NO: 1174780 - DNA, 22 bp, Artificial Sequence
  chemically synthesized
taaaacaaaagataaaaccata

SEQ ID NO: 1174781 - DNA, 22 bp, Artificial Sequence
  chemically synthesized
aaaacaaaagataaaaccataa

SEQ ID NO: 1174782 - DNA, 22 bp, Artificial Sequence
  chemically synthesized
aaacaaaagataaaaccataat

SEQ ID NO: 1174783 - DNA, 22 bp, Artificial Sequence
  chemically synthesized
ataataatagtatcctgattat

SEQ ID NO: 1174784 - DNA, 22 bp, Artificial Sequence
  chemically synthesized
ttaataataatagtatcctgat

SEQ ID NO: 1174785 - DNA, 22 bp, Artificial Sequence
  chemically synthesized
gttaataataatagtatcctga

SEQ ID NO: 1174786 - DNA, 22 bp, Artificial Sequence
  chemically synthesized
atttgttaataataatagtatc

SEQ ID NO: 1174787 - DNA, 22 bp, Artificial Sequence
  chemically synthesized
ttattattaacaaatcagatta

SEQ ID NO: 1174788 - DNA, 22 bp, Artificial Sequence
  chemically synthesized
ttattaacaaatcagattactt

SEQ ID NO: 1174789 - DNA, 22 bp, Artificial Sequence
  chemically synthesized
ttaacaaatcagattacttggc

SEQ ID NO: 1174790 - DNA, 22 bp, Artificial Sequence
  chemically synthesized
acaaatcagattacttggctat

SEQ ID NO: 1174791 - DNA, 22 bp, Artificial Sequence
  chemically synthesized
tcagagagtaaaatatatgcag

SEQ ID NO: 1174792 - DNA, 22 bp, Artificial Sequence
  chemically synthesized
cttggctatttctgcatatatt

SEQ ID NO: 1174793 - DNA, 22 bp, Artificial Sequence
  chemically synthesized
atcagagagtaaaatatatgca

SEQ ID NO: 1174794 - DNA, 22 bp, Artificial Sequence
  chemically synthesized
tatcagagagtaaaatatatgc

SEQ ID NO: 1174795 - DNA, 22 bp, Artificial Sequence
  chemically synthesized
ttatcagagagtaaaatatatg

SEQ ID NO: 1174796 - DNA, 22 bp, Artificial Sequence
  chemically synthesized
ggctatttctgcatatatttta

SEQ ID NO: 1174797 - DNA, 22 bp, Artificial Sequence
  chemically synthesized
gctatttctgcatatattttac

SEQ ID NO: 1174798 - DNA, 22 bp, Artificial Sequence
  chemically synthesized
tttctgcatatattttactctc

SEQ ID NO: 1174799 - DNA, 22 bp, Artificial Sequence
  chemically synthesized
taatatttttatcagagagtaa

SEQ ID NO: 1174800 - DNA, 22 bp, Artificial Sequence
  chemically synthesized
ctgcatatattttactctctga

SEQ ID NO: 1174801 - DNA, 22 bp, Artificial Sequence
  chemically synthesized
tgcatatattttactctctgat

SEQ ID NO: 1174802 - DNA, 22 bp, Artificial Sequence
  chemically synthesized
catatattttactctctgataa

SEQ ID NO: 1174803 - DNA, 22 bp, Artificial Sequence
  chemically synthesized
tactctctgataaaaatattat

SEQ ID NO: 1174804 - DNA, 22 bp, Artificial Sequence
  chemically synthesized
actctctgataaaaatattata

SEQ ID NO: 1174805 - DNA, 22 bp, Artificial Sequence
  chemically synthesized
gcagaaaatgattataatattt

SEQ ID NO: 1174806 - DNA, 22 bp, Artificial Sequence
  chemically synthesized
ctctctgataaaaatattataa

SEQ ID NO: 1174807 - DNA, 22 bp, Artificial Sequence
  chemically synthesized
ggcagaaaatgattataatatt

SEQ ID NO: 1174808 - DNA, 22 bp, Artificial Sequence
  chemically synthesized
tctgataaaaatattataatca

SEQ ID NO: 1174809 - DNA, 22 bp, Artificial Sequence
  chemically synthesized
tgataaaaatattataatcatt

SEQ ID NO: 1174810 - DNA, 22 bp, Artificial Sequence
  chemically synthesized
tatttggcagaaaatgattata

SEQ ID NO: 1174811 - DNA, 22 bp, Artificial Sequence
  chemically synthesized
ataaaaatattataatcatttt

SEQ ID NO: 1174812 - DNA, 22 bp, Artificial Sequence
  chemically synthesized
taatcattttctgccaaatata

SEQ ID NO: 1174813 - DNA, 22 bp, Artificial Sequence
  chemically synthesized
gcagaggtgcagattatatttg

SEQ ID NO: 1174814 - DNA, 22 bp, Artificial Sequence
  chemically synthesized
tctgccaaatataatctgcacc

SEQ ID NO: 1174815 - DNA, 22 bp, Artificial Sequence
  chemically synthesized
ctgccaaatataatctgcacct

SEQ ID NO: 1174816 - DNA, 22 bp, Artificial Sequence
  chemically synthesized
tgccaaatataatctgcacctc

SEQ ID NO: 1174817 - DNA, 22 bp, Artificial Sequence
  chemically synthesized
ccaaatataatctgcacctctg

SEQ ID NO: 1174818 - DNA, 22 bp, Artificial Sequence
  chemically synthesized
atggaaaatgagtaattagcag

SEQ ID NO: 1174819 - DNA, 22 bp, Artificial Sequence
  chemically synthesized
aatggaaaatgagtaattagca

SEQ ID NO: 1174820 - DNA, 22 bp, Artificial Sequence
  chemically synthesized
taatggaaaatgagtaattagc

SEQ ID NO: 1174821 - DNA, 22 bp, Artificial Sequence
  chemically synthesized
cacctctgctaattactcattt

SEQ ID NO: 1174822 - DNA, 22 bp, Artificial Sequence
  chemically synthesized
cattttaatggaaaatgagtaa

SEQ ID NO: 1174823 - DNA, 22 bp, Artificial Sequence
  chemically synthesized
acattttaatggaaaatgagta

SEQ ID NO: 1174824 - DNA, 22 bp, Artificial Sequence
  chemically synthesized
tacattttaatggaaaatgagt

SEQ ID NO: 1174825 - DNA, 22 bp, Artificial Sequence
  chemically synthesized
ttacattttaatggaaaatgag

SEQ ID NO: 1174826 - DNA, 22 bp, Artificial Sequence
  chemically synthesized
tgctaattactcattttccatt

SEQ ID NO: 1174827 - DNA, 22 bp, Artificial Sequence
  chemically synthesized
acttttacattttaatggaaaa

SEQ ID NO: 1174828 - DNA, 22 bp, Artificial Sequence
  chemically synthesized
ctaattactcattttccattaa

SEQ ID NO: 1174829 - DNA, 22 bp, Artificial Sequence
  chemically synthesized
ttgacttttacattttaatgga

SEQ ID NO: 1174830 - DNA, 22 bp, Artificial Sequence
  chemically synthesized
attactcattttccattaaaat

SEQ ID NO: 1174831 - DNA, 22 bp, Artificial Sequence
  chemically synthesized
attgacttttacattttaatgg

SEQ ID NO: 1174832 - DNA, 22 bp, Artificial Sequence
  chemically synthesized
tattgacttttacattttaatg

SEQ ID NO: 1174833 - DNA, 22 bp, Artificial Sequence
  chemically synthesized
ctcattttccattaaaatgtaa

SEQ ID NO: 1174834 - DNA, 22 bp, Artificial Sequence
  chemically synthesized
attttccattaaaatgtaaaag

SEQ ID NO: 1174835 - DNA, 22 bp, Artificial Sequence
  chemically synthesized
aataagttttattgacttttac

SEQ ID NO: 1174836 - DNA, 22 bp, Artificial Sequence
  chemically synthesized
tccattaaaatgtaaaagtcaa

SEQ ID NO: 1174837 - DNA, 22 bp, Artificial Sequence
  chemically synthesized
ccattaaaatgtaaaagtcaat

SEQ ID NO: 1174838 - DNA, 22 bp, Artificial Sequence
  chemically synthesized
taaataagttttattgactttt

SEQ ID NO: 1174839 - DNA, 22 bp, Artificial Sequence
  chemically synthesized
cattaaaatgtaaaagtcaata

SEQ ID NO: 1174840 - DNA, 22 bp, Artificial Sequence
  chemically synthesized
ctaaataagttttattgacttt

SEQ ID NO: 1174841 - DNA, 22 bp, Artificial Sequence
  chemically synthesized
tctaaataagttttattgactt

SEQ ID NO: 1174842 - DNA, 22 bp, Artificial Sequence
  chemically synthesized
ttctaaataagttttattgact

SEQ ID NO: 1174843 - DNA, 22 bp, Artificial Sequence
  chemically synthesized
aaatgtaaaagtcaataaaact

SEQ ID NO: 1174844 - DNA, 22 bp, Artificial Sequence
  chemically synthesized
catttttctaaataagttttat

SEQ ID NO: 1174845 - DNA, 22 bp, Artificial Sequence
  chemically synthesized
ccatttttctaaataagtttta

SEQ ID NO: 1174846 - DNA, 22 bp, Artificial Sequence
  chemically synthesized
tccatttttctaaataagtttt

SEQ ID NO: 1174847 - DNA, 22 bp, Artificial Sequence
  chemically synthesized
atgtatgattttccatttttct

SEQ ID NO: 1174848 - DNA, 22 bp, Artificial Sequence
  chemically synthesized
atttagaaaaatggaaaatcat

SEQ ID NO: 1174849 - DNA, 22 bp, Artificial Sequence
  chemically synthesized
tttagaaaaatggaaaatcata

SEQ ID NO: 1174850 - DNA, 22 bp, Artificial Sequence
  chemically synthesized
agaaaaatggaaaatcatacat

SEQ ID NO: 1174851 - DNA, 22 bp, Artificial Sequence
  chemically synthesized
gaaaaatggaaaatcatacatc

SEQ ID NO: 1174852 - DNA, 22 bp, Artificial Sequence
  chemically synthesized
ccaggtcaacctgatgtatgat

SEQ ID NO: 1174853 - DNA, 22 bp, Artificial Sequence
  chemically synthesized
taaaggacaagaataggggagc

SEQ ID NO: 1174854 - DNA, 22 bp, Artificial Sequence
  chemically synthesized
gtaaaggacaagaataggggag

SEQ ID NO: 1174855 - DNA, 22 bp, Artificial Sequence
  chemically synthesized
tgtaaaggacaagaatagggga

SEQ ID NO: 1174856 - DNA, 22 bp, Artificial Sequence
  chemically synthesized
acctgggaggctcccctattct

SEQ ID NO: 1174857 - DNA, 22 bp, Artificial Sequence
  chemically synthesized
ctttgtaaaggacaagaatagg

SEQ ID NO: 1174858 - DNA, 22 bp, Artificial Sequence
  chemically synthesized
ggaggctcccctattcttgtcc

SEQ ID NO: 1174859 - DNA, 22 bp, Artificial Sequence
  chemically synthesized
gattactttgtaaaggacaaga

SEQ ID NO: 1174860 - DNA, 22 bp, Artificial Sequence
  chemically synthesized
gttagattactttgtaaaggac

SEQ ID NO: 1174861 - DNA, 22 bp, Artificial Sequence
  chemically synthesized
ccctattcttgtcctttacaaa

SEQ ID NO: 1174862 - DNA, 22 bp, Artificial Sequence
  chemically synthesized
tctggttagattactttgtaaa

SEQ ID NO: 1174863 - DNA, 22 bp, Artificial Sequence
  chemically synthesized
atctggttagattactttgtaa

SEQ ID NO: 1174864 - DNA, 22 bp, Artificial Sequence
  chemically synthesized
tatctggttagattactttgta

SEQ ID NO: 1174865 - DNA, 22 bp, Artificial Sequence
  chemically synthesized
ttcttgtcctttacaaagtaat

SEQ ID NO: 1174866 - DNA, 22 bp, Artificial Sequence
  chemically synthesized
tttatctggttagattactttg

SEQ ID NO: 1174867 - DNA, 22 bp, Artificial Sequence
  chemically synthesized
ttgtcctttacaaagtaatcta

SEQ ID NO: 1174868 - DNA, 22 bp, Artificial Sequence
  chemically synthesized
gtcctttacaaagtaatctaac

SEQ ID NO: 1174869 - DNA, 22 bp, Artificial Sequence
  chemically synthesized
tcctttacaaagtaatctaacc

SEQ ID NO: 1174870 - DNA, 22 bp, Artificial Sequence
  chemically synthesized
tacaaagtaatctaaccagata

SEQ ID NO: 1174871 - DNA, 22 bp, Artificial Sequence
  chemically synthesized
acaaagtaatctaaccagataa

SEQ ID NO: 1174872 - DNA, 22 bp, Artificial Sequence
  chemically synthesized
caaagtaatctaaccagataaa

SEQ ID NO: 1174873 - DNA, 22 bp, Artificial Sequence
  chemically synthesized
aataaaatgaagctctttatct

SEQ ID NO: 1174874 - DNA, 22 bp, Artificial Sequence
  chemically synthesized
ataagctgaataaaatgaagct

SEQ ID NO: 1174875 - DNA, 22 bp, Artificial Sequence
  chemically synthesized
accagataaagagcttcatttt

SEQ ID NO: 1174876 - DNA, 22 bp, Artificial Sequence
  chemically synthesized
aataagctgaataaaatgaagc

SEQ ID NO: 1174877 - DNA, 22 bp, Artificial Sequence
  chemically synthesized
cattttattcagcttattaaac

SEQ ID NO: 1174878 - DNA, 22 bp, Artificial Sequence
  chemically synthesized
attttattcagcttattaaacc

SEQ ID NO: 1174879 - DNA, 22 bp, Artificial Sequence
  chemically synthesized
tattcagcttattaaaccctat

SEQ ID NO: 1174880 - DNA, 22 bp, Artificial Sequence
  chemically synthesized
cagaaacaaaccatagggttta

SEQ ID NO: 1174881 - DNA, 22 bp, Artificial Sequence
  chemically synthesized
attcagcttattaaaccctatg

SEQ ID NO: 1174882 - DNA, 22 bp, Artificial Sequence
  chemically synthesized
acagaaacaaaccatagggttt

SEQ ID NO: 1174883 - DNA, 22 bp, Artificial Sequence
  chemically synthesized
ttcagcttattaaaccctatgg

SEQ ID NO: 1174884 - DNA, 22 bp, Artificial Sequence
  chemically synthesized
agcttattaaaccctatggttt

SEQ ID NO: 1174885 - DNA, 22 bp, Artificial Sequence
  chemically synthesized
tagaatttacagaaacaaacca

SEQ ID NO: 1174886 - DNA, 22 bp, Artificial Sequence
  chemically synthesized
attaaaccctatggtttgtttc

SEQ ID NO: 1174887 - DNA, 22 bp, Artificial Sequence
  chemically synthesized
ttaaaccctatggtttgtttct

SEQ ID NO: 1174888 - DNA, 22 bp, Artificial Sequence
  chemically synthesized
aaccctatggtttgtttctgta

SEQ ID NO: 1174889 - DNA, 22 bp, Artificial Sequence
  chemically synthesized
aatgtgtactatagaatttaca

SEQ ID NO: 1174890 - DNA, 22 bp, Artificial Sequence
  chemically synthesized
tggtttgtttctgtaaattcta

SEQ ID NO: 1174891 - DNA, 22 bp, Artificial Sequence
  chemically synthesized
aaatgtgtactatagaatttac

SEQ ID NO: 1174892 - DNA, 22 bp, Artificial Sequence
  chemically synthesized
gtcttaaatgtgtactatagaa

SEQ ID NO: 1174893 - DNA, 22 bp, Artificial Sequence
  chemically synthesized
gtttctgtaaattctatagtac

SEQ ID NO: 1174894 - DNA, 22 bp, Artificial Sequence
  chemically synthesized
tttctgtaaattctatagtaca

SEQ ID NO: 1174895 - DNA, 22 bp, Artificial Sequence
  chemically synthesized
ctgtaaattctatagtacacat

SEQ ID NO: 1174896 - DNA, 22 bp, Artificial Sequence
  chemically synthesized
tgtaaattctatagtacacatt

SEQ ID NO: 1174897 - DNA, 22 bp, Artificial Sequence
  chemically synthesized
taaattctatagtacacattta

SEQ ID NO: 1174898 - DNA, 22 bp, Artificial Sequence
  chemically synthesized
acagatgactggtcttaaatgt

SEQ ID NO: 1174899 - DNA, 22 bp, Artificial Sequence
  chemically synthesized
tcacagatgactggtcttaaat

SEQ ID NO: 1174900 - DNA, 22 bp, Artificial Sequence
  chemically synthesized
ctcacagatgactggtcttaaa

SEQ ID NO: 1174901 - DNA, 22 bp, Artificial Sequence
  chemically synthesized
tatagtacacatttaagaccag

SEQ ID NO: 1174902 - DNA, 22 bp, Artificial Sequence
  chemically synthesized
ttctcacagatgactggtctta

SEQ ID NO: 1174903 - DNA, 22 bp, Artificial Sequence
  chemically synthesized
tagtacacatttaagaccagtc

SEQ ID NO: 1174904 - DNA, 22 bp, Artificial Sequence
  chemically synthesized
cttctcacagatgactggtctt

SEQ ID NO: 1174905 - DNA, 22 bp, Artificial Sequence
  chemically synthesized
tcttctcacagatgactggtct

SEQ ID NO: 1174906 - DNA, 22 bp, Artificial Sequence
  chemically synthesized
cattttcttctcacagatgact

SEQ ID NO: 1174907 - DNA, 22 bp, Artificial Sequence
  chemically synthesized
aagaccagtcatctgtgagaag

SEQ ID NO: 1174908 - DNA, 22 bp, Artificial Sequence
  chemically synthesized
agaccagtcatctgtgagaaga

SEQ ID NO: 1174909 - DNA, 22 bp, Artificial Sequence
  chemically synthesized
gtggtattacattttcttctca

SEQ ID NO: 1174910 - DNA, 22 bp, Artificial Sequence
  chemically synthesized
ggtggtattacattttcttctc

SEQ ID NO: 1174911 - DNA, 22 bp, Artificial Sequence
  chemically synthesized
aatttggtggtattacattttc

SEQ ID NO: 1174912 - DNA, 22 bp, Artificial Sequence
  chemically synthesized
aaatttggtggtattacatttt

SEQ ID NO: 1174913 - DNA, 22 bp, Artificial Sequence
  chemically synthesized
tttaaatttggtggtattacat

SEQ ID NO: 1174914 - DNA, 22 bp, Artificial Sequence
  chemically synthesized
tgagaagaaaatgtaataccac

SEQ ID NO: 1174915 - DNA, 22 bp, Artificial Sequence
  chemically synthesized
ttatttaaatttggtggtatta

SEQ ID NO: 1174916 - DNA, 22 bp, Artificial Sequence
  chemically synthesized
gattgttatttaaatttggtgg

SEQ ID NO: 1174917 - DNA, 22 bp, Artificial Sequence
  chemically synthesized
ggattgttatttaaatttggtg

SEQ ID NO: 1174918 - DNA, 22 bp, Artificial Sequence
  chemically synthesized
atagtttggattgttatttaaa

SEQ ID NO: 1174919 - DNA, 22 bp, Artificial Sequence
  chemically synthesized
catagtttggattgttatttaa

SEQ ID NO: 1174920 - DNA, 22 bp, Artificial Sequence
  chemically synthesized
tcatagtttggattgttattta

SEQ ID NO: 1174921 - DNA, 22 bp, Artificial Sequence
  chemically synthesized
ctttcatagtttggattgttat

SEQ ID NO: 1174922 - DNA, 22 bp, Artificial Sequence
  chemically synthesized
aaataacaatccaaactatgaa

SEQ ID NO: 1174923 - DNA, 22 bp, Artificial Sequence
  chemically synthesized
aataacaatccaaactatgaaa

SEQ ID NO: 1174924 - DNA, 22 bp, Artificial Sequence
  chemically synthesized
tgaaagtagatgcatatacttt

SEQ ID NO: 1174925 - DNA, 22 bp, Artificial Sequence
  chemically synthesized
tataaagcataagcatataaaa

SEQ ID NO: 1174926 - DNA, 22 bp, Artificial Sequence
  chemically synthesized
atataaagcataagcatataaa

SEQ ID NO: 1174927 - DNA, 22 bp, Artificial Sequence
  chemically synthesized
tacagcttatataaagcataag

SEQ ID NO: 1174928 - DNA, 22 bp, Artificial Sequence
  chemically synthesized
tttatatgcttatgctttatat

SEQ ID NO: 1174929 - DNA, 22 bp, Artificial Sequence
  chemically synthesized
ttatatgcttatgctttatata

SEQ ID NO: 1174930 - DNA, 22 bp, Artificial Sequence
  chemically synthesized
tatatgcttatgctttatataa

SEQ ID NO: 1174931 - DNA, 22 bp, Artificial Sequence
  chemically synthesized
atatgcttatgctttatataag

SEQ ID NO: 1174932 - DNA, 22 bp, Artificial Sequence
  chemically synthesized
catactatacagcttatataaa

SEQ ID NO: 1174933 - DNA, 22 bp, Artificial Sequence
  chemically synthesized
tatgcttatgctttatataagc

SEQ ID NO: 1174934 - DNA, 22 bp, Artificial Sequence
  chemically synthesized
gttacatactatacagcttata

SEQ ID NO: 1174935 - DNA, 22 bp, Artificial Sequence
  chemically synthesized
atgctttatataagctgtatag

SEQ ID NO: 1174936 - DNA, 22 bp, Artificial Sequence
  chemically synthesized
tgctttatataagctgtatagt

SEQ ID NO: 1174937 - DNA, 22 bp, Artificial Sequence
  chemically synthesized
agttagttacatactatacagc

SEQ ID NO: 1174938 - DNA, 22 bp, Artificial Sequence
  chemically synthesized
gagttagttacatactatacag

SEQ ID NO: 1174939 - DNA, 22 bp, Artificial Sequence
  chemically synthesized
tatataagctgtatagtatgta

SEQ ID NO: 1174940 - DNA, 22 bp, Artificial Sequence
  chemically synthesized
atataagctgtatagtatgtaa

SEQ ID NO: 1174941 - DNA, 22 bp, Artificial Sequence
  chemically synthesized
tataagctgtatagtatgtaac

SEQ ID NO: 1174942 - DNA, 22 bp, Artificial Sequence
  chemically synthesized
tatagtatgtaactaactcaag

SEQ ID NO: 1174943 - DNA, 22 bp, Artificial Sequence
  chemically synthesized
actcaagtgggctcatccatca

SEQ ID NO: 1174944 - DNA, 22 bp, Artificial Sequence
  chemically synthesized
aagtgggctcatccatcattgg

SEQ ID NO: 1174945 - DNA, 22 bp, Artificial Sequence
  chemically synthesized
agagaaacaataaaccaatgat

SEQ ID NO: 1174946 - DNA, 22 bp, Artificial Sequence
  chemically synthesized
cagagaaacaataaaccaatga

SEQ ID NO: 1174947 - DNA, 22 bp, Artificial Sequence
  chemically synthesized
tcagagaaacaataaaccaatg

SEQ ID NO: 1174948 - DNA, 22 bp, Artificial Sequence
  chemically synthesized
ttcagagaaacaataaaccaat

SEQ ID NO: 1174949 - DNA, 22 bp, Artificial Sequence
  chemically synthesized
tttcagagaaacaataaaccaa

SEQ ID NO: 1174950 - DNA, 22 bp, Artificial Sequence
  chemically synthesized
atccatcattggtttattgttt

SEQ ID NO: 1174951 - DNA, 22 bp, Artificial Sequence
  chemically synthesized
aggggtgttttttcagagaaac

SEQ ID NO: 1174952 - DNA, 22 bp, Artificial Sequence
  chemically synthesized
gaggggtgttttttcagagaaa

SEQ ID NO: 1174953 - DNA, 22 bp, Artificial Sequence
  chemically synthesized
gtttattgtttctctgaaaaaa

SEQ ID NO: 1174954 - DNA, 22 bp, Artificial Sequence
  chemically synthesized
attgtttctctgaaaaaacacc

SEQ ID NO: 1174955 - DNA, 22 bp, Artificial Sequence
  chemically synthesized
ttgtttctctgaaaaaacaccc

SEQ ID NO: 1174956 - DNA, 22 bp, Artificial Sequence
  chemically synthesized
tttctctgaaaaaacacccctc

SEQ ID NO: 1174957 - DNA, 22 bp, Artificial Sequence
  chemically synthesized
ctctgaaaaaacacccctcaag

SEQ ID NO: 1174958 - DNA, 22 bp, Artificial Sequence
  chemically synthesized
tcatataaagaccttgaggggt

SEQ ID NO: 1174959 - DNA, 22 bp, Artificial Sequence
  chemically synthesized
tctgaaaaaacacccctcaagg

SEQ ID NO: 1174960 - DNA, 22 bp, Artificial Sequence
  chemically synthesized
atcatataaagaccttgagggg

SEQ ID NO: 1174961 - DNA, 22 bp, Artificial Sequence
  chemically synthesized
tatcatataaagaccttgaggg

SEQ ID NO: 1174962 - DNA, 22 bp, Artificial Sequence
  chemically synthesized
tgaaaaaacacccctcaaggtc

SEQ ID NO: 1174963 - DNA, 22 bp, Artificial Sequence
  chemically synthesized
aaaaaacacccctcaaggtctt

SEQ ID NO: 1174964 - DNA, 22 bp, Artificial Sequence
  chemically synthesized
attttatcatataaagaccttg

SEQ ID NO: 1174965 - DNA, 22 bp, Artificial Sequence
  chemically synthesized
cattttatcatataaagacctt

SEQ ID NO: 1174966 - DNA, 22 bp, Artificial Sequence
  chemically synthesized
tcattttatcatataaagacct

SEQ ID NO: 1174967 - DNA, 22 bp, Artificial Sequence
  chemically synthesized
ttcattttatcatataaagacc

SEQ ID NO: 1174968 - DNA, 22 bp, Artificial Sequence
  chemically synthesized
tcatttttcattttatcatata

SEQ ID NO: 1174969 - DNA, 22 bp, Artificial Sequence
  chemically synthesized
tgtcatttttcattttatcata

SEQ ID NO: 1174970 - DNA, 22 bp, Artificial Sequence
  chemically synthesized
ctgtcatttttcattttatcat

SEQ ID NO: 1174971 - DNA, 22 bp, Artificial Sequence
  chemically synthesized
aaggtctttatatgataaaatg

SEQ ID NO: 1174972 - DNA, 22 bp, Artificial Sequence
  chemically synthesized
tctgtcatttttcattttatca

SEQ ID NO: 1174973 - DNA, 22 bp, Artificial Sequence
  chemically synthesized
ttctgtcatttttcattttatc

SEQ ID NO: 1174974 - DNA, 22 bp, Artificial Sequence
  chemically synthesized
ttttctgtcatttttcatttta

SEQ ID NO: 1174975 - DNA, 22 bp, Artificial Sequence
  chemically synthesized
cttttctgtcatttttcatttt

SEQ ID NO: 1174976 - DNA, 22 bp, Artificial Sequence
  chemically synthesized
tcttttctgtcatttttcattt

SEQ ID NO: 1174977 - DNA, 22 bp, Artificial Sequence
  chemically synthesized
ttcttttctgtcatttttcatt

SEQ ID NO: 1174978 - DNA, 22 bp, Artificial Sequence
  chemically synthesized
tatatgataaaatgaaaaatga

SEQ ID NO: 1174979 - DNA, 22 bp, Artificial Sequence
  chemically synthesized
atatgataaaatgaaaaatgac

SEQ ID NO: 1174980 - DNA, 22 bp, Artificial Sequence
  chemically synthesized
tatgataaaatgaaaaatgaca

SEQ ID NO: 1174981 - DNA, 22 bp, Artificial Sequence
  chemically synthesized
caatatcatcatatttttcttt

SEQ ID NO: 1174982 - DNA, 22 bp, Artificial Sequence
  chemically synthesized
ccaatatcatcatatttttctt

SEQ ID NO: 1174983 - DNA, 22 bp, Artificial Sequence
  chemically synthesized
tttccaatatcatcatattttt

SEQ ID NO: 1174984 - DNA, 22 bp, Artificial Sequence
  chemically synthesized
atttccaatatcatcatatttt

SEQ ID NO: 1174985 - DNA, 22 bp, Artificial Sequence
  chemically synthesized
agaatgtgcttatttccaatat

SEQ ID NO: 1174986 - DNA, 22 bp, Artificial Sequence
  chemically synthesized
cagaatgtgcttatttccaata

SEQ ID NO: 1174987 - DNA, 22 bp, Artificial Sequence
  chemically synthesized
tcagaatgtgcttatttccaat

SEQ ID NO: 1174988 - DNA, 22 bp, Artificial Sequence
  chemically synthesized
gctttcagaatgtgcttatttc

SEQ ID NO: 1174989 - DNA, 22 bp, Artificial Sequence
  chemically synthesized
gaaataagcacattctgaaagc

SEQ ID NO: 1174990 - DNA, 22 bp, Artificial Sequence
  chemically synthesized
tgaaagccaatttgtcattgtt

SEQ ID NO: 1174991 - DNA, 22 bp, Artificial Sequence
  chemically synthesized
aaagccaatttgtcattgtttt

SEQ ID NO: 1174992 - DNA, 22 bp, Artificial Sequence
  chemically synthesized
gtcattgttttatgacatatat

SEQ ID NO: 1174993 - DNA, 22 bp, Artificial Sequence
  chemically synthesized
tcattgttttatgacatatatt

SEQ ID NO: 1174994 - DNA, 22 bp, Artificial Sequence
  chemically synthesized
atatacatgaagataaatatat

SEQ ID NO: 1174995 - DNA, 22 bp, Artificial Sequence
  chemically synthesized
tcatatacatgaagataaatat

SEQ ID NO: 1174996 - DNA, 22 bp, Artificial Sequence
  chemically synthesized
ttttatgacatatatttatctt

SEQ ID NO: 1174997 - DNA, 22 bp, Artificial Sequence
  chemically synthesized
tatgacatatatttatcttcat

SEQ ID NO: 1174998 - DNA, 22 bp, Artificial Sequence
  chemically synthesized
atgacatatatttatcttcatg

SEQ ID NO: 1174999 - DNA, 22 bp, Artificial Sequence
  chemically synthesized
tgacatatatttatcttcatgt

SEQ ID NO: 1175000 - DNA, 22 bp, Artificial Sequence
  chemically synthesized
ggtgttctcatatacatgaaga

SEQ ID NO: 1175001 - DNA, 22 bp, Artificial Sequence
  chemically synthesized
tgctaggtgttctcatatacat

SEQ ID NO: 1175002 - DNA, 22 bp, Artificial Sequence
  chemically synthesized
atcttcatgtatatgagaacac

SEQ ID NO: 1175003 - DNA, 22 bp, Artificial Sequence
  chemically synthesized
tcttcatgtatatgagaacacc

SEQ ID NO: 1175004 - DNA, 22 bp, Artificial Sequence
  chemically synthesized
catgtatatgagaacacctagc

SEQ ID NO: 1175005 - DNA, 22 bp, Artificial Sequence
  chemically synthesized
atgtatatgagaacacctagca

SEQ ID NO: 1175006 - DNA, 22 bp, Artificial Sequence
  chemically synthesized
gaagcaaaggactatgctaggt

SEQ ID NO: 1175007 - DNA, 22 bp, Artificial Sequence
  chemically synthesized
ttagaagcaaaggactatgcta

SEQ ID NO: 1175008 - DNA, 22 bp, Artificial Sequence
  chemically synthesized
agtacctgttagaagcaaagga

SEQ ID NO: 1175009 - DNA, 22 bp, Artificial Sequence
  chemically synthesized
ttgagtacctgttagaagcaaa

SEQ ID NO: 1175010 - DNA, 22 bp, Artificial Sequence
  chemically synthesized
attgagtacctgttagaagcaa

SEQ ID NO: 1175011 - DNA, 22 bp, Artificial Sequence
  chemically synthesized
gcatagtcctttgcttctaaca

SEQ ID NO: 1175012 - DNA, 22 bp, Artificial Sequence
  chemically synthesized
gcaaaagtttattgagtacctg

SEQ ID NO: 1175013 - DNA, 22 bp, Artificial Sequence
  chemically synthesized
agcaaaagtttattgagtacct

SEQ ID NO: 1175014 - DNA, 22 bp, Artificial Sequence
  chemically synthesized
tgcttctaacaggtactcaata

SEQ ID NO: 1175015 - DNA, 22 bp, Artificial Sequence
  chemically synthesized
gcttctaacaggtactcaataa

SEQ ID NO: 1175016 - DNA, 22 bp, Artificial Sequence
  chemically synthesized
cttctaacaggtactcaataaa

SEQ ID NO: 1175017 - DNA, 22 bp, Artificial Sequence
  chemically synthesized
ctaacaggtactcaataaactt

SEQ ID NO: 1175018 - DNA, 22 bp, Artificial Sequence
  chemically synthesized
aaaatttagcaaaagtttattg

SEQ ID NO: 1175019 - DNA, 22 bp, Artificial Sequence
  chemically synthesized
taacaggtactcaataaacttt

SEQ ID NO: 1175020 - DNA, 22 bp, Artificial Sequence
  chemically synthesized
acaggtactcaataaacttttg

SEQ ID NO: 1175021 - DNA, 22 bp, Artificial Sequence
  chemically synthesized
atatattcaaaatttagcaaaa

SEQ ID NO: 1175022 - DNA, 22 bp, Artificial Sequence
  chemically synthesized
aataaacttttgctaaattttg

SEQ ID NO: 1175023 - DNA, 22 bp, Artificial Sequence
  chemically synthesized
tcccacaactaatatattcaaa

SEQ ID NO: 1175024 - DNA, 22 bp, Artificial Sequence
  chemically synthesized
ttgctaaattttgaatatatta

SEQ ID NO: 1175025 - DNA, 22 bp, Artificial Sequence
  chemically synthesized
tgctaaattttgaatatattag

SEQ ID NO: 1175026 - DNA, 22 bp, Artificial Sequence
  chemically synthesized
gctaaattttgaatatattagt

SEQ ID NO: 1175027 - DNA, 22 bp, Artificial Sequence
  chemically synthesized
ctaaattttgaatatattagtt

SEQ ID NO: 1175028 - DNA, 22 bp, Artificial Sequence
  chemically synthesized
ggacctgtcccacaactaatat

SEQ ID NO: 1175029 - DNA, 22 bp, Artificial Sequence
  chemically synthesized
aggacctgtcccacaactaata

SEQ ID NO: 1175030 - DNA, 22 bp, Artificial Sequence
  chemically synthesized
aattttgaatatattagttgtg

SEQ ID NO: 1175031 - DNA, 22 bp, Artificial Sequence
  chemically synthesized
taggacctgtcccacaactaat

SEQ ID NO: 1175032 - DNA, 22 bp, Artificial Sequence
  chemically synthesized
tgaatatattagttgtgggaca

SEQ ID NO: 1175033 - DNA, 22 bp, Artificial Sequence
  chemically synthesized
gaatatattagttgtgggacag

SEQ ID NO: 1175034 - DNA, 22 bp, Artificial Sequence
  chemically synthesized
aatatattagttgtgggacagg

SEQ ID NO: 1175035 - DNA, 22 bp, Artificial Sequence
  chemically synthesized
gagcaatactttaggacctgtc

SEQ ID NO: 1175036 - DNA, 22 bp, Artificial Sequence
  chemically synthesized
tagagcaatactttaggacctg

SEQ ID NO: 1175037 - DNA, 22 bp, Artificial Sequence
  chemically synthesized
ctagagcaatactttaggacct

SEQ ID NO: 1175038 - DNA, 22 bp, Artificial Sequence
  chemically synthesized
gttgtgggacaggtcctaaagt

SEQ ID NO: 1175039 - DNA, 22 bp, Artificial Sequence
  chemically synthesized
tgggacaggtcctaaagtattg

SEQ ID NO: 1175040 - DNA, 22 bp, Artificial Sequence
  chemically synthesized
atgaatcaaatatttctagagc

SEQ ID NO: 1175041 - DNA, 22 bp, Artificial Sequence
  chemically synthesized
ctgatgaatcaaatatttctag

SEQ ID NO: 1175042 - DNA, 22 bp, Artificial Sequence
  chemically synthesized
aagtattgctctagaaatattt

SEQ ID NO: 1175043 - DNA, 22 bp, Artificial Sequence
  chemically synthesized
ttactgatgaatcaaatatttc

SEQ ID NO: 1175044 - DNA, 22 bp, Artificial Sequence
  chemically synthesized
ggctattactgatgaatcaaat

SEQ ID NO: 1175045 - DNA, 22 bp, Artificial Sequence
  chemically synthesized
ctctagaaatatttgattcatc

SEQ ID NO: 1175046 - DNA, 22 bp, Artificial Sequence
  chemically synthesized
tagaaatatttgattcatcagt

SEQ ID NO: 1175047 - DNA, 22 bp, Artificial Sequence
  chemically synthesized
gaaatatttgattcatcagtaa

SEQ ID NO: 1175048 - DNA, 22 bp, Artificial Sequence
  chemically synthesized
gcataggttaggctattactga

SEQ ID NO: 1175049 - DNA, 22 bp, Artificial Sequence
  chemically synthesized
agcataggttaggctattactg

SEQ ID NO: 1175050 - DNA, 22 bp, Artificial Sequence
  chemically synthesized
tagcataggttaggctattact

SEQ ID NO: 1175051 - DNA, 22 bp, Artificial Sequence
  chemically synthesized
gattcatcagtaatagcctaac

SEQ ID NO: 1175052 - DNA, 22 bp, Artificial Sequence
  chemically synthesized
attcatcagtaatagcctaacc

SEQ ID NO: 1175053 - DNA, 22 bp, Artificial Sequence
  chemically synthesized
atcagtaatagcctaacctatg

SEQ ID NO: 1175054 - DNA, 22 bp, Artificial Sequence
  chemically synthesized
tcaatcaaagtcatctttagca

SEQ ID NO: 1175055 - DNA, 22 bp, Artificial Sequence
  chemically synthesized
tatcaatcaaagtcatctttag

SEQ ID NO: 1175056 - DNA, 22 bp, Artificial Sequence
  chemically synthesized
acctatgctaaagatgactttg

SEQ ID NO: 1175057 - DNA, 22 bp, Artificial Sequence
  chemically synthesized
ccctctatcaatcaaagtcatc

SEQ ID NO: 1175058 - DNA, 22 bp, Artificial Sequence
  chemically synthesized
tgctaaagatgactttgattga

SEQ ID NO: 1175059 - DNA, 22 bp, Artificial Sequence
  chemically synthesized
aagatgactttgattgatagag

SEQ ID NO: 1175060 - DNA, 22 bp, Artificial Sequence
  chemically synthesized
aaagggactgccctctatcaat

SEQ ID NO: 1175061 - DNA, 22 bp, Artificial Sequence
  chemically synthesized
caaagggactgccctctatcaa

SEQ ID NO: 1175062 - DNA, 22 bp, Artificial Sequence
  chemically synthesized
tcaaagggactgccctctatca

SEQ ID NO: 1175063 - DNA, 22 bp, Artificial Sequence
  chemically synthesized
tttcaaagggactgccctctat

SEQ ID NO: 1175064 - DNA, 22 bp, Artificial Sequence
  chemically synthesized
ctttcaaagggactgccctcta

SEQ ID NO: 1175065 - DNA, 22 bp, Artificial Sequence
  chemically synthesized
tgattgatagagggcagtccct

SEQ ID NO: 1175066 - DNA, 22 bp, Artificial Sequence
  chemically synthesized
gatttctttcaaagggactgcc

SEQ ID NO: 1175067 - DNA, 22 bp, Artificial Sequence
  chemically synthesized
gattgatagagggcagtccctt

SEQ ID NO: 1175068 - DNA, 22 bp, Artificial Sequence
  chemically synthesized
attgatagagggcagtcccttt

SEQ ID NO: 1175069 - DNA, 22 bp, Artificial Sequence
  chemically synthesized
agttggatttctttcaaaggga

SEQ ID NO: 1175070 - DNA, 22 bp, Artificial Sequence
  chemically synthesized
atagagggcagtccctttgaaa

SEQ ID NO: 1175071 - DNA, 22 bp, Artificial Sequence
  chemically synthesized
cagttggatttctttcaaaggg

SEQ ID NO: 1175072 - DNA, 22 bp, Artificial Sequence
  chemically synthesized
tacatttcagttggatttcttt

SEQ ID NO: 1175073 - DNA, 22 bp, Artificial Sequence
  chemically synthesized
tgtacatttcagttggatttct

SEQ ID NO: 1175074 - DNA, 22 bp, Artificial Sequence
  chemically synthesized
tgttctgtacatttcagttgga

SEQ ID NO: 1175075 - DNA, 22 bp, Artificial Sequence
  chemically synthesized
atgttctgtacatttcagttgg

SEQ ID NO: 1175076 - DNA, 22 bp, Artificial Sequence
  chemically synthesized
tatgttctgtacatttcagttg

SEQ ID NO: 1175077 - DNA, 22 bp, Artificial Sequence
  chemically synthesized
tgaaagaaatccaactgaaatg

SEQ ID NO: 1175078 - DNA, 22 bp, Artificial Sequence
  chemically synthesized
ttatgttctgtacatttcagtt

SEQ ID NO: 1175079 - DNA, 22 bp, Artificial Sequence
  chemically synthesized
gaaagaaatccaactgaaatgt

SEQ ID NO: 1175080 - DNA, 22 bp, Artificial Sequence
  chemically synthesized
tttatgttctgtacatttcagt

SEQ ID NO: 1175081 - DNA, 22 bp, Artificial Sequence
  chemically synthesized
aaagaaatccaactgaaatgta

SEQ ID NO: 1175082 - DNA, 22 bp, Artificial Sequence
  chemically synthesized
ttttatgttctgtacatttcag

SEQ ID NO: 1175083 - DNA, 22 bp, Artificial Sequence
  chemically synthesized
tttttatgttctgtacatttca

SEQ ID NO: 1175084 - DNA, 22 bp, Artificial Sequence
  chemically synthesized
cattttttttatgttctgtaca

SEQ ID NO: 1175085 - DNA, 22 bp, Artificial Sequence
  chemically synthesized
aaatgtacagaacataaaaaaa

SEQ ID NO: 1175086 - DNA, 22 bp, Artificial Sequence
  chemically synthesized
tatccactgcattttttttatg

SEQ ID NO: 1175087 - DNA, 22 bp, Artificial Sequence
  chemically synthesized
atatccactgcattttttttat

SEQ ID NO: 1175088 - DNA, 22 bp, Artificial Sequence
  chemically synthesized
tatatccactgcatttttttta

SEQ ID NO: 1175089 - DNA, 22 bp, Artificial Sequence
  chemically synthesized
tgttttatatccactgcatttt

SEQ ID NO: 1175090 - DNA, 22 bp, Artificial Sequence
  chemically synthesized
gaaaatgctgtgttttatatcc

SEQ ID NO: 1175091 - DNA, 22 bp, Artificial Sequence
  chemically synthesized
ggaaaatgctgtgttttatatc

SEQ ID NO: 1175092 - DNA, 22 bp, Artificial Sequence
  chemically synthesized
ttggaaaatgctgtgttttata

SEQ ID NO: 1175093 - DNA, 22 bp, Artificial Sequence
  chemically synthesized
cttggaaaatgctgtgttttat

SEQ ID NO: 1175094 - DNA, 22 bp, Artificial Sequence
  chemically synthesized
tcttggaaaatgctgtgtttta

SEQ ID NO: 1175095 - DNA, 22 bp, Artificial Sequence
  chemically synthesized
ttcttggaaaatgctgtgtttt

SEQ ID NO: 1175096 - DNA, 22 bp, Artificial Sequence
  chemically synthesized
tttcttggaaaatgctgtgttt

SEQ ID NO: 1175097 - DNA, 22 bp, Artificial Sequence
  chemically synthesized
ttttttcttggaaaatgctgtg

SEQ ID NO: 1175098 - DNA, 22 bp, Artificial Sequence
  chemically synthesized
tattttttcttggaaaatgctg

SEQ ID NO: 1175099 - DNA, 22 bp, Artificial Sequence
  chemically synthesized
gatccagaaaatatgctctatt

SEQ ID NO: 1175100 - DNA, 22 bp, Artificial Sequence
  chemically synthesized
tccaagaaaaaatagagcatat

SEQ ID NO: 1175101 - DNA, 22 bp, Artificial Sequence
  chemically synthesized
ccaagaaaaaatagagcatatt

SEQ ID NO: 1175102 - DNA, 22 bp, Artificial Sequence
  chemically synthesized
ttggatccagaaaatatgctct

SEQ ID NO: 1175103 - DNA, 22 bp, Artificial Sequence
  chemically synthesized
caagaaaaaatagagcatattt

SEQ ID NO: 1175104 - DNA, 22 bp, Artificial Sequence
  chemically synthesized
attggatccagaaaatatgctc

SEQ ID NO: 1175105 - DNA, 22 bp, Artificial Sequence
  chemically synthesized
tattggatccagaaaatatgct

SEQ ID NO: 1175106 - DNA, 22 bp, Artificial Sequence
  chemically synthesized
attttattggatccagaaaata

SEQ ID NO: 1175107 - DNA, 22 bp, Artificial Sequence
  chemically synthesized
tctggatccaataaaattagac

SEQ ID NO: 1175108 - DNA, 22 bp, Artificial Sequence
  chemically synthesized
ctggatccaataaaattagaca

SEQ ID NO: 1175109 - DNA, 22 bp, Artificial Sequence
  chemically synthesized
aaagtgtgtgtgtgtctaattt

SEQ ID NO: 1175110 - DNA, 22 bp, Artificial Sequence
  chemically synthesized
tggatccaataaaattagacac

SEQ ID NO: 1175111 - DNA, 22 bp, Artificial Sequence
  chemically synthesized
gaaagtgtgtgtgtgtctaatt

SEQ ID NO: 1175112 - DNA, 22 bp, Artificial Sequence
  chemically synthesized
gatccaataaaattagacacac

SEQ ID NO: 1175113 - DNA, 22 bp, Artificial Sequence
  chemically synthesized
caagtgtatttgaaagtgtgtg

SEQ ID NO: 1175114 - DNA, 22 bp, Artificial Sequence
  chemically synthesized
gacacacacacactttcaaata

SEQ ID NO: 1175115 - DNA, 22 bp, Artificial Sequence
  chemically synthesized
tcaaatacacttgcaattcatg

SEQ ID NO: 1175116 - DNA, 22 bp, Artificial Sequence
  chemically synthesized
caaatacacttgcaattcatga

SEQ ID NO: 1175117 - DNA, 22 bp, Artificial Sequence
  chemically synthesized
aaatacacttgcaattcatgat

SEQ ID NO: 1175118 - DNA, 22 bp, Artificial Sequence
  chemically synthesized
atagaataaaatatatcatgaa

SEQ ID NO: 1175119 - DNA, 22 bp, Artificial Sequence
  chemically synthesized
aatagaataaaatatatcatga

SEQ ID NO: 1175120 - DNA, 22 bp, Artificial Sequence
  chemically synthesized
gcaattcatgatatattttatt

SEQ ID NO: 1175121 - DNA, 22 bp, Artificial Sequence
  chemically synthesized
caattcatgatatattttattc

SEQ ID NO: 1175122 - DNA, 22 bp, Artificial Sequence
  chemically synthesized
atgatatattttattctattaa

SEQ ID NO: 1175123 - DNA, 22 bp, Artificial Sequence
  chemically synthesized
ataatataaatccttaatagaa

SEQ ID NO: 1175124 - DNA, 22 bp, Artificial Sequence
  chemically synthesized
aataatataaatccttaataga

SEQ ID NO: 1175125 - DNA, 22 bp, Artificial Sequence
  chemically synthesized
tattctattaaggatttatatt

SEQ ID NO: 1175126 - DNA, 22 bp, Artificial Sequence
  chemically synthesized
ccatgatttaataatataaatc

SEQ ID NO: 1175127 - DNA, 22 bp, Artificial Sequence
  chemically synthesized
attctattaaggatttatatta

SEQ ID NO: 1175128 - DNA, 22 bp, Artificial Sequence
  chemically synthesized
cccatgatttaataatataaat

SEQ ID NO: 1175129 - DNA, 22 bp, Artificial Sequence
  chemically synthesized
ttctattaaggatttatattat

SEQ ID NO: 1175130 - DNA, 22 bp, Artificial Sequence
  chemically synthesized
tcccatgatttaataatataaa

SEQ ID NO: 1175131 - DNA, 22 bp, Artificial Sequence
  chemically synthesized
tattaaggatttatattattaa

SEQ ID NO: 1175132 - DNA, 22 bp, Artificial Sequence
  chemically synthesized
ttaaggatttatattattaaat

SEQ ID NO: 1175133 - DNA, 22 bp, Artificial Sequence
  chemically synthesized
agtgttttcccatgatttaata

SEQ ID NO: 1175134 - DNA, 22 bp, Artificial Sequence
  chemically synthesized
aggatttatattattaaatcat

SEQ ID NO: 1175135 - DNA, 22 bp, Artificial Sequence
  chemically synthesized
atattattaaatcatgggaaaa

SEQ ID NO: 1175136 - DNA, 22 bp, Artificial Sequence
  chemically synthesized
tattattaaatcatgggaaaac

SEQ ID NO: 1175137 - DNA, 22 bp, Artificial Sequence
  chemically synthesized
aaagagttcagtgttttcccat

SEQ ID NO: 1175138 - DNA, 22 bp, Artificial Sequence
  chemically synthesized
gaaagagttcagtgttttccca

SEQ ID NO: 1175139 - DNA, 22 bp, Artificial Sequence
  chemically synthesized
ttaaatcatgggaaaacactga

SEQ ID NO: 1175140 - DNA, 22 bp, Artificial Sequence
  chemically synthesized
aatcatgggaaaacactgaact

SEQ ID NO: 1175141 - DNA, 22 bp, Artificial Sequence
  chemically synthesized
tggtagtatttgaaagagttca

SEQ ID NO: 1175142 - DNA, 22 bp, Artificial Sequence
  chemically synthesized
atggtagtatttgaaagagttc

SEQ ID NO: 1175143 - DNA, 22 bp, Artificial Sequence
  chemically synthesized
tatggtagtatttgaaagagtt

SEQ ID NO: 1175144 - DNA, 22 bp, Artificial Sequence
  chemically synthesized
ttttatggtagtatttgaaaga

SEQ ID NO: 1175145 - DNA, 22 bp, Artificial Sequence
  chemically synthesized
gaaattattttatggtagtatt

SEQ ID NO: 1175146 - DNA, 22 bp, Artificial Sequence
  chemically synthesized
ggaaattattttatggtagtat

SEQ ID NO: 1175147 - DNA, 22 bp, Artificial Sequence
  chemically synthesized
aactctttcaaatactaccata

SEQ ID NO: 1175148 - DNA, 22 bp, Artificial Sequence
  chemically synthesized
tttcaaatactaccataaaata

SEQ ID NO: 1175149 - DNA, 22 bp, Artificial Sequence
  chemically synthesized
tcaaatactaccataaaataat

SEQ ID NO: 1175150 - DNA, 22 bp, Artificial Sequence
  chemically synthesized
caaatactaccataaaataatt

SEQ ID NO: 1175151 - DNA, 22 bp, Artificial Sequence
  chemically synthesized
aaatactaccataaaataattt

SEQ ID NO: 1175152 - DNA, 22 bp, Artificial Sequence
  chemically synthesized
ccataaaataatttccaaacta

SEQ ID NO: 1175153 - DNA, 22 bp, Artificial Sequence
  chemically synthesized
ataaggatggaatatagtttgg

SEQ ID NO: 1175154 - DNA, 22 bp, Artificial Sequence
  chemically synthesized
cataaggatggaatatagtttg

SEQ ID NO: 1175155 - DNA, 22 bp, Artificial Sequence
  chemically synthesized
cttcataaggatggaatatagt

SEQ ID NO: 1175156 - DNA, 22 bp, Artificial Sequence
  chemically synthesized
ccaaactatattccatccttat

SEQ ID NO: 1175157 - DNA, 22 bp, Artificial Sequence
  chemically synthesized
caaactatattccatccttatg

SEQ ID NO: 1175158 - DNA, 22 bp, Artificial Sequence
  chemically synthesized
tattccatccttatgaaggaat

SEQ ID NO: 1175159 - DNA, 22 bp, Artificial Sequence
  chemically synthesized
ccaagccacaagattccttcat

SEQ ID NO: 1175160 - DNA, 22 bp, Artificial Sequence
  chemically synthesized
ctcccaagccacaagattcctt

SEQ ID NO: 1175161 - DNA, 22 bp, Artificial Sequence
  chemically synthesized
catccttatgaaggaatcttgt

SEQ ID NO: 1175162 - DNA, 22 bp, Artificial Sequence
  chemically synthesized
attgctcccaagccacaagatt

SEQ ID NO: 1175163 - DNA, 22 bp, Artificial Sequence
  chemically synthesized
atgaaggaatcttgtggcttgg

SEQ ID NO: 1175164 - DNA, 22 bp, Artificial Sequence
  chemically synthesized
tgaaggaatcttgtggcttggg

SEQ ID NO: 1175165 - DNA, 22 bp, Artificial Sequence
  chemically synthesized
gggaggtgattaattgctccca

SEQ ID NO: 1175166 - DNA, 22 bp, Artificial Sequence
  chemically synthesized
gtggcttgggagcaattaatca

SEQ ID NO: 1175167 - DNA, 22 bp, Artificial Sequence
  chemically synthesized
tggcttgggagcaattaatcac

SEQ ID NO: 1175168 - DNA, 22 bp, Artificial Sequence
  chemically synthesized
tgcatgggattggggaggtgat

SEQ ID NO: 1175169 - DNA, 22 bp, Artificial Sequence
  chemically synthesized
gggagcaattaatcacctcccc

SEQ ID NO: 1175170 - DNA, 22 bp, Artificial Sequence
  chemically synthesized
atgcatgggattggggaggtga

SEQ ID NO: 1175171 - DNA, 22 bp, Artificial Sequence
  chemically synthesized
ggagcaattaatcacctcccca

SEQ ID NO: 1175172 - DNA, 22 bp, Artificial Sequence
  chemically synthesized
atcacctccccaatcccatgca

SEQ ID NO: 1175173 - DNA, 22 bp, Artificial Sequence
  chemically synthesized
aagcaatcaggacttatgcatg

SEQ ID NO: 1175174 - DNA, 22 bp, Artificial Sequence
  chemically synthesized
aaagcaatcaggacttatgcat

SEQ ID NO: 1175175 - DNA, 22 bp, Artificial Sequence
  chemically synthesized
cccaatcccatgcataagtcct

SEQ ID NO: 1175176 - DNA, 22 bp, Artificial Sequence
  chemically synthesized
tttaaagcaatcaggacttatg

SEQ ID NO: 1175177 - DNA, 22 bp, Artificial Sequence
  chemically synthesized
atttaaagcaatcaggacttat

SEQ ID NO: 1175178 - DNA, 22 bp, Artificial Sequence
  chemically synthesized
gcaaaaaggatttatttaaagc

SEQ ID NO: 1175179 - DNA, 22 bp, Artificial Sequence
  chemically synthesized
tgtccctggcaaaaaggattta

SEQ ID NO: 1175180 - DNA, 22 bp, Artificial Sequence
  chemically synthesized
attgctttaaataaatcctttt

SEQ ID NO: 1175181 - DNA, 22 bp, Artificial Sequence
  chemically synthesized
tatgtccctggcaaaaaggatt

SEQ ID NO: 1175182 - DNA, 22 bp, Artificial Sequence
  chemically synthesized
ctttaaataaatcctttttgcc

SEQ ID NO: 1175183 - DNA, 22 bp, Artificial Sequence
  chemically synthesized
ttctatgtccctggcaaaaagg

SEQ ID NO: 1175184 - DNA, 22 bp, Artificial Sequence
  chemically synthesized
gttctatgtccctggcaaaaag

SEQ ID NO: 1175185 - DNA, 22 bp, Artificial Sequence
  chemically synthesized
tgttctatgtccctggcaaaaa

SEQ ID NO: 1175186 - DNA, 22 bp, Artificial Sequence
  chemically synthesized
taaataaatcctttttgccagg

SEQ ID NO: 1175187 - DNA, 22 bp, Artificial Sequence
  chemically synthesized
ttgttctatgtccctggcaaaa

SEQ ID NO: 1175188 - DNA, 22 bp, Artificial Sequence
  chemically synthesized
aaataaatcctttttgccaggg

SEQ ID NO: 1175189 - DNA, 22 bp, Artificial Sequence
  chemically synthesized
aataaatcctttttgccaggga

SEQ ID NO: 1175190 - DNA, 22 bp, Artificial Sequence
  chemically synthesized
gatttttgttctatgtccctgg

SEQ ID NO: 1175191 - DNA, 22 bp, Artificial Sequence
  chemically synthesized
tagttggatttttgttctatgt

SEQ ID NO: 1175192 - DNA, 22 bp, Artificial Sequence
  chemically synthesized
tttgccagggacatagaacaaa

SEQ ID NO: 1175193 - DNA, 22 bp, Artificial Sequence
  chemically synthesized
ttgccagggacatagaacaaaa

SEQ ID NO: 1175194 - DNA, 22 bp, Artificial Sequence
  chemically synthesized
tgccagggacatagaacaaaaa

SEQ ID NO: 1175195 - DNA, 22 bp, Artificial Sequence
  chemically synthesized
gccagggacatagaacaaaaat

SEQ ID NO: 1175196 - DNA, 22 bp, Artificial Sequence
  chemically synthesized
ccagggacatagaacaaaaatc

SEQ ID NO: 1175197 - DNA, 22 bp, Artificial Sequence
  chemically synthesized
aagcataaaatgttgtagttgg

SEQ ID NO: 1175198 - DNA, 22 bp, Artificial Sequence
  chemically synthesized
tgttaaagcataaaatgttgta

SEQ ID NO: 1175199 - DNA, 22 bp, Artificial Sequence
  chemically synthesized
atatactgtgttaaagcataaa

SEQ ID NO: 1175200 - DNA, 22 bp, Artificial Sequence
  chemically synthesized
caacattttatgctttaacaca

SEQ ID NO: 1175201 - DNA, 22 bp, Artificial Sequence
  chemically synthesized
cacagttaatatactgtgttaa

SEQ ID NO: 1175202 - DNA, 22 bp, Artificial Sequence
  chemically synthesized
ccacagttaatatactgtgtta

SEQ ID NO: 1175203 - DNA, 22 bp, Artificial Sequence
  chemically synthesized
tatgctttaacacagtatatta

SEQ ID NO: 1175204 - DNA, 22 bp, Artificial Sequence
  chemically synthesized
atgctttaacacagtatattaa

SEQ ID NO: 1175205 - DNA, 22 bp, Artificial Sequence
  chemically synthesized
tgctttaacacagtatattaac

SEQ ID NO: 1175206 - DNA, 22 bp, Artificial Sequence
  chemically synthesized
agtcatgtttccacagttaata

SEQ ID NO: 1175207 - DNA, 22 bp, Artificial Sequence
  chemically synthesized
taacacagtatattaactgtgg

SEQ ID NO: 1175208 - DNA, 22 bp, Artificial Sequence
  chemically synthesized
aacacagtatattaactgtgga

SEQ ID NO: 1175209 - DNA, 22 bp, Artificial Sequence
  chemically synthesized
acacagtatattaactgtggaa

SEQ ID NO: 1175210 - DNA, 22 bp, Artificial Sequence
  chemically synthesized
gaacatgttaagtcatgtttcc

SEQ ID NO: 1175211 - DNA, 22 bp, Artificial Sequence
  chemically synthesized
gttggaacatgttaagtcatgt

SEQ ID NO: 1175212 - DNA, 22 bp, Artificial Sequence
  chemically synthesized
tggttggaacatgttaagtcat

SEQ ID NO: 1175213 - DNA, 22 bp, Artificial Sequence
  chemically synthesized
actgtggaaacatgacttaaca

SEQ ID NO: 1175214 - DNA, 22 bp, Artificial Sequence
  chemically synthesized
ctggttggaacatgttaagtca

SEQ ID NO: 1175215 - DNA, 22 bp, Artificial Sequence
  chemically synthesized
tggaaacatgacttaacatgtt

SEQ ID NO: 1175216 - DNA, 22 bp, Artificial Sequence
  chemically synthesized
gacaccttctggttggaacatg

SEQ ID NO: 1175217 - DNA, 22 bp, Artificial Sequence
  chemically synthesized
tggacaccttctggttggaaca

SEQ ID NO: 1175218 - DNA, 22 bp, Artificial Sequence
  chemically synthesized
aacatgttccaaccagaaggtg

SEQ ID NO: 1175219 - DNA, 22 bp, Artificial Sequence
  chemically synthesized
acatgttccaaccagaaggtgt

SEQ ID NO: 1175220 - DNA, 22 bp, Artificial Sequence
  chemically synthesized
agtcaagcagaactctggacac

SEQ ID NO: 1175221 - DNA, 22 bp, Artificial Sequence
  chemically synthesized
caaccagaaggtgtccagagtt

SEQ ID NO: 1175222 - DNA, 22 bp, Artificial Sequence
  chemically synthesized
tcagtcaagcagaactctggac

SEQ ID NO: 1175223 - DNA, 22 bp, Artificial Sequence
  chemically synthesized
ctcagtcaagcagaactctgga

SEQ ID NO: 1175224 - DNA, 22 bp, Artificial Sequence
  chemically synthesized
tctcagtcaagcagaactctgg

SEQ ID NO: 1175225 - DNA, 22 bp, Artificial Sequence
  chemically synthesized
ttctcagtcaagcagaactctg

SEQ ID NO: 1175226 - DNA, 22 bp, Artificial Sequence
  chemically synthesized
tttctcagtcaagcagaactct

SEQ ID NO: 1175227 - DNA, 22 bp, Artificial Sequence
  chemically synthesized
ttttctcagtcaagcagaactc

SEQ ID NO: 1175228 - DNA, 22 bp, Artificial Sequence
  chemically synthesized
tttttctcagtcaagcagaact

SEQ ID NO: 1175229 - DNA, 22 bp, Artificial Sequence
  chemically synthesized
tgcttgactgagaaaaaaagta

SEQ ID NO: 1175230 - DNA, 22 bp, Artificial Sequence
  chemically synthesized
cttgactgagaaaaaaagtact

SEQ ID NO: 1175231 - DNA, 22 bp, Artificial Sequence
  chemically synthesized
gactgagaaaaaaagtacttat

SEQ ID NO: 1175232 - DNA, 22 bp, Artificial Sequence
  chemically synthesized
actgagaaaaaaagtacttatt

SEQ ID NO: 1175233 - DNA, 22 bp, Artificial Sequence
  chemically synthesized
tgtcaaaggaaaaataagtact

SEQ ID NO: 1175234 - DNA, 22 bp, Artificial Sequence
  chemically synthesized
atgtcaaaggaaaaataagtac

SEQ ID NO: 1175235 - DNA, 22 bp, Artificial Sequence
  chemically synthesized
agaaaaaaagtacttatttttc

SEQ ID NO: 1175236 - DNA, 22 bp, Artificial Sequence
  chemically synthesized
cttatgtcaaaggaaaaataag

SEQ ID NO: 1175237 - DNA, 22 bp, Artificial Sequence
  chemically synthesized
gcttatgtcaaaggaaaaataa

SEQ ID NO: 1175238 - DNA, 22 bp, Artificial Sequence
  chemically synthesized
tgcttatgtcaaaggaaaaata

SEQ ID NO: 1175239 - DNA, 22 bp, Artificial Sequence
  chemically synthesized
tttgcttatgtcaaaggaaaaa

SEQ ID NO: 1175240 - DNA, 22 bp, Artificial Sequence
  chemically synthesized
ctttgcttatgtcaaaggaaaa

SEQ ID NO: 1175241 - DNA, 22 bp, Artificial Sequence
  chemically synthesized
tctttgcttatgtcaaaggaaa

SEQ ID NO: 1175242 - DNA, 22 bp, Artificial Sequence
  chemically synthesized
ttctttgcttatgtcaaaggaa

SEQ ID NO: 1175243 - DNA, 22 bp, Artificial Sequence
  chemically synthesized
tttctttgcttatgtcaaagga

SEQ ID NO: 1175244 - DNA, 22 bp, Artificial Sequence
  chemically synthesized
ttttctttgcttatgtcaaagg

SEQ ID NO: 1175245 - DNA, 22 bp, Artificial Sequence
  chemically synthesized
atttttcctttgacataagcaa

SEQ ID NO: 1175246 - DNA, 22 bp, Artificial Sequence
  chemically synthesized
tttttcctttgacataagcaaa

SEQ ID NO: 1175247 - DNA, 22 bp, Artificial Sequence
  chemically synthesized
taacatttttttctttgcttat

SEQ ID NO: 1175248 - DNA, 22 bp, Artificial Sequence
  chemically synthesized
ttcctttgacataagcaaagaa

SEQ ID NO: 1175249 - DNA, 22 bp, Artificial Sequence
  chemically synthesized
tcctttgacataagcaaagaaa

SEQ ID NO: 1175250 - DNA, 22 bp, Artificial Sequence
  chemically synthesized
cctttgacataagcaaagaaaa

SEQ ID NO: 1175251 - DNA, 22 bp, Artificial Sequence
  chemically synthesized
ctttgacataagcaaagaaaaa

SEQ ID NO: 1175252 - DNA, 22 bp, Artificial Sequence
  chemically synthesized
tgacataagcaaagaaaaaaat

SEQ ID NO: 1175253 - DNA, 22 bp, Artificial Sequence
  chemically synthesized
gacataagcaaagaaaaaaatg

SEQ ID NO: 1175254 - DNA, 22 bp, Artificial Sequence
  chemically synthesized
ccagaactgtaacatttttttc

SEQ ID NO: 1175255 - DNA, 22 bp, Artificial Sequence
  chemically synthesized
acataagcaaagaaaaaaatgt

SEQ ID NO: 1175256 - DNA, 22 bp, Artificial Sequence
  chemically synthesized
tgatagatggctgccagaactg

SEQ ID NO: 1175257 - DNA, 22 bp, Artificial Sequence
  chemically synthesized
ttatgatagatggctgccagaa

SEQ ID NO: 1175258 - DNA, 22 bp, Artificial Sequence
  chemically synthesized
gttatgatagatggctgccaga

SEQ ID NO: 1175259 - DNA, 22 bp, Artificial Sequence
  chemically synthesized
tgttatgatagatggctgccag

SEQ ID NO: 1175260 - DNA, 22 bp, Artificial Sequence
  chemically synthesized
cagttctggcagccatctatca

SEQ ID NO: 1175261 - DNA, 22 bp, Artificial Sequence
  chemically synthesized
tacagttttgttatgatagatg

SEQ ID NO: 1175262 - DNA, 22 bp, Artificial Sequence
  chemically synthesized
cctatacagttttgttatgata

SEQ ID NO: 1175263 - DNA, 22 bp, Artificial Sequence
  chemically synthesized
tggcagccatctatcataacaa

SEQ ID NO: 1175264 - DNA, 22 bp, Artificial Sequence
  chemically synthesized
ccctatacagttttgttatgat

SEQ ID NO: 1175265 - DNA, 22 bp, Artificial Sequence
  chemically synthesized
tccctatacagttttgttatga

SEQ ID NO: 1175266 - DNA, 22 bp, Artificial Sequence
  chemically synthesized
gcagccatctatcataacaaaa

SEQ ID NO: 1175267 - DNA, 22 bp, Artificial Sequence
  chemically synthesized
tttccctatacagttttgttat

SEQ ID NO: 1175268 - DNA, 22 bp, Artificial Sequence
  chemically synthesized
ctttccctatacagttttgtta

SEQ ID NO: 1175269 - DNA, 22 bp, Artificial Sequence
  chemically synthesized
tttctttccctatacagttttg

SEQ ID NO: 1175270 - DNA, 22 bp, Artificial Sequence
  chemically synthesized
tcataacaaaactgtataggga

SEQ ID NO: 1175271 - DNA, 22 bp, Artificial Sequence
  chemically synthesized
tgccaggtagttatttctttcc

SEQ ID NO: 1175272 - DNA, 22 bp, Artificial Sequence
  chemically synthesized
tctatgccaggtagttatttct

SEQ ID NO: 1175273 - DNA, 22 bp, Artificial Sequence
  chemically synthesized
tatagggaaagaaataactacc

SEQ ID NO: 1175274 - DNA, 22 bp, Artificial Sequence
  chemically synthesized
cgttatctatgccaggtagtta

SEQ ID NO: 1175275 - DNA, 22 bp, Artificial Sequence
  chemically synthesized
ccgttatctatgccaggtagtt

SEQ ID NO: 1175276 - DNA, 22 bp, Artificial Sequence
  chemically synthesized
ttccgttatctatgccaggtag

SEQ ID NO: 1175277 - DNA, 22 bp, Artificial Sequence
  chemically synthesized
actcttccgttatctatgccag

SEQ ID NO: 1175278 - DNA, 22 bp, Artificial Sequence
  chemically synthesized
cactcttccgttatctatgcca

SEQ ID NO: 1175279 - DNA, 22 bp, Artificial Sequence
  chemically synthesized
ttcactcttccgttatctatgc

SEQ ID NO: 1175280 - DNA, 22 bp, Artificial Sequence
  chemically synthesized
gctcttcactcttccgttatct

SEQ ID NO: 1175281 - DNA, 22 bp, Artificial Sequence
  chemically synthesized
ggctcttcactcttccgttatc

SEQ ID NO: 1175282 - DNA, 22 bp, Artificial Sequence
  chemically synthesized
tggctcttcactcttccgttat

SEQ ID NO: 1175283 - DNA, 22 bp, Artificial Sequence
  chemically synthesized
ttggctcttcactcttccgtta

SEQ ID NO: 1175284 - DNA, 22 bp, Artificial Sequence
  chemically synthesized
cctggcatagataacggaagag

SEQ ID NO: 1175285 - DNA, 22 bp, Artificial Sequence
  chemically synthesized
ttttggctcttcactcttccgt

SEQ ID NO: 1175286 - DNA, 22 bp, Artificial Sequence
  chemically synthesized
gcatagataacggaagagtgaa

SEQ ID NO: 1175287 - DNA, 22 bp, Artificial Sequence
  chemically synthesized
agtggctcttttggctcttcac

SEQ ID NO: 1175288 - DNA, 22 bp, Artificial Sequence
  chemically synthesized
cgtatctcagtggctcttttgg

SEQ ID NO: 1175289 - DNA, 22 bp, Artificial Sequence
  chemically synthesized
cagctccgtatctcagtggctc

SEQ ID NO: 1175290 - DNA, 22 bp, Artificial Sequence
  chemically synthesized
tcatcacactgcagctccgtat

SEQ ID NO: 1175291 - DNA, 22 bp, Artificial Sequence
  chemically synthesized
acattgtcatcacactgcagct

SEQ ID NO: 1175292 - DNA, 22 bp, Artificial Sequence
  chemically synthesized
agatacggagctgcagtgtgat

SEQ ID NO: 1175293 - DNA, 22 bp, Artificial Sequence
  chemically synthesized
atccaaatattcacattgtcat

SEQ ID NO: 1175294 - DNA, 22 bp, Artificial Sequence
  chemically synthesized
aatccaaatattcacattgtca

SEQ ID NO: 1175295 - DNA, 22 bp, Artificial Sequence
  chemically synthesized
taatccaaatattcacattgtc

SEQ ID NO: 1175296 - DNA, 22 bp, Artificial Sequence
  chemically synthesized
cagtgtgatgacaatgtgaata

SEQ ID NO: 1175297 - DNA, 22 bp, Artificial Sequence
  chemically synthesized
gtaagcctttaatccaaatatt

SEQ ID NO: 1175298 - DNA, 22 bp, Artificial Sequence
  chemically synthesized
tggtaagcctttaatccaaata

SEQ ID NO: 1175299 - DNA, 22 bp, Artificial Sequence
  chemically synthesized
ggattaaaggcttaccagaatc

SEQ ID NO: 1175300 - DNA, 22 bp, Artificial Sequence
  chemically synthesized
gattaaaggcttaccagaatcc

SEQ ID NO: 1175301 - DNA, 22 bp, Artificial Sequence
  chemically synthesized
caaaggaatggcaggattctgg

SEQ ID NO: 1175302 - DNA, 22 bp, Artificial Sequence
  chemically synthesized
aaggcttaccagaatcctgcca

SEQ ID NO: 1175303 - DNA, 22 bp, Artificial Sequence
  chemically synthesized
accagaatcctgccattccttt

SEQ ID NO: 1175304 - DNA, 22 bp, Artificial Sequence
  chemically synthesized
ccagaatcctgccattcctttg

SEQ ID NO: 1175305 - DNA, 22 bp, Artificial Sequence
  chemically synthesized
tgtaacagaaaattccaaagga

SEQ ID NO: 1175306 - DNA, 22 bp, Artificial Sequence
  chemically synthesized
atgtaacagaaaattccaaagg

SEQ ID NO: 1175307 - DNA, 22 bp, Artificial Sequence
  chemically synthesized
gcttatgtaacagaaaattcca

SEQ ID NO: 1175308 - DNA, 22 bp, Artificial Sequence
  chemically synthesized
ccattcctttggaattttctgt

SEQ ID NO: 1175309 - DNA, 22 bp, Artificial Sequence
  chemically synthesized
ttggcttatgtaacagaaaatt

SEQ ID NO: 1175310 - DNA, 22 bp, Artificial Sequence
  chemically synthesized
ctttggaattttctgttacata

SEQ ID NO: 1175311 - DNA, 22 bp, Artificial Sequence
  chemically synthesized
ggaattattggcttatgtaaca

SEQ ID NO: 1175312 - DNA, 22 bp, Artificial Sequence
  chemically synthesized
gggaattattggcttatgtaac

SEQ ID NO: 1175313 - DNA, 22 bp, Artificial Sequence
  chemically synthesized
tggaattttctgttacataagc

SEQ ID NO: 1175314 - DNA, 22 bp, Artificial Sequence
  chemically synthesized
ggaattttctgttacataagcc

SEQ ID NO: 1175315 - DNA, 22 bp, Artificial Sequence
  chemically synthesized
gaattttctgttacataagcca

SEQ ID NO: 1175316 - DNA, 22 bp, Artificial Sequence
  chemically synthesized
aaccttgggaattattggctta

SEQ ID NO: 1175317 - DNA, 22 bp, Artificial Sequence
  chemically synthesized
tctgttacataagccaataatt

SEQ ID NO: 1175318 - DNA, 22 bp, Artificial Sequence
  chemically synthesized
ctgttacataagccaataattc

SEQ ID NO: 1175319 - DNA, 22 bp, Artificial Sequence
  chemically synthesized
tgttacataagccaataattcc

SEQ ID NO: 1175320 - DNA, 22 bp, Artificial Sequence
  chemically synthesized
taattaaaccttgggaattatt

SEQ ID NO: 1175321 - DNA, 22 bp, Artificial Sequence
  chemically synthesized
ttacataagccaataattccca

SEQ ID NO: 1175322 - DNA, 22 bp, Artificial Sequence
  chemically synthesized
gtaattaaaccttgggaattat

SEQ ID NO: 1175323 - DNA, 22 bp, Artificial Sequence
  chemically synthesized
ttgtaattaaaccttgggaatt

SEQ ID NO: 1175324 - DNA, 22 bp, Artificial Sequence
  chemically synthesized
cataagccaataattcccaagg

SEQ ID NO: 1175325 - DNA, 22 bp, Artificial Sequence
  chemically synthesized
cttgtaattaaaccttgggaat

SEQ ID NO: 1175326 - DNA, 22 bp, Artificial Sequence
  chemically synthesized
aagatttcttgtaattaaacct

SEQ ID NO: 1175327 - DNA, 22 bp, Artificial Sequence
  chemically synthesized
cattaaagatttcttgtaatta

SEQ ID NO: 1175328 - DNA, 22 bp, Artificial Sequence
  chemically synthesized
ccattaaagatttcttgtaatt

SEQ ID NO: 1175329 - DNA, 22 bp, Artificial Sequence
  chemically synthesized
ttccattaaagatttcttgtaa

SEQ ID NO: 1175330 - DNA, 22 bp, Artificial Sequence
  chemically synthesized
ccaaggtttaattacaagaaat

SEQ ID NO: 1175331 - DNA, 22 bp, Artificial Sequence
  chemically synthesized
cttccattaaagatttcttgta

SEQ ID NO: 1175332 - DNA, 22 bp, Artificial Sequence
  chemically synthesized
tcttccattaaagatttcttgt

SEQ ID NO: 1175333 - DNA, 22 bp, Artificial Sequence
  chemically synthesized
ttcttccattaaagatttcttg

SEQ ID NO: 1175334 - DNA, 22 bp, Artificial Sequence
  chemically synthesized
aattacaagaaatctttaatgg

SEQ ID NO: 1175335 - DNA, 22 bp, Artificial Sequence
  chemically synthesized
attacaagaaatctttaatgga

SEQ ID NO: 1175336 - DNA, 22 bp, Artificial Sequence
  chemically synthesized
caagaaatctttaatggaagaa

SEQ ID NO: 1175337 - DNA, 22 bp, Artificial Sequence
  chemically synthesized
gagcagtaacatgtgacatctt

SEQ ID NO: 1175338 - DNA, 22 bp, Artificial Sequence
  chemically synthesized
taatggaagaaaagatgtcaca

SEQ ID NO: 1175339 - DNA, 22 bp, Artificial Sequence
  chemically synthesized
aatggaagaaaagatgtcacat

SEQ ID NO: 1175340 - DNA, 22 bp, Artificial Sequence
  chemically synthesized
atggaagaaaagatgtcacatg

SEQ ID NO: 1175341 - DNA, 22 bp, Artificial Sequence
  chemically synthesized
ctgctccaatgtggatgttttc

SEQ ID NO: 1175342 - DNA, 22 bp, Artificial Sequence
  chemically synthesized
ctccaatgtggatgttttctgt

SEQ ID NO: 1175343 - DNA, 22 bp, Artificial Sequence
  chemically synthesized
caatgtggatgttttctgtatg

SEQ ID NO: 1175344 - DNA, 22 bp, Artificial Sequence
  chemically synthesized
tctgtatgtgtgtgtatgtgta

SEQ ID NO: 1175345 - DNA, 22 bp, Artificial Sequence
  chemically synthesized
ctgtatgtgtgtgtatgtgtat

SEQ ID NO: 1175346 - DNA, 22 bp, Artificial Sequence
  chemically synthesized
tgtatgtgtgtgtatgtgtatg

SEQ ID NO: 1175347 - DNA, 22 bp, Artificial Sequence
  chemically synthesized
tatgtgtgtgtatgtgtatgtg

SEQ ID NO: 1175348 - DNA, 22 bp, Artificial Sequence
  chemically synthesized
aaatatgcagacacacacacgc

SEQ ID NO: 1175349 - DNA, 22 bp, Artificial Sequence
  chemically synthesized
gaaatatgcagacacacacacg

SEQ ID NO: 1175350 - DNA, 22 bp, Artificial Sequence
  chemically synthesized
aagaaaacttgaaatatgcaga

SEQ ID NO: 1175351 - DNA, 22 bp, Artificial Sequence
  chemically synthesized
tcaagaaaacttgaaatatgca

SEQ ID NO: 1175352 - DNA, 22 bp, Artificial Sequence
  chemically synthesized
ctcaagaaaacttgaaatatgc

SEQ ID NO: 1175353 - DNA, 22 bp, Artificial Sequence
  chemically synthesized
ttctcaagaaaacttgaaatat

SEQ ID NO: 1175354 - DNA, 22 bp, Artificial Sequence
  chemically synthesized
catatttcaagttttcttgaga

SEQ ID NO: 1175355 - DNA, 22 bp, Artificial Sequence
  chemically synthesized
caagttttcttgagaagagttt

SEQ ID NO: 1175356 - DNA, 22 bp, Artificial Sequence
  chemically synthesized
aagttttcttgagaagagtttt

SEQ ID NO: 1175357 - DNA, 22 bp, Artificial Sequence
  chemically synthesized
gtacaataatggaaaactcttc

SEQ ID NO: 1175358 - DNA, 22 bp, Artificial Sequence
  chemically synthesized
ggtacaataatggaaaactctt

SEQ ID NO: 1175359 - DNA, 22 bp, Artificial Sequence
  chemically synthesized
tcttgagaagagttttccatta

SEQ ID NO: 1175360 - DNA, 22 bp, Artificial Sequence
  chemically synthesized
cttgagaagagttttccattat

SEQ ID NO: 1175361 - DNA, 22 bp, Artificial Sequence
  chemically synthesized
ttgagaagagttttccattatt

SEQ ID NO: 1175362 - DNA, 22 bp, Artificial Sequence
  chemically synthesized
gagaagagttttccattattgt

SEQ ID NO: 1175363 - DNA, 22 bp, Artificial Sequence
  chemically synthesized
agaagagttttccattattgta

SEQ ID NO: 1175364 - DNA, 22 bp, Artificial Sequence
  chemically synthesized
gaatgatgtttggtacaataat

SEQ ID NO: 1175365 - DNA, 22 bp, Artificial Sequence
  chemically synthesized
tccattattgtaccaaacatca

SEQ ID NO: 1175366 - DNA, 22 bp, Artificial Sequence
  chemically synthesized
ccattattgtaccaaacatcat

SEQ ID NO: 1175367 - DNA, 22 bp, Artificial Sequence
  chemically synthesized
cattattgtaccaaacatcatt

SEQ ID NO: 1175368 - DNA, 22 bp, Artificial Sequence
  chemically synthesized
ttgtaccaaacatcattctagt

SEQ ID NO: 1175369 - DNA, 22 bp, Artificial Sequence
  chemically synthesized
taccaaacatcattctagttta

SEQ ID NO: 1175370 - DNA, 22 bp, Artificial Sequence
  chemically synthesized
ataccaaagtccatataaacta

SEQ ID NO: 1175371 - DNA, 22 bp, Artificial Sequence
  chemically synthesized
ctgataccaaagtccatataaa

SEQ ID NO: 1175372 - DNA, 22 bp, Artificial Sequence
  chemically synthesized
cctgataccaaagtccatataa

SEQ ID NO: 1175373 - DNA, 22 bp, Artificial Sequence
  chemically synthesized
tagtttatatggactttggtat

SEQ ID NO: 1175374 - DNA, 22 bp, Artificial Sequence
  chemically synthesized
gtttatatggactttggtatca

SEQ ID NO: 1175375 - DNA, 22 bp, Artificial Sequence
  chemically synthesized
aacaacccacttcctgatacca

SEQ ID NO: 1175376 - DNA, 22 bp, Artificial Sequence
  chemically synthesized
caacaacccacttcctgatacc

SEQ ID NO: 1175377 - DNA, 22 bp, Artificial Sequence
  chemically synthesized
atatggactttggtatcaggaa

SEQ ID NO: 1175378 - DNA, 22 bp, Artificial Sequence
  chemically synthesized
tcaacaacccacttcctgatac

SEQ ID NO: 1175379 - DNA, 22 bp, Artificial Sequence
  chemically synthesized
tatggactttggtatcaggaag

SEQ ID NO: 1175380 - DNA, 22 bp, Artificial Sequence
  chemically synthesized
actttcaacaacccacttcctg

SEQ ID NO: 1175381 - DNA, 22 bp, Artificial Sequence
  chemically synthesized
ttaactttcaacaacccacttc

SEQ ID NO: 1175382 - DNA, 22 bp, Artificial Sequence
  chemically synthesized
tggtatcaggaagtgggttgtt

SEQ ID NO: 1175383 - DNA, 22 bp, Artificial Sequence
  chemically synthesized
ggtatcaggaagtgggttgttg

SEQ ID NO: 1175384 - DNA, 22 bp, Artificial Sequence
  chemically synthesized
gtatcaggaagtgggttgttga

SEQ ID NO: 1175385 - DNA, 22 bp, Artificial Sequence
  chemically synthesized
taggatctattaactttcaaca

SEQ ID NO: 1175386 - DNA, 22 bp, Artificial Sequence
  chemically synthesized
cacattataggatctattaact

SEQ ID NO: 1175387 - DNA, 22 bp, Artificial Sequence
  chemically synthesized
ttccacattataggatctatta

SEQ ID NO: 1175388 - DNA, 22 bp, Artificial Sequence
  chemically synthesized
ttgaaagttaatagatcctata

SEQ ID NO: 1175389 - DNA, 22 bp, Artificial Sequence
  chemically synthesized
agcctgttccacattataggat

SEQ ID NO: 1175390 - DNA, 22 bp, Artificial Sequence
  chemically synthesized
aaagttaatagatcctataatg

SEQ ID NO: 1175391 - DNA, 22 bp, Artificial Sequence
  chemically synthesized
ataattcagcctgttccacatt

SEQ ID NO: 1175392 - DNA, 22 bp, Artificial Sequence
  chemically synthesized
atagatcctataatgtggaaca

SEQ ID NO: 1175393 - DNA, 22 bp, Artificial Sequence
  chemically synthesized
tcataattcagcctgttccaca

SEQ ID NO: 1175394 - DNA, 22 bp, Artificial Sequence
  chemically synthesized
ctcataattcagcctgttccac

SEQ ID NO: 1175395 - DNA, 22 bp, Artificial Sequence
  chemically synthesized
tcttctcataattcagcctgtt

SEQ ID NO: 1175396 - DNA, 22 bp, Artificial Sequence
  chemically synthesized
gtcttctcataattcagcctgt

SEQ ID NO: 1175397 - DNA, 22 bp, Artificial Sequence
  chemically synthesized
taatgtggaacaggctgaatta

SEQ ID NO: 1175398 - DNA, 22 bp, Artificial Sequence
  chemically synthesized
tcatccttgtcttctcataatt

SEQ ID NO: 1175399 - DNA, 22 bp, Artificial Sequence
  chemically synthesized
atcatccttgtcttctcataat

SEQ ID NO: 1175400 - DNA, 22 bp, Artificial Sequence
  chemically synthesized
aattatgagaagacaaggatga

SEQ ID NO: 1175401 - DNA, 22 bp, Artificial Sequence
  chemically synthesized
gggtgggggaggtttatcatcc

SEQ ID NO: 1175402 - DNA, 22 bp, Artificial Sequence
  chemically synthesized
tgagaagacaaggatgataaac

SEQ ID NO: 1175403 - DNA, 22 bp, Artificial Sequence
  chemically synthesized
agttggggtgggggaggtttat

SEQ ID NO: 1175404 - DNA, 22 bp, Artificial Sequence
  chemically synthesized
gagttggggtgggggaggttta

SEQ ID NO: 1175405 - DNA, 22 bp, Artificial Sequence
  chemically synthesized
tgagttggggtgggggaggttt

SEQ ID NO: 1175406 - DNA, 22 bp, Artificial Sequence
  chemically synthesized
ccccaccccaactcaaaatgat

SEQ ID NO: 1175407 - DNA, 22 bp, Artificial Sequence
  chemically synthesized
atcatgtaccaagtatcatttt

SEQ ID NO: 1175408 - DNA, 22 bp, Artificial Sequence
  chemically synthesized
aatcatgtaccaagtatcattt

SEQ ID NO: 1175409 - DNA, 22 bp, Artificial Sequence
  chemically synthesized
taatcatgtaccaagtatcatt

SEQ ID NO: 1175410 - DNA, 22 bp, Artificial Sequence
  chemically synthesized
ttaatcatgtaccaagtatcat

SEQ ID NO: 1175411 - DNA, 22 bp, Artificial Sequence
  chemically synthesized
tttaatcatgtaccaagtatca

SEQ ID NO: 1175412 - DNA, 22 bp, Artificial Sequence
  chemically synthesized
ttttttaatcatgtaccaagta

SEQ ID NO: 1175413 - DNA, 22 bp, Artificial Sequence
  chemically synthesized
aaaatgatacttggtacatgat

SEQ ID NO: 1175414 - DNA, 22 bp, Artificial Sequence
  chemically synthesized
atcaactgttttttaatcatgt

SEQ ID NO: 1175415 - DNA, 22 bp, Artificial Sequence
  chemically synthesized
aatcaactgttttttaatcatg

SEQ ID NO: 1175416 - DNA, 22 bp, Artificial Sequence
  chemically synthesized
tttaatcaactgttttttaatc

SEQ ID NO: 1175417 - DNA, 22 bp, Artificial Sequence
  chemically synthesized
ggtacatgattaaaaaacagtt

SEQ ID NO: 1175418 - DNA, 22 bp, Artificial Sequence
  chemically synthesized
gtacatgattaaaaaacagttg

SEQ ID NO: 1175419 - DNA, 22 bp, Artificial Sequence
  chemically synthesized
aaaaacagttgattaaacaatg

SEQ ID NO: 1175420 - DNA, 22 bp, Artificial Sequence
  chemically synthesized
ggataaaatagaccattgttta

SEQ ID NO: 1175421 - DNA, 22 bp, Artificial Sequence
  chemically synthesized
aggataaaatagaccattgttt

SEQ ID NO: 1175422 - DNA, 22 bp, Artificial Sequence
  chemically synthesized
attaaacaatggtctattttat

SEQ ID NO: 1175423 - DNA, 22 bp, Artificial Sequence
  chemically synthesized
aacaatggtctattttatccta

SEQ ID NO: 1175424 - DNA, 22 bp, Artificial Sequence
  chemically synthesized
gtaaggcacatgacttaggata

SEQ ID NO: 1175425 - DNA, 22 bp, Artificial Sequence
  chemically synthesized
gtactcgtaaggcacatgactt

SEQ ID NO: 1175426 - DNA, 22 bp, Artificial Sequence
  chemically synthesized
ttttatcctaagtcatgtgcct

SEQ ID NO: 1175427 - DNA, 22 bp, Artificial Sequence
  chemically synthesized
tatcctaagtcatgtgccttac

SEQ ID NO: 1175428 - DNA, 22 bp, Artificial Sequence
  chemically synthesized
atcctaagtcatgtgccttacg

SEQ ID NO: 1175429 - DNA, 22 bp, Artificial Sequence
  chemically synthesized
tcctaagtcatgtgccttacga

SEQ ID NO: 1175430 - DNA, 22 bp, Artificial Sequence
  chemically synthesized
atagtgttggtactcgtaaggc

SEQ ID NO: 1175431 - DNA, 22 bp, Artificial Sequence
  chemically synthesized
ctaatagtgttggtactcgtaa

SEQ ID NO: 1175432 - DNA, 22 bp, Artificial Sequence
  chemically synthesized
agtcatgtgccttacgagtacc

SEQ ID NO: 1175433 - DNA, 22 bp, Artificial Sequence
  chemically synthesized
tcaaatctcctaatagtgttgg

SEQ ID NO: 1175434 - DNA, 22 bp, Artificial Sequence
  chemically synthesized
tatcaaatctcctaatagtgtt

SEQ ID NO: 1175435 - DNA, 22 bp, Artificial Sequence
  chemically synthesized
ctatcaaatctcctaatagtgt

SEQ ID NO: 1175436 - DNA, 22 bp, Artificial Sequence
  chemically synthesized
acgagtaccaacactattagga

SEQ ID NO: 1175437 - DNA, 22 bp, Artificial Sequence
  chemically synthesized
cgagtaccaacactattaggag

SEQ ID NO: 1175438 - DNA, 22 bp, Artificial Sequence
  chemically synthesized
tttctatcaaatctcctaatag

SEQ ID NO: 1175439 - DNA, 22 bp, Artificial Sequence
  chemically synthesized
gtttctatcaaatctcctaata

SEQ ID NO: 1175440 - DNA, 22 bp, Artificial Sequence
  chemically synthesized
tgtttctatcaaatctcctaat

SEQ ID NO: 1175441 - DNA, 22 bp, Artificial Sequence
  chemically synthesized
ttgtttctatcaaatctcctaa

SEQ ID NO: 1175442 - DNA, 22 bp, Artificial Sequence
  chemically synthesized
ttaggagatttgatagaaacaa

SEQ ID NO: 1175443 - DNA, 22 bp, Artificial Sequence
  chemically synthesized
ggagatttgatagaaacaaaaa

SEQ ID NO: 1175444 - DNA, 22 bp, Artificial Sequence
  chemically synthesized
gatagaaacaaaaatgttgcca

SEQ ID NO: 1175445 - DNA, 22 bp, Artificial Sequence
  chemically synthesized
atagaaacaaaaatgttgccac

SEQ ID NO: 1175446 - DNA, 22 bp, Artificial Sequence
  chemically synthesized
aagaggccagtaggtggcaaca

SEQ ID NO: 1175447 - DNA, 22 bp, Artificial Sequence
  chemically synthesized
aaagaggccagtaggtggcaac

SEQ ID NO: 1175448 - DNA, 22 bp, Artificial Sequence
  chemically synthesized
gtttaaagaggccagtaggtgg

SEQ ID NO: 1175449 - DNA, 22 bp, Artificial Sequence
  chemically synthesized
ggtttaaagaggccagtaggtg

SEQ ID NO: 1175450 - DNA, 22 bp, Artificial Sequence
  chemically synthesized
ttggtttaaagaggccagtagg

SEQ ID NO: 1175451 - DNA, 22 bp, Artificial Sequence
  chemically synthesized
cttggtttaaagaggccagtag

SEQ ID NO: 1175452 - DNA, 22 bp, Artificial Sequence
  chemically synthesized
tcttggtttaaagaggccagta

SEQ ID NO: 1175453 - DNA, 22 bp, Artificial Sequence
  chemically synthesized
tttcttggtttaaagaggccag

SEQ ID NO: 1175454 - DNA, 22 bp, Artificial Sequence
  chemically synthesized
ctttcttggtttaaagaggcca

SEQ ID NO: 1175455 - DNA, 22 bp, Artificial Sequence
  chemically synthesized
tctttcttggtttaaagaggcc

SEQ ID NO: 1175456 - DNA, 22 bp, Artificial Sequence
  chemically synthesized
ttctttcttggtttaaagaggc

SEQ ID NO: 1175457 - DNA, 22 bp, Artificial Sequence
  chemically synthesized
tttctttcttggtttaaagagg

SEQ ID NO: 1175458 - DNA, 22 bp, Artificial Sequence
  chemically synthesized
ccacctactggcctctttaaac

SEQ ID NO: 1175459 - DNA, 22 bp, Artificial Sequence
  chemically synthesized
ctggcctctttaaaccaagaaa

SEQ ID NO: 1175460 - DNA, 22 bp, Artificial Sequence
  chemically synthesized
gcctctttaaaccaagaaagaa

SEQ ID NO: 1175461 - DNA, 22 bp, Artificial Sequence
  chemically synthesized
gcatgaggttttttctttcttg

SEQ ID NO: 1175462 - DNA, 22 bp, Artificial Sequence
  chemically synthesized
tttaaaccaagaaagaaaaaac

SEQ ID NO: 1175463 - DNA, 22 bp, Artificial Sequence
  chemically synthesized
taaaccaagaaagaaaaaacct

SEQ ID NO: 1175464 - DNA, 22 bp, Artificial Sequence
  chemically synthesized
aaaccaagaaagaaaaaacctc

SEQ ID NO: 1175465 - DNA, 22 bp, Artificial Sequence
  chemically synthesized
aaccaagaaagaaaaaacctca

SEQ ID NO: 1175466 - DNA, 22 bp, Artificial Sequence
  chemically synthesized
aaaaacaagtaaccattagcat

SEQ ID NO: 1175467 - DNA, 22 bp, Artificial Sequence
  chemically synthesized
caaaaacaagtaaccattagca

SEQ ID NO: 1175468 - DNA, 22 bp, Artificial Sequence
  chemically synthesized
tacttcaaaaacaagtaaccat

SEQ ID NO: 1175469 - DNA, 22 bp, Artificial Sequence
  chemically synthesized
tgtacttcaaaaacaagtaacc

SEQ ID NO: 1175470 - DNA, 22 bp, Artificial Sequence
  chemically synthesized
ctgtacttcaaaaacaagtaac

SEQ ID NO: 1175471 - DNA, 22 bp, Artificial Sequence
  chemically synthesized
tctgtacttcaaaaacaagtaa

SEQ ID NO: 1175472 - DNA, 22 bp, Artificial Sequence
  chemically synthesized
ttctgtacttcaaaaacaagta

SEQ ID NO: 1175473 - DNA, 22 bp, Artificial Sequence
  chemically synthesized
atgctaatggttacttgttttt

SEQ ID NO: 1175474 - DNA, 22 bp, Artificial Sequence
  chemically synthesized
tttctgtacttcaaaaacaagt

SEQ ID NO: 1175475 - DNA, 22 bp, Artificial Sequence
  chemically synthesized
ttttctgtacttcaaaaacaag

SEQ ID NO: 1175476 - DNA, 22 bp, Artificial Sequence
  chemically synthesized
tttttctgtacttcaaaaacaa

SEQ ID NO: 1175477 - DNA, 22 bp, Artificial Sequence
  chemically synthesized
ttttttctgtacttcaaaaaca

SEQ ID NO: 1175478 - DNA, 22 bp, Artificial Sequence
  chemically synthesized
ttttttttctgtacttcaaaaa

SEQ ID NO: 1175479 - DNA, 22 bp, Artificial Sequence
  chemically synthesized
atggttacttgtttttgaagta

SEQ ID NO: 1175480 - DNA, 22 bp, Artificial Sequence
  chemically synthesized
cttttttttctgtacttcaaaa

SEQ ID NO: 1175481 - DNA, 22 bp, Artificial Sequence
  chemically synthesized
tcttttttttctgtacttcaaa

SEQ ID NO: 1175482 - DNA, 22 bp, Artificial Sequence
  chemically synthesized
tattttcttttttttctgtact

SEQ ID NO: 1175483 - DNA, 22 bp, Artificial Sequence
  chemically synthesized
cttgtttttgaagtacagaaaa

SEQ ID NO: 1175484 - DNA, 22 bp, Artificial Sequence
  chemically synthesized
gtttttgaagtacagaaaaaaa

SEQ ID NO: 1175485 - DNA, 22 bp, Artificial Sequence
  chemically synthesized
tttttgaagtacagaaaaaaaa

SEQ ID NO: 1175486 - DNA, 22 bp, Artificial Sequence
  chemically synthesized
ttgaagtacagaaaaaaaagaa

SEQ ID NO: 1175487 - DNA, 22 bp, Artificial Sequence
  chemically synthesized
tgaagtacagaaaaaaaagaaa

SEQ ID NO: 1175488 - DNA, 22 bp, Artificial Sequence
  chemically synthesized
gaagtacagaaaaaaaagaaaa

SEQ ID NO: 1175489 - DNA, 22 bp, Artificial Sequence
  chemically synthesized
aagtacagaaaaaaaagaaaat

SEQ ID NO: 1175490 - DNA, 22 bp, Artificial Sequence
  chemically synthesized
agacaaagctatattttctttt

SEQ ID NO: 1175491 - DNA, 22 bp, Artificial Sequence
  chemically synthesized
cagacaaagctatattttcttt

SEQ ID NO: 1175492 - DNA, 22 bp, Artificial Sequence
  chemically synthesized
ttcagacaaagctatattttct

SEQ ID NO: 1175493 - DNA, 22 bp, Artificial Sequence
  chemically synthesized
cttcagacaaagctatattttc

SEQ ID NO: 1175494 - DNA, 22 bp, Artificial Sequence
  chemically synthesized
taagccacaggcagagagggct

SEQ ID NO: 1175495 - DNA, 22 bp, Artificial Sequence
  chemically synthesized
tgtctgaagaagccctctctgc

SEQ ID NO: 1175496 - DNA, 22 bp, Artificial Sequence
  chemically synthesized
gtctgaagaagccctctctgcc

SEQ ID NO: 1175497 - DNA, 22 bp, Artificial Sequence
  chemically synthesized
tctgaagaagccctctctgcct

SEQ ID NO: 1175498 - DNA, 22 bp, Artificial Sequence
  chemically synthesized
acgttataagccacaggcagag

SEQ ID NO: 1175499 - DNA, 22 bp, Artificial Sequence
  chemically synthesized
aagaagccctctctgcctgtgg

SEQ ID NO: 1175500 - DNA, 22 bp, Artificial Sequence
  chemically synthesized
aaggcgttcacgttataagcca

SEQ ID NO: 1175501 - DNA, 22 bp, Artificial Sequence
  chemically synthesized
tcaaggcgttcacgttataagc

SEQ ID NO: 1175502 - DNA, 22 bp, Artificial Sequence
  chemically synthesized
tctgcctgtggcttataacgtg

SEQ ID NO: 1175503 - DNA, 22 bp, Artificial Sequence
  chemically synthesized
tgcctgtggcttataacgtgaa

SEQ ID NO: 1175504 - DNA, 22 bp, Artificial Sequence
  chemically synthesized
cctgtggcttataacgtgaacg

SEQ ID NO: 1175505 - DNA, 22 bp, Artificial Sequence
  chemically synthesized
tcagcctctcaaggcgttcacg

SEQ ID NO: 1175506 - DNA, 22 bp, Artificial Sequence
  chemically synthesized
tggcttataacgtgaacgcctt

SEQ ID NO: 1175507 - DNA, 22 bp, Artificial Sequence
  chemically synthesized
caaattatcagcctctcaaggc

SEQ ID NO: 1175508 - DNA, 22 bp, Artificial Sequence
  chemically synthesized
ataacgtgaacgccttgagagg

SEQ ID NO: 1175509 - DNA, 22 bp, Artificial Sequence
  chemically synthesized
taacgtgaacgccttgagaggc

SEQ ID NO: 1175510 - DNA, 22 bp, Artificial Sequence
  chemically synthesized
atatcaggctccaaattatcag

SEQ ID NO: 1175511 - DNA, 22 bp, Artificial Sequence
  chemically synthesized
cactcatatcaggctccaaatt

SEQ ID NO: 1175512 - DNA, 22 bp, Artificial Sequence
  chemically synthesized
gagaggctgataatttggagcc

SEQ ID NO: 1175513 - DNA, 22 bp, Artificial Sequence
  chemically synthesized
ccactcatatcaggctccaaat

SEQ ID NO: 1175514 - DNA, 22 bp, Artificial Sequence
  chemically synthesized
agaggctgataatttggagcct

SEQ ID NO: 1175515 - DNA, 22 bp, Artificial Sequence
  chemically synthesized
tccactcatatcaggctccaaa

SEQ ID NO: 1175516 - DNA, 22 bp, Artificial Sequence
  chemically synthesized
ttccactcatatcaggctccaa

SEQ ID NO: 1175517 - DNA, 22 bp, Artificial Sequence
  chemically synthesized
gcttttccactcatatcaggct

SEQ ID NO: 1175518 - DNA, 22 bp, Artificial Sequence
  chemically synthesized
ataatttggagcctgatatgag

SEQ ID NO: 1175519 - DNA, 22 bp, Artificial Sequence
  chemically synthesized
ggagcctgatatgagtggaaaa

SEQ ID NO: 1175520 - DNA, 22 bp, Artificial Sequence
  chemically synthesized
gagcctgatatgagtggaaaag

SEQ ID NO: 1175521 - DNA, 22 bp, Artificial Sequence
  chemically synthesized
atatgagtggaaaagccaattt

SEQ ID NO: 1175522 - DNA, 22 bp, Artificial Sequence
  chemically synthesized
gagtaaaaatacaaattggctt

SEQ ID NO: 1175523 - DNA, 22 bp, Artificial Sequence
  chemically synthesized
ggagtaaaaatacaaattggct

SEQ ID NO: 1175524 - DNA, 22 bp, Artificial Sequence
  chemically synthesized
gatttggagtaaaaatacaaat

SEQ ID NO: 1175525 - DNA, 22 bp, Artificial Sequence
  chemically synthesized
atacaaacattcgatttggagt

SEQ ID NO: 1175526 - DNA, 22 bp, Artificial Sequence
  chemically synthesized
ttcatacaaacattcgatttgg

SEQ ID NO: 1175527 - DNA, 22 bp, Artificial Sequence
  chemically synthesized
gtatttttactccaaatcgaat

SEQ ID NO: 1175528 - DNA, 22 bp, Artificial Sequence
  chemically synthesized
tatttttactccaaatcgaatg

SEQ ID NO: 1175529 - DNA, 22 bp, Artificial Sequence
  chemically synthesized
tgttcatacaaacattcgattt

SEQ ID NO: 1175530 - DNA, 22 bp, Artificial Sequence
  chemically synthesized
tctctgttcatacaaacattcg

SEQ ID NO: 1175531 - DNA, 22 bp, Artificial Sequence
  chemically synthesized
ttactccaaatcgaatgtttgt

SEQ ID NO: 1175532 - DNA, 22 bp, Artificial Sequence
  chemically synthesized
tactccaaatcgaatgtttgta

SEQ ID NO: 1175533 - DNA, 22 bp, Artificial Sequence
  chemically synthesized
actccaaatcgaatgtttgtat

SEQ ID NO: 1175534 - DNA, 22 bp, Artificial Sequence
  chemically synthesized
ctgtctctgttcatacaaacat

SEQ ID NO: 1175535 - DNA, 22 bp, Artificial Sequence
  chemically synthesized
ctccaaatcgaatgtttgtatg

SEQ ID NO: 1175536 - DNA, 22 bp, Artificial Sequence
  chemically synthesized
tcctgtctctgttcatacaaac

SEQ ID NO: 1175537 - DNA, 22 bp, Artificial Sequence
  chemically synthesized
caaatcgaatgtttgtatgaac

SEQ ID NO: 1175538 - DNA, 22 bp, Artificial Sequence
  chemically synthesized
cctctcctgtctctgttcatac

SEQ ID NO: 1175539 - DNA, 22 bp, Artificial Sequence
  chemically synthesized
tgcctctcctgtctctgttcat

SEQ ID NO: 1175540 - DNA, 22 bp, Artificial Sequence
  chemically synthesized
cattctgcctctcctgtctctg

SEQ ID NO: 1175541 - DNA, 22 bp, Artificial Sequence
  chemically synthesized
acattctgcctctcctgtctct

SEQ ID NO: 1175542 - DNA, 22 bp, Artificial Sequence
  chemically synthesized
gtatgaacagagacaggagagg

SEQ ID NO: 1175543 - DNA, 22 bp, Artificial Sequence
  chemically synthesized
tatgaacagagacaggagaggc

SEQ ID NO: 1175544 - DNA, 22 bp, Artificial Sequence
  chemically synthesized
agtcttacattctgcctctcct

SEQ ID NO: 1175545 - DNA, 22 bp, Artificial Sequence
  chemically synthesized
aagtcttacattctgcctctcc

SEQ ID NO: 1175546 - DNA, 22 bp, Artificial Sequence
  chemically synthesized
gtacttaagtcttacattctgc

SEQ ID NO: 1175547 - DNA, 22 bp, Artificial Sequence
  chemically synthesized
agtacttaagtcttacattctg

SEQ ID NO: 1175548 - DNA, 22 bp, Artificial Sequence
  chemically synthesized
tagtacttaagtcttacattct

SEQ ID NO: 1175549 - DNA, 22 bp, Artificial Sequence
  chemically synthesized
ttagtacttaagtcttacattc

SEQ ID NO: 1175550 - DNA, 22 bp, Artificial Sequence
  chemically synthesized
tttagtacttaagtcttacatt

SEQ ID NO: 1175551 - DNA, 22 bp, Artificial Sequence
  chemically synthesized
ttttagtacttaagtcttacat

SEQ ID NO: 1175552 - DNA, 22 bp, Artificial Sequence
  chemically synthesized
tttttagtacttaagtcttaca

SEQ ID NO: 1175553 - DNA, 22 bp, Artificial Sequence
  chemically synthesized
attttttttagtacttaagtct

SEQ ID NO: 1175554 - DNA, 22 bp, Artificial Sequence
  chemically synthesized
tagttgattttttttagtactt

SEQ ID NO: 1175555 - DNA, 22 bp, Artificial Sequence
  chemically synthesized
gggaagcactatagttgatttt

SEQ ID NO: 1175556 - DNA, 22 bp, Artificial Sequence
  chemically synthesized
aagtactaaaaaaaatcaacta

SEQ ID NO: 1175557 - DNA, 22 bp, Artificial Sequence
  chemically synthesized
agggaagcactatagttgattt

SEQ ID NO: 1175558 - DNA, 22 bp, Artificial Sequence
  chemically synthesized
agtactaaaaaaaatcaactat

SEQ ID NO: 1175559 - DNA, 22 bp, Artificial Sequence
  chemically synthesized
tagggaagcactatagttgatt

SEQ ID NO: 1175560 - DNA, 22 bp, Artificial Sequence
  chemically synthesized
aaaaaaatcaactatagtgctt

SEQ ID NO: 1175561 - DNA, 22 bp, Artificial Sequence
  chemically synthesized
tcacaaaagtgctttagggaag

SEQ ID NO: 1175562 - DNA, 22 bp, Artificial Sequence
  chemically synthesized
gtcacaaaagtgctttagggaa

SEQ ID NO: 1175563 - DNA, 22 bp, Artificial Sequence
  chemically synthesized
tgtcacaaaagtgctttaggga

SEQ ID NO: 1175564 - DNA, 22 bp, Artificial Sequence
  chemically synthesized
ctttgtcacaaaagtgctttag

SEQ ID NO: 1175565 - DNA, 22 bp, Artificial Sequence
  chemically synthesized
tagtgcttccctaaagcacttt

SEQ ID NO: 1175566 - DNA, 22 bp, Artificial Sequence
  chemically synthesized
ccctaaagcacttttgtgacaa

SEQ ID NO: 1175567 - DNA, 22 bp, Artificial Sequence
  chemically synthesized
cctaaagcacttttgtgacaaa

SEQ ID NO: 1175568 - DNA, 22 bp, Artificial Sequence
  chemically synthesized
aagcacttttgtgacaaagtag

SEQ ID NO: 1175569 - DNA, 22 bp, Artificial Sequence
  chemically synthesized
atgataggagggatcgtctact

SEQ ID NO: 1175570 - DNA, 22 bp, Artificial Sequence
  chemically synthesized
catgataggagggatcgtctac

SEQ ID NO: 1175571 - DNA, 22 bp, Artificial Sequence
  chemically synthesized
ttgtgacaaagtagacgatccc

SEQ ID NO: 1175572 - DNA, 22 bp, Artificial Sequence
  chemically synthesized
ttcatgataggagggatcgtct

SEQ ID NO: 1175573 - DNA, 22 bp, Artificial Sequence
  chemically synthesized
tgtgacaaagtagacgatccct

SEQ ID NO: 1175574 - DNA, 22 bp, Artificial Sequence
  chemically synthesized
cttcatgataggagggatcgtc

SEQ ID NO: 1175575 - DNA, 22 bp, Artificial Sequence
  chemically synthesized
gtgacaaagtagacgatccctc

SEQ ID NO: 1175576 - DNA, 22 bp, Artificial Sequence
  chemically synthesized
tgacaaagtagacgatccctcc

SEQ ID NO: 1175577 - DNA, 22 bp, Artificial Sequence
  chemically synthesized
cttcttcatgataggagggatc

SEQ ID NO: 1175578 - DNA, 22 bp, Artificial Sequence
  chemically synthesized
catagaagctgcttcttcatga

SEQ ID NO: 1175579 - DNA, 22 bp, Artificial Sequence
  chemically synthesized
ctatcatgaagaagcagcttct

SEQ ID NO: 1175580 - DNA, 22 bp, Artificial Sequence
  chemically synthesized
tcatgaagaagcagcttctatg

SEQ ID NO: 1175581 - DNA, 22 bp, Artificial Sequence
  chemically synthesized
aagtatagattacatagaagct

SEQ ID NO: 1175582 - DNA, 22 bp, Artificial Sequence
  chemically synthesized
gaagtatagattacatagaagc

SEQ ID NO: 1175583 - DNA, 22 bp, Artificial Sequence
  chemically synthesized
tgaagtatagattacatagaag

SEQ ID NO: 1175584 - DNA, 22 bp, Artificial Sequence
  chemically synthesized
agtatatctttgaagtatagat

SEQ ID NO: 1175585 - DNA, 22 bp, Artificial Sequence
  chemically synthesized
gagtatatctttgaagtataga

SEQ ID NO: 1175586 - DNA, 22 bp, Artificial Sequence
  chemically synthesized
tgagtatatctttgaagtatag

SEQ ID NO: 1175587 - DNA, 22 bp, Artificial Sequence
  chemically synthesized
ctatgtaatctatacttcaaag

SEQ ID NO: 1175588 - DNA, 22 bp, Artificial Sequence
  chemically synthesized
tatgtaatctatacttcaaaga

SEQ ID NO: 1175589 - DNA, 22 bp, Artificial Sequence
  chemically synthesized
tgtaatctatacttcaaagata

SEQ ID NO: 1175590 - DNA, 22 bp, Artificial Sequence
  chemically synthesized
tacttcaaagatatactcaaag

SEQ ID NO: 1175591 - DNA, 22 bp, Artificial Sequence
  chemically synthesized
caaagatatactcaaagattgg

SEQ ID NO: 1175592 - DNA, 22 bp, Artificial Sequence
  chemically synthesized
aaagatatactcaaagattggc

SEQ ID NO: 1175593 - DNA, 22 bp, Artificial Sequence
  chemically synthesized
gggtagagggcatagccaatct

SEQ ID NO: 1175594 - DNA, 22 bp, Artificial Sequence
  chemically synthesized
aaagattggctatgccctctac

SEQ ID NO: 1175595 - DNA, 22 bp, Artificial Sequence
  chemically synthesized
cagcacagggttggggtagagg

SEQ ID NO: 1175596 - DNA, 22 bp, Artificial Sequence
  chemically synthesized
gcagcacagggttggggtagag

SEQ ID NO: 1175597 - DNA, 22 bp, Artificial Sequence
  chemically synthesized
gctatgccctctaccccaaccc

SEQ ID NO: 1175598 - DNA, 22 bp, Artificial Sequence
  chemically synthesized
tgccctctaccccaaccctgtg

SEQ ID NO: 1175599 - DNA, 22 bp, Artificial Sequence
  chemically synthesized
agaaaatttgcagcacagggtt

SEQ ID NO: 1175600 - DNA, 22 bp, Artificial Sequence
  chemically synthesized
actgagaaaatttgcagcacag

SEQ ID NO: 1175601 - DNA, 22 bp, Artificial Sequence
  chemically synthesized
taccccaaccctgtgctgcaaa

SEQ ID NO: 1175602 - DNA, 22 bp, Artificial Sequence
  chemically synthesized
ccccaaccctgtgctgcaaatt

SEQ ID NO: 1175603 - DNA, 22 bp, Artificial Sequence
  chemically synthesized
cacaatcccctgactgagaaaa

SEQ ID NO: 1175604 - DNA, 22 bp, Artificial Sequence
  chemically synthesized
gcacaatcccctgactgagaaa

SEQ ID NO: 1175605 - DNA, 22 bp, Artificial Sequence
  chemically synthesized
tgcacaatcccctgactgagaa

SEQ ID NO: 1175606 - DNA, 22 bp, Artificial Sequence
  chemically synthesized
tgctgcaaattttctcagtcag

SEQ ID NO: 1175607 - DNA, 22 bp, Artificial Sequence
  chemically synthesized
tgctttgcacaatcccctgact

SEQ ID NO: 1175608 - DNA, 22 bp, Artificial Sequence
  chemically synthesized
caaattttctcagtcaggggat

SEQ ID NO: 1175609 - DNA, 22 bp, Artificial Sequence
  chemically synthesized
tgtgctttgcacaatcccctga

SEQ ID NO: 1175610 - DNA, 22 bp, Artificial Sequence
  chemically synthesized
tctcagtcaggggattgtgcaa

SEQ ID NO: 1175611 - DNA, 22 bp, Artificial Sequence
  chemically synthesized
ctcagtcaggggattgtgcaaa

SEQ ID NO: 1175612 - DNA, 22 bp, Artificial Sequence
  chemically synthesized
tcagtcaggggattgtgcaaag

SEQ ID NO: 1175613 - DNA, 22 bp, Artificial Sequence
  chemically synthesized
agaggcctctgtgctttgcaca

SEQ ID NO: 1175614 - DNA, 22 bp, Artificial Sequence
  chemically synthesized
agtcaggggattgtgcaaagca

SEQ ID NO: 1175615 - DNA, 22 bp, Artificial Sequence
  chemically synthesized
aagaggcctctgtgctttgcac

SEQ ID NO: 1175616 - DNA, 22 bp, Artificial Sequence
  chemically synthesized
taagaggcctctgtgctttgca

SEQ ID NO: 1175617 - DNA, 22 bp, Artificial Sequence
  chemically synthesized
acatctttaagaggcctctgtg

SEQ ID NO: 1175618 - DNA, 22 bp, Artificial Sequence
  chemically synthesized
gacatctttaagaggcctctgt

SEQ ID NO: 1175619 - DNA, 22 bp, Artificial Sequence
  chemically synthesized
tgacatctttaagaggcctctg

SEQ ID NO: 1175620 - DNA, 22 bp, Artificial Sequence
  chemically synthesized
ttgacatctttaagaggcctct

SEQ ID NO: 1175621 - DNA, 22 bp, Artificial Sequence
  chemically synthesized
tgcaaagcacagaggcctctta

SEQ ID NO: 1175622 - DNA, 22 bp, Artificial Sequence
  chemically synthesized
ttttgacatctttaagaggcct

SEQ ID NO: 1175623 - DNA, 22 bp, Artificial Sequence
  chemically synthesized
acctcttttgacatctttaaga

SEQ ID NO: 1175624 - DNA, 22 bp, Artificial Sequence
  chemically synthesized
aaatgttaacctcttttgacat

SEQ ID NO: 1175625 - DNA, 22 bp, Artificial Sequence
  chemically synthesized
caaatgttaacctcttttgaca

SEQ ID NO: 1175626 - DNA, 22 bp, Artificial Sequence
  chemically synthesized
ttaaagatgtcaaaagaggtta

SEQ ID NO: 1175627 - DNA, 22 bp, Artificial Sequence
  chemically synthesized
ggcttcaaatgttaacctcttt

SEQ ID NO: 1175628 - DNA, 22 bp, Artificial Sequence
  chemically synthesized
aggcttcaaatgttaacctctt

SEQ ID NO: 1175629 - DNA, 22 bp, Artificial Sequence
  chemically synthesized
aaagatgtcaaaagaggttaac

SEQ ID NO: 1175630 - DNA, 22 bp, Artificial Sequence
  chemically synthesized
taggcttcaaatgttaacctct

SEQ ID NO: 1175631 - DNA, 22 bp, Artificial Sequence
  chemically synthesized
aagatgtcaaaagaggttaaca

SEQ ID NO: 1175632 - DNA, 22 bp, Artificial Sequence
  chemically synthesized
gttttaggcttcaaatgttaac

SEQ ID NO: 1175633 - DNA, 22 bp, Artificial Sequence
  chemically synthesized
ggttttaggcttcaaatgttaa

SEQ ID NO: 1175634 - DNA, 22 bp, Artificial Sequence
  chemically synthesized
tgatttggttttaggcttcaaa

SEQ ID NO: 1175635 - DNA, 22 bp, Artificial Sequence
  chemically synthesized
tatgatttggttttaggcttca

SEQ ID NO: 1175636 - DNA, 22 bp, Artificial Sequence
  chemically synthesized
acatttgaagcctaaaaccaaa

SEQ ID NO: 1175637 - DNA, 22 bp, Artificial Sequence
  chemically synthesized
gaagcctaaaaccaaatcatag

SEQ ID NO: 1175638 - DNA, 22 bp, Artificial Sequence
  chemically synthesized
aagcctaaaaccaaatcataga

SEQ ID NO: 1175639 - DNA, 22 bp, Artificial Sequence
  chemically synthesized
aaaccaaatcatagaatttggg

SEQ ID NO: 1175640 - DNA, 22 bp, Artificial Sequence
  chemically synthesized
catgacccagtaacccaaattc

SEQ ID NO: 1175641 - DNA, 22 bp, Artificial Sequence
  chemically synthesized
tcaattccatgacccagtaacc

SEQ ID NO: 1175642 - DNA, 22 bp, Artificial Sequence
  chemically synthesized
atcaattccatgacccagtaac

SEQ ID NO: 1175643 - DNA, 22 bp, Artificial Sequence
  chemically synthesized
ttatcaattccatgacccagta

SEQ ID NO: 1175644 - DNA, 22 bp, Artificial Sequence
  chemically synthesized
ttcttatcaattccatgaccca

SEQ ID NO: 1175645 - DNA, 22 bp, Artificial Sequence
  chemically synthesized
gttcttatcaattccatgaccc

SEQ ID NO: 1175646 - DNA, 22 bp, Artificial Sequence
  chemically synthesized
gggttactgggtcatggaattg

SEQ ID NO: 1175647 - DNA, 22 bp, Artificial Sequence
  chemically synthesized
ggttactgggtcatggaattga

SEQ ID NO: 1175648 - DNA, 22 bp, Artificial Sequence
  chemically synthesized
agtatttgttcttatcaattcc

SEQ ID NO: 1175649 - DNA, 22 bp, Artificial Sequence
  chemically synthesized
cagtatttgttcttatcaattc

SEQ ID NO: 1175650 - DNA, 22 bp, Artificial Sequence
  chemically synthesized
tcagtatttgttcttatcaatt

SEQ ID NO: 1175651 - DNA, 22 bp, Artificial Sequence
  chemically synthesized
ctgggtcatggaattgataaga

SEQ ID NO: 1175652 - DNA, 22 bp, Artificial Sequence
  chemically synthesized
ggtcatggaattgataagaaca

SEQ ID NO: 1175653 - DNA, 22 bp, Artificial Sequence
  chemically synthesized
taggctttcagtatttgttctt

SEQ ID NO: 1175654 - DNA, 22 bp, Artificial Sequence
  chemically synthesized
ataggctttcagtatttgttct

SEQ ID NO: 1175655 - DNA, 22 bp, Artificial Sequence
  chemically synthesized
tttataggctttcagtatttgt

SEQ ID NO: 1175656 - DNA, 22 bp, Artificial Sequence
  chemically synthesized
ctatttataggctttcagtatt

SEQ ID NO: 1175657 - DNA, 22 bp, Artificial Sequence
  chemically synthesized
actatttataggctttcagtat

SEQ ID NO: 1175658 - DNA, 22 bp, Artificial Sequence
  chemically synthesized
ataagaacaaatactgaaagcc

SEQ ID NO: 1175659 - DNA, 22 bp, Artificial Sequence
  chemically synthesized
tttactatttataggctttcag

SEQ ID NO: 1175660 - DNA, 22 bp, Artificial Sequence
  chemically synthesized
gtttactatttataggctttca

SEQ ID NO: 1175661 - DNA, 22 bp, Artificial Sequence
  chemically synthesized
gcaatcagatttgtttactatt

SEQ ID NO: 1175662 - DNA, 22 bp, Artificial Sequence
  chemically synthesized
ggcaatcagatttgtttactat

SEQ ID NO: 1175663 - DNA, 22 bp, Artificial Sequence
  chemically synthesized
aaagcctataaatagtaaacaa

SEQ ID NO: 1175664 - DNA, 22 bp, Artificial Sequence
  chemically synthesized
tggcaatcagatttgtttacta

SEQ ID NO: 1175665 - DNA, 22 bp, Artificial Sequence
  chemically synthesized
tttggcaatcagatttgtttac

SEQ ID NO: 1175666 - DNA, 22 bp, Artificial Sequence
  chemically synthesized
ctttggcaatcagatttgttta

SEQ ID NO: 1175667 - DNA, 22 bp, Artificial Sequence
  chemically synthesized
taaatagtaaacaaatctgatt

SEQ ID NO: 1175668 - DNA, 22 bp, Artificial Sequence
  chemically synthesized
gggtttctttggcaatcagatt

SEQ ID NO: 1175669 - DNA, 22 bp, Artificial Sequence
  chemically synthesized
gacctggggtttctttggcaat

SEQ ID NO: 1175670 - DNA, 22 bp, Artificial Sequence
  chemically synthesized
gttagacctggggtttctttgg

SEQ ID NO: 1175671 - DNA, 22 bp, Artificial Sequence
  chemically synthesized
agttagacctggggtttctttg

SEQ ID NO: 1175672 - DNA, 22 bp, Artificial Sequence
  chemically synthesized
tagttagacctggggtttcttt

SEQ ID NO: 1175673 - DNA, 22 bp, Artificial Sequence
  chemically synthesized
ttagttagacctggggtttctt

SEQ ID NO: 1175674 - DNA, 22 bp, Artificial Sequence
  chemically synthesized
attgccaaagaaaccccaggtc

SEQ ID NO: 1175675 - DNA, 22 bp, Artificial Sequence
  chemically synthesized
ccaaagaaaccccaggtctaac

SEQ ID NO: 1175676 - DNA, 22 bp, Artificial Sequence
  chemically synthesized
agtgataacaaggtgtttttag

SEQ ID NO: 1175677 - DNA, 22 bp, Artificial Sequence
  chemically synthesized
gagtgataacaaggtgttttta

SEQ ID NO: 1175678 - DNA, 22 bp, Artificial Sequence
  chemically synthesized
ggtttgagtgataacaaggtgt

SEQ ID NO: 1175679 - DNA, 22 bp, Artificial Sequence
  chemically synthesized
actaaaaacaccttgttatcac

SEQ ID NO: 1175680 - DNA, 22 bp, Artificial Sequence
  chemically synthesized
ccctaggtttgagtgataacaa

SEQ ID NO: 1175681 - DNA, 22 bp, Artificial Sequence
  chemically synthesized
gccctaggtttgagtgataaca

SEQ ID NO: 1175682 - DNA, 22 bp, Artificial Sequence
  chemically synthesized
aaaacaccttgttatcactcaa

SEQ ID NO: 1175683 - DNA, 22 bp, Artificial Sequence
  chemically synthesized
gtgcttgccctaggtttgagtg

SEQ ID NO: 1175684 - DNA, 22 bp, Artificial Sequence
  chemically synthesized
gttatcactcaaacctagggca

SEQ ID NO: 1175685 - DNA, 22 bp, Artificial Sequence
  chemically synthesized
ttatcactcaaacctagggcaa

SEQ ID NO: 1175686 - DNA, 22 bp, Artificial Sequence
  chemically synthesized
aaagtcctggtgcttgccctag

SEQ ID NO: 1175687 - DNA, 22 bp, Artificial Sequence
  chemically synthesized
aaaagtcctggtgcttgcccta

SEQ ID NO: 1175688 - DNA, 22 bp, Artificial Sequence
  chemically synthesized
tcactcaaacctagggcaagca

SEQ ID NO: 1175689 - DNA, 22 bp, Artificial Sequence
  chemically synthesized
tttaaaagtcctggtgcttgcc

SEQ ID NO: 1175690 - DNA, 22 bp, Artificial Sequence
  chemically synthesized
aaacctagggcaagcaccagga

SEQ ID NO: 1175691 - DNA, 22 bp, Artificial Sequence
  chemically synthesized
tgttgtttaaaagtcctggtgc

SEQ ID NO: 1175692 - DNA, 22 bp, Artificial Sequence
  chemically synthesized
ttgtgttgtttaaaagtcctgg

SEQ ID NO: 1175693 - DNA, 22 bp, Artificial Sequence
  chemically synthesized
attgtgttgtttaaaagtcctg

SEQ ID NO: 1175694 - DNA, 22 bp, Artificial Sequence
  chemically synthesized
gggcaagcaccaggacttttaa

SEQ ID NO: 1175695 - DNA, 22 bp, Artificial Sequence
  chemically synthesized
cttattgtgttgtttaaaagtc

SEQ ID NO: 1175696 - DNA, 22 bp, Artificial Sequence
  chemically synthesized
tacttattgtgttgtttaaaag

SEQ ID NO: 1175697 - DNA, 22 bp, Artificial Sequence
  chemically synthesized
ttctacttattgtgttgtttaa

SEQ ID NO: 1175698 - DNA, 22 bp, Artificial Sequence
  chemically synthesized
ttattctacttattgtgttgtt

SEQ ID NO: 1175699 - DNA, 22 bp, Artificial Sequence
  chemically synthesized
attattctacttattgtgttgt

SEQ ID NO: 1175700 - DNA, 22 bp, Artificial Sequence
  chemically synthesized
tattattctacttattgtgttg

SEQ ID NO: 1175701 - DNA, 22 bp, Artificial Sequence
  chemically synthesized
ctttattattctacttattgtg

SEQ ID NO: 1175702 - DNA, 22 bp, Artificial Sequence
  chemically synthesized
ttaaacaacacaataagtagaa

SEQ ID NO: 1175703 - DNA, 22 bp, Artificial Sequence
  chemically synthesized
taaacaacacaataagtagaat

SEQ ID NO: 1175704 - DNA, 22 bp, Artificial Sequence
  chemically synthesized
tgttactttattattctactta

SEQ ID NO: 1175705 - DNA, 22 bp, Artificial Sequence
  chemically synthesized
aaacaacacaataagtagaata

SEQ ID NO: 1175706 - DNA, 22 bp, Artificial Sequence
  chemically synthesized
gtgttactttattattctactt

SEQ ID NO: 1175707 - DNA, 22 bp, Artificial Sequence
  chemically synthesized
aacaacacaataagtagaataa

SEQ ID NO: 1175708 - DNA, 22 bp, Artificial Sequence
  chemically synthesized
tgtgttactttattattctact

SEQ ID NO: 1175709 - DNA, 22 bp, Artificial Sequence
  chemically synthesized
gggttttgtgttactttattat

SEQ ID NO: 1175710 - DNA, 22 bp, Artificial Sequence
  chemically synthesized
ggggttttgtgttactttatta

SEQ ID NO: 1175711 - DNA, 22 bp, Artificial Sequence
  chemically synthesized
tggggttttgtgttactttatt

SEQ ID NO: 1175712 - DNA, 22 bp, Artificial Sequence
  chemically synthesized
acatattttggggttttgtgtt

SEQ ID NO: 1175713 - DNA, 22 bp, Artificial Sequence
  chemically synthesized
aagttgacatattttggggttt

SEQ ID NO: 1175714 - DNA, 22 bp, Artificial Sequence
  chemically synthesized
atcatgatatctgaagttgaca

SEQ ID NO: 1175715 - DNA, 22 bp, Artificial Sequence
  chemically synthesized
catcatgatatctgaagttgac

SEQ ID NO: 1175716 - DNA, 22 bp, Artificial Sequence
  chemically synthesized
tcttcatcatgatatctgaagt

SEQ ID NO: 1175717 - DNA, 22 bp, Artificial Sequence
  chemically synthesized
gtcttcatcatgatatctgaag

SEQ ID NO: 1175718 - DNA, 22 bp, Artificial Sequence
  chemically synthesized
aatacttgtcttcatcatgata

SEQ ID NO: 1175719 - DNA, 22 bp, Artificial Sequence
  chemically synthesized
ctaaatacttgtcttcatcatg

SEQ ID NO: 1175720 - DNA, 22 bp, Artificial Sequence
  chemically synthesized
gctaaatacttgtcttcatcat

SEQ ID NO: 1175721 - DNA, 22 bp, Artificial Sequence
  chemically synthesized
tgctaaatacttgtcttcatca

SEQ ID NO: 1175722 - DNA, 22 bp, Artificial Sequence
  chemically synthesized
cagatatcatgatgaagacaag

SEQ ID NO: 1175723 - DNA, 22 bp, Artificial Sequence
  chemically synthesized
agatatcatgatgaagacaagt

SEQ ID NO: 1175724 - DNA, 22 bp, Artificial Sequence
  chemically synthesized
taaattttgctaaatacttgtc

SEQ ID NO: 1175725 - DNA, 22 bp, Artificial Sequence
  chemically synthesized
attataaattttgctaaatact

SEQ ID NO: 1175726 - DNA, 22 bp, Artificial Sequence
  chemically synthesized
ttcattataaattttgctaaat

SEQ ID NO: 1175727 - DNA, 22 bp, Artificial Sequence
  chemically synthesized
tgttcattataaattttgctaa

SEQ ID NO: 1175728 - DNA, 22 bp, Artificial Sequence
  chemically synthesized
ctgttcattataaattttgcta

SEQ ID NO: 1175729 - DNA, 22 bp, Artificial Sequence
  chemically synthesized
cttctgttcattataaattttg

SEQ ID NO: 1175730 - DNA, 22 bp, Artificial Sequence
  chemically synthesized
ccttctgttcattataaatttt

SEQ ID NO: 1175731 - DNA, 22 bp, Artificial Sequence
  chemically synthesized
tccttctgttcattataaattt

SEQ ID NO: 1175732 - DNA, 22 bp, Artificial Sequence
  chemically synthesized
ttccttctgttcattataaatt

SEQ ID NO: 1175733 - DNA, 22 bp, Artificial Sequence
  chemically synthesized
agcaaaatttataatgaacaga

SEQ ID NO: 1175734 - DNA, 22 bp, Artificial Sequence
  chemically synthesized
gtgatttttccttctgttcatt

SEQ ID NO: 1175735 - DNA, 22 bp, Artificial Sequence
  chemically synthesized
gcaaaatttataatgaacagaa

SEQ ID NO: 1175736 - DNA, 22 bp, Artificial Sequence
  chemically synthesized
ctggtgatttttccttctgttc

SEQ ID NO: 1175737 - DNA, 22 bp, Artificial Sequence
  chemically synthesized
cctggtgatttttccttctgtt

SEQ ID NO: 1175738 - DNA, 22 bp, Artificial Sequence
  chemically synthesized
ataatgaacagaaggaaaaatc

SEQ ID NO: 1175739 - DNA, 22 bp, Artificial Sequence
  chemically synthesized
taatgaacagaaggaaaaatca

SEQ ID NO: 1175740 - DNA, 22 bp, Artificial Sequence
  chemically synthesized
agagccttcctggtgatttttc

SEQ ID NO: 1175741 - DNA, 22 bp, Artificial Sequence
  chemically synthesized
cagagccttcctggtgattttt

SEQ ID NO: 1175742 - DNA, 22 bp, Artificial Sequence
  chemically synthesized
tcagagccttcctggtgatttt

SEQ ID NO: 1175743 - DNA, 22 bp, Artificial Sequence
  chemically synthesized
cactttcagagccttcctggtg

SEQ ID NO: 1175744 - DNA, 22 bp, Artificial Sequence
  chemically synthesized
tatcctgcactttcagagcctt

SEQ ID NO: 1175745 - DNA, 22 bp, Artificial Sequence
  chemically synthesized
aaacagatattatatcctgcac

SEQ ID NO: 1175746 - DNA, 22 bp, Artificial Sequence
  chemically synthesized
tgaaagtgcaggatataatatc

SEQ ID NO: 1175747 - DNA, 22 bp, Artificial Sequence
  chemically synthesized
aaagtgcaggatataatatctg

SEQ ID NO: 1175748 - DNA, 22 bp, Artificial Sequence
  chemically synthesized
taaaagaaaccaaattgaaaca

SEQ ID NO: 1175749 - DNA, 22 bp, Artificial Sequence
  chemically synthesized
ataaaagaaaccaaattgaaac

SEQ ID NO: 1175750 - DNA, 22 bp, Artificial Sequence
  chemically synthesized
aatttataaaagaaaccaaatt

SEQ ID NO: 1175751 - DNA, 22 bp, Artificial Sequence
  chemically synthesized
aactaaatttataaaagaaacc

SEQ ID NO: 1175752 - DNA, 22 bp, Artificial Sequence
  chemically synthesized
tttcaatttggtttcttttata

SEQ ID NO: 1175753 - DNA, 22 bp, Artificial Sequence
  chemically synthesized
caatttggtttcttttataaat

SEQ ID NO: 1175754 - DNA, 22 bp, Artificial Sequence
  chemically synthesized
aaactaaactaaatttataaaa

SEQ ID NO: 1175755 - DNA, 22 bp, Artificial Sequence
  chemically synthesized
aatttggtttcttttataaatt

SEQ ID NO: 1175756 - DNA, 22 bp, Artificial Sequence
  chemically synthesized
attaaaactaaactaaatttat

SEQ ID NO: 1175757 - DNA, 22 bp, Artificial Sequence
  chemically synthesized
ggtttcttttataaatttagtt

SEQ ID NO: 1175758 - DNA, 22 bp, Artificial Sequence
  chemically synthesized
gtttcttttataaatttagttt

SEQ ID NO: 1175759 - DNA, 22 bp, Artificial Sequence
  chemically synthesized
cttttataaatttagtttagtt

SEQ ID NO: 1175760 - DNA, 22 bp, Artificial Sequence
  chemically synthesized
ttttataaatttagtttagttt

SEQ ID NO: 1175761 - DNA, 22 bp, Artificial Sequence
  chemically synthesized
ttataaatttagtttagtttta

SEQ ID NO: 1175762 - DNA, 22 bp, Artificial Sequence
  chemically synthesized
tataaatttagtttagttttaa

SEQ ID NO: 1175763 - DNA, 22 bp, Artificial Sequence
  chemically synthesized
ataaatttagtttagttttaat

SEQ ID NO: 1175764 - DNA, 22 bp, Artificial Sequence
  chemically synthesized
taaatttagtttagttttaatc

SEQ ID NO: 1175765 - DNA, 22 bp, Artificial Sequence
  chemically synthesized
gaagggcacatcctgattaaaa

SEQ ID NO: 1175766 - DNA, 22 bp, Artificial Sequence
  chemically synthesized
agtttagttttaatcaggatgt

SEQ ID NO: 1175767 - DNA, 22 bp, Artificial Sequence
  chemically synthesized
gtttagttttaatcaggatgtg

SEQ ID NO: 1175768 - DNA, 22 bp, Artificial Sequence
  chemically synthesized
agttttaatcaggatgtgccct

SEQ ID NO: 1175769 - DNA, 22 bp, Artificial Sequence
  chemically synthesized
gttttaatcaggatgtgccctt

SEQ ID NO: 1175770 - DNA, 22 bp, Artificial Sequence
  chemically synthesized
agtaaaaagttagaagggcaca

SEQ ID NO: 1175771 - DNA, 22 bp, Artificial Sequence
  chemically synthesized
taatcaggatgtgcccttctaa

SEQ ID NO: 1175772 - DNA, 22 bp, Artificial Sequence
  chemically synthesized
ctaagtaaaaagttagaagggc

SEQ ID NO: 1175773 - DNA, 22 bp, Artificial Sequence
  chemically synthesized
aatcaggatgtgcccttctaac

SEQ ID NO: 1175774 - DNA, 22 bp, Artificial Sequence
  chemically synthesized
atcaggatgtgcccttctaact

SEQ ID NO: 1175775 - DNA, 22 bp, Artificial Sequence
  chemically synthesized
atgtccagtactgctaagtaaa

SEQ ID NO: 1175776 - DNA, 22 bp, Artificial Sequence
  chemically synthesized
gatgtccagtactgctaagtaa

SEQ ID NO: 1175777 - DNA, 22 bp, Artificial Sequence
  chemically synthesized
ctaactttttacttagcagtac

SEQ ID NO: 1175778 - DNA, 22 bp, Artificial Sequence
  chemically synthesized
taactttttacttagcagtact

SEQ ID NO: 1175779 - DNA, 22 bp, Artificial Sequence
  chemically synthesized
actttttacttagcagtactgg

SEQ ID NO: 1175780 - DNA, 22 bp, Artificial Sequence
  chemically synthesized
tttacttagcagtactggacat

SEQ ID NO: 1175781 - DNA, 22 bp, Artificial Sequence
  chemically synthesized
ttacttagcagtactggacatc

SEQ ID NO: 1175782 - DNA, 22 bp, Artificial Sequence
  chemically synthesized
tacttagcagtactggacatca

SEQ ID NO: 1175783 - DNA, 22 bp, Artificial Sequence
  chemically synthesized
agtgaaaaaatttgatgtccag

SEQ ID NO: 1175784 - DNA, 22 bp, Artificial Sequence
  chemically synthesized
acttagcagtactggacatcaa

SEQ ID NO: 1175785 - DNA, 22 bp, Artificial Sequence
  chemically synthesized
cttagcagtactggacatcaaa

SEQ ID NO: 1175786 - DNA, 22 bp, Artificial Sequence
  chemically synthesized
agcagtactggacatcaaattt

SEQ ID NO: 1175787 - DNA, 22 bp, Artificial Sequence
  chemically synthesized
gcagtactggacatcaaatttt

SEQ ID NO: 1175788 - DNA, 22 bp, Artificial Sequence
  chemically synthesized
tgactaagtgaaaaaatttgat

SEQ ID NO: 1175789 - DNA, 22 bp, Artificial Sequence
  chemically synthesized
gacatcaaattttttcacttag

SEQ ID NO: 1175790 - DNA, 22 bp, Artificial Sequence
  chemically synthesized
tgatccatccagtggactatga

SEQ ID NO: 1175791 - DNA, 22 bp, Artificial Sequence
  chemically synthesized
atgatccatccagtggactatg

SEQ ID NO: 1175792 - DNA, 22 bp, Artificial Sequence
  chemically synthesized
tttcacttagtcatagtccact

SEQ ID NO: 1175793 - DNA, 22 bp, Artificial Sequence
  chemically synthesized
tatgatccatccagtggactat

SEQ ID NO: 1175794 - DNA, 22 bp, Artificial Sequence
  chemically synthesized
ttcacttagtcatagtccactg

SEQ ID NO: 1175795 - DNA, 22 bp, Artificial Sequence
  chemically synthesized
tcacttagtcatagtccactgg

SEQ ID NO: 1175796 - DNA, 22 bp, Artificial Sequence
  chemically synthesized
cacttagtcatagtccactgga

SEQ ID NO: 1175797 - DNA, 22 bp, Artificial Sequence
  chemically synthesized
acttagtcatagtccactggat

SEQ ID NO: 1175798 - DNA, 22 bp, Artificial Sequence
  chemically synthesized
gtctttatgatccatccagtgg

SEQ ID NO: 1175799 - DNA, 22 bp, Artificial Sequence
  chemically synthesized
agtcatagtccactggatggat

SEQ ID NO: 1175800 - DNA, 22 bp, Artificial Sequence
  chemically synthesized
gtcatagtccactggatggatc

SEQ ID NO: 1175801 - DNA, 22 bp, Artificial Sequence
  chemically synthesized
aattagtctttatgatccatcc

SEQ ID NO: 1175802 - DNA, 22 bp, Artificial Sequence
  chemically synthesized
caattagtctttatgatccatc

SEQ ID NO: 1175803 - DNA, 22 bp, Artificial Sequence
  chemically synthesized
tcaattagtctttatgatccat

SEQ ID NO: 1175804 - DNA, 22 bp, Artificial Sequence
  chemically synthesized
gcagtccctttcaattagtctt

SEQ ID NO: 1175805 - DNA, 22 bp, Artificial Sequence
  chemically synthesized
gatggatcataaagactaattg

SEQ ID NO: 1175806 - DNA, 22 bp, Artificial Sequence
  chemically synthesized
ggtgattagcagtccctttcaa

SEQ ID NO: 1175807 - DNA, 22 bp, Artificial Sequence
  chemically synthesized
ggatatctgggtgattagcagt

SEQ ID NO: 1175808 - DNA, 22 bp, Artificial Sequence
  chemically synthesized
attgaaagggactgctaatcac

SEQ ID NO: 1175809 - DNA, 22 bp, Artificial Sequence
  chemically synthesized
aaagggactgctaatcacccag

SEQ ID NO: 1175810 - DNA, 22 bp, Artificial Sequence
  chemically synthesized
caaggttgggatatctgggtga

SEQ ID NO: 1175811 - DNA, 22 bp, Artificial Sequence
  chemically synthesized
agctccaaggttgggatatctg

SEQ ID NO: 1175812 - DNA, 22 bp, Artificial Sequence
  chemically synthesized
ctaatcacccagatatcccaac

SEQ ID NO: 1175813 - DNA, 22 bp, Artificial Sequence
  chemically synthesized
cattcagctccaaggttgggat

SEQ ID NO: 1175814 - DNA, 22 bp, Artificial Sequence
  chemically synthesized
atcacccagatatcccaacctt

SEQ ID NO: 1175815 - DNA, 22 bp, Artificial Sequence
  chemically synthesized
tccagtgattgcattcagctcc

SEQ ID NO: 1175816 - DNA, 22 bp, Artificial Sequence
  chemically synthesized
ggagctgaatgcaatcactgga

SEQ ID NO: 1175817 - DNA, 22 bp, Artificial Sequence
  chemically synthesized
gagctgaatgcaatcactggat

SEQ ID NO: 1175818 - DNA, 22 bp, Artificial Sequence
  chemically synthesized
aatgcaatcactggataatgtt

SEQ ID NO: 1175819 - DNA, 22 bp, Artificial Sequence
  chemically synthesized
aaaaagagcaagtataaaacat

SEQ ID NO: 1175820 - DNA, 22 bp, Artificial Sequence
  chemically synthesized
ctcaaaaagagcaagtataaaa

SEQ ID NO: 1175821 - DNA, 22 bp, Artificial Sequence
  chemically synthesized
gataatgttttatacttgctct

SEQ ID NO: 1175822 - DNA, 22 bp, Artificial Sequence
  chemically synthesized
agactcctcaaaaagagcaagt

SEQ ID NO: 1175823 - DNA, 22 bp, Artificial Sequence
  chemically synthesized
tatacttgctctttttgaggag

SEQ ID NO: 1175824 - DNA, 22 bp, Artificial Sequence
  chemically synthesized
atacttgctctttttgaggagt

SEQ ID NO: 1175825 - DNA, 22 bp, Artificial Sequence
  chemically synthesized
aaagatgctcagactcctcaaa

SEQ ID NO: 1175826 - DNA, 22 bp, Artificial Sequence
  chemically synthesized
tacttgctctttttgaggagtc

SEQ ID NO: 1175827 - DNA, 22 bp, Artificial Sequence
  chemically synthesized
caaagatgctcagactcctcaa

SEQ ID NO: 1175828 - DNA, 22 bp, Artificial Sequence
  chemically synthesized
tcaaagatgctcagactcctca

SEQ ID NO: 1175829 - DNA, 22 bp, Artificial Sequence
  chemically synthesized
gctctttttgaggagtctgagc

SEQ ID NO: 1175830 - DNA, 22 bp, Artificial Sequence
  chemically synthesized
actttcaaagatgctcagactc

SEQ ID NO: 1175831 - DNA, 22 bp, Artificial Sequence
  chemically synthesized
ctctttttgaggagtctgagca

SEQ ID NO: 1175832 - DNA, 22 bp, Artificial Sequence
  chemically synthesized
tttttgaggagtctgagcatct

SEQ ID NO: 1175833 - DNA, 22 bp, Artificial Sequence
  chemically synthesized
tttgaggagtctgagcatcttt

SEQ ID NO: 1175834 - DNA, 22 bp, Artificial Sequence
  chemically synthesized
ttgaggagtctgagcatctttg

SEQ ID NO: 1175835 - DNA, 22 bp, Artificial Sequence
  chemically synthesized
tgaggagtctgagcatctttga

SEQ ID NO: 1175836 - DNA, 22 bp, Artificial Sequence
  chemically synthesized
gaggagtctgagcatctttgaa

SEQ ID NO: 1175837 - DNA, 22 bp, Artificial Sequence
  chemically synthesized
aggagtctgagcatctttgaaa

SEQ ID NO: 1175838 - DNA, 22 bp, Artificial Sequence
  chemically synthesized
atagcatatattcactttcaaa

SEQ ID NO: 1175839 - DNA, 22 bp, Artificial Sequence
  chemically synthesized
catagcatatattcactttcaa

SEQ ID NO: 1175840 - DNA, 22 bp, Artificial Sequence
  chemically synthesized
agcatctttgaaagtgaatata

SEQ ID NO: 1175841 - DNA, 22 bp, Artificial Sequence
  chemically synthesized
tacacccttcatagcatatatt

SEQ ID NO: 1175842 - DNA, 22 bp, Artificial Sequence
  chemically synthesized
ctatacacccttcatagcatat

SEQ ID NO: 1175843 - DNA, 22 bp, Artificial Sequence
  chemically synthesized
tgaaagtgaatatatgctatga

SEQ ID NO: 1175844 - DNA, 22 bp, Artificial Sequence
  chemically synthesized
gaaagtgaatatatgctatgaa

SEQ ID NO: 1175845 - DNA, 22 bp, Artificial Sequence
  chemically synthesized
aaagtgaatatatgctatgaag

SEQ ID NO: 1175846 - DNA, 22 bp, Artificial Sequence
  chemically synthesized
aatatccaacattgctatacac

SEQ ID NO: 1175847 - DNA, 22 bp, Artificial Sequence
  chemically synthesized
gaatatccaacattgctataca

SEQ ID NO: 1175848 - DNA, 22 bp, Artificial Sequence
  chemically synthesized
tgaatatccaacattgctatac

SEQ ID NO: 1175849 - DNA, 22 bp, Artificial Sequence
  chemically synthesized
tttgaatatccaacattgctat

SEQ ID NO: 1175850 - DNA, 22 bp, Artificial Sequence
  chemically synthesized
tgaagggtgtatagcaatgttg

SEQ ID NO: 1175851 - DNA, 22 bp, Artificial Sequence
  chemically synthesized
ctctttgaatatccaacattgc

SEQ ID NO: 1175852 - DNA, 22 bp, Artificial Sequence
  chemically synthesized
cagtcctcctctttgaatatcc

SEQ ID NO: 1175853 - DNA, 22 bp, Artificial Sequence
  chemically synthesized
ctacagtcctcctctttgaata

SEQ ID NO: 1175854 - DNA, 22 bp, Artificial Sequence
  chemically synthesized
actacagtcctcctctttgaat

SEQ ID NO: 1175855 - DNA, 22 bp, Artificial Sequence
  chemically synthesized
cagtgcttactacagtcctcct

SEQ ID NO: 1175856 - DNA, 22 bp, Artificial Sequence
  chemically synthesized
gatattcaaagaggaggactgt

SEQ ID NO: 1175857 - DNA, 22 bp, Artificial Sequence
  chemically synthesized
aaagaggaggactgtagtaagc

SEQ ID NO: 1175858 - DNA, 22 bp, Artificial Sequence
  chemically synthesized
tataattgcagtgcttactaca

SEQ ID NO: 1175859 - DNA, 22 bp, Artificial Sequence
  chemically synthesized
actgtataattgcagtgcttac

SEQ ID NO: 1175860 - DNA, 22 bp, Artificial Sequence
  chemically synthesized
tagtaagcactgcaattataca

SEQ ID NO: 1175861 - DNA, 22 bp, Artificial Sequence
  chemically synthesized
caattatacagtcaatatcctt

SEQ ID NO: 1175862 - DNA, 22 bp, Artificial Sequence
  chemically synthesized
tacagtcaatatcctttcttct

SEQ ID NO: 1175863 - DNA, 22 bp, Artificial Sequence
  chemically synthesized
tgccatcagagagtagaagaaa

SEQ ID NO: 1175864 - DNA, 22 bp, Artificial Sequence
  chemically synthesized
ctgtgccatcagagagtagaag

SEQ ID NO: 1175865 - DNA, 22 bp, Artificial Sequence
  chemically synthesized
tcttctactctctgatggcaca

SEQ ID NO: 1175866 - DNA, 22 bp, Artificial Sequence
  chemically synthesized
cttctactctctgatggcacag

SEQ ID NO: 1175867 - DNA, 22 bp, Artificial Sequence
  chemically synthesized
ttctactctctgatggcacagt

SEQ ID NO: 1175868 - DNA, 22 bp, Artificial Sequence
  chemically synthesized
ctactctctgatggcacagtag

SEQ ID NO: 1175869 - DNA, 22 bp, Artificial Sequence
  chemically synthesized
caaatcaccaggctactgtgcc

SEQ ID NO: 1175870 - DNA, 22 bp, Artificial Sequence
  chemically synthesized
tactctctgatggcacagtagc

SEQ ID NO: 1175871 - DNA, 22 bp, Artificial Sequence
  chemically synthesized
ccaaatcaccaggctactgtgc

SEQ ID NO: 1175872 - DNA, 22 bp, Artificial Sequence
  chemically synthesized
tccaaatcaccaggctactgtg

SEQ ID NO: 1175873 - DNA, 22 bp, Artificial Sequence
  chemically synthesized
ctctctgatggcacagtagcct

SEQ ID NO: 1175874 - DNA, 22 bp, Artificial Sequence
  chemically synthesized
tctgatggcacagtagcctggt

SEQ ID NO: 1175875 - DNA, 22 bp, Artificial Sequence
  chemically synthesized
tgatggcacagtagcctggtga

SEQ ID NO: 1175876 - DNA, 22 bp, Artificial Sequence
  chemically synthesized
atggcacagtagcctggtgatt

SEQ ID NO: 1175877 - DNA, 22 bp, Artificial Sequence
  chemically synthesized
agagtaataacaatgctttcca

SEQ ID NO: 1175878 - DNA, 22 bp, Artificial Sequence
  chemically synthesized
gtgatttggaaagcattgttat

SEQ ID NO: 1175879 - DNA, 22 bp, Artificial Sequence
  chemically synthesized
gaactgagagtaataacaatgc

SEQ ID NO: 1175880 - DNA, 22 bp, Artificial Sequence
  chemically synthesized
ggaaagcattgttattactctc

SEQ ID NO: 1175881 - DNA, 22 bp, Artificial Sequence
  chemically synthesized
gaaagcattgttattactctca

SEQ ID NO: 1175882 - DNA, 22 bp, Artificial Sequence
  chemically synthesized
ttattactctcagttctagata

SEQ ID NO: 1175883 - DNA, 22 bp, Artificial Sequence
  chemically synthesized
ttactctcagttctagatatgc

SEQ ID NO: 1175884 - DNA, 22 bp, Artificial Sequence
  chemically synthesized
cacaaaaaccgagcgcatatct

SEQ ID NO: 1175885 - DNA, 22 bp, Artificial Sequence
  chemically synthesized
ctctcagttctagatatgcgct

SEQ ID NO: 1175886 - DNA, 22 bp, Artificial Sequence
  chemically synthesized
gcacaaaaaccgagcgcatatc

SEQ ID NO: 1175887 - DNA, 22 bp, Artificial Sequence
  chemically synthesized
tcagttctagatatgcgctcgg

SEQ ID NO: 1175888 - DNA, 22 bp, Artificial Sequence
  chemically synthesized
gcttgcacaaaaaccgagcgca

SEQ ID NO: 1175889 - DNA, 22 bp, Artificial Sequence
  chemically synthesized
agttctagatatgcgctcggtt

SEQ ID NO: 1175890 - DNA, 22 bp, Artificial Sequence
  chemically synthesized
ggcttgcacaaaaaccgagcgc

SEQ ID NO: 1175891 - DNA, 22 bp, Artificial Sequence
  chemically synthesized
tagatatgcgctcggtttttgt

SEQ ID NO: 1175892 - DNA, 22 bp, Artificial Sequence
  chemically synthesized
gatatgcgctcggtttttgtgc

SEQ ID NO: 1175893 - DNA, 22 bp, Artificial Sequence
  chemically synthesized
ggtttttgtgcaagccaagtgg

SEQ ID NO: 1175894 - DNA, 22 bp, Artificial Sequence
  chemically synthesized
ttgtgcaagccaagtgggatac

SEQ ID NO: 1175895 - DNA, 22 bp, Artificial Sequence
  chemically synthesized
tgtgcaagccaagtgggatact

SEQ ID NO: 1175896 - DNA, 22 bp, Artificial Sequence
  chemically synthesized
gtgcaagccaagtgggatactg

SEQ ID NO: 1175897 - DNA, 22 bp, Artificial Sequence
  chemically synthesized
tgcaagccaagtgggatactgc

SEQ ID NO: 1175898 - DNA, 22 bp, Artificial Sequence
  chemically synthesized
aagcaaagtacatagcagtatc

SEQ ID NO: 1175899 - DNA, 22 bp, Artificial Sequence
  chemically synthesized
cctgaagcaaagtacatagcag

SEQ ID NO: 1175900 - DNA, 22 bp, Artificial Sequence
  chemically synthesized
aacacctccctgaagcaaagta

SEQ ID NO: 1175901 - DNA, 22 bp, Artificial Sequence
  chemically synthesized
gcctgaacacctccctgaagca

SEQ ID NO: 1175902 - DNA, 22 bp, Artificial Sequence
  chemically synthesized
ctatgtactttgcttcagggag

SEQ ID NO: 1175903 - DNA, 22 bp, Artificial Sequence
  chemically synthesized
tgtactttgcttcagggaggtg

SEQ ID NO: 1175904 - DNA, 22 bp, Artificial Sequence
  chemically synthesized
tgcttcagggaggtgttcaggc

SEQ ID NO: 1175905 - DNA, 22 bp, Artificial Sequence
  chemically synthesized
gcttcagggaggtgttcaggcc

SEQ ID NO: 1175906 - DNA, 22 bp, Artificial Sequence
  chemically synthesized
gatcatatgcctggcctgaaca

SEQ ID NO: 1175907 - DNA, 22 bp, Artificial Sequence
  chemically synthesized
cttcagggaggtgttcaggcca

SEQ ID NO: 1175908 - DNA, 22 bp, Artificial Sequence
  chemically synthesized
agatcatatgcctggcctgaac

SEQ ID NO: 1175909 - DNA, 22 bp, Artificial Sequence
  chemically synthesized
ttagatcatatgcctggcctga

SEQ ID NO: 1175910 - DNA, 22 bp, Artificial Sequence
  chemically synthesized
cagggaggtgttcaggccaggc

SEQ ID NO: 1175911 - DNA, 22 bp, Artificial Sequence
  chemically synthesized
agggaggtgttcaggccaggca

SEQ ID NO: 1175912 - DNA, 22 bp, Artificial Sequence
  chemically synthesized
gaaactcttagatcatatgcct

SEQ ID NO: 1175913 - DNA, 22 bp, Artificial Sequence
  chemically synthesized
ggaaactcttagatcatatgcc

SEQ ID NO: 1175914 - DNA, 22 bp, Artificial Sequence
  chemically synthesized
cttggaaactcttagatcatat

SEQ ID NO: 1175915 - DNA, 22 bp, Artificial Sequence
  chemically synthesized
tgcttggaaactcttagatcat

SEQ ID NO: 1175916 - DNA, 22 bp, Artificial Sequence
  chemically synthesized
aggccaggcatatgatctaaga

SEQ ID NO: 1175917 - DNA, 22 bp, Artificial Sequence
  chemically synthesized
tctgcttggaaactcttagatc

SEQ ID NO: 1175918 - DNA, 22 bp, Artificial Sequence
  chemically synthesized
tctctgcttggaaactcttaga

SEQ ID NO: 1175919 - DNA, 22 bp, Artificial Sequence
  chemically synthesized
ctctctgcttggaaactcttag

SEQ ID NO: 1175920 - DNA, 22 bp, Artificial Sequence
  chemically synthesized
agtttctctctgcttggaaact

SEQ ID NO: 1175921 - DNA, 22 bp, Artificial Sequence
  chemically synthesized
agagtttccaagcagagagaaa

SEQ ID NO: 1175922 - DNA, 22 bp, Artificial Sequence
  chemically synthesized
ccaagcagagagaaactcagac

SEQ ID NO: 1175923 - DNA, 22 bp, Artificial Sequence
  chemically synthesized
caagcagagagaaactcagacc

SEQ ID NO: 1175924 - DNA, 22 bp, Artificial Sequence
  chemically synthesized
cccaaataggaaacaaaaggtc

SEQ ID NO: 1175925 - DNA, 22 bp, Artificial Sequence
  chemically synthesized
acccaaataggaaacaaaaggt

SEQ ID NO: 1175926 - DNA, 22 bp, Artificial Sequence
  chemically synthesized
tacccaaataggaaacaaaagg

SEQ ID NO: 1175927 - DNA, 22 bp, Artificial Sequence
  chemically synthesized
agaccttttgtttcctatttgg

SEQ ID NO: 1175928 - DNA, 22 bp, Artificial Sequence
  chemically synthesized
ttgtttcctatttgggtaaaga

SEQ ID NO: 1175929 - DNA, 22 bp, Artificial Sequence
  chemically synthesized
tgtttcctatttgggtaaagat

SEQ ID NO: 1175930 - DNA, 22 bp, Artificial Sequence
  chemically synthesized
gtttcctatttgggtaaagata

SEQ ID NO: 1175931 - DNA, 22 bp, Artificial Sequence
  chemically synthesized
tttcctatttgggtaaagatat

SEQ ID NO: 1175932 - DNA, 22 bp, Artificial Sequence
  chemically synthesized
aatgtaaagaatatatctttac

SEQ ID NO: 1175933 - DNA, 22 bp, Artificial Sequence
  chemically synthesized
cctatttgggtaaagatatatt

SEQ ID NO: 1175934 - DNA, 22 bp, Artificial Sequence
  chemically synthesized
ctatttgggtaaagatatattc

SEQ ID NO: 1175935 - DNA, 22 bp, Artificial Sequence
  chemically synthesized
cagctaaatgtaaagaatatat

SEQ ID NO: 1175936 - DNA, 22 bp, Artificial Sequence
  chemically synthesized
tttgggtaaagatatattcttt

SEQ ID NO: 1175937 - DNA, 22 bp, Artificial Sequence
  chemically synthesized
acagctaaatgtaaagaatata

SEQ ID NO: 1175938 - DNA, 22 bp, Artificial Sequence
  chemically synthesized
gggtaaagatatattctttaca

SEQ ID NO: 1175939 - DNA, 22 bp, Artificial Sequence
  chemically synthesized
tttacagctaaatgtaaagaat

SEQ ID NO: 1175940 - DNA, 22 bp, Artificial Sequence
  chemically synthesized
ggtaaagatatattctttacat

SEQ ID NO: 1175941 - DNA, 22 bp, Artificial Sequence
  chemically synthesized
gtttacagctaaatgtaaagaa

SEQ ID NO: 1175942 - DNA, 22 bp, Artificial Sequence
  chemically synthesized
ccttgtttacagctaaatgtaa

SEQ ID NO: 1175943 - DNA, 22 bp, Artificial Sequence
  chemically synthesized
cccttgtttacagctaaatgta

SEQ ID NO: 1175944 - DNA, 22 bp, Artificial Sequence
  chemically synthesized
tcccttgtttacagctaaatgt

SEQ ID NO: 1175945 - DNA, 22 bp, Artificial Sequence
  chemically synthesized
ttcccttgtttacagctaaatg

SEQ ID NO: 1175946 - DNA, 22 bp, Artificial Sequence
  chemically synthesized
ttttcccttgtttacagctaaa

SEQ ID NO: 1175947 - DNA, 22 bp, Artificial Sequence
  chemically synthesized
tttacatttagctgtaaacaag

SEQ ID NO: 1175948 - DNA, 22 bp, Artificial Sequence
  chemically synthesized
gaaactcttttcccttgtttac

SEQ ID NO: 1175949 - DNA, 22 bp, Artificial Sequence
  chemically synthesized
tacatttagctgtaaacaaggg

SEQ ID NO: 1175950 - DNA, 22 bp, Artificial Sequence
  chemically synthesized
ggaaactcttttcccttgttta

SEQ ID NO: 1175951 - DNA, 22 bp, Artificial Sequence
  chemically synthesized
acatttagctgtaaacaaggga

SEQ ID NO: 1175952 - DNA, 22 bp, Artificial Sequence
  chemically synthesized
catttagctgtaaacaagggaa

SEQ ID NO: 1175953 - DNA, 22 bp, Artificial Sequence
  chemically synthesized
agctgtaaacaagggaaaagag

SEQ ID NO: 1175954 - DNA, 22 bp, Artificial Sequence
  chemically synthesized
gctgtaaacaagggaaaagagt

SEQ ID NO: 1175955 - DNA, 22 bp, Artificial Sequence
  chemically synthesized
agcagatcttggaaactctttt

SEQ ID NO: 1175956 - DNA, 22 bp, Artificial Sequence
  chemically synthesized
taaacaagggaaaagagtttcc

SEQ ID NO: 1175957 - DNA, 22 bp, Artificial Sequence
  chemically synthesized
cctcagcagatcttggaaactc

SEQ ID NO: 1175958 - DNA, 22 bp, Artificial Sequence
  chemically synthesized
ccctcagcagatcttggaaact

SEQ ID NO: 1175959 - DNA, 22 bp, Artificial Sequence
  chemically synthesized
atacagaccggcttccctcagc

SEQ ID NO: 1175960 - DNA, 22 bp, Artificial Sequence
  chemically synthesized
ccaagatctgctgagggaagcc

SEQ ID NO: 1175961 - DNA, 22 bp, Artificial Sequence
  chemically synthesized
caagatctgctgagggaagccg

SEQ ID NO: 1175962 - DNA, 22 bp, Artificial Sequence
  chemically synthesized
gaactcatacagaccggcttcc

SEQ ID NO: 1175963 - DNA, 22 bp, Artificial Sequence
  chemically synthesized
cgaactcatacagaccggcttc

SEQ ID NO: 1175964 - DNA, 22 bp, Artificial Sequence
  chemically synthesized
tcgaactcatacagaccggctt

SEQ ID NO: 1175965 - DNA, 22 bp, Artificial Sequence
  chemically synthesized
ttcgaactcatacagaccggct

SEQ ID NO: 1175966 - DNA, 22 bp, Artificial Sequence
  chemically synthesized
ctgagggaagccggtctgtatg

SEQ ID NO: 1175967 - DNA, 22 bp, Artificial Sequence
  chemically synthesized
agggaagccggtctgtatgagt

SEQ ID NO: 1175968 - DNA, 22 bp, Artificial Sequence
  chemically synthesized
cataacttttcgaactcataca

SEQ ID NO: 1175969 - DNA, 22 bp, Artificial Sequence
  chemically synthesized
ccctccataacttttcgaactc

SEQ ID NO: 1175970 - DNA, 22 bp, Artificial Sequence
  chemically synthesized
agcctaccctccataacttttc

SEQ ID NO: 1175971 - DNA, 22 bp, Artificial Sequence
  chemically synthesized
tatgagttcgaaaagttatgga

SEQ ID NO: 1175972 - DNA, 22 bp, Artificial Sequence
  chemically synthesized
atctaagcctaccctccataac

SEQ ID NO: 1175973 - DNA, 22 bp, Artificial Sequence
  chemically synthesized
ttaatctaagcctaccctccat

SEQ ID NO: 1175974 - DNA, 22 bp, Artificial Sequence
  chemically synthesized
tgttaatctaagcctaccctcc

SEQ ID NO: 1175975 - DNA, 22 bp, Artificial Sequence
  chemically synthesized
gaaaagttatggagggtaggct

SEQ ID NO: 1175976 - DNA, 22 bp, Artificial Sequence
  chemically synthesized
tctgttaatctaagcctaccct

SEQ ID NO: 1175977 - DNA, 22 bp, Artificial Sequence
  chemically synthesized
ctctgttaatctaagcctaccc

SEQ ID NO: 1175978 - DNA, 22 bp, Artificial Sequence
  chemically synthesized
cttctctgttaatctaagccta

SEQ ID NO: 1175979 - DNA, 22 bp, Artificial Sequence
  chemically synthesized
gcttctctgttaatctaagcct

SEQ ID NO: 1175980 - DNA, 22 bp, Artificial Sequence
  chemically synthesized
tgcttctctgttaatctaagcc

SEQ ID NO: 1175981 - DNA, 22 bp, Artificial Sequence
  chemically synthesized
tggagggtaggcttagattaac

SEQ ID NO: 1175982 - DNA, 22 bp, Artificial Sequence
  chemically synthesized
aggagaagtctttgcttctctg

SEQ ID NO: 1175983 - DNA, 22 bp, Artificial Sequence
  chemically synthesized
aaggagaagtctttgcttctct

SEQ ID NO: 1175984 - DNA, 22 bp, Artificial Sequence
  chemically synthesized
agattaacagagaagcaaagac

SEQ ID NO: 1175985 - DNA, 22 bp, Artificial Sequence
  chemically synthesized
gattaacagagaagcaaagact

SEQ ID NO: 1175986 - DNA, 22 bp, Artificial Sequence
  chemically synthesized
tggatttaaggagaagtctttg

SEQ ID NO: 1175987 - DNA, 22 bp, Artificial Sequence
  chemically synthesized
acagagaagcaaagacttctcc

SEQ ID NO: 1175988 - DNA, 22 bp, Artificial Sequence
  chemically synthesized
ttatggatttaaggagaagtct

SEQ ID NO: 1175989 - DNA, 22 bp, Artificial Sequence
  chemically synthesized
attatggatttaaggagaagtc

SEQ ID NO: 1175990 - DNA, 22 bp, Artificial Sequence
  chemically synthesized
tattatggatttaaggagaagt

SEQ ID NO: 1175991 - DNA, 22 bp, Artificial Sequence
  chemically synthesized
atacagagttttattatggatt

SEQ ID NO: 1175992 - DNA, 22 bp, Artificial Sequence
  chemically synthesized
aatacagagttttattatggat

SEQ ID NO: 1175993 - DNA, 22 bp, Artificial Sequence
  chemically synthesized
ctccttaaatccataataaaac

SEQ ID NO: 1175994 - DNA, 22 bp, Artificial Sequence
  chemically synthesized
tccttaaatccataataaaact

SEQ ID NO: 1175995 - DNA, 22 bp, Artificial Sequence
  chemically synthesized
cttaaatccataataaaactct

SEQ ID NO: 1175996 - DNA, 22 bp, Artificial Sequence
  chemically synthesized
aagggtttaatacagagtttta

SEQ ID NO: 1175997 - DNA, 22 bp, Artificial Sequence
  chemically synthesized
aaatccataataaaactctgta

SEQ ID NO: 1175998 - DNA, 22 bp, Artificial Sequence
  chemically synthesized
aatccataataaaactctgtat

SEQ ID NO: 1175999 - DNA, 22 bp, Artificial Sequence
  chemically synthesized
ctcaagggtttaatacagagtt

SEQ ID NO: 1176000 - DNA, 22 bp, Artificial Sequence
  chemically synthesized
gctcaagggtttaatacagagt

SEQ ID NO: 1176001 - DNA, 22 bp, Artificial Sequence
  chemically synthesized
aaggtttgctcaagggtttaat

SEQ ID NO: 1176002 - DNA, 22 bp, Artificial Sequence
  chemically synthesized
tgtattaaacccttgagcaaac

SEQ ID NO: 1176003 - DNA, 22 bp, Artificial Sequence
  chemically synthesized
tattaaacccttgagcaaacct

SEQ ID NO: 1176004 - DNA, 22 bp, Artificial Sequence
  chemically synthesized
agtaaagagttcaaggtttgct

SEQ ID NO: 1176005 - DNA, 22 bp, Artificial Sequence
  chemically synthesized
aacccttgagcaaaccttgaac

SEQ ID NO: 1176006 - DNA, 22 bp, Artificial Sequence
  chemically synthesized
gctaagtaaagagttcaaggtt

SEQ ID NO: 1176007 - DNA, 22 bp, Artificial Sequence
  chemically synthesized
ttggctaagtaaagagttcaag

SEQ ID NO: 1176008 - DNA, 22 bp, Artificial Sequence
  chemically synthesized
gttggctaagtaaagagttcaa

SEQ ID NO: 1176009 - DNA, 22 bp, Artificial Sequence
  chemically synthesized
gagcaaaccttgaactctttac

SEQ ID NO: 1176010 - DNA, 22 bp, Artificial Sequence
  chemically synthesized
agcaaaccttgaactctttact

SEQ ID NO: 1176011 - DNA, 22 bp, Artificial Sequence
  chemically synthesized
gaactctttacttagccaacaa

SEQ ID NO: 1176012 - DNA, 22 bp, Artificial Sequence
  chemically synthesized
aactctttacttagccaacaaa

SEQ ID NO: 1176013 - DNA, 22 bp, Artificial Sequence
  chemically synthesized
aagatacaaagagaatttgttg

SEQ ID NO: 1176014 - DNA, 22 bp, Artificial Sequence
  chemically synthesized
tttacttagccaacaaattctc

SEQ ID NO: 1176015 - DNA, 22 bp, Artificial Sequence
  chemically synthesized
tacttagccaacaaattctctt

SEQ ID NO: 1176016 - DNA, 22 bp, Artificial Sequence
  chemically synthesized
acttagccaacaaattctcttt

SEQ ID NO: 1176017 - DNA, 22 bp, Artificial Sequence
  chemically synthesized
cttagccaacaaattctctttg

SEQ ID NO: 1176018 - DNA, 22 bp, Artificial Sequence
  chemically synthesized
agccaacaaattctctttgtat

SEQ ID NO: 1176019 - DNA, 22 bp, Artificial Sequence
  chemically synthesized
gccaacaaattctctttgtatc

SEQ ID NO: 1176020 - DNA, 22 bp, Artificial Sequence
  chemically synthesized
aaatgtactcaagatacaaaga

SEQ ID NO: 1176021 - DNA, 22 bp, Artificial Sequence
  chemically synthesized
caaatgtactcaagatacaaag

SEQ ID NO: 1176022 - DNA, 22 bp, Artificial Sequence
  chemically synthesized
gtttcaaatgtactcaagatac

SEQ ID NO: 1176023 - DNA, 22 bp, Artificial Sequence
  chemically synthesized
ggtttcaaatgtactcaagata

SEQ ID NO: 1176024 - DNA, 22 bp, Artificial Sequence
  chemically synthesized
tctttgtatcttgagtacattt

SEQ ID NO: 1176025 - DNA, 22 bp, Artificial Sequence
  chemically synthesized
tttgtatcttgagtacatttga

SEQ ID NO: 1176026 - DNA, 22 bp, Artificial Sequence
  chemically synthesized
ggatgcttggtttcaaatgtac

SEQ ID NO: 1176027 - DNA, 22 bp, Artificial Sequence
  chemically synthesized
aggatgcttggtttcaaatgta

SEQ ID NO: 1176028 - DNA, 22 bp, Artificial Sequence
  chemically synthesized
tgtatcttgagtacatttgaaa

SEQ ID NO: 1176029 - DNA, 22 bp, Artificial Sequence
  chemically synthesized
gtatcttgagtacatttgaaac

SEQ ID NO: 1176030 - DNA, 22 bp, Artificial Sequence
  chemically synthesized
tatcttgagtacatttgaaacc

SEQ ID NO: 1176031 - DNA, 22 bp, Artificial Sequence
  chemically synthesized
tttaggatgcttggtttcaaat

SEQ ID NO: 1176032 - DNA, 22 bp, Artificial Sequence
  chemically synthesized
tattatttaggatgcttggttt

SEQ ID NO: 1176033 - DNA, 22 bp, Artificial Sequence
  chemically synthesized
gagtacatttgaaaccaagcat

SEQ ID NO: 1176034 - DNA, 22 bp, Artificial Sequence
  chemically synthesized
agtacatttgaaaccaagcatc

SEQ ID NO: 1176035 - DNA, 22 bp, Artificial Sequence
  chemically synthesized
tatcctgtattatttaggatgc

SEQ ID NO: 1176036 - DNA, 22 bp, Artificial Sequence
  chemically synthesized
ttatatcctgtattatttagga

SEQ ID NO: 1176037 - DNA, 22 bp, Artificial Sequence
  chemically synthesized
gaaaccaagcatcctaaataat

SEQ ID NO: 1176038 - DNA, 22 bp, Artificial Sequence
  chemically synthesized
aaaccaagcatcctaaataata

SEQ ID NO: 1176039 - DNA, 22 bp, Artificial Sequence
  chemically synthesized
aagtctattatatcctgtatta

SEQ ID NO: 1176040 - DNA, 22 bp, Artificial Sequence
  chemically synthesized
aataatacaggatataatagac

SEQ ID NO: 1176041 - DNA, 22 bp, Artificial Sequence
  chemically synthesized
atgaagaacattaaagtctatt

SEQ ID NO: 1176042 - DNA, 22 bp, Artificial Sequence
  chemically synthesized
agttgatgaagaacattaaagt

SEQ ID NO: 1176043 - DNA, 22 bp, Artificial Sequence
  chemically synthesized
ttaagttgatgaagaacattaa

SEQ ID NO: 1176044 - DNA, 22 bp, Artificial Sequence
  chemically synthesized
attaagttgatgaagaacatta

SEQ ID NO: 1176045 - DNA, 22 bp, Artificial Sequence
  chemically synthesized
aggatttattaagttgatgaag

SEQ ID NO: 1176046 - DNA, 22 bp, Artificial Sequence
  chemically synthesized
aaggatttattaagttgatgaa

SEQ ID NO: 1176047 - DNA, 22 bp, Artificial Sequence
  chemically synthesized
tttaaggatttattaagttgat

SEQ ID NO: 1176048 - DNA, 22 bp, Artificial Sequence
  chemically synthesized
taatgttcttcatcaacttaat

SEQ ID NO: 1176049 - DNA, 22 bp, Artificial Sequence
  chemically synthesized
aatgttcttcatcaacttaata

SEQ ID NO: 1176050 - DNA, 22 bp, Artificial Sequence
  chemically synthesized
atgttcttcatcaacttaataa

SEQ ID NO: 1176051 - DNA, 22 bp, Artificial Sequence
  chemically synthesized
attatttaaggatttattaagt

SEQ ID NO: 1176052 - DNA, 22 bp, Artificial Sequence
  chemically synthesized
ttgattatttaaggatttatta

SEQ ID NO: 1176053 - DNA, 22 bp, Artificial Sequence
  chemically synthesized
ttcatcaacttaataaatcctt

SEQ ID NO: 1176054 - DNA, 22 bp, Artificial Sequence
  chemically synthesized
catcaacttaataaatccttaa

SEQ ID NO: 1176055 - DNA, 22 bp, Artificial Sequence
  chemically synthesized
atcaacttaataaatccttaaa

SEQ ID NO: 1176056 - DNA, 22 bp, Artificial Sequence
  chemically synthesized
gaatgattgttgattatttaag

SEQ ID NO: 1176057 - DNA, 22 bp, Artificial Sequence
  chemically synthesized
aataaatccttaaataatcaac

SEQ ID NO: 1176058 - DNA, 22 bp, Artificial Sequence
  chemically synthesized
ataaatccttaaataatcaaca

SEQ ID NO: 1176059 - DNA, 22 bp, Artificial Sequence
  chemically synthesized
aaataatcaacaatcattctaa

SEQ ID NO: 1176060 - DNA, 22 bp, Artificial Sequence
  chemically synthesized
aataatcaacaatcattctaat

SEQ ID NO: 1176061 - DNA, 22 bp, Artificial Sequence
  chemically synthesized
aagatgatataagtacatatta

SEQ ID NO: 1176062 - DNA, 22 bp, Artificial Sequence
  chemically synthesized
ggcactgaagatgatataagta

SEQ ID NO: 1176063 - DNA, 22 bp, Artificial Sequence
  chemically synthesized
taatatgtacttatatcatctt

SEQ ID NO: 1176064 - DNA, 22 bp, Artificial Sequence
  chemically synthesized
atatgtacttatatcatcttca

SEQ ID NO: 1176065 - DNA, 22 bp, Artificial Sequence
  chemically synthesized
aaatcagaacattcggcactga

SEQ ID NO: 1176066 - DNA, 22 bp, Artificial Sequence
  chemically synthesized
gaaatcagaacattcggcactg

SEQ ID NO: 1176067 - DNA, 22 bp, Artificial Sequence
  chemically synthesized
atatcatcttcagtgccgaatg

SEQ ID NO: 1176068 - DNA, 22 bp, Artificial Sequence
  chemically synthesized
tatcatcttcagtgccgaatgt

SEQ ID NO: 1176069 - DNA, 22 bp, Artificial Sequence
  chemically synthesized
aatttgaaatcagaacattcgg

SEQ ID NO: 1176070 - DNA, 22 bp, Artificial Sequence
  chemically synthesized
cagtgccgaatgttctgatttc

SEQ ID NO: 1176071 - DNA, 22 bp, Artificial Sequence
  chemically synthesized
aacattgaatttgaaatcagaa

SEQ ID NO: 1176072 - DNA, 22 bp, Artificial Sequence
  chemically synthesized
agtgccgaatgttctgatttca

SEQ ID NO: 1176073 - DNA, 22 bp, Artificial Sequence
  chemically synthesized
agcaattgaacattgaatttga

SEQ ID NO: 1176074 - DNA, 22 bp, Artificial Sequence
  chemically synthesized
tgatttcaaattcaatgttcaa

SEQ ID NO: 1176075 - DNA, 22 bp, Artificial Sequence
  chemically synthesized
gtgaactgagcaattgaacatt

SEQ ID NO: 1176076 - DNA, 22 bp, Artificial Sequence
  chemically synthesized
atttcaaattcaatgttcaatt

SEQ ID NO: 1176077 - DNA, 22 bp, Artificial Sequence
  chemically synthesized
ggtgaactgagcaattgaacat

SEQ ID NO: 1176078 - DNA, 22 bp, Artificial Sequence
  chemically synthesized
caaattcaatgttcaattgctc

SEQ ID NO: 1176079 - DNA, 22 bp, Artificial Sequence
  chemically synthesized
aaattcaatgttcaattgctca

SEQ ID NO: 1176080 - DNA, 22 bp, Artificial Sequence
  chemically synthesized
gatttggtgaactgagcaattg

SEQ ID NO: 1176081 - DNA, 22 bp, Artificial Sequence
  chemically synthesized
actagatttggtgaactgagca

SEQ ID NO: 1176082 - DNA, 22 bp, Artificial Sequence
  chemically synthesized
aatgttcaattgctcagttcac

SEQ ID NO: 1176083 - DNA, 22 bp, Artificial Sequence
  chemically synthesized
aattgctcagttcaccaaatct

SEQ ID NO: 1176084 - DNA, 22 bp, Artificial Sequence
  chemically synthesized
acagcaattaactagatttggt

SEQ ID NO: 1176085 - DNA, 22 bp, Artificial Sequence
  chemically synthesized
ctcagttcaccaaatctagtta

SEQ ID NO: 1176086 - DNA, 22 bp, Artificial Sequence
  chemically synthesized
actaacagcaattaactagatt

SEQ ID NO: 1176087 - DNA, 22 bp, Artificial Sequence
  chemically synthesized
gactaacagcaattaactagat

SEQ ID NO: 1176088 - DNA, 22 bp, Artificial Sequence
  chemically synthesized
tgactaacagcaattaactaga

SEQ ID NO: 1176089 - DNA, 22 bp, Artificial Sequence
  chemically synthesized
agttcaccaaatctagttaatt

SEQ ID NO: 1176090 - DNA, 22 bp, Artificial Sequence
  chemically synthesized
ttgactaacagcaattaactag

SEQ ID NO: 1176091 - DNA, 22 bp, Artificial Sequence
  chemically synthesized
tttgactaacagcaattaacta

SEQ ID NO: 1176092 - DNA, 22 bp, Artificial Sequence
  chemically synthesized
accaaatctagttaattgctgt

SEQ ID NO: 1176093 - DNA, 22 bp, Artificial Sequence
  chemically synthesized
atgagaatgctttttgactaac

SEQ ID NO: 1176094 - DNA, 22 bp, Artificial Sequence
  chemically synthesized
gttaattgctgttagtcaaaaa

SEQ ID NO: 1176095 - DNA, 22 bp, Artificial Sequence
  chemically synthesized
attgctgttagtcaaaaagcat

SEQ ID NO: 1176096 - DNA, 22 bp, Artificial Sequence
  chemically synthesized
ctgttagtcaaaaagcattctc

SEQ ID NO: 1176097 - DNA, 22 bp, Artificial Sequence
  chemically synthesized
ttagtcaaaaagcattctcatt

SEQ ID NO: 1176098 - DNA, 22 bp, Artificial Sequence
  chemically synthesized
gtcaaaaagcattctcattaat

SEQ ID NO: 1176099 - DNA, 22 bp, Artificial Sequence
  chemically synthesized
ataatagcatcagtgtcattaa

SEQ ID NO: 1176100 - DNA, 22 bp, Artificial Sequence
  chemically synthesized
ttgataatagcatcagtgtcat

SEQ ID NO: 1176101 - DNA, 22 bp, Artificial Sequence
  chemically synthesized
attgataatagcatcagtgtca

SEQ ID NO: 1176102 - DNA, 22 bp, Artificial Sequence
  chemically synthesized
tattgataatagcatcagtgtc

SEQ ID NO: 1176103 - DNA, 22 bp, Artificial Sequence
  chemically synthesized
tcattaatgacactgatgctat

SEQ ID NO: 1176104 - DNA, 22 bp, Artificial Sequence
  chemically synthesized
cattttattgataatagcatca

SEQ ID NO: 1176105 - DNA, 22 bp, Artificial Sequence
  chemically synthesized
attaatgacactgatgctatta

SEQ ID NO: 1176106 - DNA, 22 bp, Artificial Sequence
  chemically synthesized
atgacactgatgctattatcaa

SEQ ID NO: 1176107 - DNA, 22 bp, Artificial Sequence
  chemically synthesized
aaaatgactccattttattgat

SEQ ID NO: 1176108 - DNA, 22 bp, Artificial Sequence
  chemically synthesized
atgctattatcaataaaatgga

SEQ ID NO: 1176109 - DNA, 22 bp, Artificial Sequence
  chemically synthesized
ttatcaataaaatggagtcatt

SEQ ID NO: 1176110 - DNA, 22 bp, Artificial Sequence
  chemically synthesized
tcaataaaatggagtcattttg

SEQ ID NO: 1176111 - DNA, 22 bp, Artificial Sequence
  chemically synthesized
atgaataagcaaaccaattcaa

SEQ ID NO: 1176112 - DNA, 22 bp, Artificial Sequence
  chemically synthesized
gatgaataagcaaaccaattca

SEQ ID NO: 1176113 - DNA, 22 bp, Artificial Sequence
  chemically synthesized
catttgatgaataagcaaacca

SEQ ID NO: 1176114 - DNA, 22 bp, Artificial Sequence
  chemically synthesized
tgaattggtttgcttattcatc

SEQ ID NO: 1176115 - DNA, 22 bp, Artificial Sequence
  chemically synthesized
aaaattccatttgatgaataag

SEQ ID NO: 1176116 - DNA, 22 bp, Artificial Sequence
  chemically synthesized
gaattggtttgcttattcatca

SEQ ID NO: 1176117 - DNA, 22 bp, Artificial Sequence
  chemically synthesized
aattggtttgcttattcatcaa

SEQ ID NO: 1176118 - DNA, 22 bp, Artificial Sequence
  chemically synthesized
taaaaattccatttgatgaata

SEQ ID NO: 1176119 - DNA, 22 bp, Artificial Sequence
  chemically synthesized
ctaaaaattccatttgatgaat

SEQ ID NO: 1176120 - DNA, 22 bp, Artificial Sequence
  chemically synthesized
tctaaaaattccatttgatgaa

SEQ ID NO: 1176121 - DNA, 22 bp, Artificial Sequence
  chemically synthesized
gtttgcttattcatcaaatgga

SEQ ID NO: 1176122 - DNA, 22 bp, Artificial Sequence
  chemically synthesized
gcttattcatcaaatggaattt

SEQ ID NO: 1176123 - DNA, 22 bp, Artificial Sequence
  chemically synthesized
cttattcatcaaatggaatttt

SEQ ID NO: 1176124 - DNA, 22 bp, Artificial Sequence
  chemically synthesized
attcatcaaatggaatttttag

SEQ ID NO: 1176125 - DNA, 22 bp, Artificial Sequence
  chemically synthesized
ttcatcaaatggaatttttaga

SEQ ID NO: 1176126 - DNA, 22 bp, Artificial Sequence
  chemically synthesized
atcaaatggaatttttagaaag

SEQ ID NO: 1176127 - DNA, 22 bp, Artificial Sequence
  chemically synthesized
tagtaagataatacatcctttc

SEQ ID NO: 1176128 - DNA, 22 bp, Artificial Sequence
  chemically synthesized
gttgtagtaagataatacatcc

SEQ ID NO: 1176129 - DNA, 22 bp, Artificial Sequence
  chemically synthesized
ttagaaaggatgtattatctta

SEQ ID NO: 1176130 - DNA, 22 bp, Artificial Sequence
  chemically synthesized
tagaaaggatgtattatcttac

SEQ ID NO: 1176131 - DNA, 22 bp, Artificial Sequence
  chemically synthesized
agaaaggatgtattatcttact

SEQ ID NO: 1176132 - DNA, 22 bp, Artificial Sequence
  chemically synthesized
gaaaggatgtattatcttacta

SEQ ID NO: 1176133 - DNA, 22 bp, Artificial Sequence
  chemically synthesized
gcatcctagttgtagtaagata

SEQ ID NO: 1176134 - DNA, 22 bp, Artificial Sequence
  chemically synthesized
ggcatcctagttgtagtaagat

SEQ ID NO: 1176135 - DNA, 22 bp, Artificial Sequence
  chemically synthesized
ccatttggcatcctagttgtag

SEQ ID NO: 1176136 - DNA, 22 bp, Artificial Sequence
  chemically synthesized
aattcccatttggcatcctagt

SEQ ID NO: 1176137 - DNA, 22 bp, Artificial Sequence
  chemically synthesized
tcttactacaactaggatgcca

SEQ ID NO: 1176138 - DNA, 22 bp, Artificial Sequence
  chemically synthesized
actacaactaggatgccaaatg

SEQ ID NO: 1176139 - DNA, 22 bp, Artificial Sequence
  chemically synthesized
ctacaactaggatgccaaatgg

SEQ ID NO: 1176140 - DNA, 22 bp, Artificial Sequence
  chemically synthesized
caactaggatgccaaatgggaa

SEQ ID NO: 1176141 - DNA, 22 bp, Artificial Sequence
  chemically synthesized
ggatgccaaatgggaatttaat

SEQ ID NO: 1176142 - DNA, 22 bp, Artificial Sequence
  chemically synthesized
tgaaaaaatggtgcattaaatt

SEQ ID NO: 1176143 - DNA, 22 bp, Artificial Sequence
  chemically synthesized
tagcaagcctgtgaaaaaatgg

SEQ ID NO: 1176144 - DNA, 22 bp, Artificial Sequence
  chemically synthesized
atagcaagcctgtgaaaaaatg

SEQ ID NO: 1176145 - DNA, 22 bp, Artificial Sequence
  chemically synthesized
atttatagcaagcctgtgaaaa

SEQ ID NO: 1176146 - DNA, 22 bp, Artificial Sequence
  chemically synthesized
aatgcaccattttttcacaggc

SEQ ID NO: 1176147 - DNA, 22 bp, Artificial Sequence
  chemically synthesized
atgcaccattttttcacaggct

SEQ ID NO: 1176148 - DNA, 22 bp, Artificial Sequence
  chemically synthesized
tgatttatagcaagcctgtgaa

SEQ ID NO: 1176149 - DNA, 22 bp, Artificial Sequence
  chemically synthesized
aagattctgatttatagcaagc

SEQ ID NO: 1176150 - DNA, 22 bp, Artificial Sequence
  chemically synthesized
aaagattctgatttatagcaag

SEQ ID NO: 1176151 - DNA, 22 bp, Artificial Sequence
  chemically synthesized
taaagattctgatttatagcaa

SEQ ID NO: 1176152 - DNA, 22 bp, Artificial Sequence
  chemically synthesized
tttcacaggcttgctataaatc

SEQ ID NO: 1176153 - DNA, 22 bp, Artificial Sequence
  chemically synthesized
ttcacaggcttgctataaatca

SEQ ID NO: 1176154 - DNA, 22 bp, Artificial Sequence
  chemically synthesized
tcacaggcttgctataaatcag

SEQ ID NO: 1176155 - DNA, 22 bp, Artificial Sequence
  chemically synthesized
cacaggcttgctataaatcaga

SEQ ID NO: 1176156 - DNA, 22 bp, Artificial Sequence
  chemically synthesized
acaggcttgctataaatcagaa

SEQ ID NO: 1176157 - DNA, 22 bp, Artificial Sequence
  chemically synthesized
gagagaaatgttttaaagattc

SEQ ID NO: 1176158 - DNA, 22 bp, Artificial Sequence
  chemically synthesized
gctataaatcagaatctttaaa

SEQ ID NO: 1176159 - DNA, 22 bp, Artificial Sequence
  chemically synthesized
ctataaatcagaatctttaaaa

SEQ ID NO: 1176160 - DNA, 22 bp, Artificial Sequence
  chemically synthesized
taaatcagaatctttaaaacat

SEQ ID NO: 1176161 - DNA, 22 bp, Artificial Sequence
  chemically synthesized
taaaacatttctctccaattct

SEQ ID NO: 1176162 - DNA, 22 bp, Artificial Sequence
  chemically synthesized
aaaacatttctctccaattctc

SEQ ID NO: 1176163 - DNA, 22 bp, Artificial Sequence
  chemically synthesized
aaacatttctctccaattctct

SEQ ID NO: 1176164 - DNA, 22 bp, Artificial Sequence
  chemically synthesized
aggagtggaagagagagaattg

SEQ ID NO: 1176165 - DNA, 22 bp, Artificial Sequence
  chemically synthesized
caggagtggaagagagagaatt

SEQ ID NO: 1176166 - DNA, 22 bp, Artificial Sequence
  chemically synthesized
tcaggagtggaagagagagaat

SEQ ID NO: 1176167 - DNA, 22 bp, Artificial Sequence
  chemically synthesized
tttcaggagtggaagagagaga

SEQ ID NO: 1176168 - DNA, 22 bp, Artificial Sequence
  chemically synthesized
ctctccaattctctctcttcca

SEQ ID NO: 1176169 - DNA, 22 bp, Artificial Sequence
  chemically synthesized
tctccaattctctctcttccac

SEQ ID NO: 1176170 - DNA, 22 bp, Artificial Sequence
  chemically synthesized
tccaattctctctcttccactc

SEQ ID NO: 1176171 - DNA, 22 bp, Artificial Sequence
  chemically synthesized
ccatctctttcaggagtggaag

SEQ ID NO: 1176172 - DNA, 22 bp, Artificial Sequence
  chemically synthesized
caattctctctcttccactcct

SEQ ID NO: 1176173 - DNA, 22 bp, Artificial Sequence
  chemically synthesized
tctctcttccactcctgaaaga

SEQ ID NO: 1176174 - DNA, 22 bp, Artificial Sequence
  chemically synthesized
tctcttccactcctgaaagaga

SEQ ID NO: 1176175 - DNA, 22 bp, Artificial Sequence
  chemically synthesized
tcttccactcctgaaagagatg

SEQ ID NO: 1176176 - DNA, 22 bp, Artificial Sequence
  chemically synthesized
agatgatattaccatctctttc

SEQ ID NO: 1176177 - DNA, 22 bp, Artificial Sequence
  chemically synthesized
ttccactcctgaaagagatggt

SEQ ID NO: 1176178 - DNA, 22 bp, Artificial Sequence
  chemically synthesized
ccactcctgaaagagatggtaa

SEQ ID NO: 1176179 - DNA, 22 bp, Artificial Sequence
  chemically synthesized
cactcctgaaagagatggtaat

SEQ ID NO: 1176180 - DNA, 22 bp, Artificial Sequence
  chemically synthesized
ctgaaagagatggtaatatcat

SEQ ID NO: 1176181 - DNA, 22 bp, Artificial Sequence
  chemically synthesized
aaagagattcagatgatattac

SEQ ID NO: 1176182 - DNA, 22 bp, Artificial Sequence
  chemically synthesized
gaaagagattcagatgatatta

SEQ ID NO: 1176183 - DNA, 22 bp, Artificial Sequence
  chemically synthesized
aaagagatggtaatatcatctg

SEQ ID NO: 1176184 - DNA, 22 bp, Artificial Sequence
  chemically synthesized
cttgaaagagattcagatgata

SEQ ID NO: 1176185 - DNA, 22 bp, Artificial Sequence
  chemically synthesized
ccttgaaagagattcagatgat

SEQ ID NO: 1176186 - DNA, 22 bp, Artificial Sequence
  chemically synthesized
tccttgaaagagattcagatga

SEQ ID NO: 1176187 - DNA, 22 bp, Artificial Sequence
  chemically synthesized
ttccttgaaagagattcagatg

SEQ ID NO: 1176188 - DNA, 22 bp, Artificial Sequence
  chemically synthesized
tttccttgaaagagattcagat

SEQ ID NO: 1176189 - DNA, 22 bp, Artificial Sequence
  chemically synthesized
ttttccttgaaagagattcaga

SEQ ID NO: 1176190 - DNA, 22 bp, Artificial Sequence
  chemically synthesized
atcttttttccttgaaagagat

SEQ ID NO: 1176191 - DNA, 22 bp, Artificial Sequence
  chemically synthesized
attaatcttttttccttgaaag

SEQ ID NO: 1176192 - DNA, 22 bp, Artificial Sequence
  chemically synthesized
cattaatcttttttccttgaaa

SEQ ID NO: 1176193 - DNA, 22 bp, Artificial Sequence
  chemically synthesized
aatctctttcaaggaaaaaaga

SEQ ID NO: 1176194 - DNA, 22 bp, Artificial Sequence
  chemically synthesized
tttcaaggaaaaaagattaatg

SEQ ID NO: 1176195 - DNA, 22 bp, Artificial Sequence
  chemically synthesized
tcaaggaaaaaagattaatgaa

SEQ ID NO: 1176196 - DNA, 22 bp, Artificial Sequence
  chemically synthesized
tcaacagatgacttcattaatc

SEQ ID NO: 1176197 - DNA, 22 bp, Artificial Sequence
  chemically synthesized
caaggaaaaaagattaatgaag

SEQ ID NO: 1176198 - DNA, 22 bp, Artificial Sequence
  chemically synthesized
aaggaaaaaagattaatgaagt

SEQ ID NO: 1176199 - DNA, 22 bp, Artificial Sequence
  chemically synthesized
tgaaatctatcaacagatgact

SEQ ID NO: 1176200 - DNA, 22 bp, Artificial Sequence
  chemically synthesized
ctgtgaaatctatcaacagatg

SEQ ID NO: 1176201 - DNA, 22 bp, Artificial Sequence
  chemically synthesized
atgaagtcatctgttgatagat

SEQ ID NO: 1176202 - DNA, 22 bp, Artificial Sequence
  chemically synthesized
ttgatagatttcacagcaatta

SEQ ID NO: 1176203 - DNA, 22 bp, Artificial Sequence
  chemically synthesized
gtaatgaggaagaataattgct

SEQ ID NO: 1176204 - DNA, 22 bp, Artificial Sequence
  chemically synthesized
atagatttcacagcaattattc

SEQ ID NO: 1176205 - DNA, 22 bp, Artificial Sequence
  chemically synthesized
ggaactggtaatgaggaagaat

SEQ ID NO: 1176206 - DNA, 22 bp, Artificial Sequence
  chemically synthesized
gggaactggtaatgaggaagaa

SEQ ID NO: 1176207 - DNA, 22 bp, Artificial Sequence
  chemically synthesized
cacagcaattattcttcctcat

SEQ ID NO: 1176208 - DNA, 22 bp, Artificial Sequence
  chemically synthesized
acagcaattattcttcctcatt

SEQ ID NO: 1176209 - DNA, 22 bp, Artificial Sequence
  chemically synthesized
ttcttcctcattaccagttccc

SEQ ID NO: 1176210 - DNA, 22 bp, Artificial Sequence
  chemically synthesized
ttcctcattaccagttcccaaa

SEQ ID NO: 1176211 - DNA, 22 bp, Artificial Sequence
  chemically synthesized
cctcattaccagttcccaaact

SEQ ID NO: 1176212 - DNA, 22 bp, Artificial Sequence
  chemically synthesized
ctcattaccagttcccaaactt

SEQ ID NO: 1176213 - DNA, 22 bp, Artificial Sequence
  chemically synthesized
taaaatgaaaggtgaagtttgg

SEQ ID NO: 1176214 - DNA, 22 bp, Artificial Sequence
  chemically synthesized
attaccagttcccaaacttcac

SEQ ID NO: 1176215 - DNA, 22 bp, Artificial Sequence
  chemically synthesized
ataaaatgaaaggtgaagtttg

SEQ ID NO: 1176216 - DNA, 22 bp, Artificial Sequence
  chemically synthesized
tataaaatgaaaggtgaagttt

SEQ ID NO: 1176217 - DNA, 22 bp, Artificial Sequence
  chemically synthesized
ccagttcccaaacttcaccttt

SEQ ID NO: 1176218 - DNA, 22 bp, Artificial Sequence
  chemically synthesized
ctttataaaatgaaaggtgaag

SEQ ID NO: 1176219 - DNA, 22 bp, Artificial Sequence
  chemically synthesized
ccaaacttcacctttcatttta

SEQ ID NO: 1176220 - DNA, 22 bp, Artificial Sequence
  chemically synthesized
aaataaaggttactttataaaa

SEQ ID NO: 1176221 - DNA, 22 bp, Artificial Sequence
  chemically synthesized
aaaataaaggttactttataaa

SEQ ID NO: 1176222 - DNA, 22 bp, Artificial Sequence
  chemically synthesized
cacctttcattttataaagtaa

SEQ ID NO: 1176223 - DNA, 22 bp, Artificial Sequence
  chemically synthesized
acctttcattttataaagtaac

SEQ ID NO: 1176224 - DNA, 22 bp, Artificial Sequence
  chemically synthesized
tcattttataaagtaaccttta

SEQ ID NO: 1176225 - DNA, 22 bp, Artificial Sequence
  chemically synthesized
cattttataaagtaacctttat

SEQ ID NO: 1176226 - DNA, 22 bp, Artificial Sequence
  chemically synthesized
attttataaagtaacctttatt

SEQ ID NO: 1176227 - DNA, 22 bp, Artificial Sequence
  chemically synthesized
tataaagtaacctttattttaa

SEQ ID NO: 1176228 - DNA, 22 bp, Artificial Sequence
  chemically synthesized
ataaagtaacctttattttaaa

SEQ ID NO: 1176229 - DNA, 22 bp, Artificial Sequence
  chemically synthesized
taaagtaacctttattttaaac

SEQ ID NO: 1176230 - DNA, 22 bp, Artificial Sequence
  chemically synthesized
tattttaaacctgcctgtattt

SEQ ID NO: 1176231 - DNA, 22 bp, Artificial Sequence
  chemically synthesized
attttaaacctgcctgtatttt

SEQ ID NO: 1176232 - DNA, 22 bp, Artificial Sequence
  chemically synthesized
ttttaaacctgcctgtatttta

SEQ ID NO: 1176233 - DNA, 22 bp, Artificial Sequence
  chemically synthesized
taaacctgcctgtattttacct

SEQ ID NO: 1176234 - DNA, 22 bp, Artificial Sequence
  chemically synthesized
aaacctgcctgtattttacctt

SEQ ID NO: 1176235 - DNA, 22 bp, Artificial Sequence
  chemically synthesized
aacctgcctgtattttaccttc

SEQ ID NO: 1176236 - DNA, 22 bp, Artificial Sequence
  chemically synthesized
cctgtattttaccttcttattt

SEQ ID NO: 1176237 - DNA, 22 bp, Artificial Sequence
  chemically synthesized
tattttaccttcttattttctg

SEQ ID NO: 1176238 - DNA, 22 bp, Artificial Sequence
  chemically synthesized
taaatcaggcaaccagaaaata

SEQ ID NO: 1176239 - DNA, 22 bp, Artificial Sequence
  chemically synthesized
taccttcttattttctggttgc

SEQ ID NO: 1176240 - DNA, 22 bp, Artificial Sequence
  chemically synthesized
accttcttattttctggttgcc

SEQ ID NO: 1176241 - DNA, 22 bp, Artificial Sequence
  chemically synthesized
ccttcttattttctggttgcct

SEQ ID NO: 1176242 - DNA, 22 bp, Artificial Sequence
  chemically synthesized
cttattttctggttgcctgatt

SEQ ID NO: 1176243 - DNA, 22 bp, Artificial Sequence
  chemically synthesized
ttattttctggttgcctgattt

SEQ ID NO: 1176244 - DNA, 22 bp, Artificial Sequence
  chemically synthesized
attttctggttgcctgatttat

SEQ ID NO: 1176245 - DNA, 22 bp, Artificial Sequence
  chemically synthesized
ttttctggttgcctgatttata

SEQ ID NO: 1176246 - DNA, 22 bp, Artificial Sequence
  chemically synthesized
tctggttgcctgatttataatt

SEQ ID NO: 1176247 - DNA, 22 bp, Artificial Sequence
  chemically synthesized
ctggttgcctgatttataattt

SEQ ID NO: 1176248 - DNA, 22 bp, Artificial Sequence
  chemically synthesized
tggttgcctgatttataatttg

SEQ ID NO: 1176249 - DNA, 22 bp, Artificial Sequence
  chemically synthesized
gttgcctgatttataatttgtc

SEQ ID NO: 1176250 - DNA, 22 bp, Artificial Sequence
  chemically synthesized
cctgatttataatttgtcatta

SEQ ID NO: 1176251 - DNA, 22 bp, Artificial Sequence
  chemically synthesized
atttataatttgtcattatatt

SEQ ID NO: 1176252 - DNA, 22 bp, Artificial Sequence
  chemically synthesized
ataatttgtcattatattgctt

SEQ ID NO: 1176253 - DNA, 22 bp, Artificial Sequence
  chemically synthesized
taatttgtcattatattgctta

SEQ ID NO: 1176254 - DNA, 22 bp, Artificial Sequence
  chemically synthesized
aaagtggatgaatatataagca

SEQ ID NO: 1176255 - DNA, 22 bp, Artificial Sequence
  chemically synthesized
gtcattatattgcttatatatt

SEQ ID NO: 1176256 - DNA, 22 bp, Artificial Sequence
  chemically synthesized
tcattatattgcttatatattc

SEQ ID NO: 1176257 - DNA, 22 bp, Artificial Sequence
  chemically synthesized
ctaaaagtggatgaatatataa

SEQ ID NO: 1176258 - DNA, 22 bp, Artificial Sequence
  chemically synthesized
actaaaagtggatgaatatata

SEQ ID NO: 1176259 - DNA, 22 bp, Artificial Sequence
  chemically synthesized
tattgcttatatattcatccac

SEQ ID NO: 1176260 - DNA, 22 bp, Artificial Sequence
  chemically synthesized
atgatttactaaaagtggatga

SEQ ID NO: 1176261 - DNA, 22 bp, Artificial Sequence
  chemically synthesized
catgatttactaaaagtggatg

SEQ ID NO: 1176262 - DNA, 22 bp, Artificial Sequence
  chemically synthesized
cttatatattcatccactttta

SEQ ID NO: 1176263 - DNA, 22 bp, Artificial Sequence
  chemically synthesized
atatattcatccacttttagta

SEQ ID NO: 1176264 - DNA, 22 bp, Artificial Sequence
  chemically synthesized
tatattcatccacttttagtaa

SEQ ID NO: 1176265 - DNA, 22 bp, Artificial Sequence
  chemically synthesized
tgcacacacttcatgatttact

SEQ ID NO: 1176266 - DNA, 22 bp, Artificial Sequence
  chemically synthesized
atgcacacacttcatgatttac

SEQ ID NO: 1176267 - DNA, 22 bp, Artificial Sequence
  chemically synthesized
atccacttttagtaaatcatga

SEQ ID NO: 1176268 - DNA, 22 bp, Artificial Sequence
  chemically synthesized
ttagtaaatcatgaagtgtgtg

SEQ ID NO: 1176269 - DNA, 22 bp, Artificial Sequence
  chemically synthesized
tagtaaatcatgaagtgtgtgc

SEQ ID NO: 1176270 - DNA, 22 bp, Artificial Sequence
  chemically synthesized
agtaaatcatgaagtgtgtgca

SEQ ID NO: 1176271 - DNA, 22 bp, Artificial Sequence
  chemically synthesized
gtaaatcatgaagtgtgtgcat

SEQ ID NO: 1176272 - DNA, 22 bp, Artificial Sequence
  chemically synthesized
ataaacacacttatgcacacac

SEQ ID NO: 1176273 - DNA, 22 bp, Artificial Sequence
  chemically synthesized
cataaacacacttatgcacaca

SEQ ID NO: 1176274 - DNA, 22 bp, Artificial Sequence
  chemically synthesized
tcataaacacacttatgcacac

SEQ ID NO: 1176275 - DNA, 22 bp, Artificial Sequence
  chemically synthesized
ggttttcataaacacacttatg

SEQ ID NO: 1176276 - DNA, 22 bp, Artificial Sequence
  chemically synthesized
gaggaaaggttgggttttcata

SEQ ID NO: 1176277 - DNA, 22 bp, Artificial Sequence
  chemically synthesized
tcattagaggaaaggttgggtt

SEQ ID NO: 1176278 - DNA, 22 bp, Artificial Sequence
  chemically synthesized
atgaaaacccaacctttcctct

SEQ ID NO: 1176279 - DNA, 22 bp, Artificial Sequence
  chemically synthesized
tgaaaacccaacctttcctcta

SEQ ID NO: 1176280 - DNA, 22 bp, Artificial Sequence
  chemically synthesized
tgaagctatcattagaggaaag

SEQ ID NO: 1176281 - DNA, 22 bp, Artificial Sequence
  chemically synthesized
atgaagctatcattagaggaaa

SEQ ID NO: 1176282 - DNA, 22 bp, Artificial Sequence
  chemically synthesized
tatgaagctatcattagaggaa

SEQ ID NO: 1176283 - DNA, 22 bp, Artificial Sequence
  chemically synthesized
tcctctaatgatagcttcataa

SEQ ID NO: 1176284 - DNA, 22 bp, Artificial Sequence
  chemically synthesized
cctctaatgatagcttcataaa

SEQ ID NO: 1176285 - DNA, 22 bp, Artificial Sequence
  chemically synthesized
ctctaatgatagcttcataaag

SEQ ID NO: 1176286 - DNA, 22 bp, Artificial Sequence
  chemically synthesized
taatgatagcttcataaagctc

SEQ ID NO: 1176287 - DNA, 22 bp, Artificial Sequence
  chemically synthesized
atgatagcttcataaagctcta

SEQ ID NO: 1176288 - DNA, 22 bp, Artificial Sequence
  chemically synthesized
aaatgacacaacatagagcttt

SEQ ID NO: 1176289 - DNA, 22 bp, Artificial Sequence
  chemically synthesized
tatgctaaaatgacacaacata

SEQ ID NO: 1176290 - DNA, 22 bp, Artificial Sequence
  chemically synthesized
cataaagctctatgttgtgtca

SEQ ID NO: 1176291 - DNA, 22 bp, Artificial Sequence
  chemically synthesized
ataaagctctatgttgtgtcat

SEQ ID NO: 1176292 - DNA, 22 bp, Artificial Sequence
  chemically synthesized
acctgtatgctaaaatgacaca

SEQ ID NO: 1176293 - DNA, 22 bp, Artificial Sequence
  chemically synthesized
ttaacctgtatgctaaaatgac

SEQ ID NO: 1176294 - DNA, 22 bp, Artificial Sequence
  chemically synthesized
tattaacctgtatgctaaaatg

SEQ ID NO: 1176295 - DNA, 22 bp, Artificial Sequence
  chemically synthesized
tatgttgtgtcattttagcata

SEQ ID NO: 1176296 - DNA, 22 bp, Artificial Sequence
  chemically synthesized
tgttgtgtcattttagcataca

SEQ ID NO: 1176297 - DNA, 22 bp, Artificial Sequence
  chemically synthesized
attctattaacctgtatgctaa

SEQ ID NO: 1176298 - DNA, 22 bp, Artificial Sequence
  chemically synthesized
tgtcattttagcatacaggtta

SEQ ID NO: 1176299 - DNA, 22 bp, Artificial Sequence
  chemically synthesized
cagaattgattctattaacctg

SEQ ID NO: 1176300 - DNA, 22 bp, Artificial Sequence
  chemically synthesized
attccagaattgattctattaa

SEQ ID NO: 1176301 - DNA, 22 bp, Artificial Sequence
  chemically synthesized
tagcatacaggttaatagaatc

SEQ ID NO: 1176302 - DNA, 22 bp, Artificial Sequence
  chemically synthesized
agcatacaggttaatagaatca

SEQ ID NO: 1176303 - DNA, 22 bp, Artificial Sequence
  chemically synthesized
gcatacaggttaatagaatcaa

SEQ ID NO: 1176304 - DNA, 22 bp, Artificial Sequence
  chemically synthesized
atagaatcaattctggaatgag

SEQ ID NO: 1176305 - DNA, 22 bp, Artificial Sequence
  chemically synthesized
aacacacacacaatctcattcc

SEQ ID NO: 1176306 - DNA, 22 bp, Artificial Sequence
  chemically synthesized
gaacacacacacaatctcattc

SEQ ID NO: 1176307 - DNA, 22 bp, Artificial Sequence
  chemically synthesized
tggaatgagattgtgtgtgtgt

SEQ ID NO: 1176308 - DNA, 22 bp, Artificial Sequence
  chemically synthesized
tgccaggatttgaacacacaca

SEQ ID NO: 1176309 - DNA, 22 bp, Artificial Sequence
  chemically synthesized
gaatgagattgtgtgtgtgttc

SEQ ID NO: 1176310 - DNA, 22 bp, Artificial Sequence
  chemically synthesized
tgtgtgtgttcaaatcctggca

SEQ ID NO: 1176311 - DNA, 22 bp, Artificial Sequence
  chemically synthesized
tgcacatgaaaagcagctgtgc

SEQ ID NO: 1176312 - DNA, 22 bp, Artificial Sequence
  chemically synthesized
aaatcctggcacagctgctttt

SEQ ID NO: 1176313 - DNA, 22 bp, Artificial Sequence
  chemically synthesized
tgcacagttatgcacatgaaaa

SEQ ID NO: 1176314 - DNA, 22 bp, Artificial Sequence
  chemically synthesized
gcacagctgcttttcatgtgca

SEQ ID NO: 1176315 - DNA, 22 bp, Artificial Sequence
  chemically synthesized
agaaatctgtgcacagttatgc

SEQ ID NO: 1176316 - DNA, 22 bp, Artificial Sequence
  chemically synthesized
cttttcatgtgcataactgtgc

SEQ ID NO: 1176317 - DNA, 22 bp, Artificial Sequence
  chemically synthesized
gttaagaaatctgtgcacagtt

SEQ ID NO: 1176318 - DNA, 22 bp, Artificial Sequence
  chemically synthesized
ttcatgtgcataactgtgcaca

SEQ ID NO: 1176319 - DNA, 22 bp, Artificial Sequence
  chemically synthesized
tcatgtgcataactgtgcacag

SEQ ID NO: 1176320 - DNA, 22 bp, Artificial Sequence
  chemically synthesized
catgtgcataactgtgcacaga

SEQ ID NO: 1176321 - DNA, 22 bp, Artificial Sequence
  chemically synthesized
atgtgcataactgtgcacagat

SEQ ID NO: 1176322 - DNA, 22 bp, Artificial Sequence
  chemically synthesized
ataagctggttaagaaatctgt

SEQ ID NO: 1176323 - DNA, 22 bp, Artificial Sequence
  chemically synthesized
tgcacagatttcttaaccagct

SEQ ID NO: 1176324 - DNA, 22 bp, Artificial Sequence
  chemically synthesized
agaaaattgataagctggttaa

SEQ ID NO: 1176325 - DNA, 22 bp, Artificial Sequence
  chemically synthesized
gagaaaattgataagctggtta

SEQ ID NO: 1176326 - DNA, 22 bp, Artificial Sequence
  chemically synthesized
cacttgagaaaattgataagct

SEQ ID NO: 1176327 - DNA, 22 bp, Artificial Sequence
  chemically synthesized
acacttgagaaaattgataagc

SEQ ID NO: 1176328 - DNA, 22 bp, Artificial Sequence
  chemically synthesized
tacacttgagaaaattgataag

SEQ ID NO: 1176329 - DNA, 22 bp, Artificial Sequence
  chemically synthesized
cttaaccagcttatcaattttc

SEQ ID NO: 1176330 - DNA, 22 bp, Artificial Sequence
  chemically synthesized
ttaaccagcttatcaattttct

SEQ ID NO: 1176331 - DNA, 22 bp, Artificial Sequence
  chemically synthesized
aaccagcttatcaattttctca

SEQ ID NO: 1176332 - DNA, 22 bp, Artificial Sequence
  chemically synthesized
accagcttatcaattttctcaa

SEQ ID NO: 1176333 - DNA, 22 bp, Artificial Sequence
  chemically synthesized
atatatccattttacacttgag

SEQ ID NO: 1176334 - DNA, 22 bp, Artificial Sequence
  chemically synthesized
atcaattttctcaagtgtaaaa

SEQ ID NO: 1176335 - DNA, 22 bp, Artificial Sequence
  chemically synthesized
ttaatatatccattttacactt

SEQ ID NO: 1176336 - DNA, 22 bp, Artificial Sequence
  chemically synthesized
tcaattttctcaagtgtaaaat

SEQ ID NO: 1176337 - DNA, 22 bp, Artificial Sequence
  chemically synthesized
tgttaatatatccattttacac

SEQ ID NO: 1176338 - DNA, 22 bp, Artificial Sequence
  chemically synthesized
tctcaagtgtaaaatggatata

SEQ ID NO: 1176339 - DNA, 22 bp, Artificial Sequence
  chemically synthesized
ctcaagtgtaaaatggatatat

SEQ ID NO: 1176340 - DNA, 22 bp, Artificial Sequence
  chemically synthesized
tcaagtgtaaaatggatatatt

SEQ ID NO: 1176341 - DNA, 22 bp, Artificial Sequence
  chemically synthesized
agaagattctgttaatatatcc

SEQ ID NO: 1176342 - DNA, 22 bp, Artificial Sequence
  chemically synthesized
aagtgtaaaatggatatattaa

SEQ ID NO: 1176343 - DNA, 22 bp, Artificial Sequence
  chemically synthesized
ttgagaagattctgttaatata

SEQ ID NO: 1176344 - DNA, 22 bp, Artificial Sequence
  chemically synthesized
taacaaccctattgagaagatt

SEQ ID NO: 1176345 - DNA, 22 bp, Artificial Sequence
  chemically synthesized
ataacaaccctattgagaagat

SEQ ID NO: 1176346 - DNA, 22 bp, Artificial Sequence
  chemically synthesized
acagaatcttctcaatagggtt

SEQ ID NO: 1176347 - DNA, 22 bp, Artificial Sequence
  chemically synthesized
aatgtttataacaaccctattg

SEQ ID NO: 1176348 - DNA, 22 bp, Artificial Sequence
  chemically synthesized
attcaatgtttataacaaccct

SEQ ID NO: 1176349 - DNA, 22 bp, Artificial Sequence
  chemically synthesized
ctcaatagggttgttataaaca

SEQ ID NO: 1176350 - DNA, 22 bp, Artificial Sequence
  chemically synthesized
tcaatagggttgttataaacat

SEQ ID NO: 1176351 - DNA, 22 bp, Artificial Sequence
  chemically synthesized
atacattaattcaatgtttata

SEQ ID NO: 1176352 - DNA, 22 bp, Artificial Sequence
  chemically synthesized
aatagggttgttataaacattg

SEQ ID NO: 1176353 - DNA, 22 bp, Artificial Sequence
  chemically synthesized
catacattaattcaatgtttat

SEQ ID NO: 1176354 - DNA, 22 bp, Artificial Sequence
  chemically synthesized
tcatacattaattcaatgttta

SEQ ID NO: 1176355 - DNA, 22 bp, Artificial Sequence
  chemically synthesized
ttcatacattaattcaatgttt

SEQ ID NO: 1176356 - DNA, 22 bp, Artificial Sequence
  chemically synthesized
ttataaacattgaattaatgta

SEQ ID NO: 1176357 - DNA, 22 bp, Artificial Sequence
  chemically synthesized
taaacacttttcatacattaat

SEQ ID NO: 1176358 - DNA, 22 bp, Artificial Sequence
  chemically synthesized
taaacattgaattaatgtatga

SEQ ID NO: 1176359 - DNA, 22 bp, Artificial Sequence
  chemically synthesized
ctgtaaacacttttcatacatt

SEQ ID NO: 1176360 - DNA, 22 bp, Artificial Sequence
  chemically synthesized
aattaatgtatgaaaagtgttt

SEQ ID NO: 1176361 - DNA, 22 bp, Artificial Sequence
  chemically synthesized
atgtatgaaaagtgtttacagc

SEQ ID NO: 1176362 - DNA, 22 bp, Artificial Sequence
  chemically synthesized
tataacaaacattgctgtaaac

SEQ ID NO: 1176363 - DNA, 22 bp, Artificial Sequence
  chemically synthesized
gacaatcattatataacaaaca

SEQ ID NO: 1176364 - DNA, 22 bp, Artificial Sequence
  chemically synthesized
acagcaatgtttgttatataat

SEQ ID NO: 1176365 - DNA, 22 bp, Artificial Sequence
  chemically synthesized
cagcaatgtttgttatataatg

SEQ ID NO: 1176366 - DNA, 22 bp, Artificial Sequence
  chemically synthesized
atattggacaatcattatataa

SEQ ID NO: 1176367 - DNA, 22 bp, Artificial Sequence
  chemically synthesized
actgatattggacaatcattat

SEQ ID NO: 1176368 - DNA, 22 bp, Artificial Sequence
  chemically synthesized
ctaactgatattggacaatcat

SEQ ID NO: 1176369 - DNA, 22 bp, Artificial Sequence
  chemically synthesized
gttatataatgattgtccaata

SEQ ID NO: 1176370 - DNA, 22 bp, Artificial Sequence
  chemically synthesized
ttatataatgattgtccaatat

SEQ ID NO: 1176371 - DNA, 22 bp, Artificial Sequence
  chemically synthesized
tataatgattgtccaatatcag

SEQ ID NO: 1176372 - DNA, 22 bp, Artificial Sequence
  chemically synthesized
tccaatatcagttagtaatttt

SEQ ID NO: 1176373 - DNA, 22 bp, Artificial Sequence
  chemically synthesized
tgatgatgaataatgtcacaaa

SEQ ID NO: 1176374 - DNA, 22 bp, Artificial Sequence
  chemically synthesized
gtaatttttgtgacattattca

SEQ ID NO: 1176375 - DNA, 22 bp, Artificial Sequence
  chemically synthesized
gataatgtctgtgatgatgaat

SEQ ID NO: 1176376 - DNA, 22 bp, Artificial Sequence
  chemically synthesized
agataatgtctgtgatgatgaa

SEQ ID NO: 1176377 - DNA, 22 bp, Artificial Sequence
  chemically synthesized
ttgtgacattattcatcatcac

SEQ ID NO: 1176378 - DNA, 22 bp, Artificial Sequence
  chemically synthesized
tgtgacattattcatcatcaca

SEQ ID NO: 1176379 - DNA, 22 bp, Artificial Sequence
  chemically synthesized
ttagataatgtctgtgatgatg

SEQ ID NO: 1176380 - DNA, 22 bp, Artificial Sequence
  chemically synthesized
gtgacattattcatcatcacag

SEQ ID NO: 1176381 - DNA, 22 bp, Artificial Sequence
  chemically synthesized
tgacattattcatcatcacaga

SEQ ID NO: 1176382 - DNA, 22 bp, Artificial Sequence
  chemically synthesized
ctcttagataatgtctgtgatg

SEQ ID NO: 1176383 - DNA, 22 bp, Artificial Sequence
  chemically synthesized
ttcatcatcacagacattatct

SEQ ID NO: 1176384 - DNA, 22 bp, Artificial Sequence
  chemically synthesized
atcatcacagacattatctaag

SEQ ID NO: 1176385 - DNA, 22 bp, Artificial Sequence
  chemically synthesized
gataatgaaccagttactctta

SEQ ID NO: 1176386 - DNA, 22 bp, Artificial Sequence
  chemically synthesized
agataatgaaccagttactctt

SEQ ID NO: 1176387 - DNA, 22 bp, Artificial Sequence
  chemically synthesized
atcttagataatgaaccagtta

SEQ ID NO: 1176388 - DNA, 22 bp, Artificial Sequence
  chemically synthesized
tctaagagtaactggttcatta

SEQ ID NO: 1176389 - DNA, 22 bp, Artificial Sequence
  chemically synthesized
agtgttgatcttagataatgaa

SEQ ID NO: 1176390 - DNA, 22 bp, Artificial Sequence
  chemically synthesized
agagtaactggttcattatcta

SEQ ID NO: 1176391 - DNA, 22 bp, Artificial Sequence
  chemically synthesized
ctgagtgttgatcttagataat

SEQ ID NO: 1176392 - DNA, 22 bp, Artificial Sequence
  chemically synthesized
cctgagtgttgatcttagataa

SEQ ID NO: 1176393 - DNA, 22 bp, Artificial Sequence
  chemically synthesized
cttcctgagtgttgatcttaga

SEQ ID NO: 1176394 - DNA, 22 bp, Artificial Sequence
  chemically synthesized
gttcattatctaagatcaacac

SEQ ID NO: 1176395 - DNA, 22 bp, Artificial Sequence
  chemically synthesized
agctccttcctgagtgttgatc

SEQ ID NO: 1176396 - DNA, 22 bp, Artificial Sequence
  chemically synthesized
attatctaagatcaacactcag

SEQ ID NO: 1176397 - DNA, 22 bp, Artificial Sequence
  chemically synthesized
gcctaagctccttcctgagtgt

SEQ ID NO: 1176398 - DNA, 22 bp, Artificial Sequence
  chemically synthesized
tctaagatcaacactcaggaag

SEQ ID NO: 1176399 - DNA, 22 bp, Artificial Sequence
  chemically synthesized
ttagcctaagctccttcctgag

SEQ ID NO: 1176400 - DNA, 22 bp, Artificial Sequence
  chemically synthesized
attagcctaagctccttcctga

SEQ ID NO: 1176401 - DNA, 22 bp, Artificial Sequence
  chemically synthesized
tattagcctaagctccttcctg

SEQ ID NO: 1176402 - DNA, 22 bp, Artificial Sequence
  chemically synthesized
agatcaacactcaggaaggagc

SEQ ID NO: 1176403 - DNA, 22 bp, Artificial Sequence
  chemically synthesized
aatcattttattagcctaagct

SEQ ID NO: 1176404 - DNA, 22 bp, Artificial Sequence
  chemically synthesized
tgaatcattttattagcctaag

SEQ ID NO: 1176405 - DNA, 22 bp, Artificial Sequence
  chemically synthesized
aggaaggagcttaggctaataa

SEQ ID NO: 1176406 - DNA, 22 bp, Artificial Sequence
  chemically synthesized
ggctctgaatcattttattagc

SEQ ID NO: 1176407 - DNA, 22 bp, Artificial Sequence
  chemically synthesized
tgggctctgaatcattttatta

SEQ ID NO: 1176408 - DNA, 22 bp, Artificial Sequence
  chemically synthesized
ctgggctctgaatcattttatt

SEQ ID NO: 1176409 - DNA, 22 bp, Artificial Sequence
  chemically synthesized
caatttctgggctctgaatcat

SEQ ID NO: 1176410 - DNA, 22 bp, Artificial Sequence
  chemically synthesized
aggctaataaaatgattcagag

SEQ ID NO: 1176411 - DNA, 22 bp, Artificial Sequence
  chemically synthesized
ccaatttctgggctctgaatca

SEQ ID NO: 1176412 - DNA, 22 bp, Artificial Sequence
  chemically synthesized
ggctaataaaatgattcagagc

SEQ ID NO: 1176413 - DNA, 22 bp, Artificial Sequence
  chemically synthesized
tccaatttctgggctctgaatc

SEQ ID NO: 1176414 - DNA, 22 bp, Artificial Sequence
  chemically synthesized
ataaaatgattcagagcccaga

SEQ ID NO: 1176415 - DNA, 22 bp, Artificial Sequence
  chemically synthesized
aacccaagttttccaatttctg

SEQ ID NO: 1176416 - DNA, 22 bp, Artificial Sequence
  chemically synthesized
agagcccagaaattggaaaact

SEQ ID NO: 1176417 - DNA, 22 bp, Artificial Sequence
  chemically synthesized
ataggtatgtcactcaacccaa

SEQ ID NO: 1176418 - DNA, 22 bp, Artificial Sequence
  chemically synthesized
gaaaacttgggttgagtgacat

SEQ ID NO: 1176419 - DNA, 22 bp, Artificial Sequence
  chemically synthesized
gaaactgataggtatgtcactc

SEQ ID NO: 1176420 - DNA, 22 bp, Artificial Sequence
  chemically synthesized
gggttgagtgacatacctatca

SEQ ID NO: 1176421 - DNA, 22 bp, Artificial Sequence
  chemically synthesized
ggttgagtgacatacctatcag

SEQ ID NO: 1176422 - DNA, 22 bp, Artificial Sequence
  chemically synthesized
agtgacatacctatcagtttct

SEQ ID NO: 1176423 - DNA, 22 bp, Artificial Sequence
  chemically synthesized
accaaagtagtatggttagaaa

SEQ ID NO: 1176424 - DNA, 22 bp, Artificial Sequence
  chemically synthesized
tcagtttctaaccatactactt

SEQ ID NO: 1176425 - DNA, 22 bp, Artificial Sequence
  chemically synthesized
aatgagttgaccaaagtagtat

SEQ ID NO: 1176426 - DNA, 22 bp, Artificial Sequence
  chemically synthesized
gaatgagttgaccaaagtagta

SEQ ID NO: 1176427 - DNA, 22 bp, Artificial Sequence
  chemically synthesized
ctaaccatactactttggtcaa

SEQ ID NO: 1176428 - DNA, 22 bp, Artificial Sequence
  chemically synthesized
taaccatactactttggtcaac

SEQ ID NO: 1176429 - DNA, 22 bp, Artificial Sequence
  chemically synthesized
accatactactttggtcaactc

SEQ ID NO: 1176430 - DNA, 22 bp, Artificial Sequence
  chemically synthesized
tatatcttgaatgagttgacca

SEQ ID NO: 1176431 - DNA, 22 bp, Artificial Sequence
  chemically synthesized
atatatcttgaatgagttgacc

SEQ ID NO: 1176432 - DNA, 22 bp, Artificial Sequence
  chemically synthesized
ctttggtcaactcattcaagat

SEQ ID NO: 1176433 - DNA, 22 bp, Artificial Sequence
  chemically synthesized
tggtcaactcattcaagatata

SEQ ID NO: 1176434 - DNA, 22 bp, Artificial Sequence
  chemically synthesized
aaaacaaccttatatatcttga

SEQ ID NO: 1176435 - DNA, 22 bp, Artificial Sequence
  chemically synthesized
ggtcaactcattcaagatatat

SEQ ID NO: 1176436 - DNA, 22 bp, Artificial Sequence
  chemically synthesized
gtcaactcattcaagatatata

SEQ ID NO: 1176437 - DNA, 22 bp, Artificial Sequence
  chemically synthesized
tcaactaaaaacaaccttatat

SEQ ID NO: 1176438 - DNA, 22 bp, Artificial Sequence
  chemically synthesized
tgtcaactaaaaacaaccttat

SEQ ID NO: 1176439 - DNA, 22 bp, Artificial Sequence
  chemically synthesized
attcaagatatataaggttgtt

SEQ ID NO: 1176440 - DNA, 22 bp, Artificial Sequence
  chemically synthesized
actctgtcaactaaaaacaacc

SEQ ID NO: 1176441 - DNA, 22 bp, Artificial Sequence
  chemically synthesized
aagatatataaggttgttttta

SEQ ID NO: 1176442 - DNA, 22 bp, Artificial Sequence
  chemically synthesized
aactctgtcaactaaaaacaac

SEQ ID NO: 1176443 - DNA, 22 bp, Artificial Sequence
  chemically synthesized
taactctgtcaactaaaaacaa

SEQ ID NO: 1176444 - DNA, 22 bp, Artificial Sequence
  chemically synthesized
ttaactctgtcaactaaaaaca

SEQ ID NO: 1176445 - DNA, 22 bp, Artificial Sequence
  chemically synthesized
tttttagttgacagagttaaaa

SEQ ID NO: 1176446 - DNA, 22 bp, Artificial Sequence
  chemically synthesized
ttagttgacagagttaaaaatt

SEQ ID NO: 1176447 - DNA, 22 bp, Artificial Sequence
  chemically synthesized
tagttgacagagttaaaaattt

SEQ ID NO: 1176448 - DNA, 22 bp, Artificial Sequence
  chemically synthesized
agttgacagagttaaaaatttc

SEQ ID NO: 1176449 - DNA, 22 bp, Artificial Sequence
  chemically synthesized
gttgacagagttaaaaatttca

SEQ ID NO: 1176450 - DNA, 22 bp, Artificial Sequence
  chemically synthesized
tgagataaaagatgaaattttt

SEQ ID NO: 1176451 - DNA, 22 bp, Artificial Sequence
  chemically synthesized
gtgagataaaagatgaaatttt

SEQ ID NO: 1176452 - DNA, 22 bp, Artificial Sequence
  chemically synthesized
acagagttaaaaatttcatctt

SEQ ID NO: 1176453 - DNA, 22 bp, Artificial Sequence
  chemically synthesized
cttgtgagataaaagatgaaat

SEQ ID NO: 1176454 - DNA, 22 bp, Artificial Sequence
  chemically synthesized
acttgtgagataaaagatgaaa

SEQ ID NO: 1176455 - DNA, 22 bp, Artificial Sequence
  chemically synthesized
aaaatttcatcttttatctcac

SEQ ID NO: 1176456 - DNA, 22 bp, Artificial Sequence
  chemically synthesized
catcttttatctcacaagtaag

SEQ ID NO: 1176457 - DNA, 22 bp, Artificial Sequence
  chemically synthesized
tgccccagtgagcttacttgtg

SEQ ID NO: 1176458 - DNA, 22 bp, Artificial Sequence
  chemically synthesized
atcttttatctcacaagtaagc

SEQ ID NO: 1176459 - DNA, 22 bp, Artificial Sequence
  chemically synthesized
atgccccagtgagcttacttgt

SEQ ID NO: 1176460 - DNA, 22 bp, Artificial Sequence
  chemically synthesized
tttatgccccagtgagcttact

SEQ ID NO: 1176461 - DNA, 22 bp, Artificial Sequence
  chemically synthesized
ttatctcacaagtaagctcact

SEQ ID NO: 1176462 - DNA, 22 bp, Artificial Sequence
  chemically synthesized
tatctcacaagtaagctcactg

SEQ ID NO: 1176463 - DNA, 22 bp, Artificial Sequence
  chemically synthesized
atctcacaagtaagctcactgg

SEQ ID NO: 1176464 - DNA, 22 bp, Artificial Sequence
  chemically synthesized
tctcacaagtaagctcactggg

SEQ ID NO: 1176465 - DNA, 22 bp, Artificial Sequence
  chemically synthesized
tattatttatgccccagtgagc

SEQ ID NO: 1176466 - DNA, 22 bp, Artificial Sequence
  chemically synthesized
gtattatttatgccccagtgag

SEQ ID NO: 1176467 - DNA, 22 bp, Artificial Sequence
  chemically synthesized
tgtattatttatgccccagtga

SEQ ID NO: 1176468 - DNA, 22 bp, Artificial Sequence
  chemically synthesized
acaagtaagctcactggggcat

SEQ ID NO: 1176469 - DNA, 22 bp, Artificial Sequence
  chemically synthesized
cgtgctttgtattatttatgcc

SEQ ID NO: 1176470 - DNA, 22 bp, Artificial Sequence
  chemically synthesized
acgtgctttgtattatttatgc

SEQ ID NO: 1176471 - DNA, 22 bp, Artificial Sequence
  chemically synthesized
tacgtgctttgtattatttatg

SEQ ID NO: 1176472 - DNA, 22 bp, Artificial Sequence
  chemically synthesized
ttacgtgctttgtattatttat

SEQ ID NO: 1176473 - DNA, 22 bp, Artificial Sequence
  chemically synthesized
actggggcataaataatacaaa

SEQ ID NO: 1176474 - DNA, 22 bp, Artificial Sequence
  chemically synthesized
gggcataaataatacaaagcac

SEQ ID NO: 1176475 - DNA, 22 bp, Artificial Sequence
  chemically synthesized
atatcccttttacgtgctttgt

SEQ ID NO: 1176476 - DNA, 22 bp, Artificial Sequence
  chemically synthesized
taaaatgttcatatccctttta

SEQ ID NO: 1176477 - DNA, 22 bp, Artificial Sequence
  chemically synthesized
ataaaatgttcatatccctttt

SEQ ID NO: 1176478 - DNA, 22 bp, Artificial Sequence
  chemically synthesized
acaccttataaaatgttcatat

SEQ ID NO: 1176479 - DNA, 22 bp, Artificial Sequence
  chemically synthesized
cacaccttataaaatgttcata

SEQ ID NO: 1176480 - DNA, 22 bp, Artificial Sequence
  chemically synthesized
ttcacaccttataaaatgttca

SEQ ID NO: 1176481 - DNA, 22 bp, Artificial Sequence
  chemically synthesized
tgtataagagggattcttcaca

SEQ ID NO: 1176482 - DNA, 22 bp, Artificial Sequence
  chemically synthesized
atgtataagagggattcttcac

SEQ ID NO: 1176483 - DNA, 22 bp, Artificial Sequence
  chemically synthesized
ttatgtataagagggattcttc

SEQ ID NO: 1176484 - DNA, 22 bp, Artificial Sequence
  chemically synthesized
tataaggtgtgaagaatccctc

SEQ ID NO: 1176485 - DNA, 22 bp, Artificial Sequence
  chemically synthesized
ataaggtgtgaagaatccctct

SEQ ID NO: 1176486 - DNA, 22 bp, Artificial Sequence
  chemically synthesized
taaggtgtgaagaatccctctt

SEQ ID NO: 1176487 - DNA, 22 bp, Artificial Sequence
  chemically synthesized
tgctcttatgtataagagggat

SEQ ID NO: 1176488 - DNA, 22 bp, Artificial Sequence
  chemically synthesized
aagaatgtgttatgctcttatg

SEQ ID NO: 1176489 - DNA, 22 bp, Artificial Sequence
  chemically synthesized
aactgaagaatgtgttatgctc

SEQ ID NO: 1176490 - DNA, 22 bp, Artificial Sequence
  chemically synthesized
caactgaagaatgtgttatgct

SEQ ID NO: 1176491 - DNA, 22 bp, Artificial Sequence
  chemically synthesized
ttatacataagagcataacaca

SEQ ID NO: 1176492 - DNA, 22 bp, Artificial Sequence
  chemically synthesized
atacataagagcataacacatt

SEQ ID NO: 1176493 - DNA, 22 bp, Artificial Sequence
  chemically synthesized
cttcaactgaagaatgtgttat

SEQ ID NO: 1176494 - DNA, 22 bp, Artificial Sequence
  chemically synthesized
tacataagagcataacacattc

SEQ ID NO: 1176495 - DNA, 22 bp, Artificial Sequence
  chemically synthesized
ttgcttcaactgaagaatgtgt

SEQ ID NO: 1176496 - DNA, 22 bp, Artificial Sequence
  chemically synthesized
tattgcttcaactgaagaatgt

SEQ ID NO: 1176497 - DNA, 22 bp, Artificial Sequence
  chemically synthesized
ttcagttgaagcaatagagccc

SEQ ID NO: 1176498 - DNA, 22 bp, Artificial Sequence
  chemically synthesized
cagttgaagcaatagagccctt

SEQ ID NO: 1176499 - DNA, 22 bp, Artificial Sequence
  chemically synthesized
agttgaagcaatagagcccttt

SEQ ID NO: 1176500 - DNA, 22 bp, Artificial Sequence
  chemically synthesized
ccagaacaggtagtgaaagggc

SEQ ID NO: 1176501 - DNA, 22 bp, Artificial Sequence
  chemically synthesized
aagcaatagagccctttcacta

SEQ ID NO: 1176502 - DNA, 22 bp, Artificial Sequence
  chemically synthesized
agccattcccagaacaggtagt

SEQ ID NO: 1176503 - DNA, 22 bp, Artificial Sequence
  chemically synthesized
cataagttgagccattcccaga

SEQ ID NO: 1176504 - DNA, 22 bp, Artificial Sequence
  chemically synthesized
tcactacctgttctgggaatgg

SEQ ID NO: 1176505 - DNA, 22 bp, Artificial Sequence
  chemically synthesized
cactacctgttctgggaatggc

SEQ ID NO: 1176506 - DNA, 22 bp, Artificial Sequence
  chemically synthesized
actacctgttctgggaatggct

SEQ ID NO: 1176507 - DNA, 22 bp, Artificial Sequence
  chemically synthesized
cctgttctgggaatggctcaac

SEQ ID NO: 1176508 - DNA, 22 bp, Artificial Sequence
  chemically synthesized
ttctgggaatggctcaacttat

SEQ ID NO: 1176509 - DNA, 22 bp, Artificial Sequence
  chemically synthesized
tgggaatggctcaacttatgta

SEQ ID NO: 1176510 - DNA, 22 bp, Artificial Sequence
  chemically synthesized
ggaatggctcaacttatgtagc

SEQ ID NO: 1176511 - DNA, 22 bp, Artificial Sequence
  chemically synthesized
gtggaaagacaagagcaagtgc

SEQ ID NO: 1176512 - DNA, 22 bp, Artificial Sequence
  chemically synthesized
aacttatgtagcacttgctctt

SEQ ID NO: 1176513 - DNA, 22 bp, Artificial Sequence
  chemically synthesized
tgttcgtggaaagacaagagca

SEQ ID NO: 1176514 - DNA, 22 bp, Artificial Sequence
  chemically synthesized
gtgttcgtggaaagacaagagc

SEQ ID NO: 1176515 - DNA, 22 bp, Artificial Sequence
  chemically synthesized
atgtagcacttgctcttgtctt

SEQ ID NO: 1176516 - DNA, 22 bp, Artificial Sequence
  chemically synthesized
tgtgttcgtggaaagacaagag

SEQ ID NO: 1176517 - DNA, 22 bp, Artificial Sequence
  chemically synthesized
tgtagcacttgctcttgtcttt

SEQ ID NO: 1176518 - DNA, 22 bp, Artificial Sequence
  chemically synthesized
caaactttgtgttcgtggaaag

SEQ ID NO: 1176519 - DNA, 22 bp, Artificial Sequence
  chemically synthesized
gctcttgtctttccacgaacac

SEQ ID NO: 1176520 - DNA, 22 bp, Artificial Sequence
  chemically synthesized
ctcttgtctttccacgaacaca

SEQ ID NO: 1176521 - DNA, 22 bp, Artificial Sequence
  chemically synthesized
agctgcaaactttgtgttcgtg

SEQ ID NO: 1176522 - DNA, 22 bp, Artificial Sequence
  chemically synthesized
cagctgcaaactttgtgttcgt

SEQ ID NO: 1176523 - DNA, 22 bp, Artificial Sequence
  chemically synthesized
ttgtctttccacgaacacaaag

SEQ ID NO: 1176524 - DNA, 22 bp, Artificial Sequence
  chemically synthesized
gtctttccacgaacacaaagtt

SEQ ID NO: 1176525 - DNA, 22 bp, Artificial Sequence
  chemically synthesized
tctttccacgaacacaaagttt

SEQ ID NO: 1176526 - DNA, 22 bp, Artificial Sequence
  chemically synthesized
atgtttcagctgcaaactttgt

SEQ ID NO: 1176527 - DNA, 22 bp, Artificial Sequence
  chemically synthesized
catgtttcagctgcaaactttg

SEQ ID NO: 1176528 - DNA, 22 bp, Artificial Sequence
  chemically synthesized
tccacgaacacaaagtttgcag

SEQ ID NO: 1176529 - DNA, 22 bp, Artificial Sequence
  chemically synthesized
ccacgaacacaaagtttgcagc

SEQ ID NO: 1176530 - DNA, 22 bp, Artificial Sequence
  chemically synthesized
cacgaacacaaagtttgcagct

SEQ ID NO: 1176531 - DNA, 22 bp, Artificial Sequence
  chemically synthesized
ggaagcaggaaagaggtttcat

SEQ ID NO: 1176532 - DNA, 22 bp, Artificial Sequence
  chemically synthesized
gcagctgaaacatgaaacctct

SEQ ID NO: 1176533 - DNA, 22 bp, Artificial Sequence
  chemically synthesized
cagctgaaacatgaaacctctt

SEQ ID NO: 1176534 - DNA, 22 bp, Artificial Sequence
  chemically synthesized
aaacatgaaacctctttcctgc

SEQ ID NO: 1176535 - DNA, 22 bp, Artificial Sequence
  chemically synthesized
gtagattgggaagcaggaaaga

SEQ ID NO: 1176536 - DNA, 22 bp, Artificial Sequence
  chemically synthesized
aaaatctggtagattgggaagc

SEQ ID NO: 1176537 - DNA, 22 bp, Artificial Sequence
  chemically synthesized
tttcctgcttcccaatctacca

SEQ ID NO: 1176538 - DNA, 22 bp, Artificial Sequence
  chemically synthesized
tcctgcttcccaatctaccaga

SEQ ID NO: 1176539 - DNA, 22 bp, Artificial Sequence
  chemically synthesized
cctgcttcccaatctaccagat

SEQ ID NO: 1176540 - DNA, 22 bp, Artificial Sequence
  chemically synthesized
tccatgttgaaaatctggtaga

SEQ ID NO: 1176541 - DNA, 22 bp, Artificial Sequence
  chemically synthesized
ctgcttcccaatctaccagatt

SEQ ID NO: 1176542 - DNA, 22 bp, Artificial Sequence
  chemically synthesized
cttcccaatctaccagattttc

SEQ ID NO: 1176543 - DNA, 22 bp, Artificial Sequence
  chemically synthesized
tattatccatgttgaaaatctg

SEQ ID NO: 1176544 - DNA, 22 bp, Artificial Sequence
  chemically synthesized
cccaatctaccagattttcaac

SEQ ID NO: 1176545 - DNA, 22 bp, Artificial Sequence
  chemically synthesized
ccaatctaccagattttcaaca

SEQ ID NO: 1176546 - DNA, 22 bp, Artificial Sequence
  chemically synthesized
tgttatattatccatgttgaaa

SEQ ID NO: 1176547 - DNA, 22 bp, Artificial Sequence
  chemically synthesized
atgttatattatccatgttgaa

SEQ ID NO: 1176548 - DNA, 22 bp, Artificial Sequence
  chemically synthesized
tatgttatattatccatgttga

SEQ ID NO: 1176549 - DNA, 22 bp, Artificial Sequence
  chemically synthesized
ccagattttcaacatggataat

SEQ ID NO: 1176550 - DNA, 22 bp, Artificial Sequence
  chemically synthesized
tcaacatggataatataacata

SEQ ID NO: 1176551 - DNA, 22 bp, Artificial Sequence
  chemically synthesized
caacatggataatataacataa

SEQ ID NO: 1176552 - DNA, 22 bp, Artificial Sequence
  chemically synthesized
aacatggataatataacataaa

SEQ ID NO: 1176553 - DNA, 22 bp, Artificial Sequence
  chemically synthesized
tggtacagacagataagtcctt

SEQ ID NO: 1176554 - DNA, 22 bp, Artificial Sequence
  chemically synthesized
tatggtacagacagataagtcc

SEQ ID NO: 1176555 - DNA, 22 bp, Artificial Sequence
  chemically synthesized
ctatggtacagacagataagtc

SEQ ID NO: 1176556 - DNA, 22 bp, Artificial Sequence
  chemically synthesized
tttctatggtacagacagataa

SEQ ID NO: 1176557 - DNA, 22 bp, Artificial Sequence
  chemically synthesized
atttctatggtacagacagata

SEQ ID NO: 1176558 - DNA, 22 bp, Artificial Sequence
  chemically synthesized
cttatttctatggtacagacag

SEQ ID NO: 1176559 - DNA, 22 bp, Artificial Sequence
  chemically synthesized
atctgtctgtaccatagaaata

SEQ ID NO: 1176560 - DNA, 22 bp, Artificial Sequence
  chemically synthesized
tctgtctgtaccatagaaataa

SEQ ID NO: 1176561 - DNA, 22 bp, Artificial Sequence
  chemically synthesized
tctgtaccatagaaataagtag

SEQ ID NO: 1176562 - DNA, 22 bp, Artificial Sequence
  chemically synthesized
taccatagaaataagtagtatt

SEQ ID NO: 1176563 - DNA, 22 bp, Artificial Sequence
  chemically synthesized
gaaagccaggcaaaatactact

SEQ ID NO: 1176564 - DNA, 22 bp, Artificial Sequence
  chemically synthesized
ggaaagccaggcaaaatactac

SEQ ID NO: 1176565 - DNA, 22 bp, Artificial Sequence
  chemically synthesized
aggacttggaaagccaggcaaa

SEQ ID NO: 1176566 - DNA, 22 bp, Artificial Sequence
  chemically synthesized
tgaggacttggaaagccaggca

SEQ ID NO: 1176567 - DNA, 22 bp, Artificial Sequence
  chemically synthesized
tgcctggctttccaagtcctca

SEQ ID NO: 1176568 - DNA, 22 bp, Artificial Sequence
  chemically synthesized
gcctggctttccaagtcctcag

SEQ ID NO: 1176569 - DNA, 22 bp, Artificial Sequence
  chemically synthesized
cctggctttccaagtcctcaga

SEQ ID NO: 1176570 - DNA, 22 bp, Artificial Sequence
  chemically synthesized
gctttccaagtcctcagagtct

SEQ ID NO: 1176571 - DNA, 22 bp, Artificial Sequence
  chemically synthesized
tccaagtcctcagagtctcacc

SEQ ID NO: 1176572 - DNA, 22 bp, Artificial Sequence
  chemically synthesized
ccaagtcctcagagtctcacca

SEQ ID NO: 1176573 - DNA, 22 bp, Artificial Sequence
  chemically synthesized
caagtcctcagagtctcaccat

SEQ ID NO: 1176574 - DNA, 22 bp, Artificial Sequence
  chemically synthesized
agaaaaatagggtatggtgaga

SEQ ID NO: 1176575 - DNA, 22 bp, Artificial Sequence
  chemically synthesized
tgagaaaaatagggtatggtga

SEQ ID NO: 1176576 - DNA, 22 bp, Artificial Sequence
  chemically synthesized
agagtctcaccataccctattt

SEQ ID NO: 1176577 - DNA, 22 bp, Artificial Sequence
  chemically synthesized
accataccctatttttctcaga

SEQ ID NO: 1176578 - DNA, 22 bp, Artificial Sequence
  chemically synthesized
ccccaaaatggcaatgaaattc

SEQ ID NO: 1176579 - DNA, 22 bp, Artificial Sequence
  chemically synthesized
tttttctcagaatttcattgcc

SEQ ID NO: 1176580 - DNA, 22 bp, Artificial Sequence
  chemically synthesized
attgccccaaaatggcaatgaa

SEQ ID NO: 1176581 - DNA, 22 bp, Artificial Sequence
  chemically synthesized
ttctcagaatttcattgccatt

SEQ ID NO: 1176582 - DNA, 22 bp, Artificial Sequence
  chemically synthesized
tctcagaatttcattgccattt

SEQ ID NO: 1176583 - DNA, 22 bp, Artificial Sequence
  chemically synthesized
ctcagaatttcattgccatttt

SEQ ID NO: 1176584 - DNA, 22 bp, Artificial Sequence
  chemically synthesized
tcagaatttcattgccattttg

SEQ ID NO: 1176585 - DNA, 22 bp, Artificial Sequence
  chemically synthesized
agaatttcattgccattttggg

SEQ ID NO: 1176586 - DNA, 22 bp, Artificial Sequence
  chemically synthesized
aaaagaattcattgccccaaaa

SEQ ID NO: 1176587 - DNA, 22 bp, Artificial Sequence
  chemically synthesized
tcaaaagaattcattgccccaa

SEQ ID NO: 1176588 - DNA, 22 bp, Artificial Sequence
  chemically synthesized
cattgccattttggggcaatga

SEQ ID NO: 1176589 - DNA, 22 bp, Artificial Sequence
  chemically synthesized
attgccattttggggcaatgaa

SEQ ID NO: 1176590 - DNA, 22 bp, Artificial Sequence
  chemically synthesized
ccattttggggcaatgaattct

SEQ ID NO: 1176591 - DNA, 22 bp, Artificial Sequence
  chemically synthesized
aatcatattctcaaaagaattc

SEQ ID NO: 1176592 - DNA, 22 bp, Artificial Sequence
  chemically synthesized
caatcatattctcaaaagaatt

SEQ ID NO: 1176593 - DNA, 22 bp, Artificial Sequence
  chemically synthesized
tggggcaatgaattcttttgag

SEQ ID NO: 1176594 - DNA, 22 bp, Artificial Sequence
  chemically synthesized
ggggcaatgaattcttttgaga

SEQ ID NO: 1176595 - DNA, 22 bp, Artificial Sequence
  chemically synthesized
gggcaatgaattcttttgagaa

SEQ ID NO: 1176596 - DNA, 22 bp, Artificial Sequence
  chemically synthesized
ttttgagaatatgattgaaatt

SEQ ID NO: 1176597 - DNA, 22 bp, Artificial Sequence
  chemically synthesized
ttgagaatatgattgaaattct

SEQ ID NO: 1176598 - DNA, 22 bp, Artificial Sequence
  chemically synthesized
tgagaatatgattgaaattctg

SEQ ID NO: 1176599 - DNA, 22 bp, Artificial Sequence
  chemically synthesized
gagaatatgattgaaattctgg

SEQ ID NO: 1176600 - DNA, 22 bp, Artificial Sequence
  chemically synthesized
agaatatgattgaaattctgga

SEQ ID NO: 1176601 - DNA, 22 bp, Artificial Sequence
  chemically synthesized
tgtacacatagtgtaaaggatc

SEQ ID NO: 1176602 - DNA, 22 bp, Artificial Sequence
  chemically synthesized
gtgtacacatagtgtaaaggat

SEQ ID NO: 1176603 - DNA, 22 bp, Artificial Sequence
  chemically synthesized
tgtgtacacatagtgtaaagga

SEQ ID NO: 1176604 - DNA, 22 bp, Artificial Sequence
  chemically synthesized
ttgtgtacacatagtgtaaagg

SEQ ID NO: 1176605 - DNA, 22 bp, Artificial Sequence
  chemically synthesized
aaattctggatcctttacacta

SEQ ID NO: 1176606 - DNA, 22 bp, Artificial Sequence
  chemically synthesized
tggatcctttacactatgtgta

SEQ ID NO: 1176607 - DNA, 22 bp, Artificial Sequence
  chemically synthesized
gatcctttacactatgtgtaca

SEQ ID NO: 1176608 - DNA, 22 bp, Artificial Sequence
  chemically synthesized
caaacatttttgtgtacacata

SEQ ID NO: 1176609 - DNA, 22 bp, Artificial Sequence
  chemically synthesized
tacactatgtgtacacaaaaat

SEQ ID NO: 1176610 - DNA, 22 bp, Artificial Sequence
  chemically synthesized
acactatgtgtacacaaaaatg

SEQ ID NO: 1176611 - DNA, 22 bp, Artificial Sequence
  chemically synthesized
cactatgtgtacacaaaaatgt

SEQ ID NO: 1176612 - DNA, 22 bp, Artificial Sequence
  chemically synthesized
acacaatctccaaacatttttg

SEQ ID NO: 1176613 - DNA, 22 bp, Artificial Sequence
  chemically synthesized
tgtgtacacaaaaatgtttgga

SEQ ID NO: 1176614 - DNA, 22 bp, Artificial Sequence
  chemically synthesized
ggagattgtgttagcgggattg

SEQ ID NO: 1176615 - DNA, 22 bp, Artificial Sequence
  chemically synthesized
gagattgtgttagcgggattgt

SEQ ID NO: 1176616 - DNA, 22 bp, Artificial Sequence
  chemically synthesized
tgttagcgggattgtggacgct

SEQ ID NO: 1176617 - DNA, 22 bp, Artificial Sequence
  chemically synthesized
aatgtgcataatagcgtccaca

SEQ ID NO: 1176618 - DNA, 22 bp, Artificial Sequence
  chemically synthesized
ttaaatgtgcataatagcgtcc

SEQ ID NO: 1176619 - DNA, 22 bp, Artificial Sequence
  chemically synthesized
gttaaatgtgcataatagcgtc

SEQ ID NO: 1176620 - DNA, 22 bp, Artificial Sequence
  chemically synthesized
gcgggattgtggacgctattat

SEQ ID NO: 1176621 - DNA, 22 bp, Artificial Sequence
  chemically synthesized
agagtttgttaaatgtgcataa

SEQ ID NO: 1176622 - DNA, 22 bp, Artificial Sequence
  chemically synthesized
tggacgctattatgcacattta

SEQ ID NO: 1176623 - DNA, 22 bp, Artificial Sequence
  chemically synthesized
taaaaccctaagagtttgttaa

SEQ ID NO: 1176624 - DNA, 22 bp, Artificial Sequence
  chemically synthesized
ataaaaccctaagagtttgtta

SEQ ID NO: 1176625 - DNA, 22 bp, Artificial Sequence
  chemically synthesized
ttatgcacatttaacaaactct

SEQ ID NO: 1176626 - DNA, 22 bp, Artificial Sequence
  chemically synthesized
tgcacatttaacaaactcttag

SEQ ID NO: 1176627 - DNA, 22 bp, Artificial Sequence
  chemically synthesized
aacaaactcttagggttttata

SEQ ID NO: 1176628 - DNA, 22 bp, Artificial Sequence
  chemically synthesized
acaaactcttagggttttataa

SEQ ID NO: 1176629 - DNA, 22 bp, Artificial Sequence
  chemically synthesized
ttagggttttataaactgtgat

SEQ ID NO: 1176630 - DNA, 22 bp, Artificial Sequence
  chemically synthesized
agggttttataaactgtgatga

SEQ ID NO: 1176631 - DNA, 22 bp, Artificial Sequence
  chemically synthesized
gggttttataaactgtgatgat

SEQ ID NO: 1176632 - DNA, 22 bp, Artificial Sequence
  chemically synthesized
tataaactgtgatgattgttat

SEQ ID NO: 1176633 - DNA, 22 bp, Artificial Sequence
  chemically synthesized
ataaactgtgatgattgttata

SEQ ID NO: 1176634 - DNA, 22 bp, Artificial Sequence
  chemically synthesized
taaactgtgatgattgttatac

SEQ ID NO: 1176635 - DNA, 22 bp, Artificial Sequence
  chemically synthesized
tgatgattgttataccatttta

SEQ ID NO: 1176636 - DNA, 22 bp, Artificial Sequence
  chemically synthesized
ttataccattttatttatctgc

SEQ ID NO: 1176637 - DNA, 22 bp, Artificial Sequence
  chemically synthesized
taccattttatttatctgcacc

SEQ ID NO: 1176638 - DNA, 22 bp, Artificial Sequence
  chemically synthesized
taatgataagccggtgcagata

SEQ ID NO: 1176639 - DNA, 22 bp, Artificial Sequence
  chemically synthesized
gtaatgataagccggtgcagat

SEQ ID NO: 1176640 - DNA, 22 bp, Artificial Sequence
  chemically synthesized
agcttgtaatgataagccggtg

SEQ ID NO: 1176641 - DNA, 22 bp, Artificial Sequence
  chemically synthesized
tatttatctgcaccggcttatc

SEQ ID NO: 1176642 - DNA, 22 bp, Artificial Sequence
  chemically synthesized
atttatctgcaccggcttatca

SEQ ID NO: 1176643 - DNA, 22 bp, Artificial Sequence
  chemically synthesized
tttatctgcaccggcttatcat

SEQ ID NO: 1176644 - DNA, 22 bp, Artificial Sequence
  chemically synthesized
actgagcttgtaatgataagcc

SEQ ID NO: 1176645 - DNA, 22 bp, Artificial Sequence
  chemically synthesized
atctgcaccggcttatcattac

SEQ ID NO: 1176646 - DNA, 22 bp, Artificial Sequence
  chemically synthesized
tctgcaccggcttatcattaca

SEQ ID NO: 1176647 - DNA, 22 bp, Artificial Sequence
  chemically synthesized
caccggcttatcattacaagct

SEQ ID NO: 1176648 - DNA, 22 bp, Artificial Sequence
  chemically synthesized
atcattacaagctcagttaaca

SEQ ID NO: 1176649 - DNA, 22 bp, Artificial Sequence
  chemically synthesized
aaggatggagaatgttaactga

SEQ ID NO: 1176650 - DNA, 22 bp, Artificial Sequence
  chemically synthesized
tcattacaagctcagttaacat

SEQ ID NO: 1176651 - DNA, 22 bp, Artificial Sequence
  chemically synthesized
ctgaaggatggagaatgttaac

SEQ ID NO: 1176652 - DNA, 22 bp, Artificial Sequence
  chemically synthesized
caagctcagttaacattctcca

SEQ ID NO: 1176653 - DNA, 22 bp, Artificial Sequence
  chemically synthesized
attactgaaggatggagaatgt

SEQ ID NO: 1176654 - DNA, 22 bp, Artificial Sequence
  chemically synthesized
ctaattactgaaggatggagaa

SEQ ID NO: 1176655 - DNA, 22 bp, Artificial Sequence
  chemically synthesized
agttaacattctccatccttca

SEQ ID NO: 1176656 - DNA, 22 bp, Artificial Sequence
  chemically synthesized
acattactaattactgaaggat

SEQ ID NO: 1176657 - DNA, 22 bp, Artificial Sequence
  chemically synthesized
acattctccatccttcagtaat

SEQ ID NO: 1176658 - DNA, 22 bp, Artificial Sequence
  chemically synthesized
tccatccttcagtaattagtaa

SEQ ID NO: 1176659 - DNA, 22 bp, Artificial Sequence
  chemically synthesized
catccttcagtaattagtaatg

SEQ ID NO: 1176660 - DNA, 22 bp, Artificial Sequence
  chemically synthesized
aagacacgggctaacattacta

SEQ ID NO: 1176661 - DNA, 22 bp, Artificial Sequence
  chemically synthesized
aaagacacgggctaacattact

SEQ ID NO: 1176662 - DNA, 22 bp, Artificial Sequence
  chemically synthesized
taaagacacgggctaacattac

SEQ ID NO: 1176663 - DNA, 22 bp, Artificial Sequence
  chemically synthesized
ttaaagacacgggctaacatta

SEQ ID NO: 1176664 - DNA, 22 bp, Artificial Sequence
  chemically synthesized
tttaaagacacgggctaacatt

SEQ ID NO: 1176665 - DNA, 22 bp, Artificial Sequence
  chemically synthesized
cagtaattagtaatgttagccc

SEQ ID NO: 1176666 - DNA, 22 bp, Artificial Sequence
  chemically synthesized
agtaattagtaatgttagcccg

SEQ ID NO: 1176667 - DNA, 22 bp, Artificial Sequence
  chemically synthesized
ttttttaaagacacgggctaac

SEQ ID NO: 1176668 - DNA, 22 bp, Artificial Sequence
  chemically synthesized
gttttttaaagacacgggctaa

SEQ ID NO: 1176669 - DNA, 22 bp, Artificial Sequence
  chemically synthesized
tgttttttaaagacacgggcta

SEQ ID NO: 1176670 - DNA, 22 bp, Artificial Sequence
  chemically synthesized
ttttgttttttaaagacacggg

SEQ ID NO: 1176671 - DNA, 22 bp, Artificial Sequence
  chemically synthesized
gttttgttttttaaagacacgg

SEQ ID NO: 1176672 - DNA, 22 bp, Artificial Sequence
  chemically synthesized
gtaatgttagcccgtgtcttta

SEQ ID NO: 1176673 - DNA, 22 bp, Artificial Sequence
  chemically synthesized
gcccgtgtctttaaaaaacaaa

SEQ ID NO: 1176674 - DNA, 22 bp, Artificial Sequence
  chemically synthesized
aatacatatgtgtttgttttgt

SEQ ID NO: 1176675 - DNA, 22 bp, Artificial Sequence
  chemically synthesized
taaaaaacaaaacaaacacata

SEQ ID NO: 1176676 - DNA, 22 bp, Artificial Sequence
  chemically synthesized
aaaaaacaaaacaaacacatat

SEQ ID NO: 1176677 - DNA, 22 bp, Artificial Sequence
  chemically synthesized
aaaaacaaaacaaacacatatg

SEQ ID NO: 1176678 - DNA, 22 bp, Artificial Sequence
  chemically synthesized
agatatataatcagaggacatc

SEQ ID NO: 1176679 - DNA, 22 bp, Artificial Sequence
  chemically synthesized
cattaagatatataatcagagg

SEQ ID NO: 1176680 - DNA, 22 bp, Artificial Sequence
  chemically synthesized
aggtatgatgtcctctgattat

SEQ ID NO: 1176681 - DNA, 22 bp, Artificial Sequence
  chemically synthesized
taaaataaaatactacattaag

SEQ ID NO: 1176682 - DNA, 22 bp, Artificial Sequence
  chemically synthesized
tgattatatatcttaatgtagt

SEQ ID NO: 1176683 - DNA, 22 bp, Artificial Sequence
  chemically synthesized
attatatatcttaatgtagtat

SEQ ID NO: 1176684 - DNA, 22 bp, Artificial Sequence
  chemically synthesized
tatatcttaatgtagtatttta

SEQ ID NO: 1176685 - DNA, 22 bp, Artificial Sequence
  chemically synthesized
aatgtagtattttattttatag

SEQ ID NO: 1176686 - DNA, 22 bp, Artificial Sequence
  chemically synthesized
gtaaatagtacactataaaata

SEQ ID NO: 1176687 - DNA, 22 bp, Artificial Sequence
  chemically synthesized
atgtagtattttattttatagt

SEQ ID NO: 1176688 - DNA, 22 bp, Artificial Sequence
  chemically synthesized
gcagaactggtaaatagtacac

SEQ ID NO: 1176689 - DNA, 22 bp, Artificial Sequence
  chemically synthesized
tattttatagtgtactatttac

SEQ ID NO: 1176690 - DNA, 22 bp, Artificial Sequence
  chemically synthesized
attttatagtgtactatttacc

SEQ ID NO: 1176691 - DNA, 22 bp, Artificial Sequence
  chemically synthesized
ttttatagtgtactatttacca

SEQ ID NO: 1176692 - DNA, 22 bp, Artificial Sequence
  chemically synthesized
acactggcagaactggtaaata

SEQ ID NO: 1176693 - DNA, 22 bp, Artificial Sequence
  chemically synthesized
tatagtgtactatttaccagtt

SEQ ID NO: 1176694 - DNA, 22 bp, Artificial Sequence
  chemically synthesized
atagtgtactatttaccagttc

SEQ ID NO: 1176695 - DNA, 22 bp, Artificial Sequence
  chemically synthesized
tagtgtactatttaccagttct

SEQ ID NO: 1176696 - DNA, 22 bp, Artificial Sequence
  chemically synthesized
cggacaatgattaacactggca

SEQ ID NO: 1176697 - DNA, 22 bp, Artificial Sequence
  chemically synthesized
tttaccagttctgccagtgtta

SEQ ID NO: 1176698 - DNA, 22 bp, Artificial Sequence
  chemically synthesized
accagttctgccagtgttaatc

SEQ ID NO: 1176699 - DNA, 22 bp, Artificial Sequence
  chemically synthesized
attacggacaatgattaacact

SEQ ID NO: 1176700 - DNA, 22 bp, Artificial Sequence
  chemically synthesized
ccagttctgccagtgttaatca

SEQ ID NO: 1176701 - DNA, 22 bp, Artificial Sequence
  chemically synthesized
taattacggacaatgattaaca

SEQ ID NO: 1176702 - DNA, 22 bp, Artificial Sequence
  chemically synthesized
tgccagtgttaatcattgtccg

SEQ ID NO: 1176703 - DNA, 22 bp, Artificial Sequence
  chemically synthesized
ccagtgttaatcattgtccgta

SEQ ID NO: 1176704 - DNA, 22 bp, Artificial Sequence
  chemically synthesized
atcattgtccgtaattagaata

SEQ ID NO: 1176705 - DNA, 22 bp, Artificial Sequence
  chemically synthesized
aagataggaaataatattctaa

SEQ ID NO: 1176706 - DNA, 22 bp, Artificial Sequence
  chemically synthesized
tccgtaattagaatattatttc

SEQ ID NO: 1176707 - DNA, 22 bp, Artificial Sequence
  chemically synthesized
atagagaaaactgaagatagga

SEQ ID NO: 1176708 - DNA, 22 bp, Artificial Sequence
  chemically synthesized
aatagagaaaactgaagatagg

SEQ ID NO: 1176709 - DNA, 22 bp, Artificial Sequence
  chemically synthesized
gaatattatttcctatcttcag

SEQ ID NO: 1176710 - DNA, 22 bp, Artificial Sequence
  chemically synthesized
tttcctatcttcagttttctct

SEQ ID NO: 1176711 - DNA, 22 bp, Artificial Sequence
  chemically synthesized
cctatcttcagttttctctatt

SEQ ID NO: 1176712 - DNA, 22 bp, Artificial Sequence
  chemically synthesized
ctatcttcagttttctctatta

SEQ ID NO: 1176713 - DNA, 22 bp, Artificial Sequence
  chemically synthesized
aaaaatcacaatttaatagaga

SEQ ID NO: 1176714 - DNA, 22 bp, Artificial Sequence
  chemically synthesized
caaaaatcacaatttaatagag

SEQ ID NO: 1176715 - DNA, 22 bp, Artificial Sequence
  chemically synthesized
tcttcagttttctctattaaat

SEQ ID NO: 1176716 - DNA, 22 bp, Artificial Sequence
  chemically synthesized
cagttttctctattaaattgtg

SEQ ID NO: 1176717 - DNA, 22 bp, Artificial Sequence
  chemically synthesized
agttttctctattaaattgtga

SEQ ID NO: 1176718 - DNA, 22 bp, Artificial Sequence
  chemically synthesized
tctctattaaattgtgattttt

SEQ ID NO: 1176719 - DNA, 22 bp, Artificial Sequence
  chemically synthesized
ctctattaaattgtgatttttg

SEQ ID NO: 1176720 - DNA, 22 bp, Artificial Sequence
  chemically synthesized
tctattaaattgtgatttttga

SEQ ID NO: 1176721 - DNA, 22 bp, Artificial Sequence
  chemically synthesized
tattaaattgtgatttttgaag

SEQ ID NO: 1176722 - DNA, 22 bp, Artificial Sequence
  chemically synthesized
ttaaattgtgatttttgaagac

SEQ ID NO: 1176723 - DNA, 22 bp, Artificial Sequence
  chemically synthesized
aattgtgatttttgaagaccat

SEQ ID NO: 1176724 - DNA, 22 bp, Artificial Sequence
  chemically synthesized
tgatttttgaagaccatgtcac

SEQ ID NO: 1176725 - DNA, 22 bp, Artificial Sequence
  chemically synthesized
ttgaagaccatgtcactatttt

SEQ ID NO: 1176726 - DNA, 22 bp, Artificial Sequence
  chemically synthesized
tgaagaccatgtcactattttc

SEQ ID NO: 1176727 - DNA, 22 bp, Artificial Sequence
  chemically synthesized
gaagaccatgtcactattttcc

SEQ ID NO: 1176728 - DNA, 22 bp, Artificial Sequence
  chemically synthesized
aagaccatgtcactattttcct

SEQ ID NO: 1176729 - DNA, 22 bp, Artificial Sequence
  chemically synthesized
aataaatgaaaatcaggaaaat

SEQ ID NO: 1176730 - DNA, 22 bp, Artificial Sequence
  chemically synthesized
caataaatgaaaatcaggaaaa

SEQ ID NO: 1176731 - DNA, 22 bp, Artificial Sequence
  chemically synthesized
aatttcaataaatgaaaatcag

SEQ ID NO: 1176732 - DNA, 22 bp, Artificial Sequence
  chemically synthesized
caatttcaataaatgaaaatca

SEQ ID NO: 1176733 - DNA, 22 bp, Artificial Sequence
  chemically synthesized
tcaatttcaataaatgaaaatc

SEQ ID NO: 1176734 - DNA, 22 bp, Artificial Sequence
  chemically synthesized
ttcaatttcaataaatgaaaat

SEQ ID NO: 1176735 - DNA, 22 bp, Artificial Sequence
  chemically synthesized
ttttcctgattttcatttattg

SEQ ID NO: 1176736 - DNA, 22 bp, Artificial Sequence
  chemically synthesized
tcctgattttcatttattgaaa

SEQ ID NO: 1176737 - DNA, 22 bp, Artificial Sequence
  chemically synthesized
cctgattttcatttattgaaat

SEQ ID NO: 1176738 - DNA, 22 bp, Artificial Sequence
  chemically synthesized
ctgattttcatttattgaaatt

SEQ ID NO: 1176739 - DNA, 22 bp, Artificial Sequence
  chemically synthesized
catatatttttcaatttcaata

SEQ ID NO: 1176740 - DNA, 22 bp, Artificial Sequence
  chemically synthesized
acatatatttttcaatttcaat

SEQ ID NO: 1176741 - DNA, 22 bp, Artificial Sequence
  chemically synthesized
attttcatttattgaaattgaa

SEQ ID NO: 1176742 - DNA, 22 bp, Artificial Sequence
  chemically synthesized
ttacatatatttttcaatttca

SEQ ID NO: 1176743 - DNA, 22 bp, Artificial Sequence
  chemically synthesized
tcatttattgaaattgaaaaat

SEQ ID NO: 1176744 - DNA, 22 bp, Artificial Sequence
  chemically synthesized
catttattgaaattgaaaaata

SEQ ID NO: 1176745 - DNA, 22 bp, Artificial Sequence
  chemically synthesized
atttattgaaattgaaaaatat

SEQ ID NO: 1176746 - DNA, 22 bp, Artificial Sequence
  chemically synthesized
attgaaattgaaaaatatatgt

SEQ ID NO: 1176747 - DNA, 22 bp, Artificial Sequence
  chemically synthesized
ttgaaattgaaaaatatatgta

SEQ ID NO: 1176748 - DNA, 22 bp, Artificial Sequence
  chemically synthesized
aaattgaaaaatatatgtaaga

SEQ ID NO: 1176749 - DNA, 22 bp, Artificial Sequence
  chemically synthesized
aaaaatatatgtaagagttttt

SEQ ID NO: 1176750 - DNA, 22 bp, Artificial Sequence
  chemically synthesized
aatgtcaataaatgaaaaactc

SEQ ID NO: 1176751 - DNA, 22 bp, Artificial Sequence
  chemically synthesized
aaatgtcaataaatgaaaaact

SEQ ID NO: 1176752 - DNA, 22 bp, Artificial Sequence
  chemically synthesized
taaatgtcaataaatgaaaaac

SEQ ID NO: 1176753 - DNA, 22 bp, Artificial Sequence
  chemically synthesized
ttaaatgtcaataaatgaaaaa

SEQ ID NO: 1176754 - DNA, 22 bp, Artificial Sequence
  chemically synthesized
catatatttttaaatgtcaata

SEQ ID NO: 1176755 - DNA, 22 bp, Artificial Sequence
  chemically synthesized
acatatatttttaaatgtcaat

SEQ ID NO: 1176756 - DNA, 22 bp, Artificial Sequence
  chemically synthesized
tacatatatttttaaatgtcaa

SEQ ID NO: 1176757 - DNA, 22 bp, Artificial Sequence
  chemically synthesized
ttacatatatttttaaatgtca

SEQ ID NO: 1176758 - DNA, 22 bp, Artificial Sequence
  chemically synthesized
ttttacatatatttttaaatgt

SEQ ID NO: 1176759 - DNA, 22 bp, Artificial Sequence
  chemically synthesized
ttcatttattgacatttaaaaa

SEQ ID NO: 1176760 - DNA, 22 bp, Artificial Sequence
  chemically synthesized
tcatttattgacatttaaaaat

SEQ ID NO: 1176761 - DNA, 22 bp, Artificial Sequence
  chemically synthesized
catttattgacatttaaaaata

SEQ ID NO: 1176762 - DNA, 22 bp, Artificial Sequence
  chemically synthesized
atttattgacatttaaaaatat

SEQ ID NO: 1176763 - DNA, 22 bp, Artificial Sequence
  chemically synthesized
attgacatttaaaaatatatgt

SEQ ID NO: 1176764 - DNA, 22 bp, Artificial Sequence
  chemically synthesized
ttgacatttaaaaatatatgta

SEQ ID NO: 1176765 - DNA, 22 bp, Artificial Sequence
  chemically synthesized
acatttaaaaatatatgtaaaa

SEQ ID NO: 1176766 - DNA, 22 bp, Artificial Sequence
  chemically synthesized
aaaatgtaaaactcttttacat

SEQ ID NO: 1176767 - DNA, 22 bp, Artificial Sequence
  chemically synthesized
aaaaatgtaaaactcttttaca

SEQ ID NO: 1176768 - DNA, 22 bp, Artificial Sequence
  chemically synthesized
aaaaatatatgtaaaagagttt

SEQ ID NO: 1176769 - DNA, 22 bp, Artificial Sequence
  chemically synthesized
aaaatatatgtaaaagagtttt

SEQ ID NO: 1176770 - DNA, 22 bp, Artificial Sequence
  chemically synthesized
tacatttttaaattacatgttt

SEQ ID NO: 1176771 - DNA, 22 bp, Artificial Sequence
  chemically synthesized
acatttttaaattacatgtttt

SEQ ID NO: 1176772 - DNA, 22 bp, Artificial Sequence
  chemically synthesized
catttttaaattacatgtttta

SEQ ID NO: 1176773 - DNA, 22 bp, Artificial Sequence
  chemically synthesized
ttaaattacatgttttatttat

SEQ ID NO: 1176774 - DNA, 22 bp, Artificial Sequence
  chemically synthesized
aaacatgcaaaaataaataaaa

SEQ ID NO: 1176775 - DNA, 22 bp, Artificial Sequence
  chemically synthesized
taaattacatgttttatttatt

SEQ ID NO: 1176776 - DNA, 22 bp, Artificial Sequence
  chemically synthesized
aaaacatgcaaaaataaataaa

SEQ ID NO: 1176777 - DNA, 22 bp, Artificial Sequence
  chemically synthesized
aaattacatgttttatttattt

SEQ ID NO: 1176778 - DNA, 22 bp, Artificial Sequence
  chemically synthesized
taaaacatgcaaaaataaataa

SEQ ID NO: 1176779 - DNA, 22 bp, Artificial Sequence
  chemically synthesized
aattacatgttttatttatttt

SEQ ID NO: 1176780 - DNA, 22 bp, Artificial Sequence
  chemically synthesized
catgttttatttatttttgcat

SEQ ID NO: 1176781 - DNA, 22 bp, Artificial Sequence
  chemically synthesized
catattttaaaacatgcaaaaa

SEQ ID NO: 1176782 - DNA, 22 bp, Artificial Sequence
  chemically synthesized
tatttatttttgcatgttttaa

SEQ ID NO: 1176783 - DNA, 22 bp, Artificial Sequence
  chemically synthesized
atttatttttgcatgttttaaa

SEQ ID NO: 1176784 - DNA, 22 bp, Artificial Sequence
  chemically synthesized
tttatttttgcatgttttaaaa

SEQ ID NO: 1176785 - DNA, 22 bp, Artificial Sequence
  chemically synthesized
atttttgcatgttttaaaatat

SEQ ID NO: 1176786 - DNA, 22 bp, Artificial Sequence
  chemically synthesized
tttttgcatgttttaaaatatg

SEQ ID NO: 1176787 - DNA, 22 bp, Artificial Sequence
  chemically synthesized
tcagtgaaattacatattttaa

SEQ ID NO: 1176788 - DNA, 22 bp, Artificial Sequence
  chemically synthesized
gtcagtgaaattacatatttta

SEQ ID NO: 1176789 - DNA, 22 bp, Artificial Sequence
  chemically synthesized
ttgcatgttttaaaatatgtaa

SEQ ID NO: 1176790 - DNA, 22 bp, Artificial Sequence
  chemically synthesized
tgcatgttttaaaatatgtaat

SEQ ID NO: 1176791 - DNA, 22 bp, Artificial Sequence
  chemically synthesized
gcatgttttaaaatatgtaatt

SEQ ID NO: 1176792 - DNA, 22 bp, Artificial Sequence
  chemically synthesized
atttgtcagtgaaattacatat

SEQ ID NO: 1176793 - DNA, 22 bp, Artificial Sequence
  chemically synthesized
catgttttaaaatatgtaattt

SEQ ID NO: 1176794 - DNA, 22 bp, Artificial Sequence
  chemically synthesized
catttgtcagtgaaattacata

SEQ ID NO: 1176795 - DNA, 22 bp, Artificial Sequence
  chemically synthesized
tcatttgtcagtgaaattacat

SEQ ID NO: 1176796 - DNA, 22 bp, Artificial Sequence
  chemically synthesized
aattttcatttgtcagtgaaat

SEQ ID NO: 1176797 - DNA, 22 bp, Artificial Sequence
  chemically synthesized
taaaatatgtaatttcactgac

SEQ ID NO: 1176798 - DNA, 22 bp, Artificial Sequence
  chemically synthesized
aaaatatgtaatttcactgaca

SEQ ID NO: 1176799 - DNA, 22 bp, Artificial Sequence
  chemically synthesized
tgaattttcatttgtcagtgaa

SEQ ID NO: 1176800 - DNA, 22 bp, Artificial Sequence
  chemically synthesized
aaatatgtaatttcactgacaa

SEQ ID NO: 1176801 - DNA, 22 bp, Artificial Sequence
  chemically synthesized
tctgaattttcatttgtcagtg

SEQ ID NO: 1176802 - DNA, 22 bp, Artificial Sequence
  chemically synthesized
ctctgaattttcatttgtcagt

SEQ ID NO: 1176803 - DNA, 22 bp, Artificial Sequence
  chemically synthesized
atttctctgaattttcatttgt

SEQ ID NO: 1176804 - DNA, 22 bp, Artificial Sequence
  chemically synthesized
catttctctgaattttcatttg

SEQ ID NO: 1176805 - DNA, 22 bp, Artificial Sequence
  chemically synthesized
cactgacaaatgaaaattcaga

SEQ ID NO: 1176806 - DNA, 22 bp, Artificial Sequence
  chemically synthesized
actgacaaatgaaaattcagag

SEQ ID NO: 1176807 - DNA, 22 bp, Artificial Sequence
  chemically synthesized
taggagtttcatttctctgaat

SEQ ID NO: 1176808 - DNA, 22 bp, Artificial Sequence
  chemically synthesized
ataggagtttcatttctctgaa

SEQ ID NO: 1176809 - DNA, 22 bp, Artificial Sequence
  chemically synthesized
acaaatgaaaattcagagaaat

SEQ ID NO: 1176810 - DNA, 22 bp, Artificial Sequence
  chemically synthesized
tataggagtttcatttctctga

SEQ ID NO: 1176811 - DNA, 22 bp, Artificial Sequence
  chemically synthesized
attttataggagtttcatttct

SEQ ID NO: 1176812 - DNA, 22 bp, Artificial Sequence
  chemically synthesized
aattaattttataggagtttca

SEQ ID NO: 1176813 - DNA, 22 bp, Artificial Sequence
  chemically synthesized
caattaattttataggagtttc

SEQ ID NO: 1176814 - DNA, 22 bp, Artificial Sequence
  chemically synthesized
tcaattaattttataggagttt

SEQ ID NO: 1176815 - DNA, 22 bp, Artificial Sequence
  chemically synthesized
ttcaattaattttataggagtt

SEQ ID NO: 1176816 - DNA, 22 bp, Artificial Sequence
  chemically synthesized
agagaaatgaaactcctataaa

SEQ ID NO: 1176817 - DNA, 22 bp, Artificial Sequence
  chemically synthesized
ttttcaattaattttataggag

SEQ ID NO: 1176818 - DNA, 22 bp, Artificial Sequence
  chemically synthesized
gactcttttcaattaattttat

SEQ ID NO: 1176819 - DNA, 22 bp, Artificial Sequence
  chemically synthesized
cactagactcttttcaattaat

SEQ ID NO: 1176820 - DNA, 22 bp, Artificial Sequence
  chemically synthesized
acactagactcttttcaattaa

SEQ ID NO: 1176821 - DNA, 22 bp, Artificial Sequence
  chemically synthesized
tacactagactcttttcaatta

SEQ ID NO: 1176822 - DNA, 22 bp, Artificial Sequence
  chemically synthesized
ctataaaattaattgaaaagag

SEQ ID NO: 1176823 - DNA, 22 bp, Artificial Sequence
  chemically synthesized
taaaattaattgaaaagagtct

SEQ ID NO: 1176824 - DNA, 22 bp, Artificial Sequence
  chemically synthesized
agaatattttacactagactct

SEQ ID NO: 1176825 - DNA, 22 bp, Artificial Sequence
  chemically synthesized
attgaaaagagtctagtgtaaa

SEQ ID NO: 1176826 - DNA, 22 bp, Artificial Sequence
  chemically synthesized
tattcagaatattttacactag

SEQ ID NO: 1176827 - DNA, 22 bp, Artificial Sequence
  chemically synthesized
aaaagagtctagtgtaaaatat

SEQ ID NO: 1176828 - DNA, 22 bp, Artificial Sequence
  chemically synthesized
gaacaaaggttatattcagaat

SEQ ID NO: 1176829 - DNA, 22 bp, Artificial Sequence
  chemically synthesized
agaacaaaggttatattcagaa

SEQ ID NO: 1176830 - DNA, 22 bp, Artificial Sequence
  chemically synthesized
gtgtaaaatattctgaatataa

SEQ ID NO: 1176831 - DNA, 22 bp, Artificial Sequence
  chemically synthesized
tatatgtacttagaacaaaggt

SEQ ID NO: 1176832 - DNA, 22 bp, Artificial Sequence
  chemically synthesized
tgaatataacctttgttctaag

SEQ ID NO: 1176833 - DNA, 22 bp, Artificial Sequence
  chemically synthesized
aatataacctttgttctaagta

SEQ ID NO: 1176834 - DNA, 22 bp, Artificial Sequence
  chemically synthesized
tacatctatatatgtacttaga

SEQ ID NO: 1176835 - DNA, 22 bp, Artificial Sequence
  chemically synthesized
tgtggttatacatctatatatg

SEQ ID NO: 1176836 - DNA, 22 bp, Artificial Sequence
  chemically synthesized
tgttctaagtacatatatagat

SEQ ID NO: 1176837 - DNA, 22 bp, Artificial Sequence
  chemically synthesized
gtgtggttatacatctatatat

SEQ ID NO: 1176838 - DNA, 22 bp, Artificial Sequence
  chemically synthesized
gttctaagtacatatatagatg

SEQ ID NO: 1176839 - DNA, 22 bp, Artificial Sequence
  chemically synthesized
ttctaagtacatatatagatgt

SEQ ID NO: 1176840 - DNA, 22 bp, Artificial Sequence
  chemically synthesized
tttgtgtggttatacatctata

SEQ ID NO: 1176841 - DNA, 22 bp, Artificial Sequence
  chemically synthesized
taagtacatatatagatgtata

SEQ ID NO: 1176842 - DNA, 22 bp, Artificial Sequence
  chemically synthesized
agtacatatatagatgtataac

SEQ ID NO: 1176843 - DNA, 22 bp, Artificial Sequence
  chemically synthesized
aaaaaataaattatttgtgtgg

SEQ ID NO: 1176844 - DNA, 22 bp, Artificial Sequence
  chemically synthesized
gaaaaaataaattatttgtgtg

SEQ ID NO: 1176845 - DNA, 22 bp, Artificial Sequence
  chemically synthesized
tgaaaaaataaattatttgtgt

SEQ ID NO: 1176846 - DNA, 22 bp, Artificial Sequence
  chemically synthesized
gttttgaaaaaataaattattt

SEQ ID NO: 1176847 - DNA, 22 bp, Artificial Sequence
  chemically synthesized
tgactggttttgaaaaaataaa

SEQ ID NO: 1176848 - DNA, 22 bp, Artificial Sequence
  chemically synthesized
agacaacattgtgactggtttt

SEQ ID NO: 1176849 - DNA, 22 bp, Artificial Sequence
  chemically synthesized
attttttcaaaaccagtcacaa

SEQ ID NO: 1176850 - DNA, 22 bp, Artificial Sequence
  chemically synthesized
ttttttcaaaaccagtcacaat

SEQ ID NO: 1176851 - DNA, 22 bp, Artificial Sequence
  chemically synthesized
tttcaaaaccagtcacaatgtt

SEQ ID NO: 1176852 - DNA, 22 bp, Artificial Sequence
  chemically synthesized
ttcaaaaccagtcacaatgttg

SEQ ID NO: 1176853 - DNA, 22 bp, Artificial Sequence
  chemically synthesized
tcaaaaccagtcacaatgttgt

SEQ ID NO: 1176854 - DNA, 22 bp, Artificial Sequence
  chemically synthesized
caaaaccagtcacaatgttgtc

SEQ ID NO: 1176855 - DNA, 22 bp, Artificial Sequence
  chemically synthesized
aaaaccagtcacaatgttgtct

SEQ ID NO: 1176856 - DNA, 22 bp, Artificial Sequence
  chemically synthesized
aaaatgtagctaagacaacatt

SEQ ID NO: 1176857 - DNA, 22 bp, Artificial Sequence
  chemically synthesized
aataactgaaaatgtagctaag

SEQ ID NO: 1176858 - DNA, 22 bp, Artificial Sequence
  chemically synthesized
caatacattaaataactgaaaa

SEQ ID NO: 1176859 - DNA, 22 bp, Artificial Sequence
  chemically synthesized
tcttagctacattttcagttat

SEQ ID NO: 1176860 - DNA, 22 bp, Artificial Sequence
  chemically synthesized
acaatacattaaataactgaaa

SEQ ID NO: 1176861 - DNA, 22 bp, Artificial Sequence
  chemically synthesized
tacaatacattaaataactgaa

SEQ ID NO: 1176862 - DNA, 22 bp, Artificial Sequence
  chemically synthesized
ttacaatacattaaataactga

SEQ ID NO: 1176863 - DNA, 22 bp, Artificial Sequence
  chemically synthesized
agctacattttcagttatttaa

SEQ ID NO: 1176864 - DNA, 22 bp, Artificial Sequence
  chemically synthesized
gctacattttcagttatttaat

SEQ ID NO: 1176865 - DNA, 22 bp, Artificial Sequence
  chemically synthesized
cattttcagttatttaatgtat

SEQ ID NO: 1176866 - DNA, 22 bp, Artificial Sequence
  chemically synthesized
tcagttatttaatgtattgtaa

SEQ ID NO: 1176867 - DNA, 22 bp, Artificial Sequence
  chemically synthesized
catggcatatttttacaataca

SEQ ID NO: 1176868 - DNA, 22 bp, Artificial Sequence
  chemically synthesized
cagttatttaatgtattgtaaa

SEQ ID NO: 1176869 - DNA, 22 bp, Artificial Sequence
  chemically synthesized
agttatttaatgtattgtaaaa

SEQ ID NO: 1176870 - DNA, 22 bp, Artificial Sequence
  chemically synthesized
attgcatggcatatttttacaa

SEQ ID NO: 1176871 - DNA, 22 bp, Artificial Sequence
  chemically synthesized
aattgcatggcatatttttaca

SEQ ID NO: 1176872 - DNA, 22 bp, Artificial Sequence
  chemically synthesized
tttaatgtattgtaaaaatatg

SEQ ID NO: 1176873 - DNA, 22 bp, Artificial Sequence
  chemically synthesized
aatgtattgtaaaaatatgcca

SEQ ID NO: 1176874 - DNA, 22 bp, Artificial Sequence
  chemically synthesized
atgtattgtaaaaatatgccat

SEQ ID NO: 1176875 - DNA, 22 bp, Artificial Sequence
  chemically synthesized
taaaaatatgccatgcaattaa

SEQ ID NO: 1176876 - DNA, 22 bp, Artificial Sequence
  chemically synthesized
agatataaaagagtttaattgc

SEQ ID NO: 1176877 - DNA, 22 bp, Artificial Sequence
  chemically synthesized
caaagttaagatataaaagagt

SEQ ID NO: 1176878 - DNA, 22 bp, Artificial Sequence
  chemically synthesized
aactcttttatatcttaacttt

SEQ ID NO: 1176879 - DNA, 22 bp, Artificial Sequence
  chemically synthesized
ttttatatcttaactttgtagt

SEQ ID NO: 1176880 - DNA, 22 bp, Artificial Sequence
  chemically synthesized
ttatatcttaactttgtagtgg

SEQ ID NO: 1176881 - DNA, 22 bp, Artificial Sequence
  chemically synthesized
tatatcttaactttgtagtggc

SEQ ID NO: 1176882 - DNA, 22 bp, Artificial Sequence
  chemically synthesized
atatcttaactttgtagtggct

SEQ ID NO: 1176883 - DNA, 22 bp, Artificial Sequence
  chemically synthesized
tatcttaactttgtagtggctt

SEQ ID NO: 1176884 - DNA, 22 bp, Artificial Sequence
  chemically synthesized
aactttgtagtggcttcatggt

SEQ ID NO: 1176885 - DNA, 22 bp, Artificial Sequence
  chemically synthesized
actttgtagtggcttcatggta

SEQ ID NO: 1176886 - DNA, 22 bp, Artificial Sequence
  chemically synthesized
caaatgatataataccatgaag

SEQ ID NO: 1176887 - DNA, 22 bp, Artificial Sequence
  chemically synthesized
tgtagtggcttcatggtattat

SEQ ID NO: 1176888 - DNA, 22 bp, Artificial Sequence
  chemically synthesized
gtagtggcttcatggtattata

SEQ ID NO: 1176889 - DNA, 22 bp, Artificial Sequence
  chemically synthesized
tagtggcttcatggtattatat

SEQ ID NO: 1176890 - DNA, 22 bp, Artificial Sequence
  chemically synthesized
tatctccaaatgatataatacc

SEQ ID NO: 1176891 - DNA, 22 bp, Artificial Sequence
  chemically synthesized
catggtattatatcatttggag

SEQ ID NO: 1176892 - DNA, 22 bp, Artificial Sequence
  chemically synthesized
aataaattatatctccaaatga

SEQ ID NO: 1176893 - DNA, 22 bp, Artificial Sequence
  chemically synthesized
atggtattatatcatttggaga

SEQ ID NO: 1176894 - DNA, 22 bp, Artificial Sequence
  chemically synthesized
aaataaattatatctccaaatg

SEQ ID NO: 1176895 - DNA, 22 bp, Artificial Sequence
  chemically synthesized
taaataaattatatctccaaat

SEQ ID NO: 1176896 - DNA, 22 bp, Artificial Sequence
  chemically synthesized
tttaaataaattatatctccaa

SEQ ID NO: 1176897 - DNA, 22 bp, Artificial Sequence
  chemically synthesized
ctttaaataaattatatctcca

SEQ ID NO: 1176898 - DNA, 22 bp, Artificial Sequence
  chemically synthesized
gtttctttaaataaattatatc

SEQ ID NO: 1176899 - DNA, 22 bp, Artificial Sequence
  chemically synthesized
tatcatttggagatataattta

SEQ ID NO: 1176900 - DNA, 22 bp, Artificial Sequence
  chemically synthesized
ttagtttctttaaataaattat

SEQ ID NO: 1176901 - DNA, 22 bp, Artificial Sequence
  chemically synthesized
ggagatataatttatttaaaga

SEQ ID NO: 1176902 - DNA, 22 bp, Artificial Sequence
  chemically synthesized
gagatataatttatttaaagaa

SEQ ID NO: 1176903 - DNA, 22 bp, Artificial Sequence
  chemically synthesized
atttaaagaaactaacagtata

SEQ ID NO: 1176904 - DNA, 22 bp, Artificial Sequence
  chemically synthesized
tttaaagaaactaacagtatat

SEQ ID NO: 1176905 - DNA, 22 bp, Artificial Sequence
  chemically synthesized
aaagaaactaacagtatattca

SEQ ID NO: 1176906 - DNA, 22 bp, Artificial Sequence
  chemically synthesized
aagaaactaacagtatattcac

SEQ ID NO: 1176907 - DNA, 22 bp, Artificial Sequence
  chemically synthesized
agtggaaatatgcacatgtgaa

SEQ ID NO: 1176908 - DNA, 22 bp, Artificial Sequence
  chemically synthesized
acagtatattcacatgtgcata

SEQ ID NO: 1176909 - DNA, 22 bp, Artificial Sequence
  chemically synthesized
atgtgtgttcagtggaaatatg

SEQ ID NO: 1176910 - DNA, 22 bp, Artificial Sequence
  chemically synthesized
acatgtgcatatttccactgaa

SEQ ID NO: 1176911 - DNA, 22 bp, Artificial Sequence
  chemically synthesized
atgaaattaatgtgtgttcagt

SEQ ID NO: 1176912 - DNA, 22 bp, Artificial Sequence
  chemically synthesized
ttaatgaaattaatgtgtgttc

SEQ ID NO: 1176913 - DNA, 22 bp, Artificial Sequence
  chemically synthesized
gttaatgaaattaatgtgtgtt

SEQ ID NO: 1176914 - DNA, 22 bp, Artificial Sequence
  chemically synthesized
tgttaatgaaattaatgtgtgt

SEQ ID NO: 1176915 - DNA, 22 bp, Artificial Sequence
  chemically synthesized
ttgttaatgaaattaatgtgtg

SEQ ID NO: 1176916 - DNA, 22 bp, Artificial Sequence
  chemically synthesized
tttgttaatgaaattaatgtgt

SEQ ID NO: 1176917 - DNA, 22 bp, Artificial Sequence
  chemically synthesized
tttttgttaatgaaattaatgt

SEQ ID NO: 1176918 - DNA, 22 bp, Artificial Sequence
  chemically synthesized
ccactgaacacacattaatttc

SEQ ID NO: 1176919 - DNA, 22 bp, Artificial Sequence
  chemically synthesized
ctttttgttaatgaaattaatg

SEQ ID NO: 1176920 - DNA, 22 bp, Artificial Sequence
  chemically synthesized
cactgaacacacattaatttca

SEQ ID NO: 1176921 - DNA, 22 bp, Artificial Sequence
  chemically synthesized
tatttctttttgttaatgaaat

SEQ ID NO: 1176922 - DNA, 22 bp, Artificial Sequence
  chemically synthesized
aacacacattaatttcattaac

SEQ ID NO: 1176923 - DNA, 22 bp, Artificial Sequence
  chemically synthesized
gtatttctttttgttaatgaaa

SEQ ID NO: 1176924 - DNA, 22 bp, Artificial Sequence
  chemically synthesized
gtcttgtatttctttttgttaa

SEQ ID NO: 1176925 - DNA, 22 bp, Artificial Sequence
  chemically synthesized
ggtcttgtatttctttttgtta

SEQ ID NO: 1176926 - DNA, 22 bp, Artificial Sequence
  chemically synthesized
tggtcttgtatttctttttgtt

SEQ ID NO: 1176927 - DNA, 22 bp, Artificial Sequence
  chemically synthesized
tttggtcttgtatttctttttg

SEQ ID NO: 1176928 - DNA, 22 bp, Artificial Sequence
  chemically synthesized
ctttggtcttgtatttcttttt

SEQ ID NO: 1176929 - DNA, 22 bp, Artificial Sequence
  chemically synthesized
atttcattaacaaaaagaaata

SEQ ID NO: 1176930 - DNA, 22 bp, Artificial Sequence
  chemically synthesized
cattaacaaaaagaaatacaag

SEQ ID NO: 1176931 - DNA, 22 bp, Artificial Sequence
  chemically synthesized
attaacaaaaagaaatacaaga

SEQ ID NO: 1176932 - DNA, 22 bp, Artificial Sequence
  chemically synthesized
acaaaaagaaatacaagaccaa

SEQ ID NO: 1176933 - DNA, 22 bp, Artificial Sequence
  chemically synthesized
gaggtcaacttctttggtcttg

SEQ ID NO: 1176934 - DNA, 22 bp, Artificial Sequence
  chemically synthesized
agaggtcaacttctttggtctt

SEQ ID NO: 1176935 - DNA, 22 bp, Artificial Sequence
  chemically synthesized
gaagtataggaagatagtttag

SEQ ID NO: 1176936 - DNA, 22 bp, Artificial Sequence
  chemically synthesized
acattagaagtataggaagata

SEQ ID NO: 1176937 - DNA, 22 bp, Artificial Sequence
  chemically synthesized
acctctaaactatcttcctata

SEQ ID NO: 1176938 - DNA, 22 bp, Artificial Sequence
  chemically synthesized
taaactatcttcctatacttct

SEQ ID NO: 1176939 - DNA, 22 bp, Artificial Sequence
  chemically synthesized
aactatcttcctatacttctaa

SEQ ID NO: 1176940 - DNA, 22 bp, Artificial Sequence
  chemically synthesized
aatagtgttcacattagaagta

SEQ ID NO: 1176941 - DNA, 22 bp, Artificial Sequence
  chemically synthesized
tcttcctatacttctaatgtga

SEQ ID NO: 1176942 - DNA, 22 bp, Artificial Sequence
  chemically synthesized
cctatacttctaatgtgaacac

SEQ ID NO: 1176943 - DNA, 22 bp, Artificial Sequence
  chemically synthesized
ctatacttctaatgtgaacact

SEQ ID NO: 1176944 - DNA, 22 bp, Artificial Sequence
  chemically synthesized
tgagatgattgaatagtgttca

SEQ ID NO: 1176945 - DNA, 22 bp, Artificial Sequence
  chemically synthesized
tacttctaatgtgaacactatt

SEQ ID NO: 1176946 - DNA, 22 bp, Artificial Sequence
  chemically synthesized
aattatgagatgattgaatagt

SEQ ID NO: 1176947 - DNA, 22 bp, Artificial Sequence
  chemically synthesized
ctaatgtgaacactattcaatc

SEQ ID NO: 1176948 - DNA, 22 bp, Artificial Sequence
  chemically synthesized
aaattatgagatgattgaatag

SEQ ID NO: 1176949 - DNA, 22 bp, Artificial Sequence
  chemically synthesized
taatgtgaacactattcaatca

SEQ ID NO: 1176950 - DNA, 22 bp, Artificial Sequence
  chemically synthesized
atgtgaacactattcaatcatc

SEQ ID NO: 1176951 - DNA, 22 bp, Artificial Sequence
  chemically synthesized
atttaaattatgagatgattga

SEQ ID NO: 1176952 - DNA, 22 bp, Artificial Sequence
  chemically synthesized
aatttaaattatgagatgattg

SEQ ID NO: 1176953 - DNA, 22 bp, Artificial Sequence
  chemically synthesized
taatttaaattatgagatgatt

SEQ ID NO: 1176954 - DNA, 22 bp, Artificial Sequence
  chemically synthesized
attttaatttaaattatgagat

SEQ ID NO: 1176955 - DNA, 22 bp, Artificial Sequence
  chemically synthesized
cattttaatttaaattatgaga

SEQ ID NO: 1176956 - DNA, 22 bp, Artificial Sequence
  chemically synthesized
tttcattttaatttaaattatg

SEQ ID NO: 1176957 - DNA, 22 bp, Artificial Sequence
  chemically synthesized
ttcaatcatctcataatttaaa

SEQ ID NO: 1176958 - DNA, 22 bp, Artificial Sequence
  chemically synthesized
atttcattttaatttaaattat

SEQ ID NO: 1176959 - DNA, 22 bp, Artificial Sequence
  chemically synthesized
aatcatctcataatttaaatta

SEQ ID NO: 1176960 - DNA, 22 bp, Artificial Sequence
  chemically synthesized
tgtagtttatttcattttaatt

SEQ ID NO: 1176961 - DNA, 22 bp, Artificial Sequence
  chemically synthesized
ataatttaaattaaaatgaaat

SEQ ID NO: 1176962 - DNA, 22 bp, Artificial Sequence
  chemically synthesized
cagtgcctatgtagtttatttc

SEQ ID NO: 1176963 - DNA, 22 bp, Artificial Sequence
  chemically synthesized
aaattaaaatgaaataaactac

SEQ ID NO: 1176964 - DNA, 22 bp, Artificial Sequence
  chemically synthesized
aattaaaatgaaataaactaca

SEQ ID NO: 1176965 - DNA, 22 bp, Artificial Sequence
  chemically synthesized
aaatgaaataaactacataggc

SEQ ID NO: 1176966 - DNA, 22 bp, Artificial Sequence
  chemically synthesized
cataggcactggaattttgttt

SEQ ID NO: 1176967 - DNA, 22 bp, Artificial Sequence
  chemically synthesized
agaggtagaaagaaacaaaatt

SEQ ID NO: 1176968 - DNA, 22 bp, Artificial Sequence
  chemically synthesized
aagaggtagaaagaaacaaaat

SEQ ID NO: 1176969 - DNA, 22 bp, Artificial Sequence
  chemically synthesized
taagaggtagaaagaaacaaaa

SEQ ID NO: 1176970 - DNA, 22 bp, Artificial Sequence
  chemically synthesized
caaattttaagaggtagaaaga

SEQ ID NO: 1176971 - DNA, 22 bp, Artificial Sequence
  chemically synthesized
gaattttgtttctttctacctc

SEQ ID NO: 1176972 - DNA, 22 bp, Artificial Sequence
  chemically synthesized
tgtttctttctacctcttaaaa

SEQ ID NO: 1176973 - DNA, 22 bp, Artificial Sequence
  chemically synthesized
gtttctttctacctcttaaaat

SEQ ID NO: 1176974 - DNA, 22 bp, Artificial Sequence
  chemically synthesized
tttctttctacctcttaaaatt

SEQ ID NO: 1176975 - DNA, 22 bp, Artificial Sequence
  chemically synthesized
agggagcattccaaattttaag

SEQ ID NO: 1176976 - DNA, 22 bp, Artificial Sequence
  chemically synthesized
aagggagcattccaaattttaa

SEQ ID NO: 1176977 - DNA, 22 bp, Artificial Sequence
  chemically synthesized
ctttctacctcttaaaatttgg

SEQ ID NO: 1176978 - DNA, 22 bp, Artificial Sequence
  chemically synthesized
taagggagcattccaaatttta

SEQ ID NO: 1176979 - DNA, 22 bp, Artificial Sequence
  chemically synthesized
tttctacctcttaaaatttgga

SEQ ID NO: 1176980 - DNA, 22 bp, Artificial Sequence
  chemically synthesized
tctacctcttaaaatttggaat

SEQ ID NO: 1176981 - DNA, 22 bp, Artificial Sequence
  chemically synthesized
ctacctcttaaaatttggaatg

SEQ ID NO: 1176982 - DNA, 22 bp, Artificial Sequence
  chemically synthesized
attttaagggagcattccaaat

SEQ ID NO: 1176983 - DNA, 22 bp, Artificial Sequence
  chemically synthesized
tacctcttaaaatttggaatgc

SEQ ID NO: 1176984 - DNA, 22 bp, Artificial Sequence
  chemically synthesized
cctcttaaaatttggaatgctc

SEQ ID NO: 1176985 - DNA, 22 bp, Artificial Sequence
  chemically synthesized
ttaattttaagggagcattcca

SEQ ID NO: 1176986 - DNA, 22 bp, Artificial Sequence
  chemically synthesized
ttaaaatttggaatgctccctt

SEQ ID NO: 1176987 - DNA, 22 bp, Artificial Sequence
  chemically synthesized
aaaatttggaatgctcccttaa

SEQ ID NO: 1176988 - DNA, 22 bp, Artificial Sequence
  chemically synthesized
aaatttggaatgctcccttaaa

SEQ ID NO: 1176989 - DNA, 22 bp, Artificial Sequence
  chemically synthesized
gaatctattaattttaagggag

SEQ ID NO: 1176990 - DNA, 22 bp, Artificial Sequence
  chemically synthesized
ttggaatctattaattttaagg

SEQ ID NO: 1176991 - DNA, 22 bp, Artificial Sequence
  chemically synthesized
ggaatgctcccttaaaattaat

SEQ ID NO: 1176992 - DNA, 22 bp, Artificial Sequence
  chemically synthesized
gaatgctcccttaaaattaata

SEQ ID NO: 1176993 - DNA, 22 bp, Artificial Sequence
  chemically synthesized
taagttattggaatctattaat

SEQ ID NO: 1176994 - DNA, 22 bp, Artificial Sequence
  chemically synthesized
gtaagttattggaatctattaa

SEQ ID NO: 1176995 - DNA, 22 bp, Artificial Sequence
  chemically synthesized
ttgtaagttattggaatctatt

SEQ ID NO: 1176996 - DNA, 22 bp, Artificial Sequence
  chemically synthesized
cttgtaagttattggaatctat

SEQ ID NO: 1176997 - DNA, 22 bp, Artificial Sequence
  chemically synthesized
ccttaaaattaatagattccaa

SEQ ID NO: 1176998 - DNA, 22 bp, Artificial Sequence
  chemically synthesized
tcttgtaagttattggaatcta

SEQ ID NO: 1176999 - DNA, 22 bp, Artificial Sequence
  chemically synthesized
aaaattaatagattccaataac

SEQ ID NO: 1177000 - DNA, 22 bp, Artificial Sequence
  chemically synthesized
aaattaatagattccaataact

SEQ ID NO: 1177001 - DNA, 22 bp, Artificial Sequence
  chemically synthesized
atagattccaataacttacaag

SEQ ID NO: 1177002 - DNA, 22 bp, Artificial Sequence
  chemically synthesized
tgtaaaggtgggtattttcttg

SEQ ID NO: 1177003 - DNA, 22 bp, Artificial Sequence
  chemically synthesized
gtgtaaaggtgggtattttctt

SEQ ID NO: 1177004 - DNA, 22 bp, Artificial Sequence
  chemically synthesized
caataacttacaagaaaatacc

SEQ ID NO: 1177005 - DNA, 22 bp, Artificial Sequence
  chemically synthesized
tgtgtaaaggtgggtattttct

SEQ ID NO: 1177006 - DNA, 22 bp, Artificial Sequence
  chemically synthesized
acaagaaaatacccacctttac

SEQ ID NO: 1177007 - DNA, 22 bp, Artificial Sequence
  chemically synthesized
tagtaactttgtgtaaaggtgg

SEQ ID NO: 1177008 - DNA, 22 bp, Artificial Sequence
  chemically synthesized
caagaaaatacccacctttaca

SEQ ID NO: 1177009 - DNA, 22 bp, Artificial Sequence
  chemically synthesized
atagtaactttgtgtaaaggtg

SEQ ID NO: 1177010 - DNA, 22 bp, Artificial Sequence
  chemically synthesized
tatagtaactttgtgtaaaggt

SEQ ID NO: 1177011 - DNA, 22 bp, Artificial Sequence
  chemically synthesized
ttatagtaactttgtgtaaagg

SEQ ID NO: 1177012 - DNA, 22 bp, Artificial Sequence
  chemically synthesized
tacacaaagttactataaaaat

SEQ ID NO: 1177013 - DNA, 22 bp, Artificial Sequence
  chemically synthesized
acacaaagttactataaaaatc

SEQ ID NO: 1177014 - DNA, 22 bp, Artificial Sequence
  chemically synthesized
cacaaagttactataaaaatcc

SEQ ID NO: 1177015 - DNA, 22 bp, Artificial Sequence
  chemically synthesized
atcacacatgaaggatttttat

SEQ ID NO: 1177016 - DNA, 22 bp, Artificial Sequence
  chemically synthesized
aatcacacatgaaggattttta

SEQ ID NO: 1177017 - DNA, 22 bp, Artificial Sequence
  chemically synthesized
taatcacacatgaaggattttt

SEQ ID NO: 1177018 - DNA, 22 bp, Artificial Sequence
  chemically synthesized
ttaatcacacatgaaggatttt

SEQ ID NO: 1177019 - DNA, 22 bp, Artificial Sequence
  chemically synthesized
tttaatcacacatgaaggattt

SEQ ID NO: 1177020 - DNA, 22 bp, Artificial Sequence
  chemically synthesized
ttttttaatcacacatgaagga

SEQ ID NO: 1177021 - DNA, 22 bp, Artificial Sequence
  chemically synthesized
ctataaaaatccttcatgtgtg

SEQ ID NO: 1177022 - DNA, 22 bp, Artificial Sequence
  chemically synthesized
taaaaatccttcatgtgtgatt

SEQ ID NO: 1177023 - DNA, 22 bp, Artificial Sequence
  chemically synthesized
catgtgtgattaaaaaataata

SEQ ID NO: 1177024 - DNA, 22 bp, Artificial Sequence
  chemically synthesized
atgtgtgattaaaaaataatat

SEQ ID NO: 1177025 - DNA, 22 bp, Artificial Sequence
  chemically synthesized
atcacaaagtaaacatgtaaat

SEQ ID NO: 1177026 - DNA, 22 bp, Artificial Sequence
  chemically synthesized
aaaaataatatttacatgttta

SEQ ID NO: 1177027 - DNA, 22 bp, Artificial Sequence
  chemically synthesized
agtataaatctgatcacaaagt

SEQ ID NO: 1177028 - DNA, 22 bp, Artificial Sequence
  chemically synthesized
ctaagtataaatctgatcacaa

SEQ ID NO: 1177029 - DNA, 22 bp, Artificial Sequence
  chemically synthesized
acatgtttactttgtgatcaga

SEQ ID NO: 1177030 - DNA, 22 bp, Artificial Sequence
  chemically synthesized
catgtttactttgtgatcagat

SEQ ID NO: 1177031 - DNA, 22 bp, Artificial Sequence
  chemically synthesized
agctgctaagtataaatctgat

SEQ ID NO: 1177032 - DNA, 22 bp, Artificial Sequence
  chemically synthesized
actttgtgatcagatttatact

SEQ ID NO: 1177033 - DNA, 22 bp, Artificial Sequence
  chemically synthesized
ctttgtgatcagatttatactt

SEQ ID NO: 1177034 - DNA, 22 bp, Artificial Sequence
  chemically synthesized
aaaattgagctgctaagtataa

SEQ ID NO: 1177035 - DNA, 22 bp, Artificial Sequence
  chemically synthesized
tgtgatcagatttatacttagc

SEQ ID NO: 1177036 - DNA, 22 bp, Artificial Sequence
  chemically synthesized
gtgatcagatttatacttagca

SEQ ID NO: 1177037 - DNA, 22 bp, Artificial Sequence
  chemically synthesized
taaaaattgagctgctaagtat

SEQ ID NO: 1177038 - DNA, 22 bp, Artificial Sequence
  chemically synthesized
tgatcagatttatacttagcag

SEQ ID NO: 1177039 - DNA, 22 bp, Artificial Sequence
  chemically synthesized
ttctaaaaattgagctgctaag

SEQ ID NO: 1177040 - DNA, 22 bp, Artificial Sequence
  chemically synthesized
atacttagcagctcaattttta

SEQ ID NO: 1177041 - DNA, 22 bp, Artificial Sequence
  chemically synthesized
atatcattattctaaaaattga

SEQ ID NO: 1177042 - DNA, 22 bp, Artificial Sequence
  chemically synthesized
tacttagcagctcaatttttag

SEQ ID NO: 1177043 - DNA, 22 bp, Artificial Sequence
  chemically synthesized
ctcatatcattattctaaaaat

SEQ ID NO: 1177044 - DNA, 22 bp, Artificial Sequence
  chemically synthesized
cctcatatcattattctaaaaa

SEQ ID NO: 1177045 - DNA, 22 bp, Artificial Sequence
  chemically synthesized
agcagctcaatttttagaataa

SEQ ID NO: 1177046 - DNA, 22 bp, Artificial Sequence
  chemically synthesized
gcagctcaatttttagaataat

SEQ ID NO: 1177047 - DNA, 22 bp, Artificial Sequence
  chemically synthesized
tttcctcatatcattattctaa

SEQ ID NO: 1177048 - DNA, 22 bp, Artificial Sequence
  chemically synthesized
aatttttagaataatgatatga

SEQ ID NO: 1177049 - DNA, 22 bp, Artificial Sequence
  chemically synthesized
ataatagttatttcctcatatc

SEQ ID NO: 1177050 - DNA, 22 bp, Artificial Sequence
  chemically synthesized
cataatagttatttcctcatat

SEQ ID NO: 1177051 - DNA, 22 bp, Artificial Sequence
  chemically synthesized
ttagaataatgatatgaggaaa

SEQ ID NO: 1177052 - DNA, 22 bp, Artificial Sequence
  chemically synthesized
tagaataatgatatgaggaaat

SEQ ID NO: 1177053 - DNA, 22 bp, Artificial Sequence
  chemically synthesized
agaataatgatatgaggaaata

SEQ ID NO: 1177054 - DNA, 22 bp, Artificial Sequence
  chemically synthesized
gaataatgatatgaggaaataa

SEQ ID NO: 1177055 - DNA, 22 bp, Artificial Sequence
  chemically synthesized
ataaaatggcttcataatagtt

SEQ ID NO: 1177056 - DNA, 22 bp, Artificial Sequence
  chemically synthesized
gataaaatggcttcataatagt

SEQ ID NO: 1177057 - DNA, 22 bp, Artificial Sequence
  chemically synthesized
tgataaaatggcttcataatag

SEQ ID NO: 1177058 - DNA, 22 bp, Artificial Sequence
  chemically synthesized
ttgataaaatggcttcataata

SEQ ID NO: 1177059 - DNA, 22 bp, Artificial Sequence
  chemically synthesized
tttgataaaatggcttcataat

SEQ ID NO: 1177060 - DNA, 22 bp, Artificial Sequence
  chemically synthesized
ttttgataaaatggcttcataa

SEQ ID NO: 1177061 - DNA, 22 bp, Artificial Sequence
  chemically synthesized
tttttgataaaatggcttcata

SEQ ID NO: 1177062 - DNA, 22 bp, Artificial Sequence
  chemically synthesized
tttttttgataaaatggcttca

SEQ ID NO: 1177063 - DNA, 22 bp, Artificial Sequence
  chemically synthesized
ctctttttttgataaaatggct

SEQ ID NO: 1177064 - DNA, 22 bp, Artificial Sequence
  chemically synthesized
gctctttttttgataaaatggc

SEQ ID NO: 1177065 - DNA, 22 bp, Artificial Sequence
  chemically synthesized
tgctctttttttgataaaatgg

SEQ ID NO: 1177066 - DNA, 22 bp, Artificial Sequence
  chemically synthesized
ttatgaagccattttatcaaaa

SEQ ID NO: 1177067 - DNA, 22 bp, Artificial Sequence
  chemically synthesized
atattttgctctttttttgata

SEQ ID NO: 1177068 - DNA, 22 bp, Artificial Sequence
  chemically synthesized
tgaagccattttatcaaaaaaa

SEQ ID NO: 1177069 - DNA, 22 bp, Artificial Sequence
  chemically synthesized
agatcctgatattttgctcttt

SEQ ID NO: 1177070 - DNA, 22 bp, Artificial Sequence
  chemically synthesized
gagatcctgatattttgctctt

SEQ ID NO: 1177071 - DNA, 22 bp, Artificial Sequence
  chemically synthesized
tgagatcctgatattttgctct

SEQ ID NO: 1177072 - DNA, 22 bp, Artificial Sequence
  chemically synthesized
tatcaaaaaaagagcaaaatat

SEQ ID NO: 1177073 - DNA, 22 bp, Artificial Sequence
  chemically synthesized
tttgagatcctgatattttgct

SEQ ID NO: 1177074 - DNA, 22 bp, Artificial Sequence
  chemically synthesized
atcaaaaaaagagcaaaatatc

SEQ ID NO: 1177075 - DNA, 22 bp, Artificial Sequence
  chemically synthesized
tcaaaaaaagagcaaaatatca

SEQ ID NO: 1177076 - DNA, 22 bp, Artificial Sequence
  chemically synthesized
atagctctttgagatcctgata

SEQ ID NO: 1177077 - DNA, 22 bp, Artificial Sequence
  chemically synthesized
gagtgctaatagctctttgaga

SEQ ID NO: 1177078 - DNA, 22 bp, Artificial Sequence
  chemically synthesized
taatgagcactggagtgctaat

SEQ ID NO: 1177079 - DNA, 22 bp, Artificial Sequence
  chemically synthesized
aaagagctattagcactccagt

SEQ ID NO: 1177080 - DNA, 22 bp, Artificial Sequence
  chemically synthesized
atcgtgctataatgagcactgg

SEQ ID NO: 1177081 - DNA, 22 bp, Artificial Sequence
  chemically synthesized
aatcgtgctataatgagcactg

SEQ ID NO: 1177082 - DNA, 22 bp, Artificial Sequence
  chemically synthesized
taatcgtgctataatgagcact

SEQ ID NO: 1177083 - DNA, 22 bp, Artificial Sequence
  chemically synthesized
ttaatcgtgctataatgagcac

SEQ ID NO: 1177084 - DNA, 22 bp, Artificial Sequence
  chemically synthesized
ttagcactccagtgctcattat

SEQ ID NO: 1177085 - DNA, 22 bp, Artificial Sequence
  chemically synthesized
tttttaatcgtgctataatgag

SEQ ID NO: 1177086 - DNA, 22 bp, Artificial Sequence
  chemically synthesized
gcactccagtgctcattatagc

SEQ ID NO: 1177087 - DNA, 22 bp, Artificial Sequence
  chemically synthesized
cagtgctcattatagcacgatt

SEQ ID NO: 1177088 - DNA, 22 bp, Artificial Sequence
  chemically synthesized
ccacatcgtgactatttttaat

SEQ ID NO: 1177089 - DNA, 22 bp, Artificial Sequence
  chemically synthesized
attatagcacgattaaaaatag

SEQ ID NO: 1177090 - DNA, 22 bp, Artificial Sequence
  chemically synthesized
ttcccacatcgtgactattttt

SEQ ID NO: 1177091 - DNA, 22 bp, Artificial Sequence
  chemically synthesized
tagcacgattaaaaatagtcac

SEQ ID NO: 1177092 - DNA, 22 bp, Artificial Sequence
  chemically synthesized
cgttgttcccacatcgtgacta

SEQ ID NO: 1177093 - DNA, 22 bp, Artificial Sequence
  chemically synthesized
acgttgttcccacatcgtgact

SEQ ID NO: 1177094 - DNA, 22 bp, Artificial Sequence
  chemically synthesized
aaaatagtcacgatgtgggaac

SEQ ID NO: 1177095 - DNA, 22 bp, Artificial Sequence
  chemically synthesized
tcgggcatttacgttgttccca

SEQ ID NO: 1177096 - DNA, 22 bp, Artificial Sequence
  chemically synthesized
agctatcgggcatttacgttgt

SEQ ID NO: 1177097 - DNA, 22 bp, Artificial Sequence
  chemically synthesized
tccattcagctatcgggcattt

SEQ ID NO: 1177098 - DNA, 22 bp, Artificial Sequence
  chemically synthesized
atccattcagctatcgggcatt

SEQ ID NO: 1177099 - DNA, 22 bp, Artificial Sequence
  chemically synthesized
tatccattcagctatcgggcat

SEQ ID NO: 1177100 - DNA, 22 bp, Artificial Sequence
  chemically synthesized
tttatccattcagctatcgggc

SEQ ID NO: 1177101 - DNA, 22 bp, Artificial Sequence
  chemically synthesized
ctttatccattcagctatcggg

SEQ ID NO: 1177102 - DNA, 22 bp, Artificial Sequence
  chemically synthesized
ccacatcttctttatccattca

SEQ ID NO: 1177103 - DNA, 22 bp, Artificial Sequence
  chemically synthesized
accacatcttctttatccattc

SEQ ID NO: 1177104 - DNA, 22 bp, Artificial Sequence
  chemically synthesized
tatgtatttaccacatcttctt

SEQ ID NO: 1177105 - DNA, 22 bp, Artificial Sequence
  chemically synthesized
aatggataaagaagatgtggta

SEQ ID NO: 1177106 - DNA, 22 bp, Artificial Sequence
  chemically synthesized
cattgtatgtatttaccacatc

SEQ ID NO: 1177107 - DNA, 22 bp, Artificial Sequence
  chemically synthesized
aataaaattccattgtatgtat

SEQ ID NO: 1177108 - DNA, 22 bp, Artificial Sequence
  chemically synthesized
aagactgaataaaattccattg

SEQ ID NO: 1177109 - DNA, 22 bp, Artificial Sequence
  chemically synthesized
aaagactgaataaaattccatt

SEQ ID NO: 1177110 - DNA, 22 bp, Artificial Sequence
  chemically synthesized
taaagactgaataaaattccat

SEQ ID NO: 1177111 - DNA, 22 bp, Artificial Sequence
  chemically synthesized
ttaaagactgaataaaattcca

SEQ ID NO: 1177112 - DNA, 22 bp, Artificial Sequence
  chemically synthesized
tttaaagactgaataaaattcc

SEQ ID NO: 1177113 - DNA, 22 bp, Artificial Sequence
  chemically synthesized
tttttaaagactgaataaaatt

SEQ ID NO: 1177114 - DNA, 22 bp, Artificial Sequence
  chemically synthesized
ctttttaaagactgaataaaat

SEQ ID NO: 1177115 - DNA, 22 bp, Artificial Sequence
  chemically synthesized
cttctttttaaagactgaataa

SEQ ID NO: 1177116 - DNA, 22 bp, Artificial Sequence
  chemically synthesized
ccttctttttaaagactgaata

SEQ ID NO: 1177117 - DNA, 22 bp, Artificial Sequence
  chemically synthesized
tccttctttttaaagactgaat

SEQ ID NO: 1177118 - DNA, 22 bp, Artificial Sequence
  chemically synthesized
caagttttccttctttttaaag

SEQ ID NO: 1177119 - DNA, 22 bp, Artificial Sequence
  chemically synthesized
tattcagtctttaaaaagaagg

SEQ ID NO: 1177120 - DNA, 22 bp, Artificial Sequence
  chemically synthesized
attcagtctttaaaaagaagga

SEQ ID NO: 1177121 - DNA, 22 bp, Artificial Sequence
  chemically synthesized
ttcagtctttaaaaagaaggaa

SEQ ID NO: 1177122 - DNA, 22 bp, Artificial Sequence
  chemically synthesized
agtctttaaaaagaaggaaaac

SEQ ID NO: 1177123 - DNA, 22 bp, Artificial Sequence
  chemically synthesized
tcacatattgcaagttttcctt

SEQ ID NO: 1177124 - DNA, 22 bp, Artificial Sequence
  chemically synthesized
gtcacatattgcaagttttcct

SEQ ID NO: 1177125 - DNA, 22 bp, Artificial Sequence
  chemically synthesized
taaaaagaaggaaaacttgcaa

SEQ ID NO: 1177126 - DNA, 22 bp, Artificial Sequence
  chemically synthesized
aaaaagaaggaaaacttgcaat

SEQ ID NO: 1177127 - DNA, 22 bp, Artificial Sequence
  chemically synthesized
aaaagaaggaaaacttgcaata

SEQ ID NO: 1177128 - DNA, 22 bp, Artificial Sequence
  chemically synthesized
atccaacttgtcacatattgca

SEQ ID NO: 1177129 - DNA, 22 bp, Artificial Sequence
  chemically synthesized
aaggttcatccaacttgtcaca

SEQ ID NO: 1177130 - DNA, 22 bp, Artificial Sequence
  chemically synthesized
caaggttcatccaacttgtcac

SEQ ID NO: 1177131 - DNA, 22 bp, Artificial Sequence
  chemically synthesized
gcaatatgtgacaagttggatg

SEQ ID NO: 1177132 - DNA, 22 bp, Artificial Sequence
  chemically synthesized
caatatgtgacaagttggatga

SEQ ID NO: 1177133 - DNA, 22 bp, Artificial Sequence
  chemically synthesized
caatataccttcaaggttcatc

SEQ ID NO: 1177134 - DNA, 22 bp, Artificial Sequence
  chemically synthesized
acaatataccttcaaggttcat

SEQ ID NO: 1177135 - DNA, 22 bp, Artificial Sequence
  chemically synthesized
atttacaatataccttcaaggt

SEQ ID NO: 1177136 - DNA, 22 bp, Artificial Sequence
  chemically synthesized
catttacaatataccttcaagg

SEQ ID NO: 1177137 - DNA, 22 bp, Artificial Sequence
  chemically synthesized
tcatttacaatataccttcaag

SEQ ID NO: 1177138 - DNA, 22 bp, Artificial Sequence
  chemically synthesized
ttcatttacaatataccttcaa

SEQ ID NO: 1177139 - DNA, 22 bp, Artificial Sequence
  chemically synthesized
tttcatttacaatataccttca

SEQ ID NO: 1177140 - DNA, 22 bp, Artificial Sequence
  chemically synthesized
ttttcatttacaatataccttc

SEQ ID NO: 1177141 - DNA, 22 bp, Artificial Sequence
  chemically synthesized
gatgaaccttgaaggtatattg

SEQ ID NO: 1177142 - DNA, 22 bp, Artificial Sequence
  chemically synthesized
gcttttttcatttacaatatac

SEQ ID NO: 1177143 - DNA, 22 bp, Artificial Sequence
  chemically synthesized
tgtctagcttttttcatttaca

SEQ ID NO: 1177144 - DNA, 22 bp, Artificial Sequence
  chemically synthesized
gaaggtatattgtaaatgaaaa

SEQ ID NO: 1177145 - DNA, 22 bp, Artificial Sequence
  chemically synthesized
tgtgtctagcttttttcattta

SEQ ID NO: 1177146 - DNA, 22 bp, Artificial Sequence
  chemically synthesized
aaggtatattgtaaatgaaaaa

SEQ ID NO: 1177147 - DNA, 22 bp, Artificial Sequence
  chemically synthesized
ctgtgtctagcttttttcattt

SEQ ID NO: 1177148 - DNA, 22 bp, Artificial Sequence
  chemically synthesized
tatttctgtgtctagctttttt

SEQ ID NO: 1177149 - DNA, 22 bp, Artificial Sequence
  chemically synthesized
gtatttctgtgtctagcttttt

SEQ ID NO: 1177150 - DNA, 22 bp, Artificial Sequence
  chemically synthesized
taaatgaaaaaagctagacaca

SEQ ID NO: 1177151 - DNA, 22 bp, Artificial Sequence
  chemically synthesized
gacacagaaatacaaatacttc

SEQ ID NO: 1177152 - DNA, 22 bp, Artificial Sequence
  chemically synthesized
gtgtgagtagaatcatgaagta

SEQ ID NO: 1177153 - DNA, 22 bp, Artificial Sequence
  chemically synthesized
gatacctggtgtgagtagaatc

SEQ ID NO: 1177154 - DNA, 22 bp, Artificial Sequence
  chemically synthesized
agatacctggtgtgagtagaat

SEQ ID NO: 1177155 - DNA, 22 bp, Artificial Sequence
  chemically synthesized
tagatacctggtgtgagtagaa

SEQ ID NO: 1177156 - DNA, 22 bp, Artificial Sequence
  chemically synthesized
catgattctactcacaccaggt

SEQ ID NO: 1177157 - DNA, 22 bp, Artificial Sequence
  chemically synthesized
gcaattttagatacctggtgtg

SEQ ID NO: 1177158 - DNA, 22 bp, Artificial Sequence
  chemically synthesized
atgattctactcacaccaggta

SEQ ID NO: 1177159 - DNA, 22 bp, Artificial Sequence
  chemically synthesized
ggcaattttagatacctggtgt

SEQ ID NO: 1177160 - DNA, 22 bp, Artificial Sequence
  chemically synthesized
agtttggcaattttagatacct

SEQ ID NO: 1177161 - DNA, 22 bp, Artificial Sequence
  chemically synthesized
tactcacaccaggtatctaaaa

SEQ ID NO: 1177162 - DNA, 22 bp, Artificial Sequence
  chemically synthesized
tgagtttggcaattttagatac

SEQ ID NO: 1177163 - DNA, 22 bp, Artificial Sequence
  chemically synthesized
ctcacaccaggtatctaaaatt

SEQ ID NO: 1177164 - DNA, 22 bp, Artificial Sequence
  chemically synthesized
tctgagtttggcaattttagat

SEQ ID NO: 1177165 - DNA, 22 bp, Artificial Sequence
  chemically synthesized
acaccaggtatctaaaattgcc

SEQ ID NO: 1177166 - DNA, 22 bp, Artificial Sequence
  chemically synthesized
attctctgagtttggcaatttt

SEQ ID NO: 1177167 - DNA, 22 bp, Artificial Sequence
  chemically synthesized
tgattctctgagtttggcaatt

SEQ ID NO: 1177168 - DNA, 22 bp, Artificial Sequence
  chemically synthesized
atctctgattctctgagtttgg

SEQ ID NO: 1177169 - DNA, 22 bp, Artificial Sequence
  chemically synthesized
taatctctgattctctgagttt

SEQ ID NO: 1177170 - DNA, 22 bp, Artificial Sequence
  chemically synthesized
aaattgccaaactcagagaatc

SEQ ID NO: 1177171 - DNA, 22 bp, Artificial Sequence
  chemically synthesized
ccaaactcagagaatcagagat

SEQ ID NO: 1177172 - DNA, 22 bp, Artificial Sequence
  chemically synthesized
aaagccaccactctaatctctg

SEQ ID NO: 1177173 - DNA, 22 bp, Artificial Sequence
  chemically synthesized
taaaagccaccactctaatctc

SEQ ID NO: 1177174 - DNA, 22 bp, Artificial Sequence
  chemically synthesized
agagaatcagagattagagtgg

SEQ ID NO: 1177175 - DNA, 22 bp, Artificial Sequence
  chemically synthesized
agcctctaaaagccaccactct

SEQ ID NO: 1177176 - DNA, 22 bp, Artificial Sequence
  chemically synthesized
cagcctctaaaagccaccactc

SEQ ID NO: 1177177 - DNA, 22 bp, Artificial Sequence
  chemically synthesized
tcagcctctaaaagccaccact

SEQ ID NO: 1177178 - DNA, 22 bp, Artificial Sequence
  chemically synthesized
ctttcagcctctaaaagccacc

SEQ ID NO: 1177179 - DNA, 22 bp, Artificial Sequence
  chemically synthesized
ctcctttcagcctctaaaagcc

SEQ ID NO: 1177180 - DNA, 22 bp, Artificial Sequence
  chemically synthesized
tcctcctttcagcctctaaaag

SEQ ID NO: 1177181 - DNA, 22 bp, Artificial Sequence
  chemically synthesized
ctcctcctttcagcctctaaaa

SEQ ID NO: 1177182 - DNA, 22 bp, Artificial Sequence
  chemically synthesized
tctcctcctttcagcctctaaa

SEQ ID NO: 1177183 - DNA, 22 bp, Artificial Sequence
  chemically synthesized
gagtggtggcttttagaggctg

SEQ ID NO: 1177184 - DNA, 22 bp, Artificial Sequence
  chemically synthesized
cccattttctcctcctttcagc

SEQ ID NO: 1177185 - DNA, 22 bp, Artificial Sequence
  chemically synthesized
ccccattttctcctcctttcag

SEQ ID NO: 1177186 - DNA, 22 bp, Artificial Sequence
  chemically synthesized
ttagaggctgaaaggaggagaa

SEQ ID NO: 1177187 - DNA, 22 bp, Artificial Sequence
  chemically synthesized
tagaggctgaaaggaggagaaa

SEQ ID NO: 1177188 - DNA, 22 bp, Artificial Sequence
  chemically synthesized
gcatttccccattttctcctcc

SEQ ID NO: 1177189 - DNA, 22 bp, Artificial Sequence
  chemically synthesized
agaggctgaaaggaggagaaaa

SEQ ID NO: 1177190 - DNA, 22 bp, Artificial Sequence
  chemically synthesized
gaggctgaaaggaggagaaaat

SEQ ID NO: 1177191 - DNA, 22 bp, Artificial Sequence
  chemically synthesized
attagcatttccccattttctc

SEQ ID NO: 1177192 - DNA, 22 bp, Artificial Sequence
  chemically synthesized
aaaggaggagaaaatggggaaa

SEQ ID NO: 1177193 - DNA, 22 bp, Artificial Sequence
  chemically synthesized
tgcccattaattagcatttccc

SEQ ID NO: 1177194 - DNA, 22 bp, Artificial Sequence
  chemically synthesized
atgcccattaattagcatttcc

SEQ ID NO: 1177195 - DNA, 22 bp, Artificial Sequence
  chemically synthesized
tatgcccattaattagcatttc

SEQ ID NO: 1177196 - DNA, 22 bp, Artificial Sequence
  chemically synthesized
catgatgaaaattttatgccca

SEQ ID NO: 1177197 - DNA, 22 bp, Artificial Sequence
  chemically synthesized
gcatgatgaaaattttatgccc

SEQ ID NO: 1177198 - DNA, 22 bp, Artificial Sequence
  chemically synthesized
atcttgcatgatgaaaatttta

SEQ ID NO: 1177199 - DNA, 22 bp, Artificial Sequence
  chemically synthesized
attaatgggcataaaattttca

SEQ ID NO: 1177200 - DNA, 22 bp, Artificial Sequence
  chemically synthesized
ttcatcttgcatgatgaaaatt

SEQ ID NO: 1177201 - DNA, 22 bp, Artificial Sequence
  chemically synthesized
attcatcttgcatgatgaaaat

SEQ ID NO: 1177202 - DNA, 22 bp, Artificial Sequence
  chemically synthesized
atgggcataaaattttcatcat

SEQ ID NO: 1177203 - DNA, 22 bp, Artificial Sequence
  chemically synthesized
gaatttattcatcttgcatgat

SEQ ID NO: 1177204 - DNA, 22 bp, Artificial Sequence
  chemically synthesized
agaatttattcatcttgcatga

SEQ ID NO: 1177205 - DNA, 22 bp, Artificial Sequence
  chemically synthesized
tagaatttattcatcttgcatg

SEQ ID NO: 1177206 - DNA, 22 bp, Artificial Sequence
  chemically synthesized
tcatcatgcaagatgaataaat

SEQ ID NO: 1177207 - DNA, 22 bp, Artificial Sequence
  chemically synthesized
catcatgcaagatgaataaatt

SEQ ID NO: 1177208 - DNA, 22 bp, Artificial Sequence
  chemically synthesized
atcatgcaagatgaataaattc

SEQ ID NO: 1177209 - DNA, 22 bp, Artificial Sequence
  chemically synthesized
tgtagcagatctttagaattta

SEQ ID NO: 1177210 - DNA, 22 bp, Artificial Sequence
  chemically synthesized
gagacaacgttgtgtagcagat

SEQ ID NO: 1177211 - DNA, 22 bp, Artificial Sequence
  chemically synthesized
ttagagacaacgttgtgtagca

SEQ ID NO: 1177212 - DNA, 22 bp, Artificial Sequence
  chemically synthesized
taaagatctgctacacaacgtt

SEQ ID NO: 1177213 - DNA, 22 bp, Artificial Sequence
  chemically synthesized
aagatctgctacacaacgttgt

SEQ ID NO: 1177214 - DNA, 22 bp, Artificial Sequence
  chemically synthesized
ctacacaacgttgtctctaata

SEQ ID NO: 1177215 - DNA, 22 bp, Artificial Sequence
  chemically synthesized
cacaacgttgtctctaataata

SEQ ID NO: 1177216 - DNA, 22 bp, Artificial Sequence
  chemically synthesized
agtgtacaatacagtattatta

SEQ ID NO: 1177217 - DNA, 22 bp, Artificial Sequence
  chemically synthesized
aagtgtacaatacagtattatt

SEQ ID NO: 1177218 - DNA, 22 bp, Artificial Sequence
  chemically synthesized
taagtgtacaatacagtattat

SEQ ID NO: 1177219 - DNA, 22 bp, Artificial Sequence
  chemically synthesized
tctctaataatactgtattgta

SEQ ID NO: 1177220 - DNA, 22 bp, Artificial Sequence
  chemically synthesized
taataatactgtattgtacact

SEQ ID NO: 1177221 - DNA, 22 bp, Artificial Sequence
  chemically synthesized
ataatactgtattgtacactta

SEQ ID NO: 1177222 - DNA, 22 bp, Artificial Sequence
  chemically synthesized
tcaaataaccattttaagtgta

SEQ ID NO: 1177223 - DNA, 22 bp, Artificial Sequence
  chemically synthesized
atcaaataaccattttaagtgt

SEQ ID NO: 1177224 - DNA, 22 bp, Artificial Sequence
  chemically synthesized
tattgtacacttaaaatggtta

SEQ ID NO: 1177225 - DNA, 22 bp, Artificial Sequence
  chemically synthesized
aacagatttatcaaataaccat

SEQ ID NO: 1177226 - DNA, 22 bp, Artificial Sequence
  chemically synthesized
tacacttaaaatggttatttga

SEQ ID NO: 1177227 - DNA, 22 bp, Artificial Sequence
  chemically synthesized
aaaatggttatttgataaatct

SEQ ID NO: 1177228 - DNA, 22 bp, Artificial Sequence
  chemically synthesized
aaatggttatttgataaatctg

SEQ ID NO: 1177229 - DNA, 22 bp, Artificial Sequence
  chemically synthesized
taaggacactcaacagatttat

SEQ ID NO: 1177230 - DNA, 22 bp, Artificial Sequence
  chemically synthesized
tgtaaggacactcaacagattt

SEQ ID NO: 1177231 - DNA, 22 bp, Artificial Sequence
  chemically synthesized
ctgtaaggacactcaacagatt

SEQ ID NO: 1177232 - DNA, 22 bp, Artificial Sequence
  chemically synthesized
ttctgtaaggacactcaacaga

SEQ ID NO: 1177233 - DNA, 22 bp, Artificial Sequence
  chemically synthesized
cttctgtaaggacactcaacag

SEQ ID NO: 1177234 - DNA, 22 bp, Artificial Sequence
  chemically synthesized
tcttctgtaaggacactcaaca

SEQ ID NO: 1177235 - DNA, 22 bp, Artificial Sequence
  chemically synthesized
tttgataaatctgttgagtgtc

SEQ ID NO: 1177236 - DNA, 22 bp, Artificial Sequence
  chemically synthesized
ttcttctgtaaggacactcaac

SEQ ID NO: 1177237 - DNA, 22 bp, Artificial Sequence
  chemically synthesized
ttttcttctgtaaggacactca

SEQ ID NO: 1177238 - DNA, 22 bp, Artificial Sequence
  chemically synthesized
gataaatctgttgagtgtcctt

SEQ ID NO: 1177239 - DNA, 22 bp, Artificial Sequence
  chemically synthesized
ataaatctgttgagtgtcctta

SEQ ID NO: 1177240 - DNA, 22 bp, Artificial Sequence
  chemically synthesized
ttcttttcttctgtaaggacac

SEQ ID NO: 1177241 - DNA, 22 bp, Artificial Sequence
  chemically synthesized
aaactgttcttttcttctgtaa

SEQ ID NO: 1177242 - DNA, 22 bp, Artificial Sequence
  chemically synthesized
ttgagtgtccttacagaagaaa

SEQ ID NO: 1177243 - DNA, 22 bp, Artificial Sequence
  chemically synthesized
ttaaaactgttcttttcttctg

SEQ ID NO: 1177244 - DNA, 22 bp, Artificial Sequence
  chemically synthesized
gttaaaactgttcttttcttct

SEQ ID NO: 1177245 - DNA, 22 bp, Artificial Sequence
  chemically synthesized
agtgtccttacagaagaaaaga

SEQ ID NO: 1177246 - DNA, 22 bp, Artificial Sequence
  chemically synthesized
acagaagaaaagaacagtttta

SEQ ID NO: 1177247 - DNA, 22 bp, Artificial Sequence
  chemically synthesized
cagaagaaaagaacagttttaa

SEQ ID NO: 1177248 - DNA, 22 bp, Artificial Sequence
  chemically synthesized
tgatacataaaacatttgttaa

SEQ ID NO: 1177249 - DNA, 22 bp, Artificial Sequence
  chemically synthesized
gtgatacataaaacatttgtta

SEQ ID NO: 1177250 - DNA, 22 bp, Artificial Sequence
  chemically synthesized
tgtgatacataaaacatttgtt

SEQ ID NO: 1177251 - DNA, 22 bp, Artificial Sequence
  chemically synthesized
ctttgtgatacataaaacattt

SEQ ID NO: 1177252 - DNA, 22 bp, Artificial Sequence
  chemically synthesized
taacaaatgttttatgtatcac

SEQ ID NO: 1177253 - DNA, 22 bp, Artificial Sequence
  chemically synthesized
aacaaatgttttatgtatcaca

SEQ ID NO: 1177254 - DNA, 22 bp, Artificial Sequence
  chemically synthesized
acaaatgttttatgtatcacaa

SEQ ID NO: 1177255 - DNA, 22 bp, Artificial Sequence
  chemically synthesized
tatgtatcacaaagcagatgat

SEQ ID NO: 1177256 - DNA, 22 bp, Artificial Sequence
  chemically synthesized
atgtatcacaaagcagatgatg

SEQ ID NO: 1177257 - DNA, 22 bp, Artificial Sequence
  chemically synthesized
tgtatcacaaagcagatgatga

SEQ ID NO: 1177258 - DNA, 22 bp, Artificial Sequence
  chemically synthesized
gcaagaaacaccatagggcatc

SEQ ID NO: 1177259 - DNA, 22 bp, Artificial Sequence
  chemically synthesized
ttagcaagaaacaccatagggc

SEQ ID NO: 1177260 - DNA, 22 bp, Artificial Sequence
  chemically synthesized
aaaattgttagcaagaaacacc

SEQ ID NO: 1177261 - DNA, 22 bp, Artificial Sequence
  chemically synthesized
tggtgtttcttgctaacaattt

SEQ ID NO: 1177262 - DNA, 22 bp, Artificial Sequence
  chemically synthesized
cataaaaaatgtgttgaaaatt

SEQ ID NO: 1177263 - DNA, 22 bp, Artificial Sequence
  chemically synthesized
acataaaaaatgtgttgaaaat

SEQ ID NO: 1177264 - DNA, 22 bp, Artificial Sequence
  chemically synthesized
cttgctaacaattttcaacaca

SEQ ID NO: 1177265 - DNA, 22 bp, Artificial Sequence
  chemically synthesized
ttgctaacaattttcaacacat

SEQ ID NO: 1177266 - DNA, 22 bp, Artificial Sequence
  chemically synthesized
gctaacaattttcaacacattt

SEQ ID NO: 1177267 - DNA, 22 bp, Artificial Sequence
  chemically synthesized
accttacataaaaaatgtgttg

SEQ ID NO: 1177268 - DNA, 22 bp, Artificial Sequence
  chemically synthesized
ctaacaattttcaacacatttt

SEQ ID NO: 1177269 - DNA, 22 bp, Artificial Sequence
  chemically synthesized
caccttacataaaaaatgtgtt

SEQ ID NO: 1177270 - DNA, 22 bp, Artificial Sequence
  chemically synthesized
acaattttcaacacatttttta

SEQ ID NO: 1177271 - DNA, 22 bp, Artificial Sequence
  chemically synthesized
acatttcaccttacataaaaaa

SEQ ID NO: 1177272 - DNA, 22 bp, Artificial Sequence
  chemically synthesized
tcaacacattttttatgtaagg

SEQ ID NO: 1177273 - DNA, 22 bp, Artificial Sequence
  chemically synthesized
gttgacatttcaccttacataa

SEQ ID NO: 1177274 - DNA, 22 bp, Artificial Sequence
  chemically synthesized
caacacattttttatgtaaggt

SEQ ID NO: 1177275 - DNA, 22 bp, Artificial Sequence
  chemically synthesized
agttgacatttcaccttacata

SEQ ID NO: 1177276 - DNA, 22 bp, Artificial Sequence
  chemically synthesized
aacacattttttatgtaaggtg

SEQ ID NO: 1177277 - DNA, 22 bp, Artificial Sequence
  chemically synthesized
tagttgacatttcaccttacat

SEQ ID NO: 1177278 - DNA, 22 bp, Artificial Sequence
  chemically synthesized
gatattttagttgacatttcac

SEQ ID NO: 1177279 - DNA, 22 bp, Artificial Sequence
  chemically synthesized
ggatattttagttgacatttca

SEQ ID NO: 1177280 - DNA, 22 bp, Artificial Sequence
  chemically synthesized
tttatgtaaggtgaaatgtcaa

SEQ ID NO: 1177281 - DNA, 22 bp, Artificial Sequence
  chemically synthesized
ttatgtaaggtgaaatgtcaac

SEQ ID NO: 1177282 - DNA, 22 bp, Artificial Sequence
  chemically synthesized
tatgtaaggtgaaatgtcaact

SEQ ID NO: 1177283 - DNA, 22 bp, Artificial Sequence
  chemically synthesized
tttggatattttagttgacatt

SEQ ID NO: 1177284 - DNA, 22 bp, Artificial Sequence
  chemically synthesized
atgtaaggtgaaatgtcaacta

SEQ ID NO: 1177285 - DNA, 22 bp, Artificial Sequence
  chemically synthesized
tgtaaggtgaaatgtcaactaa

SEQ ID NO: 1177286 - DNA, 22 bp, Artificial Sequence
  chemically synthesized
tctatttggatattttagttga

SEQ ID NO: 1177287 - DNA, 22 bp, Artificial Sequence
  chemically synthesized
gtctatttggatattttagttg

SEQ ID NO: 1177288 - DNA, 22 bp, Artificial Sequence
  chemically synthesized
tgtctatttggatattttagtt

SEQ ID NO: 1177289 - DNA, 22 bp, Artificial Sequence
  chemically synthesized
ttgtctatttggatattttagt

SEQ ID NO: 1177290 - DNA, 22 bp, Artificial Sequence
  chemically synthesized
acttttgtctatttggatattt

SEQ ID NO: 1177291 - DNA, 22 bp, Artificial Sequence
  chemically synthesized
tgctcacttttgtctatttgga

SEQ ID NO: 1177292 - DNA, 22 bp, Artificial Sequence
  chemically synthesized
aaatatccaaatagacaaaagt

SEQ ID NO: 1177293 - DNA, 22 bp, Artificial Sequence
  chemically synthesized
cacattgtgctcacttttgtct

SEQ ID NO: 1177294 - DNA, 22 bp, Artificial Sequence
  chemically synthesized
ctgcacattgtgctcacttttg

SEQ ID NO: 1177295 - DNA, 22 bp, Artificial Sequence
  chemically synthesized
aggtatattactgcacattgtg

SEQ ID NO: 1177296 - DNA, 22 bp, Artificial Sequence
  chemically synthesized
aaggtatattactgcacattgt

SEQ ID NO: 1177297 - DNA, 22 bp, Artificial Sequence
  chemically synthesized
aatgtgtgacttaaggtatatt

SEQ ID NO: 1177298 - DNA, 22 bp, Artificial Sequence
  chemically synthesized
ctaaatgtgtgacttaaggtat

SEQ ID NO: 1177299 - DNA, 22 bp, Artificial Sequence
  chemically synthesized
actaaatgtgtgacttaaggta

SEQ ID NO: 1177300 - DNA, 22 bp, Artificial Sequence
  chemically synthesized
cttactaaatgtgtgacttaag

SEQ ID NO: 1177301 - DNA, 22 bp, Artificial Sequence
  chemically synthesized
ctacttactaaatgtgtgactt

SEQ ID NO: 1177302 - DNA, 22 bp, Artificial Sequence
  chemically synthesized
tgctacttactaaatgtgtgac

SEQ ID NO: 1177303 - DNA, 22 bp, Artificial Sequence
  chemically synthesized
gttctgctacttactaaatgtg

SEQ ID NO: 1177304 - DNA, 22 bp, Artificial Sequence
  chemically synthesized
tggttctgctacttactaaatg

SEQ ID NO: 1177305 - DNA, 22 bp, Artificial Sequence
  chemically synthesized
aagtcacacatttagtaagtag

SEQ ID NO: 1177306 - DNA, 22 bp, Artificial Sequence
  chemically synthesized
agtcacacatttagtaagtagc

SEQ ID NO: 1177307 - DNA, 22 bp, Artificial Sequence
  chemically synthesized
taattctggttctgctacttac

SEQ ID NO: 1177308 - DNA, 22 bp, Artificial Sequence
  chemically synthesized
tctgtaattctggttctgctac

SEQ ID NO: 1177309 - DNA, 22 bp, Artificial Sequence
  chemically synthesized
atctgtaattctggttctgcta

SEQ ID NO: 1177310 - DNA, 22 bp, Artificial Sequence
  chemically synthesized
tatctgtaattctggttctgct

SEQ ID NO: 1177311 - DNA, 22 bp, Artificial Sequence
  chemically synthesized
ttatctgtaattctggttctgc

SEQ ID NO: 1177312 - DNA, 22 bp, Artificial Sequence
  chemically synthesized
agtaagtagcagaaccagaatt

SEQ ID NO: 1177313 - DNA, 22 bp, Artificial Sequence
  chemically synthesized
acttttatctgtaattctggtt

SEQ ID NO: 1177314 - DNA, 22 bp, Artificial Sequence
  chemically synthesized
gtaagtagcagaaccagaatta

SEQ ID NO: 1177315 - DNA, 22 bp, Artificial Sequence
  chemically synthesized
atcagtctgacttttatctgta

SEQ ID NO: 1177316 - DNA, 22 bp, Artificial Sequence
  chemically synthesized
ctaatcagtctgacttttatct

SEQ ID NO: 1177317 - DNA, 22 bp, Artificial Sequence
  chemically synthesized
cagataaaagtcagactgatta

SEQ ID NO: 1177318 - DNA, 22 bp, Artificial Sequence
  chemically synthesized
attagcaactgtgtttgcgtgt

SEQ ID NO: 1177319 - DNA, 22 bp, Artificial Sequence
  chemically synthesized
gcaactgtgtttgcgtgtccgt

SEQ ID NO: 1177320 - DNA, 22 bp, Artificial Sequence
  chemically synthesized
tgtttgcgtgtccgtgtgtgtg

SEQ ID NO: 1177321 - DNA, 22 bp, Artificial Sequence
  chemically synthesized
gcgtgtccgtgtgtgtgtgtgt

SEQ ID NO: 1177322 - DNA, 22 bp, Artificial Sequence
  chemically synthesized
cgtgtccgtgtgtgtgtgtgtg

SEQ ID NO: 1177323 - DNA, 22 bp, Artificial Sequence
  chemically synthesized
tgttgtgtatgtgtgtatgggt

SEQ ID NO: 1177324 - DNA, 22 bp, Artificial Sequence
  chemically synthesized
agcatgtaggcacccacccata

SEQ ID NO: 1177325 - DNA, 22 bp, Artificial Sequence
  chemically synthesized
tgtatgtgtgtatgggtgggtg

SEQ ID NO: 1177326 - DNA, 22 bp, Artificial Sequence
  chemically synthesized
aaatatactaagcatgtaggca

SEQ ID NO: 1177327 - DNA, 22 bp, Artificial Sequence
  chemically synthesized
ggagattaaaatatactaagca

SEQ ID NO: 1177328 - DNA, 22 bp, Artificial Sequence
  chemically synthesized
aggagattaaaatatactaagc

SEQ ID NO: 1177329 - DNA, 22 bp, Artificial Sequence
  chemically synthesized
taggagattaaaatatactaag

SEQ ID NO: 1177330 - DNA, 22 bp, Artificial Sequence
  chemically synthesized
attttaggagattaaaatatac

SEQ ID NO: 1177331 - DNA, 22 bp, Artificial Sequence
  chemically synthesized
gattttaggagattaaaatata

SEQ ID NO: 1177332 - DNA, 22 bp, Artificial Sequence
  chemically synthesized
tgattttaggagattaaaatat

SEQ ID NO: 1177333 - DNA, 22 bp, Artificial Sequence
  chemically synthesized
catgcttagtatattttaatct

SEQ ID NO: 1177334 - DNA, 22 bp, Artificial Sequence
  chemically synthesized
ccctttgattttaggagattaa

SEQ ID NO: 1177335 - DNA, 22 bp, Artificial Sequence
  chemically synthesized
agtatattttaatctcctaaaa

SEQ ID NO: 1177336 - DNA, 22 bp, Artificial Sequence
  chemically synthesized
gtatattttaatctcctaaaat

SEQ ID NO: 1177337 - DNA, 22 bp, Artificial Sequence
  chemically synthesized
gacagttgccctttgattttag

SEQ ID NO: 1177338 - DNA, 22 bp, Artificial Sequence
  chemically synthesized
taatctcctaaaatcaaagggc

SEQ ID NO: 1177339 - DNA, 22 bp, Artificial Sequence
  chemically synthesized
gcctggacagttgccctttgat

SEQ ID NO: 1177340 - DNA, 22 bp, Artificial Sequence
  chemically synthesized
aatctcctaaaatcaaagggca

SEQ ID NO: 1177341 - DNA, 22 bp, Artificial Sequence
  chemically synthesized
atctcctaaaatcaaagggcaa

SEQ ID NO: 1177342 - DNA, 22 bp, Artificial Sequence
  chemically synthesized
atattggcctggacagttgccc

SEQ ID NO: 1177343 - DNA, 22 bp, Artificial Sequence
  chemically synthesized
ctaaaatcaaagggcaactgtc

SEQ ID NO: 1177344 - DNA, 22 bp, Artificial Sequence
  chemically synthesized
aaatcaaagggcaactgtccag

SEQ ID NO: 1177345 - DNA, 22 bp, Artificial Sequence
  chemically synthesized
gtagaatgtactcatattggcc

SEQ ID NO: 1177346 - DNA, 22 bp, Artificial Sequence
  chemically synthesized
cgtagaatgtactcatattggc

SEQ ID NO: 1177347 - DNA, 22 bp, Artificial Sequence
  chemically synthesized
tttcgtagaatgtactcatatt

SEQ ID NO: 1177348 - DNA, 22 bp, Artificial Sequence
  chemically synthesized
gtttcgtagaatgtactcatat

SEQ ID NO: 1177349 - DNA, 22 bp, Artificial Sequence
  chemically synthesized
ttgtttcgtagaatgtactcat

SEQ ID NO: 1177350 - DNA, 22 bp, Artificial Sequence
  chemically synthesized
tccaggccaatatgagtacatt

SEQ ID NO: 1177351 - DNA, 22 bp, Artificial Sequence
  chemically synthesized
ttcttgtttcgtagaatgtact

SEQ ID NO: 1177352 - DNA, 22 bp, Artificial Sequence
  chemically synthesized
attcttgtttcgtagaatgtac

SEQ ID NO: 1177353 - DNA, 22 bp, Artificial Sequence
  chemically synthesized
gtgtttattcttgtttcgtaga

SEQ ID NO: 1177354 - DNA, 22 bp, Artificial Sequence
  chemically synthesized
tacgaaacaagaataaacacta

SEQ ID NO: 1177355 - DNA, 22 bp, Artificial Sequence
  chemically synthesized
cgaaacaagaataaacactaac

SEQ ID NO: 1177356 - DNA, 22 bp, Artificial Sequence
  chemically synthesized
acatgtgatcccttctctactc

SEQ ID NO: 1177357 - DNA, 22 bp, Artificial Sequence
  chemically synthesized
tgagagaatgagggaggagtag

SEQ ID NO: 1177358 - DNA, 22 bp, Artificial Sequence
  chemically synthesized
actgtgagagaatgagggagga

SEQ ID NO: 1177359 - DNA, 22 bp, Artificial Sequence
  chemically synthesized
tgactgtgagagaatgagggag

SEQ ID NO: 1177360 - DNA, 22 bp, Artificial Sequence
  chemically synthesized
ctctactcctccctcattctct

SEQ ID NO: 1177361 - DNA, 22 bp, Artificial Sequence
  chemically synthesized
tctactcctccctcattctctc

SEQ ID NO: 1177362 - DNA, 22 bp, Artificial Sequence
  chemically synthesized
tactcctccctcattctctcac

SEQ ID NO: 1177363 - DNA, 22 bp, Artificial Sequence
  chemically synthesized
ctcctccctcattctctcacag

SEQ ID NO: 1177364 - DNA, 22 bp, Artificial Sequence
  chemically synthesized
ctccctcattctctcacagtca

SEQ ID NO: 1177365 - DNA, 22 bp, Artificial Sequence
  chemically synthesized
cctcattctctcacagtcagag

SEQ ID NO: 1177366 - DNA, 22 bp, Artificial Sequence
  chemically synthesized
attctctcacagtcagagttat

SEQ ID NO: 1177367 - DNA, 22 bp, Artificial Sequence
  chemically synthesized
tctcacagtcagagttatatta

SEQ ID NO: 1177368 - DNA, 22 bp, Artificial Sequence
  chemically synthesized
tcacagtcagagttatattatc

SEQ ID NO: 1177369 - DNA, 22 bp, Artificial Sequence
  chemically synthesized
acagtcagagttatattatctt

SEQ ID NO: 1177370 - DNA, 22 bp, Artificial Sequence
  chemically synthesized
gtcatggggcagggaaagataa

SEQ ID NO: 1177371 - DNA, 22 bp, Artificial Sequence
  chemically synthesized
ggtcatggggcagggaaagata

SEQ ID NO: 1177372 - DNA, 22 bp, Artificial Sequence
  chemically synthesized
tggtcatggggcagggaaagat

SEQ ID NO: 1177373 - DNA, 22 bp, Artificial Sequence
  chemically synthesized
ttggtcatggggcagggaaaga

SEQ ID NO: 1177374 - DNA, 22 bp, Artificial Sequence
  chemically synthesized
tttggtcatggggcagggaaag

SEQ ID NO: 1177375 - DNA, 22 bp, Artificial Sequence
  chemically synthesized
ttttggtcatggggcagggaaa

SEQ ID NO: 1177376 - DNA, 22 bp, Artificial Sequence
  chemically synthesized
ttttttggtcatggggcaggga

SEQ ID NO: 1177377 - DNA, 22 bp, Artificial Sequence
  chemically synthesized
tattatctttccctgccccatg

SEQ ID NO: 1177378 - DNA, 22 bp, Artificial Sequence
  chemically synthesized
tctttccctgccccatgaccaa

SEQ ID NO: 1177379 - DNA, 22 bp, Artificial Sequence
  chemically synthesized
tccctgccccatgaccaaaaaa

SEQ ID NO: 1177380 - DNA, 22 bp, Artificial Sequence
  chemically synthesized
ccctgccccatgaccaaaaaag

SEQ ID NO: 1177381 - DNA, 22 bp, Artificial Sequence
  chemically synthesized
cctgccccatgaccaaaaaaga

SEQ ID NO: 1177382 - DNA, 22 bp, Artificial Sequence
  chemically synthesized
ccccatgaccaaaaaagaatct

SEQ ID NO: 1177383 - DNA, 22 bp, Artificial Sequence
  chemically synthesized
acaaaggacagaatgtgaaaag

SEQ ID NO: 1177384 - DNA, 22 bp, Artificial Sequence
  chemically synthesized
cacaaaggacagaatgtgaaaa

SEQ ID NO: 1177385 - DNA, 22 bp, Artificial Sequence
  chemically synthesized
ttcacaaaggacagaatgtgaa

SEQ ID NO: 1177386 - DNA, 22 bp, Artificial Sequence
  chemically synthesized
tcttcacaaaggacagaatgtg

SEQ ID NO: 1177387 - DNA, 22 bp, Artificial Sequence
  chemically synthesized
ctcttcacaaaggacagaatgt

SEQ ID NO: 1177388 - DNA, 22 bp, Artificial Sequence
  chemically synthesized
tctcttcacaaaggacagaatg

SEQ ID NO: 1177389 - DNA, 22 bp, Artificial Sequence
  chemically synthesized
tgcttttcacattctgtccttt

SEQ ID NO: 1177390 - DNA, 22 bp, Artificial Sequence
  chemically synthesized
ttcacattctgtcctttgtgaa

SEQ ID NO: 1177391 - DNA, 22 bp, Artificial Sequence
  chemically synthesized
tcacattctgtcctttgtgaag

SEQ ID NO: 1177392 - DNA, 22 bp, Artificial Sequence
  chemically synthesized
cacattctgtcctttgtgaaga

SEQ ID NO: 1177393 - DNA, 22 bp, Artificial Sequence
  chemically synthesized
acattctgtcctttgtgaagag

SEQ ID NO: 1177394 - DNA, 22 bp, Artificial Sequence
  chemically synthesized
accagtcaaattttctcttcac

SEQ ID NO: 1177395 - DNA, 22 bp, Artificial Sequence
  chemically synthesized
tgtcctttgtgaagagaaaatt

SEQ ID NO: 1177396 - DNA, 22 bp, Artificial Sequence
  chemically synthesized
tgttgaccagtcaaattttctc

SEQ ID NO: 1177397 - DNA, 22 bp, Artificial Sequence
  chemically synthesized
tcctttgtgaagagaaaatttg

SEQ ID NO: 1177398 - DNA, 22 bp, Artificial Sequence
  chemically synthesized
atgttgaccagtcaaattttct

SEQ ID NO: 1177399 - DNA, 22 bp, Artificial Sequence
  chemically synthesized
tgtgaagagaaaatttgactgg

SEQ ID NO: 1177400 - DNA, 22 bp, Artificial Sequence
  chemically synthesized
gtgaagagaaaatttgactggt

SEQ ID NO: 1177401 - DNA, 22 bp, Artificial Sequence
  chemically synthesized
tgaagagaaaatttgactggtc

SEQ ID NO: 1177402 - DNA, 22 bp, Artificial Sequence
  chemically synthesized
gactggtcaacataaacttacg

SEQ ID NO: 1177403 - DNA, 22 bp, Artificial Sequence
  chemically synthesized
actggtcaacataaacttacgc

SEQ ID NO: 1177404 - DNA, 22 bp, Artificial Sequence
  chemically synthesized
gtcaacataaacttacgcacgt

SEQ ID NO: 1177405 - DNA, 22 bp, Artificial Sequence
  chemically synthesized
acaggagtgacaacgtgcgtaa

SEQ ID NO: 1177406 - DNA, 22 bp, Artificial Sequence
  chemically synthesized
ttcacaggagtgacaacgtgcg

SEQ ID NO: 1177407 - DNA, 22 bp, Artificial Sequence
  chemically synthesized
gaattattcacaggagtgacaa

SEQ ID NO: 1177408 - DNA, 22 bp, Artificial Sequence
  chemically synthesized
ttagaattattcacaggagtga

SEQ ID NO: 1177409 - DNA, 22 bp, Artificial Sequence
  chemically synthesized
attagaattattcacaggagtg

SEQ ID NO: 1177410 - DNA, 22 bp, Artificial Sequence
  chemically synthesized
acgcacgttgtcactcctgtga

SEQ ID NO: 1177411 - DNA, 22 bp, Artificial Sequence
  chemically synthesized
cgcacgttgtcactcctgtgaa

SEQ ID NO: 1177412 - DNA, 22 bp, Artificial Sequence
  chemically synthesized
tttattagaattattcacagga

SEQ ID NO: 1177413 - DNA, 22 bp, Artificial Sequence
  chemically synthesized
atttattagaattattcacagg

SEQ ID NO: 1177414 - DNA, 22 bp, Artificial Sequence
  chemically synthesized
tcactcctgtgaataattctaa

SEQ ID NO: 1177415 - DNA, 22 bp, Artificial Sequence
  chemically synthesized
gtcatttatttattagaattat

SEQ ID NO: 1177416 - DNA, 22 bp, Artificial Sequence
  chemically synthesized
ctagtcatttatttattagaat

SEQ ID NO: 1177417 - DNA, 22 bp, Artificial Sequence
  chemically synthesized
ctgtgaataattctaataaata

SEQ ID NO: 1177418 - DNA, 22 bp, Artificial Sequence
  chemically synthesized
tgaataattctaataaataaat

SEQ ID NO: 1177419 - DNA, 22 bp, Artificial Sequence
  chemically synthesized
taataaataaatgactaggaac

SEQ ID NO: 1177420 - DNA, 22 bp, Artificial Sequence
  chemically synthesized
ataaataaatgactaggaactt

SEQ ID NO: 1177421 - DNA, 22 bp, Artificial Sequence
  chemically synthesized
taaggagggagtcaaagttcct

SEQ ID NO: 1177422 - DNA, 22 bp, Artificial Sequence
  chemically synthesized
ccaaagttgtaaggagggagtc

SEQ ID NO: 1177423 - DNA, 22 bp, Artificial Sequence
  chemically synthesized
ttgccaaagttgtaaggaggga

SEQ ID NO: 1177424 - DNA, 22 bp, Artificial Sequence
  chemically synthesized
ggaactttgactccctccttac

SEQ ID NO: 1177425 - DNA, 22 bp, Artificial Sequence
  chemically synthesized
attgccaaagttgtaaggaggg

SEQ ID NO: 1177426 - DNA, 22 bp, Artificial Sequence
  chemically synthesized
tattgccaaagttgtaaggagg

SEQ ID NO: 1177427 - DNA, 22 bp, Artificial Sequence
  chemically synthesized
ttttattgccaaagttgtaagg

SEQ ID NO: 1177428 - DNA, 22 bp, Artificial Sequence
  chemically synthesized
tgactccctccttacaactttg

SEQ ID NO: 1177429 - DNA, 22 bp, Artificial Sequence
  chemically synthesized
gactccctccttacaactttgg

SEQ ID NO: 1177430 - DNA, 22 bp, Artificial Sequence
  chemically synthesized
actccctccttacaactttggc

SEQ ID NO: 1177431 - DNA, 22 bp, Artificial Sequence
  chemically synthesized
aaaatctgttttattgccaaag

SEQ ID NO: 1177432 - DNA, 22 bp, Artificial Sequence
  chemically synthesized
cctccttacaactttggcaata

SEQ ID NO: 1177433 - DNA, 22 bp, Artificial Sequence
  chemically synthesized
aaaaatctgttttattgccaaa

SEQ ID NO: 1177434 - DNA, 22 bp, Artificial Sequence
  chemically synthesized
cttacaactttggcaataaaac

SEQ ID NO: 1177435 - DNA, 22 bp, Artificial Sequence
  chemically synthesized
acaactttggcaataaaacaga

SEQ ID NO: 1177436 - DNA, 22 bp, Artificial Sequence
  chemically synthesized
tatgtttaaaaatctgttttat

SEQ ID NO: 1177437 - DNA, 22 bp, Artificial Sequence
  chemically synthesized
caactttggcaataaaacagat

SEQ ID NO: 1177438 - DNA, 22 bp, Artificial Sequence
  chemically synthesized
tggcaataaaacagatttttaa

SEQ ID NO: 1177439 - DNA, 22 bp, Artificial Sequence
  chemically synthesized
ggcaataaaacagatttttaaa

SEQ ID NO: 1177440 - DNA, 22 bp, Artificial Sequence
  chemically synthesized
gcaataaaacagatttttaaac

SEQ ID NO: 1177441 - DNA, 22 bp, Artificial Sequence
  chemically synthesized
tgcaaattatatgtttaaaaat

SEQ ID NO: 1177442 - DNA, 22 bp, Artificial Sequence
  chemically synthesized
atgcaaattatatgtttaaaaa

SEQ ID NO: 1177443 - DNA, 22 bp, Artificial Sequence
  chemically synthesized
acttatgcaaattatatgttta

SEQ ID NO: 1177444 - DNA, 22 bp, Artificial Sequence
  chemically synthesized
catgattaacttatgcaaatta

SEQ ID NO: 1177445 - DNA, 22 bp, Artificial Sequence
  chemically synthesized
acatgattaacttatgcaaatt

SEQ ID NO: 1177446 - DNA, 22 bp, Artificial Sequence
  chemically synthesized
ttaaacatataatttgcataag

SEQ ID NO: 1177447 - DNA, 22 bp, Artificial Sequence
  chemically synthesized
taaacatataatttgcataagt

SEQ ID NO: 1177448 - DNA, 22 bp, Artificial Sequence
  chemically synthesized
aaacatataatttgcataagtt

SEQ ID NO: 1177449 - DNA, 22 bp, Artificial Sequence
  chemically synthesized
aacatataatttgcataagtta

SEQ ID NO: 1177450 - DNA, 22 bp, Artificial Sequence
  chemically synthesized
tatttacatgattaacttatgc

SEQ ID NO: 1177451 - DNA, 22 bp, Artificial Sequence
  chemically synthesized
atatttacatgattaacttatg

SEQ ID NO: 1177452 - DNA, 22 bp, Artificial Sequence
  chemically synthesized
tatatttacatgattaacttat

SEQ ID NO: 1177453 - DNA, 22 bp, Artificial Sequence
  chemically synthesized
ttatatttacatgattaactta

SEQ ID NO: 1177454 - DNA, 22 bp, Artificial Sequence
  chemically synthesized
aatttttatatttacatgatta

SEQ ID NO: 1177455 - DNA, 22 bp, Artificial Sequence
  chemically synthesized
aaatttttatatttacatgatt

SEQ ID NO: 1177456 - DNA, 22 bp, Artificial Sequence
  chemically synthesized
gcataagttaatcatgtaaata

SEQ ID NO: 1177457 - DNA, 22 bp, Artificial Sequence
  chemically synthesized
cataagttaatcatgtaaatat

SEQ ID NO: 1177458 - DNA, 22 bp, Artificial Sequence
  chemically synthesized
tgtttaaatttttatatttaca

SEQ ID NO: 1177459 - DNA, 22 bp, Artificial Sequence
  chemically synthesized
atgtttaaatttttatatttac

SEQ ID NO: 1177460 - DNA, 22 bp, Artificial Sequence
  chemically synthesized
tatgtttaaatttttatattta

SEQ ID NO: 1177461 - DNA, 22 bp, Artificial Sequence
  chemically synthesized
ttttatgtttaaatttttatat

SEQ ID NO: 1177462 - DNA, 22 bp, Artificial Sequence
  chemically synthesized
gttttatgtttaaatttttata

SEQ ID NO: 1177463 - DNA, 22 bp, Artificial Sequence
  chemically synthesized
atcatgtaaatataaaaattta

SEQ ID NO: 1177464 - DNA, 22 bp, Artificial Sequence
  chemically synthesized
agtacatttgttttatgtttaa

SEQ ID NO: 1177465 - DNA, 22 bp, Artificial Sequence
  chemically synthesized
cagtacatttgttttatgttta

SEQ ID NO: 1177466 - DNA, 22 bp, Artificial Sequence
  chemically synthesized
tcagtacatttgttttatgttt

SEQ ID NO: 1177467 - DNA, 22 bp, Artificial Sequence
  chemically synthesized
tttcagtacatttgttttatgt

SEQ ID NO: 1177468 - DNA, 22 bp, Artificial Sequence
  chemically synthesized
ctttcagtacatttgttttatg

SEQ ID NO: 1177469 - DNA, 22 bp, Artificial Sequence
  chemically synthesized
tctttcagtacatttgttttat

SEQ ID NO: 1177470 - DNA, 22 bp, Artificial Sequence
  chemically synthesized
ttctttcagtacatttgtttta

SEQ ID NO: 1177471 - DNA, 22 bp, Artificial Sequence
  chemically synthesized
tttctttcagtacatttgtttt

SEQ ID NO: 1177472 - DNA, 22 bp, Artificial Sequence
  chemically synthesized
ttttttctttcagtacatttgt

SEQ ID NO: 1177473 - DNA, 22 bp, Artificial Sequence
  chemically synthesized
aaacataaaacaaatgtactga

SEQ ID NO: 1177474 - DNA, 22 bp, Artificial Sequence
  chemically synthesized
aacataaaacaaatgtactgaa

SEQ ID NO: 1177475 - DNA, 22 bp, Artificial Sequence
  chemically synthesized
ataatagttgttttttctttca

SEQ ID NO: 1177476 - DNA, 22 bp, Artificial Sequence
  chemically synthesized
tacatgacctcataatagttgt

SEQ ID NO: 1177477 - DNA, 22 bp, Artificial Sequence
  chemically synthesized
aaagaaaaaacaactattatga

SEQ ID NO: 1177478 - DNA, 22 bp, Artificial Sequence
  chemically synthesized
ttatacatgacctcataatagt

SEQ ID NO: 1177479 - DNA, 22 bp, Artificial Sequence
  chemically synthesized
ttgttatacatgacctcataat

SEQ ID NO: 1177480 - DNA, 22 bp, Artificial Sequence
  chemically synthesized
attgttatacatgacctcataa

SEQ ID NO: 1177481 - DNA, 22 bp, Artificial Sequence
  chemically synthesized
tattgttatacatgacctcata

SEQ ID NO: 1177482 - DNA, 22 bp, Artificial Sequence
  chemically synthesized
ttatgaggtcatgtataacaat

SEQ ID NO: 1177483 - DNA, 22 bp, Artificial Sequence
  chemically synthesized
tcagtggtgattttattgttat

SEQ ID NO: 1177484 - DNA, 22 bp, Artificial Sequence
  chemically synthesized
tgaggtcatgtataacaataaa

SEQ ID NO: 1177485 - DNA, 22 bp, Artificial Sequence
  chemically synthesized
atcagtggtgattttattgtta

SEQ ID NO: 1177486 - DNA, 22 bp, Artificial Sequence
  chemically synthesized
ggtttatcagtggtgattttat

SEQ ID NO: 1177487 - DNA, 22 bp, Artificial Sequence
  chemically synthesized
gtgtgttaggtttatcagtggt

SEQ ID NO: 1177488 - DNA, 22 bp, Artificial Sequence
  chemically synthesized
agtgtgttaggtttatcagtgg

SEQ ID NO: 1177489 - DNA, 22 bp, Artificial Sequence
  chemically synthesized
tagtgtgttaggtttatcagtg

SEQ ID NO: 1177490 - DNA, 22 bp, Artificial Sequence
  chemically synthesized
ttagtgtgttaggtttatcagt

SEQ ID NO: 1177491 - DNA, 22 bp, Artificial Sequence
  chemically synthesized
tttagtgtgttaggtttatcag

SEQ ID NO: 1177492 - DNA, 22 bp, Artificial Sequence
  chemically synthesized
ctttttagtgtgttaggtttat

SEQ ID NO: 1177493 - DNA, 22 bp, Artificial Sequence
  chemically synthesized
actttttagtgtgttaggttta

SEQ ID NO: 1177494 - DNA, 22 bp, Artificial Sequence
  chemically synthesized
tcttactttttagtgtgttagg

SEQ ID NO: 1177495 - DNA, 22 bp, Artificial Sequence
  chemically synthesized
atcttactttttagtgtgttag

SEQ ID NO: 1177496 - DNA, 22 bp, Artificial Sequence
  chemically synthesized
ataaacctaacacactaaaaag

SEQ ID NO: 1177497 - DNA, 22 bp, Artificial Sequence
  chemically synthesized
agacttatcttactttttagtg

SEQ ID NO: 1177498 - DNA, 22 bp, Artificial Sequence
  chemically synthesized
gagacttatcttactttttagt

SEQ ID NO: 1177499 - DNA, 22 bp, Artificial Sequence
  chemically synthesized
tgagacttatcttactttttag

SEQ ID NO: 1177500 - DNA, 22 bp, Artificial Sequence
  chemically synthesized
acacactaaaaagtaagataag

SEQ ID NO: 1177501 - DNA, 22 bp, Artificial Sequence
  chemically synthesized
cagtgactttgagacttatctt

SEQ ID NO: 1177502 - DNA, 22 bp, Artificial Sequence
  chemically synthesized
ccagtgactttgagacttatct

SEQ ID NO: 1177503 - DNA, 22 bp, Artificial Sequence
  chemically synthesized
tccagtgactttgagacttatc

SEQ ID NO: 1177504 - DNA, 22 bp, Artificial Sequence
  chemically synthesized
ttccagtgactttgagacttat

SEQ ID NO: 1177505 - DNA, 22 bp, Artificial Sequence
  chemically synthesized
tttccagtgactttgagactta

SEQ ID NO: 1177506 - DNA, 22 bp, Artificial Sequence
  chemically synthesized
ttttccagtgactttgagactt

SEQ ID NO: 1177507 - DNA, 22 bp, Artificial Sequence
  chemically synthesized
aaaagtaagataagtctcaaag

SEQ ID NO: 1177508 - DNA, 22 bp, Artificial Sequence
  chemically synthesized
catatttttttccagtgacttt

SEQ ID NO: 1177509 - DNA, 22 bp, Artificial Sequence
  chemically synthesized
attacatatttttttccagtga

SEQ ID NO: 1177510 - DNA, 22 bp, Artificial Sequence
  chemically synthesized
cattacatatttttttccagtg

SEQ ID NO: 1177511 - DNA, 22 bp, Artificial Sequence
  chemically synthesized
tcattacatatttttttccagt

SEQ ID NO: 1177512 - DNA, 22 bp, Artificial Sequence
  chemically synthesized
ttcattacatatttttttccag

SEQ ID NO: 1177513 - DNA, 22 bp, Artificial Sequence
  chemically synthesized
aaagtcactggaaaaaaatatg

SEQ ID NO: 1177514 - DNA, 22 bp, Artificial Sequence
  chemically synthesized
aatttttcattacatatttttt

SEQ ID NO: 1177515 - DNA, 22 bp, Artificial Sequence
  chemically synthesized
aaatttttcattacatattttt

SEQ ID NO: 1177516 - DNA, 22 bp, Artificial Sequence
  chemically synthesized
taaatttttcattacatatttt

SEQ ID NO: 1177517 - DNA, 22 bp, Artificial Sequence
  chemically synthesized
taactttaaatttttcattaca

SEQ ID NO: 1177518 - DNA, 22 bp, Artificial Sequence
  chemically synthesized
ataactttaaatttttcattac

SEQ ID NO: 1177519 - DNA, 22 bp, Artificial Sequence
  chemically synthesized
gaaaaaaatatgtaatgaaaaa

SEQ ID NO: 1177520 - DNA, 22 bp, Artificial Sequence
  chemically synthesized
taagatttataactttaaattt

SEQ ID NO: 1177521 - DNA, 22 bp, Artificial Sequence
  chemically synthesized
gtaagatttataactttaaatt

SEQ ID NO: 1177522 - DNA, 22 bp, Artificial Sequence
  chemically synthesized
tgtaagatttataactttaaat

SEQ ID NO: 1177523 - DNA, 22 bp, Artificial Sequence
  chemically synthesized
ttgtaagatttataactttaaa

SEQ ID NO: 1177524 - DNA, 22 bp, Artificial Sequence
  chemically synthesized
tatttttgtaagatttataact

SEQ ID NO: 1177525 - DNA, 22 bp, Artificial Sequence
  chemically synthesized
tcctatatttttgtaagattta

SEQ ID NO: 1177526 - DNA, 22 bp, Artificial Sequence
  chemically synthesized
aaagttataaatcttacaaaaa

SEQ ID NO: 1177527 - DNA, 22 bp, Artificial Sequence
  chemically synthesized
aagttataaatcttacaaaaat

SEQ ID NO: 1177528 - DNA, 22 bp, Artificial Sequence
  chemically synthesized
ggcactgtcctatatttttgta

SEQ ID NO: 1177529 - DNA, 22 bp, Artificial Sequence
  chemically synthesized
taaatcttacaaaaatatagga

SEQ ID NO: 1177530 - DNA, 22 bp, Artificial Sequence
  chemically synthesized
agataattaggcactgtcctat

SEQ ID NO: 1177531 - DNA, 22 bp, Artificial Sequence
  chemically synthesized
acaaaaatataggacagtgcct

SEQ ID NO: 1177532 - DNA, 22 bp, Artificial Sequence
  chemically synthesized
caaaaatataggacagtgccta

SEQ ID NO: 1177533 - DNA, 22 bp, Artificial Sequence
  chemically synthesized
atcactcagataattaggcact

SEQ ID NO: 1177534 - DNA, 22 bp, Artificial Sequence
  chemically synthesized
gcaatattaatcactcagataa

SEQ ID NO: 1177535 - DNA, 22 bp, Artificial Sequence
  chemically synthesized
gcatacctagcaatattaatca

SEQ ID NO: 1177536 - DNA, 22 bp, Artificial Sequence
  chemically synthesized
attatctgagtgattaatattg

SEQ ID NO: 1177537 - DNA, 22 bp, Artificial Sequence
  chemically synthesized
ccctagcatacctagcaatatt

SEQ ID NO: 1177538 - DNA, 22 bp, Artificial Sequence
  chemically synthesized
tctgagtgattaatattgctag

SEQ ID NO: 1177539 - DNA, 22 bp, Artificial Sequence
  chemically synthesized
agtgattaatattgctaggtat

SEQ ID NO: 1177540 - DNA, 22 bp, Artificial Sequence
  chemically synthesized
atctcccctagcatacctagca

SEQ ID NO: 1177541 - DNA, 22 bp, Artificial Sequence
  chemically synthesized
gctgatctcccctagcatacct

SEQ ID NO: 1177542 - DNA, 22 bp, Artificial Sequence
  chemically synthesized
atattgctaggtatgctagggg

SEQ ID NO: 1177543 - DNA, 22 bp, Artificial Sequence
  chemically synthesized
agcattggctgatctcccctag

SEQ ID NO: 1177544 - DNA, 22 bp, Artificial Sequence
  chemically synthesized
ctaggtatgctaggggagatca

SEQ ID NO: 1177545 - DNA, 22 bp, Artificial Sequence
  chemically synthesized
gactaagcattggctgatctcc

SEQ ID NO: 1177546 - DNA, 22 bp, Artificial Sequence
  chemically synthesized
ggtatgctaggggagatcagcc

SEQ ID NO: 1177547 - DNA, 22 bp, Artificial Sequence
  chemically synthesized
taacactggactaagcattggc

SEQ ID NO: 1177548 - DNA, 22 bp, Artificial Sequence
  chemically synthesized
ggggagatcagccaatgcttag

SEQ ID NO: 1177549 - DNA, 22 bp, Artificial Sequence
  chemically synthesized
aactataacactggactaagca

SEQ ID NO: 1177550 - DNA, 22 bp, Artificial Sequence
  chemically synthesized
agtccagtgttatagttgagcc

SEQ ID NO: 1177551 - DNA, 22 bp, Artificial Sequence
  chemically synthesized
gtccagtgttatagttgagcct

SEQ ID NO: 1177552 - DNA, 22 bp, Artificial Sequence
  chemically synthesized
tagaaatacaaaaggctcaact

SEQ ID NO: 1177553 - DNA, 22 bp, Artificial Sequence
  chemically synthesized
tagttgagccttttgtatttct

SEQ ID NO: 1177554 - DNA, 22 bp, Artificial Sequence
  chemically synthesized
agccttttgtatttctacagtt

SEQ ID NO: 1177555 - DNA, 22 bp, Artificial Sequence
  chemically synthesized
ttgtatttctacagttatatgt

SEQ ID NO: 1177556 - DNA, 22 bp, Artificial Sequence
  chemically synthesized
tgtatttctacagttatatgtt

SEQ ID NO: 1177557 - DNA, 22 bp, Artificial Sequence
  chemically synthesized
gtatttctacagttatatgttt

SEQ ID NO: 1177558 - DNA, 22 bp, Artificial Sequence
  chemically synthesized
tatttctacagttatatgtttt

SEQ ID NO: 1177559 - DNA, 22 bp, Artificial Sequence
  chemically synthesized
taccatatcatgaagcaaaaca

SEQ ID NO: 1177560 - DNA, 22 bp, Artificial Sequence
  chemically synthesized
ctacagttatatgttttgcttc

SEQ ID NO: 1177561 - DNA, 22 bp, Artificial Sequence
  chemically synthesized
tacagttatatgttttgcttca

SEQ ID NO: 1177562 - DNA, 22 bp, Artificial Sequence
  chemically synthesized
cagttatatgttttgcttcatg

SEQ ID NO: 1177563 - DNA, 22 bp, Artificial Sequence
  chemically synthesized
caattataccatatcatgaagc

SEQ ID NO: 1177564 - DNA, 22 bp, Artificial Sequence
  chemically synthesized
tatgttttgcttcatgatatgg

SEQ ID NO: 1177565 - DNA, 22 bp, Artificial Sequence
  chemically synthesized
tgcttcatgatatggtataatt

SEQ ID NO: 1177566 - DNA, 22 bp, Artificial Sequence
  chemically synthesized
tggaataactccaattatacca

SEQ ID NO: 1177567 - DNA, 22 bp, Artificial Sequence
  chemically synthesized
gcttcatgatatggtataattg

SEQ ID NO: 1177568 - DNA, 22 bp, Artificial Sequence
  chemically synthesized
cttcatgatatggtataattgg

SEQ ID NO: 1177569 - DNA, 22 bp, Artificial Sequence
  chemically synthesized
catgatatggtataattggagt

SEQ ID NO: 1177570 - DNA, 22 bp, Artificial Sequence
  chemically synthesized
ccctgtggaataactccaatta

SEQ ID NO: 1177571 - DNA, 22 bp, Artificial Sequence
  chemically synthesized
atgatatggtataattggagtt

SEQ ID NO: 1177572 - DNA, 22 bp, Artificial Sequence
  chemically synthesized
cccctgtggaataactccaatt

SEQ ID NO: 1177573 - DNA, 22 bp, Artificial Sequence
  chemically synthesized
acttcccctgtggaataactcc

SEQ ID NO: 1177574 - DNA, 22 bp, Artificial Sequence
  chemically synthesized
ttaacttcccctgtggaataac

SEQ ID NO: 1177575 - DNA, 22 bp, Artificial Sequence
  chemically synthesized
tattaacttcccctgtggaata

SEQ ID NO: 1177576 - DNA, 22 bp, Artificial Sequence
  chemically synthesized
ctattaacttcccctgtggaat

SEQ ID NO: 1177577 - DNA, 22 bp, Artificial Sequence
  chemically synthesized
cttctattaacttcccctgtgg

SEQ ID NO: 1177578 - DNA, 22 bp, Artificial Sequence
  chemically synthesized
ccttctattaacttcccctgtg

SEQ ID NO: 1177579 - DNA, 22 bp, Artificial Sequence
  chemically synthesized
tccttctattaacttcccctgt

SEQ ID NO: 1177580 - DNA, 22 bp, Artificial Sequence
  chemically synthesized
gagttattccacaggggaagtt

SEQ ID NO: 1177581 - DNA, 22 bp, Artificial Sequence
  chemically synthesized
tttccttctattaacttcccct

SEQ ID NO: 1177582 - DNA, 22 bp, Artificial Sequence
  chemically synthesized
ttctttccttctattaacttcc

SEQ ID NO: 1177583 - DNA, 22 bp, Artificial Sequence
  chemically synthesized
attctttccttctattaacttc

SEQ ID NO: 1177584 - DNA, 22 bp, Artificial Sequence
  chemically synthesized
tattctttccttctattaactt

SEQ ID NO: 1177585 - DNA, 22 bp, Artificial Sequence
  chemically synthesized
ttccacaggggaagttaataga

SEQ ID NO: 1177586 - DNA, 22 bp, Artificial Sequence
  chemically synthesized
cacaggggaagttaatagaagg

SEQ ID NO: 1177587 - DNA, 22 bp, Artificial Sequence
  chemically synthesized
atctttattctttccttctatt

SEQ ID NO: 1177588 - DNA, 22 bp, Artificial Sequence
  chemically synthesized
tgatctttattctttccttcta

SEQ ID NO: 1177589 - DNA, 22 bp, Artificial Sequence
  chemically synthesized
ttctgatctttattctttcctt

SEQ ID NO: 1177590 - DNA, 22 bp, Artificial Sequence
  chemically synthesized
gttctgatctttattctttcct

SEQ ID NO: 1177591 - DNA, 22 bp, Artificial Sequence
  chemically synthesized
tgttctgatctttattctttcc

SEQ ID NO: 1177592 - DNA, 22 bp, Artificial Sequence
  chemically synthesized
ttgttctgatctttattctttc

SEQ ID NO: 1177593 - DNA, 22 bp, Artificial Sequence
  chemically synthesized
cttttgttctgatctttattct

SEQ ID NO: 1177594 - DNA, 22 bp, Artificial Sequence
  chemically synthesized
acttttgttctgatctttattc

SEQ ID NO: 1177595 - DNA, 22 bp, Artificial Sequence
  chemically synthesized
atagaaggaaagaataaagatc

SEQ ID NO: 1177596 - DNA, 22 bp, Artificial Sequence
  chemically synthesized
tttacttttgttctgatcttta

SEQ ID NO: 1177597 - DNA, 22 bp, Artificial Sequence
  chemically synthesized
atttacttttgttctgatcttt

SEQ ID NO: 1177598 - DNA, 22 bp, Artificial Sequence
  chemically synthesized
tatttacttttgttctgatctt

SEQ ID NO: 1177599 - DNA, 22 bp, Artificial Sequence
  chemically synthesized
ttttatttacttttgttctgat

SEQ ID NO: 1177600 - DNA, 22 bp, Artificial Sequence
  chemically synthesized
tattttatttacttttgttctg

SEQ ID NO: 1177601 - DNA, 22 bp, Artificial Sequence
  chemically synthesized
ctattttatttacttttgttct

SEQ ID NO: 1177602 - DNA, 22 bp, Artificial Sequence
  chemically synthesized
gtttctattttatttacttttg

SEQ ID NO: 1177603 - DNA, 22 bp, Artificial Sequence
  chemically synthesized
tagtttctattttatttacttt

SEQ ID NO: 1177604 - DNA, 22 bp, Artificial Sequence
  chemically synthesized
ctagtttctattttatttactt

SEQ ID NO: 1177605 - DNA, 22 bp, Artificial Sequence
  chemically synthesized
tctagtttctattttatttact

SEQ ID NO: 1177606 - DNA, 22 bp, Artificial Sequence
  chemically synthesized
ttctagtttctattttatttac

SEQ ID NO: 1177607 - DNA, 22 bp, Artificial Sequence
  chemically synthesized
tttttctagtttctattttatt

SEQ ID NO: 1177608 - DNA, 22 bp, Artificial Sequence
  chemically synthesized
ttgtttttctagtttctatttt

SEQ ID NO: 1177609 - DNA, 22 bp, Artificial Sequence
  chemically synthesized
tattgtttttctagtttctatt

SEQ ID NO: 1177610 - DNA, 22 bp, Artificial Sequence
  chemically synthesized
ctattgtttttctagtttctat

SEQ ID NO: 1177611 - DNA, 22 bp, Artificial Sequence
  chemically synthesized
tctattgtttttctagtttcta

SEQ ID NO: 1177612 - DNA, 22 bp, Artificial Sequence
  chemically synthesized
ttttctattgtttttctagttt

SEQ ID NO: 1177613 - DNA, 22 bp, Artificial Sequence
  chemically synthesized
ctattttctattgtttttctag

SEQ ID NO: 1177614 - DNA, 22 bp, Artificial Sequence
  chemically synthesized
ttactattttctattgtttttc

SEQ ID NO: 1177615 - DNA, 22 bp, Artificial Sequence
  chemically synthesized
gttgttactattttctattgtt

SEQ ID NO: 1177616 - DNA, 22 bp, Artificial Sequence
  chemically synthesized
gaaaaacaatagaaaatagtaa

SEQ ID NO: 1177617 - DNA, 22 bp, Artificial Sequence
  chemically synthesized
acaaaaaaaaaaaccaaaacct

SEQ ID NO: 1177618 - DNA, 22 bp, Artificial Sequence
  chemically synthesized
cacaaaaaaaaaaaccaaaacc

SEQ ID NO: 1177619 - DNA, 22 bp, Artificial Sequence
  chemically synthesized
tcacaaaaaaaaaaaccaaaac

SEQ ID NO: 1177620 - DNA, 22 bp, Artificial Sequence
  chemically synthesized
ttcacaaaaaaaaaaaccaaaa

SEQ ID NO: 1177621 - DNA, 22 bp, Artificial Sequence
  chemically synthesized
tcttttcacaaaaaaaaaaacc

SEQ ID NO: 1177622 - DNA, 22 bp, Artificial Sequence
  chemically synthesized
tggtttttttttttgtgaaaag

SEQ ID NO: 1177623 - DNA, 22 bp, Artificial Sequence
  chemically synthesized
ggtttttttttttgtgaaaaga

SEQ ID NO: 1177624 - DNA, 22 bp, Artificial Sequence
  chemically synthesized
gtttttttttttgtgaaaagat

SEQ ID NO: 1177625 - DNA, 22 bp, Artificial Sequence
  chemically synthesized
ttttttttgtgaaaagatagac

SEQ ID NO: 1177626 - DNA, 22 bp, Artificial Sequence
  chemically synthesized
tttttttgtgaaaagatagact

SEQ ID NO: 1177627 - DNA, 22 bp, Artificial Sequence
  chemically synthesized
ttttttgtgaaaagatagactg

SEQ ID NO: 1177628 - DNA, 22 bp, Artificial Sequence
  chemically synthesized
tttttgtgaaaagatagactgg

SEQ ID NO: 1177629 - DNA, 22 bp, Artificial Sequence
  chemically synthesized
ttttgtgaaaagatagactggc

SEQ ID NO: 1177630 - DNA, 22 bp, Artificial Sequence
  chemically synthesized
tttgtgaaaagatagactggct

SEQ ID NO: 1177631 - DNA, 22 bp, Artificial Sequence
  chemically synthesized
ttgtgaaaagatagactggctt

SEQ ID NO: 1177632 - DNA, 22 bp, Artificial Sequence
  chemically synthesized
tgtgaaaagatagactggcttg

SEQ ID NO: 1177633 - DNA, 22 bp, Artificial Sequence
  chemically synthesized
gtgaaaagatagactggcttgt

SEQ ID NO: 1177634 - DNA, 22 bp, Artificial Sequence
  chemically synthesized
tgaaaagatagactggcttgtt

SEQ ID NO: 1177635 - DNA, 22 bp, Artificial Sequence
  chemically synthesized
tggaatcagtaaatgtcaagaa

SEQ ID NO: 1177636 - DNA, 22 bp, Artificial Sequence
  chemically synthesized
gcttgttcttgacatttactga

SEQ ID NO: 1177637 - DNA, 22 bp, Artificial Sequence
  chemically synthesized
catattgtggaatcagtaaatg

SEQ ID NO: 1177638 - DNA, 22 bp, Artificial Sequence
  chemically synthesized
gttcttgacatttactgattcc

SEQ ID NO: 1177639 - DNA, 22 bp, Artificial Sequence
  chemically synthesized
ttcttgacatttactgattcca

SEQ ID NO: 1177640 - DNA, 22 bp, Artificial Sequence
  chemically synthesized
aattgcatattgtggaatcagt

SEQ ID NO: 1177641 - DNA, 22 bp, Artificial Sequence
  chemically synthesized
ttgacatttactgattccacaa

SEQ ID NO: 1177642 - DNA, 22 bp, Artificial Sequence
  chemically synthesized
gacatttactgattccacaata

SEQ ID NO: 1177643 - DNA, 22 bp, Artificial Sequence
  chemically synthesized
acatttactgattccacaatat

SEQ ID NO: 1177644 - DNA, 22 bp, Artificial Sequence
  chemically synthesized
aatctgaattgcatattgtgga

SEQ ID NO: 1177645 - DNA, 22 bp, Artificial Sequence
  chemically synthesized
ctaaatctgaattgcatattgt

SEQ ID NO: 1177646 - DNA, 22 bp, Artificial Sequence
  chemically synthesized
actaaatctgaattgcatattg

SEQ ID NO: 1177647 - DNA, 22 bp, Artificial Sequence
  chemically synthesized
tactaaatctgaattgcatatt

SEQ ID NO: 1177648 - DNA, 22 bp, Artificial Sequence
  chemically synthesized
actgattccacaatatgcaatt

SEQ ID NO: 1177649 - DNA, 22 bp, Artificial Sequence
  chemically synthesized
ctgattccacaatatgcaattc

SEQ ID NO: 1177650 - DNA, 22 bp, Artificial Sequence
  chemically synthesized
tttactaaatctgaattgcata

SEQ ID NO: 1177651 - DNA, 22 bp, Artificial Sequence
  chemically synthesized
attccacaatatgcaattcaga

SEQ ID NO: 1177652 - DNA, 22 bp, Artificial Sequence
  chemically synthesized
cacaatatgcaattcagattta

SEQ ID NO: 1177653 - DNA, 22 bp, Artificial Sequence
  chemically synthesized
agtaaatgttctttactaaatc

SEQ ID NO: 1177654 - DNA, 22 bp, Artificial Sequence
  chemically synthesized
cattcagtaaatgttctttact

SEQ ID NO: 1177655 - DNA, 22 bp, Artificial Sequence
  chemically synthesized
ccattcagtaaatgttctttac

SEQ ID NO: 1177656 - DNA, 22 bp, Artificial Sequence
  chemically synthesized
agatttagtaaagaacatttac

SEQ ID NO: 1177657 - DNA, 22 bp, Artificial Sequence
  chemically synthesized
agtaaagaacatttactgaatg

SEQ ID NO: 1177658 - DNA, 22 bp, Artificial Sequence
  chemically synthesized
ggtgacaatttccattcagtaa

SEQ ID NO: 1177659 - DNA, 22 bp, Artificial Sequence
  chemically synthesized
gtaaagaacatttactgaatgg

SEQ ID NO: 1177660 - DNA, 22 bp, Artificial Sequence
  chemically synthesized
actgaatggaaattgtcaccca

SEQ ID NO: 1177661 - DNA, 22 bp, Artificial Sequence
  chemically synthesized
ctgaatggaaattgtcacccaa

SEQ ID NO: 1177662 - DNA, 22 bp, Artificial Sequence
  chemically synthesized
aatggaaattgtcacccaactc

SEQ ID NO: 1177663 - DNA, 22 bp, Artificial Sequence
  chemically synthesized
acaaggacaaaaaaccagaaag

SEQ ID NO: 1177664 - DNA, 22 bp, Artificial Sequence
  chemically synthesized
aacaaggacaaaaaaccagaaa

SEQ ID NO: 1177665 - DNA, 22 bp, Artificial Sequence
  chemically synthesized
tcacccaactctttctggtttt

SEQ ID NO: 1177666 - DNA, 22 bp, Artificial Sequence
  chemically synthesized
acttaacaaggacaaaaaacca

SEQ ID NO: 1177667 - DNA, 22 bp, Artificial Sequence
  chemically synthesized
attcacttaacaaggacaaaaa

SEQ ID NO: 1177668 - DNA, 22 bp, Artificial Sequence
  chemically synthesized
ttcattcacttaacaaggacaa

SEQ ID NO: 1177669 - DNA, 22 bp, Artificial Sequence
  chemically synthesized
tttctggttttttgtccttgtt

SEQ ID NO: 1177670 - DNA, 22 bp, Artificial Sequence
  chemically synthesized
gttcattcacttaacaaggaca

SEQ ID NO: 1177671 - DNA, 22 bp, Artificial Sequence
  chemically synthesized
tgttcattcacttaacaaggac

SEQ ID NO: 1177672 - DNA, 22 bp, Artificial Sequence
  chemically synthesized
tctggttttttgtccttgttaa

SEQ ID NO: 1177673 - DNA, 22 bp, Artificial Sequence
  chemically synthesized
ctggttttttgtccttgttaag

SEQ ID NO: 1177674 - DNA, 22 bp, Artificial Sequence
  chemically synthesized
tggttttttgtccttgttaagt

SEQ ID NO: 1177675 - DNA, 22 bp, Artificial Sequence
  chemically synthesized
gttttttgtccttgttaagtga

SEQ ID NO: 1177676 - DNA, 22 bp, Artificial Sequence
  chemically synthesized
gccaattttgttcattcactta

SEQ ID NO: 1177677 - DNA, 22 bp, Artificial Sequence
  chemically synthesized
tttgtccttgttaagtgaatga

SEQ ID NO: 1177678 - DNA, 22 bp, Artificial Sequence
  chemically synthesized
cgccaattttgttcattcactt

SEQ ID NO: 1177679 - DNA, 22 bp, Artificial Sequence
  chemically synthesized
ttgtccttgttaagtgaatgaa

SEQ ID NO: 1177680 - DNA, 22 bp, Artificial Sequence
  chemically synthesized
tcgccaattttgttcattcact

SEQ ID NO: 1177681 - DNA, 22 bp, Artificial Sequence
  chemically synthesized
tgtccttgttaagtgaatgaac

SEQ ID NO: 1177682 - DNA, 22 bp, Artificial Sequence
  chemically synthesized
ttcgccaattttgttcattcac

SEQ ID NO: 1177683 - DNA, 22 bp, Artificial Sequence
  chemically synthesized
gtccttgttaagtgaatgaaca

SEQ ID NO: 1177684 - DNA, 22 bp, Artificial Sequence
  chemically synthesized
tccttgttaagtgaatgaacaa

SEQ ID NO: 1177685 - DNA, 22 bp, Artificial Sequence
  chemically synthesized
gttaagtgaatgaacaaaattg

SEQ ID NO: 1177686 - DNA, 22 bp, Artificial Sequence
  chemically synthesized
ttaagtgaatgaacaaaattgg

SEQ ID NO: 1177687 - DNA, 22 bp, Artificial Sequence
  chemically synthesized
agtgaatgaacaaaattggcga

SEQ ID NO: 1177688 - DNA, 22 bp, Artificial Sequence
  chemically synthesized
ggacataaaatttttcgccaat

SEQ ID NO: 1177689 - DNA, 22 bp, Artificial Sequence
  chemically synthesized
cggacataaaatttttcgccaa

SEQ ID NO: 1177690 - DNA, 22 bp, Artificial Sequence
  chemically synthesized
tcggacataaaatttttcgcca

SEQ ID NO: 1177691 - DNA, 22 bp, Artificial Sequence
  chemically synthesized
agaactttcggacataaaattt

SEQ ID NO: 1177692 - DNA, 22 bp, Artificial Sequence
  chemically synthesized
aagaactttcggacataaaatt

SEQ ID NO: 1177693 - DNA, 22 bp, Artificial Sequence
  chemically synthesized
taagaactttcggacataaaat

SEQ ID NO: 1177694 - DNA, 22 bp, Artificial Sequence
  chemically synthesized
gcgaaaaattttatgtccgaaa

SEQ ID NO: 1177695 - DNA, 22 bp, Artificial Sequence
  chemically synthesized
gactttaagaactttcggacat

SEQ ID NO: 1177696 - DNA, 22 bp, Artificial Sequence
  chemically synthesized
ccctagactttaagaactttcg

SEQ ID NO: 1177697 - DNA, 22 bp, Artificial Sequence
  chemically synthesized
cccctagactttaagaactttc

SEQ ID NO: 1177698 - DNA, 22 bp, Artificial Sequence
  chemically synthesized
tatgtccgaaagttcttaaagt

SEQ ID NO: 1177699 - DNA, 22 bp, Artificial Sequence
  chemically synthesized
atgtccgaaagttcttaaagtc

SEQ ID NO: 1177700 - DNA, 22 bp, Artificial Sequence
  chemically synthesized
tgtccgaaagttcttaaagtct

SEQ ID NO: 1177701 - DNA, 22 bp, Artificial Sequence
  chemically synthesized
ataagaaatgtttcccctagac

SEQ ID NO: 1177702 - DNA, 22 bp, Artificial Sequence
  chemically synthesized
gttcataagaaatgtttcccct

SEQ ID NO: 1177703 - DNA, 22 bp, Artificial Sequence
  chemically synthesized
agttcataagaaatgtttcccc

SEQ ID NO: 1177704 - DNA, 22 bp, Artificial Sequence
  chemically synthesized
ttaaagtctaggggaaacattt

SEQ ID NO: 1177705 - DNA, 22 bp, Artificial Sequence
  chemically synthesized
aaagtctaggggaaacatttct

SEQ ID NO: 1177706 - DNA, 22 bp, Artificial Sequence
  chemically synthesized
aagtctaggggaaacatttctt

SEQ ID NO: 1177707 - DNA, 22 bp, Artificial Sequence
  chemically synthesized
catttagttcataagaaatgtt

SEQ ID NO: 1177708 - DNA, 22 bp, Artificial Sequence
  chemically synthesized
aattacatttagttcataagaa

SEQ ID NO: 1177709 - DNA, 22 bp, Artificial Sequence
  chemically synthesized
gaattacatttagttcataaga

SEQ ID NO: 1177710 - DNA, 22 bp, Artificial Sequence
  chemically synthesized
ggggaaacatttcttatgaact

SEQ ID NO: 1177711 - DNA, 22 bp, Artificial Sequence
  chemically synthesized
tgaattacatttagttcataag

SEQ ID NO: 1177712 - DNA, 22 bp, Artificial Sequence
  chemically synthesized
ttgaattacatttagttcataa

SEQ ID NO: 1177713 - DNA, 22 bp, Artificial Sequence
  chemically synthesized
aatgtttttgaattacatttag

SEQ ID NO: 1177714 - DNA, 22 bp, Artificial Sequence
  chemically synthesized
ttaaatgtttttgaattacatt

SEQ ID NO: 1177715 - DNA, 22 bp, Artificial Sequence
  chemically synthesized
cttatgaactaaatgtaattca

SEQ ID NO: 1177716 - DNA, 22 bp, Artificial Sequence
  chemically synthesized
ttatgaactaaatgtaattcaa

SEQ ID NO: 1177717 - DNA, 22 bp, Artificial Sequence
  chemically synthesized
tgttaaatgtttttgaattaca

SEQ ID NO: 1177718 - DNA, 22 bp, Artificial Sequence
  chemically synthesized
ctgttaaatgtttttgaattac

SEQ ID NO: 1177719 - DNA, 22 bp, Artificial Sequence
  chemically synthesized
atgaactaaatgtaattcaaaa

SEQ ID NO: 1177720 - DNA, 22 bp, Artificial Sequence
  chemically synthesized
tgaactaaatgtaattcaaaaa

SEQ ID NO: 1177721 - DNA, 22 bp, Artificial Sequence
  chemically synthesized
cttctgttaaatgtttttgaat

SEQ ID NO: 1177722 - DNA, 22 bp, Artificial Sequence
  chemically synthesized
aatgtaattcaaaaacatttaa

SEQ ID NO: 1177723 - DNA, 22 bp, Artificial Sequence
  chemically synthesized
agattccttctgttaaatgttt

SEQ ID NO: 1177724 - DNA, 22 bp, Artificial Sequence
  chemically synthesized
acattaagattccttctgttaa

SEQ ID NO: 1177725 - DNA, 22 bp, Artificial Sequence
  chemically synthesized
aaaaacatttaacagaaggaat

SEQ ID NO: 1177726 - DNA, 22 bp, Artificial Sequence
  chemically synthesized
cctgacattaagattccttctg

SEQ ID NO: 1177727 - DNA, 22 bp, Artificial Sequence
  chemically synthesized
actgcctgacattaagattcct

SEQ ID NO: 1177728 - DNA, 22 bp, Artificial Sequence
  chemically synthesized
tcactgcctgacattaagattc

SEQ ID NO: 1177729 - DNA, 22 bp, Artificial Sequence
  chemically synthesized
ctcactgcctgacattaagatt

SEQ ID NO: 1177730 - DNA, 22 bp, Artificial Sequence
  chemically synthesized
tctcactgcctgacattaagat

SEQ ID NO: 1177731 - DNA, 22 bp, Artificial Sequence
  chemically synthesized
ttctcactgcctgacattaaga

SEQ ID NO: 1177732 - DNA, 22 bp, Artificial Sequence
  chemically synthesized
aacagaaggaatcttaatgtca

SEQ ID NO: 1177733 - DNA, 22 bp, Artificial Sequence
  chemically synthesized
tttctcactgcctgacattaag

SEQ ID NO: 1177734 - DNA, 22 bp, Artificial Sequence
  chemically synthesized
acagaaggaatcttaatgtcag

SEQ ID NO: 1177735 - DNA, 22 bp, Artificial Sequence
  chemically synthesized
ttttttctcactgcctgacatt

SEQ ID NO: 1177736 - DNA, 22 bp, Artificial Sequence
  chemically synthesized
tattttttctcactgcctgaca

SEQ ID NO: 1177737 - DNA, 22 bp, Artificial Sequence
  chemically synthesized
ctattttttctcactgcctgac

SEQ ID NO: 1177738 - DNA, 22 bp, Artificial Sequence
  chemically synthesized
tctattttttctcactgcctga

SEQ ID NO: 1177739 - DNA, 22 bp, Artificial Sequence
  chemically synthesized
actttctattttttctcactgc

SEQ ID NO: 1177740 - DNA, 22 bp, Artificial Sequence
  chemically synthesized
gactttctattttttctcactg

SEQ ID NO: 1177741 - DNA, 22 bp, Artificial Sequence
  chemically synthesized
tgactttctattttttctcact

SEQ ID NO: 1177742 - DNA, 22 bp, Artificial Sequence
  chemically synthesized
aatgtcaggcagtgagaaaaaa

SEQ ID NO: 1177743 - DNA, 22 bp, Artificial Sequence
  chemically synthesized
atgtcaggcagtgagaaaaaat

SEQ ID NO: 1177744 - DNA, 22 bp, Artificial Sequence
  chemically synthesized
gagatctttgactttctatttt

SEQ ID NO: 1177745 - DNA, 22 bp, Artificial Sequence
  chemically synthesized
agagatctttgactttctattt

SEQ ID NO: 1177746 - DNA, 22 bp, Artificial Sequence
  chemically synthesized
tagagatctttgactttctatt

SEQ ID NO: 1177747 - DNA, 22 bp, Artificial Sequence
  chemically synthesized
atcacccccatctttagagatc

SEQ ID NO: 1177748 - DNA, 22 bp, Artificial Sequence
  chemically synthesized
catcacccccatctttagagat

SEQ ID NO: 1177749 - DNA, 22 bp, Artificial Sequence
  chemically synthesized
tcatcacccccatctttagaga

SEQ ID NO: 1177750 - DNA, 22 bp, Artificial Sequence
  chemically synthesized
ttcatcacccccatctttagag

SEQ ID NO: 1177751 - DNA, 22 bp, Artificial Sequence
  chemically synthesized
tttcatcacccccatctttaga

SEQ ID NO: 1177752 - DNA, 22 bp, Artificial Sequence
  chemically synthesized
tttttcatcacccccatcttta

SEQ ID NO: 1177753 - DNA, 22 bp, Artificial Sequence
  chemically synthesized
ctttttcatcacccccatcttt

SEQ ID NO: 1177754 - DNA, 22 bp, Artificial Sequence
  chemically synthesized
tctttttcatcacccccatctt

SEQ ID NO: 1177755 - DNA, 22 bp, Artificial Sequence
  chemically synthesized
ttctttttcatcacccccatct

SEQ ID NO: 1177756 - DNA, 22 bp, Artificial Sequence
  chemically synthesized
cttttctttttcatcaccccca

SEQ ID NO: 1177757 - DNA, 22 bp, Artificial Sequence
  chemically synthesized
taaagatgggggtgatgaaaaa

SEQ ID NO: 1177758 - DNA, 22 bp, Artificial Sequence
  chemically synthesized
aagatgggggtgatgaaaaaga

SEQ ID NO: 1177759 - DNA, 22 bp, Artificial Sequence
  chemically synthesized
ataaaaggcagttccttttctt

SEQ ID NO: 1177760 - DNA, 22 bp, Artificial Sequence
  chemically synthesized
cataaaaggcagttccttttct

SEQ ID NO: 1177761 - DNA, 22 bp, Artificial Sequence
  chemically synthesized
tcataaaaggcagttccttttc

SEQ ID NO: 1177762 - DNA, 22 bp, Artificial Sequence
  chemically synthesized
cattttcataaaaggcagttcc

SEQ ID NO: 1177763 - DNA, 22 bp, Artificial Sequence
  chemically synthesized
ccattttcataaaaggcagttc

SEQ ID NO: 1177764 - DNA, 22 bp, Artificial Sequence
  chemically synthesized
ccttttatgaaaatggaaatac

SEQ ID NO: 1177765 - DNA, 22 bp, Artificial Sequence
  chemically synthesized
ttatgaaaatggaaatactatt

SEQ ID NO: 1177766 - DNA, 22 bp, Artificial Sequence
  chemically synthesized
tatgaaaatggaaatactattt

SEQ ID NO: 1177767 - DNA, 22 bp, Artificial Sequence
  chemically synthesized
atgaaaatggaaatactatttt

SEQ ID NO: 1177768 - DNA, 22 bp, Artificial Sequence
  chemically synthesized
tgaaaatggaaatactattttg

SEQ ID NO: 1177769 - DNA, 22 bp, Artificial Sequence
  chemically synthesized
ccccccagtaaacaaaatagta

SEQ ID NO: 1177770 - DNA, 22 bp, Artificial Sequence
  chemically synthesized
aatctaccccccagtaaacaaa

SEQ ID NO: 1177771 - DNA, 22 bp, Artificial Sequence
  chemically synthesized
cctaaatctaccccccagtaaa

SEQ ID NO: 1177772 - DNA, 22 bp, Artificial Sequence
  chemically synthesized
acctaaatctaccccccagtaa

SEQ ID NO: 1177773 - DNA, 22 bp, Artificial Sequence
  chemically synthesized
tttacctaaatctaccccccag

SEQ ID NO: 1177774 - DNA, 22 bp, Artificial Sequence
  chemically synthesized
ttttgtttactggggggtagat

SEQ ID NO: 1177775 - DNA, 22 bp, Artificial Sequence
  chemically synthesized
ttatttacctaaatctaccccc

SEQ ID NO: 1177776 - DNA, 22 bp, Artificial Sequence
  chemically synthesized
attatttacctaaatctacccc

SEQ ID NO: 1177777 - DNA, 22 bp, Artificial Sequence
  chemically synthesized
tattatttacctaaatctaccc

SEQ ID NO: 1177778 - DNA, 22 bp, Artificial Sequence
  chemically synthesized
tgtttactggggggtagattta

SEQ ID NO: 1177779 - DNA, 22 bp, Artificial Sequence
  chemically synthesized
gtttactggggggtagatttag

SEQ ID NO: 1177780 - DNA, 22 bp, Artificial Sequence
  chemically synthesized
tttactggggggtagatttagg

SEQ ID NO: 1177781 - DNA, 22 bp, Artificial Sequence
  chemically synthesized
ttttattatttacctaaatcta

SEQ ID NO: 1177782 - DNA, 22 bp, Artificial Sequence
  chemically synthesized
tattttattatttacctaaatc

SEQ ID NO: 1177783 - DNA, 22 bp, Artificial Sequence
  chemically synthesized
actggggggtagatttaggtaa

SEQ ID NO: 1177784 - DNA, 22 bp, Artificial Sequence
  chemically synthesized
ctattttattatttacctaaat

SEQ ID NO: 1177785 - DNA, 22 bp, Artificial Sequence
  chemically synthesized
ctggggggtagatttaggtaaa

SEQ ID NO: 1177786 - DNA, 22 bp, Artificial Sequence
  chemically synthesized
gggggtagatttaggtaaataa

SEQ ID NO: 1177787 - DNA, 22 bp, Artificial Sequence
  chemically synthesized
aaacttctattttattatttac

SEQ ID NO: 1177788 - DNA, 22 bp, Artificial Sequence
  chemically synthesized
ccaattaaaacttctattttat

SEQ ID NO: 1177789 - DNA, 22 bp, Artificial Sequence
  chemically synthesized
gccaattaaaacttctatttta

SEQ ID NO: 1177790 - DNA, 22 bp, Artificial Sequence
  chemically synthesized
tgccaattaaaacttctatttt

SEQ ID NO: 1177791 - DNA, 22 bp, Artificial Sequence
  chemically synthesized
aggtaaataataaaatagaagt

SEQ ID NO: 1177792 - DNA, 22 bp, Artificial Sequence
  chemically synthesized
ggtaaataataaaatagaagtt

SEQ ID NO: 1177793 - DNA, 22 bp, Artificial Sequence
  chemically synthesized
gctttgccaattaaaacttcta

SEQ ID NO: 1177794 - DNA, 22 bp, Artificial Sequence
  chemically synthesized
cgctttgccaattaaaacttct

SEQ ID NO: 1177795 - DNA, 22 bp, Artificial Sequence
  chemically synthesized
tcgctttgccaattaaaacttc

SEQ ID NO: 1177796 - DNA, 22 bp, Artificial Sequence
  chemically synthesized
ttcgctttgccaattaaaactt

SEQ ID NO: 1177797 - DNA, 22 bp, Artificial Sequence
  chemically synthesized
agtgtttttcgctttgccaatt

SEQ ID NO: 1177798 - DNA, 22 bp, Artificial Sequence
  chemically synthesized
aagtgtttttcgctttgccaat

SEQ ID NO: 1177799 - DNA, 22 bp, Artificial Sequence
  chemically synthesized
taagtgtttttcgctttgccaa

SEQ ID NO: 1177800 - DNA, 22 bp, Artificial Sequence
  chemically synthesized
taattggcaaagcgaaaaacac

SEQ ID NO: 1177801 - DNA, 22 bp, Artificial Sequence
  chemically synthesized
agcatgttttaagtgtttttcg

SEQ ID NO: 1177802 - DNA, 22 bp, Artificial Sequence
  chemically synthesized
aattggcaaagcgaaaaacact

SEQ ID NO: 1177803 - DNA, 22 bp, Artificial Sequence
  chemically synthesized
cagcatgttttaagtgtttttc

SEQ ID NO: 1177804 - DNA, 22 bp, Artificial Sequence
  chemically synthesized
attggcaaagcgaaaaacactt

SEQ ID NO: 1177805 - DNA, 22 bp, Artificial Sequence
  chemically synthesized
tcagcatgttttaagtgttttt

SEQ ID NO: 1177806 - DNA, 22 bp, Artificial Sequence
  chemically synthesized
ttcagcatgttttaagtgtttt

SEQ ID NO: 1177807 - DNA, 22 bp, Artificial Sequence
  chemically synthesized
tttcagcatgttttaagtgttt

SEQ ID NO: 1177808 - DNA, 22 bp, Artificial Sequence
  chemically synthesized
gcaaagcgaaaaacacttaaaa

SEQ ID NO: 1177809 - DNA, 22 bp, Artificial Sequence
  chemically synthesized
acgtggtctttttcagcatgtt

SEQ ID NO: 1177810 - DNA, 22 bp, Artificial Sequence
  chemically synthesized
attgacgtggtctttttcagca

SEQ ID NO: 1177811 - DNA, 22 bp, Artificial Sequence
  chemically synthesized
aaaacatgctgaaaaagaccac

SEQ ID NO: 1177812 - DNA, 22 bp, Artificial Sequence
  chemically synthesized
aaacatgctgaaaaagaccacg

SEQ ID NO: 1177813 - DNA, 22 bp, Artificial Sequence
  chemically synthesized
aagtgagtaaaattgattgacg

SEQ ID NO: 1177814 - DNA, 22 bp, Artificial Sequence
  chemically synthesized
aaagtgagtaaaattgattgac

SEQ ID NO: 1177815 - DNA, 22 bp, Artificial Sequence
  chemically synthesized
aaaaagaccacgtcaatcaatt

SEQ ID NO: 1177816 - DNA, 22 bp, Artificial Sequence
  chemically synthesized
tactcactttaaacatgttttt

SEQ ID NO: 1177817 - DNA, 22 bp, Artificial Sequence
  chemically synthesized
actcactttaaacatgtttttt

SEQ ID NO: 1177818 - DNA, 22 bp, Artificial Sequence
  chemically synthesized
ctcactttaaacatgttttttt

SEQ ID NO: 1177819 - DNA, 22 bp, Artificial Sequence
  chemically synthesized
tgaaaagggaatgaaaaaaaca

SEQ ID NO: 1177820 - DNA, 22 bp, Artificial Sequence
  chemically synthesized
actttaaacatgtttttttcat

SEQ ID NO: 1177821 - DNA, 22 bp, Artificial Sequence
  chemically synthesized
taaacatgtttttttcattccc

SEQ ID NO: 1177822 - DNA, 22 bp, Artificial Sequence
  chemically synthesized
aaacatgtttttttcattccct

SEQ ID NO: 1177823 - DNA, 22 bp, Artificial Sequence
  chemically synthesized
aacatgtttttttcattccctt

SEQ ID NO: 1177824 - DNA, 22 bp, Artificial Sequence
  chemically synthesized
agtatactgtgaaaagggaatg

SEQ ID NO: 1177825 - DNA, 22 bp, Artificial Sequence
  chemically synthesized
agtctcagtatactgtgaaaag

SEQ ID NO: 1177826 - DNA, 22 bp, Artificial Sequence
  chemically synthesized
cagtctcagtatactgtgaaaa

SEQ ID NO: 1177827 - DNA, 22 bp, Artificial Sequence
  chemically synthesized
ttttcattcccttttcacagta

SEQ ID NO: 1177828 - DNA, 22 bp, Artificial Sequence
  chemically synthesized
tttcattcccttttcacagtat

SEQ ID NO: 1177829 - DNA, 22 bp, Artificial Sequence
  chemically synthesized
ttcattcccttttcacagtata

SEQ ID NO: 1177830 - DNA, 22 bp, Artificial Sequence
  chemically synthesized
tcattcccttttcacagtatac

SEQ ID NO: 1177831 - DNA, 22 bp, Artificial Sequence
  chemically synthesized
cattcccttttcacagtatact

SEQ ID NO: 1177832 - DNA, 22 bp, Artificial Sequence
  chemically synthesized
attcccttttcacagtatactg

SEQ ID NO: 1177833 - DNA, 22 bp, Artificial Sequence
  chemically synthesized
tgtcagtttcagtctcagtata

SEQ ID NO: 1177834 - DNA, 22 bp, Artificial Sequence
  chemically synthesized
ccttttcacagtatactgagac

SEQ ID NO: 1177835 - DNA, 22 bp, Artificial Sequence
  chemically synthesized
gtgtcagtttcagtctcagtat

SEQ ID NO: 1177836 - DNA, 22 bp, Artificial Sequence
  chemically synthesized
ttgtgtcagtttcagtctcagt

SEQ ID NO: 1177837 - DNA, 22 bp, Artificial Sequence
  chemically synthesized
cttgtgtcagtttcagtctcag

SEQ ID NO: 1177838 - DNA, 22 bp, Artificial Sequence
  chemically synthesized
ttcacagtatactgagactgaa

SEQ ID NO: 1177839 - DNA, 22 bp, Artificial Sequence
  chemically synthesized
tcacagtatactgagactgaaa

SEQ ID NO: 1177840 - DNA, 22 bp, Artificial Sequence
  chemically synthesized
cacagtatactgagactgaaac

SEQ ID NO: 1177841 - DNA, 22 bp, Artificial Sequence
  chemically synthesized
acagtatactgagactgaaact

SEQ ID NO: 1177842 - DNA, 22 bp, Artificial Sequence
  chemically synthesized
gtgaacgtttcttgtgtcagtt

SEQ ID NO: 1177843 - DNA, 22 bp, Artificial Sequence
  chemically synthesized
agtgaacgtttcttgtgtcagt

SEQ ID NO: 1177844 - DNA, 22 bp, Artificial Sequence
  chemically synthesized
agactgaaactgacacaagaaa

SEQ ID NO: 1177845 - DNA, 22 bp, Artificial Sequence
  chemically synthesized
aaactgacacaagaaacgttca

SEQ ID NO: 1177846 - DNA, 22 bp, Artificial Sequence
  chemically synthesized
acacaagaaacgttcactaaat

SEQ ID NO: 1177847 - DNA, 22 bp, Artificial Sequence
  chemically synthesized
gagcgaaacgaacatcaacaat

SEQ ID NO: 1177848 - DNA, 22 bp, Artificial Sequence
  chemically synthesized
actaaattgttgatgttcgttt

SEQ ID NO: 1177849 - DNA, 22 bp, Artificial Sequence
  chemically synthesized
aattgttgatgttcgtttcgct

SEQ ID NO: 1177850 - DNA, 22 bp, Artificial Sequence
  chemically synthesized
ttgatgttcgtttcgctctaat

SEQ ID NO: 1177851 - DNA, 22 bp, Artificial Sequence
  chemically synthesized
atgttcgtttcgctctaatatt

SEQ ID NO: 1177852 - DNA, 22 bp, Artificial Sequence
  chemically synthesized
gtttcgctctaatatttgtact

SEQ ID NO: 1177853 - DNA, 22 bp, Artificial Sequence
  chemically synthesized
cgctctaatatttgtacttttt

SEQ ID NO: 1177854 - DNA, 22 bp, Artificial Sequence
  chemically synthesized
gctctaatatttgtactttttt

SEQ ID NO: 1177855 - DNA, 22 bp, Artificial Sequence
  chemically synthesized
taatatttgtactttttttttt

SEQ ID NO: 1177856 - DNA, 22 bp, Artificial Sequence
  chemically synthesized
atatttgtactttttttttttt

SEQ ID NO: 1177857 - DNA, 22 bp, Artificial Sequence
  chemically synthesized
gtactttttttttttttttttt

SEQ ID NO: 1177858 - DNA, 22 bp, Artificial Sequence
  chemically synthesized
aaaaaaaaaaaaaaaaaaaaaa

SEQ ID NO: 1177859 - DNA, 22 bp, Artificial Sequence
  chemically synthesized
tacttttttttttttttttttt

SEQ ID NO: 1177860 - DNA, 22 bp, Artificial Sequence
  chemically synthesized
tttttttttttttttttttttt

SEQ ID NO: 1177861 - DNA, 22 bp, Artificial Sequence
  chemically synthesized
cgtctcaaaaaaaaaaaaaaaa

SEQ ID NO: 1177862 - DNA, 22 bp, Artificial Sequence
  chemically synthesized
tttttttttttttttttttttt

SEQ ID NO: 1177863 - DNA, 22 bp, Artificial Sequence
  chemically synthesized
tttttttttttttttttttttt

SEQ ID NO: 1177864 - DNA, 22 bp, Artificial Sequence
  chemically synthesized
tttttttttttttttttttttt

SEQ ID NO: 1177865 - DNA, 22 bp, Artificial Sequence
  chemically synthesized
tttttttttttttttttttttt

SEQ ID NO: 1177866 - DNA, 22 bp, Artificial Sequence
  chemically synthesized
tttttttttttttttttttttt

SEQ ID NO: 1177867 - DNA, 22 bp, Artificial Sequence
  chemically synthesized
tttttttttttttttttttttt

SEQ ID NO: 1177868 - DNA, 22 bp, Artificial Sequence
  chemically synthesized
tttttttttttttttttttttg

SEQ ID NO: 1177869 - DNA, 22 bp, Artificial Sequence
  chemically synthesized
ttttttttttttttttttttga

SEQ ID NO: 1177870 - DNA, 22 bp, Artificial Sequence
  chemically synthesized
tttttttttttttttttttgag

SEQ ID NO: 1177871 - DNA, 22 bp, Artificial Sequence
  chemically synthesized
ttttttttttttttttttgaga

SEQ ID NO: 1177872 - DNA, 22 bp, Artificial Sequence
  chemically synthesized
tttttttttttttttttgagac

SEQ ID NO: 1177873 - DNA, 22 bp, Artificial Sequence
  chemically synthesized
ttttttttttttttttgagacg

SEQ ID NO: 1177874 - DNA, 22 bp, Artificial Sequence
  chemically synthesized
tttttttttttttttgagacgg

SEQ ID NO: 1177875 - DNA, 22 bp, Artificial Sequence
  chemically synthesized
ttttttttttttttgagacgga

SEQ ID NO: 1177876 - DNA, 22 bp, Artificial Sequence
  chemically synthesized
tttttttttttttgagacggag

SEQ ID NO: 1177877 - DNA, 22 bp, Artificial Sequence
  chemically synthesized
ttttttttttttgagacggagt

SEQ ID NO: 1177878 - DNA, 22 bp, Artificial Sequence
  chemically synthesized
tttttttttttgagacggagtc

SEQ ID NO: 1177879 - DNA, 22 bp, Artificial Sequence
  chemically synthesized
ttttttttttgagacggagtct

SEQ ID NO: 1177880 - DNA, 22 bp, Artificial Sequence
  chemically synthesized
ggtgacagagtaagactccgtc

SEQ ID NO: 1177881 - DNA, 22 bp, Artificial Sequence
  chemically synthesized
tttttttttgagacggagtctt

SEQ ID NO: 1177882 - DNA, 22 bp, Artificial Sequence
  chemically synthesized
ttttttttgagacggagtctta

SEQ ID NO: 1177883 - DNA, 22 bp, Artificial Sequence
  chemically synthesized
tttttttgagacggagtcttac

SEQ ID NO: 1177884 - DNA, 22 bp, Artificial Sequence
  chemically synthesized
ttttttgagacggagtcttact

SEQ ID NO: 1177885 - DNA, 22 bp, Artificial Sequence
  chemically synthesized
tttttgagacggagtcttactc

SEQ ID NO: 1177886 - DNA, 22 bp, Artificial Sequence
  chemically synthesized
ttttgagacggagtcttactct

SEQ ID NO: 1177887 - DNA, 22 bp, Artificial Sequence
  chemically synthesized
tttgagacggagtcttactctg

SEQ ID NO: 1177888 - DNA, 22 bp, Artificial Sequence
  chemically synthesized
cagcctgggtgacagagtaaga

SEQ ID NO: 1177889 - DNA, 22 bp, Artificial Sequence
  chemically synthesized
ttgagacggagtcttactctgt

SEQ ID NO: 1177890 - DNA, 22 bp, Artificial Sequence
  chemically synthesized
tgagacggagtcttactctgtc

SEQ ID NO: 1177891 - DNA, 22 bp, Artificial Sequence
  chemically synthesized
gagacggagtcttactctgtca

SEQ ID NO: 1177892 - DNA, 22 bp, Artificial Sequence
  chemically synthesized
agacggagtcttactctgtcac

SEQ ID NO: 1177893 - DNA, 22 bp, Artificial Sequence
  chemically synthesized
cactccagcctgggtgacagag

SEQ ID NO: 1177894 - DNA, 22 bp, Artificial Sequence
  chemically synthesized
actctgtcacccaggctggagt

SEQ ID NO: 1177895 - DNA, 22 bp, Artificial Sequence
  chemically synthesized
ctctgtcacccaggctggagtg

SEQ ID NO: 1177896 - DNA, 22 bp, Artificial Sequence
  chemically synthesized
tgtcacccaggctggagtgcag

SEQ ID NO: 1177897 - DNA, 22 bp, Artificial Sequence
  chemically synthesized
tcacccaggctggagtgcagtg

SEQ ID NO: 1177898 - DNA, 22 bp, Artificial Sequence
  chemically synthesized
cagtgagccgagatcgcgccac

SEQ ID NO: 1177899 - DNA, 22 bp, Artificial Sequence
  chemically synthesized
gagtgcagtggcgcgatctcgg

SEQ ID NO: 1177900 - DNA, 22 bp, Artificial Sequence
  chemically synthesized
aaccccagaggcggaggttgca

SEQ ID NO: 1177901 - DNA, 22 bp, Artificial Sequence
  chemically synthesized
gaaccccagaggcggaggttgc

SEQ ID NO: 1177902 - DNA, 22 bp, Artificial Sequence
  chemically synthesized
ggctcactgcaacctccgcctc

SEQ ID NO: 1177903 - DNA, 22 bp, Artificial Sequence
  chemically synthesized
actgcaacctccgcctctgggg

SEQ ID NO: 1177904 - DNA, 22 bp, Artificial Sequence
  chemically synthesized
caacctccgcctctggggttca

SEQ ID NO: 1177905 - DNA, 22 bp, Artificial Sequence
  chemically synthesized
aggcaggagaatcgcttgaacc

SEQ ID NO: 1177906 - DNA, 22 bp, Artificial Sequence
  chemically synthesized
cgcctctggggttcaagcgatt

SEQ ID NO: 1177907 - DNA, 22 bp, Artificial Sequence
  chemically synthesized
agaggctgaggcaggagaatcg

SEQ ID NO: 1177908 - DNA, 22 bp, Artificial Sequence
  chemically synthesized
tggggttcaagcgattctcctg

SEQ ID NO: 1177909 - DNA, 22 bp, Artificial Sequence
  chemically synthesized
gggttcaagcgattctcctgcc

SEQ ID NO: 1177910 - DNA, 22 bp, Artificial Sequence
  chemically synthesized
ctcagaggctgaggcaggagaa

SEQ ID NO: 1177911 - DNA, 22 bp, Artificial Sequence
  chemically synthesized
aagcgattctcctgcctcagcc

SEQ ID NO: 1177912 - DNA, 22 bp, Artificial Sequence
  chemically synthesized
ccagctactcagaggctgaggc

SEQ ID NO: 1177913 - DNA, 22 bp, Artificial Sequence
  chemically synthesized
tattcccagctactcagaggct

SEQ ID NO: 1177914 - DNA, 22 bp, Artificial Sequence
  chemically synthesized
tcctgcctcagcctctgagtag

SEQ ID NO: 1177915 - DNA, 22 bp, Artificial Sequence
  chemically synthesized
ctgcctcagcctctgagtagct

SEQ ID NO: 1177916 - DNA, 22 bp, Artificial Sequence
  chemically synthesized
cctcagcctctgagtagctggg

SEQ ID NO: 1177917 - DNA, 22 bp, Artificial Sequence
  chemically synthesized
agcctctgagtagctgggaata

SEQ ID NO: 1177918 - DNA, 22 bp, Artificial Sequence
  chemically synthesized
tgagtagctgggaatacaggca

SEQ ID NO: 1177919 - DNA, 22 bp, Artificial Sequence
  chemically synthesized
agtagctgggaatacaggcatg

SEQ ID NO: 1177920 - DNA, 22 bp, Artificial Sequence
  chemically synthesized
ggaatacaggcatgtgccacca

SEQ ID NO: 1177921 - DNA, 22 bp, Artificial Sequence
  chemically synthesized
aagtaaaaatacaaaaatcagc

SEQ ID NO: 1177922 - DNA, 22 bp, Artificial Sequence
  chemically synthesized
gctgatttttgtatttttactt

SEQ ID NO: 1177923 - DNA, 22 bp, Artificial Sequence
  chemically synthesized
atttttgtatttttacttgaga

SEQ ID NO: 1177924 - DNA, 22 bp, Artificial Sequence
  chemically synthesized
ttgtatttttacttgagacggg

SEQ ID NO: 1177925 - DNA, 22 bp, Artificial Sequence
  chemically synthesized
tgtatttttacttgagacgggg

SEQ ID NO: 1177926 - DNA, 22 bp, Artificial Sequence
  chemically synthesized
gtatttttacttgagacggggc

SEQ ID NO: 1177927 - DNA, 22 bp, Artificial Sequence
  chemically synthesized
tatttttacttgagacggggct

SEQ ID NO: 1177928 - DNA, 22 bp, Artificial Sequence
  chemically synthesized
accaacatggtgaagccccgtc

SEQ ID NO: 1177929 - DNA, 22 bp, Artificial Sequence
  chemically synthesized
ttacttgagacggggcttcacc

SEQ ID NO: 1177930 - DNA, 22 bp, Artificial Sequence
  chemically synthesized
tacttgagacggggcttcacca

SEQ ID NO: 1177931 - DNA, 22 bp, Artificial Sequence
  chemically synthesized
acttgagacggggcttcaccat

SEQ ID NO: 1177932 - DNA, 22 bp, Artificial Sequence
  chemically synthesized
cttgagacggggcttcaccatg

SEQ ID NO: 1177933 - DNA, 22 bp, Artificial Sequence
  chemically synthesized
gagacggggcttcaccatgttg

SEQ ID NO: 1177934 - DNA, 22 bp, Artificial Sequence
  chemically synthesized
agacggggcttcaccatgttgg

SEQ ID NO: 1177935 - DNA, 22 bp, Artificial Sequence
  chemically synthesized
gagaccagcctgaccaacatgg

SEQ ID NO: 1177936 - DNA, 22 bp, Artificial Sequence
  chemically synthesized
aggagttcgagaccagcctgac

SEQ ID NO: 1177937 - DNA, 22 bp, Artificial Sequence
  chemically synthesized
caccatgttggtcaggctggtc

SEQ ID NO: 1177938 - DNA, 22 bp, Artificial Sequence
  chemically synthesized
accatgttggtcaggctggtct

SEQ ID NO: 1177939 - DNA, 22 bp, Artificial Sequence
  chemically synthesized
gtcaggctggtctcgaactcct

SEQ ID NO: 1177940 - DNA, 22 bp, Artificial Sequence
  chemically synthesized
gtctcgaactcctgaactcatg

SEQ ID NO: 1177941 - DNA, 22 bp, Artificial Sequence
  chemically synthesized
gaactcctgaactcatgatccg

SEQ ID NO: 1177942 - DNA, 22 bp, Artificial Sequence
  chemically synthesized
ggaggccgaagcaggcggatca

SEQ ID NO: 1177943 - DNA, 22 bp, Artificial Sequence
  chemically synthesized
tgggaggccgaagcaggcggat

SEQ ID NO: 1177944 - DNA, 22 bp, Artificial Sequence
  chemically synthesized
ctgaactcatgatccgcctgct

SEQ ID NO: 1177945 - DNA, 22 bp, Artificial Sequence
  chemically synthesized
aactcatgatccgcctgcttcg

SEQ ID NO: 1177946 - DNA, 22 bp, Artificial Sequence
  chemically synthesized
atgatccgcctgcttcggcctc

SEQ ID NO: 1177947 - DNA, 22 bp, Artificial Sequence
  chemically synthesized
taatcccagcactctgggaggc

SEQ ID NO: 1177948 - DNA, 22 bp, Artificial Sequence
  chemically synthesized
cttcggcctcccagagtgctgg

SEQ ID NO: 1177949 - DNA, 22 bp, Artificial Sequence
  chemically synthesized
atgcctgtaatcccagcactct

SEQ ID NO: 1177950 - DNA, 22 bp, Artificial Sequence
  chemically synthesized
cggcctcccagagtgctgggat

SEQ ID NO: 1177951 - DNA, 22 bp, Artificial Sequence
  chemically synthesized
ggcctcccagagtgctgggatt

SEQ ID NO: 1177952 - DNA, 22 bp, Artificial Sequence
  chemically synthesized
ccagagtgctgggattacaggc

SEQ ID NO: 1177953 - DNA, 22 bp, Artificial Sequence
  chemically synthesized
ggccaggcacggtggctcatgc

SEQ ID NO: 1177954 - DNA, 22 bp, Artificial Sequence
  chemically synthesized
aggccaggcacggtggctcatg

SEQ ID NO: 1177955 - DNA, 22 bp, Artificial Sequence
  chemically synthesized
ggattacaggcatgagccaccg

SEQ ID NO: 1177956 - DNA, 22 bp, Artificial Sequence
  chemically synthesized
caggcatgagccaccgtgcctg

SEQ ID NO: 1177957 - DNA, 22 bp, Artificial Sequence
  chemically synthesized
agagtacaaaaatttaggccag

SEQ ID NO: 1177958 - DNA, 22 bp, Artificial Sequence
  chemically synthesized
aagagtacaaaaatttaggcca

SEQ ID NO: 1177959 - DNA, 22 bp, Artificial Sequence
  chemically synthesized
taagagtacaaaaatttaggcc

SEQ ID NO: 1177960 - DNA, 22 bp, Artificial Sequence
  chemically synthesized
ttaagagtacaaaaatttaggc

SEQ ID NO: 1177961 - DNA, 22 bp, Artificial Sequence
  chemically synthesized
tttaagagtacaaaaatttagg

SEQ ID NO: 1177962 - DNA, 22 bp, Artificial Sequence
  chemically synthesized
gttttttaagagtacaaaaatt

SEQ ID NO: 1177963 - DNA, 22 bp, Artificial Sequence
  chemically synthesized
agttttttaagagtacaaaaat

SEQ ID NO: 1177964 - DNA, 22 bp, Artificial Sequence
  chemically synthesized
gcctaaatttttgtactcttaa

SEQ ID NO: 1177965 - DNA, 22 bp, Artificial Sequence
  chemically synthesized
aatttttgtactcttaaaaaac

SEQ ID NO: 1177966 - DNA, 22 bp, Artificial Sequence
  chemically synthesized
ttgtactcttaaaaaactaagc

SEQ ID NO: 1177967 - DNA, 22 bp, Artificial Sequence
  chemically synthesized
tgtactcttaaaaaactaagct

SEQ ID NO: 1177968 - DNA, 22 bp, Artificial Sequence
  chemically synthesized
gtactcttaaaaaactaagcta

SEQ ID NO: 1177969 - DNA, 22 bp, Artificial Sequence
  chemically synthesized
tactcttaaaaaactaagctat

SEQ ID NO: 1177970 - DNA, 22 bp, Artificial Sequence
  chemically synthesized
ttaaaaaactaagctatcatat

SEQ ID NO: 1177971 - DNA, 22 bp, Artificial Sequence
  chemically synthesized
aaaaaactaagctatcatattg

SEQ ID NO: 1177972 - DNA, 22 bp, Artificial Sequence
  chemically synthesized
aaaaactaagctatcatattga

SEQ ID NO: 1177973 - DNA, 22 bp, Artificial Sequence
  chemically synthesized
agctatcatattgattatgacc

SEQ ID NO: 1177974 - DNA, 22 bp, Artificial Sequence
  chemically synthesized
tcatattgattatgaccatgac

SEQ ID NO: 1177975 - DNA, 22 bp, Artificial Sequence
  chemically synthesized
atggtcatatgtgtcatggtca

SEQ ID NO: 1177976 - DNA, 22 bp, Artificial Sequence
  chemically synthesized
catggtcatatgtgtcatggtc

SEQ ID NO: 1177977 - DNA, 22 bp, Artificial Sequence
  chemically synthesized
tcatggtcatatgtgtcatggt

SEQ ID NO: 1177978 - DNA, 22 bp, Artificial Sequence
  chemically synthesized
attatgaccatgacacatatga

SEQ ID NO: 1177979 - DNA, 22 bp, Artificial Sequence
  chemically synthesized
tgaccatgacacatatgaccat

SEQ ID NO: 1177980 - DNA, 22 bp, Artificial Sequence
  chemically synthesized
gaaaaatattttcatggtcata

SEQ ID NO: 1177981 - DNA, 22 bp, Artificial Sequence
  chemically synthesized
aatattagaaaaatattttcat

SEQ ID NO: 1177982 - DNA, 22 bp, Artificial Sequence
  chemically synthesized
cgttaaatattagaaaaatatt

SEQ ID NO: 1177983 - DNA, 22 bp, Artificial Sequence
  chemically synthesized
aacgttacgttaaatattagaa

SEQ ID NO: 1177984 - DNA, 22 bp, Artificial Sequence
  chemically synthesized
taaacgttacgttaaatattag

SEQ ID NO: 1177985 - DNA, 22 bp, Artificial Sequence
  chemically synthesized
ctaaacgttacgttaaatatta

SEQ ID NO: 1177986 - DNA, 22 bp, Artificial Sequence
  chemically synthesized
ttctaatatttaacgtaacgtt

SEQ ID NO: 1177987 - DNA, 22 bp, Artificial Sequence
  chemically synthesized
gtgatgtttctaaacgttacgt

SEQ ID NO: 1177988 - DNA, 22 bp, Artificial Sequence
  chemically synthesized
tctaatatttaacgtaacgttt

SEQ ID NO: 1177989 - DNA, 22 bp, Artificial Sequence
  chemically synthesized
agtgatgtttctaaacgttacg

SEQ ID NO: 1177990 - DNA, 22 bp, Artificial Sequence
  chemically synthesized
ctaatatttaacgtaacgttta

SEQ ID NO: 1177991 - DNA, 22 bp, Artificial Sequence
  chemically synthesized
taatatttaacgtaacgtttag

SEQ ID NO: 1177992 - DNA, 22 bp, Artificial Sequence
  chemically synthesized
ttagtgatgtttctaaacgtta

SEQ ID NO: 1177993 - DNA, 22 bp, Artificial Sequence
  chemically synthesized
atatttaacgtaacgtttagaa

SEQ ID NO: 1177994 - DNA, 22 bp, Artificial Sequence
  chemically synthesized
aagttcttagtgatgtttctaa

SEQ ID NO: 1177995 - DNA, 22 bp, Artificial Sequence
  chemically synthesized
gaagttcttagtgatgtttcta

SEQ ID NO: 1177996 - DNA, 22 bp, Artificial Sequence
  chemically synthesized
aacgtaacgtttagaaacatca

SEQ ID NO: 1177997 - DNA, 22 bp, Artificial Sequence
  chemically synthesized
acgtaacgtttagaaacatcac

SEQ ID NO: 1177998 - DNA, 22 bp, Artificial Sequence
  chemically synthesized
tatttgaagttcttagtgatgt

SEQ ID NO: 1177999 - DNA, 22 bp, Artificial Sequence
  chemically synthesized
attgtatttgaagttcttagtg

SEQ ID NO: 1178000 - DNA, 22 bp, Artificial Sequence
  chemically synthesized
gattgtatttgaagttcttagt

SEQ ID NO: 1178001 - DNA, 22 bp, Artificial Sequence
  chemically synthesized
tgattgtatttgaagttcttag

SEQ ID NO: 1178002 - DNA, 22 bp, Artificial Sequence
  chemically synthesized
agaaacatcactaagaacttca

SEQ ID NO: 1178003 - DNA, 22 bp, Artificial Sequence
  chemically synthesized
gaaacatcactaagaacttcaa

SEQ ID NO: 1178004 - DNA, 22 bp, Artificial Sequence
  chemically synthesized
aaagtcagtattttgattgtat

SEQ ID NO: 1178005 - DNA, 22 bp, Artificial Sequence
  chemically synthesized
agaacttcaaatacaatcaaaa

SEQ ID NO: 1178006 - DNA, 22 bp, Artificial Sequence
  chemically synthesized
caaatacaatcaaaatactgac

SEQ ID NO: 1178007 - DNA, 22 bp, Artificial Sequence
  chemically synthesized
aaatacaatcaaaatactgact

SEQ ID NO: 1178008 - DNA, 22 bp, Artificial Sequence
  chemically synthesized
aaaaaaacaatattcaaagtca

SEQ ID NO: 1178009 - DNA, 22 bp, Artificial Sequence
  chemically synthesized
gaaaaaaacaatattcaaagtc

SEQ ID NO: 1178010 - DNA, 22 bp, Artificial Sequence
  chemically synthesized
tgaaaaaaacaatattcaaagt

SEQ ID NO: 1178011 - DNA, 22 bp, Artificial Sequence
  chemically synthesized
actttgaatattgtttttttca

SEQ ID NO: 1178012 - DNA, 22 bp, Artificial Sequence
  chemically synthesized
tgaatattgtttttttcaaagg

SEQ ID NO: 1178013 - DNA, 22 bp, Artificial Sequence
  chemically synthesized
gaatattgtttttttcaaaggc

SEQ ID NO: 1178014 - DNA, 22 bp, Artificial Sequence
  chemically synthesized
aatattgtttttttcaaaggcc

SEQ ID NO: 1178015 - DNA, 22 bp, Artificial Sequence
  chemically synthesized
gacaaaaacgtcaggcctttga

SEQ ID NO: 1178016 - DNA, 22 bp, Artificial Sequence
  chemically synthesized
tgttggacaaaaacgtcaggcc

SEQ ID NO: 1178017 - DNA, 22 bp, Artificial Sequence
  chemically synthesized
tttttttcaaaggcctgacgtt

SEQ ID NO: 1178018 - DNA, 22 bp, Artificial Sequence
  chemically synthesized
gtgttggacaaaaacgtcaggc

SEQ ID NO: 1178019 - DNA, 22 bp, Artificial Sequence
  chemically synthesized
ttttcaaaggcctgacgttttt

SEQ ID NO: 1178020 - DNA, 22 bp, Artificial Sequence
  chemically synthesized
tttgtgttggacaaaaacgtca

SEQ ID NO: 1178021 - DNA, 22 bp, Artificial Sequence
  chemically synthesized
tttcaaaggcctgacgtttttg

SEQ ID NO: 1178022 - DNA, 22 bp, Artificial Sequence
  chemically synthesized
atttgtgttggacaaaaacgtc

SEQ ID NO: 1178023 - DNA, 22 bp, Artificial Sequence
  chemically synthesized
ttcaaaggcctgacgtttttgt

SEQ ID NO: 1178024 - DNA, 22 bp, Artificial Sequence
  chemically synthesized
tcaaaggcctgacgtttttgtc

SEQ ID NO: 1178025 - DNA, 22 bp, Artificial Sequence
  chemically synthesized
caaaggcctgacgtttttgtcc

SEQ ID NO: 1178026 - DNA, 22 bp, Artificial Sequence
  chemically synthesized
aaaggcctgacgtttttgtcca

SEQ ID NO: 1178027 - DNA, 22 bp, Artificial Sequence
  chemically synthesized
acgtttttgtccaacacaaata

SEQ ID NO: 1178028 - DNA, 22 bp, Artificial Sequence
  chemically synthesized
tgaagacagtcttatttgtgtt

SEQ ID NO: 1178029 - DNA, 22 bp, Artificial Sequence
  chemically synthesized
ttgtccaacacaaataagactg

SEQ ID NO: 1178030 - DNA, 22 bp, Artificial Sequence
  chemically synthesized
tgtccaacacaaataagactgt

SEQ ID NO: 1178031 - DNA, 22 bp, Artificial Sequence
  chemically synthesized
gtccaacacaaataagactgtc

SEQ ID NO: 1178032 - DNA, 22 bp, Artificial Sequence
  chemically synthesized
tccaacacaaataagactgtct

SEQ ID NO: 1178033 - DNA, 22 bp, Artificial Sequence
  chemically synthesized
aggaccagttgtgaagacagtc

SEQ ID NO: 1178034 - DNA, 22 bp, Artificial Sequence
  chemically synthesized
agtgcctgaggaccagttgtga

SEQ ID NO: 1178035 - DNA, 22 bp, Artificial Sequence
  chemically synthesized
ctcagtgcctgaggaccagttg

SEQ ID NO: 1178036 - DNA, 22 bp, Artificial Sequence
  chemically synthesized
tactcagtgcctgaggaccagt

SEQ ID NO: 1178037 - DNA, 22 bp, Artificial Sequence
  chemically synthesized
ctctactcagtgcctgaggacc

SEQ ID NO: 1178038 - DNA, 22 bp, Artificial Sequence
  chemically synthesized
tcttcacaactggtcctcaggc

SEQ ID NO: 1178039 - DNA, 22 bp, Artificial Sequence
  chemically synthesized
actctactcagtgcctgaggac

SEQ ID NO: 1178040 - DNA, 22 bp, Artificial Sequence
  chemically synthesized
cacaactggtcctcaggcactg

SEQ ID NO: 1178041 - DNA, 22 bp, Artificial Sequence
  chemically synthesized
acaactggtcctcaggcactga

SEQ ID NO: 1178042 - DNA, 22 bp, Artificial Sequence
  chemically synthesized
gagaaacttactctactcagtg

SEQ ID NO: 1178043 - DNA, 22 bp, Artificial Sequence
  chemically synthesized
ggagaaacttactctactcagt

SEQ ID NO: 1178044 - DNA, 22 bp, Artificial Sequence
  chemically synthesized
gtcctcaggcactgagtagagt

SEQ ID NO: 1178045 - DNA, 22 bp, Artificial Sequence
  chemically synthesized
gcttggagaaacttactctact

SEQ ID NO: 1178046 - DNA, 22 bp, Artificial Sequence
  chemically synthesized
ggcttggagaaacttactctac

SEQ ID NO: 1178047 - DNA, 22 bp, Artificial Sequence
  chemically synthesized
tggcttggagaaacttactcta

SEQ ID NO: 1178048 - DNA, 22 bp, Artificial Sequence
  chemically synthesized
aggcactgagtagagtaagttt

SEQ ID NO: 1178049 - DNA, 22 bp, Artificial Sequence
  chemically synthesized
agtagagtaagtttctccaagc

SEQ ID NO: 1178050 - DNA, 22 bp, Artificial Sequence
  chemically synthesized
tagacagcctttggcttggaga

SEQ ID NO: 1178051 - DNA, 22 bp, Artificial Sequence
  chemically synthesized
atagacagcctttggcttggag

SEQ ID NO: 1178052 - DNA, 22 bp, Artificial Sequence
  chemically synthesized
agatttatagacagcctttggc

SEQ ID NO: 1178053 - DNA, 22 bp, Artificial Sequence
  chemically synthesized
ctccaagccaaaggctgtctat

SEQ ID NO: 1178054 - DNA, 22 bp, Artificial Sequence
  chemically synthesized
tccaagccaaaggctgtctata

SEQ ID NO: 1178055 - DNA, 22 bp, Artificial Sequence
  chemically synthesized
caagccaaaggctgtctataaa

SEQ ID NO: 1178056 - DNA, 22 bp, Artificial Sequence
  chemically synthesized
gtagtgtacaaaagtagattaa

SEQ ID NO: 1178057 - DNA, 22 bp, Artificial Sequence
  chemically synthesized
agtagtgtacaaaagtagatta

SEQ ID NO: 1178058 - DNA, 22 bp, Artificial Sequence
  chemically synthesized
tctataaatcttaatctacttt

SEQ ID NO: 1178059 - DNA, 22 bp, Artificial Sequence
  chemically synthesized
tagtagtgtacaaaagtagatt

SEQ ID NO: 1178060 - DNA, 22 bp, Artificial Sequence
  chemically synthesized
taaatcttaatctacttttgta

SEQ ID NO: 1178061 - DNA, 22 bp, Artificial Sequence
  chemically synthesized
aatctacttttgtacactacta

SEQ ID NO: 1178062 - DNA, 22 bp, Artificial Sequence
  chemically synthesized
atctacttttgtacactactaa

SEQ ID NO: 1178063 - DNA, 22 bp, Artificial Sequence
  chemically synthesized
catgagaggaaattttagtagt

SEQ ID NO: 1178064 - DNA, 22 bp, Artificial Sequence
  chemically synthesized
cttttgtacactactaaaattt

SEQ ID NO: 1178065 - DNA, 22 bp, Artificial Sequence
  chemically synthesized
ttgtacactactaaaatttcct

SEQ ID NO: 1178066 - DNA, 22 bp, Artificial Sequence
  chemically synthesized
tgtacactactaaaatttcctc

SEQ ID NO: 1178067 - DNA, 22 bp, Artificial Sequence
  chemically synthesized
accattccatgagaggaaattt

SEQ ID NO: 1178068 - DNA, 22 bp, Artificial Sequence
  chemically synthesized
gtacactactaaaatttcctct

SEQ ID NO: 1178069 - DNA, 22 bp, Artificial Sequence
  chemically synthesized
caccattccatgagaggaaatt

SEQ ID NO: 1178070 - DNA, 22 bp, Artificial Sequence
  chemically synthesized
tacactactaaaatttcctctc

SEQ ID NO: 1178071 - DNA, 22 bp, Artificial Sequence
  chemically synthesized
tcaccattccatgagaggaaat

SEQ ID NO: 1178072 - DNA, 22 bp, Artificial Sequence
  chemically synthesized
ttcaccattccatgagaggaaa

SEQ ID NO: 1178073 - DNA, 22 bp, Artificial Sequence
  chemically synthesized
ctaaaatttcctctcatggaat

SEQ ID NO: 1178074 - DNA, 22 bp, Artificial Sequence
  chemically synthesized
gagatttttcaccattccatga

SEQ ID NO: 1178075 - DNA, 22 bp, Artificial Sequence
  chemically synthesized
aaatttcctctcatggaatggt

SEQ ID NO: 1178076 - DNA, 22 bp, Artificial Sequence
  chemically synthesized
ttggagatttttcaccattcca

SEQ ID NO: 1178077 - DNA, 22 bp, Artificial Sequence
  chemically synthesized
cctctcatggaatggtgaaaaa

SEQ ID NO: 1178078 - DNA, 22 bp, Artificial Sequence
  chemically synthesized
ctctcatggaatggtgaaaaat

SEQ ID NO: 1178079 - DNA, 22 bp, Artificial Sequence
  chemically synthesized
tcatggaatggtgaaaaatctc

SEQ ID NO: 1178080 - DNA, 22 bp, Artificial Sequence
  chemically synthesized
atggaatggtgaaaaatctcca

SEQ ID NO: 1178081 - DNA, 22 bp, Artificial Sequence
  chemically synthesized
aagcataagaattattggagat

SEQ ID NO: 1178082 - DNA, 22 bp, Artificial Sequence
  chemically synthesized
aataaattaaagcataagaatt

SEQ ID NO: 1178083 - DNA, 22 bp, Artificial Sequence
  chemically synthesized
tcaataaattaaagcataagaa

SEQ ID NO: 1178084 - DNA, 22 bp, Artificial Sequence
  chemically synthesized
ctcaataaattaaagcataaga

SEQ ID NO: 1178085 - DNA, 22 bp, Artificial Sequence
  chemically synthesized
tctcaataaattaaagcataag

SEQ ID NO: 1178086 - DNA, 22 bp, Artificial Sequence
  chemically synthesized
ttctcaataaattaaagcataa

SEQ ID NO: 1178087 - DNA, 22 bp, Artificial Sequence
  chemically synthesized
caataattcttatgctttaatt

SEQ ID NO: 1178088 - DNA, 22 bp, Artificial Sequence
  chemically synthesized
tttttctcaataaattaaagca

SEQ ID NO: 1178089 - DNA, 22 bp, Artificial Sequence
  chemically synthesized
ttatgctttaatttattgagaa

SEQ ID NO: 1178090 - DNA, 22 bp, Artificial Sequence
  chemically synthesized
atgctttaatttattgagaaaa

SEQ ID NO: 1178091 - DNA, 22 bp, Artificial Sequence
  chemically synthesized
tgctttaatttattgagaaaaa

SEQ ID NO: 1178092 - DNA, 22 bp, Artificial Sequence
  chemically synthesized
aatgaaataattgtttttctca

SEQ ID NO: 1178093 - DNA, 22 bp, Artificial Sequence
  chemically synthesized
gaatgaaataattgtttttctc

SEQ ID NO: 1178094 - DNA, 22 bp, Artificial Sequence
  chemically synthesized
tgaatgaaataattgtttttct

SEQ ID NO: 1178095 - DNA, 22 bp, Artificial Sequence
  chemically synthesized
taatttattgagaaaaacaatt

SEQ ID NO: 1178096 - DNA, 22 bp, Artificial Sequence
  chemically synthesized
aatttattgagaaaaacaatta

SEQ ID NO: 1178097 - DNA, 22 bp, Artificial Sequence
  chemically synthesized
atttattgagaaaaacaattat

SEQ ID NO: 1178098 - DNA, 22 bp, Artificial Sequence
  chemically synthesized
attttgaatgaaataattgttt

SEQ ID NO: 1178099 - DNA, 22 bp, Artificial Sequence
  chemically synthesized
attgagaaaaacaattatttca

SEQ ID NO: 1178100 - DNA, 22 bp, Artificial Sequence
  chemically synthesized
ttgagaaaaacaattatttcat

SEQ ID NO: 1178101 - DNA, 22 bp, Artificial Sequence
  chemically synthesized
agaaaaacaattatttcattca

SEQ ID NO: 1178102 - DNA, 22 bp, Artificial Sequence
  chemically synthesized
agatgtaatacctaattttgaa

SEQ ID NO: 1178103 - DNA, 22 bp, Artificial Sequence
  chemically synthesized
gagatgtaatacctaattttga

SEQ ID NO: 1178104 - DNA, 22 bp, Artificial Sequence
  chemically synthesized
tttcattcaaaattaggtatta

SEQ ID NO: 1178105 - DNA, 22 bp, Artificial Sequence
  chemically synthesized
ataatttgagatgtaataccta

SEQ ID NO: 1178106 - DNA, 22 bp, Artificial Sequence
  chemically synthesized
cattcaaaattaggtattacat

SEQ ID NO: 1178107 - DNA, 22 bp, Artificial Sequence
  chemically synthesized
attcaaaattaggtattacatc

SEQ ID NO: 1178108 - DNA, 22 bp, Artificial Sequence
  chemically synthesized
aaaattaggtattacatctcaa

SEQ ID NO: 1178109 - DNA, 22 bp, Artificial Sequence
  chemically synthesized
ggcattcataatttgagatgta

SEQ ID NO: 1178110 - DNA, 22 bp, Artificial Sequence
  chemically synthesized
ggtattacatctcaaattatga

SEQ ID NO: 1178111 - DNA, 22 bp, Artificial Sequence
  chemically synthesized
acaaatattgggcattcataat

SEQ ID NO: 1178112 - DNA, 22 bp, Artificial Sequence
  chemically synthesized
aacaaatattgggcattcataa

SEQ ID NO: 1178113 - DNA, 22 bp, Artificial Sequence
  chemically synthesized
taacaaatattgggcattcata

SEQ ID NO: 1178114 - DNA, 22 bp, Artificial Sequence
  chemically synthesized
ttaacaaatattgggcattcat

SEQ ID NO: 1178115 - DNA, 22 bp, Artificial Sequence
  chemically synthesized
catctcaaattatgaatgccca

SEQ ID NO: 1178116 - DNA, 22 bp, Artificial Sequence
  chemically synthesized
aaattatgaatgcccaatattt

SEQ ID NO: 1178117 - DNA, 22 bp, Artificial Sequence
  chemically synthesized
tgaatgcccaatatttgttaaa

SEQ ID NO: 1178118 - DNA, 22 bp, Artificial Sequence
  chemically synthesized
aatatatgagtcttttaacaaa

SEQ ID NO: 1178119 - DNA, 22 bp, Artificial Sequence
  chemically synthesized
aagtaatattaaatatatgagt

SEQ ID NO: 1178120 - DNA, 22 bp, Artificial Sequence
  chemically synthesized
gaagtaatattaaatatatgag

SEQ ID NO: 1178121 - DNA, 22 bp, Artificial Sequence
  chemically synthesized
tgaagtaatattaaatatatga

SEQ ID NO: 1178122 - DNA, 22 bp, Artificial Sequence
  chemically synthesized
ttgaagtaatattaaatatatg

SEQ ID NO: 1178123 - DNA, 22 bp, Artificial Sequence
  chemically synthesized
gttaaaagactcatatatttaa

SEQ ID NO: 1178124 - DNA, 22 bp, Artificial Sequence
  chemically synthesized
ttaaaagactcatatatttaat

SEQ ID NO: 1178125 - DNA, 22 bp, Artificial Sequence
  chemically synthesized
atttttgaagtaatattaaata

SEQ ID NO: 1178126 - DNA, 22 bp, Artificial Sequence
  chemically synthesized
aaagactcatatatttaatatt

SEQ ID NO: 1178127 - DNA, 22 bp, Artificial Sequence
  chemically synthesized
actaatttttgaagtaatatta

SEQ ID NO: 1178128 - DNA, 22 bp, Artificial Sequence
  chemically synthesized
cactaatttttgaagtaatatt

SEQ ID NO: 1178129 - DNA, 22 bp, Artificial Sequence
  chemically synthesized
tcactaatttttgaagtaatat

SEQ ID NO: 1178130 - DNA, 22 bp, Artificial Sequence
  chemically synthesized
atatatttaatattacttcaaa

SEQ ID NO: 1178131 - DNA, 22 bp, Artificial Sequence
  chemically synthesized
tataaagttttcactaattttt

SEQ ID NO: 1178132 - DNA, 22 bp, Artificial Sequence
  chemically synthesized
aatattacttcaaaaattagtg

SEQ ID NO: 1178133 - DNA, 22 bp, Artificial Sequence
  chemically synthesized
atataaagttttcactaatttt

SEQ ID NO: 1178134 - DNA, 22 bp, Artificial Sequence
  chemically synthesized
atattacttcaaaaattagtga

SEQ ID NO: 1178135 - DNA, 22 bp, Artificial Sequence
  chemically synthesized
gcttatataaagttttcactaa

SEQ ID NO: 1178136 - DNA, 22 bp, Artificial Sequence
  chemically synthesized
cttcaaaaattagtgaaaactt

SEQ ID NO: 1178137 - DNA, 22 bp, Artificial Sequence
  chemically synthesized
caaaaattagtgaaaactttat

SEQ ID NO: 1178138 - DNA, 22 bp, Artificial Sequence
  chemically synthesized
aaaaattagtgaaaactttata

SEQ ID NO: 1178139 - DNA, 22 bp, Artificial Sequence
  chemically synthesized
aaaatattggcttatataaagt

SEQ ID NO: 1178140 - DNA, 22 bp, Artificial Sequence
  chemically synthesized
gaaaatattggcttatataaag

SEQ ID NO: 1178141 - DNA, 22 bp, Artificial Sequence
  chemically synthesized
tgaaaatattggcttatataaa

SEQ ID NO: 1178142 - DNA, 22 bp, Artificial Sequence
  chemically synthesized
gtgaaaactttatataagccaa

SEQ ID NO: 1178143 - DNA, 22 bp, Artificial Sequence
  chemically synthesized
agtacattttgaaaatattggc

SEQ ID NO: 1178144 - DNA, 22 bp, Artificial Sequence
  chemically synthesized
aagtacattttgaaaatattgg

SEQ ID NO: 1178145 - DNA, 22 bp, Artificial Sequence
  chemically synthesized
taagtacattttgaaaatattg

SEQ ID NO: 1178146 - DNA, 22 bp, Artificial Sequence
  chemically synthesized
ttaagtacattttgaaaatatt

SEQ ID NO: 1178147 - DNA, 22 bp, Artificial Sequence
  chemically synthesized
tatataagccaatattttcaaa

SEQ ID NO: 1178148 - DNA, 22 bp, Artificial Sequence
  chemically synthesized
atataagccaatattttcaaaa

SEQ ID NO: 1178149 - DNA, 22 bp, Artificial Sequence
  chemically synthesized
tttttaagtacattttgaaaat

SEQ ID NO: 1178150 - DNA, 22 bp, Artificial Sequence
  chemically synthesized
tataagccaatattttcaaaat

SEQ ID NO: 1178151 - DNA, 22 bp, Artificial Sequence
  chemically synthesized
tatttttaagtacattttgaaa

SEQ ID NO: 1178152 - DNA, 22 bp, Artificial Sequence
  chemically synthesized
ctatttttaagtacattttgaa

SEQ ID NO: 1178153 - DNA, 22 bp, Artificial Sequence
  chemically synthesized
aaaatgaaatttctatttttaa

SEQ ID NO: 1178154 - DNA, 22 bp, Artificial Sequence
  chemically synthesized
tcaaaatgtacttaaaaataga

SEQ ID NO: 1178155 - DNA, 22 bp, Artificial Sequence
  chemically synthesized
caaaatgtacttaaaaatagaa

SEQ ID NO: 1178156 - DNA, 22 bp, Artificial Sequence
  chemically synthesized
aaaatgtacttaaaaatagaaa

SEQ ID NO: 1178157 - DNA, 22 bp, Artificial Sequence
  chemically synthesized
aggctcaaaatgaaatttctat

SEQ ID NO: 1178158 - DNA, 22 bp, Artificial Sequence
  chemically synthesized
aaaaatagaaatttcattttga

SEQ ID NO: 1178159 - DNA, 22 bp, Artificial Sequence
  chemically synthesized
aaaatagaaatttcattttgag

SEQ ID NO: 1178160 - DNA, 22 bp, Artificial Sequence
  chemically synthesized
cattttgagcctcaacattgtt

SEQ ID NO: 1178161 - DNA, 22 bp, Artificial Sequence
  chemically synthesized
attttgagcctcaacattgttt

SEQ ID NO: 1178162 - DNA, 22 bp, Artificial Sequence
  chemically synthesized
tgagcctcaacattgtttgctg

SEQ ID NO: 1178163 - DNA, 22 bp, Artificial Sequence
  chemically synthesized
gagcctcaacattgtttgctgt

SEQ ID NO: 1178164 - DNA, 22 bp, Artificial Sequence
  chemically synthesized
agcctcaacattgtttgctgtc

SEQ ID NO: 1178165 - DNA, 22 bp, Artificial Sequence
  chemically synthesized
atggggggagagagacagcaaa

SEQ ID NO: 1178166 - DNA, 22 bp, Artificial Sequence
  chemically synthesized
aacattgtttgctgtctctctc

SEQ ID NO: 1178167 - DNA, 22 bp, Artificial Sequence
  chemically synthesized
tttgctgtctctctccccccat

SEQ ID NO: 1178168 - DNA, 22 bp, Artificial Sequence
  chemically synthesized
gctgtctctctccccccatcaa

SEQ ID NO: 1178169 - DNA, 22 bp, Artificial Sequence
  chemically synthesized
ctgtctctctccccccatcaac

SEQ ID NO: 1178170 - DNA, 22 bp, Artificial Sequence
  chemically synthesized
tctctctccccccatcaactct

SEQ ID NO: 1178171 - DNA, 22 bp, Artificial Sequence
  chemically synthesized
gggtgggtggaaggagagttga

SEQ ID NO: 1178172 - DNA, 22 bp, Artificial Sequence
  chemically synthesized
tctccccccatcaactctcctt

SEQ ID NO: 1178173 - DNA, 22 bp, Artificial Sequence
  chemically synthesized
tccccccatcaactctccttcc

SEQ ID NO: 1178174 - DNA, 22 bp, Artificial Sequence
  chemically synthesized
cccccatcaactctccttccac

SEQ ID NO: 1178175 - DNA, 22 bp, Artificial Sequence
  chemically synthesized
gggagaaaggttggggtgggtg

SEQ ID NO: 1178176 - DNA, 22 bp, Artificial Sequence
  chemically synthesized
tccttccacccaccccaacctt

SEQ ID NO: 1178177 - DNA, 22 bp, Artificial Sequence
  chemically synthesized
cttccacccaccccaacctttc

SEQ ID NO: 1178178 - DNA, 22 bp, Artificial Sequence
  chemically synthesized
ccacccaccccaacctttctcc

SEQ ID NO: 1178179 - DNA, 22 bp, Artificial Sequence
  chemically synthesized
cacccaccccaacctttctccc

SEQ ID NO: 1178180 - DNA, 22 bp, Artificial Sequence
  chemically synthesized
tgtgtgtgtgctggggagaaag

SEQ ID NO: 1178181 - DNA, 22 bp, Artificial Sequence
  chemically synthesized
tgtgtgtgtgtgctggggagaa

SEQ ID NO: 1178182 - DNA, 22 bp, Artificial Sequence
  chemically synthesized
ctgtgtgtgtgtgctggggaga

SEQ ID NO: 1178183 - DNA, 22 bp, Artificial Sequence
  chemically synthesized
tctccccagcacacacacacag

SEQ ID NO: 1178184 - DNA, 22 bp, Artificial Sequence
  chemically synthesized
ctccccagcacacacacacaga

SEQ ID NO: 1178185 - DNA, 22 bp, Artificial Sequence
  chemically synthesized
tccccagcacacacacacagaa

SEQ ID NO: 1178186 - DNA, 22 bp, Artificial Sequence
  chemically synthesized
cccagcacacacacacagaaac

SEQ ID NO: 1178187 - DNA, 22 bp, Artificial Sequence
  chemically synthesized
tgtgtgtgtgtgtatgtgtttc

SEQ ID NO: 1178188 - DNA, 22 bp, Artificial Sequence
  chemically synthesized
actgtgtgtgtgtgtgtatgtg

SEQ ID NO: 1178189 - DNA, 22 bp, Artificial Sequence
  chemically synthesized
gactgtgtgtgtgtgtgtatgt

SEQ ID NO: 1178190 - DNA, 22 bp, Artificial Sequence
  chemically synthesized
tgactgtgtgtgtgtgtgtatg

SEQ ID NO: 1178191 - DNA, 22 bp, Artificial Sequence
  chemically synthesized
aaaacaactttgactgtgtgtg

SEQ ID NO: 1178192 - DNA, 22 bp, Artificial Sequence
  chemically synthesized
ttcaaaacaactttgactgtgt

SEQ ID NO: 1178193 - DNA, 22 bp, Artificial Sequence
  chemically synthesized
tgttcaaaacaactttgactgt

SEQ ID NO: 1178194 - DNA, 22 bp, Artificial Sequence
  chemically synthesized
ctgttcaaaacaactttgactg

SEQ ID NO: 1178195 - DNA, 22 bp, Artificial Sequence
  chemically synthesized
tctgttcaaaacaactttgact

SEQ ID NO: 1178196 - DNA, 22 bp, Artificial Sequence
  chemically synthesized
agggttttctgttcaaaacaac

SEQ ID NO: 1178197 - DNA, 22 bp, Artificial Sequence
  chemically synthesized
ttttgaacagaaaaccctcagg

SEQ ID NO: 1178198 - DNA, 22 bp, Artificial Sequence
  chemically synthesized
tgaacagaaaaccctcaggcta

SEQ ID NO: 1178199 - DNA, 22 bp, Artificial Sequence
  chemically synthesized
gaacagaaaaccctcaggctac

SEQ ID NO: 1178200 - DNA, 22 bp, Artificial Sequence
  chemically synthesized
aacagaaaaccctcaggctacg

SEQ ID NO: 1178201 - DNA, 22 bp, Artificial Sequence
  chemically synthesized
aaatataaggggcgtagcctga

SEQ ID NO: 1178202 - DNA, 22 bp, Artificial Sequence
  chemically synthesized
ccgtctcaaatataaggggcgt

SEQ ID NO: 1178203 - DNA, 22 bp, Artificial Sequence
  chemically synthesized
aggctacgccccttatatttga

SEQ ID NO: 1178204 - DNA, 22 bp, Artificial Sequence
  chemically synthesized
cccccactcccgtctcaaatat

SEQ ID NO: 1178205 - DNA, 22 bp, Artificial Sequence
  chemically synthesized
ttacccccactcccgtctcaaa

SEQ ID NO: 1178206 - DNA, 22 bp, Artificial Sequence
  chemically synthesized
cgccccttatatttgagacggg

SEQ ID NO: 1178207 - DNA, 22 bp, Artificial Sequence
  chemically synthesized
tggactgttacccccactcccg

SEQ ID NO: 1178208 - DNA, 22 bp, Artificial Sequence
  chemically synthesized
atatttgagacgggagtggggg

SEQ ID NO: 1178209 - DNA, 22 bp, Artificial Sequence
  chemically synthesized
tatttgagacgggagtgggggt

SEQ ID NO: 1178210 - DNA, 22 bp, Artificial Sequence
  chemically synthesized
gagacgggagtgggggtaacag

SEQ ID NO: 1178211 - DNA, 22 bp, Artificial Sequence
  chemically synthesized
agacgggagtgggggtaacagt

SEQ ID NO: 1178212 - DNA, 22 bp, Artificial Sequence
  chemically synthesized
gagaaggtaccagaagtagatg

SEQ ID NO: 1178213 - DNA, 22 bp, Artificial Sequence
  chemically synthesized
ctcatctacttctggtaccttc

SEQ ID NO: 1178214 - DNA, 22 bp, Artificial Sequence
  chemically synthesized
atctacttctggtaccttctct

SEQ ID NO: 1178215 - DNA, 22 bp, Artificial Sequence
  chemically synthesized
ggaaataaataaggctagagaa

SEQ ID NO: 1178216 - DNA, 22 bp, Artificial Sequence
  chemically synthesized
cttctggtaccttctctagcct

SEQ ID NO: 1178217 - DNA, 22 bp, Artificial Sequence
  chemically synthesized
ctggtaccttctctagccttat

SEQ ID NO: 1178218 - DNA, 22 bp, Artificial Sequence
  chemically synthesized
tggtaccttctctagccttatt

SEQ ID NO: 1178219 - DNA, 22 bp, Artificial Sequence
  chemically synthesized
gtaccttctctagccttattta

SEQ ID NO: 1178220 - DNA, 22 bp, Artificial Sequence
  chemically synthesized
ctctagccttatttatttccta

SEQ ID NO: 1178221 - DNA, 22 bp, Artificial Sequence
  chemically synthesized
tctagccttatttatttcctag

SEQ ID NO: 1178222 - DNA, 22 bp, Artificial Sequence
  chemically synthesized
tagccttatttatttcctagtt

SEQ ID NO: 1178223 - DNA, 22 bp, Artificial Sequence
  chemically synthesized
gccttatttatttcctagttac

SEQ ID NO: 1178224 - DNA, 22 bp, Artificial Sequence
  chemically synthesized
atttatttcctagttacatatt

SEQ ID NO: 1178225 - DNA, 22 bp, Artificial Sequence
  chemically synthesized
tttatttcctagttacatattt

SEQ ID NO: 1178226 - DNA, 22 bp, Artificial Sequence
  chemically synthesized
atttcctagttacatattttac

SEQ ID NO: 1178227 - DNA, 22 bp, Artificial Sequence
  chemically synthesized
tttcctagttacatattttaca

SEQ ID NO: 1178228 - DNA, 22 bp, Artificial Sequence
  chemically synthesized
cctagttacatattttacatca

SEQ ID NO: 1178229 - DNA, 22 bp, Artificial Sequence
  chemically synthesized
ctagttacatattttacatcac

SEQ ID NO: 1178230 - DNA, 22 bp, Artificial Sequence
  chemically synthesized
gttacatattttacatcacttt

SEQ ID NO: 1178231 - DNA, 22 bp, Artificial Sequence
  chemically synthesized
catattttacatcacttttcac

SEQ ID NO: 1178232 - DNA, 22 bp, Artificial Sequence
  chemically synthesized
tacatcacttttcactgatttc

SEQ ID NO: 1178233 - DNA, 22 bp, Artificial Sequence
  chemically synthesized
acatcacttttcactgatttct

SEQ ID NO: 1178234 - DNA, 22 bp, Artificial Sequence
  chemically synthesized
catcacttttcactgatttctt

SEQ ID NO: 1178235 - DNA, 22 bp, Artificial Sequence
  chemically synthesized
ttcactgatttcttctccatac

SEQ ID NO: 1178236 - DNA, 22 bp, Artificial Sequence
  chemically synthesized
tcactgatttcttctccataca

SEQ ID NO: 1178237 - DNA, 22 bp, Artificial Sequence
  chemically synthesized
cactgatttcttctccatacat

SEQ ID NO: 1178238 - DNA, 22 bp, Artificial Sequence
  chemically synthesized
actgatttcttctccatacatt

SEQ ID NO: 1178239 - DNA, 22 bp, Artificial Sequence
  chemically synthesized
gtcaaaggtagaaaatgtatgg

SEQ ID NO: 1178240 - DNA, 22 bp, Artificial Sequence
  chemically synthesized
atttcttctccatacattttct

SEQ ID NO: 1178241 - DNA, 22 bp, Artificial Sequence
  chemically synthesized
ctggtcaaaggtagaaaatgta

SEQ ID NO: 1178242 - DNA, 22 bp, Artificial Sequence
  chemically synthesized
actggtcaaaggtagaaaatgt

SEQ ID NO: 1178243 - DNA, 22 bp, Artificial Sequence
  chemically synthesized
cttctccatacattttctacct

SEQ ID NO: 1178244 - DNA, 22 bp, Artificial Sequence
  chemically synthesized
ttctccatacattttctacctt

SEQ ID NO: 1178245 - DNA, 22 bp, Artificial Sequence
  chemically synthesized
ctccatacattttctacctttg

SEQ ID NO: 1178246 - DNA, 22 bp, Artificial Sequence
  chemically synthesized
tcacttactggtcaaaggtaga

SEQ ID NO: 1178247 - DNA, 22 bp, Artificial Sequence
  chemically synthesized
tccatacattttctacctttga

SEQ ID NO: 1178248 - DNA, 22 bp, Artificial Sequence
  chemically synthesized
catacattttctacctttgacc

SEQ ID NO: 1178249 - DNA, 22 bp, Artificial Sequence
  chemically synthesized
tctacctttgaccagtaagtga

SEQ ID NO: 1178250 - DNA, 22 bp, Artificial Sequence
  chemically synthesized
ctacctttgaccagtaagtgat

SEQ ID NO: 1178251 - DNA, 22 bp, Artificial Sequence
  chemically synthesized
tacctttgaccagtaagtgata

SEQ ID NO: 1178252 - DNA, 22 bp, Artificial Sequence
  chemically synthesized
cctttgaccagtaagtgatagt

SEQ ID NO: 1178253 - DNA, 22 bp, Artificial Sequence
  chemically synthesized
gataaagaggaaaactatcact

SEQ ID NO: 1178254 - DNA, 22 bp, Artificial Sequence
  chemically synthesized
tgaccagtaagtgatagttttc

SEQ ID NO: 1178255 - DNA, 22 bp, Artificial Sequence
  chemically synthesized
gaccagtaagtgatagttttcc

SEQ ID NO: 1178256 - DNA, 22 bp, Artificial Sequence
  chemically synthesized
accagtaagtgatagttttcct

SEQ ID NO: 1178257 - DNA, 22 bp, Artificial Sequence
  chemically synthesized
atagcaaaaagattagataaag

SEQ ID NO: 1178258 - DNA, 22 bp, Artificial Sequence
  chemically synthesized
tcgcctaatagcaaaaagatta

SEQ ID NO: 1178259 - DNA, 22 bp, Artificial Sequence
  chemically synthesized
tcctctttatctaatctttttg

SEQ ID NO: 1178260 - DNA, 22 bp, Artificial Sequence
  chemically synthesized
atcgcctaatagcaaaaagatt

SEQ ID NO: 1178261 - DNA, 22 bp, Artificial Sequence
  chemically synthesized
cctctttatctaatctttttgc

SEQ ID NO: 1178262 - DNA, 22 bp, Artificial Sequence
  chemically synthesized
tatcgcctaatagcaaaaagat

SEQ ID NO: 1178263 - DNA, 22 bp, Artificial Sequence
  chemically synthesized
ctctttatctaatctttttgct

SEQ ID NO: 1178264 - DNA, 22 bp, Artificial Sequence
  chemically synthesized
tttatcgcctaatagcaaaaag

SEQ ID NO: 1178265 - DNA, 22 bp, Artificial Sequence
  chemically synthesized
tttatctaatctttttgctatt

SEQ ID NO: 1178266 - DNA, 22 bp, Artificial Sequence
  chemically synthesized
tatctaatctttttgctattag

SEQ ID NO: 1178267 - DNA, 22 bp, Artificial Sequence
  chemically synthesized
atctaatctttttgctattagg

SEQ ID NO: 1178268 - DNA, 22 bp, Artificial Sequence
  chemically synthesized
tctaatctttttgctattaggc

SEQ ID NO: 1178269 - DNA, 22 bp, Artificial Sequence
  chemically synthesized
agattctttatcgcctaatagc

SEQ ID NO: 1178270 - DNA, 22 bp, Artificial Sequence
  chemically synthesized
taagattctttatcgcctaata

SEQ ID NO: 1178271 - DNA, 22 bp, Artificial Sequence
  chemically synthesized
atctttttgctattaggcgata

SEQ ID NO: 1178272 - DNA, 22 bp, Artificial Sequence
  chemically synthesized
ctctaagattctttatcgccta

SEQ ID NO: 1178273 - DNA, 22 bp, Artificial Sequence
  chemically synthesized
ctgctctaagattctttatcgc

SEQ ID NO: 1178274 - DNA, 22 bp, Artificial Sequence
  chemically synthesized
tttgctattaggcgataaagaa

SEQ ID NO: 1178275 - DNA, 22 bp, Artificial Sequence
  chemically synthesized
gctgctctaagattctttatcg

SEQ ID NO: 1178276 - DNA, 22 bp, Artificial Sequence
  chemically synthesized
ttgctattaggcgataaagaat

SEQ ID NO: 1178277 - DNA, 22 bp, Artificial Sequence
  chemically synthesized
tgctgctctaagattctttatc

SEQ ID NO: 1178278 - DNA, 22 bp, Artificial Sequence
  chemically synthesized
tgctattaggcgataaagaatc

SEQ ID NO: 1178279 - DNA, 22 bp, Artificial Sequence
  chemically synthesized
gctattaggcgataaagaatct

SEQ ID NO: 1178280 - DNA, 22 bp, Artificial Sequence
  chemically synthesized
ctattaggcgataaagaatctt

SEQ ID NO: 1178281 - DNA, 22 bp, Artificial Sequence
  chemically synthesized
ttaggcgataaagaatcttaga

SEQ ID NO: 1178282 - DNA, 22 bp, Artificial Sequence
  chemically synthesized
gaatctttgctgctctaagatt

SEQ ID NO: 1178283 - DNA, 22 bp, Artificial Sequence
  chemically synthesized
ggaatctttgctgctctaagat

SEQ ID NO: 1178284 - DNA, 22 bp, Artificial Sequence
  chemically synthesized
ggcgataaagaatcttagagca

SEQ ID NO: 1178285 - DNA, 22 bp, Artificial Sequence
  chemically synthesized
tggaatctttgctgctctaaga

SEQ ID NO: 1178286 - DNA, 22 bp, Artificial Sequence
  chemically synthesized
agagcagcaaagattccaaaat

SEQ ID NO: 1178287 - DNA, 22 bp, Artificial Sequence
  chemically synthesized
gagcagcaaagattccaaaata

SEQ ID NO: 1178288 - DNA, 22 bp, Artificial Sequence
  chemically synthesized
agagatggacgaaacagatatt

SEQ ID NO: 1178289 - DNA, 22 bp, Artificial Sequence
  chemically synthesized
aagagatggacgaaacagatat

SEQ ID NO: 1178290 - DNA, 22 bp, Artificial Sequence
  chemically synthesized
tgcttaagagatggacgaaaca

SEQ ID NO: 1178291 - DNA, 22 bp, Artificial Sequence
  chemically synthesized
caaaatatctgtttcgtccatc

SEQ ID NO: 1178292 - DNA, 22 bp, Artificial Sequence
  chemically synthesized
tttcgtccatctcttaagcata

SEQ ID NO: 1178293 - DNA, 22 bp, Artificial Sequence
  chemically synthesized
cgtccatctcttaagcataggg

SEQ ID NO: 1178294 - DNA, 22 bp, Artificial Sequence
  chemically synthesized
gtccatctcttaagcatagggt

SEQ ID NO: 1178295 - DNA, 22 bp, Artificial Sequence
  chemically synthesized
aagccatggaaataaccctatg

SEQ ID NO: 1178296 - DNA, 22 bp, Artificial Sequence
  chemically synthesized
ctaaagccatggaaataaccct

SEQ ID NO: 1178297 - DNA, 22 bp, Artificial Sequence
  chemically synthesized
ttaagcatagggttatttccat

SEQ ID NO: 1178298 - DNA, 22 bp, Artificial Sequence
  chemically synthesized
aagcatagggttatttccatgg

SEQ ID NO: 1178299 - DNA, 22 bp, Artificial Sequence
  chemically synthesized
agcatagggttatttccatggc

SEQ ID NO: 1178300 - DNA, 22 bp, Artificial Sequence
  chemically synthesized
aataaatggtattactaaagcc

SEQ ID NO: 1178301 - DNA, 22 bp, Artificial Sequence
  chemically synthesized
caataaatggtattactaaagc

SEQ ID NO: 1178302 - DNA, 22 bp, Artificial Sequence
  chemically synthesized
tttccatggctttagtaatacc

SEQ ID NO: 1178303 - DNA, 22 bp, Artificial Sequence
  chemically synthesized
ccatggctttagtaataccatt

SEQ ID NO: 1178304 - DNA, 22 bp, Artificial Sequence
  chemically synthesized
catggctttagtaataccattt

SEQ ID NO: 1178305 - DNA, 22 bp, Artificial Sequence
  chemically synthesized
ggtgggacatgatttcaataaa

SEQ ID NO: 1178306 - DNA, 22 bp, Artificial Sequence
  chemically synthesized
tagtaataccatttattgaaat

SEQ ID NO: 1178307 - DNA, 22 bp, Artificial Sequence
  chemically synthesized
aggtgggacatgatttcaataa

SEQ ID NO: 1178308 - DNA, 22 bp, Artificial Sequence
  chemically synthesized
agtaataccatttattgaaatc

SEQ ID NO: 1178309 - DNA, 22 bp, Artificial Sequence
  chemically synthesized
taggtgggacatgatttcaata

SEQ ID NO: 1178310 - DNA, 22 bp, Artificial Sequence
  chemically synthesized
gtaataccatttattgaaatca

SEQ ID NO: 1178311 - DNA, 22 bp, Artificial Sequence
  chemically synthesized
attgaaatcatgtcccacctaa

SEQ ID NO: 1178312 - DNA, 22 bp, Artificial Sequence
  chemically synthesized
ttgaaatcatgtcccacctaaa

SEQ ID NO: 1178313 - DNA, 22 bp, Artificial Sequence
  chemically synthesized
aaatcatgtcccacctaaagta

SEQ ID NO: 1178314 - DNA, 22 bp, Artificial Sequence
  chemically synthesized
gataagaaaagaatgaaaatac

SEQ ID NO: 1178315 - DNA, 22 bp, Artificial Sequence
  chemically synthesized
agataagaaaagaatgaaaata

SEQ ID NO: 1178316 - DNA, 22 bp, Artificial Sequence
  chemically synthesized
cgaggcttagataagaaaagaa

SEQ ID NO: 1178317 - DNA, 22 bp, Artificial Sequence
  chemically synthesized
aagtattttcattcttttctta

SEQ ID NO: 1178318 - DNA, 22 bp, Artificial Sequence
  chemically synthesized
acgaggcttagataagaaaaga

SEQ ID NO: 1178319 - DNA, 22 bp, Artificial Sequence
  chemically synthesized
tacgaggcttagataagaaaag

SEQ ID NO: 1178320 - DNA, 22 bp, Artificial Sequence
  chemically synthesized
ttacgaggcttagataagaaaa

SEQ ID NO: 1178321 - DNA, 22 bp, Artificial Sequence
  chemically synthesized
tttacgaggcttagataagaaa

SEQ ID NO: 1178322 - DNA, 22 bp, Artificial Sequence
  chemically synthesized
tcattcttttcttatctaagcc

SEQ ID NO: 1178323 - DNA, 22 bp, Artificial Sequence
  chemically synthesized
cattcttttcttatctaagcct

SEQ ID NO: 1178324 - DNA, 22 bp, Artificial Sequence
  chemically synthesized
attcttttcttatctaagcctc

SEQ ID NO: 1178325 - DNA, 22 bp, Artificial Sequence
  chemically synthesized
aacagagctttttacgaggctt

SEQ ID NO: 1178326 - DNA, 22 bp, Artificial Sequence
  chemically synthesized
ttttcttatctaagcctcgtaa

SEQ ID NO: 1178327 - DNA, 22 bp, Artificial Sequence
  chemically synthesized
gaacagagctttttacgaggct

SEQ ID NO: 1178328 - DNA, 22 bp, Artificial Sequence
  chemically synthesized
ttcttatctaagcctcgtaaaa

SEQ ID NO: 1178329 - DNA, 22 bp, Artificial Sequence
  chemically synthesized
tcttatctaagcctcgtaaaaa

SEQ ID NO: 1178330 - DNA, 22 bp, Artificial Sequence
  chemically synthesized
cttatctaagcctcgtaaaaag

SEQ ID NO: 1178331 - DNA, 22 bp, Artificial Sequence
  chemically synthesized
ttatctaagcctcgtaaaaagc

SEQ ID NO: 1178332 - DNA, 22 bp, Artificial Sequence
  chemically synthesized
atcttgaacagagctttttacg

SEQ ID NO: 1178333 - DNA, 22 bp, Artificial Sequence
  chemically synthesized
atctaagcctcgtaaaaagctc

SEQ ID NO: 1178334 - DNA, 22 bp, Artificial Sequence
  chemically synthesized
tctaagcctcgtaaaaagctct

SEQ ID NO: 1178335 - DNA, 22 bp, Artificial Sequence
  chemically synthesized
agcctcgtaaaaagctctgttc

SEQ ID NO: 1178336 - DNA, 22 bp, Artificial Sequence
  chemically synthesized
gtaaaaagctctgttcaagatg

SEQ ID NO: 1178337 - DNA, 22 bp, Artificial Sequence
  chemically synthesized
catagagtaagttcatcttgaa

SEQ ID NO: 1178338 - DNA, 22 bp, Artificial Sequence
  chemically synthesized
ccatagagtaagttcatcttga

SEQ ID NO: 1178339 - DNA, 22 bp, Artificial Sequence
  chemically synthesized
tgttcaagatgaacttactcta

SEQ ID NO: 1178340 - DNA, 22 bp, Artificial Sequence
  chemically synthesized
aggaagatttccatagagtaag

SEQ ID NO: 1178341 - DNA, 22 bp, Artificial Sequence
  chemically synthesized
ttcaagatgaacttactctatg

SEQ ID NO: 1178342 - DNA, 22 bp, Artificial Sequence
  chemically synthesized
aagatgaacttactctatggaa

SEQ ID NO: 1178343 - DNA, 22 bp, Artificial Sequence
  chemically synthesized
gtactcaggaagatttccatag

SEQ ID NO: 1178344 - DNA, 22 bp, Artificial Sequence
  chemically synthesized
actctatggaaatcttcctgag

SEQ ID NO: 1178345 - DNA, 22 bp, Artificial Sequence
  chemically synthesized
ctctatggaaatcttcctgagt

SEQ ID NO: 1178346 - DNA, 22 bp, Artificial Sequence
  chemically synthesized
tatggaaatcttcctgagtacg

SEQ ID NO: 1178347 - DNA, 22 bp, Artificial Sequence
  chemically synthesized
tggaaatcttcctgagtacgag

SEQ ID NO: 1178348 - DNA, 22 bp, Artificial Sequence
  chemically synthesized
caatggtccatcgactcgtact

SEQ ID NO: 1178349 - DNA, 22 bp, Artificial Sequence
  chemically synthesized
cctgagtacgagtcgatggacc

SEQ ID NO: 1178350 - DNA, 22 bp, Artificial Sequence
  chemically synthesized
ctgagtacgagtcgatggacca

SEQ ID NO: 1178351 - DNA, 22 bp, Artificial Sequence
  chemically synthesized
tgcatcctacaatggtccatcg

SEQ ID NO: 1178352 - DNA, 22 bp, Artificial Sequence
  chemically synthesized
atgcatcctacaatggtccatc

SEQ ID NO: 1178353 - DNA, 22 bp, Artificial Sequence
  chemically synthesized
agtacgagtcgatggaccattg

SEQ ID NO: 1178354 - DNA, 22 bp, Artificial Sequence
  chemically synthesized
taggatgcataaactgccgatt

SEQ ID NO: 1178355 - DNA, 22 bp, Artificial Sequence
  chemically synthesized
gcgtgatgaatgggatccaaga

SEQ ID NO: 1178356 - DNA, 22 bp, Artificial Sequence
  chemically synthesized
ctagcgtgatgaatgggatcca

SEQ ID NO: 1178357 - DNA, 22 bp, Artificial Sequence
  chemically synthesized
ttactagcgtgatgaatgggat

SEQ ID NO: 1178358 - DNA, 22 bp, Artificial Sequence
  chemically synthesized
ccgattcttggatcccattcat

SEQ ID NO: 1178359 - DNA, 22 bp, Artificial Sequence
  chemically synthesized
attactagcgtgatgaatggga

SEQ ID NO: 1178360 - DNA, 22 bp, Artificial Sequence
  chemically synthesized
ttggatcccattcatcacgcta

SEQ ID NO: 1178361 - DNA, 22 bp, Artificial Sequence
  chemically synthesized
ggatcccattcatcacgctagt

SEQ ID NO: 1178362 - DNA, 22 bp, Artificial Sequence
  chemically synthesized
gatcccattcatcacgctagta

SEQ ID NO: 1178363 - DNA, 22 bp, Artificial Sequence
  chemically synthesized
atcacgctagtaataagcctta

SEQ ID NO: 1178364 - DNA, 22 bp, Artificial Sequence
  chemically synthesized
gtaataagccttatatatccat

SEQ ID NO: 1178365 - DNA, 22 bp, Artificial Sequence
  chemically synthesized
gagagatcgtacaaatatggat

SEQ ID NO: 1178366 - DNA, 22 bp, Artificial Sequence
  chemically synthesized
atatatccatatttgtacgatc

SEQ ID NO: 1178367 - DNA, 22 bp, Artificial Sequence
  chemically synthesized
agtgattggagagatcgtacaa

SEQ ID NO: 1178368 - DNA, 22 bp, Artificial Sequence
  chemically synthesized
tatatccatatttgtacgatct

SEQ ID NO: 1178369 - DNA, 22 bp, Artificial Sequence
  chemically synthesized
cagtgattggagagatcgtaca

SEQ ID NO: 1178370 - DNA, 22 bp, Artificial Sequence
  chemically synthesized
atttcagtgattggagagatcg

SEQ ID NO: 1178371 - DNA, 22 bp, Artificial Sequence
  chemically synthesized
caaactaatttcagtgattgga

SEQ ID NO: 1178372 - DNA, 22 bp, Artificial Sequence
  chemically synthesized
ccaaactaatttcagtgattgg

SEQ ID NO: 1178373 - DNA, 22 bp, Artificial Sequence
  chemically synthesized
gtacgatctctccaatcactga

SEQ ID NO: 1178374 - DNA, 22 bp, Artificial Sequence
  chemically synthesized
tccaaactaatttcagtgattg

SEQ ID NO: 1178375 - DNA, 22 bp, Artificial Sequence
  chemically synthesized
tacgatctctccaatcactgaa

SEQ ID NO: 1178376 - DNA, 22 bp, Artificial Sequence
  chemically synthesized
ttccaaactaatttcagtgatt

SEQ ID NO: 1178377 - DNA, 22 bp, Artificial Sequence
  chemically synthesized
atttttccaaactaatttcagt

SEQ ID NO: 1178378 - DNA, 22 bp, Artificial Sequence
  chemically synthesized
gatttttccaaactaatttcag

SEQ ID NO: 1178379 - DNA, 22 bp, Artificial Sequence
  chemically synthesized
tccaatcactgaaattagtttg

SEQ ID NO: 1178380 - DNA, 22 bp, Artificial Sequence
  chemically synthesized
caatcactgaaattagtttgga

SEQ ID NO: 1178381 - DNA, 22 bp, Artificial Sequence
  chemically synthesized
aaacacatgtttgatttttcca

SEQ ID NO: 1178382 - DNA, 22 bp, Artificial Sequence
  chemically synthesized
caaacacatgtttgatttttcc

SEQ ID NO: 1178383 - DNA, 22 bp, Artificial Sequence
  chemically synthesized
aaattagtttggaaaaatcaaa

SEQ ID NO: 1178384 - DNA, 22 bp, Artificial Sequence
  chemically synthesized
tatttcaaacacatgtttgatt

SEQ ID NO: 1178385 - DNA, 22 bp, Artificial Sequence
  chemically synthesized
gtatttcaaacacatgtttgat

SEQ ID NO: 1178386 - DNA, 22 bp, Artificial Sequence
  chemically synthesized
gtttggaaaaatcaaacatgtg

SEQ ID NO: 1178387 - DNA, 22 bp, Artificial Sequence
  chemically synthesized
ccttgtatttcaaacacatgtt

SEQ ID NO: 1178388 - DNA, 22 bp, Artificial Sequence
  chemically synthesized
ggaaaaatcaaacatgtgtttg

SEQ ID NO: 1178389 - DNA, 22 bp, Artificial Sequence
  chemically synthesized
gaaaaatcaaacatgtgtttga

SEQ ID NO: 1178390 - DNA, 22 bp, Artificial Sequence
  chemically synthesized
gaaatacaaggtagcatatccc

SEQ ID NO: 1178391 - DNA, 22 bp, Artificial Sequence
  chemically synthesized
aaatacaaggtagcatatccca

SEQ ID NO: 1178392 - DNA, 22 bp, Artificial Sequence
  chemically synthesized
cgtataaaagaatgagtaatac

SEQ ID NO: 1178393 - DNA, 22 bp, Artificial Sequence
  chemically synthesized
gtattactcattcttttatacg

SEQ ID NO: 1178394 - DNA, 22 bp, Artificial Sequence
  chemically synthesized
tattactcattcttttatacgt

SEQ ID NO: 1178395 - DNA, 22 bp, Artificial Sequence
  chemically synthesized
ctcattcttttatacgtaactc

SEQ ID NO: 1178396 - DNA, 22 bp, Artificial Sequence
  chemically synthesized
atcgtaatagaagagttacgta

SEQ ID NO: 1178397 - DNA, 22 bp, Artificial Sequence
  chemically synthesized
attcttttatacgtaactcttc

SEQ ID NO: 1178398 - DNA, 22 bp, Artificial Sequence
  chemically synthesized
ttttatacgtaactcttctatt

SEQ ID NO: 1178399 - DNA, 22 bp, Artificial Sequence
  chemically synthesized
ttatacgtaactcttctattac

SEQ ID NO: 1178400 - DNA, 22 bp, Artificial Sequence
  chemically synthesized
tatacgtaactcttctattacg

SEQ ID NO: 1178401 - DNA, 22 bp, Artificial Sequence
  chemically synthesized
atacgtaactcttctattacga

SEQ ID NO: 1178402 - DNA, 22 bp, Artificial Sequence
  chemically synthesized
tacgtaactcttctattacgat

SEQ ID NO: 1178403 - DNA, 22 bp, Artificial Sequence
  chemically synthesized
atcccatcaacctcatcgtaat

SEQ ID NO: 1178404 - DNA, 22 bp, Artificial Sequence
  chemically synthesized
ttaatcccatcaacctcatcgt

SEQ ID NO: 1178405 - DNA, 22 bp, Artificial Sequence
  chemically synthesized
ttctattacgatgaggttgatg

SEQ ID NO: 1178406 - DNA, 22 bp, Artificial Sequence
  chemically synthesized
ctattacgatgaggttgatggg

SEQ ID NO: 1178407 - DNA, 22 bp, Artificial Sequence
  chemically synthesized
tgaattattaatcccatcaacc

SEQ ID NO: 1178408 - DNA, 22 bp, Artificial Sequence
  chemically synthesized
tattacgatgaggttgatggga

SEQ ID NO: 1178409 - DNA, 22 bp, Artificial Sequence
  chemically synthesized
ttacgatgaggttgatgggatt

SEQ ID NO: 1178410 - DNA, 22 bp, Artificial Sequence
  chemically synthesized
ctatgaattattaatcccatca

SEQ ID NO: 1178411 - DNA, 22 bp, Artificial Sequence
  chemically synthesized
actatgaattattaatcccatc

SEQ ID NO: 1178412 - DNA, 22 bp, Artificial Sequence
  chemically synthesized
cgatgaggttgatgggattaat

SEQ ID NO: 1178413 - DNA, 22 bp, Artificial Sequence
  chemically synthesized
ttactatgaattattaatccca

SEQ ID NO: 1178414 - DNA, 22 bp, Artificial Sequence
  chemically synthesized
tcttactatgaattattaatcc

SEQ ID NO: 1178415 - DNA, 22 bp, Artificial Sequence
  chemically synthesized
ctcttactatgaattattaatc

SEQ ID NO: 1178416 - DNA, 22 bp, Artificial Sequence
  chemically synthesized
cttctcttactatgaattatta

SEQ ID NO: 1178417 - DNA, 22 bp, Artificial Sequence
  chemically synthesized
ccttctcttactatgaattatt

SEQ ID NO: 1178418 - DNA, 22 bp, Artificial Sequence
  chemically synthesized
atgggattaataattcatagta

SEQ ID NO: 1178419 - DNA, 22 bp, Artificial Sequence
  chemically synthesized
cgtcatcttccttctcttacta

SEQ ID NO: 1178420 - DNA, 22 bp, Artificial Sequence
  chemically synthesized
acgtcatcttccttctcttact

SEQ ID NO: 1178421 - DNA, 22 bp, Artificial Sequence
  chemically synthesized
tacgtcatcttccttctcttac

SEQ ID NO: 1178422 - DNA, 22 bp, Artificial Sequence
  chemically synthesized
ataattcatagtaagagaagga

SEQ ID NO: 1178423 - DNA, 22 bp, Artificial Sequence
  chemically synthesized
atagtaagagaaggaagatgac

SEQ ID NO: 1178424 - DNA, 22 bp, Artificial Sequence
  chemically synthesized
cagcacagttttacgtcatctt

SEQ ID NO: 1178425 - DNA, 22 bp, Artificial Sequence
  chemically synthesized
ctgcagcacagttttacgtcat

SEQ ID NO: 1178426 - DNA, 22 bp, Artificial Sequence
  chemically synthesized
caatataaaccctgctgcagca

SEQ ID NO: 1178427 - DNA, 22 bp, Artificial Sequence
  chemically synthesized
tgctgcagcagggtttatattg

SEQ ID NO: 1178428 - DNA, 22 bp, Artificial Sequence
  chemically synthesized
aagcaggtcctgcaatataaac

SEQ ID NO: 1178429 - DNA, 22 bp, Artificial Sequence
  chemically synthesized
gaagcaggtcctgcaatataaa

SEQ ID NO: 1178430 - DNA, 22 bp, Artificial Sequence
  chemically synthesized
tgaagcaggtcctgcaatataa

SEQ ID NO: 1178431 - DNA, 22 bp, Artificial Sequence
  chemically synthesized
cagcagggtttatattgcagga

SEQ ID NO: 1178432 - DNA, 22 bp, Artificial Sequence
  chemically synthesized
agggttttgaagcaggtcctgc

SEQ ID NO: 1178433 - DNA, 22 bp, Artificial Sequence
  chemically synthesized
ttcagggttttgaagcaggtcc

SEQ ID NO: 1178434 - DNA, 22 bp, Artificial Sequence
  chemically synthesized
atattgcaggacctgcttcaaa

SEQ ID NO: 1178435 - DNA, 22 bp, Artificial Sequence
  chemically synthesized
tattgcaggacctgcttcaaaa

SEQ ID NO: 1178436 - DNA, 22 bp, Artificial Sequence
  chemically synthesized
atatattgttcagggttttgaa

SEQ ID NO: 1178437 - DNA, 22 bp, Artificial Sequence
  chemically synthesized
caggacctgcttcaaaaccctg

SEQ ID NO: 1178438 - DNA, 22 bp, Artificial Sequence
  chemically synthesized
cttcaaaaccctgaacaatata

SEQ ID NO: 1178439 - DNA, 22 bp, Artificial Sequence
  chemically synthesized
cccgtgaatctaatatattgtt

SEQ ID NO: 1178440 - DNA, 22 bp, Artificial Sequence
  chemically synthesized
caaaaccctgaacaatatatta

SEQ ID NO: 1178441 - DNA, 22 bp, Artificial Sequence
  chemically synthesized
aaaaccctgaacaatatattag

SEQ ID NO: 1178442 - DNA, 22 bp, Artificial Sequence
  chemically synthesized
aacaatatattagattcacggg

SEQ ID NO: 1178443 - DNA, 22 bp, Artificial Sequence
  chemically synthesized
agggagcagctgcccgtgaatc

SEQ ID NO: 1178444 - DNA, 22 bp, Artificial Sequence
  chemically synthesized
aagggagcagctgcccgtgaat

SEQ ID NO: 1178445 - DNA, 22 bp, Artificial Sequence
  chemically synthesized
gattcacgggcagctgctccct

SEQ ID NO: 1178446 - DNA, 22 bp, Artificial Sequence
  chemically synthesized
acgggcagctgctcccttaagt

SEQ ID NO: 1178447 - DNA, 22 bp, Artificial Sequence
  chemically synthesized
agtgaacagcaatacttaaggg

SEQ ID NO: 1178448 - DNA, 22 bp, Artificial Sequence
  chemically synthesized
agagttgagtgaacagcaatac

SEQ ID NO: 1178449 - DNA, 22 bp, Artificial Sequence
  chemically synthesized
taagagttgagtgaacagcaat

SEQ ID NO: 1178450 - DNA, 22 bp, Artificial Sequence
  chemically synthesized
ctcccttaagtattgctgttca

SEQ ID NO: 1178451 - DNA, 22 bp, Artificial Sequence
  chemically synthesized
ccttaagtattgctgttcactc

SEQ ID NO: 1178452 - DNA, 22 bp, Artificial Sequence
  chemically synthesized
tatattctaagagttgagtgaa

SEQ ID NO: 1178453 - DNA, 22 bp, Artificial Sequence
  chemically synthesized
aagtattgctgttcactcaact

SEQ ID NO: 1178454 - DNA, 22 bp, Artificial Sequence
  chemically synthesized
agtattgctgttcactcaactc

SEQ ID NO: 1178455 - DNA, 22 bp, Artificial Sequence
  chemically synthesized
tattgtatattctaagagttga

SEQ ID NO: 1178456 - DNA, 22 bp, Artificial Sequence
  chemically synthesized
ctgttcactcaactcttagaat

SEQ ID NO: 1178457 - DNA, 22 bp, Artificial Sequence
  chemically synthesized
cgattgtattgtatattctaag

SEQ ID NO: 1178458 - DNA, 22 bp, Artificial Sequence
  chemically synthesized
ttcactcaactcttagaatata

SEQ ID NO: 1178459 - DNA, 22 bp, Artificial Sequence
  chemically synthesized
gcgattgtattgtatattctaa

SEQ ID NO: 1178460 - DNA, 22 bp, Artificial Sequence
  chemically synthesized
actcaactcttagaatatacaa

SEQ ID NO: 1178461 - DNA, 22 bp, Artificial Sequence
  chemically synthesized
aactcttagaatatacaataca

SEQ ID NO: 1178462 - DNA, 22 bp, Artificial Sequence
  chemically synthesized
ttagaatatacaatacaatcgc

SEQ ID NO: 1178463 - DNA, 22 bp, Artificial Sequence
  chemically synthesized
tatgccccagtttgcgattgta

SEQ ID NO: 1178464 - DNA, 22 bp, Artificial Sequence
  chemically synthesized
agaatatacaatacaatcgcaa

SEQ ID NO: 1178465 - DNA, 22 bp, Artificial Sequence
  chemically synthesized
atatgccccagtttgcgattgt

SEQ ID NO: 1178466 - DNA, 22 bp, Artificial Sequence
  chemically synthesized
gaatatacaatacaatcgcaaa

SEQ ID NO: 1178467 - DNA, 22 bp, Artificial Sequence
  chemically synthesized
tatatgccccagtttgcgattg

SEQ ID NO: 1178468 - DNA, 22 bp, Artificial Sequence
  chemically synthesized
ttatatgccccagtttgcgatt

SEQ ID NO: 1178469 - DNA, 22 bp, Artificial Sequence
  chemically synthesized
ttttatatgccccagtttgcga

SEQ ID NO: 1178470 - DNA, 22 bp, Artificial Sequence
  chemically synthesized
cttttatatgccccagtttgcg

SEQ ID NO: 1178471 - DNA, 22 bp, Artificial Sequence
  chemically synthesized
gggcatataaaagaaacgtgat

SEQ ID NO: 1178472 - DNA, 22 bp, Artificial Sequence
  chemically synthesized
atcaaatgaatgaaagcatcac

SEQ ID NO: 1178473 - DNA, 22 bp, Artificial Sequence
  chemically synthesized
ggtacataaagcatattgatca

SEQ ID NO: 1178474 - DNA, 22 bp, Artificial Sequence
  chemically synthesized
tcattcatttgatcaatatgct

SEQ ID NO: 1178475 - DNA, 22 bp, Artificial Sequence
  chemically synthesized
cattcatttgatcaatatgctt

SEQ ID NO: 1178476 - DNA, 22 bp, Artificial Sequence
  chemically synthesized
attcatttgatcaatatgcttt

SEQ ID NO: 1178477 - DNA, 22 bp, Artificial Sequence
  chemically synthesized
atttgatcaatatgctttatgt

SEQ ID NO: 1178478 - DNA, 22 bp, Artificial Sequence
  chemically synthesized
gaatatatactaggtacataaa

SEQ ID NO: 1178479 - DNA, 22 bp, Artificial Sequence
  chemically synthesized
gatcaatatgctttatgtacct

SEQ ID NO: 1178480 - DNA, 22 bp, Artificial Sequence
  chemically synthesized
atcaatatgctttatgtaccta

SEQ ID NO: 1178481 - DNA, 22 bp, Artificial Sequence
  chemically synthesized
tatgtacctagtatatattcta

SEQ ID NO: 1178482 - DNA, 22 bp, Artificial Sequence
  chemically synthesized
atgtacctagtatatattctag

SEQ ID NO: 1178483 - DNA, 22 bp, Artificial Sequence
  chemically synthesized
tgtacctagtatatattctagt

SEQ ID NO: 1178484 - DNA, 22 bp, Artificial Sequence
  chemically synthesized
caagaggaaaaggactagaata

SEQ ID NO: 1178485 - DNA, 22 bp, Artificial Sequence
  chemically synthesized
gtatatattctagtccttttcc

SEQ ID NO: 1178486 - DNA, 22 bp, Artificial Sequence
  chemically synthesized
atgagtaaaaactccaagagga

SEQ ID NO: 1178487 - DNA, 22 bp, Artificial Sequence
  chemically synthesized
tagtccttttcctcttggagtt

SEQ ID NO: 1178488 - DNA, 22 bp, Artificial Sequence
  chemically synthesized
cctaatgagtaaaaactccaag

SEQ ID NO: 1178489 - DNA, 22 bp, Artificial Sequence
  chemically synthesized
gtccttttcctcttggagtttt

SEQ ID NO: 1178490 - DNA, 22 bp, Artificial Sequence
  chemically synthesized
ccctaatgagtaaaaactccaa

SEQ ID NO: 1178491 - DNA, 22 bp, Artificial Sequence
  chemically synthesized
tccctaatgagtaaaaactcca

SEQ ID NO: 1178492 - DNA, 22 bp, Artificial Sequence
  chemically synthesized
ttccctaatgagtaaaaactcc

SEQ ID NO: 1178493 - DNA, 22 bp, Artificial Sequence
  chemically synthesized
ttcctcttggagtttttactca

SEQ ID NO: 1178494 - DNA, 22 bp, Artificial Sequence
  chemically synthesized
tcctcttggagtttttactcat

SEQ ID NO: 1178495 - DNA, 22 bp, Artificial Sequence
  chemically synthesized
cctcttggagtttttactcatt

SEQ ID NO: 1178496 - DNA, 22 bp, Artificial Sequence
  chemically synthesized
ctcttggagtttttactcatta

SEQ ID NO: 1178497 - DNA, 22 bp, Artificial Sequence
  chemically synthesized
ttggagtttttactcattaggg

SEQ ID NO: 1178498 - DNA, 22 bp, Artificial Sequence
  chemically synthesized
caggtcgtttttccctaatgag

SEQ ID NO: 1178499 - DNA, 22 bp, Artificial Sequence
  chemically synthesized
gcaggtcgtttttccctaatga

SEQ ID NO: 1178500 - DNA, 22 bp, Artificial Sequence
  chemically synthesized
ggagtttttactcattagggaa

SEQ ID NO: 1178501 - DNA, 22 bp, Artificial Sequence
  chemically synthesized
gagtttttactcattagggaaa

SEQ ID NO: 1178502 - DNA, 22 bp, Artificial Sequence
  chemically synthesized
ttactcattagggaaaaacgac

SEQ ID NO: 1178503 - DNA, 22 bp, Artificial Sequence
  chemically synthesized
cgatatttgcaggtcgtttttc

SEQ ID NO: 1178504 - DNA, 22 bp, Artificial Sequence
  chemically synthesized
tactcattagggaaaaacgacc

SEQ ID NO: 1178505 - DNA, 22 bp, Artificial Sequence
  chemically synthesized
actcattagggaaaaacgacct

SEQ ID NO: 1178506 - DNA, 22 bp, Artificial Sequence
  chemically synthesized
ctcattagggaaaaacgacctg

SEQ ID NO: 1178507 - DNA, 22 bp, Artificial Sequence
  chemically synthesized
attagggaaaaacgacctgcaa

SEQ ID NO: 1178508 - DNA, 22 bp, Artificial Sequence
  chemically synthesized
acattacgatatttgcaggtcg

SEQ ID NO: 1178509 - DNA, 22 bp, Artificial Sequence
  chemically synthesized
ctgacattacgatatttgcagg

SEQ ID NO: 1178510 - DNA, 22 bp, Artificial Sequence
  chemically synthesized
gggaaaaacgacctgcaaatat

SEQ ID NO: 1178511 - DNA, 22 bp, Artificial Sequence
  chemically synthesized
tcactactgacattacgatatt

SEQ ID NO: 1178512 - DNA, 22 bp, Artificial Sequence
  chemically synthesized
tagttatcactactgacattac

SEQ ID NO: 1178513 - DNA, 22 bp, Artificial Sequence
  chemically synthesized
caaatatcgtaatgtcagtagt

SEQ ID NO: 1178514 - DNA, 22 bp, Artificial Sequence
  chemically synthesized
attgtagttatcactactgaca

SEQ ID NO: 1178515 - DNA, 22 bp, Artificial Sequence
  chemically synthesized
ctcattgtagttatcactactg

SEQ ID NO: 1178516 - DNA, 22 bp, Artificial Sequence
  chemically synthesized
cctcattgtagttatcactact

SEQ ID NO: 1178517 - DNA, 22 bp, Artificial Sequence
  chemically synthesized
tcctcattgtagttatcactac

SEQ ID NO: 1178518 - DNA, 22 bp, Artificial Sequence
  chemically synthesized
ttcctcattgtagttatcacta

SEQ ID NO: 1178519 - DNA, 22 bp, Artificial Sequence
  chemically synthesized
tttcctcattgtagttatcact

SEQ ID NO: 1178520 - DNA, 22 bp, Artificial Sequence
  chemically synthesized
ttttcctcattgtagttatcac

SEQ ID NO: 1178521 - DNA, 22 bp, Artificial Sequence
  chemically synthesized
atttttttcctcattgtagtta

SEQ ID NO: 1178522 - DNA, 22 bp, Artificial Sequence
  chemically synthesized
aatttttttcctcattgtagtt

SEQ ID NO: 1178523 - DNA, 22 bp, Artificial Sequence
  chemically synthesized
taatttttttcctcattgtagt

SEQ ID NO: 1178524 - DNA, 22 bp, Artificial Sequence
  chemically synthesized
aaagctttaatttttttcctca

SEQ ID NO: 1178525 - DNA, 22 bp, Artificial Sequence
  chemically synthesized
caaagctttaatttttttcctc

SEQ ID NO: 1178526 - DNA, 22 bp, Artificial Sequence
  chemically synthesized
tcaaagctttaatttttttcct

SEQ ID NO: 1178527 - DNA, 22 bp, Artificial Sequence
  chemically synthesized
tttcaaagctttaatttttttc

SEQ ID NO: 1178528 - DNA, 22 bp, Artificial Sequence
  chemically synthesized
ctttcaaagctttaattttttt

SEQ ID NO: 1178529 - DNA, 22 bp, Artificial Sequence
  chemically synthesized
caatgaggaaaaaaattaaagc

SEQ ID NO: 1178530 - DNA, 22 bp, Artificial Sequence
  chemically synthesized
tcttctttcaaagctttaattt

SEQ ID NO: 1178531 - DNA, 22 bp, Artificial Sequence
  chemically synthesized
tgtcttctttcaaagctttaat

SEQ ID NO: 1178532 - DNA, 22 bp, Artificial Sequence
  chemically synthesized
ttctgtcttctttcaaagcttt

SEQ ID NO: 1178533 - DNA, 22 bp, Artificial Sequence
  chemically synthesized
ccattgttctgtcttctttcaa

SEQ ID NO: 1178534 - DNA, 22 bp, Artificial Sequence
  chemically synthesized
aagctttgaaagaagacagaac

SEQ ID NO: 1178535 - DNA, 22 bp, Artificial Sequence
  chemically synthesized
atatgccactaccattgttctg

SEQ ID NO: 1178536 - DNA, 22 bp, Artificial Sequence
  chemically synthesized
gatatgccactaccattgttct

SEQ ID NO: 1178537 - DNA, 22 bp, Artificial Sequence
  chemically synthesized
tgaaagaagacagaacaatggt

SEQ ID NO: 1178538 - DNA, 22 bp, Artificial Sequence
  chemically synthesized
gaaagaagacagaacaatggta

SEQ ID NO: 1178539 - DNA, 22 bp, Artificial Sequence
  chemically synthesized
aaagaagacagaacaatggtag

SEQ ID NO: 1178540 - DNA, 22 bp, Artificial Sequence
  chemically synthesized
tttgatatgccactaccattgt

SEQ ID NO: 1178541 - DNA, 22 bp, Artificial Sequence
  chemically synthesized
ccctatttgatatgccactacc

SEQ ID NO: 1178542 - DNA, 22 bp, Artificial Sequence
  chemically synthesized
actaccctatttgatatgccac

SEQ ID NO: 1178543 - DNA, 22 bp, Artificial Sequence
  chemically synthesized
tgactaccctatttgatatgcc

SEQ ID NO: 1178544 - DNA, 22 bp, Artificial Sequence
  chemically synthesized
ctgactaccctatttgatatgc

SEQ ID NO: 1178545 - DNA, 22 bp, Artificial Sequence
  chemically synthesized
tctgactaccctatttgatatg

SEQ ID NO: 1178546 - DNA, 22 bp, Artificial Sequence
  chemically synthesized
ttctgactaccctatttgatat

SEQ ID NO: 1178547 - DNA, 22 bp, Artificial Sequence
  chemically synthesized
caaagagatcttttctgactac

SEQ ID NO: 1178548 - DNA, 22 bp, Artificial Sequence
  chemically synthesized
gactgcaaagagatcttttctg

SEQ ID NO: 1178549 - DNA, 22 bp, Artificial Sequence
  chemically synthesized
agactgcaaagagatcttttct

SEQ ID NO: 1178550 - DNA, 22 bp, Artificial Sequence
  chemically synthesized
ccttagactgcaaagagatctt

SEQ ID NO: 1178551 - DNA, 22 bp, Artificial Sequence
  chemically synthesized
accttagactgcaaagagatct

SEQ ID NO: 1178552 - DNA, 22 bp, Artificial Sequence
  chemically synthesized
taccttagactgcaaagagatc

SEQ ID NO: 1178553 - DNA, 22 bp, Artificial Sequence
  chemically synthesized
ctttaccttagactgcaaagag

SEQ ID NO: 1178554 - DNA, 22 bp, Artificial Sequence
  chemically synthesized
cctttaccttagactgcaaaga

SEQ ID NO: 1178555 - DNA, 22 bp, Artificial Sequence
  chemically synthesized
atatggcgcacttcctttacct

SEQ ID NO: 1178556 - DNA, 22 bp, Artificial Sequence
  chemically synthesized
tttgcagtctaaggtaaaggaa

SEQ ID NO: 1178557 - DNA, 22 bp, Artificial Sequence
  chemically synthesized
tgcagtctaaggtaaaggaagt

SEQ ID NO: 1178558 - DNA, 22 bp, Artificial Sequence
  chemically synthesized
ttcatatggcgcacttccttta

SEQ ID NO: 1178559 - DNA, 22 bp, Artificial Sequence
  chemically synthesized
gcagtctaaggtaaaggaagtg

SEQ ID NO: 1178560 - DNA, 22 bp, Artificial Sequence
  chemically synthesized
cagtctaaggtaaaggaagtgc

SEQ ID NO: 1178561 - DNA, 22 bp, Artificial Sequence
  chemically synthesized
aggtaaaggaagtgcgccatat

SEQ ID NO: 1178562 - DNA, 22 bp, Artificial Sequence
  chemically synthesized
ccccagttattcatatggcgca

SEQ ID NO: 1178563 - DNA, 22 bp, Artificial Sequence
  chemically synthesized
cccccagttattcatatggcgc

SEQ ID NO: 1178564 - DNA, 22 bp, Artificial Sequence
  chemically synthesized
tcccccagttattcatatggcg

SEQ ID NO: 1178565 - DNA, 22 bp, Artificial Sequence
  chemically synthesized
ttcccccagttattcatatggc

SEQ ID NO: 1178566 - DNA, 22 bp, Artificial Sequence
  chemically synthesized
gaagggtttttcccccagttat

SEQ ID NO: 1178567 - DNA, 22 bp, Artificial Sequence
  chemically synthesized
ctggaagggtttttcccccagt

SEQ ID NO: 1178568 - DNA, 22 bp, Artificial Sequence
  chemically synthesized
cctggaagggtttttcccccag

SEQ ID NO: 1178569 - DNA, 22 bp, Artificial Sequence
  chemically synthesized
ttcctggaagggtttttccccc

SEQ ID NO: 1178570 - DNA, 22 bp, Artificial Sequence
  chemically synthesized
cctcttcctggaagggtttttc

SEQ ID NO: 1178571 - DNA, 22 bp, Artificial Sequence
  chemically synthesized
ggggaaaaacccttccaggaag

SEQ ID NO: 1178572 - DNA, 22 bp, Artificial Sequence
  chemically synthesized
cacatgtatctccctcttcctg

SEQ ID NO: 1178573 - DNA, 22 bp, Artificial Sequence
  chemically synthesized
acacatgtatctccctcttcct

SEQ ID NO: 1178574 - DNA, 22 bp, Artificial Sequence
  chemically synthesized
tacacatgtatctccctcttcc

SEQ ID NO: 1178575 - DNA, 22 bp, Artificial Sequence
  chemically synthesized
agtgactttacacatgtatctc

SEQ ID NO: 1178576 - DNA, 22 bp, Artificial Sequence
  chemically synthesized
ccaggaagagggagatacatgt

SEQ ID NO: 1178577 - DNA, 22 bp, Artificial Sequence
  chemically synthesized
caggaagagggagatacatgtg

SEQ ID NO: 1178578 - DNA, 22 bp, Artificial Sequence
  chemically synthesized
agttcagtgactttacacatgt

SEQ ID NO: 1178579 - DNA, 22 bp, Artificial Sequence
  chemically synthesized
gagttcagtgactttacacatg

SEQ ID NO: 1178580 - DNA, 22 bp, Artificial Sequence
  chemically synthesized
tgagttcagtgactttacacat

SEQ ID NO: 1178581 - DNA, 22 bp, Artificial Sequence
  chemically synthesized
gcatcaaatacgccaagcatac

SEQ ID NO: 1178582 - DNA, 22 bp, Artificial Sequence
  chemically synthesized
ggcatcaaatacgccaagcata

SEQ ID NO: 1178583 - DNA, 22 bp, Artificial Sequence
  chemically synthesized
aactcaaagtatgcttggcgta

SEQ ID NO: 1178584 - DNA, 22 bp, Artificial Sequence
  chemically synthesized
gcttggcatcaaatacgccaag

SEQ ID NO: 1178585 - DNA, 22 bp, Artificial Sequence
  chemically synthesized
ctagcttggcatcaaatacgcc

SEQ ID NO: 1178586 - DNA, 22 bp, Artificial Sequence
  chemically synthesized
aaagtatgcttggcgtatttga

SEQ ID NO: 1178587 - DNA, 22 bp, Artificial Sequence
  chemically synthesized
gcctactagcttggcatcaaat

SEQ ID NO: 1178588 - DNA, 22 bp, Artificial Sequence
  chemically synthesized
ggcgtatttgatgccaagctag

SEQ ID NO: 1178589 - DNA, 22 bp, Artificial Sequence
  chemically synthesized
gcgtatttgatgccaagctagt

SEQ ID NO: 1178590 - DNA, 22 bp, Artificial Sequence
  chemically synthesized
cagatacactggcctactagct

SEQ ID NO: 1178591 - DNA, 22 bp, Artificial Sequence
  chemically synthesized
gatgccaagctagtaggccagt

SEQ ID NO: 1178592 - DNA, 22 bp, Artificial Sequence
  chemically synthesized
agctccagatacactggcctac

SEQ ID NO: 1178593 - DNA, 22 bp, Artificial Sequence
  chemically synthesized
atgccaagctagtaggccagtg

SEQ ID NO: 1178594 - DNA, 22 bp, Artificial Sequence
  chemically synthesized
tcagctccagatacactggcct

SEQ ID NO: 1178595 - DNA, 22 bp, Artificial Sequence
  chemically synthesized
ctcagctccagatacactggcc

SEQ ID NO: 1178596 - DNA, 22 bp, Artificial Sequence
  chemically synthesized
gtaggccagtgtatctggagct

SEQ ID NO: 1178597 - DNA, 22 bp, Artificial Sequence
  chemically synthesized
accccatttctcagctccagat

SEQ ID NO: 1178598 - DNA, 22 bp, Artificial Sequence
  chemically synthesized
aaccccatttctcagctccaga

SEQ ID NO: 1178599 - DNA, 22 bp, Artificial Sequence
  chemically synthesized
cccttaaccccatttctcagct

SEQ ID NO: 1178600 - DNA, 22 bp, Artificial Sequence
  chemically synthesized
ctacccttaaccccatttctca

SEQ ID NO: 1178601 - DNA, 22 bp, Artificial Sequence
  chemically synthesized
cctacccttaaccccatttctc

SEQ ID NO: 1178602 - DNA, 22 bp, Artificial Sequence
  chemically synthesized
tcctacccttaaccccatttct

SEQ ID NO: 1178603 - DNA, 22 bp, Artificial Sequence
  chemically synthesized
tttcctacccttaaccccattt

SEQ ID NO: 1178604 - DNA, 22 bp, Artificial Sequence
  chemically synthesized
ctttcctacccttaaccccatt

SEQ ID NO: 1178605 - DNA, 22 bp, Artificial Sequence
  chemically synthesized
gagctgagaaatggggttaagg

SEQ ID NO: 1178606 - DNA, 22 bp, Artificial Sequence
  chemically synthesized
ccttctttcctacccttaaccc

SEQ ID NO: 1178607 - DNA, 22 bp, Artificial Sequence
  chemically synthesized
agaaatggggttaagggtagga

SEQ ID NO: 1178608 - DNA, 22 bp, Artificial Sequence
  chemically synthesized
taggtatcctaccttctttcct

SEQ ID NO: 1178609 - DNA, 22 bp, Artificial Sequence
  chemically synthesized
cctataggtatcctaccttctt

SEQ ID NO: 1178610 - DNA, 22 bp, Artificial Sequence
  chemically synthesized
agggtaggaaagaaggtaggat

SEQ ID NO: 1178611 - DNA, 22 bp, Artificial Sequence
  chemically synthesized
ttccctataggtatcctacctt

SEQ ID NO: 1178612 - DNA, 22 bp, Artificial Sequence
  chemically synthesized
gttccctataggtatcctacct

SEQ ID NO: 1178613 - DNA, 22 bp, Artificial Sequence
  chemically synthesized
tagggaacaaatcacgatggtg

SEQ ID NO: 1178614 - DNA, 22 bp, Artificial Sequence
  chemically synthesized
ggaagaaaatccaaaacaccat

SEQ ID NO: 1178615 - DNA, 22 bp, Artificial Sequence
  chemically synthesized
cactcggaagaaaatccaaaac

SEQ ID NO: 1178616 - DNA, 22 bp, Artificial Sequence
  chemically synthesized
acactcggaagaaaatccaaaa

SEQ ID NO: 1178617 - DNA, 22 bp, Artificial Sequence
  chemically synthesized
tacactcggaagaaaatccaaa

SEQ ID NO: 1178618 - DNA, 22 bp, Artificial Sequence
  chemically synthesized
actttacactcggaagaaaatc

SEQ ID NO: 1178619 - DNA, 22 bp, Artificial Sequence
  chemically synthesized
cactttacactcggaagaaaat

SEQ ID NO: 1178620 - DNA, 22 bp, Artificial Sequence
  chemically synthesized
tggattttcttccgagtgtaaa

SEQ ID NO: 1178621 - DNA, 22 bp, Artificial Sequence
  chemically synthesized
aaataatttcactttacactcg

SEQ ID NO: 1178622 - DNA, 22 bp, Artificial Sequence
  chemically synthesized
ggattttcttccgagtgtaaag

SEQ ID NO: 1178623 - DNA, 22 bp, Artificial Sequence
  chemically synthesized
gattttcttccgagtgtaaagt

SEQ ID NO: 1178624 - DNA, 22 bp, Artificial Sequence
  chemically synthesized
tcttccgagtgtaaagtgaaat

SEQ ID NO: 1178625 - DNA, 22 bp, Artificial Sequence
  chemically synthesized
aatcctgaaataatttcacttt

SEQ ID NO: 1178626 - DNA, 22 bp, Artificial Sequence
  chemically synthesized
cttccgagtgtaaagtgaaatt

SEQ ID NO: 1178627 - DNA, 22 bp, Artificial Sequence
  chemically synthesized
ttccgagtgtaaagtgaaatta

SEQ ID NO: 1178628 - DNA, 22 bp, Artificial Sequence
  chemically synthesized
taaatcctgaaataatttcact

SEQ ID NO: 1178629 - DNA, 22 bp, Artificial Sequence
  chemically synthesized
ccgagtgtaaagtgaaattatt

SEQ ID NO: 1178630 - DNA, 22 bp, Artificial Sequence
  chemically synthesized
cgagtgtaaagtgaaattattt

SEQ ID NO: 1178631 - DNA, 22 bp, Artificial Sequence
  chemically synthesized
agagtagttctaaatcctgaaa

SEQ ID NO: 1178632 - DNA, 22 bp, Artificial Sequence
  chemically synthesized
tttcaggatttagaactactct

SEQ ID NO: 1178633 - DNA, 22 bp, Artificial Sequence
  chemically synthesized
caggatttagaactactctcaa

SEQ ID NO: 1178634 - DNA, 22 bp, Artificial Sequence
  chemically synthesized
aggatttagaactactctcaac

SEQ ID NO: 1178635 - DNA, 22 bp, Artificial Sequence
  chemically synthesized
agtaagtagagaagatgttgag

SEQ ID NO: 1178636 - DNA, 22 bp, Artificial Sequence
  chemically synthesized
agaactactctcaacatcttct

SEQ ID NO: 1178637 - DNA, 22 bp, Artificial Sequence
  chemically synthesized
gaactactctcaacatcttctc

SEQ ID NO: 1178638 - DNA, 22 bp, Artificial Sequence
  chemically synthesized
caaactgagtaagtagagaaga

SEQ ID NO: 1178639 - DNA, 22 bp, Artificial Sequence
  chemically synthesized
acaaactgagtaagtagagaag

SEQ ID NO: 1178640 - DNA, 22 bp, Artificial Sequence
  chemically synthesized
ctctcaacatcttctctactta

SEQ ID NO: 1178641 - DNA, 22 bp, Artificial Sequence
  chemically synthesized
tcaacatcttctctacttactc

SEQ ID NO: 1178642 - DNA, 22 bp, Artificial Sequence
  chemically synthesized
aacatcttctctacttactcag

SEQ ID NO: 1178643 - DNA, 22 bp, Artificial Sequence
  chemically synthesized
aggaatttacaaactgagtaag

SEQ ID NO: 1178644 - DNA, 22 bp, Artificial Sequence
  chemically synthesized
aaggaatttacaaactgagtaa

SEQ ID NO: 1178645 - DNA, 22 bp, Artificial Sequence
  chemically synthesized
cccttaaggaatttacaaactg

SEQ ID NO: 1178646 - DNA, 22 bp, Artificial Sequence
  chemically synthesized
ctctacttactcagtttgtaaa

SEQ ID NO: 1178647 - DNA, 22 bp, Artificial Sequence
  chemically synthesized
tctacttactcagtttgtaaat

SEQ ID NO: 1178648 - DNA, 22 bp, Artificial Sequence
  chemically synthesized
ttgcccttaaggaatttacaaa

SEQ ID NO: 1178649 - DNA, 22 bp, Artificial Sequence
  chemically synthesized
tacttactcagtttgtaaattc

SEQ ID NO: 1178650 - DNA, 22 bp, Artificial Sequence
  chemically synthesized
cttactcagtttgtaaattcct

SEQ ID NO: 1178651 - DNA, 22 bp, Artificial Sequence
  chemically synthesized
actcagtttgtaaattccttaa

SEQ ID NO: 1178652 - DNA, 22 bp, Artificial Sequence
  chemically synthesized
ctcagtttgtaaattccttaag

SEQ ID NO: 1178653 - DNA, 22 bp, Artificial Sequence
  chemically synthesized
agtttgtaaattccttaagggc

SEQ ID NO: 1178654 - DNA, 22 bp, Artificial Sequence
  chemically synthesized
gtaaattccttaagggcaataa

SEQ ID NO: 1178655 - DNA, 22 bp, Artificial Sequence
  chemically synthesized
taaattccttaagggcaataat

SEQ ID NO: 1178656 - DNA, 22 bp, Artificial Sequence
  chemically synthesized
cttaagggcaataatatggcca

SEQ ID NO: 1178657 - DNA, 22 bp, Artificial Sequence
  chemically synthesized
aagggcaataatatggccatat

SEQ ID NO: 1178658 - DNA, 22 bp, Artificial Sequence
  chemically synthesized
agggcaataatatggccatata

SEQ ID NO: 1178659 - DNA, 22 bp, Artificial Sequence
  chemically synthesized
tggaatgagagacagtgaacca

SEQ ID NO: 1178660 - DNA, 22 bp, Artificial Sequence
  chemically synthesized
ttatggaatgagagacagtgaa

SEQ ID NO: 1178661 - DNA, 22 bp, Artificial Sequence
  chemically synthesized
cccatgcttggttcactgtctc

SEQ ID NO: 1178662 - DNA, 22 bp, Artificial Sequence
  chemically synthesized
ggttcactgtctctcattccat

SEQ ID NO: 1178663 - DNA, 22 bp, Artificial Sequence
  chemically synthesized
gttcactgtctctcattccata

SEQ ID NO: 1178664 - DNA, 22 bp, Artificial Sequence
  chemically synthesized
actgtctctcattccataatag

SEQ ID NO: 1178665 - DNA, 22 bp, Artificial Sequence
  chemically synthesized
tggaatagtggtaactattatg

SEQ ID NO: 1178666 - DNA, 22 bp, Artificial Sequence
  chemically synthesized
gtggaatagtggtaactattat

SEQ ID NO: 1178667 - DNA, 22 bp, Artificial Sequence
  chemically synthesized
tctctcattccataatagttac

SEQ ID NO: 1178668 - DNA, 22 bp, Artificial Sequence
  chemically synthesized
tcattccataatagttaccact

SEQ ID NO: 1178669 - DNA, 22 bp, Artificial Sequence
  chemically synthesized
attccataatagttaccactat

SEQ ID NO: 1178670 - DNA, 22 bp, Artificial Sequence
  chemically synthesized
cataatagttaccactattcca

SEQ ID NO: 1178671 - DNA, 22 bp, Artificial Sequence
  chemically synthesized
atcgatgggtcttgtggaatag

SEQ ID NO: 1178672 - DNA, 22 bp, Artificial Sequence
  chemically synthesized
taatcgatgggtcttgtggaat

SEQ ID NO: 1178673 - DNA, 22 bp, Artificial Sequence
  chemically synthesized
ccactattccacaagacccatc

SEQ ID NO: 1178674 - DNA, 22 bp, Artificial Sequence
  chemically synthesized
aatccataattctaatcgatgg

SEQ ID NO: 1178675 - DNA, 22 bp, Artificial Sequence
  chemically synthesized
ttccacaagacccatcgattag

SEQ ID NO: 1178676 - DNA, 22 bp, Artificial Sequence
  chemically synthesized
aaatccataattctaatcgatg

SEQ ID NO: 1178677 - DNA, 22 bp, Artificial Sequence
  chemically synthesized
cacaagacccatcgattagaat

SEQ ID NO: 1178678 - DNA, 22 bp, Artificial Sequence
  chemically synthesized
caagccttaaatccataattct

SEQ ID NO: 1178679 - DNA, 22 bp, Artificial Sequence
  chemically synthesized
gcaagccttaaatccataattc

SEQ ID NO: 1178680 - DNA, 22 bp, Artificial Sequence
  chemically synthesized
tgcaagccttaaatccataatt

SEQ ID NO: 1178681 - DNA, 22 bp, Artificial Sequence
  chemically synthesized
ctttgcaagccttaaatccata

SEQ ID NO: 1178682 - DNA, 22 bp, Artificial Sequence
  chemically synthesized
tcctttgcaagccttaaatcca

SEQ ID NO: 1178683 - DNA, 22 bp, Artificial Sequence
  chemically synthesized
ctcctttgcaagccttaaatcc

SEQ ID NO: 1178684 - DNA, 22 bp, Artificial Sequence
  chemically synthesized
ttctcctttgcaagccttaaat

SEQ ID NO: 1178685 - DNA, 22 bp, Artificial Sequence
  chemically synthesized
cttctcctttgcaagccttaaa

SEQ ID NO: 1178686 - DNA, 22 bp, Artificial Sequence
  chemically synthesized
tcttctcctttgcaagccttaa

SEQ ID NO: 1178687 - DNA, 22 bp, Artificial Sequence
  chemically synthesized
gaattatggatttaaggcttgc

SEQ ID NO: 1178688 - DNA, 22 bp, Artificial Sequence
  chemically synthesized
tggatttaaggcttgcaaagga

SEQ ID NO: 1178689 - DNA, 22 bp, Artificial Sequence
  chemically synthesized
agatgagctttcttctcctttg

SEQ ID NO: 1178690 - DNA, 22 bp, Artificial Sequence
  chemically synthesized
aaggcttgcaaaggagaagaaa

SEQ ID NO: 1178691 - DNA, 22 bp, Artificial Sequence
  chemically synthesized
tctaagatgagctttcttctcc

SEQ ID NO: 1178692 - DNA, 22 bp, Artificial Sequence
  chemically synthesized
aggcttgcaaaggagaagaaag

SEQ ID NO: 1178693 - DNA, 22 bp, Artificial Sequence
  chemically synthesized
gcaaaggagaagaaagctcatc

SEQ ID NO: 1178694 - DNA, 22 bp, Artificial Sequence
  chemically synthesized
caaaggagaagaaagctcatct

SEQ ID NO: 1178695 - DNA, 22 bp, Artificial Sequence
  chemically synthesized
gaaccatatagctgtctaagat

SEQ ID NO: 1178696 - DNA, 22 bp, Artificial Sequence
  chemically synthesized
tgtactggaaccatatagctgt

SEQ ID NO: 1178697 - DNA, 22 bp, Artificial Sequence
  chemically synthesized
ctatgtactggaaccatatagc

SEQ ID NO: 1178698 - DNA, 22 bp, Artificial Sequence
  chemically synthesized
actatgtactggaaccatatag

SEQ ID NO: 1178699 - DNA, 22 bp, Artificial Sequence
  chemically synthesized
atcttagacagctatatggttc

SEQ ID NO: 1178700 - DNA, 22 bp, Artificial Sequence
  chemically synthesized
acttactatgtactggaaccat

SEQ ID NO: 1178701 - DNA, 22 bp, Artificial Sequence
  chemically synthesized
agacagctatatggttccagta

SEQ ID NO: 1178702 - DNA, 22 bp, Artificial Sequence
  chemically synthesized
gacagctatatggttccagtac

SEQ ID NO: 1178703 - DNA, 22 bp, Artificial Sequence
  chemically synthesized
atatgttcacttactatgtact

SEQ ID NO: 1178704 - DNA, 22 bp, Artificial Sequence
  chemically synthesized
tatggttccagtacatagtaag

SEQ ID NO: 1178705 - DNA, 22 bp, Artificial Sequence
  chemically synthesized
ttaatatgttcacttactatgt

SEQ ID NO: 1178706 - DNA, 22 bp, Artificial Sequence
  chemically synthesized
attaatatgttcacttactatg

SEQ ID NO: 1178707 - DNA, 22 bp, Artificial Sequence
  chemically synthesized
cagtacatagtaagtgaacata

SEQ ID NO: 1178708 - DNA, 22 bp, Artificial Sequence
  chemically synthesized
ataagccatgtgtcccgtgacc

SEQ ID NO: 1178709 - DNA, 22 bp, Artificial Sequence
  chemically synthesized
taaaaggcagtcggtcacggga

SEQ ID NO: 1178710 - DNA, 22 bp, Artificial Sequence
  chemically synthesized
gttgtaaaaggcagtcggtcac

SEQ ID NO: 1178711 - DNA, 22 bp, Artificial Sequence
  chemically synthesized
atgagactggttgtaaaaggca

SEQ ID NO: 1178712 - DNA, 22 bp, Artificial Sequence
  chemically synthesized
cctaatgagactggttgtaaaa

SEQ ID NO: 1178713 - DNA, 22 bp, Artificial Sequence
  chemically synthesized
ccttttacaaccagtctcatta

SEQ ID NO: 1178714 - DNA, 22 bp, Artificial Sequence
  chemically synthesized
agtatagactacctaatgagac

SEQ ID NO: 1178715 - DNA, 22 bp, Artificial Sequence
  chemically synthesized
aagtatagactacctaatgaga

SEQ ID NO: 1178716 - DNA, 22 bp, Artificial Sequence
  chemically synthesized
ttacaaccagtctcattaggta

SEQ ID NO: 1178717 - DNA, 22 bp, Artificial Sequence
  chemically synthesized
tacaaccagtctcattaggtag

SEQ ID NO: 1178718 - DNA, 22 bp, Artificial Sequence
  chemically synthesized
acaaccagtctcattaggtagt

SEQ ID NO: 1178719 - DNA, 22 bp, Artificial Sequence
  chemically synthesized
caaccagtctcattaggtagtc

SEQ ID NO: 1178720 - DNA, 22 bp, Artificial Sequence
  chemically synthesized
tcagagtagtgtttaagtatag

SEQ ID NO: 1178721 - DNA, 22 bp, Artificial Sequence
  chemically synthesized
attaggtagtctatacttaaac

SEQ ID NO: 1178722 - DNA, 22 bp, Artificial Sequence
  chemically synthesized
tgtcagagtagtgtttaagtat

SEQ ID NO: 1178723 - DNA, 22 bp, Artificial Sequence
  chemically synthesized
ggtagtctatacttaaacacta

SEQ ID NO: 1178724 - DNA, 22 bp, Artificial Sequence
  chemically synthesized
tacttaaacactactctgacag

SEQ ID NO: 1178725 - DNA, 22 bp, Artificial Sequence
  chemically synthesized
ggggatagtgagccctctgtca

SEQ ID NO: 1178726 - DNA, 22 bp, Artificial Sequence
  chemically synthesized
aaacactactctgacagagggc

SEQ ID NO: 1178727 - DNA, 22 bp, Artificial Sequence
  chemically synthesized
gggggatagtgagccctctgtc

SEQ ID NO: 1178728 - DNA, 22 bp, Artificial Sequence
  chemically synthesized
aacactactctgacagagggct

SEQ ID NO: 1178729 - DNA, 22 bp, Artificial Sequence
  chemically synthesized
tgggggatagtgagccctctgt

SEQ ID NO: 1178730 - DNA, 22 bp, Artificial Sequence
  chemically synthesized
ctctgacagagggctcactatc

SEQ ID NO: 1178731 - DNA, 22 bp, Artificial Sequence
  chemically synthesized
tgacagagggctcactatcccc

SEQ ID NO: 1178732 - DNA, 22 bp, Artificial Sequence
  chemically synthesized
acagagggctcactatccccca

SEQ ID NO: 1178733 - DNA, 22 bp, Artificial Sequence
  chemically synthesized
aaaatgcaataaaaggctttgg

SEQ ID NO: 1178734 - DNA, 22 bp, Artificial Sequence
  chemically synthesized
actatcccccaaagccttttat

SEQ ID NO: 1178735 - DNA, 22 bp, Artificial Sequence
  chemically synthesized
tcccccaaagccttttattgca

SEQ ID NO: 1178736 - DNA, 22 bp, Artificial Sequence
  chemically synthesized
atagaaatgtctcaaaatgcaa

SEQ ID NO: 1178737 - DNA, 22 bp, Artificial Sequence
  chemically synthesized
gctaatagaaatgtctcaaaat

SEQ ID NO: 1178738 - DNA, 22 bp, Artificial Sequence
  chemically synthesized
ttattgcattttgagacatttc

SEQ ID NO: 1178739 - DNA, 22 bp, Artificial Sequence
  chemically synthesized
tattgcattttgagacatttct

SEQ ID NO: 1178740 - DNA, 22 bp, Artificial Sequence
  chemically synthesized
attgcattttgagacatttcta

SEQ ID NO: 1178741 - DNA, 22 bp, Artificial Sequence
  chemically synthesized
aatactcgctaatagaaatgtc

SEQ ID NO: 1178742 - DNA, 22 bp, Artificial Sequence
  chemically synthesized
ttgcattttgagacatttctat

SEQ ID NO: 1178743 - DNA, 22 bp, Artificial Sequence
  chemically synthesized
gaatactcgctaatagaaatgt

SEQ ID NO: 1178744 - DNA, 22 bp, Artificial Sequence
  chemically synthesized
cattttgagacatttctattag

SEQ ID NO: 1178745 - DNA, 22 bp, Artificial Sequence
  chemically synthesized
tgagacatttctattagcgagt

SEQ ID NO: 1178746 - DNA, 22 bp, Artificial Sequence
  chemically synthesized
gagacatttctattagcgagta

SEQ ID NO: 1178747 - DNA, 22 bp, Artificial Sequence
  chemically synthesized
agacatttctattagcgagtat

SEQ ID NO: 1178748 - DNA, 22 bp, Artificial Sequence
  chemically synthesized
ctattagcgagtattcaaatat

SEQ ID NO: 1178749 - DNA, 22 bp, Artificial Sequence
  chemically synthesized
tattagcgagtattcaaatatc

SEQ ID NO: 1178750 - DNA, 22 bp, Artificial Sequence
  chemically synthesized
ttagcgagtattcaaatatcac

SEQ ID NO: 1178751 - DNA, 22 bp, Artificial Sequence
  chemically synthesized
atggggtcaaatatgtgatatt

SEQ ID NO: 1178752 - DNA, 22 bp, Artificial Sequence
  chemically synthesized
gcgagtattcaaatatcacata

SEQ ID NO: 1178753 - DNA, 22 bp, Artificial Sequence
  chemically synthesized
aaattcatggggtcaaatatgt

SEQ ID NO: 1178754 - DNA, 22 bp, Artificial Sequence
  chemically synthesized
ctaaaattcatggggtcaaata

SEQ ID NO: 1178755 - DNA, 22 bp, Artificial Sequence
  chemically synthesized
gctaaaattcatggggtcaaat

SEQ ID NO: 1178756 - DNA, 22 bp, Artificial Sequence
  chemically synthesized
aaatatcacatatttgacccca

SEQ ID NO: 1178757 - DNA, 22 bp, Artificial Sequence
  chemically synthesized
acttgctaaaattcatggggtc

SEQ ID NO: 1178758 - DNA, 22 bp, Artificial Sequence
  chemically synthesized
agttaacttgctaaaattcatg

SEQ ID NO: 1178759 - DNA, 22 bp, Artificial Sequence
  chemically synthesized
gaccccatgaattttagcaagt

SEQ ID NO: 1178760 - DNA, 22 bp, Artificial Sequence
  chemically synthesized
accccatgaattttagcaagtt

SEQ ID NO: 1178761 - DNA, 22 bp, Artificial Sequence
  chemically synthesized
aaatcataaactaagttaactt

SEQ ID NO: 1178762 - DNA, 22 bp, Artificial Sequence
  chemically synthesized
tagcaagttaacttagtttatg

SEQ ID NO: 1178763 - DNA, 22 bp, Artificial Sequence
  chemically synthesized
caaaattgaaatcataaactaa

SEQ ID NO: 1178764 - DNA, 22 bp, Artificial Sequence
  chemically synthesized
agcaagttaacttagtttatga

SEQ ID NO: 1178765 - DNA, 22 bp, Artificial Sequence
  chemically synthesized
gcaagttaacttagtttatgat

SEQ ID NO: 1178766 - DNA, 22 bp, Artificial Sequence
  chemically synthesized
aattccaaaattgaaatcataa

SEQ ID NO: 1178767 - DNA, 22 bp, Artificial Sequence
  chemically synthesized
acttagtttatgatttcaattt

SEQ ID NO: 1178768 - DNA, 22 bp, Artificial Sequence
  chemically synthesized
agtttatgatttcaattttgga

SEQ ID NO: 1178769 - DNA, 22 bp, Artificial Sequence
  chemically synthesized
gtttatgatttcaattttggaa

SEQ ID NO: 1178770 - DNA, 22 bp, Artificial Sequence
  chemically synthesized
atgatttcaattttggaattta

SEQ ID NO: 1178771 - DNA, 22 bp, Artificial Sequence
  chemically synthesized
tgatttcaattttggaatttaa

SEQ ID NO: 1178772 - DNA, 22 bp, Artificial Sequence
  chemically synthesized
aagcataaaaaattaaattcca

SEQ ID NO: 1178773 - DNA, 22 bp, Artificial Sequence
  chemically synthesized
caagcataaaaaattaaattcc

SEQ ID NO: 1178774 - DNA, 22 bp, Artificial Sequence
  chemically synthesized
ttcaagcataaaaaattaaatt

SEQ ID NO: 1178775 - DNA, 22 bp, Artificial Sequence
  chemically synthesized
caattttggaatttaatttttt

SEQ ID NO: 1178776 - DNA, 22 bp, Artificial Sequence
  chemically synthesized
aattttggaatttaatttttta

SEQ ID NO: 1178777 - DNA, 22 bp, Artificial Sequence
  chemically synthesized
tggaatttaattttttatgctt

SEQ ID NO: 1178778 - DNA, 22 bp, Artificial Sequence
  chemically synthesized
ggaatttaattttttatgcttg

SEQ ID NO: 1178779 - DNA, 22 bp, Artificial Sequence
  chemically synthesized
atatgaactcttcaagcataaa

SEQ ID NO: 1178780 - DNA, 22 bp, Artificial Sequence
  chemically synthesized
gaatttaattttttatgcttga

SEQ ID NO: 1178781 - DNA, 22 bp, Artificial Sequence
  chemically synthesized
gatatgaactcttcaagcataa

SEQ ID NO: 1178782 - DNA, 22 bp, Artificial Sequence
  chemically synthesized
tgatatgaactcttcaagcata

SEQ ID NO: 1178783 - DNA, 22 bp, Artificial Sequence
  chemically synthesized
ttgatatgaactcttcaagcat

SEQ ID NO: 1178784 - DNA, 22 bp, Artificial Sequence
  chemically synthesized
tttgatatgaactcttcaagca

SEQ ID NO: 1178785 - DNA, 22 bp, Artificial Sequence
  chemically synthesized
ttttgatatgaactcttcaagc

SEQ ID NO: 1178786 - DNA, 22 bp, Artificial Sequence
  chemically synthesized
tttttgatatgaactcttcaag

SEQ ID NO: 1178787 - DNA, 22 bp, Artificial Sequence
  chemically synthesized
aattttttatgcttgaagagtt

SEQ ID NO: 1178788 - DNA, 22 bp, Artificial Sequence
  chemically synthesized
attttttatgcttgaagagttc

SEQ ID NO: 1178789 - DNA, 22 bp, Artificial Sequence
  chemically synthesized
ttttttttgatatgaactcttc

SEQ ID NO: 1178790 - DNA, 22 bp, Artificial Sequence
  chemically synthesized
gttttttttgatatgaactctt

SEQ ID NO: 1178791 - DNA, 22 bp, Artificial Sequence
  chemically synthesized
tttatgcttgaagagttcatat

SEQ ID NO: 1178792 - DNA, 22 bp, Artificial Sequence
  chemically synthesized
ttatgcttgaagagttcatatc

SEQ ID NO: 1178793 - DNA, 22 bp, Artificial Sequence
  chemically synthesized
tatgcttgaagagttcatatca

SEQ ID NO: 1178794 - DNA, 22 bp, Artificial Sequence
  chemically synthesized
atgcttgaagagttcatatcaa

SEQ ID NO: 1178795 - DNA, 22 bp, Artificial Sequence
  chemically synthesized
tgcttgaagagttcatatcaaa

SEQ ID NO: 1178796 - DNA, 22 bp, Artificial Sequence
  chemically synthesized
aaaatttgttttttttgatatg

SEQ ID NO: 1178797 - DNA, 22 bp, Artificial Sequence
  chemically synthesized
tcaaaatttgttttttttgata

SEQ ID NO: 1178798 - DNA, 22 bp, Artificial Sequence
  chemically synthesized
gaagagttcatatcaaaaaaaa

SEQ ID NO: 1178799 - DNA, 22 bp, Artificial Sequence
  chemically synthesized
aagagttcatatcaaaaaaaac

SEQ ID NO: 1178800 - DNA, 22 bp, Artificial Sequence
  chemically synthesized
atatcaaaaaaaacaaattttg

SEQ ID NO: 1178801 - DNA, 22 bp, Artificial Sequence
  chemically synthesized
tgaaataaaaacatggccatgc

SEQ ID NO: 1178802 - DNA, 22 bp, Artificial Sequence
  chemically synthesized
tgagagcatggccatgttttta

SEQ ID NO: 1178803 - DNA, 22 bp, Artificial Sequence
  chemically synthesized
gagagcatggccatgtttttat

SEQ ID NO: 1178804 - DNA, 22 bp, Artificial Sequence
  chemically synthesized
agagcatggccatgtttttatt

SEQ ID NO: 1178805 - DNA, 22 bp, Artificial Sequence
  chemically synthesized
aggacaaaatgaactatgaaat

SEQ ID NO: 1178806 - DNA, 22 bp, Artificial Sequence
  chemically synthesized
ttatttcatagttcattttgtc

SEQ ID NO: 1178807 - DNA, 22 bp, Artificial Sequence
  chemically synthesized
tatttcatagttcattttgtcc

SEQ ID NO: 1178808 - DNA, 22 bp, Artificial Sequence
  chemically synthesized
atttcatagttcattttgtcct

SEQ ID NO: 1178809 - DNA, 22 bp, Artificial Sequence
  chemically synthesized
tttcatagttcattttgtcctt

SEQ ID NO: 1178810 - DNA, 22 bp, Artificial Sequence
  chemically synthesized
tcagaaacatctaaggacaaaa

SEQ ID NO: 1178811 - DNA, 22 bp, Artificial Sequence
  chemically synthesized
catagttcattttgtccttaga

SEQ ID NO: 1178812 - DNA, 22 bp, Artificial Sequence
  chemically synthesized
atagttcattttgtccttagat

SEQ ID NO: 1178813 - DNA, 22 bp, Artificial Sequence
  chemically synthesized
tgttgtcagaaacatctaagga

SEQ ID NO: 1178814 - DNA, 22 bp, Artificial Sequence
  chemically synthesized
atgttgtcagaaacatctaagg

SEQ ID NO: 1178815 - DNA, 22 bp, Artificial Sequence
  chemically synthesized
attttgtccttagatgtttctg

SEQ ID NO: 1178816 - DNA, 22 bp, Artificial Sequence
  chemically synthesized
aatttatgttgtcagaaacatc

SEQ ID NO: 1178817 - DNA, 22 bp, Artificial Sequence
  chemically synthesized
ctaaatttatgttgtcagaaac

SEQ ID NO: 1178818 - DNA, 22 bp, Artificial Sequence
  chemically synthesized
tgtccttagatgtttctgacaa

SEQ ID NO: 1178819 - DNA, 22 bp, Artificial Sequence
  chemically synthesized
gtccttagatgtttctgacaac

SEQ ID NO: 1178820 - DNA, 22 bp, Artificial Sequence
  chemically synthesized
tccttagatgtttctgacaaca

SEQ ID NO: 1178821 - DNA, 22 bp, Artificial Sequence
  chemically synthesized
cactgctaaatttatgttgtca

SEQ ID NO: 1178822 - DNA, 22 bp, Artificial Sequence
  chemically synthesized
agatgtttctgacaacataaat

SEQ ID NO: 1178823 - DNA, 22 bp, Artificial Sequence
  chemically synthesized
ctacactgctaaatttatgttg

SEQ ID NO: 1178824 - DNA, 22 bp, Artificial Sequence
  chemically synthesized
gatgtttctgacaacataaatt

SEQ ID NO: 1178825 - DNA, 22 bp, Artificial Sequence
  chemically synthesized
ataactgctacactgctaaatt

SEQ ID NO: 1178826 - DNA, 22 bp, Artificial Sequence
  chemically synthesized
ctgacaacataaatttagcagt

SEQ ID NO: 1178827 - DNA, 22 bp, Artificial Sequence
  chemically synthesized
tgacaacataaatttagcagtg

SEQ ID NO: 1178828 - DNA, 22 bp, Artificial Sequence
  chemically synthesized
acaacataaatttagcagtgta

SEQ ID NO: 1178829 - DNA, 22 bp, Artificial Sequence
  chemically synthesized
agcagtgtagcagttattaaca

SEQ ID NO: 1178830 - DNA, 22 bp, Artificial Sequence
  chemically synthesized
gcagtgtagcagttattaacac

SEQ ID NO: 1178831 - DNA, 22 bp, Artificial Sequence
  chemically synthesized
gaaataaatatgaatggtgtta

SEQ ID NO: 1178832 - DNA, 22 bp, Artificial Sequence
  chemically synthesized
ttaacaccattcatatttattt

SEQ ID NO: 1178833 - DNA, 22 bp, Artificial Sequence
  chemically synthesized
acaccattcatatttatttcca

SEQ ID NO: 1178834 - DNA, 22 bp, Artificial Sequence
  chemically synthesized
aaaggtagaaagctggaaataa

SEQ ID NO: 1178835 - DNA, 22 bp, Artificial Sequence
  chemically synthesized
atatttatttccagctttctac

SEQ ID NO: 1178836 - DNA, 22 bp, Artificial Sequence
  chemically synthesized
catgtctcaaaggtagaaagct

SEQ ID NO: 1178837 - DNA, 22 bp, Artificial Sequence
  chemically synthesized
atttccagctttctacctttga

SEQ ID NO: 1178838 - DNA, 22 bp, Artificial Sequence
  chemically synthesized
gtattacatgtctcaaaggtag

SEQ ID NO: 1178839 - DNA, 22 bp, Artificial Sequence
  chemically synthesized
tttccagctttctacctttgag

SEQ ID NO: 1178840 - DNA, 22 bp, Artificial Sequence
  chemically synthesized
ccagctttctacctttgagaca

SEQ ID NO: 1178841 - DNA, 22 bp, Artificial Sequence
  chemically synthesized
cagctttctacctttgagacat

SEQ ID NO: 1178842 - DNA, 22 bp, Artificial Sequence
  chemically synthesized
tctacctttgagacatgtaata

SEQ ID NO: 1178843 - DNA, 22 bp, Artificial Sequence
  chemically synthesized
ctacctttgagacatgtaatac

SEQ ID NO: 1178844 - DNA, 22 bp, Artificial Sequence
  chemically synthesized
agaaatatattcgtattacatg

SEQ ID NO: 1178845 - DNA, 22 bp, Artificial Sequence
  chemically synthesized
tacctttgagacatgtaatacg

SEQ ID NO: 1178846 - DNA, 22 bp, Artificial Sequence
  chemically synthesized
cctttgagacatgtaatacgaa

SEQ ID NO: 1178847 - DNA, 22 bp, Artificial Sequence
  chemically synthesized
gaactaagaaatatattcgtat

SEQ ID NO: 1178848 - DNA, 22 bp, Artificial Sequence
  chemically synthesized
tgagacatgtaatacgaatata

SEQ ID NO: 1178849 - DNA, 22 bp, Artificial Sequence
  chemically synthesized
agaactaagaaatatattcgta

SEQ ID NO: 1178850 - DNA, 22 bp, Artificial Sequence
  chemically synthesized
gagacatgtaatacgaatatat

SEQ ID NO: 1178851 - DNA, 22 bp, Artificial Sequence
  chemically synthesized
agacatgtaatacgaatatatt

SEQ ID NO: 1178852 - DNA, 22 bp, Artificial Sequence
  chemically synthesized
acccaacttagaactaagaaat

SEQ ID NO: 1178853 - DNA, 22 bp, Artificial Sequence
  chemically synthesized
catggtctcacccaacttagaa

SEQ ID NO: 1178854 - DNA, 22 bp, Artificial Sequence
  chemically synthesized
gttacatggtctcacccaactt

SEQ ID NO: 1178855 - DNA, 22 bp, Artificial Sequence
  chemically synthesized
cttagttctaagttgggtgaga

SEQ ID NO: 1178856 - DNA, 22 bp, Artificial Sequence
  chemically synthesized
ttagttctaagttgggtgagac

SEQ ID NO: 1178857 - DNA, 22 bp, Artificial Sequence
  chemically synthesized
agttctaagttgggtgagacca

SEQ ID NO: 1178858 - DNA, 22 bp, Artificial Sequence
  chemically synthesized
gttctaagttgggtgagaccat

SEQ ID NO: 1178859 - DNA, 22 bp, Artificial Sequence
  chemically synthesized
taagttgggtgagaccatgtaa

SEQ ID NO: 1178860 - DNA, 22 bp, Artificial Sequence
  chemically synthesized
agttgggtgagaccatgtaact

SEQ ID NO: 1178861 - DNA, 22 bp, Artificial Sequence
  chemically synthesized
acgagcacaactagttacatgg

SEQ ID NO: 1178862 - DNA, 22 bp, Artificial Sequence
  chemically synthesized
ggtgagaccatgtaactagttg

SEQ ID NO: 1178863 - DNA, 22 bp, Artificial Sequence
  chemically synthesized
acaactcacgagcacaactagt

SEQ ID NO: 1178864 - DNA, 22 bp, Artificial Sequence
  chemically synthesized
agttcacaactcacgagcacaa

SEQ ID NO: 1178865 - DNA, 22 bp, Artificial Sequence
  chemically synthesized
cagttcacaactcacgagcaca

SEQ ID NO: 1178866 - DNA, 22 bp, Artificial Sequence
  chemically synthesized
cttcagttcacaactcacgagc

SEQ ID NO: 1178867 - DNA, 22 bp, Artificial Sequence
  chemically synthesized
gttgtgctcgtgagttgtgaac

SEQ ID NO: 1178868 - DNA, 22 bp, Artificial Sequence
  chemically synthesized
tgctcgtgagttgtgaactgaa

SEQ ID NO: 1178869 - DNA, 22 bp, Artificial Sequence
  chemically synthesized
gaagtgacatatctgcttcagt

SEQ ID NO: 1178870 - DNA, 22 bp, Artificial Sequence
  chemically synthesized
gtgagttgtgaactgaagcaga

SEQ ID NO: 1178871 - DNA, 22 bp, Artificial Sequence
  chemically synthesized
aactggaagtgacatatctgct

SEQ ID NO: 1178872 - DNA, 22 bp, Artificial Sequence
  chemically synthesized
gaactggaagtgacatatctgc

SEQ ID NO: 1178873 - DNA, 22 bp, Artificial Sequence
  chemically synthesized
tgaactgaagcagatatgtcac

SEQ ID NO: 1178874 - DNA, 22 bp, Artificial Sequence
  chemically synthesized
cttgaactggaagtgacatatc

SEQ ID NO: 1178875 - DNA, 22 bp, Artificial Sequence
  chemically synthesized
attgcttgaactggaagtgaca

SEQ ID NO: 1178876 - DNA, 22 bp, Artificial Sequence
  chemically synthesized
aagcagatatgtcacttccagt

SEQ ID NO: 1178877 - DNA, 22 bp, Artificial Sequence
  chemically synthesized
gcaattaattgcttgaactgga

SEQ ID NO: 1178878 - DNA, 22 bp, Artificial Sequence
  chemically synthesized
tgctggcaattaattgcttgaa

SEQ ID NO: 1178879 - DNA, 22 bp, Artificial Sequence
  chemically synthesized
gtgctggcaattaattgcttga

SEQ ID NO: 1178880 - DNA, 22 bp, Artificial Sequence
  chemically synthesized
ccagttcaagcaattaattgcc

SEQ ID NO: 1178881 - DNA, 22 bp, Artificial Sequence
  chemically synthesized
cagttcaagcaattaattgcca

SEQ ID NO: 1178882 - DNA, 22 bp, Artificial Sequence
  chemically synthesized
aaaggtcttgtgctggcaatta

SEQ ID NO: 1178883 - DNA, 22 bp, Artificial Sequence
  chemically synthesized
tgaaaggtcttgtgctggcaat

SEQ ID NO: 1178884 - DNA, 22 bp, Artificial Sequence
  chemically synthesized
aagcaattaattgccagcacaa

SEQ ID NO: 1178885 - DNA, 22 bp, Artificial Sequence
  chemically synthesized
attgccagcacaagacctttca

SEQ ID NO: 1178886 - DNA, 22 bp, Artificial Sequence
  chemically synthesized
ccagcacaagacctttcagaat

SEQ ID NO: 1178887 - DNA, 22 bp, Artificial Sequence
  chemically synthesized
cgcaaagggaaagaaaattctg

SEQ ID NO: 1178888 - DNA, 22 bp, Artificial Sequence
  chemically synthesized
ccagtcactccgcaaagggaaa

SEQ ID NO: 1178889 - DNA, 22 bp, Artificial Sequence
  chemically synthesized
tcagaattttctttccctttgc

SEQ ID NO: 1178890 - DNA, 22 bp, Artificial Sequence
  chemically synthesized
cagaattttctttccctttgcg

SEQ ID NO: 1178891 - DNA, 22 bp, Artificial Sequence
  chemically synthesized
agaattttctttccctttgcgg

SEQ ID NO: 1178892 - DNA, 22 bp, Artificial Sequence
  chemically synthesized
ggatactcccagtcactccgca

SEQ ID NO: 1178893 - DNA, 22 bp, Artificial Sequence
  chemically synthesized
tctttccctttgcggagtgact

SEQ ID NO: 1178894 - DNA, 22 bp, Artificial Sequence
  chemically synthesized
ctttccctttgcggagtgactg

SEQ ID NO: 1178895 - DNA, 22 bp, Artificial Sequence
  chemically synthesized
tttccctttgcggagtgactgg

SEQ ID NO: 1178896 - DNA, 22 bp, Artificial Sequence
  chemically synthesized
tctaggatactcccagtcactc

SEQ ID NO: 1178897 - DNA, 22 bp, Artificial Sequence
  chemically synthesized
tccctttgcggagtgactggga

SEQ ID NO: 1178898 - DNA, 22 bp, Artificial Sequence
  chemically synthesized
ccctttgcggagtgactgggag

SEQ ID NO: 1178899 - DNA, 22 bp, Artificial Sequence
  chemically synthesized
ctatctaggatactcccagtca

SEQ ID NO: 1178900 - DNA, 22 bp, Artificial Sequence
  chemically synthesized
cctttgcggagtgactgggagt

SEQ ID NO: 1178901 - DNA, 22 bp, Artificial Sequence
  chemically synthesized
tgcggagtgactgggagtatcc

SEQ ID NO: 1178902 - DNA, 22 bp, Artificial Sequence
  chemically synthesized
gcggagtgactgggagtatcct

SEQ ID NO: 1178903 - DNA, 22 bp, Artificial Sequence
  chemically synthesized
cggagtgactgggagtatccta

SEQ ID NO: 1178904 - DNA, 22 bp, Artificial Sequence
  chemically synthesized
atgaaacagctactatctagga

SEQ ID NO: 1178905 - DNA, 22 bp, Artificial Sequence
  chemically synthesized
ggagtatcctagatagtagctg

SEQ ID NO: 1178906 - DNA, 22 bp, Artificial Sequence
  chemically synthesized
gaaacccagcctgatgaaacag

SEQ ID NO: 1178907 - DNA, 22 bp, Artificial Sequence
  chemically synthesized
ggaaacccagcctgatgaaaca

SEQ ID NO: 1178908 - DNA, 22 bp, Artificial Sequence
  chemically synthesized
gatagtagctgtttcatcaggc

SEQ ID NO: 1178909 - DNA, 22 bp, Artificial Sequence
  chemically synthesized
tggtcatttggaaacccagcct

SEQ ID NO: 1178910 - DNA, 22 bp, Artificial Sequence
  chemically synthesized
attgtggtcatttggaaaccca

SEQ ID NO: 1178911 - DNA, 22 bp, Artificial Sequence
  chemically synthesized
tttcatcaggctgggtttccaa

SEQ ID NO: 1178912 - DNA, 22 bp, Artificial Sequence
  chemically synthesized
ttcattgtggtcatttggaaac

SEQ ID NO: 1178913 - DNA, 22 bp, Artificial Sequence
  chemically synthesized
catcaggctgggtttccaaatg

SEQ ID NO: 1178914 - DNA, 22 bp, Artificial Sequence
  chemically synthesized
atcaggctgggtttccaaatga

SEQ ID NO: 1178915 - DNA, 22 bp, Artificial Sequence
  chemically synthesized
ggtttccaaatgaccacaatga

SEQ ID NO: 1178916 - DNA, 22 bp, Artificial Sequence
  chemically synthesized
ccaaatgaccacaatgaatagc

SEQ ID NO: 1178917 - DNA, 22 bp, Artificial Sequence
  chemically synthesized
caaatgaccacaatgaatagcg

SEQ ID NO: 1178918 - DNA, 22 bp, Artificial Sequence
  chemically synthesized
tgaatcagcaagggaacgctat

SEQ ID NO: 1178919 - DNA, 22 bp, Artificial Sequence
  chemically synthesized
caatgtgcactgtgaatcagca

SEQ ID NO: 1178920 - DNA, 22 bp, Artificial Sequence
  chemically synthesized
attccaatgtgcactgtgaatc

SEQ ID NO: 1178921 - DNA, 22 bp, Artificial Sequence
  chemically synthesized
cattccaatgtgcactgtgaat

SEQ ID NO: 1178922 - DNA, 22 bp, Artificial Sequence
  chemically synthesized
tcattccaatgtgcactgtgaa

SEQ ID NO: 1178923 - DNA, 22 bp, Artificial Sequence
  chemically synthesized
ttcattccaatgtgcactgtga

SEQ ID NO: 1178924 - DNA, 22 bp, Artificial Sequence
  chemically synthesized
tttcattccaatgtgcactgtg

SEQ ID NO: 1178925 - DNA, 22 bp, Artificial Sequence
  chemically synthesized
ccttgctgattcacagtgcaca

SEQ ID NO: 1178926 - DNA, 22 bp, Artificial Sequence
  chemically synthesized
gctgattcacagtgcacattgg

SEQ ID NO: 1178927 - DNA, 22 bp, Artificial Sequence
  chemically synthesized
ctgattcacagtgcacattgga

SEQ ID NO: 1178928 - DNA, 22 bp, Artificial Sequence
  chemically synthesized
attcacagtgcacattggaatg

SEQ ID NO: 1178929 - DNA, 22 bp, Artificial Sequence
  chemically synthesized
taataactttttcattccaatg

SEQ ID NO: 1178930 - DNA, 22 bp, Artificial Sequence
  chemically synthesized
acagtgcacattggaatgaaaa

SEQ ID NO: 1178931 - DNA, 22 bp, Artificial Sequence
  chemically synthesized
tgttataataactttttcattc

SEQ ID NO: 1178932 - DNA, 22 bp, Artificial Sequence
  chemically synthesized
actatgttataataactttttc

SEQ ID NO: 1178933 - DNA, 22 bp, Artificial Sequence
  chemically synthesized
cactatgttataataacttttt

SEQ ID NO: 1178934 - DNA, 22 bp, Artificial Sequence
  chemically synthesized
aatttcactatgttataataac

SEQ ID NO: 1178935 - DNA, 22 bp, Artificial Sequence
  chemically synthesized
gaatgaaaaagttattataaca

SEQ ID NO: 1178936 - DNA, 22 bp, Artificial Sequence
  chemically synthesized
ttaaatttcactatgttataat

SEQ ID NO: 1178937 - DNA, 22 bp, Artificial Sequence
  chemically synthesized
gttattaaatttcactatgtta

SEQ ID NO: 1178938 - DNA, 22 bp, Artificial Sequence
  chemically synthesized
gatctggttattaaatttcact

SEQ ID NO: 1178939 - DNA, 22 bp, Artificial Sequence
  chemically synthesized
tagatctggttattaaatttca

SEQ ID NO: 1178940 - DNA, 22 bp, Artificial Sequence
  chemically synthesized
ttataacatagtgaaatttaat

SEQ ID NO: 1178941 - DNA, 22 bp, Artificial Sequence
  chemically synthesized
taacatagtgaaatttaataac

SEQ ID NO: 1178942 - DNA, 22 bp, Artificial Sequence
  chemically synthesized
aaccagtcattctagatctggt

SEQ ID NO: 1178943 - DNA, 22 bp, Artificial Sequence
  chemically synthesized
aataaccagatctagaatgact

SEQ ID NO: 1178944 - DNA, 22 bp, Artificial Sequence
  chemically synthesized
ataaccagatctagaatgactg

SEQ ID NO: 1178945 - DNA, 22 bp, Artificial Sequence
  chemically synthesized
agtgccatctaaaccagtcatt

SEQ ID NO: 1178946 - DNA, 22 bp, Artificial Sequence
  chemically synthesized
ttaagtgccatctaaaccagtc

SEQ ID NO: 1178947 - DNA, 22 bp, Artificial Sequence
  chemically synthesized
attaagtgccatctaaaccagt

SEQ ID NO: 1178948 - DNA, 22 bp, Artificial Sequence
  chemically synthesized
atgtttattaagtgccatctaa

SEQ ID NO: 1178949 - DNA, 22 bp, Artificial Sequence
  chemically synthesized
gaatgactggtttagatggcac

SEQ ID NO: 1178950 - DNA, 22 bp, Artificial Sequence
  chemically synthesized
aatgtttattaagtgccatcta

SEQ ID NO: 1178951 - DNA, 22 bp, Artificial Sequence
  chemically synthesized
gtcacttaatgtttattaagtg

SEQ ID NO: 1178952 - DNA, 22 bp, Artificial Sequence
  chemically synthesized
gtttagatggcacttaataaac

SEQ ID NO: 1178953 - DNA, 22 bp, Artificial Sequence
  chemically synthesized
ctagtcacttaatgtttattaa

SEQ ID NO: 1178954 - DNA, 22 bp, Artificial Sequence
  chemically synthesized
agatggcacttaataaacatta

SEQ ID NO: 1178955 - DNA, 22 bp, Artificial Sequence
  chemically synthesized
gatggcacttaataaacattaa

SEQ ID NO: 1178956 - DNA, 22 bp, Artificial Sequence
  chemically synthesized
gaatgtgttactagtcacttaa

SEQ ID NO: 1178957 - DNA, 22 bp, Artificial Sequence
  chemically synthesized
ttagaatgtgttactagtcact

SEQ ID NO: 1178958 - DNA, 22 bp, Artificial Sequence
  chemically synthesized
aataaacattaagtgactagta

SEQ ID NO: 1178959 - DNA, 22 bp, Artificial Sequence
  chemically synthesized
ataaacattaagtgactagtaa

SEQ ID NO: 1178960 - DNA, 22 bp, Artificial Sequence
  chemically synthesized
ctgttagaatgtgttactagtc

SEQ ID NO: 1178961 - DNA, 22 bp, Artificial Sequence
  chemically synthesized
aagactgctgttagaatgtgtt

SEQ ID NO: 1178962 - DNA, 22 bp, Artificial Sequence
  chemically synthesized
agtgactagtaacacattctaa

SEQ ID NO: 1178963 - DNA, 22 bp, Artificial Sequence
  chemically synthesized
gtaacacattctaacagcagtc

SEQ ID NO: 1178964 - DNA, 22 bp, Artificial Sequence
  chemically synthesized
taacagcagtctttaacctgca

SEQ ID NO: 1178965 - DNA, 22 bp, Artificial Sequence
  chemically synthesized
atgtatcacaatatgcaggtta

SEQ ID NO: 1178966 - DNA, 22 bp, Artificial Sequence
  chemically synthesized
acagcagtctttaacctgcata

SEQ ID NO: 1178967 - DNA, 22 bp, Artificial Sequence
  chemically synthesized
ctaatgtatcacaatatgcagg

SEQ ID NO: 1178968 - DNA, 22 bp, Artificial Sequence
  chemically synthesized
actaatgtatcacaatatgcag

SEQ ID NO: 1178969 - DNA, 22 bp, Artificial Sequence
  chemically synthesized
gagatttactaatgtatcacaa

SEQ ID NO: 1178970 - DNA, 22 bp, Artificial Sequence
  chemically synthesized
taacctgcatattgtgatacat

SEQ ID NO: 1178971 - DNA, 22 bp, Artificial Sequence
  chemically synthesized
ggagatttactaatgtatcaca

SEQ ID NO: 1178972 - DNA, 22 bp, Artificial Sequence
  chemically synthesized
aacctgcatattgtgatacatt

SEQ ID NO: 1178973 - DNA, 22 bp, Artificial Sequence
  chemically synthesized
acctgcatattgtgatacatta

SEQ ID NO: 1178974 - DNA, 22 bp, Artificial Sequence
  chemically synthesized
tggtttggagatttactaatgt

SEQ ID NO: 1178975 - DNA, 22 bp, Artificial Sequence
  chemically synthesized
catattgtgatacattagtaaa

SEQ ID NO: 1178976 - DNA, 22 bp, Artificial Sequence
  chemically synthesized
tgatacattagtaaatctccaa

SEQ ID NO: 1178977 - DNA, 22 bp, Artificial Sequence
  chemically synthesized
ccatgataacccaattgtggtt

SEQ ID NO: 1178978 - DNA, 22 bp, Artificial Sequence
  chemically synthesized
gtaaatctccaaaccacaattg

SEQ ID NO: 1178979 - DNA, 22 bp, Artificial Sequence
  chemically synthesized
accatgataacccaattgtggt

SEQ ID NO: 1178980 - DNA, 22 bp, Artificial Sequence
  chemically synthesized
taccatgataacccaattgtgg

SEQ ID NO: 1178981 - DNA, 22 bp, Artificial Sequence
  chemically synthesized
tttaccatgataacccaattgt

SEQ ID NO: 1178982 - DNA, 22 bp, Artificial Sequence
  chemically synthesized
caaaccacaattgggttatcat

SEQ ID NO: 1178983 - DNA, 22 bp, Artificial Sequence
  chemically synthesized
ccataaagctctttaccatgat

SEQ ID NO: 1178984 - DNA, 22 bp, Artificial Sequence
  chemically synthesized
gaaactaccataaagctcttta

SEQ ID NO: 1178985 - DNA, 22 bp, Artificial Sequence
  chemically synthesized
ggttatcatggtaaagagcttt

SEQ ID NO: 1178986 - DNA, 22 bp, Artificial Sequence
  chemically synthesized
tcatggtaaagagctttatggt

SEQ ID NO: 1178987 - DNA, 22 bp, Artificial Sequence
  chemically synthesized
gtatgtcctagaaactaccata

SEQ ID NO: 1178988 - DNA, 22 bp, Artificial Sequence
  chemically synthesized
agtaattagtatgtcctagaaa

SEQ ID NO: 1178989 - DNA, 22 bp, Artificial Sequence
  chemically synthesized
ttgagtaattagtatgtcctag

SEQ ID NO: 1178990 - DNA, 22 bp, Artificial Sequence
  chemically synthesized
tatggtagtttctaggacatac

SEQ ID NO: 1178991 - DNA, 22 bp, Artificial Sequence
  chemically synthesized
atggtagtttctaggacatact

SEQ ID NO: 1178992 - DNA, 22 bp, Artificial Sequence
  chemically synthesized
tggtagtttctaggacatacta

SEQ ID NO: 1178993 - DNA, 22 bp, Artificial Sequence
  chemically synthesized
ctaggacatactaattactcaa

SEQ ID NO: 1178994 - DNA, 22 bp, Artificial Sequence
  chemically synthesized
aatagaaaattattgagtaatt

SEQ ID NO: 1178995 - DNA, 22 bp, Artificial Sequence
  chemically synthesized
taggacatactaattactcaat

SEQ ID NO: 1178996 - DNA, 22 bp, Artificial Sequence
  chemically synthesized
caatagaaaattattgagtaat

SEQ ID NO: 1178997 - DNA, 22 bp, Artificial Sequence
  chemically synthesized
tcaatagaaaattattgagtaa

SEQ ID NO: 1178998 - DNA, 22 bp, Artificial Sequence
  chemically synthesized
ggacatactaattactcaataa

SEQ ID NO: 1178999 - DNA, 22 bp, Artificial Sequence
  chemically synthesized
tttcaatagaaaattattgagt

SEQ ID NO: 1179000 - DNA, 22 bp, Artificial Sequence
  chemically synthesized
ctttcaatagaaaattattgag

SEQ ID NO: 1179001 - DNA, 22 bp, Artificial Sequence
  chemically synthesized
cttctttcaatagaaaattatt

SEQ ID NO: 1179002 - DNA, 22 bp, Artificial Sequence
  chemically synthesized
attactcaataattttctattg

SEQ ID NO: 1179003 - DNA, 22 bp, Artificial Sequence
  chemically synthesized
ctcaataattttctattgaaag

SEQ ID NO: 1179004 - DNA, 22 bp, Artificial Sequence
  chemically synthesized
aataattttctattgaaagaag

SEQ ID NO: 1179005 - DNA, 22 bp, Artificial Sequence
  chemically synthesized
aggaatcgccactccttctttc

SEQ ID NO: 1179006 - DNA, 22 bp, Artificial Sequence
  chemically synthesized
tctattgaaagaaggagtggcg

SEQ ID NO: 1179007 - DNA, 22 bp, Artificial Sequence
  chemically synthesized
ctattgaaagaaggagtggcga

SEQ ID NO: 1179008 - DNA, 22 bp, Artificial Sequence
  chemically synthesized
tattgaaagaaggagtggcgat

SEQ ID NO: 1179009 - DNA, 22 bp, Artificial Sequence
  chemically synthesized
gatccctgaggaatcgccactc

SEQ ID NO: 1179010 - DNA, 22 bp, Artificial Sequence
  chemically synthesized
ttgaaagaaggagtggcgattc

SEQ ID NO: 1179011 - DNA, 22 bp, Artificial Sequence
  chemically synthesized
tagatccctgaggaatcgccac

SEQ ID NO: 1179012 - DNA, 22 bp, Artificial Sequence
  chemically synthesized
aaagaaggagtggcgattcctc

SEQ ID NO: 1179013 - DNA, 22 bp, Artificial Sequence
  chemically synthesized
gttctagatccctgaggaatcg

SEQ ID NO: 1179014 - DNA, 22 bp, Artificial Sequence
  chemically synthesized
tagttctagatccctgaggaat

SEQ ID NO: 1179015 - DNA, 22 bp, Artificial Sequence
  chemically synthesized
ctagttctagatccctgaggaa

SEQ ID NO: 1179016 - DNA, 22 bp, Artificial Sequence
  chemically synthesized
ctcagggatctagaactagaaa

SEQ ID NO: 1179017 - DNA, 22 bp, Artificial Sequence
  chemically synthesized
ggtcaagtggtatttctagttc

SEQ ID NO: 1179018 - DNA, 22 bp, Artificial Sequence
  chemically synthesized
agggatctagaactagaaatac

SEQ ID NO: 1179019 - DNA, 22 bp, Artificial Sequence
  chemically synthesized
gaactagaaataccacttgacc

SEQ ID NO: 1179020 - DNA, 22 bp, Artificial Sequence
  chemically synthesized
gaaataccacttgacccagcca

SEQ ID NO: 1179021 - DNA, 22 bp, Artificial Sequence
  chemically synthesized
ggtatatacccagtaatgtgat

SEQ ID NO: 1179022 - DNA, 22 bp, Artificial Sequence
  chemically synthesized
gggtatatacccagtaatgtga

SEQ ID NO: 1179023 - DNA, 22 bp, Artificial Sequence
  chemically synthesized
tgggtatatacccagtaatgtg

SEQ ID NO: 1179024 - DNA, 22 bp, Artificial Sequence
  chemically synthesized
gacccagccatcacattactgg

SEQ ID NO: 1179025 - DNA, 22 bp, Artificial Sequence
  chemically synthesized
acccagccatcacattactggg

SEQ ID NO: 1179026 - DNA, 22 bp, Artificial Sequence
  chemically synthesized
taatcctttgggtatataccca

SEQ ID NO: 1179027 - DNA, 22 bp, Artificial Sequence
  chemically synthesized
ataatcctttgggtatataccc

SEQ ID NO: 1179028 - DNA, 22 bp, Artificial Sequence
  chemically synthesized
ctgggtatatacccaaaggatt

SEQ ID NO: 1179029 - DNA, 22 bp, Artificial Sequence
  chemically synthesized
ggtatatacccaaaggattata

SEQ ID NO: 1179030 - DNA, 22 bp, Artificial Sequence
  chemically synthesized
tagcagcatgatttataatcct

SEQ ID NO: 1179031 - DNA, 22 bp, Artificial Sequence
  chemically synthesized
atagcagcatgatttataatcc

SEQ ID NO: 1179032 - DNA, 22 bp, Artificial Sequence
  chemically synthesized
tatagcagcatgatttataatc

SEQ ID NO: 1179033 - DNA, 22 bp, Artificial Sequence
  chemically synthesized
taaatcatgctgctataaagat

SEQ ID NO: 1179034 - DNA, 22 bp, Artificial Sequence
  chemically synthesized
ctataaagatacatgtacacgt

SEQ ID NO: 1179035 - DNA, 22 bp, Artificial Sequence
  chemically synthesized
taaagatacatgtacacgtatg

SEQ ID NO: 1179036 - DNA, 22 bp, Artificial Sequence
  chemically synthesized
tgagtagtgccacaataagcat

SEQ ID NO: 1179037 - DNA, 22 bp, Artificial Sequence
  chemically synthesized
ttgtgagtagtgccacaataag

SEQ ID NO: 1179038 - DNA, 22 bp, Artificial Sequence
  chemically synthesized
ctattgtgagtagtgccacaat

SEQ ID NO: 1179039 - DNA, 22 bp, Artificial Sequence
  chemically synthesized
gctattgtgagtagtgccacaa

SEQ ID NO: 1179040 - DNA, 22 bp, Artificial Sequence
  chemically synthesized
tgctattgtgagtagtgccaca

SEQ ID NO: 1179041 - DNA, 22 bp, Artificial Sequence
  chemically synthesized
caagtctttgctattgtgagta

SEQ ID NO: 1179042 - DNA, 22 bp, Artificial Sequence
  chemically synthesized
attgtggcactactcacaatag

SEQ ID NO: 1179043 - DNA, 22 bp, Artificial Sequence
  chemically synthesized
ttgtggcactactcacaatagc

SEQ ID NO: 1179044 - DNA, 22 bp, Artificial Sequence
  chemically synthesized
attccaagtctttgctattgtg

SEQ ID NO: 1179045 - DNA, 22 bp, Artificial Sequence
  chemically synthesized
tggcactactcacaatagcaaa

SEQ ID NO: 1179046 - DNA, 22 bp, Artificial Sequence
  chemically synthesized
ggttgattccaagtctttgcta

SEQ ID NO: 1179047 - DNA, 22 bp, Artificial Sequence
  chemically synthesized
gggttgattccaagtctttgct

SEQ ID NO: 1179048 - DNA, 22 bp, Artificial Sequence
  chemically synthesized
ctcacaatagcaaagacttgga

SEQ ID NO: 1179049 - DNA, 22 bp, Artificial Sequence
  chemically synthesized
acaatagcaaagacttggaatc

SEQ ID NO: 1179050 - DNA, 22 bp, Artificial Sequence
  chemically synthesized
gacatttgggttgattccaagt

SEQ ID NO: 1179051 - DNA, 22 bp, Artificial Sequence
  chemically synthesized
ttggacatttgggttgattcca

SEQ ID NO: 1179052 - DNA, 22 bp, Artificial Sequence
  chemically synthesized
tcattgttggacatttgggttg

SEQ ID NO: 1179053 - DNA, 22 bp, Artificial Sequence
  chemically synthesized
ggaatcaacccaaatgtccaac

SEQ ID NO: 1179054 - DNA, 22 bp, Artificial Sequence
  chemically synthesized
gaatcaacccaaatgtccaaca

SEQ ID NO: 1179055 - DNA, 22 bp, Artificial Sequence
  chemically synthesized
atccagtctatcattgttggac

SEQ ID NO: 1179056 - DNA, 22 bp, Artificial Sequence
  chemically synthesized
aatccagtctatcattgttgga

SEQ ID NO: 1179057 - DNA, 22 bp, Artificial Sequence
  chemically synthesized
ttaatccagtctatcattgttg

SEQ ID NO: 1179058 - DNA, 22 bp, Artificial Sequence
  chemically synthesized
cttaatccagtctatcattgtt

SEQ ID NO: 1179059 - DNA, 22 bp, Artificial Sequence
  chemically synthesized
tcttaatccagtctatcattgt

SEQ ID NO: 1179060 - DNA, 22 bp, Artificial Sequence
  chemically synthesized
catggtgtatatgtggcacatt

SEQ ID NO: 1179061 - DNA, 22 bp, Artificial Sequence
  chemically synthesized
gattaagaaaatgtgccacata

SEQ ID NO: 1179062 - DNA, 22 bp, Artificial Sequence
  chemically synthesized
agaaaatgtgccacatatacac

SEQ ID NO: 1179063 - DNA, 22 bp, Artificial Sequence
  chemically synthesized
catagtattccatggtgtatat

SEQ ID NO: 1179064 - DNA, 22 bp, Artificial Sequence
  chemically synthesized
tggctgcatagtattccatggt

SEQ ID NO: 1179065 - DNA, 22 bp, Artificial Sequence
  chemically synthesized
atggctgcatagtattccatgg

SEQ ID NO: 1179066 - DNA, 22 bp, Artificial Sequence
  chemically synthesized
tatggctgcatagtattccatg

SEQ ID NO: 1179067 - DNA, 22 bp, Artificial Sequence
  chemically synthesized
ttatggctgcatagtattccat

SEQ ID NO: 1179068 - DNA, 22 bp, Artificial Sequence
  chemically synthesized
tttatggctgcatagtattcca

SEQ ID NO: 1179069 - DNA, 22 bp, Artificial Sequence
  chemically synthesized
ttttatggctgcatagtattcc

SEQ ID NO: 1179070 - DNA, 22 bp, Artificial Sequence
  chemically synthesized
atccttttttatggctgcatag

SEQ ID NO: 1179071 - DNA, 22 bp, Artificial Sequence
  chemically synthesized
tgcagccataaaaaaggatgag

SEQ ID NO: 1179072 - DNA, 22 bp, Artificial Sequence
  chemically synthesized
caaaggacatgaactcatcctt

SEQ ID NO: 1179073 - DNA, 22 bp, Artificial Sequence
  chemically synthesized
atccatgtccctacaaaggaca

SEQ ID NO: 1179074 - DNA, 22 bp, Artificial Sequence
  chemically synthesized
catccatgtccctacaaaggac

SEQ ID NO: 1179075 - DNA, 22 bp, Artificial Sequence
  chemically synthesized
cagcttcatccatgtccctaca

SEQ ID NO: 1179076 - DNA, 22 bp, Artificial Sequence
  chemically synthesized
ccagcttcatccatgtccctac

SEQ ID NO: 1179077 - DNA, 22 bp, Artificial Sequence
  chemically synthesized
atgtcctttgtagggacatgga

SEQ ID NO: 1179078 - DNA, 22 bp, Artificial Sequence
  chemically synthesized
tgtagggacatggatgaagctg

SEQ ID NO: 1179079 - DNA, 22 bp, Artificial Sequence
  chemically synthesized
gtagggacatggatgaagctgg

SEQ ID NO: 1179080 - DNA, 22 bp, Artificial Sequence
  chemically synthesized
tagggacatggatgaagctgga

SEQ ID NO: 1179081 - DNA, 22 bp, Artificial Sequence
  chemically synthesized
agaatgatggtttccagcttca

SEQ ID NO: 1179082 - DNA, 22 bp, Artificial Sequence
  chemically synthesized
ctgagaatgatggtttccagct

SEQ ID NO: 1179083 - DNA, 22 bp, Artificial Sequence
  chemically synthesized
gctgagaatgatggtttccagc

SEQ ID NO: 1179084 - DNA, 22 bp, Artificial Sequence
  chemically synthesized
cgatagtttgctgagaatgatg

SEQ ID NO: 1179085 - DNA, 22 bp, Artificial Sequence
  chemically synthesized
gcgatagtttgctgagaatgat

SEQ ID NO: 1179086 - DNA, 22 bp, Artificial Sequence
  chemically synthesized
tccttgcgatagtttgctgaga

SEQ ID NO: 1179087 - DNA, 22 bp, Artificial Sequence
  chemically synthesized
gaaaccatcattctcagcaaac

SEQ ID NO: 1179088 - DNA, 22 bp, Artificial Sequence
  chemically synthesized
gtccttgcgatagtttgctgag

SEQ ID NO: 1179089 - DNA, 22 bp, Artificial Sequence
  chemically synthesized
tgtccttgcgatagtttgctga

SEQ ID NO: 1179090 - DNA, 22 bp, Artificial Sequence
  chemically synthesized
ttgtccttgcgatagtttgctg

SEQ ID NO: 1179091 - DNA, 22 bp, Artificial Sequence
  chemically synthesized
tttgtccttgcgatagtttgct

SEQ ID NO: 1179092 - DNA, 22 bp, Artificial Sequence
  chemically synthesized
gttttttgtccttgcgatagtt

SEQ ID NO: 1179093 - DNA, 22 bp, Artificial Sequence
  chemically synthesized
ggttttttgtccttgcgatagt

SEQ ID NO: 1179094 - DNA, 22 bp, Artificial Sequence
  chemically synthesized
tcagcaaactatcgcaaggaca

SEQ ID NO: 1179095 - DNA, 22 bp, Artificial Sequence
  chemically synthesized
agcaaactatcgcaaggacaaa

SEQ ID NO: 1179096 - DNA, 22 bp, Artificial Sequence
  chemically synthesized
tcgcaaggacaaaaaaccaaac

SEQ ID NO: 1179097 - DNA, 22 bp, Artificial Sequence
  chemically synthesized
tgagtgagaacatgcggtgttt

SEQ ID NO: 1179098 - DNA, 22 bp, Artificial Sequence
  chemically synthesized
ccacctatgagtgagaacatgc

SEQ ID NO: 1179099 - DNA, 22 bp, Artificial Sequence
  chemically synthesized
gattcccacctatgagtgagaa

SEQ ID NO: 1179100 - DNA, 22 bp, Artificial Sequence
  chemically synthesized
ttcgattcccacctatgagtga

SEQ ID NO: 1179101 - DNA, 22 bp, Artificial Sequence
  chemically synthesized
attgttcgattcccacctatga

SEQ ID NO: 1179102 - DNA, 22 bp, Artificial Sequence
  chemically synthesized
tcattgttcgattcccacctat

SEQ ID NO: 1179103 - DNA, 22 bp, Artificial Sequence
  chemically synthesized
tcactcataggtgggaatcgaa

SEQ ID NO: 1179104 - DNA, 22 bp, Artificial Sequence
  chemically synthesized
actcataggtgggaatcgaaca

SEQ ID NO: 1179105 - DNA, 22 bp, Artificial Sequence
  chemically synthesized
ataggtgggaatcgaacaatga

SEQ ID NO: 1179106 - DNA, 22 bp, Artificial Sequence
  chemically synthesized
tgtccatgtgttctcattgttc

SEQ ID NO: 1179107 - DNA, 22 bp, Artificial Sequence
  chemically synthesized
ctgtgtccatgtgttctcattg

SEQ ID NO: 1179108 - DNA, 22 bp, Artificial Sequence
  chemically synthesized
cctgtgtccatgtgttctcatt

SEQ ID NO: 1179109 - DNA, 22 bp, Artificial Sequence
  chemically synthesized
cccttcctgtgtccatgtgttc

SEQ ID NO: 1179110 - DNA, 22 bp, Artificial Sequence
  chemically synthesized
cgggacccagtgtgtgatgttc

SEQ ID NO: 1179111 - DNA, 22 bp, Artificial Sequence
  chemically synthesized
cccccaccccactacgggaccc

SEQ ID NO: 1179112 - DNA, 22 bp, Artificial Sequence
  chemically synthesized
cccctccccccaccccactacg

SEQ ID NO: 1179113 - DNA, 22 bp, Artificial Sequence
  chemically synthesized
ccccctccccccaccccactac

SEQ ID NO: 1179114 - DNA, 22 bp, Artificial Sequence
  chemically synthesized
ggtcccgtagtggggtgggggg

SEQ ID NO: 1179115 - DNA, 22 bp, Artificial Sequence
  chemically synthesized
tcccttccccctccccccaccc

SEQ ID NO: 1179116 - DNA, 22 bp, Artificial Sequence
  chemically synthesized
atgctatcccttccccctcccc

SEQ ID NO: 1179117 - DNA, 22 bp, Artificial Sequence
  chemically synthesized
ctaatgctatcccttccccctc

SEQ ID NO: 1179118 - DNA, 22 bp, Artificial Sequence
  chemically synthesized
ggtatatctcctaatgctatcc

SEQ ID NO: 1179119 - DNA, 22 bp, Artificial Sequence
  chemically synthesized
acattaggtatatctcctaatg

SEQ ID NO: 1179120 - DNA, 22 bp, Artificial Sequence
  chemically synthesized
aacattaggtatatctcctaat

SEQ ID NO: 1179121 - DNA, 22 bp, Artificial Sequence
  chemically synthesized
atcatttaacattaggtatatc

SEQ ID NO: 1179122 - DNA, 22 bp, Artificial Sequence
  chemically synthesized
actcatcatttaacattaggta

SEQ ID NO: 1179123 - DNA, 22 bp, Artificial Sequence
  chemically synthesized
ggagatatacctaatgttaaat

SEQ ID NO: 1179124 - DNA, 22 bp, Artificial Sequence
  chemically synthesized
cacccattaactcatcatttaa

SEQ ID NO: 1179125 - DNA, 22 bp, Artificial Sequence
  chemically synthesized
gtgtgctgcacccattaactca

SEQ ID NO: 1179126 - DNA, 22 bp, Artificial Sequence
  chemically synthesized
atgttaaatgatgagttaatgg

SEQ ID NO: 1179127 - DNA, 22 bp, Artificial Sequence
  chemically synthesized
aatgatgagttaatgggtgcag

SEQ ID NO: 1179128 - DNA, 22 bp, Artificial Sequence
  chemically synthesized
atgggtgcagcacaccaacatg

SEQ ID NO: 1179129 - DNA, 22 bp, Artificial Sequence
  chemically synthesized
catatgtatacatgtgccatgt

SEQ ID NO: 1179130 - DNA, 22 bp, Artificial Sequence
  chemically synthesized
gttacatatgtatacatgtgcc

SEQ ID NO: 1179131 - DNA, 22 bp, Artificial Sequence
  chemically synthesized
gggtacatgtgcacaatgtgca

SEQ ID NO: 1179132 - DNA, 22 bp, Artificial Sequence
  chemically synthesized
agggtacatgtgcacaatgtgc

SEQ ID NO: 1179133 - DNA, 22 bp, Artificial Sequence
  chemically synthesized
tagggtacatgtgcacaatgtg

SEQ ID NO: 1179134 - DNA, 22 bp, Artificial Sequence
  chemically synthesized
ttagggtacatgtgcacaatgt

SEQ ID NO: 1179135 - DNA, 22 bp, Artificial Sequence
  chemically synthesized
tacttttagggtacatgtgcac

SEQ ID NO: 1179136 - DNA, 22 bp, Artificial Sequence
  chemically synthesized
acctgcacattgtgcacatgta

SEQ ID NO: 1179137 - DNA, 22 bp, Artificial Sequence
  chemically synthesized
ttatacttttagggtacatgtg

SEQ ID NO: 1179138 - DNA, 22 bp, Artificial Sequence
  chemically synthesized
attatacttttagggtacatgt

SEQ ID NO: 1179139 - DNA, 22 bp, Artificial Sequence
  chemically synthesized
tattatacttttagggtacatg

SEQ ID NO: 1179140 - DNA, 22 bp, Artificial Sequence
  chemically synthesized
cacattgtgcacatgtacccta

SEQ ID NO: 1179141 - DNA, 22 bp, Artificial Sequence
  chemically synthesized
ttattatacttttagggtacat

SEQ ID NO: 1179142 - DNA, 22 bp, Artificial Sequence
  chemically synthesized
tttattatacttttagggtaca

SEQ ID NO: 1179143 - DNA, 22 bp, Artificial Sequence
  chemically synthesized
ttttattatacttttagggtac

SEQ ID NO: 1179144 - DNA, 22 bp, Artificial Sequence
  chemically synthesized
tttttattatacttttagggta

SEQ ID NO: 1179145 - DNA, 22 bp, Artificial Sequence
  chemically synthesized
ttttttattatacttttagggt

SEQ ID NO: 1179146 - DNA, 22 bp, Artificial Sequence
  chemically synthesized
tttttttattatacttttaggg

SEQ ID NO: 1179147 - DNA, 22 bp, Artificial Sequence
  chemically synthesized
ttttttttattatacttttagg

SEQ ID NO: 1179148 - DNA, 22 bp, Artificial Sequence
  chemically synthesized
tgcacatgtaccctaaaagtat

SEQ ID NO: 1179149 - DNA, 22 bp, Artificial Sequence
  chemically synthesized
tttttttttattatacttttag

SEQ ID NO: 1179150 - DNA, 22 bp, Artificial Sequence
  chemically synthesized
tttttttttttattatactttt

SEQ ID NO: 1179151 - DNA, 22 bp, Artificial Sequence
  chemically synthesized
ctttttttttttattatacttt

SEQ ID NO: 1179152 - DNA, 22 bp, Artificial Sequence
  chemically synthesized
tctttttttttttattatactt

SEQ ID NO: 1179153 - DNA, 22 bp, Artificial Sequence
  chemically synthesized
tttctttttttttttattatac

SEQ ID NO: 1179154 - DNA, 22 bp, Artificial Sequence
  chemically synthesized
ctttctttttttttttattata

SEQ ID NO: 1179155 - DNA, 22 bp, Artificial Sequence
  chemically synthesized
tctttctttttttttttattat

SEQ ID NO: 1179156 - DNA, 22 bp, Artificial Sequence
  chemically synthesized
tttctttctttttttttttatt

SEQ ID NO: 1179157 - DNA, 22 bp, Artificial Sequence
  chemically synthesized
ctttctttctttttttttttat

SEQ ID NO: 1179158 - DNA, 22 bp, Artificial Sequence
  chemically synthesized
cttctttctttctttttttttt

SEQ ID NO: 1179159 - DNA, 22 bp, Artificial Sequence
  chemically synthesized
aaagtataataaaaaaaaaaag

SEQ ID NO: 1179160 - DNA, 22 bp, Artificial Sequence
  chemically synthesized
actccttctttctttctttttt

SEQ ID NO: 1179161 - DNA, 22 bp, Artificial Sequence
  chemically synthesized
cattcactccttctttctttct

SEQ ID NO: 1179162 - DNA, 22 bp, Artificial Sequence
  chemically synthesized
ggtgaatggttacattcactcc

SEQ ID NO: 1179163 - DNA, 22 bp, Artificial Sequence
  chemically synthesized
ttaggtgaatggttacattcac

SEQ ID NO: 1179164 - DNA, 22 bp, Artificial Sequence
  chemically synthesized
gttaggtgaatggttacattca

SEQ ID NO: 1179165 - DNA, 22 bp, Artificial Sequence
  chemically synthesized
ttgttaggtgaatggttacatt

SEQ ID NO: 1179166 - DNA, 22 bp, Artificial Sequence
  chemically synthesized
cttgttaggtgaatggttacat

SEQ ID NO: 1179167 - DNA, 22 bp, Artificial Sequence
  chemically synthesized
aaaaacttcttgttaggtgaat

SEQ ID NO: 1179168 - DNA, 22 bp, Artificial Sequence
  chemically synthesized
aggcaatatgtctcaaaaactt

SEQ ID NO: 1179169 - DNA, 22 bp, Artificial Sequence
  chemically synthesized
acctaacaagaagtttttgaga

SEQ ID NO: 1179170 - DNA, 22 bp, Artificial Sequence
  chemically synthesized
acaagaagtttttgagacatat

SEQ ID NO: 1179171 - DNA, 22 bp, Artificial Sequence
  chemically synthesized
aaatattgaggcaatatgtctc

SEQ ID NO: 1179172 - DNA, 22 bp, Artificial Sequence
  chemically synthesized
gaaatattgaggcaatatgtct

SEQ ID NO: 1179173 - DNA, 22 bp, Artificial Sequence
  chemically synthesized
ttgagacatattgcctcaatat

SEQ ID NO: 1179174 - DNA, 22 bp, Artificial Sequence
  chemically synthesized
tgagacatattgcctcaatatt

SEQ ID NO: 1179175 - DNA, 22 bp, Artificial Sequence
  chemically synthesized
agtggcccttgaaatattgagg

SEQ ID NO: 1179176 - DNA, 22 bp, Artificial Sequence
  chemically synthesized
gagacatattgcctcaatattt

SEQ ID NO: 1179177 - DNA, 22 bp, Artificial Sequence
  chemically synthesized
agacatattgcctcaatatttc

SEQ ID NO: 1179178 - DNA, 22 bp, Artificial Sequence
  chemically synthesized
ctcagtggcccttgaaatattg

SEQ ID NO: 1179179 - DNA, 22 bp, Artificial Sequence
  chemically synthesized
ttactcagtggcccttgaaata

SEQ ID NO: 1179180 - DNA, 22 bp, Artificial Sequence
  chemically synthesized
cctcaatatttcaagggccact

SEQ ID NO: 1179181 - DNA, 22 bp, Artificial Sequence
  chemically synthesized
aatatttcaagggccactgagt

SEQ ID NO: 1179182 - DNA, 22 bp, Artificial Sequence
  chemically synthesized
aacaaataagtcattattactc

SEQ ID NO: 1179183 - DNA, 22 bp, Artificial Sequence
  chemically synthesized
caagggccactgagtaataatg

SEQ ID NO: 1179184 - DNA, 22 bp, Artificial Sequence
  chemically synthesized
aaacaaataagtcattattact

SEQ ID NO: 1179185 - DNA, 22 bp, Artificial Sequence
  chemically synthesized
aagggccactgagtaataatga

SEQ ID NO: 1179186 - DNA, 22 bp, Artificial Sequence
  chemically synthesized
taaacaaataagtcattattac

SEQ ID NO: 1179187 - DNA, 22 bp, Artificial Sequence
  chemically synthesized
ttaaacaaataagtcattatta

SEQ ID NO: 1179188 - DNA, 22 bp, Artificial Sequence
  chemically synthesized
atttttaaacaaataagtcatt

SEQ ID NO: 1179189 - DNA, 22 bp, Artificial Sequence
  chemically synthesized
aatttttaaacaaataagtcat

SEQ ID NO: 1179190 - DNA, 22 bp, Artificial Sequence
  chemically synthesized
agtaataatgacttatttgttt

SEQ ID NO: 1179191 - DNA, 22 bp, Artificial Sequence
  chemically synthesized
ccgtcttaatttttaaacaaat

SEQ ID NO: 1179192 - DNA, 22 bp, Artificial Sequence
  chemically synthesized
accgtcttaatttttaaacaaa

SEQ ID NO: 1179193 - DNA, 22 bp, Artificial Sequence
  chemically synthesized
taccgtcttaatttttaaacaa

SEQ ID NO: 1179194 - DNA, 22 bp, Artificial Sequence
  chemically synthesized
ttaccgtcttaatttttaaaca

SEQ ID NO: 1179195 - DNA, 22 bp, Artificial Sequence
  chemically synthesized
tttttaccgtcttaatttttaa

SEQ ID NO: 1179196 - DNA, 22 bp, Artificial Sequence
  chemically synthesized
ctatttttaccgtcttaatttt

SEQ ID NO: 1179197 - DNA, 22 bp, Artificial Sequence
  chemically synthesized
actatttttaccgtcttaattt

SEQ ID NO: 1179198 - DNA, 22 bp, Artificial Sequence
  chemically synthesized
atttgtttaaaaattaagacgg

SEQ ID NO: 1179199 - DNA, 22 bp, Artificial Sequence
  chemically synthesized
tttgtttaaaaattaagacggt

SEQ ID NO: 1179200 - DNA, 22 bp, Artificial Sequence
  chemically synthesized
gtttaaaaattaagacggtaaa

SEQ ID NO: 1179201 - DNA, 22 bp, Artificial Sequence
  chemically synthesized
tttaaaaattaagacggtaaaa

SEQ ID NO: 1179202 - DNA, 22 bp, Artificial Sequence
  chemically synthesized
acaacttactatttttaccgtc

SEQ ID NO: 1179203 - DNA, 22 bp, Artificial Sequence
  chemically synthesized
aacaacttactatttttaccgt

SEQ ID NO: 1179204 - DNA, 22 bp, Artificial Sequence
  chemically synthesized
aaaaattaagacggtaaaaata

SEQ ID NO: 1179205 - DNA, 22 bp, Artificial Sequence
  chemically synthesized
aaaattaagacggtaaaaatag

SEQ ID NO: 1179206 - DNA, 22 bp, Artificial Sequence
  chemically synthesized
gaaatttaacaacttactattt

SEQ ID NO: 1179207 - DNA, 22 bp, Artificial Sequence
  chemically synthesized
agacggtaaaaatagtaagttg

SEQ ID NO: 1179208 - DNA, 22 bp, Artificial Sequence
  chemically synthesized
attggaaatttaacaacttact

SEQ ID NO: 1179209 - DNA, 22 bp, Artificial Sequence
  chemically synthesized
cattggaaatttaacaacttac

SEQ ID NO: 1179210 - DNA, 22 bp, Artificial Sequence
  chemically synthesized
tcattggaaatttaacaactta

SEQ ID NO: 1179211 - DNA, 22 bp, Artificial Sequence
  chemically synthesized
ttcattggaaatttaacaactt

SEQ ID NO: 1179212 - DNA, 22 bp, Artificial Sequence
  chemically synthesized
tttcattggaaatttaacaact

SEQ ID NO: 1179213 - DNA, 22 bp, Artificial Sequence
  chemically synthesized
ttttcattggaaatttaacaac

SEQ ID NO: 1179214 - DNA, 22 bp, Artificial Sequence
  chemically synthesized
tggtgcaatttttttcattgga

SEQ ID NO: 1179215 - DNA, 22 bp, Artificial Sequence
  chemically synthesized
tatggtgcaatttttttcattg

SEQ ID NO: 1179216 - DNA, 22 bp, Artificial Sequence
  chemically synthesized
ctatggtgcaatttttttcatt

SEQ ID NO: 1179217 - DNA, 22 bp, Artificial Sequence
  chemically synthesized
ttaaatttccaatgaaaaaaat

SEQ ID NO: 1179218 - DNA, 22 bp, Artificial Sequence
  chemically synthesized
cttctatggtgcaatttttttc

SEQ ID NO: 1179219 - DNA, 22 bp, Artificial Sequence
  chemically synthesized
gcttctatggtgcaattttttt

SEQ ID NO: 1179220 - DNA, 22 bp, Artificial Sequence
  chemically synthesized
aatttccaatgaaaaaaattgc

SEQ ID NO: 1179221 - DNA, 22 bp, Artificial Sequence
  chemically synthesized
tgcttctatggtgcaatttttt

SEQ ID NO: 1179222 - DNA, 22 bp, Artificial Sequence
  chemically synthesized
ttgcttctatggtgcaattttt

SEQ ID NO: 1179223 - DNA, 22 bp, Artificial Sequence
  chemically synthesized
ccaatgaaaaaaattgcaccat

SEQ ID NO: 1179224 - DNA, 22 bp, Artificial Sequence
  chemically synthesized
acttttgcttctatggtgcaat

SEQ ID NO: 1179225 - DNA, 22 bp, Artificial Sequence
  chemically synthesized
caatgaaaaaaattgcaccata

SEQ ID NO: 1179226 - DNA, 22 bp, Artificial Sequence
  chemically synthesized
cacttttgcttctatggtgcaa

SEQ ID NO: 1179227 - DNA, 22 bp, Artificial Sequence
  chemically synthesized
taacatttcacttttgcttcta

SEQ ID NO: 1179228 - DNA, 22 bp, Artificial Sequence
  chemically synthesized
caccatagaagcaaaagtgaaa

SEQ ID NO: 1179229 - DNA, 22 bp, Artificial Sequence
  chemically synthesized
tatgtgctataacatttcactt

SEQ ID NO: 1179230 - DNA, 22 bp, Artificial Sequence
  chemically synthesized
gtatgtgctataacatttcact

SEQ ID NO: 1179231 - DNA, 22 bp, Artificial Sequence
  chemically synthesized
tgtatgtgctataacatttcac

SEQ ID NO: 1179232 - DNA, 22 bp, Artificial Sequence
  chemically synthesized
tagcacatacaaaacacacaca

SEQ ID NO: 1179233 - DNA, 22 bp, Artificial Sequence
  chemically synthesized
tgtgtgtgtgtgtgtgtgtgtg

SEQ ID NO: 1179234 - DNA, 22 bp, Artificial Sequence
  chemically synthesized
tgtatacacactgtgtgtgtgt

SEQ ID NO: 1179235 - DNA, 22 bp, Artificial Sequence
  chemically synthesized
aatccattatgtatacacactg

SEQ ID NO: 1179236 - DNA, 22 bp, Artificial Sequence
  chemically synthesized
taaatccattatgtatacacac

SEQ ID NO: 1179237 - DNA, 22 bp, Artificial Sequence
  chemically synthesized
gaactctaaatccattatgtat

SEQ ID NO: 1179238 - DNA, 22 bp, Artificial Sequence
  chemically synthesized
ataactagaactctaaatccat

SEQ ID NO: 1179239 - DNA, 22 bp, Artificial Sequence
  chemically synthesized
atcctcataactagaactctaa

SEQ ID NO: 1179240 - DNA, 22 bp, Artificial Sequence
  chemically synthesized
gtctcatcctcataactagaac

SEQ ID NO: 1179241 - DNA, 22 bp, Artificial Sequence
  chemically synthesized
cctagtctcatcctcataacta

SEQ ID NO: 1179242 - DNA, 22 bp, Artificial Sequence
  chemically synthesized
ccctagtctcatcctcataact

SEQ ID NO: 1179243 - DNA, 22 bp, Artificial Sequence
  chemically synthesized
tttccctagtctcatcctcata

SEQ ID NO: 1179244 - DNA, 22 bp, Artificial Sequence
  chemically synthesized
agagttctagttatgaggatga

SEQ ID NO: 1179245 - DNA, 22 bp, Artificial Sequence
  chemically synthesized
gagttctagttatgaggatgag

SEQ ID NO: 1179246 - DNA, 22 bp, Artificial Sequence
  chemically synthesized
tgcctatttccctagtctcatc

SEQ ID NO: 1179247 - DNA, 22 bp, Artificial Sequence
  chemically synthesized
tagttatgaggatgagactagg

SEQ ID NO: 1179248 - DNA, 22 bp, Artificial Sequence
  chemically synthesized
tgtgcctatttccctagtctca

SEQ ID NO: 1179249 - DNA, 22 bp, Artificial Sequence
  chemically synthesized
gttatgaggatgagactaggga

SEQ ID NO: 1179250 - DNA, 22 bp, Artificial Sequence
  chemically synthesized
tctctgtgcctatttccctagt

SEQ ID NO: 1179251 - DNA, 22 bp, Artificial Sequence
  chemically synthesized
atctctgtgcctatttccctag

SEQ ID NO: 1179252 - DNA, 22 bp, Artificial Sequence
  chemically synthesized
tgaggatgagactagggaaata

SEQ ID NO: 1179253 - DNA, 22 bp, Artificial Sequence
  chemically synthesized
tatctctgtgcctatttcccta

SEQ ID NO: 1179254 - DNA, 22 bp, Artificial Sequence
  chemically synthesized
acagcactttatctctgtgcct

SEQ ID NO: 1179255 - DNA, 22 bp, Artificial Sequence
  chemically synthesized
taacagcactttatctctgtgc

SEQ ID NO: 1179256 - DNA, 22 bp, Artificial Sequence
  chemically synthesized
gggaaataggcacagagataaa

SEQ ID NO: 1179257 - DNA, 22 bp, Artificial Sequence
  chemically synthesized
tctctaacagcactttatctct

SEQ ID NO: 1179258 - DNA, 22 bp, Artificial Sequence
  chemically synthesized
tacatatgggttgtctctaaca

SEQ ID NO: 1179259 - DNA, 22 bp, Artificial Sequence
  chemically synthesized
gaagttatacatatgggttgtc

SEQ ID NO: 1179260 - DNA, 22 bp, Artificial Sequence
  chemically synthesized
ttcgaagttatacatatgggtt

SEQ ID NO: 1179261 - DNA, 22 bp, Artificial Sequence
  chemically synthesized
tattcgaagttatacatatggg

SEQ ID NO: 1179262 - DNA, 22 bp, Artificial Sequence
  chemically synthesized
ttagagacaacccatatgtata

SEQ ID NO: 1179263 - DNA, 22 bp, Artificial Sequence
  chemically synthesized
gagacaacccatatgtataact

SEQ ID NO: 1179264 - DNA, 22 bp, Artificial Sequence
  chemically synthesized
catagggagtatgttctattcg

SEQ ID NO: 1179265 - DNA, 22 bp, Artificial Sequence
  chemically synthesized
acatagggagtatgttctattc

SEQ ID NO: 1179266 - DNA, 22 bp, Artificial Sequence
  chemically synthesized
aacacttacatagggagtatgt

SEQ ID NO: 1179267 - DNA, 22 bp, Artificial Sequence
  chemically synthesized
cgaatagaacatactccctatg

SEQ ID NO: 1179268 - DNA, 22 bp, Artificial Sequence
  chemically synthesized
gaatagaacatactccctatgt

SEQ ID NO: 1179269 - DNA, 22 bp, Artificial Sequence
  chemically synthesized
ccaataatactaaacacttaca

SEQ ID NO: 1179270 - DNA, 22 bp, Artificial Sequence
  chemically synthesized
cctatgtaagtgtttagtatta

SEQ ID NO: 1179271 - DNA, 22 bp, Artificial Sequence
  chemically synthesized
tgtaagtgtttagtattattgg

SEQ ID NO: 1179272 - DNA, 22 bp, Artificial Sequence
  chemically synthesized
agtattattggtagatatgtgt

SEQ ID NO: 1179273 - DNA, 22 bp, Artificial Sequence
  chemically synthesized
gtattattggtagatatgtgta

SEQ ID NO: 1179274 - DNA, 22 bp, Artificial Sequence
  chemically synthesized
ttggtagatatgtgtattgctg

SEQ ID NO: 1179275 - DNA, 22 bp, Artificial Sequence
  chemically synthesized
gtagatatgtgtattgctgtat

SEQ ID NO: 1179276 - DNA, 22 bp, Artificial Sequence
  chemically synthesized
ctgtatgtatatacccacacac

SEQ ID NO: 1179277 - DNA, 22 bp, Artificial Sequence
  chemically synthesized
tatgtatatacccacacacaca

SEQ ID NO: 1179278 - DNA, 22 bp, Artificial Sequence
  chemically synthesized
cgtgtgcatatatatgtgtgtg

SEQ ID NO: 1179279 - DNA, 22 bp, Artificial Sequence
  chemically synthesized
tgtgttacgtgtgcatatatat

SEQ ID NO: 1179280 - DNA, 22 bp, Artificial Sequence
  chemically synthesized
aaatagagtatatatctgtgtg

SEQ ID NO: 1179281 - DNA, 22 bp, Artificial Sequence
  chemically synthesized
caaatagagtatatatctgtgt

SEQ ID NO: 1179282 - DNA, 22 bp, Artificial Sequence
  chemically synthesized
tcaaatagagtatatatctgtg

SEQ ID NO: 1179283 - DNA, 22 bp, Artificial Sequence
  chemically synthesized
taagcaaagttttcaaatagag

SEQ ID NO: 1179284 - DNA, 22 bp, Artificial Sequence
  chemically synthesized
gattataagcaaagttttcaaa

SEQ ID NO: 1179285 - DNA, 22 bp, Artificial Sequence
  chemically synthesized
tatttgaaaactttgcttataa

SEQ ID NO: 1179286 - DNA, 22 bp, Artificial Sequence
  chemically synthesized
atacatggttagattataagca

SEQ ID NO: 1179287 - DNA, 22 bp, Artificial Sequence
  chemically synthesized
tttgaaaactttgcttataatc

SEQ ID NO: 1179288 - DNA, 22 bp, Artificial Sequence
  chemically synthesized
gaaaactttgcttataatctaa

SEQ ID NO: 1179289 - DNA, 22 bp, Artificial Sequence
  chemically synthesized
aaaactttgcttataatctaac

SEQ ID NO: 1179290 - DNA, 22 bp, Artificial Sequence
  chemically synthesized
tgcttataatctaaccatgtat

SEQ ID NO: 1179291 - DNA, 22 bp, Artificial Sequence
  chemically synthesized
gcttataatctaaccatgtatc

SEQ ID NO: 1179292 - DNA, 22 bp, Artificial Sequence
  chemically synthesized
cttataatctaaccatgtatca

SEQ ID NO: 1179293 - DNA, 22 bp, Artificial Sequence
  chemically synthesized
taaagatagcactgatacatgg

SEQ ID NO: 1179294 - DNA, 22 bp, Artificial Sequence
  chemically synthesized
ataatctaaccatgtatcagtg

SEQ ID NO: 1179295 - DNA, 22 bp, Artificial Sequence
  chemically synthesized
taatctaaccatgtatcagtgc

SEQ ID NO: 1179296 - DNA, 22 bp, Artificial Sequence
  chemically synthesized
accatgtatcagtgctatcttt

SEQ ID NO: 1179297 - DNA, 22 bp, Artificial Sequence
  chemically synthesized
ataccatgctgtaaagatagca

SEQ ID NO: 1179298 - DNA, 22 bp, Artificial Sequence
  chemically synthesized
aataccatgctgtaaagatagc

SEQ ID NO: 1179299 - DNA, 22 bp, Artificial Sequence
  chemically synthesized
tatacttaataccatgctgtaa

SEQ ID NO: 1179300 - DNA, 22 bp, Artificial Sequence
  chemically synthesized
tagttatatacttaataccatg

SEQ ID NO: 1179301 - DNA, 22 bp, Artificial Sequence
  chemically synthesized
tctttacagcatggtattaagt

SEQ ID NO: 1179302 - DNA, 22 bp, Artificial Sequence
  chemically synthesized
atgctatagttatatacttaat

SEQ ID NO: 1179303 - DNA, 22 bp, Artificial Sequence
  chemically synthesized
tacagcatggtattaagtatat

SEQ ID NO: 1179304 - DNA, 22 bp, Artificial Sequence
  chemically synthesized
acagcatggtattaagtatata

SEQ ID NO: 1179305 - DNA, 22 bp, Artificial Sequence
  chemically synthesized
cagcatggtattaagtatataa

SEQ ID NO: 1179306 - DNA, 22 bp, Artificial Sequence
  chemically synthesized
aaattcatgctatagttatata

SEQ ID NO: 1179307 - DNA, 22 bp, Artificial Sequence
  chemically synthesized
aaaattcatgctatagttatat

SEQ ID NO: 1179308 - DNA, 22 bp, Artificial Sequence
  chemically synthesized
taaaattcatgctatagttata

SEQ ID NO: 1179309 - DNA, 22 bp, Artificial Sequence
  chemically synthesized
agtatataactatagcatgaat

SEQ ID NO: 1179310 - DNA, 22 bp, Artificial Sequence
  chemically synthesized
tagcatgaattttaaagatttc

SEQ ID NO: 1179311 - DNA, 22 bp, Artificial Sequence
  chemically synthesized
atgcaatatcatgaaatcttta

SEQ ID NO: 1179312 - DNA, 22 bp, Artificial Sequence
  chemically synthesized
aatgcaatatcatgaaatcttt

SEQ ID NO: 1179313 - DNA, 22 bp, Artificial Sequence
  chemically synthesized
taatgcaatatcatgaaatctt

SEQ ID NO: 1179314 - DNA, 22 bp, Artificial Sequence
  chemically synthesized
ttaatgcaatatcatgaaatct

SEQ ID NO: 1179315 - DNA, 22 bp, Artificial Sequence
  chemically synthesized
taaagatttcatgatattgcat

SEQ ID NO: 1179316 - DNA, 22 bp, Artificial Sequence
  chemically synthesized
aaagatttcatgatattgcatt

SEQ ID NO: 1179317 - DNA, 22 bp, Artificial Sequence
  chemically synthesized
aagatttcatgatattgcatta

SEQ ID NO: 1179318 - DNA, 22 bp, Artificial Sequence
  chemically synthesized
gggtaaatatttttaatgcaat

SEQ ID NO: 1179319 - DNA, 22 bp, Artificial Sequence
  chemically synthesized
agggtaaatatttttaatgcaa

SEQ ID NO: 1179320 - DNA, 22 bp, Artificial Sequence
  chemically synthesized
catgatattgcattaaaaatat

SEQ ID NO: 1179321 - DNA, 22 bp, Artificial Sequence
  chemically synthesized
atgatattgcattaaaaatatt

SEQ ID NO: 1179322 - DNA, 22 bp, Artificial Sequence
  chemically synthesized
ataaaacttagggtaaatattt

SEQ ID NO: 1179323 - DNA, 22 bp, Artificial Sequence
  chemically synthesized
cattaaaaatatttaccctaag

SEQ ID NO: 1179324 - DNA, 22 bp, Artificial Sequence
  chemically synthesized
aaaatatttaccctaagtttta

SEQ ID NO: 1179325 - DNA, 22 bp, Artificial Sequence
  chemically synthesized
accctaagttttattaatccta

SEQ ID NO: 1179326 - DNA, 22 bp, Artificial Sequence
  chemically synthesized
ccctaagttttattaatcctat

SEQ ID NO: 1179327 - DNA, 22 bp, Artificial Sequence
  chemically synthesized
aatagtgatcaccataggatta

SEQ ID NO: 1179328 - DNA, 22 bp, Artificial Sequence
  chemically synthesized
gaatagtgatcaccataggatt

SEQ ID NO: 1179329 - DNA, 22 bp, Artificial Sequence
  chemically synthesized
agttttattaatcctatggtga

SEQ ID NO: 1179330 - DNA, 22 bp, Artificial Sequence
  chemically synthesized
tattaatcctatggtgatcact

SEQ ID NO: 1179331 - DNA, 22 bp, Artificial Sequence
  chemically synthesized
attaatcctatggtgatcacta

SEQ ID NO: 1179332 - DNA, 22 bp, Artificial Sequence
  chemically synthesized
ttaatcctatggtgatcactat

SEQ ID NO: 1179333 - DNA, 22 bp, Artificial Sequence
  chemically synthesized
ataaacacttgaatagtgatca

SEQ ID NO: 1179334 - DNA, 22 bp, Artificial Sequence
  chemically synthesized
aataaacacttgaatagtgatc

SEQ ID NO: 1179335 - DNA, 22 bp, Artificial Sequence
  chemically synthesized
atcctatggtgatcactattca

SEQ ID NO: 1179336 - DNA, 22 bp, Artificial Sequence
  chemically synthesized
tggtgatcactattcaagtgtt

SEQ ID NO: 1179337 - DNA, 22 bp, Artificial Sequence
  chemically synthesized
aaagagggaaagtttaataaac

SEQ ID NO: 1179338 - DNA, 22 bp, Artificial Sequence
  chemically synthesized
caaagagggaaagtttaataaa

SEQ ID NO: 1179339 - DNA, 22 bp, Artificial Sequence
  chemically synthesized
tcaaagagggaaagtttaataa

SEQ ID NO: 1179340 - DNA, 22 bp, Artificial Sequence
  chemically synthesized
ttcaagtgtttattaaactttc

SEQ ID NO: 1179341 - DNA, 22 bp, Artificial Sequence
  chemically synthesized
aagtgtttattaaactttccct

SEQ ID NO: 1179342 - DNA, 22 bp, Artificial Sequence
  chemically synthesized
aaacaggttttcaaagagggaa

SEQ ID NO: 1179343 - DNA, 22 bp, Artificial Sequence
  chemically synthesized
attaaactttccctctttgaaa

SEQ ID NO: 1179344 - DNA, 22 bp, Artificial Sequence
  chemically synthesized
ttaaactttccctctttgaaaa

SEQ ID NO: 1179345 - DNA, 22 bp, Artificial Sequence
  chemically synthesized
aactttccctctttgaaaacct

SEQ ID NO: 1179346 - DNA, 22 bp, Artificial Sequence
  chemically synthesized
tccctctttgaaaacctgtttt

SEQ ID NO: 1179347 - DNA, 22 bp, Artificial Sequence
  chemically synthesized
ccctctttgaaaacctgtttta

SEQ ID NO: 1179348 - DNA, 22 bp, Artificial Sequence
  chemically synthesized
cctctttgaaaacctgttttaa

SEQ ID NO: 1179349 - DNA, 22 bp, Artificial Sequence
  chemically synthesized
tttgaaaacctgttttaactat

SEQ ID NO: 1179350 - DNA, 22 bp, Artificial Sequence
  chemically synthesized
tgaaaacctgttttaactatgt

SEQ ID NO: 1179351 - DNA, 22 bp, Artificial Sequence
  chemically synthesized
gaaaacctgttttaactatgtc

SEQ ID NO: 1179352 - DNA, 22 bp, Artificial Sequence
  chemically synthesized
aaaacctgttttaactatgtct

SEQ ID NO: 1179353 - DNA, 22 bp, Artificial Sequence
  chemically synthesized
gtaaatgaaatgatgtaagaca

SEQ ID NO: 1179354 - DNA, 22 bp, Artificial Sequence
  chemically synthesized
ttttaactatgtcttacatcat

SEQ ID NO: 1179355 - DNA, 22 bp, Artificial Sequence
  chemically synthesized
taactatgtcttacatcatttc

SEQ ID NO: 1179356 - DNA, 22 bp, Artificial Sequence
  chemically synthesized
aactatgtcttacatcatttca

SEQ ID NO: 1179357 - DNA, 22 bp, Artificial Sequence
  chemically synthesized
actatgtcttacatcatttcat

SEQ ID NO: 1179358 - DNA, 22 bp, Artificial Sequence
  chemically synthesized
tgtcttacatcatttcatttac

SEQ ID NO: 1179359 - DNA, 22 bp, Artificial Sequence
  chemically synthesized
ggagtaataatctggtaaatga

SEQ ID NO: 1179360 - DNA, 22 bp, Artificial Sequence
  chemically synthesized
aggagtaataatctggtaaatg

SEQ ID NO: 1179361 - DNA, 22 bp, Artificial Sequence
  chemically synthesized
acatcatttcatttaccagatt

SEQ ID NO: 1179362 - DNA, 22 bp, Artificial Sequence
  chemically synthesized
catcatttcatttaccagatta

SEQ ID NO: 1179363 - DNA, 22 bp, Artificial Sequence
  chemically synthesized
aatttaggagtaataatctggt

SEQ ID NO: 1179364 - DNA, 22 bp, Artificial Sequence
  chemically synthesized
aaatttaggagtaataatctgg

SEQ ID NO: 1179365 - DNA, 22 bp, Artificial Sequence
  chemically synthesized
catttaccagattattactcct

SEQ ID NO: 1179366 - DNA, 22 bp, Artificial Sequence
  chemically synthesized
atttaccagattattactccta

SEQ ID NO: 1179367 - DNA, 22 bp, Artificial Sequence
  chemically synthesized
accagattattactcctaaatt

SEQ ID NO: 1179368 - DNA, 22 bp, Artificial Sequence
  chemically synthesized
ccagattattactcctaaattt

SEQ ID NO: 1179369 - DNA, 22 bp, Artificial Sequence
  chemically synthesized
atcacaaaatttaaatttagga

SEQ ID NO: 1179370 - DNA, 22 bp, Artificial Sequence
  chemically synthesized
aatcacaaaatttaaatttagg

SEQ ID NO: 1179371 - DNA, 22 bp, Artificial Sequence
  chemically synthesized
taatcacaaaatttaaatttag

SEQ ID NO: 1179372 - DNA, 22 bp, Artificial Sequence
  chemically synthesized
ttaatcacaaaatttaaattta

SEQ ID NO: 1179373 - DNA, 22 bp, Artificial Sequence
  chemically synthesized
tttaatcacaaaatttaaattt

SEQ ID NO: 1179374 - DNA, 22 bp, Artificial Sequence
  chemically synthesized
ttactcctaaatttaaattttg

SEQ ID NO: 1179375 - DNA, 22 bp, Artificial Sequence
  chemically synthesized
ctcctaaatttaaattttgtga

SEQ ID NO: 1179376 - DNA, 22 bp, Artificial Sequence
  chemically synthesized
ctaaatttaaattttgtgatta

SEQ ID NO: 1179377 - DNA, 22 bp, Artificial Sequence
  chemically synthesized
gtgcataattttttaatcacaa

SEQ ID NO: 1179378 - DNA, 22 bp, Artificial Sequence
  chemically synthesized
aatttaaattttgtgattaaaa

SEQ ID NO: 1179379 - DNA, 22 bp, Artificial Sequence
  chemically synthesized
tggtgcataattttttaatcac

SEQ ID NO: 1179380 - DNA, 22 bp, Artificial Sequence
  chemically synthesized
ctggtgcataattttttaatca

SEQ ID NO: 1179381 - DNA, 22 bp, Artificial Sequence
  chemically synthesized
aaattttgtgattaaaaaatta

SEQ ID NO: 1179382 - DNA, 22 bp, Artificial Sequence
  chemically synthesized
aattttgtgattaaaaaattat

SEQ ID NO: 1179383 - DNA, 22 bp, Artificial Sequence
  chemically synthesized
tccttctggtgcataatttttt

SEQ ID NO: 1179384 - DNA, 22 bp, Artificial Sequence
  chemically synthesized
tgtgattaaaaaattatgcacc

SEQ ID NO: 1179385 - DNA, 22 bp, Artificial Sequence
  chemically synthesized
gtgattaaaaaattatgcacca

SEQ ID NO: 1179386 - DNA, 22 bp, Artificial Sequence
  chemically synthesized
atgctgtccttctggtgcataa

SEQ ID NO: 1179387 - DNA, 22 bp, Artificial Sequence
  chemically synthesized
tgattaaaaaattatgcaccag

SEQ ID NO: 1179388 - DNA, 22 bp, Artificial Sequence
  chemically synthesized
aaaaattatgcaccagaaggac

SEQ ID NO: 1179389 - DNA, 22 bp, Artificial Sequence
  chemically synthesized
tgcaccagaaggacagcatcaa

SEQ ID NO: 1179390 - DNA, 22 bp, Artificial Sequence
  chemically synthesized
tgacagaataaattgatgctgt

SEQ ID NO: 1179391 - DNA, 22 bp, Artificial Sequence
  chemically synthesized
atgacagaataaattgatgctg

SEQ ID NO: 1179392 - DNA, 22 bp, Artificial Sequence
  chemically synthesized
taagagggcttatgacagaata

SEQ ID NO: 1179393 - DNA, 22 bp, Artificial Sequence
  chemically synthesized
attctgtcataagccctcttac

SEQ ID NO: 1179394 - DNA, 22 bp, Artificial Sequence
  chemically synthesized
ttctgtcataagccctcttaca

SEQ ID NO: 1179395 - DNA, 22 bp, Artificial Sequence
  chemically synthesized
tgtcataagccctcttacaact

SEQ ID NO: 1179396 - DNA, 22 bp, Artificial Sequence
  chemically synthesized
tcataagccctcttacaacttt

SEQ ID NO: 1179397 - DNA, 22 bp, Artificial Sequence
  chemically synthesized
ttacaacttttgatgtttcctg

SEQ ID NO: 1179398 - DNA, 22 bp, Artificial Sequence
  chemically synthesized
acaacttttgatgtttcctgtt

SEQ ID NO: 1179399 - DNA, 22 bp, Artificial Sequence
  chemically synthesized
caacttttgatgtttcctgttt

SEQ ID NO: 1179400 - DNA, 22 bp, Artificial Sequence
  chemically synthesized
cagaacataaagaaacaggaaa

SEQ ID NO: 1179401 - DNA, 22 bp, Artificial Sequence
  chemically synthesized
gcagaacataaagaaacaggaa

SEQ ID NO: 1179402 - DNA, 22 bp, Artificial Sequence
  chemically synthesized
tgcagaacataaagaaacagga

SEQ ID NO: 1179403 - DNA, 22 bp, Artificial Sequence
  chemically synthesized
ttgatgtttcctgtttctttat

SEQ ID NO: 1179404 - DNA, 22 bp, Artificial Sequence
  chemically synthesized
tgatgtttcctgtttctttatg

SEQ ID NO: 1179405 - DNA, 22 bp, Artificial Sequence
  chemically synthesized
gatgtttcctgtttctttatgt

SEQ ID NO: 1179406 - DNA, 22 bp, Artificial Sequence
  chemically synthesized
atgtttcctgtttctttatgtt

SEQ ID NO: 1179407 - DNA, 22 bp, Artificial Sequence
  chemically synthesized
ataattttgcagaacataaaga

SEQ ID NO: 1179408 - DNA, 22 bp, Artificial Sequence
  chemically synthesized
cctgtttctttatgttctgcaa

SEQ ID NO: 1179409 - DNA, 22 bp, Artificial Sequence
  chemically synthesized
ctgtttctttatgttctgcaaa

SEQ ID NO: 1179410 - DNA, 22 bp, Artificial Sequence
  chemically synthesized
tttctttatgttctgcaaaatt

SEQ ID NO: 1179411 - DNA, 22 bp, Artificial Sequence
  chemically synthesized
ctttatgttctgcaaaattatc

SEQ ID NO: 1179412 - DNA, 22 bp, Artificial Sequence
  chemically synthesized
tttatgttctgcaaaattatca

SEQ ID NO: 1179413 - DNA, 22 bp, Artificial Sequence
  chemically synthesized
tatgttctgcaaaattatcagt

SEQ ID NO: 1179414 - DNA, 22 bp, Artificial Sequence
  chemically synthesized
atgttctgcaaaattatcagta

SEQ ID NO: 1179415 - DNA, 22 bp, Artificial Sequence
  chemically synthesized
aaacagtgataatactgataat

SEQ ID NO: 1179416 - DNA, 22 bp, Artificial Sequence
  chemically synthesized
tgttctgcaaaattatcagtat

SEQ ID NO: 1179417 - DNA, 22 bp, Artificial Sequence
  chemically synthesized
tgcaaaattatcagtattatca

SEQ ID NO: 1179418 - DNA, 22 bp, Artificial Sequence
  chemically synthesized
caaaattatcagtattatcact

SEQ ID NO: 1179419 - DNA, 22 bp, Artificial Sequence
  chemically synthesized
tcagtattatcactgtttcaat

SEQ ID NO: 1179420 - DNA, 22 bp, Artificial Sequence
  chemically synthesized
ccagataggcagattgaaacag

SEQ ID NO: 1179421 - DNA, 22 bp, Artificial Sequence
  chemically synthesized
actaccagataggcagattgaa

SEQ ID NO: 1179422 - DNA, 22 bp, Artificial Sequence
  chemically synthesized
aactaccagataggcagattga

SEQ ID NO: 1179423 - DNA, 22 bp, Artificial Sequence
  chemically synthesized
taactaccagataggcagattg

SEQ ID NO: 1179424 - DNA, 22 bp, Artificial Sequence
  chemically synthesized
ttaactaccagataggcagatt

SEQ ID NO: 1179425 - DNA, 22 bp, Artificial Sequence
  chemically synthesized
tcactgtttcaatctgcctatc

SEQ ID NO: 1179426 - DNA, 22 bp, Artificial Sequence
  chemically synthesized
tttttaactaccagataggcag

SEQ ID NO: 1179427 - DNA, 22 bp, Artificial Sequence
  chemically synthesized
tttcaatctgcctatctggtag

SEQ ID NO: 1179428 - DNA, 22 bp, Artificial Sequence
  chemically synthesized
caatctgcctatctggtagtta

SEQ ID NO: 1179429 - DNA, 22 bp, Artificial Sequence
  chemically synthesized
aatctgcctatctggtagttaa

SEQ ID NO: 1179430 - DNA, 22 bp, Artificial Sequence
  chemically synthesized
cctatctggtagttaaaaataa

SEQ ID NO: 1179431 - DNA, 22 bp, Artificial Sequence
  chemically synthesized
tctggtagttaaaaataatttg

SEQ ID NO: 1179432 - DNA, 22 bp, Artificial Sequence
  chemically synthesized
gtagttaaaaataatttgattg

SEQ ID NO: 1179433 - DNA, 22 bp, Artificial Sequence
  chemically synthesized
aaaataatttgattgtttatat

SEQ ID NO: 1179434 - DNA, 22 bp, Artificial Sequence
  chemically synthesized
ataaaaaaatataatataaaca

SEQ ID NO: 1179435 - DNA, 22 bp, Artificial Sequence
  chemically synthesized
aataaaaaaatataatataaac

SEQ ID NO: 1179436 - DNA, 22 bp, Artificial Sequence
  chemically synthesized
cttaataaaaaaatataatata

SEQ ID NO: 1179437 - DNA, 22 bp, Artificial Sequence
  chemically synthesized
gattgtttatattatatttttt

SEQ ID NO: 1179438 - DNA, 22 bp, Artificial Sequence
  chemically synthesized
attgtttatattatattttttt

SEQ ID NO: 1179439 - DNA, 22 bp, Artificial Sequence
  chemically synthesized
tttatattatatttttttatta

SEQ ID NO: 1179440 - DNA, 22 bp, Artificial Sequence
  chemically synthesized
atattatatttttttattaagt

SEQ ID NO: 1179441 - DNA, 22 bp, Artificial Sequence
  chemically synthesized
tattatatttttttattaagta

SEQ ID NO: 1179442 - DNA, 22 bp, Artificial Sequence
  chemically synthesized
tatttttttattaagtagatgg

SEQ ID NO: 1179443 - DNA, 22 bp, Artificial Sequence
  chemically synthesized
ttttattaagtagatggtatgt

SEQ ID NO: 1179444 - DNA, 22 bp, Artificial Sequence
  chemically synthesized
tttattaagtagatggtatgtc

SEQ ID NO: 1179445 - DNA, 22 bp, Artificial Sequence
  chemically synthesized
agtatgtaaaaagacataccat

SEQ ID NO: 1179446 - DNA, 22 bp, Artificial Sequence
  chemically synthesized
ttattaagtagatggtatgtct

SEQ ID NO: 1179447 - DNA, 22 bp, Artificial Sequence
  chemically synthesized
tattaagtagatggtatgtctt

SEQ ID NO: 1179448 - DNA, 22 bp, Artificial Sequence
  chemically synthesized
attaagtagatggtatgtcttt

SEQ ID NO: 1179449 - DNA, 22 bp, Artificial Sequence
  chemically synthesized
ttaagtagatggtatgtctttt

SEQ ID NO: 1179450 - DNA, 22 bp, Artificial Sequence
  chemically synthesized
agtagatggtatgtctttttac

SEQ ID NO: 1179451 - DNA, 22 bp, Artificial Sequence
  chemically synthesized
tttacatacttaatgatatatg

SEQ ID NO: 1179452 - DNA, 22 bp, Artificial Sequence
  chemically synthesized
ttacatacttaatgatatatgg

SEQ ID NO: 1179453 - DNA, 22 bp, Artificial Sequence
  chemically synthesized
tacatacttaatgatatatggg

SEQ ID NO: 1179454 - DNA, 22 bp, Artificial Sequence
  chemically synthesized
acatacttaatgatatatgggc

SEQ ID NO: 1179455 - DNA, 22 bp, Artificial Sequence
  chemically synthesized
catacttaatgatatatgggct

SEQ ID NO: 1179456 - DNA, 22 bp, Artificial Sequence
  chemically synthesized
aatgatatatgggctttttcgc

SEQ ID NO: 1179457 - DNA, 22 bp, Artificial Sequence
  chemically synthesized
atgatatatgggctttttcgct

SEQ ID NO: 1179458 - DNA, 22 bp, Artificial Sequence
  chemically synthesized
tttcgcttttgtcattttctgg

SEQ ID NO: 1179459 - DNA, 22 bp, Artificial Sequence
  chemically synthesized
ttcgcttttgtcattttctggc

SEQ ID NO: 1179460 - DNA, 22 bp, Artificial Sequence
  chemically synthesized
tcgcttttgtcattttctggct

SEQ ID NO: 1179461 - DNA, 22 bp, Artificial Sequence
  chemically synthesized
ataaagaacatgagccagaaaa

SEQ ID NO: 1179462 - DNA, 22 bp, Artificial Sequence
  chemically synthesized
cgcttttgtcattttctggctc

SEQ ID NO: 1179463 - DNA, 22 bp, Artificial Sequence
  chemically synthesized
gcttttgtcattttctggctca

SEQ ID NO: 1179464 - DNA, 22 bp, Artificial Sequence
  chemically synthesized
ttgtcattttctggctcatgtt

SEQ ID NO: 1179465 - DNA, 22 bp, Artificial Sequence
  chemically synthesized
tgtcattttctggctcatgttc

SEQ ID NO: 1179466 - DNA, 22 bp, Artificial Sequence
  chemically synthesized
gtcattttctggctcatgttct

SEQ ID NO: 1179467 - DNA, 22 bp, Artificial Sequence
  chemically synthesized
tcattttctggctcatgttctt

SEQ ID NO: 1179468 - DNA, 22 bp, Artificial Sequence
  chemically synthesized
tctggctcatgttctttatgaa

SEQ ID NO: 1179469 - DNA, 22 bp, Artificial Sequence
  chemically synthesized
ctggctcatgttctttatgaat

SEQ ID NO: 1179470 - DNA, 22 bp, Artificial Sequence
  chemically synthesized
tggctcatgttctttatgaatt

SEQ ID NO: 1179471 - DNA, 22 bp, Artificial Sequence
  chemically synthesized
gctcatgttctttatgaatttt

SEQ ID NO: 1179472 - DNA, 22 bp, Artificial Sequence
  chemically synthesized
gaatgccccaataggaaaattc

SEQ ID NO: 1179473 - DNA, 22 bp, Artificial Sequence
  chemically synthesized
atgttctttatgaattttccta

SEQ ID NO: 1179474 - DNA, 22 bp, Artificial Sequence
  chemically synthesized
tttatgaattttcctattgggg

SEQ ID NO: 1179475 - DNA, 22 bp, Artificial Sequence
  chemically synthesized
tatgaattttcctattggggca

SEQ ID NO: 1179476 - DNA, 22 bp, Artificial Sequence
  chemically synthesized
atgaattttcctattggggcat

SEQ ID NO: 1179477 - DNA, 22 bp, Artificial Sequence
  chemically synthesized
tgaattttcctattggggcatt

SEQ ID NO: 1179478 - DNA, 22 bp, Artificial Sequence
  chemically synthesized
tcctattggggcattctagttt

SEQ ID NO: 1179479 - DNA, 22 bp, Artificial Sequence
  chemically synthesized
cctattggggcattctagtttt

SEQ ID NO: 1179480 - DNA, 22 bp, Artificial Sequence
  chemically synthesized
ctattggggcattctagtttta

SEQ ID NO: 1179481 - DNA, 22 bp, Artificial Sequence
  chemically synthesized
ataaatcaataagtaaaactag

SEQ ID NO: 1179482 - DNA, 22 bp, Artificial Sequence
  chemically synthesized
ttggggcattctagttttactt

SEQ ID NO: 1179483 - DNA, 22 bp, Artificial Sequence
  chemically synthesized
gggcattctagttttacttatt

SEQ ID NO: 1179484 - DNA, 22 bp, Artificial Sequence
  chemically synthesized
tagttttacttattgatttatc

SEQ ID NO: 1179485 - DNA, 22 bp, Artificial Sequence
  chemically synthesized
gttttacttattgatttatcag

SEQ ID NO: 1179486 - DNA, 22 bp, Artificial Sequence
  chemically synthesized
atatataaataatgctgataaa

SEQ ID NO: 1179487 - DNA, 22 bp, Artificial Sequence
  chemically synthesized
tacttattgatttatcagcatt

SEQ ID NO: 1179488 - DNA, 22 bp, Artificial Sequence
  chemically synthesized
acttattgatttatcagcatta

SEQ ID NO: 1179489 - DNA, 22 bp, Artificial Sequence
  chemically synthesized
cttattgatttatcagcattat

SEQ ID NO: 1179490 - DNA, 22 bp, Artificial Sequence
  chemically synthesized
attgatttatcagcattattta

SEQ ID NO: 1179491 - DNA, 22 bp, Artificial Sequence
  chemically synthesized
ttgatttatcagcattatttat

SEQ ID NO: 1179492 - DNA, 22 bp, Artificial Sequence
  chemically synthesized
atagccctcatatataaataat

SEQ ID NO: 1179493 - DNA, 22 bp, Artificial Sequence
  chemically synthesized
atttatcagcattatttatata

SEQ ID NO: 1179494 - DNA, 22 bp, Artificial Sequence
  chemically synthesized
atcagcattatttatatatgag

SEQ ID NO: 1179495 - DNA, 22 bp, Artificial Sequence
  chemically synthesized
tcagcattatttatatatgagg

SEQ ID NO: 1179496 - DNA, 22 bp, Artificial Sequence
  chemically synthesized
tttatatatgagggctatcaat

SEQ ID NO: 1179497 - DNA, 22 bp, Artificial Sequence
  chemically synthesized
taacatacgaaggattgatagc

SEQ ID NO: 1179498 - DNA, 22 bp, Artificial Sequence
  chemically synthesized
ataacatacgaaggattgatag

SEQ ID NO: 1179499 - DNA, 22 bp, Artificial Sequence
  chemically synthesized
atatatgagggctatcaatcct

SEQ ID NO: 1179500 - DNA, 22 bp, Artificial Sequence
  chemically synthesized
tatatgagggctatcaatcctt

SEQ ID NO: 1179501 - DNA, 22 bp, Artificial Sequence
  chemically synthesized
gtaacatttataacatacgaag

SEQ ID NO: 1179502 - DNA, 22 bp, Artificial Sequence
  chemically synthesized
ttagtaacatttataacatacg

SEQ ID NO: 1179503 - DNA, 22 bp, Artificial Sequence
  chemically synthesized
tcaatccttcgtatgttataaa

SEQ ID NO: 1179504 - DNA, 22 bp, Artificial Sequence
  chemically synthesized
ggaaaattattagtaacattta

SEQ ID NO: 1179505 - DNA, 22 bp, Artificial Sequence
  chemically synthesized
cgtatgttataaatgttactaa

SEQ ID NO: 1179506 - DNA, 22 bp, Artificial Sequence
  chemically synthesized
gtatgttataaatgttactaat

SEQ ID NO: 1179507 - DNA, 22 bp, Artificial Sequence
  chemically synthesized
taaatgttactaataattttcc

SEQ ID NO: 1179508 - DNA, 22 bp, Artificial Sequence
  chemically synthesized
gaagtcaaatataaagttggga

SEQ ID NO: 1179509 - DNA, 22 bp, Artificial Sequence
  chemically synthesized
ctaataattttcccaactttat

SEQ ID NO: 1179510 - DNA, 22 bp, Artificial Sequence
  chemically synthesized
ataattttcccaactttatatt

SEQ ID NO: 1179511 - DNA, 22 bp, Artificial Sequence
  chemically synthesized
aggaaagttagaagtcaaatat

SEQ ID NO: 1179512 - DNA, 22 bp, Artificial Sequence
  chemically synthesized
tcccaactttatatttgacttc

SEQ ID NO: 1179513 - DNA, 22 bp, Artificial Sequence
  chemically synthesized
taaggaaagttagaagtcaaat

SEQ ID NO: 1179514 - DNA, 22 bp, Artificial Sequence
  chemically synthesized
cccaactttatatttgacttct

SEQ ID NO: 1179515 - DNA, 22 bp, Artificial Sequence
  chemically synthesized
ccaactttatatttgacttcta

SEQ ID NO: 1179516 - DNA, 22 bp, Artificial Sequence
  chemically synthesized
tatatttgacttctaactttcc

SEQ ID NO: 1179517 - DNA, 22 bp, Artificial Sequence
  chemically synthesized
atatttgacttctaactttcct

SEQ ID NO: 1179518 - DNA, 22 bp, Artificial Sequence
  chemically synthesized
agaaagactctaaggaaagtta

SEQ ID NO: 1179519 - DNA, 22 bp, Artificial Sequence
  chemically synthesized
tatttgacttctaactttcctt

SEQ ID NO: 1179520 - DNA, 22 bp, Artificial Sequence
  chemically synthesized
aagaaagactctaaggaaagtt

SEQ ID NO: 1179521 - DNA, 22 bp, Artificial Sequence
  chemically synthesized
taagaaagactctaaggaaagt

SEQ ID NO: 1179522 - DNA, 22 bp, Artificial Sequence
  chemically synthesized
ttaagaaagactctaaggaaag

SEQ ID NO: 1179523 - DNA, 22 bp, Artificial Sequence
  chemically synthesized
gacttctaactttccttagagt

SEQ ID NO: 1179524 - DNA, 22 bp, Artificial Sequence
  chemically synthesized
acttctaactttccttagagtc

SEQ ID NO: 1179525 - DNA, 22 bp, Artificial Sequence
  chemically synthesized
ctaactttccttagagtctttc

SEQ ID NO: 1179526 - DNA, 22 bp, Artificial Sequence
  chemically synthesized
tgatgcttttaagaaagactct

SEQ ID NO: 1179527 - DNA, 22 bp, Artificial Sequence
  chemically synthesized
taactttccttagagtctttct

SEQ ID NO: 1179528 - DNA, 22 bp, Artificial Sequence
  chemically synthesized
actttccttagagtctttctta

SEQ ID NO: 1179529 - DNA, 22 bp, Artificial Sequence
  chemically synthesized
gttatgatgcttttaagaaaga

SEQ ID NO: 1179530 - DNA, 22 bp, Artificial Sequence
  chemically synthesized
tccttagagtctttcttaaaag

SEQ ID NO: 1179531 - DNA, 22 bp, Artificial Sequence
  chemically synthesized
ccttagagtctttcttaaaagc

SEQ ID NO: 1179532 - DNA, 22 bp, Artificial Sequence
  chemically synthesized
cttagagtctttcttaaaagca

SEQ ID NO: 1179533 - DNA, 22 bp, Artificial Sequence
  chemically synthesized
agagtctttcttaaaagcatca

SEQ ID NO: 1179534 - DNA, 22 bp, Artificial Sequence
  chemically synthesized
gagtctttcttaaaagcatcat

SEQ ID NO: 1179535 - DNA, 22 bp, Artificial Sequence
  chemically synthesized
catcatgtattggttatgatgc

SEQ ID NO: 1179536 - DNA, 22 bp, Artificial Sequence
  chemically synthesized
gcatcatgtattggttatgatg

SEQ ID NO: 1179537 - DNA, 22 bp, Artificial Sequence
  chemically synthesized
ttgcatcatgtattggttatga

SEQ ID NO: 1179538 - DNA, 22 bp, Artificial Sequence
  chemically synthesized
tcttaaaagcatcataaccaat

SEQ ID NO: 1179539 - DNA, 22 bp, Artificial Sequence
  chemically synthesized
cttaaaagcatcataaccaata

SEQ ID NO: 1179540 - DNA, 22 bp, Artificial Sequence
  chemically synthesized
ttaaaagcatcataaccaatac

SEQ ID NO: 1179541 - DNA, 22 bp, Artificial Sequence
  chemically synthesized
aaaagcatcataaccaatacat

SEQ ID NO: 1179542 - DNA, 22 bp, Artificial Sequence
  chemically synthesized
aaagcatcataaccaatacatg

SEQ ID NO: 1179543 - DNA, 22 bp, Artificial Sequence
  chemically synthesized
gtatggcaattcttgcatcatg

SEQ ID NO: 1179544 - DNA, 22 bp, Artificial Sequence
  chemically synthesized
agtatggcaattcttgcatcat

SEQ ID NO: 1179545 - DNA, 22 bp, Artificial Sequence
  chemically synthesized
tggagtcaataaaggaatttag

SEQ ID NO: 1179546 - DNA, 22 bp, Artificial Sequence
  chemically synthesized
atggagtcaataaaggaattta

SEQ ID NO: 1179547 - DNA, 22 bp, Artificial Sequence
  chemically synthesized
tttatggagtcaataaaggaat

SEQ ID NO: 1179548 - DNA, 22 bp, Artificial Sequence
  chemically synthesized
ccatactaaattcctttattga

SEQ ID NO: 1179549 - DNA, 22 bp, Artificial Sequence
  chemically synthesized
attatttatggagtcaataaag

SEQ ID NO: 1179550 - DNA, 22 bp, Artificial Sequence
  chemically synthesized
tagttaattatttatggagtca

SEQ ID NO: 1179551 - DNA, 22 bp, Artificial Sequence
  chemically synthesized
aattcctttattgactccataa

SEQ ID NO: 1179552 - DNA, 22 bp, Artificial Sequence
  chemically synthesized
ctttattgactccataaataat

SEQ ID NO: 1179553 - DNA, 22 bp, Artificial Sequence
  chemically synthesized
tattgactccataaataattaa

SEQ ID NO: 1179554 - DNA, 22 bp, Artificial Sequence
  chemically synthesized
attgactccataaataattaac

SEQ ID NO: 1179555 - DNA, 22 bp, Artificial Sequence
  chemically synthesized
ttgactccataaataattaact

SEQ ID NO: 1179556 - DNA, 22 bp, Artificial Sequence
  chemically synthesized
actccataaataattaactata

SEQ ID NO: 1179557 - DNA, 22 bp, Artificial Sequence
  chemically synthesized
atagagcatgattatagttaat

SEQ ID NO: 1179558 - DNA, 22 bp, Artificial Sequence
  chemically synthesized
catagagcatgattatagttaa

SEQ ID NO: 1179559 - DNA, 22 bp, Artificial Sequence
  chemically synthesized
cataaataattaactataatca

SEQ ID NO: 1179560 - DNA, 22 bp, Artificial Sequence
  chemically synthesized
cttcatagagcatgattatagt

SEQ ID NO: 1179561 - DNA, 22 bp, Artificial Sequence
  chemically synthesized
ttgcttcatagagcatgattat

SEQ ID NO: 1179562 - DNA, 22 bp, Artificial Sequence
  chemically synthesized
tattgcttcatagagcatgatt

SEQ ID NO: 1179563 - DNA, 22 bp, Artificial Sequence
  chemically synthesized
ctattgcttcatagagcatgat

SEQ ID NO: 1179564 - DNA, 22 bp, Artificial Sequence
  chemically synthesized
actataatcatgctctatgaag

SEQ ID NO: 1179565 - DNA, 22 bp, Artificial Sequence
  chemically synthesized
acatttctattgcttcatagag

SEQ ID NO: 1179566 - DNA, 22 bp, Artificial Sequence
  chemically synthesized
aacatttctattgcttcataga

SEQ ID NO: 1179567 - DNA, 22 bp, Artificial Sequence
  chemically synthesized
taatcatgctctatgaagcaat

SEQ ID NO: 1179568 - DNA, 22 bp, Artificial Sequence
  chemically synthesized
aaaatcttaacatttctattgc

SEQ ID NO: 1179569 - DNA, 22 bp, Artificial Sequence
  chemically synthesized
aaaaatcttaacatttctattg

SEQ ID NO: 1179570 - DNA, 22 bp, Artificial Sequence
  chemically synthesized
ttaaaaatcttaacatttctat

SEQ ID NO: 1179571 - DNA, 22 bp, Artificial Sequence
  chemically synthesized
tatgaagcaatagaaatgttaa

SEQ ID NO: 1179572 - DNA, 22 bp, Artificial Sequence
  chemically synthesized
tgaagcaatagaaatgttaaga

SEQ ID NO: 1179573 - DNA, 22 bp, Artificial Sequence
  chemically synthesized
taagctcttaaaaatcttaaca

SEQ ID NO: 1179574 - DNA, 22 bp, Artificial Sequence
  chemically synthesized
ataagctcttaaaaatcttaac

SEQ ID NO: 1179575 - DNA, 22 bp, Artificial Sequence
  chemically synthesized
tataagctcttaaaaatcttaa

SEQ ID NO: 1179576 - DNA, 22 bp, Artificial Sequence
  chemically synthesized
ttataagctcttaaaaatctta

SEQ ID NO: 1179577 - DNA, 22 bp, Artificial Sequence
  chemically synthesized
agatttttaagagcttataaaa

SEQ ID NO: 1179578 - DNA, 22 bp, Artificial Sequence
  chemically synthesized
ttaagagcttataaaaacttta

SEQ ID NO: 1179579 - DNA, 22 bp, Artificial Sequence
  chemically synthesized
taagagcttataaaaactttat

SEQ ID NO: 1179580 - DNA, 22 bp, Artificial Sequence
  chemically synthesized
aagagcttataaaaactttatt

SEQ ID NO: 1179581 - DNA, 22 bp, Artificial Sequence
  chemically synthesized
agagcttataaaaactttattt

SEQ ID NO: 1179582 - DNA, 22 bp, Artificial Sequence
  chemically synthesized
ataaaaactttatttcacattt

SEQ ID NO: 1179583 - DNA, 22 bp, Artificial Sequence
  chemically synthesized
gaagccaggaataaatgtgaaa

SEQ ID NO: 1179584 - DNA, 22 bp, Artificial Sequence
  chemically synthesized
taaaaactttatttcacattta

SEQ ID NO: 1179585 - DNA, 22 bp, Artificial Sequence
  chemically synthesized
atcctagaagccaggaataaat

SEQ ID NO: 1179586 - DNA, 22 bp, Artificial Sequence
  chemically synthesized
gatcctagaagccaggaataaa

SEQ ID NO: 1179587 - DNA, 22 bp, Artificial Sequence
  chemically synthesized
tatttcacatttattcctggct

SEQ ID NO: 1179588 - DNA, 22 bp, Artificial Sequence
  chemically synthesized
atttcacatttattcctggctt

SEQ ID NO: 1179589 - DNA, 22 bp, Artificial Sequence
  chemically synthesized
tttcacatttattcctggcttc

SEQ ID NO: 1179590 - DNA, 22 bp, Artificial Sequence
  chemically synthesized
gccacttgatcctagaagccag

SEQ ID NO: 1179591 - DNA, 22 bp, Artificial Sequence
  chemically synthesized
cacatttattcctggcttctag

SEQ ID NO: 1179592 - DNA, 22 bp, Artificial Sequence
  chemically synthesized
acatttattcctggcttctagg

SEQ ID NO: 1179593 - DNA, 22 bp, Artificial Sequence
  chemically synthesized
ttggccacttgatcctagaagc

SEQ ID NO: 1179594 - DNA, 22 bp, Artificial Sequence
  chemically synthesized
attggccacttgatcctagaag

SEQ ID NO: 1179595 - DNA, 22 bp, Artificial Sequence
  chemically synthesized
cttattggccacttgatcctag

SEQ ID NO: 1179596 - DNA, 22 bp, Artificial Sequence
  chemically synthesized
attcctggcttctaggatcaag

SEQ ID NO: 1179597 - DNA, 22 bp, Artificial Sequence
  chemically synthesized
ttcctggcttctaggatcaagt

SEQ ID NO: 1179598 - DNA, 22 bp, Artificial Sequence
  chemically synthesized
ctggcttctaggatcaagtggc

SEQ ID NO: 1179599 - DNA, 22 bp, Artificial Sequence
  chemically synthesized
ataattgcttattggccacttg

SEQ ID NO: 1179600 - DNA, 22 bp, Artificial Sequence
  chemically synthesized
gcttctaggatcaagtggccaa

SEQ ID NO: 1179601 - DNA, 22 bp, Artificial Sequence
  chemically synthesized
aataattgcttattggccactt

SEQ ID NO: 1179602 - DNA, 22 bp, Artificial Sequence
  chemically synthesized
ctaggatcaagtggccaataag

SEQ ID NO: 1179603 - DNA, 22 bp, Artificial Sequence
  chemically synthesized
atttaataattgcttattggcc

SEQ ID NO: 1179604 - DNA, 22 bp, Artificial Sequence
  chemically synthesized
taggatcaagtggccaataagc

SEQ ID NO: 1179605 - DNA, 22 bp, Artificial Sequence
  chemically synthesized
ggatcaagtggccaataagcaa

SEQ ID NO: 1179606 - DNA, 22 bp, Artificial Sequence
  chemically synthesized
ccattaatttaataattgctta

SEQ ID NO: 1179607 - DNA, 22 bp, Artificial Sequence
  chemically synthesized
tagtattaccattaatttaata

SEQ ID NO: 1179608 - DNA, 22 bp, Artificial Sequence
  chemically synthesized
ttaaattaatggtaatactaca

SEQ ID NO: 1179609 - DNA, 22 bp, Artificial Sequence
  chemically synthesized
aattaatggtaatactacagtg

SEQ ID NO: 1179610 - DNA, 22 bp, Artificial Sequence
  chemically synthesized
atggtaatactacagtgcttcc

SEQ ID NO: 1179611 - DNA, 22 bp, Artificial Sequence
  chemically synthesized
aggaacaagtatgccggaagca

SEQ ID NO: 1179612 - DNA, 22 bp, Artificial Sequence
  chemically synthesized
cagtgcttccggcatacttgtt

SEQ ID NO: 1179613 - DNA, 22 bp, Artificial Sequence
  chemically synthesized
aaatagttcaggaacaagtatg

SEQ ID NO: 1179614 - DNA, 22 bp, Artificial Sequence
  chemically synthesized
gtacctcaaatagttcaggaac

SEQ ID NO: 1179615 - DNA, 22 bp, Artificial Sequence
  chemically synthesized
ccggcatacttgttcctgaact

SEQ ID NO: 1179616 - DNA, 22 bp, Artificial Sequence
  chemically synthesized
ggtacctcaaatagttcaggaa

SEQ ID NO: 1179617 - DNA, 22 bp, Artificial Sequence
  chemically synthesized
cggcatacttgttcctgaacta

SEQ ID NO: 1179618 - DNA, 22 bp, Artificial Sequence
  chemically synthesized
tttggtacctcaaatagttcag

SEQ ID NO: 1179619 - DNA, 22 bp, Artificial Sequence
  chemically synthesized
actatttggtacctcaaatagt

SEQ ID NO: 1179620 - DNA, 22 bp, Artificial Sequence
  chemically synthesized
aactatttggtacctcaaatag

SEQ ID NO: 1179621 - DNA, 22 bp, Artificial Sequence
  chemically synthesized
taactatttggtacctcaaata

SEQ ID NO: 1179622 - DNA, 22 bp, Artificial Sequence
  chemically synthesized
gttcctgaactatttgaggtac

SEQ ID NO: 1179623 - DNA, 22 bp, Artificial Sequence
  chemically synthesized
ttcctgaactatttgaggtacc

SEQ ID NO: 1179624 - DNA, 22 bp, Artificial Sequence
  chemically synthesized
ctgaactatttgaggtaccaaa

SEQ ID NO: 1179625 - DNA, 22 bp, Artificial Sequence
  chemically synthesized
aactatttgaggtaccaaatag

SEQ ID NO: 1179626 - DNA, 22 bp, Artificial Sequence
  chemically synthesized
aagtcattttaactatttggta

SEQ ID NO: 1179627 - DNA, 22 bp, Artificial Sequence
  chemically synthesized
tttgaggtaccaaatagttaaa

SEQ ID NO: 1179628 - DNA, 22 bp, Artificial Sequence
  chemically synthesized
gaggtaccaaatagttaaaatg

SEQ ID NO: 1179629 - DNA, 22 bp, Artificial Sequence
  chemically synthesized
ggtgattaaagtcattttaact

SEQ ID NO: 1179630 - DNA, 22 bp, Artificial Sequence
  chemically synthesized
aggtaccaaatagttaaaatga

SEQ ID NO: 1179631 - DNA, 22 bp, Artificial Sequence
  chemically synthesized
aggtgagctaggtgattaaagt

SEQ ID NO: 1179632 - DNA, 22 bp, Artificial Sequence
  chemically synthesized
caggtgagctaggtgattaaag

SEQ ID NO: 1179633 - DNA, 22 bp, Artificial Sequence
  chemically synthesized
aatttcaggtgagctaggtgat

SEQ ID NO: 1179634 - DNA, 22 bp, Artificial Sequence
  chemically synthesized
aaatgactttaatcacctagct

SEQ ID NO: 1179635 - DNA, 22 bp, Artificial Sequence
  chemically synthesized
aaatttcaggtgagctaggtga

SEQ ID NO: 1179636 - DNA, 22 bp, Artificial Sequence
  chemically synthesized
taatttaaatttcaggtgagct

SEQ ID NO: 1179637 - DNA, 22 bp, Artificial Sequence
  chemically synthesized
ataatttaaatttcaggtgagc

SEQ ID NO: 1179638 - DNA, 22 bp, Artificial Sequence
  chemically synthesized
tataatttaaatttcaggtgag

SEQ ID NO: 1179639 - DNA, 22 bp, Artificial Sequence
  chemically synthesized
taatcacctagctcacctgaaa

SEQ ID NO: 1179640 - DNA, 22 bp, Artificial Sequence
  chemically synthesized
aatcacctagctcacctgaaat

SEQ ID NO: 1179641 - DNA, 22 bp, Artificial Sequence
  chemically synthesized
atcacctagctcacctgaaatt

SEQ ID NO: 1179642 - DNA, 22 bp, Artificial Sequence
  chemically synthesized
ctttataatttaaatttcaggt

SEQ ID NO: 1179643 - DNA, 22 bp, Artificial Sequence
  chemically synthesized
tactttataatttaaatttcag

SEQ ID NO: 1179644 - DNA, 22 bp, Artificial Sequence
  chemically synthesized
ctactttataatttaaatttca

SEQ ID NO: 1179645 - DNA, 22 bp, Artificial Sequence
  chemically synthesized
cttctactttataatttaaatt

SEQ ID NO: 1179646 - DNA, 22 bp, Artificial Sequence
  chemically synthesized
gctcacctgaaatttaaattat

SEQ ID NO: 1179647 - DNA, 22 bp, Artificial Sequence
  chemically synthesized
tacttctactttataatttaaa

SEQ ID NO: 1179648 - DNA, 22 bp, Artificial Sequence
  chemically synthesized
ctacttctactttataatttaa

SEQ ID NO: 1179649 - DNA, 22 bp, Artificial Sequence
  chemically synthesized
ttctacttctactttataattt

SEQ ID NO: 1179650 - DNA, 22 bp, Artificial Sequence
  chemically synthesized
acctgaaatttaaattataaag

SEQ ID NO: 1179651 - DNA, 22 bp, Artificial Sequence
  chemically synthesized
aaatttaaattataaagtagaa

SEQ ID NO: 1179652 - DNA, 22 bp, Artificial Sequence
  chemically synthesized
aaattataaagtagaagtagaa

SEQ ID NO: 1179653 - DNA, 22 bp, Artificial Sequence
  chemically synthesized
gcccgtggattcttctacttct

SEQ ID NO: 1179654 - DNA, 22 bp, Artificial Sequence
  chemically synthesized
aattataaagtagaagtagaag

SEQ ID NO: 1179655 - DNA, 22 bp, Artificial Sequence
  chemically synthesized
taaagtagaagtagaagaatcc

SEQ ID NO: 1179656 - DNA, 22 bp, Artificial Sequence
  chemically synthesized
atggaatgagaaataagattag

SEQ ID NO: 1179657 - DNA, 22 bp, Artificial Sequence
  chemically synthesized
gatcattaatggaatgagaaat

SEQ ID NO: 1179658 - DNA, 22 bp, Artificial Sequence
  chemically synthesized
agatcattaatggaatgagaaa

SEQ ID NO: 1179659 - DNA, 22 bp, Artificial Sequence
  chemically synthesized
atcttatttctcattccattaa

SEQ ID NO: 1179660 - DNA, 22 bp, Artificial Sequence
  chemically synthesized
atttctcattccattaatgatc

SEQ ID NO: 1179661 - DNA, 22 bp, Artificial Sequence
  chemically synthesized
tttctcattccattaatgatct

SEQ ID NO: 1179662 - DNA, 22 bp, Artificial Sequence
  chemically synthesized
aagaagaaatttagatcattaa

SEQ ID NO: 1179663 - DNA, 22 bp, Artificial Sequence
  chemically synthesized
caagaagaaatttagatcatta

SEQ ID NO: 1179664 - DNA, 22 bp, Artificial Sequence
  chemically synthesized
ctcattccattaatgatctaaa

SEQ ID NO: 1179665 - DNA, 22 bp, Artificial Sequence
  chemically synthesized
tcattccattaatgatctaaat

SEQ ID NO: 1179666 - DNA, 22 bp, Artificial Sequence
  chemically synthesized
attccattaatgatctaaattt

SEQ ID NO: 1179667 - DNA, 22 bp, Artificial Sequence
  chemically synthesized
cattaatgatctaaatttcttc

SEQ ID NO: 1179668 - DNA, 22 bp, Artificial Sequence
  chemically synthesized
aaaaagtcatttcaagaagaaa

SEQ ID NO: 1179669 - DNA, 22 bp, Artificial Sequence
  chemically synthesized
atgatctaaatttcttcttgaa

SEQ ID NO: 1179670 - DNA, 22 bp, Artificial Sequence
  chemically synthesized
taatacctgaaaaagtcatttc

SEQ ID NO: 1179671 - DNA, 22 bp, Artificial Sequence
  chemically synthesized
aatttcttcttgaaatgacttt

SEQ ID NO: 1179672 - DNA, 22 bp, Artificial Sequence
  chemically synthesized
ataatacctgaaaaagtcattt

SEQ ID NO: 1179673 - DNA, 22 bp, Artificial Sequence
  chemically synthesized
tataatacctgaaaaagtcatt

SEQ ID NO: 1179674 - DNA, 22 bp, Artificial Sequence
  chemically synthesized
ctttataatacctgaaaaagtc

SEQ ID NO: 1179675 - DNA, 22 bp, Artificial Sequence
  chemically synthesized
cttcttgaaatgactttttcag

SEQ ID NO: 1179676 - DNA, 22 bp, Artificial Sequence
  chemically synthesized
actttataatacctgaaaaagt

SEQ ID NO: 1179677 - DNA, 22 bp, Artificial Sequence
  chemically synthesized
ttcttgaaatgactttttcagg

SEQ ID NO: 1179678 - DNA, 22 bp, Artificial Sequence
  chemically synthesized
cttgaaatgactttttcaggta

SEQ ID NO: 1179679 - DNA, 22 bp, Artificial Sequence
  chemically synthesized
ttgaaatgactttttcaggtat

SEQ ID NO: 1179680 - DNA, 22 bp, Artificial Sequence
  chemically synthesized
gaaatgactttttcaggtatta

SEQ ID NO: 1179681 - DNA, 22 bp, Artificial Sequence
  chemically synthesized
aaatttactttataatacctga

SEQ ID NO: 1179682 - DNA, 22 bp, Artificial Sequence
  chemically synthesized
aaatgactttttcaggtattat

SEQ ID NO: 1179683 - DNA, 22 bp, Artificial Sequence
  chemically synthesized
aaacattcaaatttactttata

SEQ ID NO: 1179684 - DNA, 22 bp, Artificial Sequence
  chemically synthesized
tttcaggtattataaagtaaat

SEQ ID NO: 1179685 - DNA, 22 bp, Artificial Sequence
  chemically synthesized
tgaaacattcaaatttacttta

SEQ ID NO: 1179686 - DNA, 22 bp, Artificial Sequence
  chemically synthesized
ttcaggtattataaagtaaatt

SEQ ID NO: 1179687 - DNA, 22 bp, Artificial Sequence
  chemically synthesized
ctgaaacattcaaatttacttt

SEQ ID NO: 1179688 - DNA, 22 bp, Artificial Sequence
  chemically synthesized
tcaggtattataaagtaaattt

SEQ ID NO: 1179689 - DNA, 22 bp, Artificial Sequence
  chemically synthesized
tctgaaacattcaaatttactt

SEQ ID NO: 1179690 - DNA, 22 bp, Artificial Sequence
  chemically synthesized
caggtattataaagtaaatttg

SEQ ID NO: 1179691 - DNA, 22 bp, Artificial Sequence
  chemically synthesized
aggtattataaagtaaatttga

SEQ ID NO: 1179692 - DNA, 22 bp, Artificial Sequence
  chemically synthesized
tttctgaaacattcaaatttac

SEQ ID NO: 1179693 - DNA, 22 bp, Artificial Sequence
  chemically synthesized
taaagtaaatttgaatgtttca

SEQ ID NO: 1179694 - DNA, 22 bp, Artificial Sequence
  chemically synthesized
agatatgtagtcctctttctga

SEQ ID NO: 1179695 - DNA, 22 bp, Artificial Sequence
  chemically synthesized
ctaagatatgtagtcctctttc

SEQ ID NO: 1179696 - DNA, 22 bp, Artificial Sequence
  chemically synthesized
cctaagatatgtagtcctcttt

SEQ ID NO: 1179697 - DNA, 22 bp, Artificial Sequence
  chemically synthesized
gaatgtttcagaaagaggacta

SEQ ID NO: 1179698 - DNA, 22 bp, Artificial Sequence
  chemically synthesized
aatgtttcagaaagaggactac

SEQ ID NO: 1179699 - DNA, 22 bp, Artificial Sequence
  chemically synthesized
cttcctaagatatgtagtcctc

SEQ ID NO: 1179700 - DNA, 22 bp, Artificial Sequence
  chemically synthesized
tctgcttcctaagatatgtagt

SEQ ID NO: 1179701 - DNA, 22 bp, Artificial Sequence
  chemically synthesized
cagaaagaggactacatatctt

SEQ ID NO: 1179702 - DNA, 22 bp, Artificial Sequence
  chemically synthesized
agaaagaggactacatatctta

SEQ ID NO: 1179703 - DNA, 22 bp, Artificial Sequence
  chemically synthesized
catatcttaggaagcagataat

SEQ ID NO: 1179704 - DNA, 22 bp, Artificial Sequence
  chemically synthesized
aatccagtggcaattatctgct

SEQ ID NO: 1179705 - DNA, 22 bp, Artificial Sequence
  chemically synthesized
ctaaatccagtggcaattatct

SEQ ID NO: 1179706 - DNA, 22 bp, Artificial Sequence
  chemically synthesized
aggaagcagataattgccactg

SEQ ID NO: 1179707 - DNA, 22 bp, Artificial Sequence
  chemically synthesized
ggaagcagataattgccactgg

SEQ ID NO: 1179708 - DNA, 22 bp, Artificial Sequence
  chemically synthesized
tgtgtcagattgctaaatccag

SEQ ID NO: 1179709 - DNA, 22 bp, Artificial Sequence
  chemically synthesized
tattgtgtgtcagattgctaaa

SEQ ID NO: 1179710 - DNA, 22 bp, Artificial Sequence
  chemically synthesized
tatattgtgtgtcagattgcta

SEQ ID NO: 1179711 - DNA, 22 bp, Artificial Sequence
  chemically synthesized
ctatattgtgtgtcagattgct

SEQ ID NO: 1179712 - DNA, 22 bp, Artificial Sequence
  chemically synthesized
ccactggatttagcaatctgac

SEQ ID NO: 1179713 - DNA, 22 bp, Artificial Sequence
  chemically synthesized
gatttagcaatctgacacacaa

SEQ ID NO: 1179714 - DNA, 22 bp, Artificial Sequence
  chemically synthesized
gaaatttctatattgtgtgtca

SEQ ID NO: 1179715 - DNA, 22 bp, Artificial Sequence
  chemically synthesized
attagaaatttctatattgtgt

SEQ ID NO: 1179716 - DNA, 22 bp, Artificial Sequence
  chemically synthesized
agcaatctgacacacaatatag

SEQ ID NO: 1179717 - DNA, 22 bp, Artificial Sequence
  chemically synthesized
aattagaaatttctatattgtg

SEQ ID NO: 1179718 - DNA, 22 bp, Artificial Sequence
  chemically synthesized
gcaatctgacacacaatataga

SEQ ID NO: 1179719 - DNA, 22 bp, Artificial Sequence
  chemically synthesized
taattagaaatttctatattgt

SEQ ID NO: 1179720 - DNA, 22 bp, Artificial Sequence
  chemically synthesized
acacacaatatagaaatttcta

SEQ ID NO: 1179721 - DNA, 22 bp, Artificial Sequence
  chemically synthesized
taaaaatagaactttaattaga

SEQ ID NO: 1179722 - DNA, 22 bp, Artificial Sequence
  chemically synthesized
gcattataaaaatagaacttta

SEQ ID NO: 1179723 - DNA, 22 bp, Artificial Sequence
  chemically synthesized
ctaattaaagttctatttttat

SEQ ID NO: 1179724 - DNA, 22 bp, Artificial Sequence
  chemically synthesized
taattaaagttctatttttata

SEQ ID NO: 1179725 - DNA, 22 bp, Artificial Sequence
  chemically synthesized
aaagattagcattataaaaata

SEQ ID NO: 1179726 - DNA, 22 bp, Artificial Sequence
  chemically synthesized
attaaagttctatttttataat

SEQ ID NO: 1179727 - DNA, 22 bp, Artificial Sequence
  chemically synthesized
gctgaaagattagcattataaa

SEQ ID NO: 1179728 - DNA, 22 bp, Artificial Sequence
  chemically synthesized
ggctgaaagattagcattataa

SEQ ID NO: 1179729 - DNA, 22 bp, Artificial Sequence
  chemically synthesized
aagttctatttttataatgcta

SEQ ID NO: 1179730 - DNA, 22 bp, Artificial Sequence
  chemically synthesized
tggctgaaagattagcattata

SEQ ID NO: 1179731 - DNA, 22 bp, Artificial Sequence
  chemically synthesized
ttggctgaaagattagcattat

SEQ ID NO: 1179732 - DNA, 22 bp, Artificial Sequence
  chemically synthesized
tatttttataatgctaatcttt

SEQ ID NO: 1179733 - DNA, 22 bp, Artificial Sequence
  chemically synthesized
tttttataatgctaatctttca

SEQ ID NO: 1179734 - DNA, 22 bp, Artificial Sequence
  chemically synthesized
ttataatgctaatctttcagcc

SEQ ID NO: 1179735 - DNA, 22 bp, Artificial Sequence
  chemically synthesized
tataatgctaatctttcagcca

SEQ ID NO: 1179736 - DNA, 22 bp, Artificial Sequence
  chemically synthesized
ataatgctaatctttcagccaa

SEQ ID NO: 1179737 - DNA, 22 bp, Artificial Sequence
  chemically synthesized
taatgctaatctttcagccaaa

SEQ ID NO: 1179738 - DNA, 22 bp, Artificial Sequence
  chemically synthesized
atctttcagccaaaaatttcct

SEQ ID NO: 1179739 - DNA, 22 bp, Artificial Sequence
  chemically synthesized
taacatgtcccaaggaaatttt

SEQ ID NO: 1179740 - DNA, 22 bp, Artificial Sequence
  chemically synthesized
attataacatgtcccaaggaaa

SEQ ID NO: 1179741 - DNA, 22 bp, Artificial Sequence
  chemically synthesized
tcagccaaaaatttccttggga

SEQ ID NO: 1179742 - DNA, 22 bp, Artificial Sequence
  chemically synthesized
cattataacatgtcccaaggaa

SEQ ID NO: 1179743 - DNA, 22 bp, Artificial Sequence
  chemically synthesized
cagccaaaaatttccttgggac

SEQ ID NO: 1179744 - DNA, 22 bp, Artificial Sequence
  chemically synthesized
agccaaaaatttccttgggaca

SEQ ID NO: 1179745 - DNA, 22 bp, Artificial Sequence
  chemically synthesized
tcttcattataacatgtcccaa

SEQ ID NO: 1179746 - DNA, 22 bp, Artificial Sequence
  chemically synthesized
atcttcattataacatgtccca

SEQ ID NO: 1179747 - DNA, 22 bp, Artificial Sequence
  chemically synthesized
tatcttcattataacatgtccc

SEQ ID NO: 1179748 - DNA, 22 bp, Artificial Sequence
  chemically synthesized
ccttgggacatgttataatgaa

SEQ ID NO: 1179749 - DNA, 22 bp, Artificial Sequence
  chemically synthesized
gtacattttatcttcattataa

SEQ ID NO: 1179750 - DNA, 22 bp, Artificial Sequence
  chemically synthesized
cttgggacatgttataatgaag

SEQ ID NO: 1179751 - DNA, 22 bp, Artificial Sequence
  chemically synthesized
agtacattttatcttcattata

SEQ ID NO: 1179752 - DNA, 22 bp, Artificial Sequence
  chemically synthesized
gggacatgttataatgaagata

SEQ ID NO: 1179753 - DNA, 22 bp, Artificial Sequence
  chemically synthesized
ggacatgttataatgaagataa

SEQ ID NO: 1179754 - DNA, 22 bp, Artificial Sequence
  chemically synthesized
aaatcttagtacattttatctt

SEQ ID NO: 1179755 - DNA, 22 bp, Artificial Sequence
  chemically synthesized
aaaatcttagtacattttatct

SEQ ID NO: 1179756 - DNA, 22 bp, Artificial Sequence
  chemically synthesized
taatgaagataaaatgtactaa

SEQ ID NO: 1179757 - DNA, 22 bp, Artificial Sequence
  chemically synthesized
gtcaatttaaaatcttagtaca

SEQ ID NO: 1179758 - DNA, 22 bp, Artificial Sequence
  chemically synthesized
tggtcaatttaaaatcttagta

SEQ ID NO: 1179759 - DNA, 22 bp, Artificial Sequence
  chemically synthesized
ggaactctggtcaatttaaaat

SEQ ID NO: 1179760 - DNA, 22 bp, Artificial Sequence
  chemically synthesized
tgggaactctggtcaatttaaa

SEQ ID NO: 1179761 - DNA, 22 bp, Artificial Sequence
  chemically synthesized
agattttaaattgaccagagtt

SEQ ID NO: 1179762 - DNA, 22 bp, Artificial Sequence
  chemically synthesized
ggtgtctctgggaactctggtc

SEQ ID NO: 1179763 - DNA, 22 bp, Artificial Sequence
  chemically synthesized
ttaggtgtctctgggaactctg

SEQ ID NO: 1179764 - DNA, 22 bp, Artificial Sequence
  chemically synthesized
attaggtgtctctgggaactct

SEQ ID NO: 1179765 - DNA, 22 bp, Artificial Sequence
  chemically synthesized
taaattgaccagagttcccaga

SEQ ID NO: 1179766 - DNA, 22 bp, Artificial Sequence
  chemically synthesized
aaattgaccagagttcccagag

SEQ ID NO: 1179767 - DNA, 22 bp, Artificial Sequence
  chemically synthesized
aattgaccagagttcccagaga

SEQ ID NO: 1179768 - DNA, 22 bp, Artificial Sequence
  chemically synthesized
accagagttcccagagacacct

SEQ ID NO: 1179769 - DNA, 22 bp, Artificial Sequence
  chemically synthesized
tgaaaatgtttattaggtgtct

SEQ ID NO: 1179770 - DNA, 22 bp, Artificial Sequence
  chemically synthesized
atgaaaatgtttattaggtgtc

SEQ ID NO: 1179771 - DNA, 22 bp, Artificial Sequence
  chemically synthesized
ccagagacacctaataaacatt

SEQ ID NO: 1179772 - DNA, 22 bp, Artificial Sequence
  chemically synthesized
tagtgaatatttatgaaaatgt

SEQ ID NO: 1179773 - DNA, 22 bp, Artificial Sequence
  chemically synthesized
atagtgaatatttatgaaaatg

SEQ ID NO: 1179774 - DNA, 22 bp, Artificial Sequence
  chemically synthesized
cttatagtgaatatttatgaaa

SEQ ID NO: 1179775 - DNA, 22 bp, Artificial Sequence
  chemically synthesized
acttatagtgaatatttatgaa

SEQ ID NO: 1179776 - DNA, 22 bp, Artificial Sequence
  chemically synthesized
ataaacattttcataaatattc

SEQ ID NO: 1179777 - DNA, 22 bp, Artificial Sequence
  chemically synthesized
acaataaaacttacttatagtg

SEQ ID NO: 1179778 - DNA, 22 bp, Artificial Sequence
  chemically synthesized
tcataaatattcactataagta

SEQ ID NO: 1179779 - DNA, 22 bp, Artificial Sequence
  chemically synthesized
cacaataaaacttacttatagt

SEQ ID NO: 1179780 - DNA, 22 bp, Artificial Sequence
  chemically synthesized
cataaatattcactataagtaa

SEQ ID NO: 1179781 - DNA, 22 bp, Artificial Sequence
  chemically synthesized
ataaatattcactataagtaag

SEQ ID NO: 1179782 - DNA, 22 bp, Artificial Sequence
  chemically synthesized
cttcacaataaaacttacttat

SEQ ID NO: 1179783 - DNA, 22 bp, Artificial Sequence
  chemically synthesized
actataagtaagttttattgtg

SEQ ID NO: 1179784 - DNA, 22 bp, Artificial Sequence
  chemically synthesized
taagtaagttttattgtgaagt

SEQ ID NO: 1179785 - DNA, 22 bp, Artificial Sequence
  chemically synthesized
tattgtgaagtaatcccattgt

SEQ ID NO: 1179786 - DNA, 22 bp, Artificial Sequence
  chemically synthesized
attgtgaagtaatcccattgtt

SEQ ID NO: 1179787 - DNA, 22 bp, Artificial Sequence
  chemically synthesized
ttgtgaagtaatcccattgtta

SEQ ID NO: 1179788 - DNA, 22 bp, Artificial Sequence
  chemically synthesized
tgaagtaatcccattgttatac

SEQ ID NO: 1179789 - DNA, 22 bp, Artificial Sequence
  chemically synthesized
ttatacatacctctcatcattg

SEQ ID NO: 1179790 - DNA, 22 bp, Artificial Sequence
  chemically synthesized
aagtgtaatgatgccaatgatg

SEQ ID NO: 1179791 - DNA, 22 bp, Artificial Sequence
  chemically synthesized
tacatacctctcatcattggca

SEQ ID NO: 1179792 - DNA, 22 bp, Artificial Sequence
  chemically synthesized
aaagtgtaatgatgccaatgat

SEQ ID NO: 1179793 - DNA, 22 bp, Artificial Sequence
  chemically synthesized
tttaaagtgtaatgatgccaat

SEQ ID NO: 1179794 - DNA, 22 bp, Artificial Sequence
  chemically synthesized
atttaaagtgtaatgatgccaa

SEQ ID NO: 1179795 - DNA, 22 bp, Artificial Sequence
  chemically synthesized
tcatcattggcatcattacact

SEQ ID NO: 1179796 - DNA, 22 bp, Artificial Sequence
  chemically synthesized
atcattggcatcattacacttt

SEQ ID NO: 1179797 - DNA, 22 bp, Artificial Sequence
  chemically synthesized
ggtaacttatttaaagtgtaat

SEQ ID NO: 1179798 - DNA, 22 bp, Artificial Sequence
  chemically synthesized
ttaggtaacttatttaaagtgt

SEQ ID NO: 1179799 - DNA, 22 bp, Artificial Sequence
  chemically synthesized
tattaggtaacttatttaaagt

SEQ ID NO: 1179800 - DNA, 22 bp, Artificial Sequence
  chemically synthesized
ctattaggtaacttatttaaag

SEQ ID NO: 1179801 - DNA, 22 bp, Artificial Sequence
  chemically synthesized
gcatcattacactttaaataag

SEQ ID NO: 1179802 - DNA, 22 bp, Artificial Sequence
  chemically synthesized
cttctattaggtaacttattta

SEQ ID NO: 1179803 - DNA, 22 bp, Artificial Sequence
  chemically synthesized
acttctattaggtaacttattt

SEQ ID NO: 1179804 - DNA, 22 bp, Artificial Sequence
  chemically synthesized
cactttaaataagttacctaat

SEQ ID NO: 1179805 - DNA, 22 bp, Artificial Sequence
  chemically synthesized
aatacttacttctattaggtaa

SEQ ID NO: 1179806 - DNA, 22 bp, Artificial Sequence
  chemically synthesized
aaatacttacttctattaggta

SEQ ID NO: 1179807 - DNA, 22 bp, Artificial Sequence
  chemically synthesized
taaatacttacttctattaggt

SEQ ID NO: 1179808 - DNA, 22 bp, Artificial Sequence
  chemically synthesized
taaataagttacctaatagaag

SEQ ID NO: 1179809 - DNA, 22 bp, Artificial Sequence
  chemically synthesized
aaataagttacctaatagaagt

SEQ ID NO: 1179810 - DNA, 22 bp, Artificial Sequence
  chemically synthesized
aataagttacctaatagaagta

SEQ ID NO: 1179811 - DNA, 22 bp, Artificial Sequence
  chemically synthesized
gcattttaaatacttacttcta

SEQ ID NO: 1179812 - DNA, 22 bp, Artificial Sequence
  chemically synthesized
agcattttaaatacttacttct

SEQ ID NO: 1179813 - DNA, 22 bp, Artificial Sequence
  chemically synthesized
cctaatagaagtaagtatttaa

SEQ ID NO: 1179814 - DNA, 22 bp, Artificial Sequence
  chemically synthesized
aagcttagcattttaaatactt

SEQ ID NO: 1179815 - DNA, 22 bp, Artificial Sequence
  chemically synthesized
caagcttagcattttaaatact

SEQ ID NO: 1179816 - DNA, 22 bp, Artificial Sequence
  chemically synthesized
tcaagcttagcattttaaatac

SEQ ID NO: 1179817 - DNA, 22 bp, Artificial Sequence
  chemically synthesized
atagaagtaagtatttaaaatg

SEQ ID NO: 1179818 - DNA, 22 bp, Artificial Sequence
  chemically synthesized
aaaatgctaagcttgaaaatct

SEQ ID NO: 1179819 - DNA, 22 bp, Artificial Sequence
  chemically synthesized
aaatgctaagcttgaaaatctg

SEQ ID NO: 1179820 - DNA, 22 bp, Artificial Sequence
  chemically synthesized
tgtgtagcaaatccagattttc

SEQ ID NO: 1179821 - DNA, 22 bp, Artificial Sequence
  chemically synthesized
atgtgtagcaaatccagatttt

SEQ ID NO: 1179822 - DNA, 22 bp, Artificial Sequence
  chemically synthesized
tatgtgtagcaaatccagattt

SEQ ID NO: 1179823 - DNA, 22 bp, Artificial Sequence
  chemically synthesized
ttatgtgtagcaaatccagatt

SEQ ID NO: 1179824 - DNA, 22 bp, Artificial Sequence
  chemically synthesized
ttttatgtgtagcaaatccaga

SEQ ID NO: 1179825 - DNA, 22 bp, Artificial Sequence
  chemically synthesized
agcttgaaaatctggatttgct

SEQ ID NO: 1179826 - DNA, 22 bp, Artificial Sequence
  chemically synthesized
ctcttttatgtgtagcaaatcc

SEQ ID NO: 1179827 - DNA, 22 bp, Artificial Sequence
  chemically synthesized
gaaaatctggatttgctacaca

SEQ ID NO: 1179828 - DNA, 22 bp, Artificial Sequence
  chemically synthesized
aaaatctggatttgctacacat

SEQ ID NO: 1179829 - DNA, 22 bp, Artificial Sequence
  chemically synthesized
gatttgctacacataaaagagg

SEQ ID NO: 1179830 - DNA, 22 bp, Artificial Sequence
  chemically synthesized
cataaagtcatgttcctctttt

SEQ ID NO: 1179831 - DNA, 22 bp, Artificial Sequence
  chemically synthesized
gctacacataaaagaggaacat

SEQ ID NO: 1179832 - DNA, 22 bp, Artificial Sequence
  chemically synthesized
ctacacataaaagaggaacatg

SEQ ID NO: 1179833 - DNA, 22 bp, Artificial Sequence
  chemically synthesized
agctacataaagtcatgttcct

SEQ ID NO: 1179834 - DNA, 22 bp, Artificial Sequence
  chemically synthesized
cacataaaagaggaacatgact

SEQ ID NO: 1179835 - DNA, 22 bp, Artificial Sequence
  chemically synthesized
cataccaattcagctacataaa

SEQ ID NO: 1179836 - DNA, 22 bp, Artificial Sequence
  chemically synthesized
gatcatctgcataccaattcag

SEQ ID NO: 1179837 - DNA, 22 bp, Artificial Sequence
  chemically synthesized
tagatcatctgcataccaattc

SEQ ID NO: 1179838 - DNA, 22 bp, Artificial Sequence
  chemically synthesized
ctagatcatctgcataccaatt

SEQ ID NO: 1179839 - DNA, 22 bp, Artificial Sequence
  chemically synthesized
tatgtagctgaattggtatgca

SEQ ID NO: 1179840 - DNA, 22 bp, Artificial Sequence
  chemically synthesized
atgtagctgaattggtatgcag

SEQ ID NO: 1179841 - DNA, 22 bp, Artificial Sequence
  chemically synthesized
tgtagctgaattggtatgcaga

SEQ ID NO: 1179842 - DNA, 22 bp, Artificial Sequence
  chemically synthesized
atttctagatcatctgcatacc

SEQ ID NO: 1179843 - DNA, 22 bp, Artificial Sequence
  chemically synthesized
ctcatttctagatcatctgcat

SEQ ID NO: 1179844 - DNA, 22 bp, Artificial Sequence
  chemically synthesized
aattggtatgcagatgatctag

SEQ ID NO: 1179845 - DNA, 22 bp, Artificial Sequence
  chemically synthesized
tgaaactcctcatttctagatc

SEQ ID NO: 1179846 - DNA, 22 bp, Artificial Sequence
  chemically synthesized
gtatgcagatgatctagaaatg

SEQ ID NO: 1179847 - DNA, 22 bp, Artificial Sequence
  chemically synthesized
atggtatcgttatgaaactcct

SEQ ID NO: 1179848 - DNA, 22 bp, Artificial Sequence
  chemically synthesized
gaaatgaggagtttcataacga

SEQ ID NO: 1179849 - DNA, 22 bp, Artificial Sequence
  chemically synthesized
atgatgagttgatggtatcgtt

SEQ ID NO: 1179850 - DNA, 22 bp, Artificial Sequence
  chemically synthesized
cataacgataccatcaactcat

SEQ ID NO: 1179851 - DNA, 22 bp, Artificial Sequence
  chemically synthesized
gaaggattaatgatgagttgat

SEQ ID NO: 1179852 - DNA, 22 bp, Artificial Sequence
  chemically synthesized
ataacgataccatcaactcatc

SEQ ID NO: 1179853 - DNA, 22 bp, Artificial Sequence
  chemically synthesized
ggaaggattaatgatgagttga

SEQ ID NO: 1179854 - DNA, 22 bp, Artificial Sequence
  chemically synthesized
tggaaggattaatgatgagttg

SEQ ID NO: 1179855 - DNA, 22 bp, Artificial Sequence
  chemically synthesized
tctttggaaggattaatgatga

SEQ ID NO: 1179856 - DNA, 22 bp, Artificial Sequence
  chemically synthesized
gggaaataaactatctttggaa

SEQ ID NO: 1179857 - DNA, 22 bp, Artificial Sequence
  chemically synthesized
atcattaatccttccaaagata

SEQ ID NO: 1179858 - DNA, 22 bp, Artificial Sequence
  chemically synthesized
ggggaaataaactatctttgga

SEQ ID NO: 1179859 - DNA, 22 bp, Artificial Sequence
  chemically synthesized
tggggaaataaactatctttgg

SEQ ID NO: 1179860 - DNA, 22 bp, Artificial Sequence
  chemically synthesized
atccttccaaagatagtttatt

SEQ ID NO: 1179861 - DNA, 22 bp, Artificial Sequence
  chemically synthesized
aatctttggggaaataaactat

SEQ ID NO: 1179862 - DNA, 22 bp, Artificial Sequence
  chemically synthesized
ccaaagatagtttatttcccca

SEQ ID NO: 1179863 - DNA, 22 bp, Artificial Sequence
  chemically synthesized
caaagatagtttatttccccaa

SEQ ID NO: 1179864 - DNA, 22 bp, Artificial Sequence
  chemically synthesized
tcaattaaatctttggggaaat

SEQ ID NO: 1179865 - DNA, 22 bp, Artificial Sequence
  chemically synthesized
tgagaatgctatcaattaaatc

SEQ ID NO: 1179866 - DNA, 22 bp, Artificial Sequence
  chemically synthesized
atttccccaaagatttaattga

SEQ ID NO: 1179867 - DNA, 22 bp, Artificial Sequence
  chemically synthesized
tttccccaaagatttaattgat

SEQ ID NO: 1179868 - DNA, 22 bp, Artificial Sequence
  chemically synthesized
ccccaaagatttaattgatagc

SEQ ID NO: 1179869 - DNA, 22 bp, Artificial Sequence
  chemically synthesized
aattatgagaatgctatcaatt

SEQ ID NO: 1179870 - DNA, 22 bp, Artificial Sequence
  chemically synthesized
cccaaagatttaattgatagca

SEQ ID NO: 1179871 - DNA, 22 bp, Artificial Sequence
  chemically synthesized
aaattatgagaatgctatcaat

SEQ ID NO: 1179872 - DNA, 22 bp, Artificial Sequence
  chemically synthesized
taaattatgagaatgctatcaa

SEQ ID NO: 1179873 - DNA, 22 bp, Artificial Sequence
  chemically synthesized
ttaaattatgagaatgctatca

SEQ ID NO: 1179874 - DNA, 22 bp, Artificial Sequence
  chemically synthesized
tttaaattatgagaatgctatc

SEQ ID NO: 1179875 - DNA, 22 bp, Artificial Sequence
  chemically synthesized
aattgatagcattctcataatt

SEQ ID NO: 1179876 - DNA, 22 bp, Artificial Sequence
  chemically synthesized
attgatagcattctcataattt

SEQ ID NO: 1179877 - DNA, 22 bp, Artificial Sequence
  chemically synthesized
atagcattctcataatttaaaa

SEQ ID NO: 1179878 - DNA, 22 bp, Artificial Sequence
  chemically synthesized
atagaaatacagtcatttttta

SEQ ID NO: 1179879 - DNA, 22 bp, Artificial Sequence
  chemically synthesized
aatagaaatacagtcatttttt

SEQ ID NO: 1179880 - DNA, 22 bp, Artificial Sequence
  chemically synthesized
tcataatttaaaaaatgactgt

SEQ ID NO: 1179881 - DNA, 22 bp, Artificial Sequence
  chemically synthesized
ataatttaaaaaatgactgtat

SEQ ID NO: 1179882 - DNA, 22 bp, Artificial Sequence
  chemically synthesized
taaagtttaatagaaatacagt

SEQ ID NO: 1179883 - DNA, 22 bp, Artificial Sequence
  chemically synthesized
aaaaaatgactgtatttctatt

SEQ ID NO: 1179884 - DNA, 22 bp, Artificial Sequence
  chemically synthesized
attataaagtttaatagaaata

SEQ ID NO: 1179885 - DNA, 22 bp, Artificial Sequence
  chemically synthesized
aaaaatgactgtatttctatta

SEQ ID NO: 1179886 - DNA, 22 bp, Artificial Sequence
  chemically synthesized
ttcattataaagtttaatagaa

SEQ ID NO: 1179887 - DNA, 22 bp, Artificial Sequence
  chemically synthesized
gttcattataaagtttaataga

SEQ ID NO: 1179888 - DNA, 22 bp, Artificial Sequence
  chemically synthesized
tgttcattataaagtttaatag

SEQ ID NO: 1179889 - DNA, 22 bp, Artificial Sequence
  chemically synthesized
tatttctattaaactttataat

SEQ ID NO: 1179890 - DNA, 22 bp, Artificial Sequence
  chemically synthesized
ctattaaactttataatgaaca

SEQ ID NO: 1179891 - DNA, 22 bp, Artificial Sequence
  chemically synthesized
tattaaactttataatgaacaa

SEQ ID NO: 1179892 - DNA, 22 bp, Artificial Sequence
  chemically synthesized
acggtcacatattttgttcatt

SEQ ID NO: 1179893 - DNA, 22 bp, Artificial Sequence
  chemically synthesized
ttaaactttataatgaacaaaa

SEQ ID NO: 1179894 - DNA, 22 bp, Artificial Sequence
  chemically synthesized
aactttataatgaacaaaatat

SEQ ID NO: 1179895 - DNA, 22 bp, Artificial Sequence
  chemically synthesized
tataatgaacaaaatatgtgac

SEQ ID NO: 1179896 - DNA, 22 bp, Artificial Sequence
  chemically synthesized
ataatgaacaaaatatgtgacc

SEQ ID NO: 1179897 - DNA, 22 bp, Artificial Sequence
  chemically synthesized
taatgaacaaaatatgtgaccg

SEQ ID NO: 1179898 - DNA, 22 bp, Artificial Sequence
  chemically synthesized
aaatcaacacataattaacggt

SEQ ID NO: 1179899 - DNA, 22 bp, Artificial Sequence
  chemically synthesized
aaaatcaacacataattaacgg

SEQ ID NO: 1179900 - DNA, 22 bp, Artificial Sequence
  chemically synthesized
taaaatcaacacataattaacg

SEQ ID NO: 1179901 - DNA, 22 bp, Artificial Sequence
  chemically synthesized
gagtgactttaaaatcaacaca

SEQ ID NO: 1179902 - DNA, 22 bp, Artificial Sequence
  chemically synthesized
attatgtgttgattttaaagtc

SEQ ID NO: 1179903 - DNA, 22 bp, Artificial Sequence
  chemically synthesized
gtaataattagagtgactttaa

SEQ ID NO: 1179904 - DNA, 22 bp, Artificial Sequence
  chemically synthesized
agtaataattagagtgacttta

SEQ ID NO: 1179905 - DNA, 22 bp, Artificial Sequence
  chemically synthesized
tgtgttgattttaaagtcactc

SEQ ID NO: 1179906 - DNA, 22 bp, Artificial Sequence
  chemically synthesized
tttagtaataattagagtgact

SEQ ID NO: 1179907 - DNA, 22 bp, Artificial Sequence
  chemically synthesized
atttagtaataattagagtgac

SEQ ID NO: 1179908 - DNA, 22 bp, Artificial Sequence
  chemically synthesized
attttaaagtcactctaattat

SEQ ID NO: 1179909 - DNA, 22 bp, Artificial Sequence
  chemically synthesized
taaagtcactctaattattact

SEQ ID NO: 1179910 - DNA, 22 bp, Artificial Sequence
  chemically synthesized
aaagtcactctaattattacta

SEQ ID NO: 1179911 - DNA, 22 bp, Artificial Sequence
  chemically synthesized
aagtcactctaattattactaa

SEQ ID NO: 1179912 - DNA, 22 bp, Artificial Sequence
  chemically synthesized
aagagataccttatttagtaat

SEQ ID NO: 1179913 - DNA, 22 bp, Artificial Sequence
  chemically synthesized
gaagagataccttatttagtaa

SEQ ID NO: 1179914 - DNA, 22 bp, Artificial Sequence
  chemically synthesized
tgaagagataccttatttagta

SEQ ID NO: 1179915 - DNA, 22 bp, Artificial Sequence
  chemically synthesized
ttgaagagataccttatttagt

SEQ ID NO: 1179916 - DNA, 22 bp, Artificial Sequence
  chemically synthesized
ttttgaagagataccttattta

SEQ ID NO: 1179917 - DNA, 22 bp, Artificial Sequence
  chemically synthesized
taattattactaaataaggtat

SEQ ID NO: 1179918 - DNA, 22 bp, Artificial Sequence
  chemically synthesized
attattactaaataaggtatct

SEQ ID NO: 1179919 - DNA, 22 bp, Artificial Sequence
  chemically synthesized
attcttttgaagagatacctta

SEQ ID NO: 1179920 - DNA, 22 bp, Artificial Sequence
  chemically synthesized
ttactaaataaggtatctcttc

SEQ ID NO: 1179921 - DNA, 22 bp, Artificial Sequence
  chemically synthesized
ctaaataaggtatctcttcaaa

SEQ ID NO: 1179922 - DNA, 22 bp, Artificial Sequence
  chemically synthesized
aataaggtatctcttcaaaaga

SEQ ID NO: 1179923 - DNA, 22 bp, Artificial Sequence
  chemically synthesized
ttcaaaagaattaatatttttc

SEQ ID NO: 1179924 - DNA, 22 bp, Artificial Sequence
  chemically synthesized
caaaagaattaatatttttctt

SEQ ID NO: 1179925 - DNA, 22 bp, Artificial Sequence
  chemically synthesized
aaaagaattaatatttttcttt

SEQ ID NO: 1179926 - DNA, 22 bp, Artificial Sequence
  chemically synthesized
agcatgtcaatgtaaagaaaaa

SEQ ID NO: 1179927 - DNA, 22 bp, Artificial Sequence
  chemically synthesized
aagcatgtcaatgtaaagaaaa

SEQ ID NO: 1179928 - DNA, 22 bp, Artificial Sequence
  chemically synthesized
cccccttaagcatgtcaatgta

SEQ ID NO: 1179929 - DNA, 22 bp, Artificial Sequence
  chemically synthesized
atatttttctttacattgacat

SEQ ID NO: 1179930 - DNA, 22 bp, Artificial Sequence
  chemically synthesized
acccccttaagcatgtcaatgt

SEQ ID NO: 1179931 - DNA, 22 bp, Artificial Sequence
  chemically synthesized
ttctttacattgacatgcttaa

SEQ ID NO: 1179932 - DNA, 22 bp, Artificial Sequence
  chemically synthesized
tctttacattgacatgcttaag

SEQ ID NO: 1179933 - DNA, 22 bp, Artificial Sequence
  chemically synthesized
agagtttacccccttaagcatg

SEQ ID NO: 1179934 - DNA, 22 bp, Artificial Sequence
  chemically synthesized
ctttacattgacatgcttaagg

SEQ ID NO: 1179935 - DNA, 22 bp, Artificial Sequence
  chemically synthesized
tttacattgacatgcttaaggg

SEQ ID NO: 1179936 - DNA, 22 bp, Artificial Sequence
  chemically synthesized
tacattgacatgcttaaggggg

SEQ ID NO: 1179937 - DNA, 22 bp, Artificial Sequence
  chemically synthesized
actaagagtttacccccttaag

SEQ ID NO: 1179938 - DNA, 22 bp, Artificial Sequence
  chemically synthesized
acattgacatgcttaagggggt

SEQ ID NO: 1179939 - DNA, 22 bp, Artificial Sequence
  chemically synthesized
cactaagagtttacccccttaa

SEQ ID NO: 1179940 - DNA, 22 bp, Artificial Sequence
  chemically synthesized
cattgacatgcttaagggggta

SEQ ID NO: 1179941 - DNA, 22 bp, Artificial Sequence
  chemically synthesized
tcactaagagtttaccccctta

SEQ ID NO: 1179942 - DNA, 22 bp, Artificial Sequence
  chemically synthesized
ttttcactaagagtttaccccc

SEQ ID NO: 1179943 - DNA, 22 bp, Artificial Sequence
  chemically synthesized
gttttcactaagagtttacccc

SEQ ID NO: 1179944 - DNA, 22 bp, Artificial Sequence
  chemically synthesized
acatgcttaagggggtaaactc

SEQ ID NO: 1179945 - DNA, 22 bp, Artificial Sequence
  chemically synthesized
tgttttcactaagagtttaccc

SEQ ID NO: 1179946 - DNA, 22 bp, Artificial Sequence
  chemically synthesized
ttgttttcactaagagtttacc

SEQ ID NO: 1179947 - DNA, 22 bp, Artificial Sequence
  chemically synthesized
tttgttttcactaagagtttac

SEQ ID NO: 1179948 - DNA, 22 bp, Artificial Sequence
  chemically synthesized
ttttgttttcactaagagttta

SEQ ID NO: 1179949 - DNA, 22 bp, Artificial Sequence
  chemically synthesized
aagggggtaaactcttagtgaa

SEQ ID NO: 1179950 - DNA, 22 bp, Artificial Sequence
  chemically synthesized
agggggtaaactcttagtgaaa

SEQ ID NO: 1179951 - DNA, 22 bp, Artificial Sequence
  chemically synthesized
gcaaacttttttgttttcacta

SEQ ID NO: 1179952 - DNA, 22 bp, Artificial Sequence
  chemically synthesized
ctagcaaacttttttgttttca

SEQ ID NO: 1179953 - DNA, 22 bp, Artificial Sequence
  chemically synthesized
aaatctactagcaaactttttt

SEQ ID NO: 1179954 - DNA, 22 bp, Artificial Sequence
  chemically synthesized
ttagtgaaaacaaaaaagtttg

SEQ ID NO: 1179955 - DNA, 22 bp, Artificial Sequence
  chemically synthesized
agtgaaaacaaaaaagtttgct

SEQ ID NO: 1179956 - DNA, 22 bp, Artificial Sequence
  chemically synthesized
gtgaaaacaaaaaagtttgcta

SEQ ID NO: 1179957 - DNA, 22 bp, Artificial Sequence
  chemically synthesized
aatccatgtgggtctcaaatct

SEQ ID NO: 1179958 - DNA, 22 bp, Artificial Sequence
  chemically synthesized
gctagtagatttgagacccaca

SEQ ID NO: 1179959 - DNA, 22 bp, Artificial Sequence
  chemically synthesized
ctagtagatttgagacccacat

SEQ ID NO: 1179960 - DNA, 22 bp, Artificial Sequence
  chemically synthesized
gtagatttgagacccacatgga

SEQ ID NO: 1179961 - DNA, 22 bp, Artificial Sequence
  chemically synthesized
tgtcatacatgtgttaaatcca

SEQ ID NO: 1179962 - DNA, 22 bp, Artificial Sequence
  chemically synthesized
gagacccacatggatttaacac

SEQ ID NO: 1179963 - DNA, 22 bp, Artificial Sequence
  chemically synthesized
agacccacatggatttaacaca

SEQ ID NO: 1179964 - DNA, 22 bp, Artificial Sequence
  chemically synthesized
ttatgtcatacatgtgttaaat

SEQ ID NO: 1179965 - DNA, 22 bp, Artificial Sequence
  chemically synthesized
ctattatgtcatacatgtgtta

SEQ ID NO: 1179966 - DNA, 22 bp, Artificial Sequence
  chemically synthesized
acacagagcctcctattatgtc

SEQ ID NO: 1179967 - DNA, 22 bp, Artificial Sequence
  chemically synthesized
aacacatgtatgacataatagg

SEQ ID NO: 1179968 - DNA, 22 bp, Artificial Sequence
  chemically synthesized
acacatgtatgacataatagga

SEQ ID NO: 1179969 - DNA, 22 bp, Artificial Sequence
  chemically synthesized
tagattaacacagagcctccta

SEQ ID NO: 1179970 - DNA, 22 bp, Artificial Sequence
  chemically synthesized
gtagattaacacagagcctcct

SEQ ID NO: 1179971 - DNA, 22 bp, Artificial Sequence
  chemically synthesized
ccaaacttgtagattaacacag

SEQ ID NO: 1179972 - DNA, 22 bp, Artificial Sequence
  chemically synthesized
ttaccaaacttgtagattaaca

SEQ ID NO: 1179973 - DNA, 22 bp, Artificial Sequence
  chemically synthesized
gttaccaaacttgtagattaac

SEQ ID NO: 1179974 - DNA, 22 bp, Artificial Sequence
  chemically synthesized
tgtgttaatctacaagtttggt

SEQ ID NO: 1179975 - DNA, 22 bp, Artificial Sequence
  chemically synthesized
tgttaatctacaagtttggtaa

SEQ ID NO: 1179976 - DNA, 22 bp, Artificial Sequence
  chemically synthesized
atcaacataaacttgttaccaa

SEQ ID NO: 1179977 - DNA, 22 bp, Artificial Sequence
  chemically synthesized
atctacaagtttggtaacaagt

SEQ ID NO: 1179978 - DNA, 22 bp, Artificial Sequence
  chemically synthesized
gttaatcaacataaacttgtta

SEQ ID NO: 1179979 - DNA, 22 bp, Artificial Sequence
  chemically synthesized
ggttaatcaacataaacttgtt

SEQ ID NO: 1179980 - DNA, 22 bp, Artificial Sequence
  chemically synthesized
caagtttggtaacaagtttatg

SEQ ID NO: 1179981 - DNA, 22 bp, Artificial Sequence
  chemically synthesized
ggtaacaagtttatgttgatta

SEQ ID NO: 1179982 - DNA, 22 bp, Artificial Sequence
  chemically synthesized
gtaacaagtttatgttgattaa

SEQ ID NO: 1179983 - DNA, 22 bp, Artificial Sequence
  chemically synthesized
atgttgattaaccaagcattat

SEQ ID NO: 1179984 - DNA, 22 bp, Artificial Sequence
  chemically synthesized
tgttgattaaccaagcattatt

SEQ ID NO: 1179985 - DNA, 22 bp, Artificial Sequence
  chemically synthesized
attaaccaagcattattacatt

SEQ ID NO: 1179986 - DNA, 22 bp, Artificial Sequence
  chemically synthesized
accaagcattattacatttttt

SEQ ID NO: 1179987 - DNA, 22 bp, Artificial Sequence
  chemically synthesized
caaataatatcagtgaaaaaat

SEQ ID NO: 1179988 - DNA, 22 bp, Artificial Sequence
  chemically synthesized
tctacaaataatatcagtgaaa

SEQ ID NO: 1179989 - DNA, 22 bp, Artificial Sequence
  chemically synthesized
atctacaaataatatcagtgaa

SEQ ID NO: 1179990 - DNA, 22 bp, Artificial Sequence
  chemically synthesized
tatctacaaataatatcagtga

SEQ ID NO: 1179991 - DNA, 22 bp, Artificial Sequence
  chemically synthesized
ttacattttttcactgatatta

SEQ ID NO: 1179992 - DNA, 22 bp, Artificial Sequence
  chemically synthesized
cattttttcactgatattattt

SEQ ID NO: 1179993 - DNA, 22 bp, Artificial Sequence
  chemically synthesized
tggtctttatctacaaataata

SEQ ID NO: 1179994 - DNA, 22 bp, Artificial Sequence
  chemically synthesized
tttcactgatattatttgtaga

SEQ ID NO: 1179995 - DNA, 22 bp, Artificial Sequence
  chemically synthesized
ttcactgatattatttgtagat

SEQ ID NO: 1179996 - DNA, 22 bp, Artificial Sequence
  chemically synthesized
tcactgatattatttgtagata

SEQ ID NO: 1179997 - DNA, 22 bp, Artificial Sequence
  chemically synthesized
cactgatattatttgtagataa

SEQ ID NO: 1179998 - DNA, 22 bp, Artificial Sequence
  chemically synthesized
actgatattatttgtagataaa

SEQ ID NO: 1179999 - DNA, 22 bp, Artificial Sequence
  chemically synthesized
catattgtggtctttatctaca

SEQ ID NO: 1180000 - DNA, 22 bp, Artificial Sequence
  chemically synthesized
gcatattgtggtctttatctac

SEQ ID NO: 1180001 - DNA, 22 bp, Artificial Sequence
  chemically synthesized
atattatttgtagataaagacc

SEQ ID NO: 1180002 - DNA, 22 bp, Artificial Sequence
  chemically synthesized
tttgtagataaagaccacaata

SEQ ID NO: 1180003 - DNA, 22 bp, Artificial Sequence
  chemically synthesized
gtagataaagaccacaatatgc

SEQ ID NO: 1180004 - DNA, 22 bp, Artificial Sequence
  chemically synthesized
tagataaagaccacaatatgca

SEQ ID NO: 1180005 - DNA, 22 bp, Artificial Sequence
  chemically synthesized
gcagcacatatccttgcatatt

SEQ ID NO: 1180006 - DNA, 22 bp, Artificial Sequence
  chemically synthesized
tggcagcacatatccttgcata

SEQ ID NO: 1180007 - DNA, 22 bp, Artificial Sequence
  chemically synthesized
tagaattctggcagcacatatc

SEQ ID NO: 1180008 - DNA, 22 bp, Artificial Sequence
  chemically synthesized
ctatagaattctggcagcacat

SEQ ID NO: 1180009 - DNA, 22 bp, Artificial Sequence
  chemically synthesized
atccctgctatagaattctggc

SEQ ID NO: 1180010 - DNA, 22 bp, Artificial Sequence
  chemically synthesized
aatccctgctatagaattctgg

SEQ ID NO: 1180011 - DNA, 22 bp, Artificial Sequence
  chemically synthesized
taatccctgctatagaattctg

SEQ ID NO: 1180012 - DNA, 22 bp, Artificial Sequence
  chemically synthesized
attttaatccctgctatagaat

SEQ ID NO: 1180013 - DNA, 22 bp, Artificial Sequence
  chemically synthesized
ccagaattctatagcagggatt

SEQ ID NO: 1180014 - DNA, 22 bp, Artificial Sequence
  chemically synthesized
tatagcagggattaaaattagg

SEQ ID NO: 1180015 - DNA, 22 bp, Artificial Sequence
  chemically synthesized
gtggatacccatgcctaatttt

SEQ ID NO: 1180016 - DNA, 22 bp, Artificial Sequence
  chemically synthesized
tagcagggattaaaattaggca

SEQ ID NO: 1180017 - DNA, 22 bp, Artificial Sequence
  chemically synthesized
aaattaggcatgggtatccact

SEQ ID NO: 1180018 - DNA, 22 bp, Artificial Sequence
  chemically synthesized
aaatgtataattagtggatacc

SEQ ID NO: 1180019 - DNA, 22 bp, Artificial Sequence
  chemically synthesized
aaaatgtataattagtggatac

SEQ ID NO: 1180020 - DNA, 22 bp, Artificial Sequence
  chemically synthesized
cttaaaatgtataattagtgga

SEQ ID NO: 1180021 - DNA, 22 bp, Artificial Sequence
  chemically synthesized
ggcatgggtatccactaattat

SEQ ID NO: 1180022 - DNA, 22 bp, Artificial Sequence
  chemically synthesized
attatacattttaaggaatata

SEQ ID NO: 1180023 - DNA, 22 bp, Artificial Sequence
  chemically synthesized
tacattttaaggaatatatctg

SEQ ID NO: 1180024 - DNA, 22 bp, Artificial Sequence
  chemically synthesized
tgcccggccatacagatatatt

SEQ ID NO: 1180025 - DNA, 22 bp, Artificial Sequence
  chemically synthesized
taaggaatatatctgtatggcc

SEQ ID NO: 1180026 - DNA, 22 bp, Artificial Sequence
  chemically synthesized
aaggaatatatctgtatggccg

SEQ ID NO: 1180027 - DNA, 22 bp, Artificial Sequence
  chemically synthesized
aggaatatatctgtatggccgg

SEQ ID NO: 1180028 - DNA, 22 bp, Artificial Sequence
  chemically synthesized
cagatgtgagccattgtgcccg

SEQ ID NO: 1180029 - DNA, 22 bp, Artificial Sequence
  chemically synthesized
tatggccgggcacaatggctca

SEQ ID NO: 1180030 - DNA, 22 bp, Artificial Sequence
  chemically synthesized
tgattacagatgtgagccattg

SEQ ID NO: 1180031 - DNA, 22 bp, Artificial Sequence
  chemically synthesized
tgtgattacagatgtgagccat

SEQ ID NO: 1180032 - DNA, 22 bp, Artificial Sequence
  chemically synthesized
gccatccaaagttctgtgatta

SEQ ID NO: 1180033 - DNA, 22 bp, Artificial Sequence
  chemically synthesized
ggccatccaaagttctgtgatt

SEQ ID NO: 1180034 - DNA, 22 bp, Artificial Sequence
  chemically synthesized
acatctgtaatcacagaacttt

SEQ ID NO: 1180035 - DNA, 22 bp, Artificial Sequence
  chemically synthesized
taatcacagaactttggatggc

SEQ ID NO: 1180036 - DNA, 22 bp, Artificial Sequence
  chemically synthesized
aggtgatccagccgccttggcc

SEQ ID NO: 1180037 - DNA, 22 bp, Artificial Sequence
  chemically synthesized
acctcaggtgatccagccgcct

SEQ ID NO: 1180038 - DNA, 22 bp, Artificial Sequence
  chemically synthesized
gacctcaggtgatccagccgcc

SEQ ID NO: 1180039 - DNA, 22 bp, Artificial Sequence
  chemically synthesized
tggatggccaaggcggctggat

SEQ ID NO: 1180040 - DNA, 22 bp, Artificial Sequence
  chemically synthesized
ggatggccaaggcggctggatc

SEQ ID NO: 1180041 - DNA, 22 bp, Artificial Sequence
  chemically synthesized
ttgacctcaggtgatccagccg

SEQ ID NO: 1180042 - DNA, 22 bp, Artificial Sequence
  chemically synthesized
gatggccaaggcggctggatca

SEQ ID NO: 1180043 - DNA, 22 bp, Artificial Sequence
  chemically synthesized
gaactcttgacctcaggtgatc

SEQ ID NO: 1180044 - DNA, 22 bp, Artificial Sequence
  chemically synthesized
gtctcgaactcttgacctcagg

SEQ ID NO: 1180045 - DNA, 22 bp, Artificial Sequence
  chemically synthesized
gatcacctgaggtcaagagttc

SEQ ID NO: 1180046 - DNA, 22 bp, Artificial Sequence
  chemically synthesized
gccaggctggtctcgaactctt

SEQ ID NO: 1180047 - DNA, 22 bp, Artificial Sequence
  chemically synthesized
ggccaggctggtctcgaactct

SEQ ID NO: 1180048 - DNA, 22 bp, Artificial Sequence
  chemically synthesized
tggccaggctggtctcgaactc

SEQ ID NO: 1180049 - DNA, 22 bp, Artificial Sequence
  chemically synthesized
aggtcaagagttcgagaccagc

SEQ ID NO: 1180050 - DNA, 22 bp, Artificial Sequence
  chemically synthesized
cccattttggccaggctggtct

SEQ ID NO: 1180051 - DNA, 22 bp, Artificial Sequence
  chemically synthesized
ccccattttggccaggctggtc

SEQ ID NO: 1180052 - DNA, 22 bp, Artificial Sequence
  chemically synthesized
gagaccagcctggccaaaatgg

SEQ ID NO: 1180053 - DNA, 22 bp, Artificial Sequence
  chemically synthesized
agtagagacgaggtttccccat

SEQ ID NO: 1180054 - DNA, 22 bp, Artificial Sequence
  chemically synthesized
cagtagagacgaggtttcccca

SEQ ID NO: 1180055 - DNA, 22 bp, Artificial Sequence
  chemically synthesized
tcagtagagacgaggtttcccc

SEQ ID NO: 1180056 - DNA, 22 bp, Artificial Sequence
  chemically synthesized
ttcagtagagacgaggtttccc

SEQ ID NO: 1180057 - DNA, 22 bp, Artificial Sequence
  chemically synthesized
gccaaaatggggaaacctcgtc

SEQ ID NO: 1180058 - DNA, 22 bp, Artificial Sequence
  chemically synthesized
tatttttcagtagagacgaggt

SEQ ID NO: 1180059 - DNA, 22 bp, Artificial Sequence
  chemically synthesized
gtatttttcagtagagacgagg

SEQ ID NO: 1180060 - DNA, 22 bp, Artificial Sequence
  chemically synthesized
tgtatttttcagtagagacgag

SEQ ID NO: 1180061 - DNA, 22 bp, Artificial Sequence
  chemically synthesized
ttgtatttttcagtagagacga

SEQ ID NO: 1180062 - DNA, 22 bp, Artificial Sequence
  chemically synthesized
atttttgtatttttcagtagag

SEQ ID NO: 1180063 - DNA, 22 bp, Artificial Sequence
  chemically synthesized
gtctctactgaaaaatacaaaa

SEQ ID NO: 1180064 - DNA, 22 bp, Artificial Sequence
  chemically synthesized
tactgaaaaatacaaaaattag

SEQ ID NO: 1180065 - DNA, 22 bp, Artificial Sequence
  chemically synthesized
ccaccacacccagctaattttt

SEQ ID NO: 1180066 - DNA, 22 bp, Artificial Sequence
  chemically synthesized
ctgaaaaatacaaaaattagct

SEQ ID NO: 1180067 - DNA, 22 bp, Artificial Sequence
  chemically synthesized
aaaaatacaaaaattagctggg

SEQ ID NO: 1180068 - DNA, 22 bp, Artificial Sequence
  chemically synthesized
caggtgcctgccaccacaccca

SEQ ID NO: 1180069 - DNA, 22 bp, Artificial Sequence
  chemically synthesized
gtattacaggtgcctgccacca

SEQ ID NO: 1180070 - DNA, 22 bp, Artificial Sequence
  chemically synthesized
gctgggtgtggtggcaggcacc

SEQ ID NO: 1180071 - DNA, 22 bp, Artificial Sequence
  chemically synthesized
ggtgtggtggcaggcacctgta

SEQ ID NO: 1180072 - DNA, 22 bp, Artificial Sequence
  chemically synthesized
agtagctggtattacaggtgcc

SEQ ID NO: 1180073 - DNA, 22 bp, Artificial Sequence
  chemically synthesized
ctgagtagctggtattacaggt

SEQ ID NO: 1180074 - DNA, 22 bp, Artificial Sequence
  chemically synthesized
agcctcctgagtagctggtatt

SEQ ID NO: 1180075 - DNA, 22 bp, Artificial Sequence
  chemically synthesized
cctcagcctcctgagtagctgg

SEQ ID NO: 1180076 - DNA, 22 bp, Artificial Sequence
  chemically synthesized
ctgcctcagcctcctgagtagc

SEQ ID NO: 1180077 - DNA, 22 bp, Artificial Sequence
  chemically synthesized
tcctgcctcagcctcctgagta

SEQ ID NO: 1180078 - DNA, 22 bp, Artificial Sequence
  chemically synthesized
taataccagctactcaggaggc

SEQ ID NO: 1180079 - DNA, 22 bp, Artificial Sequence
  chemically synthesized
aagcaactctcctgcctcagcc

SEQ ID NO: 1180080 - DNA, 22 bp, Artificial Sequence
  chemically synthesized
ctcaggaggctgaggcaggaga

SEQ ID NO: 1180081 - DNA, 22 bp, Artificial Sequence
  chemically synthesized
ggttcaagcaactctcctgcct

SEQ ID NO: 1180082 - DNA, 22 bp, Artificial Sequence
  chemically synthesized
aggaggctgaggcaggagagtt

SEQ ID NO: 1180083 - DNA, 22 bp, Artificial Sequence
  chemically synthesized
ctgggttcaagcaactctcctg

SEQ ID NO: 1180084 - DNA, 22 bp, Artificial Sequence
  chemically synthesized
cctcctgggttcaagcaactct

SEQ ID NO: 1180085 - DNA, 22 bp, Artificial Sequence
  chemically synthesized
tgcctcctgggttcaagcaact

SEQ ID NO: 1180086 - DNA, 22 bp, Artificial Sequence
  chemically synthesized
aggcaggagagttgcttgaacc

SEQ ID NO: 1180087 - DNA, 22 bp, Artificial Sequence
  chemically synthesized
aatgcaacctctgcctcctggg

SEQ ID NO: 1180088 - DNA, 22 bp, Artificial Sequence
  chemically synthesized
gctcaatgcaacctctgcctcc

SEQ ID NO: 1180089 - DNA, 22 bp, Artificial Sequence
  chemically synthesized
ggctcaatgcaacctctgcctc

SEQ ID NO: 1180090 - DNA, 22 bp, Artificial Sequence
  chemically synthesized
cttgaacccaggaggcagaggt

SEQ ID NO: 1180091 - DNA, 22 bp, Artificial Sequence
  chemically synthesized
gaacccaggaggcagaggttgc

SEQ ID NO: 1180092 - DNA, 22 bp, Artificial Sequence
  chemically synthesized
aacccaggaggcagaggttgca

SEQ ID NO: 1180093 - DNA, 22 bp, Artificial Sequence
  chemically synthesized
gcacgatcttggctcaatgcaa

SEQ ID NO: 1180094 - DNA, 22 bp, Artificial Sequence
  chemically synthesized
aagtgcactggcacgatcttgg

SEQ ID NO: 1180095 - DNA, 22 bp, Artificial Sequence
  chemically synthesized
cattgagccaagatcgtgccag

SEQ ID NO: 1180096 - DNA, 22 bp, Artificial Sequence
  chemically synthesized
ccccggctgaagtgcactggca

SEQ ID NO: 1180097 - DNA, 22 bp, Artificial Sequence
  chemically synthesized
agccaagatcgtgccagtgcac

SEQ ID NO: 1180098 - DNA, 22 bp, Artificial Sequence
  chemically synthesized
ttgccccggctgaagtgcactg

SEQ ID NO: 1180099 - DNA, 22 bp, Artificial Sequence
  chemically synthesized
tgttgccccggctgaagtgcac

SEQ ID NO: 1180100 - DNA, 22 bp, Artificial Sequence
  chemically synthesized
ctctgttgccccggctgaagtg

SEQ ID NO: 1180101 - DNA, 22 bp, Artificial Sequence
  chemically synthesized
gctctgttgccccggctgaagt

SEQ ID NO: 1180102 - DNA, 22 bp, Artificial Sequence
  chemically synthesized
tgctctgttgccccggctgaag

SEQ ID NO: 1180103 - DNA, 22 bp, Artificial Sequence
  chemically synthesized
ttgctctgttgccccggctgaa

SEQ ID NO: 1180104 - DNA, 22 bp, Artificial Sequence
  chemically synthesized
agatggagtttttgctctgttg

SEQ ID NO: 1180105 - DNA, 22 bp, Artificial Sequence
  chemically synthesized
gagatggagtttttgctctgtt

SEQ ID NO: 1180106 - DNA, 22 bp, Artificial Sequence
  chemically synthesized
tgagatggagtttttgctctgt

SEQ ID NO: 1180107 - DNA, 22 bp, Artificial Sequence
  chemically synthesized
cagccggggcaacagagcaaaa

SEQ ID NO: 1180108 - DNA, 22 bp, Artificial Sequence
  chemically synthesized
ttgagatggagtttttgctctg

SEQ ID NO: 1180109 - DNA, 22 bp, Artificial Sequence
  chemically synthesized
agccggggcaacagagcaaaaa

SEQ ID NO: 1180110 - DNA, 22 bp, Artificial Sequence
  chemically synthesized
tttgagatggagtttttgctct

SEQ ID NO: 1180111 - DNA, 22 bp, Artificial Sequence
  chemically synthesized
ttttgagatggagtttttgctc

SEQ ID NO: 1180112 - DNA, 22 bp, Artificial Sequence
  chemically synthesized
tttttgagatggagtttttgct

SEQ ID NO: 1180113 - DNA, 22 bp, Artificial Sequence
  chemically synthesized
ttttttgagatggagtttttgc

SEQ ID NO: 1180114 - DNA, 22 bp, Artificial Sequence
  chemically synthesized
tttttttgagatggagtttttg

SEQ ID NO: 1180115 - DNA, 22 bp, Artificial Sequence
  chemically synthesized
ttttttttgagatggagttttt

SEQ ID NO: 1180116 - DNA, 22 bp, Artificial Sequence
  chemically synthesized
tttttttttgagatggagtttt

SEQ ID NO: 1180117 - DNA, 22 bp, Artificial Sequence
  chemically synthesized
ttttttttttgagatggagttt

SEQ ID NO: 1180118 - DNA, 22 bp, Artificial Sequence
  chemically synthesized
tttttttttttgagatggagtt

SEQ ID NO: 1180119 - DNA, 22 bp, Artificial Sequence
  chemically synthesized
ttttttttttttgagatggagt

SEQ ID NO: 1180120 - DNA, 22 bp, Artificial Sequence
  chemically synthesized
tttttttttttttgagatggag

SEQ ID NO: 1180121 - DNA, 22 bp, Artificial Sequence
  chemically synthesized
ttttttttttttttgagatgga

SEQ ID NO: 1180122 - DNA, 22 bp, Artificial Sequence
  chemically synthesized
tttttttttttttttgagatgg

SEQ ID NO: 1180123 - DNA, 22 bp, Artificial Sequence
  chemically synthesized
ttttttttttttttttgagatg

SEQ ID NO: 1180124 - DNA, 22 bp, Artificial Sequence
  chemically synthesized
tttttttttttttttttgagat

SEQ ID NO: 1180125 - DNA, 22 bp, Artificial Sequence
  chemically synthesized
ttttttttttttttttttgaga

SEQ ID NO: 1180126 - DNA, 22 bp, Artificial Sequence
  chemically synthesized
tttttttttttttttttttgag

SEQ ID NO: 1180127 - DNA, 22 bp, Artificial Sequence
  chemically synthesized
ttttttttttttttttttttga

SEQ ID NO: 1180128 - DNA, 22 bp, Artificial Sequence
  chemically synthesized
tttttttttttttttttttttg

SEQ ID NO: 1180129 - DNA, 22 bp, Artificial Sequence
  chemically synthesized
tttttttttttttttttttttt

SEQ ID NO: 1180130 - DNA, 22 bp, Artificial Sequence
  chemically synthesized
cttttttttttttttttttttt

SEQ ID NO: 1180131 - DNA, 22 bp, Artificial Sequence
  chemically synthesized
tctttttttttttttttttttt

SEQ ID NO: 1180132 - DNA, 22 bp, Artificial Sequence
  chemically synthesized
ttcttttttttttttttttttt

SEQ ID NO: 1180133 - DNA, 22 bp, Artificial Sequence
  chemically synthesized
catctcaaaaaaaaaaaaaaaa

SEQ ID NO: 1180134 - DNA, 22 bp, Artificial Sequence
  chemically synthesized
ttttcttttttttttttttttt

SEQ ID NO: 1180135 - DNA, 22 bp, Artificial Sequence
  chemically synthesized
cttttctttttttttttttttt

SEQ ID NO: 1180136 - DNA, 22 bp, Artificial Sequence
  chemically synthesized
tcttttcttttttttttttttt

SEQ ID NO: 1180137 - DNA, 22 bp, Artificial Sequence
  chemically synthesized
ttcttttctttttttttttttt

SEQ ID NO: 1180138 - DNA, 22 bp, Artificial Sequence
  chemically synthesized
ttttcttttctttttttttttt

SEQ ID NO: 1180139 - DNA, 22 bp, Artificial Sequence
  chemically synthesized
aaaaaaaaaaaaaaaaaaaaaa

SEQ ID NO: 1180140 - DNA, 22 bp, Artificial Sequence
  chemically synthesized
cttttcttttcttttttttttt

SEQ ID NO: 1180141 - DNA, 22 bp, Artificial Sequence
  chemically synthesized
tcttttcttttctttttttttt

SEQ ID NO: 1180142 - DNA, 22 bp, Artificial Sequence
  chemically synthesized
ttcttttcttttcttttttttt

SEQ ID NO: 1180143 - DNA, 22 bp, Artificial Sequence
  chemically synthesized
ttttcttttcttttcttttttt

SEQ ID NO: 1180144 - DNA, 22 bp, Artificial Sequence
  chemically synthesized
cttttcttttcttttctttttt

SEQ ID NO: 1180145 - DNA, 22 bp, Artificial Sequence
  chemically synthesized
tcttttcttttcttttcttttt

SEQ ID NO: 1180146 - DNA, 22 bp, Artificial Sequence
  chemically synthesized
tttcttttcttttcttttcttt

SEQ ID NO: 1180147 - DNA, 22 bp, Artificial Sequence
  chemically synthesized
ctttcttttcttttcttttctt

SEQ ID NO: 1180148 - DNA, 22 bp, Artificial Sequence
  chemically synthesized
gatacatttctttcttttcttt

SEQ ID NO: 1180149 - DNA, 22 bp, Artificial Sequence
  chemically synthesized
agatacatttctttcttttctt

SEQ ID NO: 1180150 - DNA, 22 bp, Artificial Sequence
  chemically synthesized
aaaatgaaaacttagatacatt

SEQ ID NO: 1180151 - DNA, 22 bp, Artificial Sequence
  chemically synthesized
agttttcattttcaatcatggt

SEQ ID NO: 1180152 - DNA, 22 bp, Artificial Sequence
  chemically synthesized
agatacatgacaaccatgattg

SEQ ID NO: 1180153 - DNA, 22 bp, Artificial Sequence
  chemically synthesized
tcattttcaatcatggttgtca

SEQ ID NO: 1180154 - DNA, 22 bp, Artificial Sequence
  chemically synthesized
cattttcaatcatggttgtcat

SEQ ID NO: 1180155 - DNA, 22 bp, Artificial Sequence
  chemically synthesized
attttcaatcatggttgtcatg

SEQ ID NO: 1180156 - DNA, 22 bp, Artificial Sequence
  chemically synthesized
tcaatcatggttgtcatgtatc

SEQ ID NO: 1180157 - DNA, 22 bp, Artificial Sequence
  chemically synthesized
caatcatggttgtcatgtatct

SEQ ID NO: 1180158 - DNA, 22 bp, Artificial Sequence
  chemically synthesized
aatcatggttgtcatgtatctt

SEQ ID NO: 1180159 - DNA, 22 bp, Artificial Sequence
  chemically synthesized
taacatcataattaagatacat

SEQ ID NO: 1180160 - DNA, 22 bp, Artificial Sequence
  chemically synthesized
aaagtgttgtaacatcataatt

SEQ ID NO: 1180161 - DNA, 22 bp, Artificial Sequence
  chemically synthesized
tcatgtatcttaattatgatgt

SEQ ID NO: 1180162 - DNA, 22 bp, Artificial Sequence
  chemically synthesized
tattcaaagtgttgtaacatca

SEQ ID NO: 1180163 - DNA, 22 bp, Artificial Sequence
  chemically synthesized
aattatgatgttacaacacttt

SEQ ID NO: 1180164 - DNA, 22 bp, Artificial Sequence
  chemically synthesized
attatgatgttacaacactttg

SEQ ID NO: 1180165 - DNA, 22 bp, Artificial Sequence
  chemically synthesized
atgaaactatattcaaagtgtt

SEQ ID NO: 1180166 - DNA, 22 bp, Artificial Sequence
  chemically synthesized
aatgaaactatattcaaagtgt

SEQ ID NO: 1180167 - DNA, 22 bp, Artificial Sequence
  chemically synthesized
taatgaaactatattcaaagtg

SEQ ID NO: 1180168 - DNA, 22 bp, Artificial Sequence
  chemically synthesized
tgatgttacaacactttgaata

SEQ ID NO: 1180169 - DNA, 22 bp, Artificial Sequence
  chemically synthesized
tattttaatgaaactatattca

SEQ ID NO: 1180170 - DNA, 22 bp, Artificial Sequence
  chemically synthesized
atattttaatgaaactatattc

SEQ ID NO: 1180171 - DNA, 22 bp, Artificial Sequence
  chemically synthesized
caacactttgaatatagtttca

SEQ ID NO: 1180172 - DNA, 22 bp, Artificial Sequence
  chemically synthesized
accttatattttaatgaaacta

SEQ ID NO: 1180173 - DNA, 22 bp, Artificial Sequence
  chemically synthesized
ttaaccttatattttaatgaaa

SEQ ID NO: 1180174 - DNA, 22 bp, Artificial Sequence
  chemically synthesized
tgaatatagtttcattaaaata

SEQ ID NO: 1180175 - DNA, 22 bp, Artificial Sequence
  chemically synthesized
gaatatagtttcattaaaatat

SEQ ID NO: 1180176 - DNA, 22 bp, Artificial Sequence
  chemically synthesized
aatatagtttcattaaaatata

SEQ ID NO: 1180177 - DNA, 22 bp, Artificial Sequence
  chemically synthesized
aattattaaccttatattttaa

SEQ ID NO: 1180178 - DNA, 22 bp, Artificial Sequence
  chemically synthesized
aaattattaaccttatatttta

SEQ ID NO: 1180179 - DNA, 22 bp, Artificial Sequence
  chemically synthesized
taaattattaaccttatatttt

SEQ ID NO: 1180180 - DNA, 22 bp, Artificial Sequence
  chemically synthesized
tttaaattattaaccttatatt

SEQ ID NO: 1180181 - DNA, 22 bp, Artificial Sequence
  chemically synthesized
tctttaaattattaaccttata

SEQ ID NO: 1180182 - DNA, 22 bp, Artificial Sequence
  chemically synthesized
ctctttaaattattaaccttat

SEQ ID NO: 1180183 - DNA, 22 bp, Artificial Sequence
  chemically synthesized
tctctttaaattattaacctta

SEQ ID NO: 1180184 - DNA, 22 bp, Artificial Sequence
  chemically synthesized
ttctctttaaattattaacctt

SEQ ID NO: 1180185 - DNA, 22 bp, Artificial Sequence
  chemically synthesized
cattaaaatataaggttaataa

SEQ ID NO: 1180186 - DNA, 22 bp, Artificial Sequence
  chemically synthesized
attaaaatataaggttaataat

SEQ ID NO: 1180187 - DNA, 22 bp, Artificial Sequence
  chemically synthesized
atcttttctctttaaattatta

SEQ ID NO: 1180188 - DNA, 22 bp, Artificial Sequence
  chemically synthesized
aaatataaggttaataatttaa

SEQ ID NO: 1180189 - DNA, 22 bp, Artificial Sequence
  chemically synthesized
aatcttttctctttaaattatt

SEQ ID NO: 1180190 - DNA, 22 bp, Artificial Sequence
  chemically synthesized
taatcttttctctttaaattat

SEQ ID NO: 1180191 - DNA, 22 bp, Artificial Sequence
  chemically synthesized
ttaatcttttctctttaaatta

SEQ ID NO: 1180192 - DNA, 22 bp, Artificial Sequence
  chemically synthesized
atatttttaatcttttctcttt

SEQ ID NO: 1180193 - DNA, 22 bp, Artificial Sequence
  chemically synthesized
aatatttttaatcttttctctt

SEQ ID NO: 1180194 - DNA, 22 bp, Artificial Sequence
  chemically synthesized
taatatttttaatcttttctct

SEQ ID NO: 1180195 - DNA, 22 bp, Artificial Sequence
  chemically synthesized
ataatttaaagagaaaagatta

SEQ ID NO: 1180196 - DNA, 22 bp, Artificial Sequence
  chemically synthesized
aaagagaaaagattaaaaatat

SEQ ID NO: 1180197 - DNA, 22 bp, Artificial Sequence
  chemically synthesized
aagagaaaagattaaaaatatt

SEQ ID NO: 1180198 - DNA, 22 bp, Artificial Sequence
  chemically synthesized
agaaaatattttaatattttta

SEQ ID NO: 1180199 - DNA, 22 bp, Artificial Sequence
  chemically synthesized
cagaaaatattttaatattttt

SEQ ID NO: 1180200 - DNA, 22 bp, Artificial Sequence
  chemically synthesized
tcagaaaatattttaatatttt

SEQ ID NO: 1180201 - DNA, 22 bp, Artificial Sequence
  chemically synthesized
ttttcagaaaatattttaatat

SEQ ID NO: 1180202 - DNA, 22 bp, Artificial Sequence
  chemically synthesized
gttttcagaaaatattttaata

SEQ ID NO: 1180203 - DNA, 22 bp, Artificial Sequence
  chemically synthesized
tgttttcagaaaatattttaat

SEQ ID NO: 1180204 - DNA, 22 bp, Artificial Sequence
  chemically synthesized
ttttgttttcagaaaatatttt

SEQ ID NO: 1180205 - DNA, 22 bp, Artificial Sequence
  chemically synthesized
aaaatattaaaatattttctga

SEQ ID NO: 1180206 - DNA, 22 bp, Artificial Sequence
  chemically synthesized
caatctattttgttttcagaaa

SEQ ID NO: 1180207 - DNA, 22 bp, Artificial Sequence
  chemically synthesized
ttacaatctattttgttttcag

SEQ ID NO: 1180208 - DNA, 22 bp, Artificial Sequence
  chemically synthesized
attacaatctattttgttttca

SEQ ID NO: 1180209 - DNA, 22 bp, Artificial Sequence
  chemically synthesized
tattacaatctattttgttttc

SEQ ID NO: 1180210 - DNA, 22 bp, Artificial Sequence
  chemically synthesized
aaatattttctgaaaacaaaat

SEQ ID NO: 1180211 - DNA, 22 bp, Artificial Sequence
  chemically synthesized
attttattacaatctattttgt

SEQ ID NO: 1180212 - DNA, 22 bp, Artificial Sequence
  chemically synthesized
tctgaaaacaaaatagattgta

SEQ ID NO: 1180213 - DNA, 22 bp, Artificial Sequence
  chemically synthesized
cattaattttattacaatctat

SEQ ID NO: 1180214 - DNA, 22 bp, Artificial Sequence
  chemically synthesized
ctgaaaacaaaatagattgtaa

SEQ ID NO: 1180215 - DNA, 22 bp, Artificial Sequence
  chemically synthesized
gcattaattttattacaatcta

SEQ ID NO: 1180216 - DNA, 22 bp, Artificial Sequence
  chemically synthesized
tgaaaacaaaatagattgtaat

SEQ ID NO: 1180217 - DNA, 22 bp, Artificial Sequence
  chemically synthesized
tgcattaattttattacaatct

SEQ ID NO: 1180218 - DNA, 22 bp, Artificial Sequence
  chemically synthesized
ttgcattaattttattacaatc

SEQ ID NO: 1180219 - DNA, 22 bp, Artificial Sequence
  chemically synthesized
aaaacaaaatagattgtaataa

SEQ ID NO: 1180220 - DNA, 22 bp, Artificial Sequence
  chemically synthesized
tttgcattaattttattacaat

SEQ ID NO: 1180221 - DNA, 22 bp, Artificial Sequence
  chemically synthesized
ttttgcattaattttattacaa

SEQ ID NO: 1180222 - DNA, 22 bp, Artificial Sequence
  chemically synthesized
ttttttgcattaattttattac

SEQ ID NO: 1180223 - DNA, 22 bp, Artificial Sequence
  chemically synthesized
cttttttgcattaattttatta

SEQ ID NO: 1180224 - DNA, 22 bp, Artificial Sequence
  chemically synthesized
tcttttttgcattaattttatt

SEQ ID NO: 1180225 - DNA, 22 bp, Artificial Sequence
  chemically synthesized
attttcttttttgcattaattt

SEQ ID NO: 1180226 - DNA, 22 bp, Artificial Sequence
  chemically synthesized
gattttcttttttgcattaatt

SEQ ID NO: 1180227 - DNA, 22 bp, Artificial Sequence
  chemically synthesized
taataaaattaatgcaaaaaag

SEQ ID NO: 1180228 - DNA, 22 bp, Artificial Sequence
  chemically synthesized
agtaatttgattttcttttttg

SEQ ID NO: 1180229 - DNA, 22 bp, Artificial Sequence
  chemically synthesized
attaagtaatttgattttcttt

SEQ ID NO: 1180230 - DNA, 22 bp, Artificial Sequence
  chemically synthesized
atgcaaaaaagaaaatcaaatt

SEQ ID NO: 1180231 - DNA, 22 bp, Artificial Sequence
  chemically synthesized
cattcattaagtaatttgattt

SEQ ID NO: 1180232 - DNA, 22 bp, Artificial Sequence
  chemically synthesized
tacattcattaagtaatttgat

SEQ ID NO: 1180233 - DNA, 22 bp, Artificial Sequence
  chemically synthesized
ctacattcattaagtaatttga

SEQ ID NO: 1180234 - DNA, 22 bp, Artificial Sequence
  chemically synthesized
gtttctacattcattaagtaat

SEQ ID NO: 1180235 - DNA, 22 bp, Artificial Sequence
  chemically synthesized
tagtttctacattcattaagta

SEQ ID NO: 1180236 - DNA, 22 bp, Artificial Sequence
  chemically synthesized
tagggcgatctctagtttctac

SEQ ID NO: 1180237 - DNA, 22 bp, Artificial Sequence
  chemically synthesized
cttaatgaatgtagaaactaga

SEQ ID NO: 1180238 - DNA, 22 bp, Artificial Sequence
  chemically synthesized
tgtagggcgatctctagtttct

SEQ ID NO: 1180239 - DNA, 22 bp, Artificial Sequence
  chemically synthesized
ctgtagggcgatctctagtttc

SEQ ID NO: 1180240 - DNA, 22 bp, Artificial Sequence
  chemically synthesized
tctgtagggcgatctctagttt

SEQ ID NO: 1180241 - DNA, 22 bp, Artificial Sequence
  chemically synthesized
aatgaatgtagaaactagagat

SEQ ID NO: 1180242 - DNA, 22 bp, Artificial Sequence
  chemically synthesized
atgaatgtagaaactagagatc

SEQ ID NO: 1180243 - DNA, 22 bp, Artificial Sequence
  chemically synthesized
tcacattttctgtagggcgatc

SEQ ID NO: 1180244 - DNA, 22 bp, Artificial Sequence
  chemically synthesized
atcacactgtcacattttctgt

SEQ ID NO: 1180245 - DNA, 22 bp, Artificial Sequence
  chemically synthesized
gagatcgccctacagaaaatgt

SEQ ID NO: 1180246 - DNA, 22 bp, Artificial Sequence
  chemically synthesized
attcatcacactgtcacatttt

SEQ ID NO: 1180247 - DNA, 22 bp, Artificial Sequence
  chemically synthesized
agctaattcatcacactgtcac

SEQ ID NO: 1180248 - DNA, 22 bp, Artificial Sequence
  chemically synthesized
aagctaattcatcacactgtca

SEQ ID NO: 1180249 - DNA, 22 bp, Artificial Sequence
  chemically synthesized
taagctaattcatcacactgtc

SEQ ID NO: 1180250 - DNA, 22 bp, Artificial Sequence
  chemically synthesized
cagaaaatgtgacagtgtgatg

SEQ ID NO: 1180251 - DNA, 22 bp, Artificial Sequence
  chemically synthesized
ttttaagctaattcatcacact

SEQ ID NO: 1180252 - DNA, 22 bp, Artificial Sequence
  chemically synthesized
taattattttaagctaattcat

SEQ ID NO: 1180253 - DNA, 22 bp, Artificial Sequence
  chemically synthesized
aggattataattattttaagct

SEQ ID NO: 1180254 - DNA, 22 bp, Artificial Sequence
  chemically synthesized
aaggattataattattttaagc

SEQ ID NO: 1180255 - DNA, 22 bp, Artificial Sequence
  chemically synthesized
ttaaggattataattattttaa

SEQ ID NO: 1180256 - DNA, 22 bp, Artificial Sequence
  chemically synthesized
cttaaggattataattatttta

SEQ ID NO: 1180257 - DNA, 22 bp, Artificial Sequence
  chemically synthesized
gcttaaaataattataatcctt

SEQ ID NO: 1180258 - DNA, 22 bp, Artificial Sequence
  chemically synthesized
aaaataattataatccttaaga

SEQ ID NO: 1180259 - DNA, 22 bp, Artificial Sequence
  chemically synthesized
aacatgatgtcttcttaaggat

SEQ ID NO: 1180260 - DNA, 22 bp, Artificial Sequence
  chemically synthesized
aaataattataatccttaagaa

SEQ ID NO: 1180261 - DNA, 22 bp, Artificial Sequence
  chemically synthesized
ttaaacatgatgtcttcttaag

SEQ ID NO: 1180262 - DNA, 22 bp, Artificial Sequence
  chemically synthesized
gttaaacatgatgtcttcttaa

SEQ ID NO: 1180263 - DNA, 22 bp, Artificial Sequence
  chemically synthesized
tgttaaacatgatgtcttctta

SEQ ID NO: 1180264 - DNA, 22 bp, Artificial Sequence
  chemically synthesized
taatccttaagaagacatcatg

SEQ ID NO: 1180265 - DNA, 22 bp, Artificial Sequence
  chemically synthesized
aattttgttaaacatgatgtct

SEQ ID NO: 1180266 - DNA, 22 bp, Artificial Sequence
  chemically synthesized
aagaagacatcatgtttaacaa

SEQ ID NO: 1180267 - DNA, 22 bp, Artificial Sequence
  chemically synthesized
atatcctgaattttgttaaaca

SEQ ID NO: 1180268 - DNA, 22 bp, Artificial Sequence
  chemically synthesized
agaagacatcatgtttaacaaa

SEQ ID NO: 1180269 - DNA, 22 bp, Artificial Sequence
  chemically synthesized
ggatcctgatatcctgaatttt

SEQ ID NO: 1180270 - DNA, 22 bp, Artificial Sequence
  chemically synthesized
gtctaggatcctgatatcctga

SEQ ID NO: 1180271 - DNA, 22 bp, Artificial Sequence
  chemically synthesized
ggtctaggatcctgatatcctg

SEQ ID NO: 1180272 - DNA, 22 bp, Artificial Sequence
  chemically synthesized
aacaaaattcaggatatcagga

SEQ ID NO: 1180273 - DNA, 22 bp, Artificial Sequence
  chemically synthesized
acaaaattcaggatatcaggat

SEQ ID NO: 1180274 - DNA, 22 bp, Artificial Sequence
  chemically synthesized
aggatatcaggatcctagacca

SEQ ID NO: 1180275 - DNA, 22 bp, Artificial Sequence
  chemically synthesized
cagagcagaaatatttggtcta

SEQ ID NO: 1180276 - DNA, 22 bp, Artificial Sequence
  chemically synthesized
agattacagagcagaaatattt

SEQ ID NO: 1180277 - DNA, 22 bp, Artificial Sequence
  chemically synthesized
gaccaaatatttctgctctgta

SEQ ID NO: 1180278 - DNA, 22 bp, Artificial Sequence
  chemically synthesized
agtcatgtacctaagattacag

SEQ ID NO: 1180279 - DNA, 22 bp, Artificial Sequence
  chemically synthesized
ctgctctgtaatcttaggtaca

SEQ ID NO: 1180280 - DNA, 22 bp, Artificial Sequence
  chemically synthesized
tgctctgtaatcttaggtacat

SEQ ID NO: 1180281 - DNA, 22 bp, Artificial Sequence
  chemically synthesized
ctctgtaatcttaggtacatga

SEQ ID NO: 1180282 - DNA, 22 bp, Artificial Sequence
  chemically synthesized
agatatgctaagtcatgtacct

SEQ ID NO: 1180283 - DNA, 22 bp, Artificial Sequence
  chemically synthesized
tgtaatcttaggtacatgactt

SEQ ID NO: 1180284 - DNA, 22 bp, Artificial Sequence
  chemically synthesized
taatcttaggtacatgacttag

SEQ ID NO: 1180285 - DNA, 22 bp, Artificial Sequence
  chemically synthesized
aagctgagatatgctaagtcat

SEQ ID NO: 1180286 - DNA, 22 bp, Artificial Sequence
  chemically synthesized
aggtacatgacttagcatatct

SEQ ID NO: 1180287 - DNA, 22 bp, Artificial Sequence
  chemically synthesized
ggtacatgacttagcatatctc

SEQ ID NO: 1180288 - DNA, 22 bp, Artificial Sequence
  chemically synthesized
caggtgaagacactcaagctga

SEQ ID NO: 1180289 - DNA, 22 bp, Artificial Sequence
  chemically synthesized
acaggtgaagacactcaagctg

SEQ ID NO: 1180290 - DNA, 22 bp, Artificial Sequence
  chemically synthesized
tacaggtgaagacactcaagct

SEQ ID NO: 1180291 - DNA, 22 bp, Artificial Sequence
  chemically synthesized
agcatatctcagcttgagtgtc

SEQ ID NO: 1180292 - DNA, 22 bp, Artificial Sequence
  chemically synthesized
gcatatctcagcttgagtgtct

SEQ ID NO: 1180293 - DNA, 22 bp, Artificial Sequence
  chemically synthesized
attttacaggtgaagacactca

SEQ ID NO: 1180294 - DNA, 22 bp, Artificial Sequence
  chemically synthesized
cattttacaggtgaagacactc

SEQ ID NO: 1180295 - DNA, 22 bp, Artificial Sequence
  chemically synthesized
tcattttacaggtgaagacact

SEQ ID NO: 1180296 - DNA, 22 bp, Artificial Sequence
  chemically synthesized
agcttgagtgtcttcacctgta

SEQ ID NO: 1180297 - DNA, 22 bp, Artificial Sequence
  chemically synthesized
cacctttcattttacaggtgaa

SEQ ID NO: 1180298 - DNA, 22 bp, Artificial Sequence
  chemically synthesized
tacacctttcattttacaggtg

SEQ ID NO: 1180299 - DNA, 22 bp, Artificial Sequence
  chemically synthesized
gagtgtcttcacctgtaaaatg

SEQ ID NO: 1180300 - DNA, 22 bp, Artificial Sequence
  chemically synthesized
agtgtcttcacctgtaaaatga

SEQ ID NO: 1180301 - DNA, 22 bp, Artificial Sequence
  chemically synthesized
aaacctctacacctttcatttt

SEQ ID NO: 1180302 - DNA, 22 bp, Artificial Sequence
  chemically synthesized
cacctgtaaaatgaaaggtgta

SEQ ID NO: 1180303 - DNA, 22 bp, Artificial Sequence
  chemically synthesized
acctgtaaaatgaaaggtgtag

SEQ ID NO: 1180304 - DNA, 22 bp, Artificial Sequence
  chemically synthesized
taaaatgaaaggtgtagaggtt

SEQ ID NO: 1180305 - DNA, 22 bp, Artificial Sequence
  chemically synthesized
agtagacactgaaacctctaca

SEQ ID NO: 1180306 - DNA, 22 bp, Artificial Sequence
  chemically synthesized
ataccaagaatattaagtagac

SEQ ID NO: 1180307 - DNA, 22 bp, Artificial Sequence
  chemically synthesized
aataccaagaatattaagtaga

SEQ ID NO: 1180308 - DNA, 22 bp, Artificial Sequence
  chemically synthesized
cagtgtctacttaatattcttg

SEQ ID NO: 1180309 - DNA, 22 bp, Artificial Sequence
  chemically synthesized
agtgtctacttaatattcttgg

SEQ ID NO: 1180310 - DNA, 22 bp, Artificial Sequence
  chemically synthesized
tatgtgtaatttaataccaaga

SEQ ID NO: 1180311 - DNA, 22 bp, Artificial Sequence
  chemically synthesized
gtatgtgtaatttaataccaag

SEQ ID NO: 1180312 - DNA, 22 bp, Artificial Sequence
  chemically synthesized
cttaatattcttggtattaaat

SEQ ID NO: 1180313 - DNA, 22 bp, Artificial Sequence
  chemically synthesized
aatattcttggtattaaattac

SEQ ID NO: 1180314 - DNA, 22 bp, Artificial Sequence
  chemically synthesized
atattcttggtattaaattaca

SEQ ID NO: 1180315 - DNA, 22 bp, Artificial Sequence
  chemically synthesized
gaaataatttgtatgtgtaatt

SEQ ID NO: 1180316 - DNA, 22 bp, Artificial Sequence
  chemically synthesized
ggaaataatttgtatgtgtaat

SEQ ID NO: 1180317 - DNA, 22 bp, Artificial Sequence
  chemically synthesized
ttggtattaaattacacataca

SEQ ID NO: 1180318 - DNA, 22 bp, Artificial Sequence
  chemically synthesized
ggtattaaattacacatacaaa

SEQ ID NO: 1180319 - DNA, 22 bp, Artificial Sequence
  chemically synthesized
gtattaaattacacatacaaat

SEQ ID NO: 1180320 - DNA, 22 bp, Artificial Sequence
  chemically synthesized
aaatccatttggaaataatttg

SEQ ID NO: 1180321 - DNA, 22 bp, Artificial Sequence
  chemically synthesized
aattacacatacaaattatttc

SEQ ID NO: 1180322 - DNA, 22 bp, Artificial Sequence
  chemically synthesized
caaatccatttggaaataattt

SEQ ID NO: 1180323 - DNA, 22 bp, Artificial Sequence
  chemically synthesized
cacatacaaattatttccaaat

SEQ ID NO: 1180324 - DNA, 22 bp, Artificial Sequence
  chemically synthesized
gcacaaatgaaatttcaaatcc

SEQ ID NO: 1180325 - DNA, 22 bp, Artificial Sequence
  chemically synthesized
tagcacaaatgaaatttcaaat

SEQ ID NO: 1180326 - DNA, 22 bp, Artificial Sequence
  chemically synthesized
tttccaaatggatttgaaattt

SEQ ID NO: 1180327 - DNA, 22 bp, Artificial Sequence
  chemically synthesized
ctagcacaaatgaaatttcaaa

SEQ ID NO: 1180328 - DNA, 22 bp, Artificial Sequence
  chemically synthesized
tctagcacaaatgaaatttcaa

SEQ ID NO: 1180329 - DNA, 22 bp, Artificial Sequence
  chemically synthesized
ccaaatggatttgaaatttcat

SEQ ID NO: 1180330 - DNA, 22 bp, Artificial Sequence
  chemically synthesized
caaatggatttgaaatttcatt

SEQ ID NO: 1180331 - DNA, 22 bp, Artificial Sequence
  chemically synthesized
ctttctagcacaaatgaaattt

SEQ ID NO: 1180332 - DNA, 22 bp, Artificial Sequence
  chemically synthesized
attgctttctagcacaaatgaa

SEQ ID NO: 1180333 - DNA, 22 bp, Artificial Sequence
  chemically synthesized
aattgctttctagcacaaatga

SEQ ID NO: 1180334 - DNA, 22 bp, Artificial Sequence
  chemically synthesized
gaaatttcatttgtgctagaaa

SEQ ID NO: 1180335 - DNA, 22 bp, Artificial Sequence
  chemically synthesized
aaatttcatttgtgctagaaag

SEQ ID NO: 1180336 - DNA, 22 bp, Artificial Sequence
  chemically synthesized
catttgtgctagaaagcaatta

SEQ ID NO: 1180337 - DNA, 22 bp, Artificial Sequence
  chemically synthesized
atttgtgctagaaagcaattaa

SEQ ID NO: 1180338 - DNA, 22 bp, Artificial Sequence
  chemically synthesized
gtgctagaaagcaattaagtgg

SEQ ID NO: 1180339 - DNA, 22 bp, Artificial Sequence
  chemically synthesized
tgctagaaagcaattaagtggc

SEQ ID NO: 1180340 - DNA, 22 bp, Artificial Sequence
  chemically synthesized
gaaagcaattaagtggccattt

SEQ ID NO: 1180341 - DNA, 22 bp, Artificial Sequence
  chemically synthesized
agtggccatttcggctcctact

SEQ ID NO: 1180342 - DNA, 22 bp, Artificial Sequence
  chemically synthesized
cacataagtgtcacagagtagg

SEQ ID NO: 1180343 - DNA, 22 bp, Artificial Sequence
  chemically synthesized
gcacataagtgtcacagagtag

SEQ ID NO: 1180344 - DNA, 22 bp, Artificial Sequence
  chemically synthesized
cggctcctactctgtgacactt

SEQ ID NO: 1180345 - DNA, 22 bp, Artificial Sequence
  chemically synthesized
ggctcctactctgtgacactta

SEQ ID NO: 1180346 - DNA, 22 bp, Artificial Sequence
  chemically synthesized
agaatgtccttgcacataagtg

SEQ ID NO: 1180347 - DNA, 22 bp, Artificial Sequence
  chemically synthesized
ctactctgtgacacttatgtgc

SEQ ID NO: 1180348 - DNA, 22 bp, Artificial Sequence
  chemically synthesized
gagaatgtccttgcacataagt

SEQ ID NO: 1180349 - DNA, 22 bp, Artificial Sequence
  chemically synthesized
ctctgtgacacttatgtgcaag

SEQ ID NO: 1180350 - DNA, 22 bp, Artificial Sequence
  chemically synthesized
tgtgacacttatgtgcaaggac

SEQ ID NO: 1180351 - DNA, 22 bp, Artificial Sequence
  chemically synthesized
tgacacttatgtgcaaggacat

SEQ ID NO: 1180352 - DNA, 22 bp, Artificial Sequence
  chemically synthesized
agaagtttgagaatgtccttgc

SEQ ID NO: 1180353 - DNA, 22 bp, Artificial Sequence
  chemically synthesized
attaagaagtttgagaatgtcc

SEQ ID NO: 1180354 - DNA, 22 bp, Artificial Sequence
  chemically synthesized
ctgattaagaagtttgagaatg

SEQ ID NO: 1180355 - DNA, 22 bp, Artificial Sequence
  chemically synthesized
atgtgcaaggacattctcaaac

SEQ ID NO: 1180356 - DNA, 22 bp, Artificial Sequence
  chemically synthesized
tgtgcaaggacattctcaaact

SEQ ID NO: 1180357 - DNA, 22 bp, Artificial Sequence
  chemically synthesized
aaatatccaggctcctgattaa

SEQ ID NO: 1180358 - DNA, 22 bp, Artificial Sequence
  chemically synthesized
caaatatccaggctcctgatta

SEQ ID NO: 1180359 - DNA, 22 bp, Artificial Sequence
  chemically synthesized
tcaaacttcttaatcaggagcc

SEQ ID NO: 1180360 - DNA, 22 bp, Artificial Sequence
  chemically synthesized
aaacttcttaatcaggagcctg

SEQ ID NO: 1180361 - DNA, 22 bp, Artificial Sequence
  chemically synthesized
cttaatcaggagcctggatatt

SEQ ID NO: 1180362 - DNA, 22 bp, Artificial Sequence
  chemically synthesized
tacagatcttcaaatatccagg

SEQ ID NO: 1180363 - DNA, 22 bp, Artificial Sequence
  chemically synthesized
ttaatcaggagcctggatattt

SEQ ID NO: 1180364 - DNA, 22 bp, Artificial Sequence
  chemically synthesized
gtacagatcttcaaatatccag

SEQ ID NO: 1180365 - DNA, 22 bp, Artificial Sequence
  chemically synthesized
aatcaggagcctggatatttga

SEQ ID NO: 1180366 - DNA, 22 bp, Artificial Sequence
  chemically synthesized
atcaggagcctggatatttgaa

SEQ ID NO: 1180367 - DNA, 22 bp, Artificial Sequence
  chemically synthesized
ggtaagcttgtacagatcttca

SEQ ID NO: 1180368 - DNA, 22 bp, Artificial Sequence
  chemically synthesized
aggtaagcttgtacagatcttc

SEQ ID NO: 1180369 - DNA, 22 bp, Artificial Sequence
  chemically synthesized
taggtaagcttgtacagatctt

SEQ ID NO: 1180370 - DNA, 22 bp, Artificial Sequence
  chemically synthesized
ttttaggtaagcttgtacagat

SEQ ID NO: 1180371 - DNA, 22 bp, Artificial Sequence
  chemically synthesized
gatatttgaagatctgtacaag

SEQ ID NO: 1180372 - DNA, 22 bp, Artificial Sequence
  chemically synthesized
gttttaggtaagcttgtacaga

SEQ ID NO: 1180373 - DNA, 22 bp, Artificial Sequence
  chemically synthesized
tacttgttttaggtaagcttgt

SEQ ID NO: 1180374 - DNA, 22 bp, Artificial Sequence
  chemically synthesized
gaagatctgtacaagcttacct

SEQ ID NO: 1180375 - DNA, 22 bp, Artificial Sequence
  chemically synthesized
aagatctgtacaagcttaccta

SEQ ID NO: 1180376 - DNA, 22 bp, Artificial Sequence
  chemically synthesized
atgactgtacttgttttaggta

SEQ ID NO: 1180377 - DNA, 22 bp, Artificial Sequence
  chemically synthesized
ctgatgactgtacttgttttag

SEQ ID NO: 1180378 - DNA, 22 bp, Artificial Sequence
  chemically synthesized
tacaagcttacctaaaacaagt

SEQ ID NO: 1180379 - DNA, 22 bp, Artificial Sequence
  chemically synthesized
actgatgactgtacttgtttta

SEQ ID NO: 1180380 - DNA, 22 bp, Artificial Sequence
  chemically synthesized
cttactgatgactgtacttgtt

SEQ ID NO: 1180381 - DNA, 22 bp, Artificial Sequence
  chemically synthesized
tacttactgatgactgtacttg

SEQ ID NO: 1180382 - DNA, 22 bp, Artificial Sequence
  chemically synthesized
acctaaaacaagtacagtcatc

SEQ ID NO: 1180383 - DNA, 22 bp, Artificial Sequence
  chemically synthesized
cctaaaacaagtacagtcatca

SEQ ID NO: 1180384 - DNA, 22 bp, Artificial Sequence
  chemically synthesized
aaacaagtacagtcatcagtaa

SEQ ID NO: 1180385 - DNA, 22 bp, Artificial Sequence
  chemically synthesized
aataaagtgcactctacttact

SEQ ID NO: 1180386 - DNA, 22 bp, Artificial Sequence
  chemically synthesized
acaggtgttcaataaagtgcac

SEQ ID NO: 1180387 - DNA, 22 bp, Artificial Sequence
  chemically synthesized
gcatggtgcctaacaggtgttc

SEQ ID NO: 1180388 - DNA, 22 bp, Artificial Sequence
  chemically synthesized
tattgaacacctgttaggcacc

SEQ ID NO: 1180389 - DNA, 22 bp, Artificial Sequence
  chemically synthesized
attgaacacctgttaggcacca

SEQ ID NO: 1180390 - DNA, 22 bp, Artificial Sequence
  chemically synthesized
ttgaacacctgttaggcaccat

SEQ ID NO: 1180391 - DNA, 22 bp, Artificial Sequence
  chemically synthesized
aacacctgttaggcaccatgct

SEQ ID NO: 1180392 - DNA, 22 bp, Artificial Sequence
  chemically synthesized
ggaaatgtggctagcatggtgc

SEQ ID NO: 1180393 - DNA, 22 bp, Artificial Sequence
  chemically synthesized
gttgggaaatgtggctagcatg

SEQ ID NO: 1180394 - DNA, 22 bp, Artificial Sequence
  chemically synthesized
ttaggcaccatgctagccacat

SEQ ID NO: 1180395 - DNA, 22 bp, Artificial Sequence
  chemically synthesized
ggcaccatgctagccacatttc

SEQ ID NO: 1180396 - DNA, 22 bp, Artificial Sequence
  chemically synthesized
aagaatccaggttagttgggaa

SEQ ID NO: 1180397 - DNA, 22 bp, Artificial Sequence
  chemically synthesized
tgaagaatccaggttagttggg

SEQ ID NO: 1180398 - DNA, 22 bp, Artificial Sequence
  chemically synthesized
ctgaagaatccaggttagttgg

SEQ ID NO: 1180399 - DNA, 22 bp, Artificial Sequence
  chemically synthesized
gccacatttcccaactaacctg

SEQ ID NO: 1180400 - DNA, 22 bp, Artificial Sequence
  chemically synthesized
ttctgaagaatccaggttagtt

SEQ ID NO: 1180401 - DNA, 22 bp, Artificial Sequence
  chemically synthesized
caagattcttctgaagaatcca

SEQ ID NO: 1180402 - DNA, 22 bp, Artificial Sequence
  chemically synthesized
cccaactaacctggattcttca

SEQ ID NO: 1180403 - DNA, 22 bp, Artificial Sequence
  chemically synthesized
acaagattcttctgaagaatcc

SEQ ID NO: 1180404 - DNA, 22 bp, Artificial Sequence
  chemically synthesized
ccaactaacctggattcttcag

SEQ ID NO: 1180405 - DNA, 22 bp, Artificial Sequence
  chemically synthesized
acctggattcttcagaagaatc

SEQ ID NO: 1180406 - DNA, 22 bp, Artificial Sequence
  chemically synthesized
tcagaacttacaagattcttct

SEQ ID NO: 1180407 - DNA, 22 bp, Artificial Sequence
  chemically synthesized
gattcttcagaagaatcttgta

SEQ ID NO: 1180408 - DNA, 22 bp, Artificial Sequence
  chemically synthesized
ttcagaagaatcttgtaagttc

SEQ ID NO: 1180409 - DNA, 22 bp, Artificial Sequence
  chemically synthesized
cagaagaatcttgtaagttctg

SEQ ID NO: 1180410 - DNA, 22 bp, Artificial Sequence
  chemically synthesized
agaagaatcttgtaagttctga

SEQ ID NO: 1180411 - DNA, 22 bp, Artificial Sequence
  chemically synthesized
aaaaaatacaatctgtcagaac

SEQ ID NO: 1180412 - DNA, 22 bp, Artificial Sequence
  chemically synthesized
aaaaaaatacaatctgtcagaa

SEQ ID NO: 1180413 - DNA, 22 bp, Artificial Sequence
  chemically synthesized
gtaagttctgacagattgtatt

SEQ ID NO: 1180414 - DNA, 22 bp, Artificial Sequence
  chemically synthesized
taagttctgacagattgtattt

SEQ ID NO: 1180415 - DNA, 22 bp, Artificial Sequence
  chemically synthesized
tatccatcttaaaaaaatacaa

SEQ ID NO: 1180416 - DNA, 22 bp, Artificial Sequence
  chemically synthesized
tgacagattgtatttttttaag

SEQ ID NO: 1180417 - DNA, 22 bp, Artificial Sequence
  chemically synthesized
acagattgtatttttttaagat

SEQ ID NO: 1180418 - DNA, 22 bp, Artificial Sequence
  chemically synthesized
tatttttttaagatggatacaa

SEQ ID NO: 1180419 - DNA, 22 bp, Artificial Sequence
  chemically synthesized
ttttaagatggatacaatatgt

SEQ ID NO: 1180420 - DNA, 22 bp, Artificial Sequence
  chemically synthesized
tttaagatggatacaatatgtt

SEQ ID NO: 1180421 - DNA, 22 bp, Artificial Sequence
  chemically synthesized
ttaagatggatacaatatgttt

SEQ ID NO: 1180422 - DNA, 22 bp, Artificial Sequence
  chemically synthesized
taagatggatacaatatgtttc

SEQ ID NO: 1180423 - DNA, 22 bp, Artificial Sequence
  chemically synthesized
aagatggatacaatatgtttca

SEQ ID NO: 1180424 - DNA, 22 bp, Artificial Sequence
  chemically synthesized
agatggatacaatatgtttcat

SEQ ID NO: 1180425 - DNA, 22 bp, Artificial Sequence
  chemically synthesized
catccgaagaataacatgtaag

SEQ ID NO: 1180426 - DNA, 22 bp, Artificial Sequence
  chemically synthesized
catcttacatgttattcttcgg

SEQ ID NO: 1180427 - DNA, 22 bp, Artificial Sequence
  chemically synthesized
atcttacatgttattcttcgga

SEQ ID NO: 1180428 - DNA, 22 bp, Artificial Sequence
  chemically synthesized
acatgttattcttcggatgtaa

SEQ ID NO: 1180429 - DNA, 22 bp, Artificial Sequence
  chemically synthesized
catgttattcttcggatgtaac

SEQ ID NO: 1180430 - DNA, 22 bp, Artificial Sequence
  chemically synthesized
atggagaagtatcagtgttaca

SEQ ID NO: 1180431 - DNA, 22 bp, Artificial Sequence
  chemically synthesized
gatggagaagtatcagtgttac

SEQ ID NO: 1180432 - DNA, 22 bp, Artificial Sequence
  chemically synthesized
ttcttcggatgtaacactgata

SEQ ID NO: 1180433 - DNA, 22 bp, Artificial Sequence
  chemically synthesized
ttgatggagaagtatcagtgtt

SEQ ID NO: 1180434 - DNA, 22 bp, Artificial Sequence
  chemically synthesized
ttcggatgtaacactgatactt

SEQ ID NO: 1180435 - DNA, 22 bp, Artificial Sequence
  chemically synthesized
cggatgtaacactgatacttct

SEQ ID NO: 1180436 - DNA, 22 bp, Artificial Sequence
  chemically synthesized
ggatgtaacactgatacttctc

SEQ ID NO: 1180437 - DNA, 22 bp, Artificial Sequence
  chemically synthesized
atacttctccatcaagagttgg

SEQ ID NO: 1180438 - DNA, 22 bp, Artificial Sequence
  chemically synthesized
ctccatcaagagttgggtttat

SEQ ID NO: 1180439 - DNA, 22 bp, Artificial Sequence
  chemically synthesized
tccatcaagagttgggtttatg

SEQ ID NO: 1180440 - DNA, 22 bp, Artificial Sequence
  chemically synthesized
catcaagagttgggtttatgtt

SEQ ID NO: 1180441 - DNA, 22 bp, Artificial Sequence
  chemically synthesized
gtcaaggggcagaaacataaac

SEQ ID NO: 1180442 - DNA, 22 bp, Artificial Sequence
  chemically synthesized
ggtttatgtttctgccccttga

SEQ ID NO: 1180443 - DNA, 22 bp, Artificial Sequence
  chemically synthesized
atgtttctgccccttgactagg

SEQ ID NO: 1180444 - DNA, 22 bp, Artificial Sequence
  chemically synthesized
tgtttctgccccttgactagga

SEQ ID NO: 1180445 - DNA, 22 bp, Artificial Sequence
  chemically synthesized
catagtcaggggtccatcctag

SEQ ID NO: 1180446 - DNA, 22 bp, Artificial Sequence
  chemically synthesized
ctgccccttgactaggatggac

SEQ ID NO: 1180447 - DNA, 22 bp, Artificial Sequence
  chemically synthesized
ccatagtcaggggtccatccta

SEQ ID NO: 1180448 - DNA, 22 bp, Artificial Sequence
  chemically synthesized
tgccccttgactaggatggacc

SEQ ID NO: 1180449 - DNA, 22 bp, Artificial Sequence
  chemically synthesized
ttccatagtcaggggtccatcc

SEQ ID NO: 1180450 - DNA, 22 bp, Artificial Sequence
  chemically synthesized
ccccttgactaggatggacccc

SEQ ID NO: 1180451 - DNA, 22 bp, Artificial Sequence
  chemically synthesized
cttccatagtcaggggtccatc

SEQ ID NO: 1180452 - DNA, 22 bp, Artificial Sequence
  chemically synthesized
gactaggatggacccctgacta

SEQ ID NO: 1180453 - DNA, 22 bp, Artificial Sequence
  chemically synthesized
actaggatggacccctgactat

SEQ ID NO: 1180454 - DNA, 22 bp, Artificial Sequence
  chemically synthesized
ggatggacccctgactatggaa

SEQ ID NO: 1180455 - DNA, 22 bp, Artificial Sequence
  chemically synthesized
gaagtcacatagtataacttct

SEQ ID NO: 1180456 - DNA, 22 bp, Artificial Sequence
  chemically synthesized
ggaagtcacatagtataacttc

SEQ ID NO: 1180457 - DNA, 22 bp, Artificial Sequence
  chemically synthesized
actatggaagaagttatactat

SEQ ID NO: 1180458 - DNA, 22 bp, Artificial Sequence
  chemically synthesized
gtcttggaagtcacatagtata

SEQ ID NO: 1180459 - DNA, 22 bp, Artificial Sequence
  chemically synthesized
agtcttggaagtcacatagtat

SEQ ID NO: 1180460 - DNA, 22 bp, Artificial Sequence
  chemically synthesized
tggaagaagttatactatgtga

SEQ ID NO: 1180461 - DNA, 22 bp, Artificial Sequence
  chemically synthesized
tgacttagtcttggaagtcaca

SEQ ID NO: 1180462 - DNA, 22 bp, Artificial Sequence
  chemically synthesized
gtgacttagtcttggaagtcac

SEQ ID NO: 1180463 - DNA, 22 bp, Artificial Sequence
  chemically synthesized
tgtgacttagtcttggaagtca

SEQ ID NO: 1180464 - DNA, 22 bp, Artificial Sequence
  chemically synthesized
ttgtgacttagtcttggaagtc

SEQ ID NO: 1180465 - DNA, 22 bp, Artificial Sequence
  chemically synthesized
tactatgtgacttccaagacta

SEQ ID NO: 1180466 - DNA, 22 bp, Artificial Sequence
  chemically synthesized
ccttttgtgacttagtcttgga

SEQ ID NO: 1180467 - DNA, 22 bp, Artificial Sequence
  chemically synthesized
ttgccttttgtgacttagtctt

SEQ ID NO: 1180468 - DNA, 22 bp, Artificial Sequence
  chemically synthesized
tgtgacttccaagactaagtca

SEQ ID NO: 1180469 - DNA, 22 bp, Artificial Sequence
  chemically synthesized
tattgccttttgtgacttagtc

SEQ ID NO: 1180470 - DNA, 22 bp, Artificial Sequence
  chemically synthesized
ccaagactaagtcacaaaaggc

SEQ ID NO: 1180471 - DNA, 22 bp, Artificial Sequence
  chemically synthesized
caagactaagtcacaaaaggca

SEQ ID NO: 1180472 - DNA, 22 bp, Artificial Sequence
  chemically synthesized
agtcacaaaaggcaatagagtt

SEQ ID NO: 1180473 - DNA, 22 bp, Artificial Sequence
  chemically synthesized
caagagtaagtgacccaaagag

SEQ ID NO: 1180474 - DNA, 22 bp, Artificial Sequence
  chemically synthesized
ctgcttggtactctttgggtca

SEQ ID NO: 1180475 - DNA, 22 bp, Artificial Sequence
  chemically synthesized
tgcttggtactctttgggtcac

SEQ ID NO: 1180476 - DNA, 22 bp, Artificial Sequence
  chemically synthesized
cttggtactctttgggtcactt

SEQ ID NO: 1180477 - DNA, 22 bp, Artificial Sequence
  chemically synthesized
gattccaagagtaagtgaccca

SEQ ID NO: 1180478 - DNA, 22 bp, Artificial Sequence
  chemically synthesized
ggtactctttgggtcacttact

SEQ ID NO: 1180479 - DNA, 22 bp, Artificial Sequence
  chemically synthesized
gtactctttgggtcacttactc

SEQ ID NO: 1180480 - DNA, 22 bp, Artificial Sequence
  chemically synthesized
gctggattccaagagtaagtga

SEQ ID NO: 1180481 - DNA, 22 bp, Artificial Sequence
  chemically synthesized
tttgggtcacttactcttggaa

SEQ ID NO: 1180482 - DNA, 22 bp, Artificial Sequence
  chemically synthesized
aatgctggctggattccaagag

SEQ ID NO: 1180483 - DNA, 22 bp, Artificial Sequence
  chemically synthesized
tgggtcacttactcttggaatc

SEQ ID NO: 1180484 - DNA, 22 bp, Artificial Sequence
  chemically synthesized
gggtcacttactcttggaatcc

SEQ ID NO: 1180485 - DNA, 22 bp, Artificial Sequence
  chemically synthesized
ggtcacttactcttggaatcca

SEQ ID NO: 1180486 - DNA, 22 bp, Artificial Sequence
  chemically synthesized
actaaatgctggctggattcca

SEQ ID NO: 1180487 - DNA, 22 bp, Artificial Sequence
  chemically synthesized
actcttggaatccagccagcat

SEQ ID NO: 1180488 - DNA, 22 bp, Artificial Sequence
  chemically synthesized
ctcttggaatccagccagcatt

SEQ ID NO: 1180489 - DNA, 22 bp, Artificial Sequence
  chemically synthesized
cagtcactcactaaatgctggc

SEQ ID NO: 1180490 - DNA, 22 bp, Artificial Sequence
  chemically synthesized
ttggaatccagccagcatttag

SEQ ID NO: 1180491 - DNA, 22 bp, Artificial Sequence
  chemically synthesized
ggaatccagccagcatttagtg

SEQ ID NO: 1180492 - DNA, 22 bp, Artificial Sequence
  chemically synthesized
gaatccagccagcatttagtga

SEQ ID NO: 1180493 - DNA, 22 bp, Artificial Sequence
  chemically synthesized
atctgcagtcactcactaaatg

SEQ ID NO: 1180494 - DNA, 22 bp, Artificial Sequence
  chemically synthesized
aatctgcagtcactcactaaat

SEQ ID NO: 1180495 - DNA, 22 bp, Artificial Sequence
  chemically synthesized
tttaatctgcagtcactcacta

SEQ ID NO: 1180496 - DNA, 22 bp, Artificial Sequence
  chemically synthesized
atttaatctgcagtcactcact

SEQ ID NO: 1180497 - DNA, 22 bp, Artificial Sequence
  chemically synthesized
agtgagtgactgcagattaaat

SEQ ID NO: 1180498 - DNA, 22 bp, Artificial Sequence
  chemically synthesized
gtgagtgactgcagattaaata

SEQ ID NO: 1180499 - DNA, 22 bp, Artificial Sequence
  chemically synthesized
gaacatgtatatgtggccttat

SEQ ID NO: 1180500 - DNA, 22 bp, Artificial Sequence
  chemically synthesized
cagattaaataaggccacatat

SEQ ID NO: 1180501 - DNA, 22 bp, Artificial Sequence
  chemically synthesized
gctggaacatgtatatgtggcc

SEQ ID NO: 1180502 - DNA, 22 bp, Artificial Sequence
  chemically synthesized
aataaggccacatatacatgtt

SEQ ID NO: 1180503 - DNA, 22 bp, Artificial Sequence
  chemically synthesized
agccagggcagttggctggaac

SEQ ID NO: 1180504 - DNA, 22 bp, Artificial Sequence
  chemically synthesized
cagccagggcagttggctggaa

SEQ ID NO: 1180505 - DNA, 22 bp, Artificial Sequence
  chemically synthesized
gaacttcagccagggcagttgg

SEQ ID NO: 1180506 - DNA, 22 bp, Artificial Sequence
  chemically synthesized
ctggaacttcagccagggcagt

SEQ ID NO: 1180507 - DNA, 22 bp, Artificial Sequence
  chemically synthesized
ctgctggaacttcagccagggc

SEQ ID NO: 1180508 - DNA, 22 bp, Artificial Sequence
  chemically synthesized
cagccaactgccctggctgaag

SEQ ID NO: 1180509 - DNA, 22 bp, Artificial Sequence
  chemically synthesized
gtggctactgctggaacttcag

SEQ ID NO: 1180510 - DNA, 22 bp, Artificial Sequence
  chemically synthesized
ccctggctgaagttccagcagt

SEQ ID NO: 1180511 - DNA, 22 bp, Artificial Sequence
  chemically synthesized
acatgcctggtggctactgctg

SEQ ID NO: 1180512 - DNA, 22 bp, Artificial Sequence
  chemically synthesized
gctgaagttccagcagtagcca

SEQ ID NO: 1180513 - DNA, 22 bp, Artificial Sequence
  chemically synthesized
actaacatgcctggtggctact

SEQ ID NO: 1180514 - DNA, 22 bp, Artificial Sequence
  chemically synthesized
cactaacatgcctggtggctac

SEQ ID NO: 1180515 - DNA, 22 bp, Artificial Sequence
  chemically synthesized
aagttccagcagtagccaccag

SEQ ID NO: 1180516 - DNA, 22 bp, Artificial Sequence
  chemically synthesized
ttcactaacatgcctggtggct

SEQ ID NO: 1180517 - DNA, 22 bp, Artificial Sequence
  chemically synthesized
cttcactaacatgcctggtggc

SEQ ID NO: 1180518 - DNA, 22 bp, Artificial Sequence
  chemically synthesized
cagcagtagccaccaggcatgt

SEQ ID NO: 1180519 - DNA, 22 bp, Artificial Sequence
  chemically synthesized
aaggcttcttcactaacatgcc

SEQ ID NO: 1180520 - DNA, 22 bp, Artificial Sequence
  chemically synthesized
gaaggcttcttcactaacatgc

SEQ ID NO: 1180521 - DNA, 22 bp, Artificial Sequence
  chemically synthesized
tgaaggcttcttcactaacatg

SEQ ID NO: 1180522 - DNA, 22 bp, Artificial Sequence
  chemically synthesized
aagtcattttgaaggcttcttc

SEQ ID NO: 1180523 - DNA, 22 bp, Artificial Sequence
  chemically synthesized
gtgaagaagccttcaaaatgac

SEQ ID NO: 1180524 - DNA, 22 bp, Artificial Sequence
  chemically synthesized
caaaatgacttcagcttcatct

SEQ ID NO: 1180525 - DNA, 22 bp, Artificial Sequence
  chemically synthesized
aaaatgacttcagcttcatcta

SEQ ID NO: 1180526 - DNA, 22 bp, Artificial Sequence
  chemically synthesized
atataggtgtaataaaatagta

SEQ ID NO: 1180527 - DNA, 22 bp, Artificial Sequence
  chemically synthesized
cagcttcatctactattttatt

SEQ ID NO: 1180528 - DNA, 22 bp, Artificial Sequence
  chemically synthesized
tcatataggtgtaataaaatag

SEQ ID NO: 1180529 - DNA, 22 bp, Artificial Sequence
  chemically synthesized
agcttcatctactattttatta

SEQ ID NO: 1180530 - DNA, 22 bp, Artificial Sequence
  chemically synthesized
ctcatataggtgtaataaaata

SEQ ID NO: 1180531 - DNA, 22 bp, Artificial Sequence
  chemically synthesized
catctactattttattacacct

SEQ ID NO: 1180532 - DNA, 22 bp, Artificial Sequence
  chemically synthesized
atctactattttattacaccta

SEQ ID NO: 1180533 - DNA, 22 bp, Artificial Sequence
  chemically synthesized
agggcttctcatataggtgtaa

SEQ ID NO: 1180534 - DNA, 22 bp, Artificial Sequence
  chemically synthesized
ctattttattacacctatatga

SEQ ID NO: 1180535 - DNA, 22 bp, Artificial Sequence
  chemically synthesized
ttttattacacctatatgagaa

SEQ ID NO: 1180536 - DNA, 22 bp, Artificial Sequence
  chemically synthesized
tattacacctatatgagaagcc

SEQ ID NO: 1180537 - DNA, 22 bp, Artificial Sequence
  chemically synthesized
agatgggttcagggcttctcat

SEQ ID NO: 1180538 - DNA, 22 bp, Artificial Sequence
  chemically synthesized
attacacctatatgagaagccc

SEQ ID NO: 1180539 - DNA, 22 bp, Artificial Sequence
  chemically synthesized
ttacacctatatgagaagccct

SEQ ID NO: 1180540 - DNA, 22 bp, Artificial Sequence
  chemically synthesized
cacctatatgagaagccctgaa

SEQ ID NO: 1180541 - DNA, 22 bp, Artificial Sequence
  chemically synthesized
ggtctcagatgggttcagggct

SEQ ID NO: 1180542 - DNA, 22 bp, Artificial Sequence
  chemically synthesized
tgggtctcagatgggttcaggg

SEQ ID NO: 1180543 - DNA, 22 bp, Artificial Sequence
  chemically synthesized
tatgagaagccctgaacccatc

SEQ ID NO: 1180544 - DNA, 22 bp, Artificial Sequence
  chemically synthesized
attctgggtctcagatgggttc

SEQ ID NO: 1180545 - DNA, 22 bp, Artificial Sequence
  chemically synthesized
gattctgggtctcagatgggtt

SEQ ID NO: 1180546 - DNA, 22 bp, Artificial Sequence
  chemically synthesized
tgattctgggtctcagatgggt

SEQ ID NO: 1180547 - DNA, 22 bp, Artificial Sequence
  chemically synthesized
ttgattctgggtctcagatggg

SEQ ID NO: 1180548 - DNA, 22 bp, Artificial Sequence
  chemically synthesized
ttttgattctgggtctcagatg

SEQ ID NO: 1180549 - DNA, 22 bp, Artificial Sequence
  chemically synthesized
tctcttttgattctgggtctca

SEQ ID NO: 1180550 - DNA, 22 bp, Artificial Sequence
  chemically synthesized
ttatctcttttgattctgggtc

SEQ ID NO: 1180551 - DNA, 22 bp, Artificial Sequence
  chemically synthesized
aacccatctgagacccagaatc

SEQ ID NO: 1180552 - DNA, 22 bp, Artificial Sequence
  chemically synthesized
attatctcttttgattctgggt

SEQ ID NO: 1180553 - DNA, 22 bp, Artificial Sequence
  chemically synthesized
ttattatctcttttgattctgg

SEQ ID NO: 1180554 - DNA, 22 bp, Artificial Sequence
  chemically synthesized
cttattatctcttttgattctg

SEQ ID NO: 1180555 - DNA, 22 bp, Artificial Sequence
  chemically synthesized
tcttattatctcttttgattct

SEQ ID NO: 1180556 - DNA, 22 bp, Artificial Sequence
  chemically synthesized
ttcttattatctcttttgattc

SEQ ID NO: 1180557 - DNA, 22 bp, Artificial Sequence
  chemically synthesized
gtttttcttattatctcttttg

SEQ ID NO: 1180558 - DNA, 22 bp, Artificial Sequence
  chemically synthesized
agacccagaatcaaaagagata

SEQ ID NO: 1180559 - DNA, 22 bp, Artificial Sequence
  chemically synthesized
taaaaacaacattcgtttttct

SEQ ID NO: 1180560 - DNA, 22 bp, Artificial Sequence
  chemically synthesized
ataaaaacaacattcgtttttc

SEQ ID NO: 1180561 - DNA, 22 bp, Artificial Sequence
  chemically synthesized
ggagcttataaaaacaacattc

SEQ ID NO: 1180562 - DNA, 22 bp, Artificial Sequence
  chemically synthesized
gggagcttataaaaacaacatt

SEQ ID NO: 1180563 - DNA, 22 bp, Artificial Sequence
  chemically synthesized
aaaacttgggagcttataaaaa

SEQ ID NO: 1180564 - DNA, 22 bp, Artificial Sequence
  chemically synthesized
tttttataagctcccaagtttt

SEQ ID NO: 1180565 - DNA, 22 bp, Artificial Sequence
  chemically synthesized
ttataagctcccaagttttgag

SEQ ID NO: 1180566 - DNA, 22 bp, Artificial Sequence
  chemically synthesized
tataagctcccaagttttgagt

SEQ ID NO: 1180567 - DNA, 22 bp, Artificial Sequence
  chemically synthesized
ataagctcccaagttttgagtt

SEQ ID NO: 1180568 - DNA, 22 bp, Artificial Sequence
  chemically synthesized
taagctcccaagttttgagttg

SEQ ID NO: 1180569 - DNA, 22 bp, Artificial Sequence
  chemically synthesized
ccatatagcaaatcaactcaaa

SEQ ID NO: 1180570 - DNA, 22 bp, Artificial Sequence
  chemically synthesized
ttgccatatagcaaatcaactc

SEQ ID NO: 1180571 - DNA, 22 bp, Artificial Sequence
  chemically synthesized
ccaagttttgagttgatttgct

SEQ ID NO: 1180572 - DNA, 22 bp, Artificial Sequence
  chemically synthesized
tgagttgatttgctatatggca

SEQ ID NO: 1180573 - DNA, 22 bp, Artificial Sequence
  chemically synthesized
accagtaactattgccatatag

SEQ ID NO: 1180574 - DNA, 22 bp, Artificial Sequence
  chemically synthesized
gagttgatttgctatatggcaa

SEQ ID NO: 1180575 - DNA, 22 bp, Artificial Sequence
  chemically synthesized
agttgatttgctatatggcaat

SEQ ID NO: 1180576 - DNA, 22 bp, Artificial Sequence
  chemically synthesized
ttcaccagtaactattgccata

SEQ ID NO: 1180577 - DNA, 22 bp, Artificial Sequence
  chemically synthesized
gttcaccagtaactattgccat

SEQ ID NO: 1180578 - DNA, 22 bp, Artificial Sequence
  chemically synthesized
atttgctatatggcaatagtta

SEQ ID NO: 1180579 - DNA, 22 bp, Artificial Sequence
  chemically synthesized
ccttgttcaccagtaactattg

SEQ ID NO: 1180580 - DNA, 22 bp, Artificial Sequence
  chemically synthesized
accttgttcaccagtaactatt

SEQ ID NO: 1180581 - DNA, 22 bp, Artificial Sequence
  chemically synthesized
gctatatggcaatagttactgg

SEQ ID NO: 1180582 - DNA, 22 bp, Artificial Sequence
  chemically synthesized
ctatatggcaatagttactggt

SEQ ID NO: 1180583 - DNA, 22 bp, Artificial Sequence
  chemically synthesized
tatggcaatagttactggtgaa

SEQ ID NO: 1180584 - DNA, 22 bp, Artificial Sequence
  chemically synthesized
tgtaatacaggtgtgcttacct

SEQ ID NO: 1180585 - DNA, 22 bp, Artificial Sequence
  chemically synthesized
ctggtgaacaaggtaagcacac

SEQ ID NO: 1180586 - DNA, 22 bp, Artificial Sequence
  chemically synthesized
gtgaacaaggtaagcacacctg

SEQ ID NO: 1180587 - DNA, 22 bp, Artificial Sequence
  chemically synthesized
acctgtgtaatacaggtgtgct

SEQ ID NO: 1180588 - DNA, 22 bp, Artificial Sequence
  chemically synthesized
gctcacctgtgtaatacaggtg

SEQ ID NO: 1180589 - DNA, 22 bp, Artificial Sequence
  chemically synthesized
agctcacctgtgtaatacaggt

SEQ ID NO: 1180590 - DNA, 22 bp, Artificial Sequence
  chemically synthesized
tgtaatgcttagctcacctgtg

SEQ ID NO: 1180591 - DNA, 22 bp, Artificial Sequence
  chemically synthesized
tattacacaggtgagctaagca

SEQ ID NO: 1180592 - DNA, 22 bp, Artificial Sequence
  chemically synthesized
gcatacctgtgtaatgcttagc

SEQ ID NO: 1180593 - DNA, 22 bp, Artificial Sequence
  chemically synthesized
ggcatacctgtgtaatgcttag

SEQ ID NO: 1180594 - DNA, 22 bp, Artificial Sequence
  chemically synthesized
cacaggtgagctaagcattaca

SEQ ID NO: 1180595 - DNA, 22 bp, Artificial Sequence
  chemically synthesized
ttggcatacctgtgtaatgctt

SEQ ID NO: 1180596 - DNA, 22 bp, Artificial Sequence
  chemically synthesized
tctcttggcatacctgtgtaat

SEQ ID NO: 1180597 - DNA, 22 bp, Artificial Sequence
  chemically synthesized
agttatctcttggcatacctgt

SEQ ID NO: 1180598 - DNA, 22 bp, Artificial Sequence
  chemically synthesized
agcattacacaggtatgccaag

SEQ ID NO: 1180599 - DNA, 22 bp, Artificial Sequence
  chemically synthesized
tgtgactcagttatctcttggc

SEQ ID NO: 1180600 - DNA, 22 bp, Artificial Sequence
  chemically synthesized
cacaggtatgccaagagataac

SEQ ID NO: 1180601 - DNA, 22 bp, Artificial Sequence
  chemically synthesized
gttgtgtgactcagttatctct

SEQ ID NO: 1180602 - DNA, 22 bp, Artificial Sequence
  chemically synthesized
agttgtgtgactcagttatctc

SEQ ID NO: 1180603 - DNA, 22 bp, Artificial Sequence
  chemically synthesized
accttagttgtgtgactcagtt

SEQ ID NO: 1180604 - DNA, 22 bp, Artificial Sequence
  chemically synthesized
attgaccttagttgtgtgactc

SEQ ID NO: 1180605 - DNA, 22 bp, Artificial Sequence
  chemically synthesized
caactgattgaccttagttgtg

SEQ ID NO: 1180606 - DNA, 22 bp, Artificial Sequence
  chemically synthesized
gtgttacaactgattgacctta

SEQ ID NO: 1180607 - DNA, 22 bp, Artificial Sequence
  chemically synthesized
agtcacacaactaaggtcaatc

SEQ ID NO: 1180608 - DNA, 22 bp, Artificial Sequence
  chemically synthesized
aggtcaatcagttgtaacacga

SEQ ID NO: 1180609 - DNA, 22 bp, Artificial Sequence
  chemically synthesized
tggaagtaagaattcgtgttac

SEQ ID NO: 1180610 - DNA, 22 bp, Artificial Sequence
  chemically synthesized
atggaagtaagaattcgtgtta

SEQ ID NO: 1180611 - DNA, 22 bp, Artificial Sequence
  chemically synthesized
tatggaagtaagaattcgtgtt

SEQ ID NO: 1180612 - DNA, 22 bp, Artificial Sequence
  chemically synthesized
taacacgaattcttacttccat

SEQ ID NO: 1180613 - DNA, 22 bp, Artificial Sequence
  chemically synthesized
caaatcaagtctttatggaagt

SEQ ID NO: 1180614 - DNA, 22 bp, Artificial Sequence
  chemically synthesized
acaaatcaagtctttatggaag

SEQ ID NO: 1180615 - DNA, 22 bp, Artificial Sequence
  chemically synthesized
tacaaatcaagtctttatggaa

SEQ ID NO: 1180616 - DNA, 22 bp, Artificial Sequence
  chemically synthesized
ttacaaatcaagtctttatgga

SEQ ID NO: 1180617 - DNA, 22 bp, Artificial Sequence
  chemically synthesized
ttttacaaatcaagtctttatg

SEQ ID NO: 1180618 - DNA, 22 bp, Artificial Sequence
  chemically synthesized
cttttacaaatcaagtctttat

SEQ ID NO: 1180619 - DNA, 22 bp, Artificial Sequence
  chemically synthesized
tcttttacaaatcaagtcttta

SEQ ID NO: 1180620 - DNA, 22 bp, Artificial Sequence
  chemically synthesized
ttcttttacaaatcaagtcttt

SEQ ID NO: 1180621 - DNA, 22 bp, Artificial Sequence
  chemically synthesized
ttacttccataaagacttgatt

SEQ ID NO: 1180622 - DNA, 22 bp, Artificial Sequence
  chemically synthesized
tttttcttttacaaatcaagtc

SEQ ID NO: 1180623 - DNA, 22 bp, Artificial Sequence
  chemically synthesized
acttccataaagacttgatttg

SEQ ID NO: 1180624 - DNA, 22 bp, Artificial Sequence
  chemically synthesized
cttccataaagacttgatttgt

SEQ ID NO: 1180625 - DNA, 22 bp, Artificial Sequence
  chemically synthesized
ttatttttcttttacaaatcaa

SEQ ID NO: 1180626 - DNA, 22 bp, Artificial Sequence
  chemically synthesized
attatttttcttttacaaatca

SEQ ID NO: 1180627 - DNA, 22 bp, Artificial Sequence
  chemically synthesized
ccataaagacttgatttgtaaa

SEQ ID NO: 1180628 - DNA, 22 bp, Artificial Sequence
  chemically synthesized
tattatttttcttttacaaatc

SEQ ID NO: 1180629 - DNA, 22 bp, Artificial Sequence
  chemically synthesized
cataaagacttgatttgtaaaa

SEQ ID NO: 1180630 - DNA, 22 bp, Artificial Sequence
  chemically synthesized
tgttttattatttttcttttac

SEQ ID NO: 1180631 - DNA, 22 bp, Artificial Sequence
  chemically synthesized
atgttttattatttttctttta

SEQ ID NO: 1180632 - DNA, 22 bp, Artificial Sequence
  chemically synthesized
tatgttttattatttttctttt

SEQ ID NO: 1180633 - DNA, 22 bp, Artificial Sequence
  chemically synthesized
ttatgttttattatttttcttt

SEQ ID NO: 1180634 - DNA, 22 bp, Artificial Sequence
  chemically synthesized
tttttatgttttattatttttc

SEQ ID NO: 1180635 - DNA, 22 bp, Artificial Sequence
  chemically synthesized
gatttgtaaaagaaaaataata

SEQ ID NO: 1180636 - DNA, 22 bp, Artificial Sequence
  chemically synthesized
atttttatgttttattattttt

SEQ ID NO: 1180637 - DNA, 22 bp, Artificial Sequence
  chemically synthesized
atttgtaaaagaaaaataataa

SEQ ID NO: 1180638 - DNA, 22 bp, Artificial Sequence
  chemically synthesized
tatttttatgttttattatttt

SEQ ID NO: 1180639 - DNA, 22 bp, Artificial Sequence
  chemically synthesized
ttatttttatgttttattattt

SEQ ID NO: 1180640 - DNA, 22 bp, Artificial Sequence
  chemically synthesized
tttatttttatgttttattatt

SEQ ID NO: 1180641 - DNA, 22 bp, Artificial Sequence
  chemically synthesized
ttttatttttatgttttattat

SEQ ID NO: 1180642 - DNA, 22 bp, Artificial Sequence
  chemically synthesized
gtaaaagaaaaataataaaaca

SEQ ID NO: 1180643 - DNA, 22 bp, Artificial Sequence
  chemically synthesized
taaaagaaaaataataaaacat

SEQ ID NO: 1180644 - DNA, 22 bp, Artificial Sequence
  chemically synthesized
atacttttttatttttatgttt

SEQ ID NO: 1180645 - DNA, 22 bp, Artificial Sequence
  chemically synthesized
aatacttttttatttttatgtt

SEQ ID NO: 1180646 - DNA, 22 bp, Artificial Sequence
  chemically synthesized
taatacttttttatttttatgt

SEQ ID NO: 1180647 - DNA, 22 bp, Artificial Sequence
  chemically synthesized
ttttaatacttttttattttta

SEQ ID NO: 1180648 - DNA, 22 bp, Artificial Sequence
  chemically synthesized
attttaatacttttttattttt

SEQ ID NO: 1180649 - DNA, 22 bp, Artificial Sequence
  chemically synthesized
aaacatttattttaatactttt

SEQ ID NO: 1180650 - DNA, 22 bp, Artificial Sequence
  chemically synthesized
caaacatttattttaatacttt

SEQ ID NO: 1180651 - DNA, 22 bp, Artificial Sequence
  chemically synthesized
tcaaacatttattttaatactt

SEQ ID NO: 1180652 - DNA, 22 bp, Artificial Sequence
  chemically synthesized
ttcaaacatttattttaatact

SEQ ID NO: 1180653 - DNA, 22 bp, Artificial Sequence
  chemically synthesized
tttcaaacatttattttaatac

SEQ ID NO: 1180654 - DNA, 22 bp, Artificial Sequence
  chemically synthesized
aggaatatctttttcaaacatt

SEQ ID NO: 1180655 - DNA, 22 bp, Artificial Sequence
  chemically synthesized
aaggaatatctttttcaaacat

SEQ ID NO: 1180656 - DNA, 22 bp, Artificial Sequence
  chemically synthesized
ttaaggaatatctttttcaaac

SEQ ID NO: 1180657 - DNA, 22 bp, Artificial Sequence
  chemically synthesized
aaataaatgtttgaaaaagata

SEQ ID NO: 1180658 - DNA, 22 bp, Artificial Sequence
  chemically synthesized
ggaagggcctcttaaggaatat

SEQ ID NO: 1180659 - DNA, 22 bp, Artificial Sequence
  chemically synthesized
aggaagggcctcttaaggaata

SEQ ID NO: 1180660 - DNA, 22 bp, Artificial Sequence
  chemically synthesized
taggaagggcctcttaaggaat

SEQ ID NO: 1180661 - DNA, 22 bp, Artificial Sequence
  chemically synthesized
tttaggaagggcctcttaagga

SEQ ID NO: 1180662 - DNA, 22 bp, Artificial Sequence
  chemically synthesized
gaaaaagatattccttaagagg

SEQ ID NO: 1180663 - DNA, 22 bp, Artificial Sequence
  chemically synthesized
ctttaggaagggcctcttaagg

SEQ ID NO: 1180664 - DNA, 22 bp, Artificial Sequence
  chemically synthesized
aaaaagatattccttaagaggc

SEQ ID NO: 1180665 - DNA, 22 bp, Artificial Sequence
  chemically synthesized
cttaagaggcccttcctaaaga

SEQ ID NO: 1180666 - DNA, 22 bp, Artificial Sequence
  chemically synthesized
gatgcagtatgccttctttagg

SEQ ID NO: 1180667 - DNA, 22 bp, Artificial Sequence
  chemically synthesized
aagaggcccttcctaaagaagg

SEQ ID NO: 1180668 - DNA, 22 bp, Artificial Sequence
  chemically synthesized
agaggcccttcctaaagaaggc

SEQ ID NO: 1180669 - DNA, 22 bp, Artificial Sequence
  chemically synthesized
cctaaagaaggcatactgcatc

SEQ ID NO: 1180670 - DNA, 22 bp, Artificial Sequence
  chemically synthesized
ctaaagaaggcatactgcatct

SEQ ID NO: 1180671 - DNA, 22 bp, Artificial Sequence
  chemically synthesized
cacatgtaggctagatgcagta

SEQ ID NO: 1180672 - DNA, 22 bp, Artificial Sequence
  chemically synthesized
aagaaggcatactgcatctagc

SEQ ID NO: 1180673 - DNA, 22 bp, Artificial Sequence
  chemically synthesized
gatctccacatgtaggctagat

SEQ ID NO: 1180674 - DNA, 22 bp, Artificial Sequence
  chemically synthesized
ggatctccacatgtaggctaga

SEQ ID NO: 1180675 - DNA, 22 bp, Artificial Sequence
  chemically synthesized
tttggatctccacatgtaggct

SEQ ID NO: 1180676 - DNA, 22 bp, Artificial Sequence
  chemically synthesized
gtttggatctccacatgtaggc

SEQ ID NO: 1180677 - DNA, 22 bp, Artificial Sequence
  chemically synthesized
catctagcctacatgtggagat

SEQ ID NO: 1180678 - DNA, 22 bp, Artificial Sequence
  chemically synthesized
atagtttgtttggatctccaca

SEQ ID NO: 1180679 - DNA, 22 bp, Artificial Sequence
  chemically synthesized
gcctacatgtggagatccaaac

SEQ ID NO: 1180680 - DNA, 22 bp, Artificial Sequence
  chemically synthesized
taatcattaatagtttgtttgg

SEQ ID NO: 1180681 - DNA, 22 bp, Artificial Sequence
  chemically synthesized
catgtggagatccaaacaaact

SEQ ID NO: 1180682 - DNA, 22 bp, Artificial Sequence
  chemically synthesized
gtaatcattaatagtttgtttg

SEQ ID NO: 1180683 - DNA, 22 bp, Artificial Sequence
  chemically synthesized
tttgtaatcattaatagtttgt

SEQ ID NO: 1180684 - DNA, 22 bp, Artificial Sequence
  chemically synthesized
atttgtaatcattaatagtttg

SEQ ID NO: 1180685 - DNA, 22 bp, Artificial Sequence
  chemically synthesized
agcaggtcagggcggcttattt

SEQ ID NO: 1180686 - DNA, 22 bp, Artificial Sequence
  chemically synthesized
ttaatgattacaaataagccgc

SEQ ID NO: 1180687 - DNA, 22 bp, Artificial Sequence
  chemically synthesized
aagcaggtcagggcggcttatt

SEQ ID NO: 1180688 - DNA, 22 bp, Artificial Sequence
  chemically synthesized
atgattacaaataagccgccct

SEQ ID NO: 1180689 - DNA, 22 bp, Artificial Sequence
  chemically synthesized
cggtgtttaagcaggtcagggc

SEQ ID NO: 1180690 - DNA, 22 bp, Artificial Sequence
  chemically synthesized
caaataagccgccctgacctgc

SEQ ID NO: 1180691 - DNA, 22 bp, Artificial Sequence
  chemically synthesized
tgttccggtgtttaagcaggtc

SEQ ID NO: 1180692 - DNA, 22 bp, Artificial Sequence
  chemically synthesized
atctgtgttccggtgtttaagc

SEQ ID NO: 1180693 - DNA, 22 bp, Artificial Sequence
  chemically synthesized
gctaatctgtgttccggtgttt

SEQ ID NO: 1180694 - DNA, 22 bp, Artificial Sequence
  chemically synthesized
agctaatctgtgttccggtgtt

SEQ ID NO: 1180695 - DNA, 22 bp, Artificial Sequence
  chemically synthesized
acctgcttaaacaccggaacac

SEQ ID NO: 1180696 - DNA, 22 bp, Artificial Sequence
  chemically synthesized
cttaaacaccggaacacagatt

SEQ ID NO: 1180697 - DNA, 22 bp, Artificial Sequence
  chemically synthesized
gatggaatttagctaatctgtg

SEQ ID NO: 1180698 - DNA, 22 bp, Artificial Sequence
  chemically synthesized
aaacaccggaacacagattagc

SEQ ID NO: 1180699 - DNA, 22 bp, Artificial Sequence
  chemically synthesized
aacaccggaacacagattagct

SEQ ID NO: 1180700 - DNA, 22 bp, Artificial Sequence
  chemically synthesized
ttggatggaatttagctaatct

SEQ ID NO: 1180701 - DNA, 22 bp, Artificial Sequence
  chemically synthesized
aatgaattattggatggaattt

SEQ ID NO: 1180702 - DNA, 22 bp, Artificial Sequence
  chemically synthesized
gaatgaattattggatggaatt

SEQ ID NO: 1180703 - DNA, 22 bp, Artificial Sequence
  chemically synthesized
gaatttgaatgaattattggat

SEQ ID NO: 1180704 - DNA, 22 bp, Artificial Sequence
  chemically synthesized
gctaaattccatccaataattc

SEQ ID NO: 1180705 - DNA, 22 bp, Artificial Sequence
  chemically synthesized
ctagaatttgaatgaattattg

SEQ ID NO: 1180706 - DNA, 22 bp, Artificial Sequence
  chemically synthesized
aattccatccaataattcattc

SEQ ID NO: 1180707 - DNA, 22 bp, Artificial Sequence
  chemically synthesized
tcggttcctagaatttgaatga

SEQ ID NO: 1180708 - DNA, 22 bp, Artificial Sequence
  chemically synthesized
catccaataattcattcaaatt

SEQ ID NO: 1180709 - DNA, 22 bp, Artificial Sequence
  chemically synthesized
gtcggttcctagaatttgaatg

SEQ ID NO: 1180710 - DNA, 22 bp, Artificial Sequence
  chemically synthesized
tgggatttgtcggttcctagaa

SEQ ID NO: 1180711 - DNA, 22 bp, Artificial Sequence
  chemically synthesized
atgggatttgtcggttcctaga

SEQ ID NO: 1180712 - DNA, 22 bp, Artificial Sequence
  chemically synthesized
tatgggatttgtcggttcctag

SEQ ID NO: 1180713 - DNA, 22 bp, Artificial Sequence
  chemically synthesized
attcaaattctaggaaccgaca

SEQ ID NO: 1180714 - DNA, 22 bp, Artificial Sequence
  chemically synthesized
cattttatgggatttgtcggtt

SEQ ID NO: 1180715 - DNA, 22 bp, Artificial Sequence
  chemically synthesized
aaattctaggaaccgacaaatc

SEQ ID NO: 1180716 - DNA, 22 bp, Artificial Sequence
  chemically synthesized
ttacattttatgggatttgtcg

SEQ ID NO: 1180717 - DNA, 22 bp, Artificial Sequence
  chemically synthesized
attacattttatgggatttgtc

SEQ ID NO: 1180718 - DNA, 22 bp, Artificial Sequence
  chemically synthesized
taggaaccgacaaatcccataa

SEQ ID NO: 1180719 - DNA, 22 bp, Artificial Sequence
  chemically synthesized
ggaaccgacaaatcccataaaa

SEQ ID NO: 1180720 - DNA, 22 bp, Artificial Sequence
  chemically synthesized
agtcatgtttattacattttat

SEQ ID NO: 1180721 - DNA, 22 bp, Artificial Sequence
  chemically synthesized
aagtcatgtttattacatttta

SEQ ID NO: 1180722 - DNA, 22 bp, Artificial Sequence
  chemically synthesized
atttaagtcatgtttattacat

SEQ ID NO: 1180723 - DNA, 22 bp, Artificial Sequence
  chemically synthesized
tcatttaagtcatgtttattac

SEQ ID NO: 1180724 - DNA, 22 bp, Artificial Sequence
  chemically synthesized
aatgctctcatttaagtcatgt

SEQ ID NO: 1180725 - DNA, 22 bp, Artificial Sequence
  chemically synthesized
gaatgctctcatttaagtcatg

SEQ ID NO: 1180726 - DNA, 22 bp, Artificial Sequence
  chemically synthesized
cgaaccaaggatatttgaatgc

SEQ ID NO: 1180727 - DNA, 22 bp, Artificial Sequence
  chemically synthesized
gcgaaccaaggatatttgaatg

SEQ ID NO: 1180728 - DNA, 22 bp, Artificial Sequence
  chemically synthesized
tgcgaaccaaggatatttgaat

SEQ ID NO: 1180729 - DNA, 22 bp, Artificial Sequence
  chemically synthesized
ttgcgaaccaaggatatttgaa

SEQ ID NO: 1180730 - DNA, 22 bp, Artificial Sequence
  chemically synthesized
aaatgagagcattcaaatatcc

SEQ ID NO: 1180731 - DNA, 22 bp, Artificial Sequence
  chemically synthesized
aatgagagcattcaaatatcct

SEQ ID NO: 1180732 - DNA, 22 bp, Artificial Sequence
  chemically synthesized
aaatatccttggttcgcaaaaa

SEQ ID NO: 1180733 - DNA, 22 bp, Artificial Sequence
  chemically synthesized
caaaaatagagtcaatttttgc

SEQ ID NO: 1180734 - DNA, 22 bp, Artificial Sequence
  chemically synthesized
ggttcgcaaaaattgactctat

SEQ ID NO: 1180735 - DNA, 22 bp, Artificial Sequence
  chemically synthesized
gttcgcaaaaattgactctatt

SEQ ID NO: 1180736 - DNA, 22 bp, Artificial Sequence
  chemically synthesized
tggatgttacaaaaatagagtc

SEQ ID NO: 1180737 - DNA, 22 bp, Artificial Sequence
  chemically synthesized
gcaaaaattgactctatttttg

SEQ ID NO: 1180738 - DNA, 22 bp, Artificial Sequence
  chemically synthesized
ctgtggatgttacaaaaataga

SEQ ID NO: 1180739 - DNA, 22 bp, Artificial Sequence
  chemically synthesized
actctatttttgtaacatccac

SEQ ID NO: 1180740 - DNA, 22 bp, Artificial Sequence
  chemically synthesized
tatttttgtaacatccacagca

SEQ ID NO: 1180741 - DNA, 22 bp, Artificial Sequence
  chemically synthesized
tttttgtaacatccacagcaat

SEQ ID NO: 1180742 - DNA, 22 bp, Artificial Sequence
  chemically synthesized
ttgtaacatccacagcaatacc

SEQ ID NO: 1180743 - DNA, 22 bp, Artificial Sequence
  chemically synthesized
tgtaacatccacagcaatacct

SEQ ID NO: 1180744 - DNA, 22 bp, Artificial Sequence
  chemically synthesized
gtaacatccacagcaatacctc

SEQ ID NO: 1180745 - DNA, 22 bp, Artificial Sequence
  chemically synthesized
taacatccacagcaatacctct

SEQ ID NO: 1180746 - DNA, 22 bp, Artificial Sequence
  chemically synthesized
ataccagagataggtccagagg

SEQ ID NO: 1180747 - DNA, 22 bp, Artificial Sequence
  chemically synthesized
gataccagagataggtccagag

SEQ ID NO: 1180748 - DNA, 22 bp, Artificial Sequence
  chemically synthesized
ttgataccagagataggtccag

SEQ ID NO: 1180749 - DNA, 22 bp, Artificial Sequence
  chemically synthesized
tctcttgataccagagataggt

SEQ ID NO: 1180750 - DNA, 22 bp, Artificial Sequence
  chemically synthesized
gtctcttgataccagagatagg

SEQ ID NO: 1180751 - DNA, 22 bp, Artificial Sequence
  chemically synthesized
tgtctcttgataccagagatag

SEQ ID NO: 1180752 - DNA, 22 bp, Artificial Sequence
  chemically synthesized
ttgtctcttgataccagagata

SEQ ID NO: 1180753 - DNA, 22 bp, Artificial Sequence
  chemically synthesized
tttgtctcttgataccagagat

SEQ ID NO: 1180754 - DNA, 22 bp, Artificial Sequence
  chemically synthesized
ttttgtctcttgataccagaga

SEQ ID NO: 1180755 - DNA, 22 bp, Artificial Sequence
  chemically synthesized
tggacctatctctggtatcaag

SEQ ID NO: 1180756 - DNA, 22 bp, Artificial Sequence
  chemically synthesized
gacctatctctggtatcaagag

SEQ ID NO: 1180757 - DNA, 22 bp, Artificial Sequence
  chemically synthesized
gaaaatgacttttttgtctctt

SEQ ID NO: 1180758 - DNA, 22 bp, Artificial Sequence
  chemically synthesized
tctctggtatcaagagacaaaa

SEQ ID NO: 1180759 - DNA, 22 bp, Artificial Sequence
  chemically synthesized
tagaaaatgacttttttgtctc

SEQ ID NO: 1180760 - DNA, 22 bp, Artificial Sequence
  chemically synthesized
tggtatcaagagacaaaaaagt

SEQ ID NO: 1180761 - DNA, 22 bp, Artificial Sequence
  chemically synthesized
gtatcaagagacaaaaaagtca

SEQ ID NO: 1180762 - DNA, 22 bp, Artificial Sequence
  chemically synthesized
ccaaccattctagaaaatgact

SEQ ID NO: 1180763 - DNA, 22 bp, Artificial Sequence
  chemically synthesized
accaaccattctagaaaatgac

SEQ ID NO: 1180764 - DNA, 22 bp, Artificial Sequence
  chemically synthesized
taccaaccattctagaaaatga

SEQ ID NO: 1180765 - DNA, 22 bp, Artificial Sequence
  chemically synthesized
tctagaatggttggtaaaatta

SEQ ID NO: 1180766 - DNA, 22 bp, Artificial Sequence
  chemically synthesized
ctagaatggttggtaaaattat

SEQ ID NO: 1180767 - DNA, 22 bp, Artificial Sequence
  chemically synthesized
tagaatggttggtaaaattata

SEQ ID NO: 1180768 - DNA, 22 bp, Artificial Sequence
  chemically synthesized
gaagagatgatatataatttta

SEQ ID NO: 1180769 - DNA, 22 bp, Artificial Sequence
  chemically synthesized
gaatggttggtaaaattatata

SEQ ID NO: 1180770 - DNA, 22 bp, Artificial Sequence
  chemically synthesized
tggaagagatgatatataattt

SEQ ID NO: 1180771 - DNA, 22 bp, Artificial Sequence
  chemically synthesized
ctggaagagatgatatataatt

SEQ ID NO: 1180772 - DNA, 22 bp, Artificial Sequence
  chemically synthesized
gagtttctggaagagatgatat

SEQ ID NO: 1180773 - DNA, 22 bp, Artificial Sequence
  chemically synthesized
ggagtttctggaagagatgata

SEQ ID NO: 1180774 - DNA, 22 bp, Artificial Sequence
  chemically synthesized
gtaaaattatatatcatctctt

SEQ ID NO: 1180775 - DNA, 22 bp, Artificial Sequence
  chemically synthesized
tatatcatctcttccagaaact

SEQ ID NO: 1180776 - DNA, 22 bp, Artificial Sequence
  chemically synthesized
gtaaagatatttggagtttctg

SEQ ID NO: 1180777 - DNA, 22 bp, Artificial Sequence
  chemically synthesized
ggtaaagatatttggagtttct

SEQ ID NO: 1180778 - DNA, 22 bp, Artificial Sequence
  chemically synthesized
catttggtaaagatatttggag

SEQ ID NO: 1180779 - DNA, 22 bp, Artificial Sequence
  chemically synthesized
acatttggtaaagatatttgga

SEQ ID NO: 1180780 - DNA, 22 bp, Artificial Sequence
  chemically synthesized
tacatttggtaaagatatttgg

SEQ ID NO: 1180781 - DNA, 22 bp, Artificial Sequence
  chemically synthesized
ttccagaaactccaaatatctt

SEQ ID NO: 1180782 - DNA, 22 bp, Artificial Sequence
  chemically synthesized
ttacatttggtaaagatatttg

SEQ ID NO: 1180783 - DNA, 22 bp, Artificial Sequence
  chemically synthesized
ccagaaactccaaatatcttta

SEQ ID NO: 1180784 - DNA, 22 bp, Artificial Sequence
  chemically synthesized
cagaaactccaaatatctttac

SEQ ID NO: 1180785 - DNA, 22 bp, Artificial Sequence
  chemically synthesized
caaatatctttaccaaatgtaa

SEQ ID NO: 1180786 - DNA, 22 bp, Artificial Sequence
  chemically synthesized
taccaaatgtaaaaatggactt

SEQ ID NO: 1180787 - DNA, 22 bp, Artificial Sequence
  chemically synthesized
accaaatgtaaaaatggacttt

SEQ ID NO: 1180788 - DNA, 22 bp, Artificial Sequence
  chemically synthesized
ccaaatgtaaaaatggactttc

SEQ ID NO: 1180789 - DNA, 22 bp, Artificial Sequence
  chemically synthesized
aaaatataagtcaaaaaatgta

SEQ ID NO: 1180790 - DNA, 22 bp, Artificial Sequence
  chemically synthesized
aaaaatataagtcaaaaaatgt

SEQ ID NO: 1180791 - DNA, 22 bp, Artificial Sequence
  chemically synthesized
tcattctacattttttgactta

SEQ ID NO: 1180792 - DNA, 22 bp, Artificial Sequence
  chemically synthesized
cattctacattttttgacttat

SEQ ID NO: 1180793 - DNA, 22 bp, Artificial Sequence
  chemically synthesized
attctacattttttgacttata

SEQ ID NO: 1180794 - DNA, 22 bp, Artificial Sequence
  chemically synthesized
tacattttttgacttatatttt

SEQ ID NO: 1180795 - DNA, 22 bp, Artificial Sequence
  chemically synthesized
cattttttgacttatattttta

SEQ ID NO: 1180796 - DNA, 22 bp, Artificial Sequence
  chemically synthesized
tttgacttatatttttaagatt

SEQ ID NO: 1180797 - DNA, 22 bp, Artificial Sequence
  chemically synthesized
ttgacttatatttttaagatta

SEQ ID NO: 1180798 - DNA, 22 bp, Artificial Sequence
  chemically synthesized
taaatgataatgtaatcttaaa

SEQ ID NO: 1180799 - DNA, 22 bp, Artificial Sequence
  chemically synthesized
tgacttatatttttaagattac

SEQ ID NO: 1180800 - DNA, 22 bp, Artificial Sequence
  chemically synthesized
ataaatgataatgtaatcttaa

SEQ ID NO: 1180801 - DNA, 22 bp, Artificial Sequence
  chemically synthesized
gacttatatttttaagattaca

SEQ ID NO: 1180802 - DNA, 22 bp, Artificial Sequence
  chemically synthesized
acttatatttttaagattacat

SEQ ID NO: 1180803 - DNA, 22 bp, Artificial Sequence
  chemically synthesized
tatttataaatgataatgtaat

SEQ ID NO: 1180804 - DNA, 22 bp, Artificial Sequence
  chemically synthesized
atatttttaagattacattatc

SEQ ID NO: 1180805 - DNA, 22 bp, Artificial Sequence
  chemically synthesized
tatttttaagattacattatca

SEQ ID NO: 1180806 - DNA, 22 bp, Artificial Sequence
  chemically synthesized
cattatatttataaatgataat

SEQ ID NO: 1180807 - DNA, 22 bp, Artificial Sequence
  chemically synthesized
gcattatatttataaatgataa

SEQ ID NO: 1180808 - DNA, 22 bp, Artificial Sequence
  chemically synthesized
ttaagattacattatcatttat

SEQ ID NO: 1180809 - DNA, 22 bp, Artificial Sequence
  chemically synthesized
tgcattatatttataaatgata

SEQ ID NO: 1180810 - DNA, 22 bp, Artificial Sequence
  chemically synthesized
taagattacattatcatttata

SEQ ID NO: 1180811 - DNA, 22 bp, Artificial Sequence
  chemically synthesized
aagattacattatcatttataa

SEQ ID NO: 1180812 - DNA, 22 bp, Artificial Sequence
  chemically synthesized
agattacattatcatttataaa

SEQ ID NO: 1180813 - DNA, 22 bp, Artificial Sequence
  chemically synthesized
cattttgcattatatttataaa

SEQ ID NO: 1180814 - DNA, 22 bp, Artificial Sequence
  chemically synthesized
ccattttgcattatatttataa

SEQ ID NO: 1180815 - DNA, 22 bp, Artificial Sequence
  chemically synthesized
ttccattttgcattatatttat

SEQ ID NO: 1180816 - DNA, 22 bp, Artificial Sequence
  chemically synthesized
cattatcatttataaatataat

SEQ ID NO: 1180817 - DNA, 22 bp, Artificial Sequence
  chemically synthesized
tcatttataaatataatgcaaa

SEQ ID NO: 1180818 - DNA, 22 bp, Artificial Sequence
  chemically synthesized
ataaatataatgcaaaatggaa

SEQ ID NO: 1180819 - DNA, 22 bp, Artificial Sequence
  chemically synthesized
taaatataatgcaaaatggaag

SEQ ID NO: 1180820 - DNA, 22 bp, Artificial Sequence
  chemically synthesized
caacaacgtggatcaacactct

SEQ ID NO: 1180821 - DNA, 22 bp, Artificial Sequence
  chemically synthesized
acaacaacgtggatcaacactc

SEQ ID NO: 1180822 - DNA, 22 bp, Artificial Sequence
  chemically synthesized
agggtaaagaaatatttacaac

SEQ ID NO: 1180823 - DNA, 22 bp, Artificial Sequence
  chemically synthesized
atccacgttgttgtaaatattt

SEQ ID NO: 1180824 - DNA, 22 bp, Artificial Sequence
  chemically synthesized
aataagtagttaagggtaaaga

SEQ ID NO: 1180825 - DNA, 22 bp, Artificial Sequence
  chemically synthesized
ttgtaaatatttctttaccctt

SEQ ID NO: 1180826 - DNA, 22 bp, Artificial Sequence
  chemically synthesized
taaatatttctttacccttaac

SEQ ID NO: 1180827 - DNA, 22 bp, Artificial Sequence
  chemically synthesized
ctttacccttaactacttattg

SEQ ID NO: 1180828 - DNA, 22 bp, Artificial Sequence
  chemically synthesized
tttacccttaactacttattga

SEQ ID NO: 1180829 - DNA, 22 bp, Artificial Sequence
  chemically synthesized
cacaacaggcattcaataagta

SEQ ID NO: 1180830 - DNA, 22 bp, Artificial Sequence
  chemically synthesized
acacaacaggcattcaataagt

SEQ ID NO: 1180831 - DNA, 22 bp, Artificial Sequence
  chemically synthesized
tacccttaactacttattgaat

SEQ ID NO: 1180832 - DNA, 22 bp, Artificial Sequence
  chemically synthesized
acccttaactacttattgaatg

SEQ ID NO: 1180833 - DNA, 22 bp, Artificial Sequence
  chemically synthesized
ttacacaacaggcattcaataa

SEQ ID NO: 1180834 - DNA, 22 bp, Artificial Sequence
  chemically synthesized
cccttaactacttattgaatgc

SEQ ID NO: 1180835 - DNA, 22 bp, Artificial Sequence
  chemically synthesized
cttacacaacaggcattcaata

SEQ ID NO: 1180836 - DNA, 22 bp, Artificial Sequence
  chemically synthesized
aactacttattgaatgcctgtt

SEQ ID NO: 1180837 - DNA, 22 bp, Artificial Sequence
  chemically synthesized
accttcttacacaacaggcatt

SEQ ID NO: 1180838 - DNA, 22 bp, Artificial Sequence
  chemically synthesized
actacttattgaatgcctgttg

SEQ ID NO: 1180839 - DNA, 22 bp, Artificial Sequence
  chemically synthesized
cttattgaatgcctgttgtgta

SEQ ID NO: 1180840 - DNA, 22 bp, Artificial Sequence
  chemically synthesized
cattcaccttcttacacaacag

SEQ ID NO: 1180841 - DNA, 22 bp, Artificial Sequence
  chemically synthesized
attgaatgcctgttgtgtaaga

SEQ ID NO: 1180842 - DNA, 22 bp, Artificial Sequence
  chemically synthesized
ttgaatgcctgttgtgtaagaa

SEQ ID NO: 1180843 - DNA, 22 bp, Artificial Sequence
  chemically synthesized
aatgcctgttgtgtaagaaggt

SEQ ID NO: 1180844 - DNA, 22 bp, Artificial Sequence
  chemically synthesized
gaggggaaagactccattcacc

SEQ ID NO: 1180845 - DNA, 22 bp, Artificial Sequence
  chemically synthesized
ttgtgtaagaaggtgaatggag

SEQ ID NO: 1180846 - DNA, 22 bp, Artificial Sequence
  chemically synthesized
tgtaagaaggtgaatggagtct

SEQ ID NO: 1180847 - DNA, 22 bp, Artificial Sequence
  chemically synthesized
tcacatagagtgttagagggga

SEQ ID NO: 1180848 - DNA, 22 bp, Artificial Sequence
  chemically synthesized
cactatcacatagagtgttaga

SEQ ID NO: 1180849 - DNA, 22 bp, Artificial Sequence
  chemically synthesized
tcccctctaacactctatgtga

SEQ ID NO: 1180850 - DNA, 22 bp, Artificial Sequence
  chemically synthesized
cccctctaacactctatgtgat

SEQ ID NO: 1180851 - DNA, 22 bp, Artificial Sequence
  chemically synthesized
ccctctaacactctatgtgata

SEQ ID NO: 1180852 - DNA, 22 bp, Artificial Sequence
  chemically synthesized
taacactctatgtgatagtgga

SEQ ID NO: 1180853 - DNA, 22 bp, Artificial Sequence
  chemically synthesized
acactctatgtgatagtggagg

SEQ ID NO: 1180854 - DNA, 22 bp, Artificial Sequence
  chemically synthesized
tatgtgatagtggaggcttttc

SEQ ID NO: 1180855 - DNA, 22 bp, Artificial Sequence
  chemically synthesized
tgtgatagtggaggcttttctc

SEQ ID NO: 1180856 - DNA, 22 bp, Artificial Sequence
  chemically synthesized
atgcatagtgtatgtgagaaaa

SEQ ID NO: 1180857 - DNA, 22 bp, Artificial Sequence
  chemically synthesized
aaataattaatgcatagtgtat

SEQ ID NO: 1180858 - DNA, 22 bp, Artificial Sequence
  chemically synthesized
ttctcacatacactatgcatta

SEQ ID NO: 1180859 - DNA, 22 bp, Artificial Sequence
  chemically synthesized
tctcacatacactatgcattaa

SEQ ID NO: 1180860 - DNA, 22 bp, Artificial Sequence
  chemically synthesized
ctcacatacactatgcattaat

SEQ ID NO: 1180861 - DNA, 22 bp, Artificial Sequence
  chemically synthesized
tcacatacactatgcattaatt

SEQ ID NO: 1180862 - DNA, 22 bp, Artificial Sequence
  chemically synthesized
acatacactatgcattaattat

SEQ ID NO: 1180863 - DNA, 22 bp, Artificial Sequence
  chemically synthesized
catggggtggctaaaataatta

SEQ ID NO: 1180864 - DNA, 22 bp, Artificial Sequence
  chemically synthesized
ccatggggtggctaaaataatt

SEQ ID NO: 1180865 - DNA, 22 bp, Artificial Sequence
  chemically synthesized
tccatggggtggctaaaataat

SEQ ID NO: 1180866 - DNA, 22 bp, Artificial Sequence
  chemically synthesized
tgcattaattattttagccacc

SEQ ID NO: 1180867 - DNA, 22 bp, Artificial Sequence
  chemically synthesized
aactttccatggggtggctaaa

SEQ ID NO: 1180868 - DNA, 22 bp, Artificial Sequence
  chemically synthesized
caactttccatggggtggctaa

SEQ ID NO: 1180869 - DNA, 22 bp, Artificial Sequence
  chemically synthesized
tcaactttccatggggtggcta

SEQ ID NO: 1180870 - DNA, 22 bp, Artificial Sequence
  chemically synthesized
attattttagccaccccatgga

SEQ ID NO: 1180871 - DNA, 22 bp, Artificial Sequence
  chemically synthesized
ttttagccaccccatggaaagt

SEQ ID NO: 1180872 - DNA, 22 bp, Artificial Sequence
  chemically synthesized
tagccaccccatggaaagttga

SEQ ID NO: 1180873 - DNA, 22 bp, Artificial Sequence
  chemically synthesized
agccaccccatggaaagttgaa

SEQ ID NO: 1180874 - DNA, 22 bp, Artificial Sequence
  chemically synthesized
gccaccccatggaaagttgaaa

SEQ ID NO: 1180875 - DNA, 22 bp, Artificial Sequence
  chemically synthesized
aaataaagatactttcaacttt

SEQ ID NO: 1180876 - DNA, 22 bp, Artificial Sequence
  chemically synthesized
taaaataaagatactttcaact

SEQ ID NO: 1180877 - DNA, 22 bp, Artificial Sequence
  chemically synthesized
atctctaaaataaagatacttt

SEQ ID NO: 1180878 - DNA, 22 bp, Artificial Sequence
  chemically synthesized
tcatctctaaaataaagatact

SEQ ID NO: 1180879 - DNA, 22 bp, Artificial Sequence
  chemically synthesized
ctcatctctaaaataaagatac

SEQ ID NO: 1180880 - DNA, 22 bp, Artificial Sequence
  chemically synthesized
tctcatctctaaaataaagata

SEQ ID NO: 1180881 - DNA, 22 bp, Artificial Sequence
  chemically synthesized
agttttctcatctctaaaataa

SEQ ID NO: 1180882 - DNA, 22 bp, Artificial Sequence
  chemically synthesized
aaagtatctttattttagagat

SEQ ID NO: 1180883 - DNA, 22 bp, Artificial Sequence
  chemically synthesized
ctcagttttctcatctctaaaa

SEQ ID NO: 1180884 - DNA, 22 bp, Artificial Sequence
  chemically synthesized
ttactcagttttctcatctcta

SEQ ID NO: 1180885 - DNA, 22 bp, Artificial Sequence
  chemically synthesized
tattactcagttttctcatctc

SEQ ID NO: 1180886 - DNA, 22 bp, Artificial Sequence
  chemically synthesized
tctattactcagttttctcatc

SEQ ID NO: 1180887 - DNA, 22 bp, Artificial Sequence
  chemically synthesized
tctctattactcagttttctca

SEQ ID NO: 1180888 - DNA, 22 bp, Artificial Sequence
  chemically synthesized
tattttagagatgagaaaactg

SEQ ID NO: 1180889 - DNA, 22 bp, Artificial Sequence
  chemically synthesized
ctctctattactcagttttctc

SEQ ID NO: 1180890 - DNA, 22 bp, Artificial Sequence
  chemically synthesized
attttagagatgagaaaactga

SEQ ID NO: 1180891 - DNA, 22 bp, Artificial Sequence
  chemically synthesized
tctctctattactcagttttct

SEQ ID NO: 1180892 - DNA, 22 bp, Artificial Sequence
  chemically synthesized
ttttagagatgagaaaactgag

SEQ ID NO: 1180893 - DNA, 22 bp, Artificial Sequence
  chemically synthesized
ttttctctctattactcagttt

SEQ ID NO: 1180894 - DNA, 22 bp, Artificial Sequence
  chemically synthesized
tagagatgagaaaactgagtaa

SEQ ID NO: 1180895 - DNA, 22 bp, Artificial Sequence
  chemically synthesized
agagatgagaaaactgagtaat

SEQ ID NO: 1180896 - DNA, 22 bp, Artificial Sequence
  chemically synthesized
gagatgagaaaactgagtaata

SEQ ID NO: 1180897 - DNA, 22 bp, Artificial Sequence
  chemically synthesized
catatgctattttctctctatt

SEQ ID NO: 1180898 - DNA, 22 bp, Artificial Sequence
  chemically synthesized
agtaatagagagaaaatagcat

SEQ ID NO: 1180899 - DNA, 22 bp, Artificial Sequence
  chemically synthesized
tgggacctgcatatgctatttt

SEQ ID NO: 1180900 - DNA, 22 bp, Artificial Sequence
  chemically synthesized
gtctgtgggacctgcatatgct

SEQ ID NO: 1180901 - DNA, 22 bp, Artificial Sequence
  chemically synthesized
agatgaaaacaggagtataata

SEQ ID NO: 1180902 - DNA, 22 bp, Artificial Sequence
  chemically synthesized
gattcctattatactcctgttt

SEQ ID NO: 1180903 - DNA, 22 bp, Artificial Sequence
  chemically synthesized
agatattaagatgaaaacagga

SEQ ID NO: 1180904 - DNA, 22 bp, Artificial Sequence
  chemically synthesized
ctattatactcctgttttcatc

SEQ ID NO: 1180905 - DNA, 22 bp, Artificial Sequence
  chemically synthesized
ttatactcctgttttcatctta

SEQ ID NO: 1180906 - DNA, 22 bp, Artificial Sequence
  chemically synthesized
catagctaagatattaagatga

SEQ ID NO: 1180907 - DNA, 22 bp, Artificial Sequence
  chemically synthesized
tactcctgttttcatcttaata

SEQ ID NO: 1180908 - DNA, 22 bp, Artificial Sequence
  chemically synthesized
ctgttttcatcttaatatctta

SEQ ID NO: 1180909 - DNA, 22 bp, Artificial Sequence
  chemically synthesized
ttttcatcttaatatcttagct

SEQ ID NO: 1180910 - DNA, 22 bp, Artificial Sequence
  chemically synthesized
aggaatattccatagctaagat

SEQ ID NO: 1180911 - DNA, 22 bp, Artificial Sequence
  chemically synthesized
tcatcttaatatcttagctatg

SEQ ID NO: 1180912 - DNA, 22 bp, Artificial Sequence
  chemically synthesized
catcttaatatcttagctatgg

SEQ ID NO: 1180913 - DNA, 22 bp, Artificial Sequence
  chemically synthesized
atcttaatatcttagctatgga

SEQ ID NO: 1180914 - DNA, 22 bp, Artificial Sequence
  chemically synthesized
aatatcttagctatggaatatt

SEQ ID NO: 1180915 - DNA, 22 bp, Artificial Sequence
  chemically synthesized
atatcttagctatggaatattc

SEQ ID NO: 1180916 - DNA, 22 bp, Artificial Sequence
  chemically synthesized
gaagaacattaaggaatattcc

SEQ ID NO: 1180917 - DNA, 22 bp, Artificial Sequence
  chemically synthesized
cgaagaacattaaggaatattc

SEQ ID NO: 1180918 - DNA, 22 bp, Artificial Sequence
  chemically synthesized
tcgaagaacattaaggaatatt

SEQ ID NO: 1180919 - DNA, 22 bp, Artificial Sequence
  chemically synthesized
ttcgaagaacattaaggaatat

SEQ ID NO: 1180920 - DNA, 22 bp, Artificial Sequence
  chemically synthesized
agctatggaatattccttaatg

SEQ ID NO: 1180921 - DNA, 22 bp, Artificial Sequence
  chemically synthesized
gctatggaatattccttaatgt

SEQ ID NO: 1180922 - DNA, 22 bp, Artificial Sequence
  chemically synthesized
aacttttcgaagaacattaagg

SEQ ID NO: 1180923 - DNA, 22 bp, Artificial Sequence
  chemically synthesized
tggaatattccttaatgttctt

SEQ ID NO: 1180924 - DNA, 22 bp, Artificial Sequence
  chemically synthesized
atggtgttaaacttttcgaaga

SEQ ID NO: 1180925 - DNA, 22 bp, Artificial Sequence
  chemically synthesized
aatggtgttaaacttttcgaag

SEQ ID NO: 1180926 - DNA, 22 bp, Artificial Sequence
  chemically synthesized
taatggtgttaaacttttcgaa

SEQ ID NO: 1180927 - DNA, 22 bp, Artificial Sequence
  chemically synthesized
cttaatgttcttcgaaaagttt

SEQ ID NO: 1180928 - DNA, 22 bp, Artificial Sequence
  chemically synthesized
aatgttcttcgaaaagtttaac

SEQ ID NO: 1180929 - DNA, 22 bp, Artificial Sequence
  chemically synthesized
atgttcttcgaaaagtttaaca

SEQ ID NO: 1180930 - DNA, 22 bp, Artificial Sequence
  chemically synthesized
ttcgaaaagtttaacaccatta

SEQ ID NO: 1180931 - DNA, 22 bp, Artificial Sequence
  chemically synthesized
cgaaaagtttaacaccattaaa

SEQ ID NO: 1180932 - DNA, 22 bp, Artificial Sequence
  chemically synthesized
gaaaagtttaacaccattaaaa

SEQ ID NO: 1180933 - DNA, 22 bp, Artificial Sequence
  chemically synthesized
atgtaaataagaattttaatgg

SEQ ID NO: 1180934 - DNA, 22 bp, Artificial Sequence
  chemically synthesized
gatgtaaataagaattttaatg

SEQ ID NO: 1180935 - DNA, 22 bp, Artificial Sequence
  chemically synthesized
tgatgtaaataagaattttaat

SEQ ID NO: 1180936 - DNA, 22 bp, Artificial Sequence
  chemically synthesized
ttttgatgtaaataagaatttt

SEQ ID NO: 1180937 - DNA, 22 bp, Artificial Sequence
  chemically synthesized
attttgatgtaaataagaattt

SEQ ID NO: 1180938 - DNA, 22 bp, Artificial Sequence
  chemically synthesized
aacaccattaaaattcttattt

SEQ ID NO: 1180939 - DNA, 22 bp, Artificial Sequence
  chemically synthesized
acaccattaaaattcttattta

SEQ ID NO: 1180940 - DNA, 22 bp, Artificial Sequence
  chemically synthesized
atgtttattttgatgtaaataa

SEQ ID NO: 1180941 - DNA, 22 bp, Artificial Sequence
  chemically synthesized
ttcatgtttattttgatgtaaa

SEQ ID NO: 1180942 - DNA, 22 bp, Artificial Sequence
  chemically synthesized
tattcatgtttattttgatgta

SEQ ID NO: 1180943 - DNA, 22 bp, Artificial Sequence
  chemically synthesized
aaattcttatttacatcaaaat

SEQ ID NO: 1180944 - DNA, 22 bp, Artificial Sequence
  chemically synthesized
ttctattcatgtttattttgat

SEQ ID NO: 1180945 - DNA, 22 bp, Artificial Sequence
  chemically synthesized
ttatttacatcaaaataaacat

SEQ ID NO: 1180946 - DNA, 22 bp, Artificial Sequence
  chemically synthesized
aattattctattcatgtttatt

SEQ ID NO: 1180947 - DNA, 22 bp, Artificial Sequence
  chemically synthesized
atttacatcaaaataaacatga

SEQ ID NO: 1180948 - DNA, 22 bp, Artificial Sequence
  chemically synthesized
tttacatcaaaataaacatgaa

SEQ ID NO: 1180949 - DNA, 22 bp, Artificial Sequence
  chemically synthesized
tgaattattctattcatgttta

SEQ ID NO: 1180950 - DNA, 22 bp, Artificial Sequence
  chemically synthesized
acatcaaaataaacatgaatag

SEQ ID NO: 1180951 - DNA, 22 bp, Artificial Sequence
  chemically synthesized
catcaaaataaacatgaataga

SEQ ID NO: 1180952 - DNA, 22 bp, Artificial Sequence
  chemically synthesized
tcctctgaattattctattcat

SEQ ID NO: 1180953 - DNA, 22 bp, Artificial Sequence
  chemically synthesized
gtcctctgaattattctattca

SEQ ID NO: 1180954 - DNA, 22 bp, Artificial Sequence
  chemically synthesized
tgtcctctgaattattctattc

SEQ ID NO: 1180955 - DNA, 22 bp, Artificial Sequence
  chemically synthesized
ttttgtcctctgaattattcta

SEQ ID NO: 1180956 - DNA, 22 bp, Artificial Sequence
  chemically synthesized
ctgttttgtcctctgaattatt

SEQ ID NO: 1180957 - DNA, 22 bp, Artificial Sequence
  chemically synthesized
cctgttttgtcctctgaattat

SEQ ID NO: 1180958 - DNA, 22 bp, Artificial Sequence
  chemically synthesized
agaggacaaaacaggaaatgta

SEQ ID NO: 1180959 - DNA, 22 bp, Artificial Sequence
  chemically synthesized
tcatccatgtcccaaatacatt

SEQ ID NO: 1180960 - DNA, 22 bp, Artificial Sequence
  chemically synthesized
tgtcatccatgtcccaaataca

SEQ ID NO: 1180961 - DNA, 22 bp, Artificial Sequence
  chemically synthesized
ctgtcatccatgtcccaaatac

SEQ ID NO: 1180962 - DNA, 22 bp, Artificial Sequence
  chemically synthesized
tctgtcatccatgtcccaaata

SEQ ID NO: 1180963 - DNA, 22 bp, Artificial Sequence
  chemically synthesized
gggacatggatgacagaaaatt

SEQ ID NO: 1180964 - DNA, 22 bp, Artificial Sequence
  chemically synthesized
ggacatggatgacagaaaattt

SEQ ID NO: 1180965 - DNA, 22 bp, Artificial Sequence
  chemically synthesized
aataagaataggaaattttctg

SEQ ID NO: 1180966 - DNA, 22 bp, Artificial Sequence
  chemically synthesized
taaataagaataggaaattttc

SEQ ID NO: 1180967 - DNA, 22 bp, Artificial Sequence
  chemically synthesized
acatataagtgataattctaaa

SEQ ID NO: 1180968 - DNA, 22 bp, Artificial Sequence
  chemically synthesized
gacatataagtgataattctaa

SEQ ID NO: 1180969 - DNA, 22 bp, Artificial Sequence
  chemically synthesized
cctattcttatttagaattatc

SEQ ID NO: 1180970 - DNA, 22 bp, Artificial Sequence
  chemically synthesized
ctattcttatttagaattatca

SEQ ID NO: 1180971 - DNA, 22 bp, Artificial Sequence
  chemically synthesized
ttgacatataagtgataattct

SEQ ID NO: 1180972 - DNA, 22 bp, Artificial Sequence
  chemically synthesized
cttgacatataagtgataattc

SEQ ID NO: 1180973 - DNA, 22 bp, Artificial Sequence
  chemically synthesized
ttcttatttagaattatcactt

SEQ ID NO: 1180974 - DNA, 22 bp, Artificial Sequence
  chemically synthesized
ttcttgacatataagtgataat

SEQ ID NO: 1180975 - DNA, 22 bp, Artificial Sequence
  chemically synthesized
cttcttgacatataagtgataa

SEQ ID NO: 1180976 - DNA, 22 bp, Artificial Sequence
  chemically synthesized
tcttcttgacatataagtgata

SEQ ID NO: 1180977 - DNA, 22 bp, Artificial Sequence
  chemically synthesized
ttatttagaattatcacttata

SEQ ID NO: 1180978 - DNA, 22 bp, Artificial Sequence
  chemically synthesized
ttcttcttgacatataagtgat

SEQ ID NO: 1180979 - DNA, 22 bp, Artificial Sequence
  chemically synthesized
atttagaattatcacttatatg

SEQ ID NO: 1180980 - DNA, 22 bp, Artificial Sequence
  chemically synthesized
tttagaattatcacttatatgt

SEQ ID NO: 1180981 - DNA, 22 bp, Artificial Sequence
  chemically synthesized
tttttcttcttgacatataagt

SEQ ID NO: 1180982 - DNA, 22 bp, Artificial Sequence
  chemically synthesized
agaattatcacttatatgtcaa

SEQ ID NO: 1180983 - DNA, 22 bp, Artificial Sequence
  chemically synthesized
gaattatcacttatatgtcaag

SEQ ID NO: 1180984 - DNA, 22 bp, Artificial Sequence
  chemically synthesized
tcacttatatgtcaagaagaaa

SEQ ID NO: 1180985 - DNA, 22 bp, Artificial Sequence
  chemically synthesized
atatgtcaagaagaaaaataac

SEQ ID NO: 1180986 - DNA, 22 bp, Artificial Sequence
  chemically synthesized
tatgtcaagaagaaaaataaca

SEQ ID NO: 1180987 - DNA, 22 bp, Artificial Sequence
  chemically synthesized
aatagtgtgggaatgttatttt

SEQ ID NO: 1180988 - DNA, 22 bp, Artificial Sequence
  chemically synthesized
gaatagtgtgggaatgttattt

SEQ ID NO: 1180989 - DNA, 22 bp, Artificial Sequence
  chemically synthesized
tgaatagtgtgggaatgttatt

SEQ ID NO: 1180990 - DNA, 22 bp, Artificial Sequence
  chemically synthesized
aaaaaagctttgaatagtgtgg

SEQ ID NO: 1180991 - DNA, 22 bp, Artificial Sequence
  chemically synthesized
aaaaaaagctttgaatagtgtg

SEQ ID NO: 1180992 - DNA, 22 bp, Artificial Sequence
  chemically synthesized
atgcttaaaaaaagctttgaat

SEQ ID NO: 1180993 - DNA, 22 bp, Artificial Sequence
  chemically synthesized
ccacactattcaaagctttttt

SEQ ID NO: 1180994 - DNA, 22 bp, Artificial Sequence
  chemically synthesized
ggaaattgatgcttaaaaaaag

SEQ ID NO: 1180995 - DNA, 22 bp, Artificial Sequence
  chemically synthesized
ttcaaagctttttttaagcatc

SEQ ID NO: 1180996 - DNA, 22 bp, Artificial Sequence
  chemically synthesized
aaagctttttttaagcatcaat

SEQ ID NO: 1180997 - DNA, 22 bp, Artificial Sequence
  chemically synthesized
tcaaaataggttaggaaattga

SEQ ID NO: 1180998 - DNA, 22 bp, Artificial Sequence
  chemically synthesized
tttttaagcatcaatttcctaa

SEQ ID NO: 1180999 - DNA, 22 bp, Artificial Sequence
  chemically synthesized
ttttaagcatcaatttcctaac

SEQ ID NO: 1181000 - DNA, 22 bp, Artificial Sequence
  chemically synthesized
tttaagcatcaatttcctaacc

SEQ ID NO: 1181001 - DNA, 22 bp, Artificial Sequence
  chemically synthesized
cctatcaaaataggttaggaaa

SEQ ID NO: 1181002 - DNA, 22 bp, Artificial Sequence
  chemically synthesized
ttaagcatcaatttcctaacct

SEQ ID NO: 1181003 - DNA, 22 bp, Artificial Sequence
  chemically synthesized
taagcatcaatttcctaaccta

SEQ ID NO: 1181004 - DNA, 22 bp, Artificial Sequence
  chemically synthesized
aagcatcaatttcctaacctat

SEQ ID NO: 1181005 - DNA, 22 bp, Artificial Sequence
  chemically synthesized
agcatcaatttcctaacctatt

SEQ ID NO: 1181006 - DNA, 22 bp, Artificial Sequence
  chemically synthesized
cacaaatggagttacctatcaa

SEQ ID NO: 1181007 - DNA, 22 bp, Artificial Sequence
  chemically synthesized
cctaacctattttgataggtaa

SEQ ID NO: 1181008 - DNA, 22 bp, Artificial Sequence
  chemically synthesized
ctaacctattttgataggtaac

SEQ ID NO: 1181009 - DNA, 22 bp, Artificial Sequence
  chemically synthesized
acctattttgataggtaactcc

SEQ ID NO: 1181010 - DNA, 22 bp, Artificial Sequence
  chemically synthesized
ttttgataggtaactccatttg

SEQ ID NO: 1181011 - DNA, 22 bp, Artificial Sequence
  chemically synthesized
tgataggtaactccatttgtgg

SEQ ID NO: 1181012 - DNA, 22 bp, Artificial Sequence
  chemically synthesized
gataggtaactccatttgtgga

SEQ ID NO: 1181013 - DNA, 22 bp, Artificial Sequence
  chemically synthesized
caaagatgtaactccacaaatg

SEQ ID NO: 1181014 - DNA, 22 bp, Artificial Sequence
  chemically synthesized
ataggtaactccatttgtggag

SEQ ID NO: 1181015 - DNA, 22 bp, Artificial Sequence
  chemically synthesized
acaaagatgtaactccacaaat

SEQ ID NO: 1181016 - DNA, 22 bp, Artificial Sequence
  chemically synthesized
catttgtggagttacatctttg

SEQ ID NO: 1181017 - DNA, 22 bp, Artificial Sequence
  chemically synthesized
aaaaaaatcttacaaagatgta

SEQ ID NO: 1181018 - DNA, 22 bp, Artificial Sequence
  chemically synthesized
caaaaaaatcttacaaagatgt

SEQ ID NO: 1181019 - DNA, 22 bp, Artificial Sequence
  chemically synthesized
gtggagttacatctttgtaaga

SEQ ID NO: 1181020 - DNA, 22 bp, Artificial Sequence
  chemically synthesized
tggagttacatctttgtaagat

SEQ ID NO: 1181021 - DNA, 22 bp, Artificial Sequence
  chemically synthesized
atcttcaaaaaaatcttacaaa

SEQ ID NO: 1181022 - DNA, 22 bp, Artificial Sequence
  chemically synthesized
tgatcttcaaaaaaatcttaca

SEQ ID NO: 1181023 - DNA, 22 bp, Artificial Sequence
  chemically synthesized
ctgatcttcaaaaaaatcttac

SEQ ID NO: 1181024 - DNA, 22 bp, Artificial Sequence
  chemically synthesized
tttctgatcttcaaaaaaatct

SEQ ID NO: 1181025 - DNA, 22 bp, Artificial Sequence
  chemically synthesized
catctttgtaagatttttttga

SEQ ID NO: 1181026 - DNA, 22 bp, Artificial Sequence
  chemically synthesized
ttatttctgatcttcaaaaaaa

SEQ ID NO: 1181027 - DNA, 22 bp, Artificial Sequence
  chemically synthesized
attatttctgatcttcaaaaaa

SEQ ID NO: 1181028 - DNA, 22 bp, Artificial Sequence
  chemically synthesized
tgtaagatttttttgaagatca

SEQ ID NO: 1181029 - DNA, 22 bp, Artificial Sequence
  chemically synthesized
gtaagatttttttgaagatcag

SEQ ID NO: 1181030 - DNA, 22 bp, Artificial Sequence
  chemically synthesized
catttattatttctgatcttca

SEQ ID NO: 1181031 - DNA, 22 bp, Artificial Sequence
  chemically synthesized
taagatttttttgaagatcaga

SEQ ID NO: 1181032 - DNA, 22 bp, Artificial Sequence
  chemically synthesized
acatttattatttctgatcttc

SEQ ID NO: 1181033 - DNA, 22 bp, Artificial Sequence
  chemically synthesized
ttttgaagatcagaaataataa

SEQ ID NO: 1181034 - DNA, 22 bp, Artificial Sequence
  chemically synthesized
tttgaagatcagaaataataaa

SEQ ID NO: 1181035 - DNA, 22 bp, Artificial Sequence
  chemically synthesized
ttgaagatcagaaataataaat

SEQ ID NO: 1181036 - DNA, 22 bp, Artificial Sequence
  chemically synthesized
tgaagatcagaaataataaatg

SEQ ID NO: 1181037 - DNA, 22 bp, Artificial Sequence
  chemically synthesized
gcatgtaatttacatttattat

SEQ ID NO: 1181038 - DNA, 22 bp, Artificial Sequence
  chemically synthesized
gaagatcagaaataataaatgt

SEQ ID NO: 1181039 - DNA, 22 bp, Artificial Sequence
  chemically synthesized
aagatcagaaataataaatgta

SEQ ID NO: 1181040 - DNA, 22 bp, Artificial Sequence
  chemically synthesized
aatgcctagcatgtaatttaca

SEQ ID NO: 1181041 - DNA, 22 bp, Artificial Sequence
  chemically synthesized
ggaaatatgttaaatgcctagc

SEQ ID NO: 1181042 - DNA, 22 bp, Artificial Sequence
  chemically synthesized
aggaaatatgttaaatgcctag

SEQ ID NO: 1181043 - DNA, 22 bp, Artificial Sequence
  chemically synthesized
catttaggaaatatgttaaatg

SEQ ID NO: 1181044 - DNA, 22 bp, Artificial Sequence
  chemically synthesized
catgctaggcatttaacatatt

SEQ ID NO: 1181045 - DNA, 22 bp, Artificial Sequence
  chemically synthesized
ggcatttaacatatttcctaaa

SEQ ID NO: 1181046 - DNA, 22 bp, Artificial Sequence
  chemically synthesized
ggtgtgtctgcatttaggaaat

SEQ ID NO: 1181047 - DNA, 22 bp, Artificial Sequence
  chemically synthesized
cactaggtgtgtctgcatttag

SEQ ID NO: 1181048 - DNA, 22 bp, Artificial Sequence
  chemically synthesized
aacatatttcctaaatgcagac

SEQ ID NO: 1181049 - DNA, 22 bp, Artificial Sequence
  chemically synthesized
acatatttcctaaatgcagaca

SEQ ID NO: 1181050 - DNA, 22 bp, Artificial Sequence
  chemically synthesized
ttccactaggtgtgtctgcatt

SEQ ID NO: 1181051 - DNA, 22 bp, Artificial Sequence
  chemically synthesized
attccactaggtgtgtctgcat

SEQ ID NO: 1181052 - DNA, 22 bp, Artificial Sequence
  chemically synthesized
cctaaatgcagacacacctagt

SEQ ID NO: 1181053 - DNA, 22 bp, Artificial Sequence
  chemically synthesized
ctaaatgcagacacacctagtg

SEQ ID NO: 1181054 - DNA, 22 bp, Artificial Sequence
  chemically synthesized
aatgcagacacacctagtggaa

SEQ ID NO: 1181055 - DNA, 22 bp, Artificial Sequence
  chemically synthesized
gtggaataaatgatgtattttg

SEQ ID NO: 1181056 - DNA, 22 bp, Artificial Sequence
  chemically synthesized
taaggatagtataaccaaaata

SEQ ID NO: 1181057 - DNA, 22 bp, Artificial Sequence
  chemically synthesized
ataaggatagtataaccaaaat

SEQ ID NO: 1181058 - DNA, 22 bp, Artificial Sequence
  chemically synthesized
tataaggatagtataaccaaaa

SEQ ID NO: 1181059 - DNA, 22 bp, Artificial Sequence
  chemically synthesized
agtatgaaaattttataaggat

SEQ ID NO: 1181060 - DNA, 22 bp, Artificial Sequence
  chemically synthesized
tggttatactatccttataaaa

SEQ ID NO: 1181061 - DNA, 22 bp, Artificial Sequence
  chemically synthesized
ggttatactatccttataaaat

SEQ ID NO: 1181062 - DNA, 22 bp, Artificial Sequence
  chemically synthesized
gttatactatccttataaaatt

SEQ ID NO: 1181063 - DNA, 22 bp, Artificial Sequence
  chemically synthesized
attaagtatgaaaattttataa

SEQ ID NO: 1181064 - DNA, 22 bp, Artificial Sequence
  chemically synthesized
tactatccttataaaattttca

SEQ ID NO: 1181065 - DNA, 22 bp, Artificial Sequence
  chemically synthesized
tccttataaaattttcatactt

SEQ ID NO: 1181066 - DNA, 22 bp, Artificial Sequence
  chemically synthesized
aggtaaagccctcattaagtat

SEQ ID NO: 1181067 - DNA, 22 bp, Artificial Sequence
  chemically synthesized
ataaaattttcatacttaatga

SEQ ID NO: 1181068 - DNA, 22 bp, Artificial Sequence
  chemically synthesized
aaggtaaagccctcattaagta

SEQ ID NO: 1181069 - DNA, 22 bp, Artificial Sequence
  chemically synthesized
taaaattttcatacttaatgag

SEQ ID NO: 1181070 - DNA, 22 bp, Artificial Sequence
  chemically synthesized
tttaaggtaaagccctcattaa

SEQ ID NO: 1181071 - DNA, 22 bp, Artificial Sequence
  chemically synthesized
tcatacttaatgagggctttac

SEQ ID NO: 1181072 - DNA, 22 bp, Artificial Sequence
  chemically synthesized
catacttaatgagggctttacc

SEQ ID NO: 1181073 - DNA, 22 bp, Artificial Sequence
  chemically synthesized
atacttaatgagggctttacct

SEQ ID NO: 1181074 - DNA, 22 bp, Artificial Sequence
  chemically synthesized
aatgagggctttaccttaaata

SEQ ID NO: 1181075 - DNA, 22 bp, Artificial Sequence
  chemically synthesized
aaaacaaaaagttatttaaggt

SEQ ID NO: 1181076 - DNA, 22 bp, Artificial Sequence
  chemically synthesized
atgagggctttaccttaaataa

SEQ ID NO: 1181077 - DNA, 22 bp, Artificial Sequence
  chemically synthesized
aaaaacaaaaagttatttaagg

SEQ ID NO: 1181078 - DNA, 22 bp, Artificial Sequence
  chemically synthesized
taccttaaataactttttgttt

SEQ ID NO: 1181079 - DNA, 22 bp, Artificial Sequence
  chemically synthesized
accttaaataactttttgtttt

SEQ ID NO: 1181080 - DNA, 22 bp, Artificial Sequence
  chemically synthesized
ccttaaataactttttgttttt

SEQ ID NO: 1181081 - DNA, 22 bp, Artificial Sequence
  chemically synthesized
gtgtaagtaacttaaaaacaaa

SEQ ID NO: 1181082 - DNA, 22 bp, Artificial Sequence
  chemically synthesized
agtgtaagtaacttaaaaacaa

SEQ ID NO: 1181083 - DNA, 22 bp, Artificial Sequence
  chemically synthesized
aaataactttttgtttttaagt

SEQ ID NO: 1181084 - DNA, 22 bp, Artificial Sequence
  chemically synthesized
aataactttttgtttttaagtt

SEQ ID NO: 1181085 - DNA, 22 bp, Artificial Sequence
  chemically synthesized
tttgtttttaagttacttacac

SEQ ID NO: 1181086 - DNA, 22 bp, Artificial Sequence
  chemically synthesized
ttgtttttaagttacttacact

SEQ ID NO: 1181087 - DNA, 22 bp, Artificial Sequence
  chemically synthesized
aaaaaatgatttagtgtaagta

SEQ ID NO: 1181088 - DNA, 22 bp, Artificial Sequence
  chemically synthesized
tgtttttaagttacttacacta

SEQ ID NO: 1181089 - DNA, 22 bp, Artificial Sequence
  chemically synthesized
aaaaaaatgatttagtgtaagt

SEQ ID NO: 1181090 - DNA, 22 bp, Artificial Sequence
  chemically synthesized
gtttttaagttacttacactaa

SEQ ID NO: 1181091 - DNA, 22 bp, Artificial Sequence
  chemically synthesized
taaaaaaatgatttagtgtaag

SEQ ID NO: 1181092 - DNA, 22 bp, Artificial Sequence
  chemically synthesized
tttttaagttacttacactaaa

SEQ ID NO: 1181093 - DNA, 22 bp, Artificial Sequence
  chemically synthesized
ttaaaaaaatgatttagtgtaa

SEQ ID NO: 1181094 - DNA, 22 bp, Artificial Sequence
  chemically synthesized
ttaagttacttacactaaatca

SEQ ID NO: 1181095 - DNA, 22 bp, Artificial Sequence
  chemically synthesized
taagttacttacactaaatcat

SEQ ID NO: 1181096 - DNA, 22 bp, Artificial Sequence
  chemically synthesized
aagttacttacactaaatcatt

SEQ ID NO: 1181097 - DNA, 22 bp, Artificial Sequence
  chemically synthesized
agttacttacactaaatcattt

SEQ ID NO: 1181098 - DNA, 22 bp, Artificial Sequence
  chemically synthesized
gaggtttttaaaaaaatgattt

SEQ ID NO: 1181099 - DNA, 22 bp, Artificial Sequence
  chemically synthesized
cttacactaaatcattttttta

SEQ ID NO: 1181100 - DNA, 22 bp, Artificial Sequence
  chemically synthesized
acactaaatcatttttttaaaa

SEQ ID NO: 1181101 - DNA, 22 bp, Artificial Sequence
  chemically synthesized
cactaaatcatttttttaaaaa

SEQ ID NO: 1181102 - DNA, 22 bp, Artificial Sequence
  chemically synthesized
aatcatttttttaaaaacctct

SEQ ID NO: 1181103 - DNA, 22 bp, Artificial Sequence
  chemically synthesized
tagtccaaaaacctagaggttt

SEQ ID NO: 1181104 - DNA, 22 bp, Artificial Sequence
  chemically synthesized
tgttatagtccaaaaacctaga

SEQ ID NO: 1181105 - DNA, 22 bp, Artificial Sequence
  chemically synthesized
ttttaaaaacctctaggttttt

SEQ ID NO: 1181106 - DNA, 22 bp, Artificial Sequence
  chemically synthesized
tttaaaaacctctaggtttttg

SEQ ID NO: 1181107 - DNA, 22 bp, Artificial Sequence
  chemically synthesized
ttaaaaacctctaggtttttgg

SEQ ID NO: 1181108 - DNA, 22 bp, Artificial Sequence
  chemically synthesized
ttgtgttatagtccaaaaacct

SEQ ID NO: 1181109 - DNA, 22 bp, Artificial Sequence
  chemically synthesized
taaaaacctctaggtttttgga

SEQ ID NO: 1181110 - DNA, 22 bp, Artificial Sequence
  chemically synthesized
aaaaacctctaggtttttggac

SEQ ID NO: 1181111 - DNA, 22 bp, Artificial Sequence
  chemically synthesized
aaaacctctaggtttttggact

SEQ ID NO: 1181112 - DNA, 22 bp, Artificial Sequence
  chemically synthesized
taggtttttggactataacaca

SEQ ID NO: 1181113 - DNA, 22 bp, Artificial Sequence
  chemically synthesized
aaggagcgttattgtgttatag

SEQ ID NO: 1181114 - DNA, 22 bp, Artificial Sequence
  chemically synthesized
ggtttttggactataacacaat

SEQ ID NO: 1181115 - DNA, 22 bp, Artificial Sequence
  chemically synthesized
ttggactataacacaataacgc

SEQ ID NO: 1181116 - DNA, 22 bp, Artificial Sequence
  chemically synthesized
tggactataacacaataacgct

SEQ ID NO: 1181117 - DNA, 22 bp, Artificial Sequence
  chemically synthesized
ggactataacacaataacgctc

SEQ ID NO: 1181118 - DNA, 22 bp, Artificial Sequence
  chemically synthesized
tgaagattaaaggagcgttatt

SEQ ID NO: 1181119 - DNA, 22 bp, Artificial Sequence
  chemically synthesized
gactataacacaataacgctcc

SEQ ID NO: 1181120 - DNA, 22 bp, Artificial Sequence
  chemically synthesized
atgaagattaaaggagcgttat

SEQ ID NO: 1181121 - DNA, 22 bp, Artificial Sequence
  chemically synthesized
tatgaagattaaaggagcgtta

SEQ ID NO: 1181122 - DNA, 22 bp, Artificial Sequence
  chemically synthesized
tttatgaagattaaaggagcgt

SEQ ID NO: 1181123 - DNA, 22 bp, Artificial Sequence
  chemically synthesized
taacacaataacgctcctttaa

SEQ ID NO: 1181124 - DNA, 22 bp, Artificial Sequence
  chemically synthesized
atagtggtctctttatgaagat

SEQ ID NO: 1181125 - DNA, 22 bp, Artificial Sequence
  chemically synthesized
ttcatagtggtctctttatgaa

SEQ ID NO: 1181126 - DNA, 22 bp, Artificial Sequence
  chemically synthesized
ctttaatcttcataaagagacc

SEQ ID NO: 1181127 - DNA, 22 bp, Artificial Sequence
  chemically synthesized
taatcttcataaagagaccact

SEQ ID NO: 1181128 - DNA, 22 bp, Artificial Sequence
  chemically synthesized
aatcttcataaagagaccacta

SEQ ID NO: 1181129 - DNA, 22 bp, Artificial Sequence
  chemically synthesized
atcttcataaagagaccactat

SEQ ID NO: 1181130 - DNA, 22 bp, Artificial Sequence
  chemically synthesized
gtgtaaaattgttcatagtggt

SEQ ID NO: 1181131 - DNA, 22 bp, Artificial Sequence
  chemically synthesized
ggtgtaaaattgttcatagtgg

SEQ ID NO: 1181132 - DNA, 22 bp, Artificial Sequence
  chemically synthesized
cataaagagaccactatgaaca

SEQ ID NO: 1181133 - DNA, 22 bp, Artificial Sequence
  chemically synthesized
ttggtgtaaaattgttcatagt

SEQ ID NO: 1181134 - DNA, 22 bp, Artificial Sequence
  chemically synthesized
ataaagagaccactatgaacaa

SEQ ID NO: 1181135 - DNA, 22 bp, Artificial Sequence
  chemically synthesized
cttggtgtaaaattgttcatag

SEQ ID NO: 1181136 - DNA, 22 bp, Artificial Sequence
  chemically synthesized
cagtttcttggtgtaaaattgt

SEQ ID NO: 1181137 - DNA, 22 bp, Artificial Sequence
  chemically synthesized
gattacagtttcttggtgtaaa

SEQ ID NO: 1181138 - DNA, 22 bp, Artificial Sequence
  chemically synthesized
agattacagtttcttggtgtaa

SEQ ID NO: 1181139 - DNA, 22 bp, Artificial Sequence
  chemically synthesized
tagattacagtttcttggtgta

SEQ ID NO: 1181140 - DNA, 22 bp, Artificial Sequence
  chemically synthesized
ttagattacagtttcttggtgt

SEQ ID NO: 1181141 - DNA, 22 bp, Artificial Sequence
  chemically synthesized
tgaacaattttacaccaagaaa

SEQ ID NO: 1181142 - DNA, 22 bp, Artificial Sequence
  chemically synthesized
accatgtttttagattacagtt

SEQ ID NO: 1181143 - DNA, 22 bp, Artificial Sequence
  chemically synthesized
aaccatgtttttagattacagt

SEQ ID NO: 1181144 - DNA, 22 bp, Artificial Sequence
  chemically synthesized
tacaccaagaaactgtaatcta

SEQ ID NO: 1181145 - DNA, 22 bp, Artificial Sequence
  chemically synthesized
acaccaagaaactgtaatctaa

SEQ ID NO: 1181146 - DNA, 22 bp, Artificial Sequence
  chemically synthesized
caccaagaaactgtaatctaaa

SEQ ID NO: 1181147 - DNA, 22 bp, Artificial Sequence
  chemically synthesized
ggaatttaaccatgtttttaga

SEQ ID NO: 1181148 - DNA, 22 bp, Artificial Sequence
  chemically synthesized
taggaatttaaccatgttttta

SEQ ID NO: 1181149 - DNA, 22 bp, Artificial Sequence
  chemically synthesized
ctaggaatttaaccatgttttt

SEQ ID NO: 1181150 - DNA, 22 bp, Artificial Sequence
  chemically synthesized
tgtttctaggaatttaaccatg

SEQ ID NO: 1181151 - DNA, 22 bp, Artificial Sequence
  chemically synthesized
taatctaaaaacatggttaaat

SEQ ID NO: 1181152 - DNA, 22 bp, Artificial Sequence
  chemically synthesized
atgtttctaggaatttaaccat

SEQ ID NO: 1181153 - DNA, 22 bp, Artificial Sequence
  chemically synthesized
tatgtttctaggaatttaacca

SEQ ID NO: 1181154 - DNA, 22 bp, Artificial Sequence
  chemically synthesized
aaaacatggttaaattcctaga

SEQ ID NO: 1181155 - DNA, 22 bp, Artificial Sequence
  chemically synthesized
gtaggttttatgtttctaggaa

SEQ ID NO: 1181156 - DNA, 22 bp, Artificial Sequence
  chemically synthesized
ggtaggttttatgtttctagga

SEQ ID NO: 1181157 - DNA, 22 bp, Artificial Sequence
  chemically synthesized
agatttggtaggttttatgttt

SEQ ID NO: 1181158 - DNA, 22 bp, Artificial Sequence
  chemically synthesized
aattcctagaaacataaaacct

SEQ ID NO: 1181159 - DNA, 22 bp, Artificial Sequence
  chemically synthesized
ctagaaacataaaacctaccaa

SEQ ID NO: 1181160 - DNA, 22 bp, Artificial Sequence
  chemically synthesized
cacagttcagatttggtaggtt

SEQ ID NO: 1181161 - DNA, 22 bp, Artificial Sequence
  chemically synthesized
acacagttcagatttggtaggt

SEQ ID NO: 1181162 - DNA, 22 bp, Artificial Sequence
  chemically synthesized
tacacagttcagatttggtagg

SEQ ID NO: 1181163 - DNA, 22 bp, Artificial Sequence
  chemically synthesized
gaaacataaaacctaccaaatc

SEQ ID NO: 1181164 - DNA, 22 bp, Artificial Sequence
  chemically synthesized
ttacacagttcagatttggtag

SEQ ID NO: 1181165 - DNA, 22 bp, Artificial Sequence
  chemically synthesized
catttttacacagttcagattt

SEQ ID NO: 1181166 - DNA, 22 bp, Artificial Sequence
  chemically synthesized
ccatttttacacagttcagatt

SEQ ID NO: 1181167 - DNA, 22 bp, Artificial Sequence
  chemically synthesized
tccatttttacacagttcagat

SEQ ID NO: 1181168 - DNA, 22 bp, Artificial Sequence
  chemically synthesized
ttccatttttacacagttcaga

SEQ ID NO: 1181169 - DNA, 22 bp, Artificial Sequence
  chemically synthesized
agacttttccatttttacacag

SEQ ID NO: 1181170 - DNA, 22 bp, Artificial Sequence
  chemically synthesized
ccaaatctgaactgtgtaaaaa

SEQ ID NO: 1181171 - DNA, 22 bp, Artificial Sequence
  chemically synthesized
ttcagacttttccatttttaca

SEQ ID NO: 1181172 - DNA, 22 bp, Artificial Sequence
  chemically synthesized
atctattcagacttttccattt

SEQ ID NO: 1181173 - DNA, 22 bp, Artificial Sequence
  chemically synthesized
aactgtgtaaaaatggaaaagt

SEQ ID NO: 1181174 - DNA, 22 bp, Artificial Sequence
  chemically synthesized
tattgatctattcagacttttc

SEQ ID NO: 1181175 - DNA, 22 bp, Artificial Sequence
  chemically synthesized
gtattgatctattcagactttt

SEQ ID NO: 1181176 - DNA, 22 bp, Artificial Sequence
  chemically synthesized
tgtaaaaatggaaaagtctgaa

SEQ ID NO: 1181177 - DNA, 22 bp, Artificial Sequence
  chemically synthesized
cttgtattgatctattcagact

SEQ ID NO: 1181178 - DNA, 22 bp, Artificial Sequence
  chemically synthesized
acttgtattgatctattcagac

SEQ ID NO: 1181179 - DNA, 22 bp, Artificial Sequence
  chemically synthesized
aatcccttacttgtattgatct

SEQ ID NO: 1181180 - DNA, 22 bp, Artificial Sequence
  chemically synthesized
ctcaatcccttacttgtattga

SEQ ID NO: 1181181 - DNA, 22 bp, Artificial Sequence
  chemically synthesized
actcaatcccttacttgtattg

SEQ ID NO: 1181182 - DNA, 22 bp, Artificial Sequence
  chemically synthesized
cttactcaatcccttacttgta

SEQ ID NO: 1181183 - DNA, 22 bp, Artificial Sequence
  chemically synthesized
aatagatcaatacaagtaaggg

SEQ ID NO: 1181184 - DNA, 22 bp, Artificial Sequence
  chemically synthesized
aaaattacttactcaatccctt

SEQ ID NO: 1181185 - DNA, 22 bp, Artificial Sequence
  chemically synthesized
aaaaattacttactcaatccct

SEQ ID NO: 1181186 - DNA, 22 bp, Artificial Sequence
  chemically synthesized
agagtttaaaaattacttactc

SEQ ID NO: 1181187 - DNA, 22 bp, Artificial Sequence
  chemically synthesized
ttgagagtttaaaaattactta

SEQ ID NO: 1181188 - DNA, 22 bp, Artificial Sequence
  chemically synthesized
gttgagagtttaaaaattactt

SEQ ID NO: 1181189 - DNA, 22 bp, Artificial Sequence
  chemically synthesized
tgttgagagtttaaaaattact

SEQ ID NO: 1181190 - DNA, 22 bp, Artificial Sequence
  chemically synthesized
tttgttgagagtttaaaaatta

SEQ ID NO: 1181191 - DNA, 22 bp, Artificial Sequence
  chemically synthesized
ctttgttgagagtttaaaaatt

SEQ ID NO: 1181192 - DNA, 22 bp, Artificial Sequence
  chemically synthesized
tctttgttgagagtttaaaaat

SEQ ID NO: 1181193 - DNA, 22 bp, Artificial Sequence
  chemically synthesized
ttctttgttgagagtttaaaaa

SEQ ID NO: 1181194 - DNA, 22 bp, Artificial Sequence
  chemically synthesized
agtaagtaatttttaaactctc

SEQ ID NO: 1181195 - DNA, 22 bp, Artificial Sequence
  chemically synthesized
cttttctttgttgagagtttaa

SEQ ID NO: 1181196 - DNA, 22 bp, Artificial Sequence
  chemically synthesized
gcttttctttgttgagagttta

SEQ ID NO: 1181197 - DNA, 22 bp, Artificial Sequence
  chemically synthesized
tgcttttctttgttgagagttt

SEQ ID NO: 1181198 - DNA, 22 bp, Artificial Sequence
  chemically synthesized
ttgcttttctttgttgagagtt

SEQ ID NO: 1181199 - DNA, 22 bp, Artificial Sequence
  chemically synthesized
gtcttttgcttttctttgttga

SEQ ID NO: 1181200 - DNA, 22 bp, Artificial Sequence
  chemically synthesized
ttaaactctcaacaaagaaaag

SEQ ID NO: 1181201 - DNA, 22 bp, Artificial Sequence
  chemically synthesized
taaactctcaacaaagaaaagc

SEQ ID NO: 1181202 - DNA, 22 bp, Artificial Sequence
  chemically synthesized
aaactctcaacaaagaaaagca

SEQ ID NO: 1181203 - DNA, 22 bp, Artificial Sequence
  chemically synthesized
aactctcaacaaagaaaagcaa

SEQ ID NO: 1181204 - DNA, 22 bp, Artificial Sequence
  chemically synthesized
tcaacaaagaaaagcaaaagac

SEQ ID NO: 1181205 - DNA, 22 bp, Artificial Sequence
  chemically synthesized
tgaagtcacctcgtcttttgct

SEQ ID NO: 1181206 - DNA, 22 bp, Artificial Sequence
  chemically synthesized
atgaagtcacctcgtcttttgc

SEQ ID NO: 1181207 - DNA, 22 bp, Artificial Sequence
  chemically synthesized
aacaaagaaaagcaaaagacga

SEQ ID NO: 1181208 - DNA, 22 bp, Artificial Sequence
  chemically synthesized
atagaaatcacttatgaagtca

SEQ ID NO: 1181209 - DNA, 22 bp, Artificial Sequence
  chemically synthesized
gatagaaatcacttatgaagtc

SEQ ID NO: 1181210 - DNA, 22 bp, Artificial Sequence
  chemically synthesized
aaaaatgtttgatagaaatcac

SEQ ID NO: 1181211 - DNA, 22 bp, Artificial Sequence
  chemically synthesized
aaaaaatgtttgatagaaatca

SEQ ID NO: 1181212 - DNA, 22 bp, Artificial Sequence
  chemically synthesized
taaaaaatgtttgatagaaatc

SEQ ID NO: 1181213 - DNA, 22 bp, Artificial Sequence
  chemically synthesized
tttaaaaaatgtttgatagaaa

SEQ ID NO: 1181214 - DNA, 22 bp, Artificial Sequence
  chemically synthesized
ctttaaaaaatgtttgatagaa

SEQ ID NO: 1181215 - DNA, 22 bp, Artificial Sequence
  chemically synthesized
tctttaaaaaatgtttgataga

SEQ ID NO: 1181216 - DNA, 22 bp, Artificial Sequence
  chemically synthesized
cataagtgatttctatcaaaca

SEQ ID NO: 1181217 - DNA, 22 bp, Artificial Sequence
  chemically synthesized
ataagtgatttctatcaaacat

SEQ ID NO: 1181218 - DNA, 22 bp, Artificial Sequence
  chemically synthesized
attttctttaaaaaatgtttga

SEQ ID NO: 1181219 - DNA, 22 bp, Artificial Sequence
  chemically synthesized
gcattaattttctttaaaaaat

SEQ ID NO: 1181220 - DNA, 22 bp, Artificial Sequence
  chemically synthesized
ctatcaaacattttttaaagaa

SEQ ID NO: 1181221 - DNA, 22 bp, Artificial Sequence
  chemically synthesized
tatcaaacattttttaaagaaa

SEQ ID NO: 1181222 - DNA, 22 bp, Artificial Sequence
  chemically synthesized
tcaaacattttttaaagaaaat

SEQ ID NO: 1181223 - DNA, 22 bp, Artificial Sequence
  chemically synthesized
gtgaagcattggcattaatttt

SEQ ID NO: 1181224 - DNA, 22 bp, Artificial Sequence
  chemically synthesized
tttaaagaaaattaatgccaat

SEQ ID NO: 1181225 - DNA, 22 bp, Artificial Sequence
  chemically synthesized
ttaaagaaaattaatgccaatg

SEQ ID NO: 1181226 - DNA, 22 bp, Artificial Sequence
  chemically synthesized
taaagaaaattaatgccaatgc

SEQ ID NO: 1181227 - DNA, 22 bp, Artificial Sequence
  chemically synthesized
aaagaaaattaatgccaatgct

SEQ ID NO: 1181228 - DNA, 22 bp, Artificial Sequence
  chemically synthesized
aagaaaattaatgccaatgctt

SEQ ID NO: 1181229 - DNA, 22 bp, Artificial Sequence
  chemically synthesized
aaagagttcgtgaagcattggc

SEQ ID NO: 1181230 - DNA, 22 bp, Artificial Sequence
  chemically synthesized
caaagagttcgtgaagcattgg

SEQ ID NO: 1181231 - DNA, 22 bp, Artificial Sequence
  chemically synthesized
tcaaagagttcgtgaagcattg

SEQ ID NO: 1181232 - DNA, 22 bp, Artificial Sequence
  chemically synthesized
ttcaaagagttcgtgaagcatt

SEQ ID NO: 1181233 - DNA, 22 bp, Artificial Sequence
  chemically synthesized
tttcaaagagttcgtgaagcat

SEQ ID NO: 1181234 - DNA, 22 bp, Artificial Sequence
  chemically synthesized
agttttttcaaagagttcgtga

SEQ ID NO: 1181235 - DNA, 22 bp, Artificial Sequence
  chemically synthesized
atgccaatgcttcacgaactct

SEQ ID NO: 1181236 - DNA, 22 bp, Artificial Sequence
  chemically synthesized
cagttttttcaaagagttcgtg

SEQ ID NO: 1181237 - DNA, 22 bp, Artificial Sequence
  chemically synthesized
cacttcagttttttcaaagagt

SEQ ID NO: 1181238 - DNA, 22 bp, Artificial Sequence
  chemically synthesized
cctccacttcagttttttcaaa

SEQ ID NO: 1181239 - DNA, 22 bp, Artificial Sequence
  chemically synthesized
cacgaactctttgaaaaaactg

SEQ ID NO: 1181240 - DNA, 22 bp, Artificial Sequence
  chemically synthesized
acgaactctttgaaaaaactga

SEQ ID NO: 1181241 - DNA, 22 bp, Artificial Sequence
  chemically synthesized
gaagtgctccctccacttcagt

SEQ ID NO: 1181242 - DNA, 22 bp, Artificial Sequence
  chemically synthesized
ggaagtgctccctccacttcag

SEQ ID NO: 1181243 - DNA, 22 bp, Artificial Sequence
  chemically synthesized
tttgaaaaaactgaagtggagg

SEQ ID NO: 1181244 - DNA, 22 bp, Artificial Sequence
  chemically synthesized
tgaaaaaactgaagtggaggga

SEQ ID NO: 1181245 - DNA, 22 bp, Artificial Sequence
  chemically synthesized
gaaaaaactgaagtggagggag

SEQ ID NO: 1181246 - DNA, 22 bp, Artificial Sequence
  chemically synthesized
aaaaaactgaagtggagggagc

SEQ ID NO: 1181247 - DNA, 22 bp, Artificial Sequence
  chemically synthesized
taaagtgaatttggaagtgctc

SEQ ID NO: 1181248 - DNA, 22 bp, Artificial Sequence
  chemically synthesized
ataaagtgaatttggaagtgct

SEQ ID NO: 1181249 - DNA, 22 bp, Artificial Sequence
  chemically synthesized
aagtggagggagcacttccaaa

SEQ ID NO: 1181250 - DNA, 22 bp, Artificial Sequence
  chemically synthesized
accttataaagtgaatttggaa

SEQ ID NO: 1181251 - DNA, 22 bp, Artificial Sequence
  chemically synthesized
gtaatgctgaccttataaagtg

SEQ ID NO: 1181252 - DNA, 22 bp, Artificial Sequence
  chemically synthesized
ggtaatgctgaccttataaagt

SEQ ID NO: 1181253 - DNA, 22 bp, Artificial Sequence
  chemically synthesized
tggtaatgctgaccttataaag

SEQ ID NO: 1181254 - DNA, 22 bp, Artificial Sequence
  chemically synthesized
ccaaattcactttataaggtca

SEQ ID NO: 1181255 - DNA, 22 bp, Artificial Sequence
  chemically synthesized
caaattcactttataaggtcag

SEQ ID NO: 1181256 - DNA, 22 bp, Artificial Sequence
  chemically synthesized
gctttggtaatgctgaccttat

SEQ ID NO: 1181257 - DNA, 22 bp, Artificial Sequence
  chemically synthesized
tggctttggtaatgctgacctt

SEQ ID NO: 1181258 - DNA, 22 bp, Artificial Sequence
  chemically synthesized
ctggctttggtaatgctgacct

SEQ ID NO: 1181259 - DNA, 22 bp, Artificial Sequence
  chemically synthesized
tctggctttggtaatgctgacc

SEQ ID NO: 1181260 - DNA, 22 bp, Artificial Sequence
  chemically synthesized
ttctggctttggtaatgctgac

SEQ ID NO: 1181261 - DNA, 22 bp, Artificial Sequence
  chemically synthesized
tttctggctttggtaatgctga

SEQ ID NO: 1181262 - DNA, 22 bp, Artificial Sequence
  chemically synthesized
actttataaggtcagcattacc

SEQ ID NO: 1181263 - DNA, 22 bp, Artificial Sequence
  chemically synthesized
tataaggtcagcattaccaaag

SEQ ID NO: 1181264 - DNA, 22 bp, Artificial Sequence
  chemically synthesized
ataaggtcagcattaccaaagc

SEQ ID NO: 1181265 - DNA, 22 bp, Artificial Sequence
  chemically synthesized
taaggtcagcattaccaaagcc

SEQ ID NO: 1181266 - DNA, 22 bp, Artificial Sequence
  chemically synthesized
ggatgtctttttctggctttgg

SEQ ID NO: 1181267 - DNA, 22 bp, Artificial Sequence
  chemically synthesized
gggatgtctttttctggctttg

SEQ ID NO: 1181268 - DNA, 22 bp, Artificial Sequence
  chemically synthesized
ttgggatgtctttttctggctt

SEQ ID NO: 1181269 - DNA, 22 bp, Artificial Sequence
  chemically synthesized
cttgggatgtctttttctggct

SEQ ID NO: 1181270 - DNA, 22 bp, Artificial Sequence
  chemically synthesized
tcttgggatgtctttttctggc

SEQ ID NO: 1181271 - DNA, 22 bp, Artificial Sequence
  chemically synthesized
cagttttcttgggatgtctttt

SEQ ID NO: 1181272 - DNA, 22 bp, Artificial Sequence
  chemically synthesized
ccaaagccagaaaaagacatcc

SEQ ID NO: 1181273 - DNA, 22 bp, Artificial Sequence
  chemically synthesized
agttgcagttttcttgggatgt

SEQ ID NO: 1181274 - DNA, 22 bp, Artificial Sequence
  chemically synthesized
tcaaggatattgagttgcagtt

SEQ ID NO: 1181275 - DNA, 22 bp, Artificial Sequence
  chemically synthesized
tatctgtcaaggatattgagtt

SEQ ID NO: 1181276 - DNA, 22 bp, Artificial Sequence
  chemically synthesized
tatatctgtcaaggatattgag

SEQ ID NO: 1181277 - DNA, 22 bp, Artificial Sequence
  chemically synthesized
cctctatatctgtcaaggatat

SEQ ID NO: 1181278 - DNA, 22 bp, Artificial Sequence
  chemically synthesized
gcctctatatctgtcaaggata

SEQ ID NO: 1181279 - DNA, 22 bp, Artificial Sequence
  chemically synthesized
tgcctctatatctgtcaaggat

SEQ ID NO: 1181280 - DNA, 22 bp, Artificial Sequence
  chemically synthesized
caactcaatatccttgacagat

SEQ ID NO: 1181281 - DNA, 22 bp, Artificial Sequence
  chemically synthesized
agaattttgcctctatatctgt

SEQ ID NO: 1181282 - DNA, 22 bp, Artificial Sequence
  chemically synthesized
aatatccttgacagatatagag

SEQ ID NO: 1181283 - DNA, 22 bp, Artificial Sequence
  chemically synthesized
ttgagaattttgcctctatatc

SEQ ID NO: 1181284 - DNA, 22 bp, Artificial Sequence
  chemically synthesized
gttgagaattttgcctctatat

SEQ ID NO: 1181285 - DNA, 22 bp, Artificial Sequence
  chemically synthesized
tgttgagaattttgcctctata

SEQ ID NO: 1181286 - DNA, 22 bp, Artificial Sequence
  chemically synthesized
gacagatatagaggcaaaattc

SEQ ID NO: 1181287 - DNA, 22 bp, Artificial Sequence
  chemically synthesized
acagatatagaggcaaaattct

SEQ ID NO: 1181288 - DNA, 22 bp, Artificial Sequence
  chemically synthesized
ccagaattttgttgagaatttt

SEQ ID NO: 1181289 - DNA, 22 bp, Artificial Sequence
  chemically synthesized
gccagaattttgttgagaattt

SEQ ID NO: 1181290 - DNA, 22 bp, Artificial Sequence
  chemically synthesized
aaatttgccagaattttgttga

SEQ ID NO: 1181291 - DNA, 22 bp, Artificial Sequence
  chemically synthesized
ttaaaatttgccagaattttgt

SEQ ID NO: 1181292 - DNA, 22 bp, Artificial Sequence
  chemically synthesized
atgtgttgttaaaatttgccag

SEQ ID NO: 1181293 - DNA, 22 bp, Artificial Sequence
  chemically synthesized
tcaacaaaattctggcaaattt

SEQ ID NO: 1181294 - DNA, 22 bp, Artificial Sequence
  chemically synthesized
aatgtgttgttaaaatttgcca

SEQ ID NO: 1181295 - DNA, 22 bp, Artificial Sequence
  chemically synthesized
taatgtgttgttaaaatttgcc

SEQ ID NO: 1181296 - DNA, 22 bp, Artificial Sequence
  chemically synthesized
aacaaaattctggcaaatttta

SEQ ID NO: 1181297 - DNA, 22 bp, Artificial Sequence
  chemically synthesized
ttaatgtgttgttaaaatttgc

SEQ ID NO: 1181298 - DNA, 22 bp, Artificial Sequence
  chemically synthesized
tggcaaattttaacaacacatt

SEQ ID NO: 1181299 - DNA, 22 bp, Artificial Sequence
  chemically synthesized
gcaaattttaacaacacattaa

SEQ ID NO: 1181300 - DNA, 22 bp, Artificial Sequence
  chemically synthesized
gtcatggtatatgatcctttta

SEQ ID NO: 1181301 - DNA, 22 bp, Artificial Sequence
  chemically synthesized
taacaacacattaaaaggatca

SEQ ID NO: 1181302 - DNA, 22 bp, Artificial Sequence
  chemically synthesized
ggtcatggtatatgatcctttt

SEQ ID NO: 1181303 - DNA, 22 bp, Artificial Sequence
  chemically synthesized
aacaacacattaaaaggatcat

SEQ ID NO: 1181304 - DNA, 22 bp, Artificial Sequence
  chemically synthesized
acaacacattaaaaggatcata

SEQ ID NO: 1181305 - DNA, 22 bp, Artificial Sequence
  chemically synthesized
acttggtcatggtatatgatcc

SEQ ID NO: 1181306 - DNA, 22 bp, Artificial Sequence
  chemically synthesized
aaaggatcatataccatgacca

SEQ ID NO: 1181307 - DNA, 22 bp, Artificial Sequence
  chemically synthesized
tatcccaaggataaatctcact

SEQ ID NO: 1181308 - DNA, 22 bp, Artificial Sequence
  chemically synthesized
gtatcccaaggataaatctcac

SEQ ID NO: 1181309 - DNA, 22 bp, Artificial Sequence
  chemically synthesized
aaccatccttgtatcccaagga

SEQ ID NO: 1181310 - DNA, 22 bp, Artificial Sequence
  chemically synthesized
atgttgaaccatccttgtatcc

SEQ ID NO: 1181311 - DNA, 22 bp, Artificial Sequence
  chemically synthesized
catgttgaaccatccttgtatc

SEQ ID NO: 1181312 - DNA, 22 bp, Artificial Sequence
  chemically synthesized
tcatgttgaaccatccttgtat

SEQ ID NO: 1181313 - DNA, 22 bp, Artificial Sequence
  chemically synthesized
atccttgggatacaaggatggt

SEQ ID NO: 1181314 - DNA, 22 bp, Artificial Sequence
  chemically synthesized
tccttgggatacaaggatggtt

SEQ ID NO: 1181315 - DNA, 22 bp, Artificial Sequence
  chemically synthesized
attttcatgttgaaccatcctt

SEQ ID NO: 1181316 - DNA, 22 bp, Artificial Sequence
  chemically synthesized
attgattttcatgttgaaccat

SEQ ID NO: 1181317 - DNA, 22 bp, Artificial Sequence
  chemically synthesized
gggatacaaggatggttcaaca

SEQ ID NO: 1181318 - DNA, 22 bp, Artificial Sequence
  chemically synthesized
ggatacaaggatggttcaacat

SEQ ID NO: 1181319 - DNA, 22 bp, Artificial Sequence
  chemically synthesized
acgtggtgtatcatactaattg

SEQ ID NO: 1181320 - DNA, 22 bp, Artificial Sequence
  chemically synthesized
aacatgaaaatcaattagtatg

SEQ ID NO: 1181321 - DNA, 22 bp, Artificial Sequence
  chemically synthesized
ttaacgtggtgtatcatactaa

SEQ ID NO: 1181322 - DNA, 22 bp, Artificial Sequence
  chemically synthesized
tgttaacgtggtgtatcatact

SEQ ID NO: 1181323 - DNA, 22 bp, Artificial Sequence
  chemically synthesized
ttctgttaacgtggtgtatcat

SEQ ID NO: 1181324 - DNA, 22 bp, Artificial Sequence
  chemically synthesized
attctgttaacgtggtgtatca

SEQ ID NO: 1181325 - DNA, 22 bp, Artificial Sequence
  chemically synthesized
tttattctgttaacgtggtgta

SEQ ID NO: 1181326 - DNA, 22 bp, Artificial Sequence
  chemically synthesized
atttattctgttaacgtggtgt

SEQ ID NO: 1181327 - DNA, 22 bp, Artificial Sequence
  chemically synthesized
ttatttattctgttaacgtggt

SEQ ID NO: 1181328 - DNA, 22 bp, Artificial Sequence
  chemically synthesized
cttatttattctgttaacgtgg

SEQ ID NO: 1181329 - DNA, 22 bp, Artificial Sequence
  chemically synthesized
gtatgatacaccacgttaacag

SEQ ID NO: 1181330 - DNA, 22 bp, Artificial Sequence
  chemically synthesized
acagaataaataagaagtcaca

SEQ ID NO: 1181331 - DNA, 22 bp, Artificial Sequence
  chemically synthesized
atgaaatgaacatgtgacttct

SEQ ID NO: 1181332 - DNA, 22 bp, Artificial Sequence
  chemically synthesized
agcatctaatgaaatgaacatg

SEQ ID NO: 1181333 - DNA, 22 bp, Artificial Sequence
  chemically synthesized
cagcatctaatgaaatgaacat

SEQ ID NO: 1181334 - DNA, 22 bp, Artificial Sequence
  chemically synthesized
tcagcatctaatgaaatgaaca

SEQ ID NO: 1181335 - DNA, 22 bp, Artificial Sequence
  chemically synthesized
ccaaacaagttttcagcatcta

SEQ ID NO: 1181336 - DNA, 22 bp, Artificial Sequence
  chemically synthesized
gccaaacaagttttcagcatct

SEQ ID NO: 1181337 - DNA, 22 bp, Artificial Sequence
  chemically synthesized
tgccaaacaagttttcagcatc

SEQ ID NO: 1181338 - DNA, 22 bp, Artificial Sequence
  chemically synthesized
atttcattagatgctgaaaact

SEQ ID NO: 1181339 - DNA, 22 bp, Artificial Sequence
  chemically synthesized
aattttgccaaacaagttttca

SEQ ID NO: 1181340 - DNA, 22 bp, Artificial Sequence
  chemically synthesized
cattagatgctgaaaacttgtt

SEQ ID NO: 1181341 - DNA, 22 bp, Artificial Sequence
  chemically synthesized
attagatgctgaaaacttgttt

SEQ ID NO: 1181342 - DNA, 22 bp, Artificial Sequence
  chemically synthesized
tgttgaattttgccaaacaagt

SEQ ID NO: 1181343 - DNA, 22 bp, Artificial Sequence
  chemically synthesized
gatgctgaaaacttgtttggca

SEQ ID NO: 1181344 - DNA, 22 bp, Artificial Sequence
  chemically synthesized
aaaacttgtttggcaaaattca

SEQ ID NO: 1181345 - DNA, 22 bp, Artificial Sequence
  chemically synthesized
aatagtgaaattgtgttgaatt

SEQ ID NO: 1181346 - DNA, 22 bp, Artificial Sequence
  chemically synthesized
aaatagtgaaattgtgttgaat

SEQ ID NO: 1181347 - DNA, 22 bp, Artificial Sequence
  chemically synthesized
taaatagtgaaattgtgttgaa

SEQ ID NO: 1181348 - DNA, 22 bp, Artificial Sequence
  chemically synthesized
gtttggcaaaattcaacacaat

SEQ ID NO: 1181349 - DNA, 22 bp, Artificial Sequence
  chemically synthesized
ttaaatagtgaaattgtgttga

SEQ ID NO: 1181350 - DNA, 22 bp, Artificial Sequence
  chemically synthesized
tttggcaaaattcaacacaatt

SEQ ID NO: 1181351 - DNA, 22 bp, Artificial Sequence
  chemically synthesized
tttaaatagtgaaattgtgttg

SEQ ID NO: 1181352 - DNA, 22 bp, Artificial Sequence
  chemically synthesized
ttttaaatagtgaaattgtgtt

SEQ ID NO: 1181353 - DNA, 22 bp, Artificial Sequence
  chemically synthesized
tttttaaatagtgaaattgtgt

SEQ ID NO: 1181354 - DNA, 22 bp, Artificial Sequence
  chemically synthesized
ggcaaaattcaacacaatttca

SEQ ID NO: 1181355 - DNA, 22 bp, Artificial Sequence
  chemically synthesized
gcaaaattcaacacaatttcac

SEQ ID NO: 1181356 - DNA, 22 bp, Artificial Sequence
  chemically synthesized
atggttttttttaaatagtgaa

SEQ ID NO: 1181357 - DNA, 22 bp, Artificial Sequence
  chemically synthesized
aatggttttttttaaatagtga

SEQ ID NO: 1181358 - DNA, 22 bp, Artificial Sequence
  chemically synthesized
aacacaatttcactatttaaaa

SEQ ID NO: 1181359 - DNA, 22 bp, Artificial Sequence
  chemically synthesized
agagtttaatggttttttttaa

SEQ ID NO: 1181360 - DNA, 22 bp, Artificial Sequence
  chemically synthesized
ttgagagtttaatggttttttt

SEQ ID NO: 1181361 - DNA, 22 bp, Artificial Sequence
  chemically synthesized
gttgagagtttaatggtttttt

SEQ ID NO: 1181362 - DNA, 22 bp, Artificial Sequence
  chemically synthesized
cactatttaaaaaaaaccatta

SEQ ID NO: 1181363 - DNA, 22 bp, Artificial Sequence
  chemically synthesized
actatttaaaaaaaaccattaa

SEQ ID NO: 1181364 - DNA, 22 bp, Artificial Sequence
  chemically synthesized
gtttgttgagagtttaatggtt

SEQ ID NO: 1181365 - DNA, 22 bp, Artificial Sequence
  chemically synthesized
tttaaaaaaaaccattaaactc

SEQ ID NO: 1181366 - DNA, 22 bp, Artificial Sequence
  chemically synthesized
ctagtttgttgagagtttaatg

SEQ ID NO: 1181367 - DNA, 22 bp, Artificial Sequence
  chemically synthesized
aaaaaaaaccattaaactctca

SEQ ID NO: 1181368 - DNA, 22 bp, Artificial Sequence
  chemically synthesized
ttcctagtttgttgagagttta

SEQ ID NO: 1181369 - DNA, 22 bp, Artificial Sequence
  chemically synthesized
aaaaaaaccattaaactctcaa

SEQ ID NO: 1181370 - DNA, 22 bp, Artificial Sequence
  chemically synthesized
tattcctagtttgttgagagtt

SEQ ID NO: 1181371 - DNA, 22 bp, Artificial Sequence
  chemically synthesized
ctattcctagtttgttgagagt

SEQ ID NO: 1181372 - DNA, 22 bp, Artificial Sequence
  chemically synthesized
cttctattcctagtttgttgag

SEQ ID NO: 1181373 - DNA, 22 bp, Artificial Sequence
  chemically synthesized
ccttctattcctagtttgttga

SEQ ID NO: 1181374 - DNA, 22 bp, Artificial Sequence
  chemically synthesized
aactctcaacaaactaggaata

SEQ ID NO: 1181375 - DNA, 22 bp, Artificial Sequence
  chemically synthesized
aagcaatttccttctattccta

SEQ ID NO: 1181376 - DNA, 22 bp, Artificial Sequence
  chemically synthesized
tcaacaaactaggaatagaagg

SEQ ID NO: 1181377 - DNA, 22 bp, Artificial Sequence
  chemically synthesized
aacaaactaggaatagaaggaa

SEQ ID NO: 1181378 - DNA, 22 bp, Artificial Sequence
  chemically synthesized
cattgaagcaatttccttctat

SEQ ID NO: 1181379 - DNA, 22 bp, Artificial Sequence
  chemically synthesized
acattgaagcaatttccttcta

SEQ ID NO: 1181380 - DNA, 22 bp, Artificial Sequence
  chemically synthesized
tacattgaagcaatttccttct

SEQ ID NO: 1181381 - DNA, 22 bp, Artificial Sequence
  chemically synthesized
ttacattgaagcaatttccttc

SEQ ID NO: 1181382 - DNA, 22 bp, Artificial Sequence
  chemically synthesized
ggaatagaaggaaattgcttca

SEQ ID NO: 1181383 - DNA, 22 bp, Artificial Sequence
  chemically synthesized
tatatggcttttacattgaagc

SEQ ID NO: 1181384 - DNA, 22 bp, Artificial Sequence
  chemically synthesized
atatatggcttttacattgaag

SEQ ID NO: 1181385 - DNA, 22 bp, Artificial Sequence
  chemically synthesized
tatatatggcttttacattgaa

SEQ ID NO: 1181386 - DNA, 22 bp, Artificial Sequence
  chemically synthesized
ttatatatggcttttacattga

SEQ ID NO: 1181387 - DNA, 22 bp, Artificial Sequence
  chemically synthesized
tttatatatggcttttacattg

SEQ ID NO: 1181388 - DNA, 22 bp, Artificial Sequence
  chemically synthesized
cgatctttttatatatggcttt

SEQ ID NO: 1181389 - DNA, 22 bp, Artificial Sequence
  chemically synthesized
cttcaatgtaaaagccatatat

SEQ ID NO: 1181390 - DNA, 22 bp, Artificial Sequence
  chemically synthesized
caatgtaaaagccatatataaa

SEQ ID NO: 1181391 - DNA, 22 bp, Artificial Sequence
  chemically synthesized
aatgtaaaagccatatataaaa

SEQ ID NO: 1181392 - DNA, 22 bp, Artificial Sequence
  chemically synthesized
tgatatgacctgcgatcttttt

SEQ ID NO: 1181393 - DNA, 22 bp, Artificial Sequence
  chemically synthesized
ttgtgatatgacctgcgatctt

SEQ ID NO: 1181394 - DNA, 22 bp, Artificial Sequence
  chemically synthesized
gcagttgttgtgatatgacctg

SEQ ID NO: 1181395 - DNA, 22 bp, Artificial Sequence
  chemically synthesized
agttcgcagttgttgtgatatg

SEQ ID NO: 1181396 - DNA, 22 bp, Artificial Sequence
  chemically synthesized
cagttcgcagttgttgtgatat

SEQ ID NO: 1181397 - DNA, 22 bp, Artificial Sequence
  chemically synthesized
tcagttcgcagttgttgtgata

SEQ ID NO: 1181398 - DNA, 22 bp, Artificial Sequence
  chemically synthesized
atagaaaatcctttcagttcgc

SEQ ID NO: 1181399 - DNA, 22 bp, Artificial Sequence
  chemically synthesized
catagaaaatcctttcagttcg

SEQ ID NO: 1181400 - DNA, 22 bp, Artificial Sequence
  chemically synthesized
atttcatagaaaatcctttcag

SEQ ID NO: 1181401 - DNA, 22 bp, Artificial Sequence
  chemically synthesized
ctgatttcatagaaaatccttt

SEQ ID NO: 1181402 - DNA, 22 bp, Artificial Sequence
  chemically synthesized
ttcctgatttcatagaaaatcc

SEQ ID NO: 1181403 - DNA, 22 bp, Artificial Sequence
  chemically synthesized
cgaactgaaaggattttctatg

SEQ ID NO: 1181404 - DNA, 22 bp, Artificial Sequence
  chemically synthesized
ctgttcctgatttcatagaaaa

SEQ ID NO: 1181405 - DNA, 22 bp, Artificial Sequence
  chemically synthesized
ctcctgttcctgatttcataga

SEQ ID NO: 1181406 - DNA, 22 bp, Artificial Sequence
  chemically synthesized
aaaggattttctatgaaatcag

SEQ ID NO: 1181407 - DNA, 22 bp, Artificial Sequence
  chemically synthesized
ttcctcctgttcctgatttcat

SEQ ID NO: 1181408 - DNA, 22 bp, Artificial Sequence
  chemically synthesized
gttcctcctgttcctgatttca

SEQ ID NO: 1181409 - DNA, 22 bp, Artificial Sequence
  chemically synthesized
ccttgttcctcctgttcctgat

SEQ ID NO: 1181410 - DNA, 22 bp, Artificial Sequence
  chemically synthesized
accttgttcctcctgttcctga

SEQ ID NO: 1181411 - DNA, 22 bp, Artificial Sequence
  chemically synthesized
tctatgaaatcaggaacaggag

SEQ ID NO: 1181412 - DNA, 22 bp, Artificial Sequence
  chemically synthesized
ctatgaaatcaggaacaggagg

SEQ ID NO: 1181413 - DNA, 22 bp, Artificial Sequence
  chemically synthesized
tatgaaatcaggaacaggagga

SEQ ID NO: 1181414 - DNA, 22 bp, Artificial Sequence
  chemically synthesized
tgaaatcaggaacaggaggaac

SEQ ID NO: 1181415 - DNA, 22 bp, Artificial Sequence
  chemically synthesized
ccatcggtagaagtggcaagaa

SEQ ID NO: 1181416 - DNA, 22 bp, Artificial Sequence
  chemically synthesized
cagtattgccatcggtagaagt

SEQ ID NO: 1181417 - DNA, 22 bp, Artificial Sequence
  chemically synthesized
ccagtattgccatcggtagaag

SEQ ID NO: 1181418 - DNA, 22 bp, Artificial Sequence
  chemically synthesized
ttgccacttctaccgatggcaa

SEQ ID NO: 1181419 - DNA, 22 bp, Artificial Sequence
  chemically synthesized
gccacttctaccgatggcaata

SEQ ID NO: 1181420 - DNA, 22 bp, Artificial Sequence
  chemically synthesized
ccacttctaccgatggcaatac

SEQ ID NO: 1181421 - DNA, 22 bp, Artificial Sequence
  chemically synthesized
gcaaggacttccagtattgcca

SEQ ID NO: 1181422 - DNA, 22 bp, Artificial Sequence
  chemically synthesized
tagcaaggacttccagtattgc

SEQ ID NO: 1181423 - DNA, 22 bp, Artificial Sequence
  chemically synthesized
ctaccgatggcaatactggaag

SEQ ID NO: 1181424 - DNA, 22 bp, Artificial Sequence
  chemically synthesized
ttctagcaaggacttccagtat

SEQ ID NO: 1181425 - DNA, 22 bp, Artificial Sequence
  chemically synthesized
taccgatggcaatactggaagt

SEQ ID NO: 1181426 - DNA, 22 bp, Artificial Sequence
  chemically synthesized
ccgatggcaatactggaagtcc

SEQ ID NO: 1181427 - DNA, 22 bp, Artificial Sequence
  chemically synthesized
attattctagcaaggacttcca

SEQ ID NO: 1181428 - DNA, 22 bp, Artificial Sequence
  chemically synthesized
cctaattattctagcaaggact

SEQ ID NO: 1181429 - DNA, 22 bp, Artificial Sequence
  chemically synthesized
gcctaattattctagcaaggac

SEQ ID NO: 1181430 - DNA, 22 bp, Artificial Sequence
  chemically synthesized
tgcctaattattctagcaagga

SEQ ID NO: 1181431 - DNA, 22 bp, Artificial Sequence
  chemically synthesized
ttgcctaattattctagcaagg

SEQ ID NO: 1181432 - DNA, 22 bp, Artificial Sequence
  chemically synthesized
tttgcctaattattctagcaag

SEQ ID NO: 1181433 - DNA, 22 bp, Artificial Sequence
  chemically synthesized
ttttgcctaattattctagcaa

SEQ ID NO: 1181434 - DNA, 22 bp, Artificial Sequence
  chemically synthesized
tttttgcctaattattctagca

SEQ ID NO: 1181435 - DNA, 22 bp, Artificial Sequence
  chemically synthesized
ttttttgcctaattattctagc

SEQ ID NO: 1181436 - DNA, 22 bp, Artificial Sequence
  chemically synthesized
tttttttgcctaattattctag

SEQ ID NO: 1181437 - DNA, 22 bp, Artificial Sequence
  chemically synthesized
ttttttttgcctaattattcta

SEQ ID NO: 1181438 - DNA, 22 bp, Artificial Sequence
  chemically synthesized
gaagtccttgctagaataatta

SEQ ID NO: 1181439 - DNA, 22 bp, Artificial Sequence
  chemically synthesized
tttttttttgcctaattattct

SEQ ID NO: 1181440 - DNA, 22 bp, Artificial Sequence
  chemically synthesized
ttttttttttgcctaattattc

SEQ ID NO: 1181441 - DNA, 22 bp, Artificial Sequence
  chemically synthesized
cttttttttttttgcctaatta

SEQ ID NO: 1181442 - DNA, 22 bp, Artificial Sequence
  chemically synthesized
acttttttttttttgcctaatt

SEQ ID NO: 1181443 - DNA, 22 bp, Artificial Sequence
  chemically synthesized
tacttttttttttttgcctaat

SEQ ID NO: 1181444 - DNA, 22 bp, Artificial Sequence
  chemically synthesized
gctagaataattaggcaaaaaa

SEQ ID NO: 1181445 - DNA, 22 bp, Artificial Sequence
  chemically synthesized
ctagaataattaggcaaaaaaa

SEQ ID NO: 1181446 - DNA, 22 bp, Artificial Sequence
  chemically synthesized
gaataattaggcaaaaaaaaaa

SEQ ID NO: 1181447 - DNA, 22 bp, Artificial Sequence
  chemically synthesized
tatacctttacttttttttttt

SEQ ID NO: 1181448 - DNA, 22 bp, Artificial Sequence
  chemically synthesized
atatacctttactttttttttt

SEQ ID NO: 1181449 - DNA, 22 bp, Artificial Sequence
  chemically synthesized
atttatatacctttactttttt

SEQ ID NO: 1181450 - DNA, 22 bp, Artificial Sequence
  chemically synthesized
tgatttatatacctttactttt

SEQ ID NO: 1181451 - DNA, 22 bp, Artificial Sequence
  chemically synthesized
ggcaaaaaaaaaaaagtaaagg

SEQ ID NO: 1181452 - DNA, 22 bp, Artificial Sequence
  chemically synthesized
ctgatttatatacctttacttt

SEQ ID NO: 1181453 - DNA, 22 bp, Artificial Sequence
  chemically synthesized
atttctgatttatataccttta

SEQ ID NO: 1181454 - DNA, 22 bp, Artificial Sequence
  chemically synthesized
catttctgatttatataccttt

SEQ ID NO: 1181455 - DNA, 22 bp, Artificial Sequence
  chemically synthesized
ttcatttctgatttatatacct

SEQ ID NO: 1181456 - DNA, 22 bp, Artificial Sequence
  chemically synthesized
caaataggaataacattcttca

SEQ ID NO: 1181457 - DNA, 22 bp, Artificial Sequence
  chemically synthesized
tgtcatctgcaaataggaataa

SEQ ID NO: 1181458 - DNA, 22 bp, Artificial Sequence
  chemically synthesized
ataagattatgtcatctgcaaa

SEQ ID NO: 1181459 - DNA, 22 bp, Artificial Sequence
  chemically synthesized
ttcataagattatgtcatctgc

SEQ ID NO: 1181460 - DNA, 22 bp, Artificial Sequence
  chemically synthesized
tattcataagattatgtcatct

SEQ ID NO: 1181461 - DNA, 22 bp, Artificial Sequence
  chemically synthesized
ttcctatttgcagatgacataa

SEQ ID NO: 1181462 - DNA, 22 bp, Artificial Sequence
  chemically synthesized
ctattcataagattatgtcatc

SEQ ID NO: 1181463 - DNA, 22 bp, Artificial Sequence
  chemically synthesized
tctattcataagattatgtcat

SEQ ID NO: 1181464 - DNA, 22 bp, Artificial Sequence
  chemically synthesized
ctatttgcagatgacataatct

SEQ ID NO: 1181465 - DNA, 22 bp, Artificial Sequence
  chemically synthesized
tttgcagatgacataatcttat

SEQ ID NO: 1181466 - DNA, 22 bp, Artificial Sequence
  chemically synthesized
gggttttctattcataagatta

SEQ ID NO: 1181467 - DNA, 22 bp, Artificial Sequence
  chemically synthesized
gcagatgacataatcttatgaa

SEQ ID NO: 1181468 - DNA, 22 bp, Artificial Sequence
  chemically synthesized
tagggttttctattcataagat

SEQ ID NO: 1181469 - DNA, 22 bp, Artificial Sequence
  chemically synthesized
cagatgacataatcttatgaat

SEQ ID NO: 1181470 - DNA, 22 bp, Artificial Sequence
  chemically synthesized
atggattctagggttttctatt

SEQ ID NO: 1181471 - DNA, 22 bp, Artificial Sequence
  chemically synthesized
aatggattctagggttttctat

SEQ ID NO: 1181472 - DNA, 22 bp, Artificial Sequence
  chemically synthesized
taatggattctagggttttcta

SEQ ID NO: 1181473 - DNA, 22 bp, Artificial Sequence
  chemically synthesized
ttaatggattctagggttttct

SEQ ID NO: 1181474 - DNA, 22 bp, Artificial Sequence
  chemically synthesized
atgaatagaaaaccctagaatc

SEQ ID NO: 1181475 - DNA, 22 bp, Artificial Sequence
  chemically synthesized
gtgtttttaatggattctaggg

SEQ ID NO: 1181476 - DNA, 22 bp, Artificial Sequence
  chemically synthesized
tgaatagaaaaccctagaatcc

SEQ ID NO: 1181477 - DNA, 22 bp, Artificial Sequence
  chemically synthesized
tagtgtttttaatggattctag

SEQ ID NO: 1181478 - DNA, 22 bp, Artificial Sequence
  chemically synthesized
gttctagtgtttttaatggatt

SEQ ID NO: 1181479 - DNA, 22 bp, Artificial Sequence
  chemically synthesized
aattggttctagtgtttttaat

SEQ ID NO: 1181480 - DNA, 22 bp, Artificial Sequence
  chemically synthesized
aaattggttctagtgtttttaa

SEQ ID NO: 1181481 - DNA, 22 bp, Artificial Sequence
  chemically synthesized
taaattggttctagtgttttta

SEQ ID NO: 1181482 - DNA, 22 bp, Artificial Sequence
  chemically synthesized
ttaaattggttctagtgttttt

SEQ ID NO: 1181483 - DNA, 22 bp, Artificial Sequence
  chemically synthesized
gaatccattaaaaacactagaa

SEQ ID NO: 1181484 - DNA, 22 bp, Artificial Sequence
  chemically synthesized
atttttaaattggttctagtgt

SEQ ID NO: 1181485 - DNA, 22 bp, Artificial Sequence
  chemically synthesized
ctgatttttaaattggttctag

SEQ ID NO: 1181486 - DNA, 22 bp, Artificial Sequence
  chemically synthesized
actgatttttaaattggttcta

SEQ ID NO: 1181487 - DNA, 22 bp, Artificial Sequence
  chemically synthesized
tactgatttttaaattggttct

SEQ ID NO: 1181488 - DNA, 22 bp, Artificial Sequence
  chemically synthesized
aaaacactagaaccaatttaaa

SEQ ID NO: 1181489 - DNA, 22 bp, Artificial Sequence
  chemically synthesized
caactttactgatttttaaatt

SEQ ID NO: 1181490 - DNA, 22 bp, Artificial Sequence
  chemically synthesized
gaaccaatttaaaaatcagtaa

SEQ ID NO: 1181491 - DNA, 22 bp, Artificial Sequence
  chemically synthesized
tatcctacaactttactgattt

SEQ ID NO: 1181492 - DNA, 22 bp, Artificial Sequence
  chemically synthesized
gtatcctacaactttactgatt

SEQ ID NO: 1181493 - DNA, 22 bp, Artificial Sequence
  chemically synthesized
tgtatcctacaactttactgat

SEQ ID NO: 1181494 - DNA, 22 bp, Artificial Sequence
  chemically synthesized
aaaaatcagtaaagttgtagga

SEQ ID NO: 1181495 - DNA, 22 bp, Artificial Sequence
  chemically synthesized
aaaatcagtaaagttgtaggat

SEQ ID NO: 1181496 - DNA, 22 bp, Artificial Sequence
  chemically synthesized
tatgatgattttgtatcctaca

SEQ ID NO: 1181497 - DNA, 22 bp, Artificial Sequence
  chemically synthesized
gtatgatgattttgtatcctac

SEQ ID NO: 1181498 - DNA, 22 bp, Artificial Sequence
  chemically synthesized
tgtatgatgattttgtatccta

SEQ ID NO: 1181499 - DNA, 22 bp, Artificial Sequence
  chemically synthesized
ttgtatgatgattttgtatcct

SEQ ID NO: 1181500 - DNA, 22 bp, Artificial Sequence
  chemically synthesized
atttttgtatgatgattttgta

SEQ ID NO: 1181501 - DNA, 22 bp, Artificial Sequence
  chemically synthesized
aactaatttttgtatgatgatt

SEQ ID NO: 1181502 - DNA, 22 bp, Artificial Sequence
  chemically synthesized
taggatacaaaatcatcataca

SEQ ID NO: 1181503 - DNA, 22 bp, Artificial Sequence
  chemically synthesized
gaaactcaactaatttttgtat

SEQ ID NO: 1181504 - DNA, 22 bp, Artificial Sequence
  chemically synthesized
ctagaaactcaactaatttttg

SEQ ID NO: 1181505 - DNA, 22 bp, Artificial Sequence
  chemically synthesized
tctcctagaaactcaactaatt

SEQ ID NO: 1181506 - DNA, 22 bp, Artificial Sequence
  chemically synthesized
gtctcctagaaactcaactaat

SEQ ID NO: 1181507 - DNA, 22 bp, Artificial Sequence
  chemically synthesized
tgaatggaatttgtctcctaga

SEQ ID NO: 1181508 - DNA, 22 bp, Artificial Sequence
  chemically synthesized
gtgaatggaatttgtctcctag

SEQ ID NO: 1181509 - DNA, 22 bp, Artificial Sequence
  chemically synthesized
ttgtgaatggaatttgtctcct

SEQ ID NO: 1181510 - DNA, 22 bp, Artificial Sequence
  chemically synthesized
gttgagtttctaggagacaaat

SEQ ID NO: 1181511 - DNA, 22 bp, Artificial Sequence
  chemically synthesized
agtttctaggagacaaattcca

SEQ ID NO: 1181512 - DNA, 22 bp, Artificial Sequence
  chemically synthesized
gtgctcttgtgaatggaatttg

SEQ ID NO: 1181513 - DNA, 22 bp, Artificial Sequence
  chemically synthesized
ggtgctcttgtgaatggaattt

SEQ ID NO: 1181514 - DNA, 22 bp, Artificial Sequence
  chemically synthesized
tggtgctcttgtgaatggaatt

SEQ ID NO: 1181515 - DNA, 22 bp, Artificial Sequence
  chemically synthesized
ttggtgctcttgtgaatggaat

SEQ ID NO: 1181516 - DNA, 22 bp, Artificial Sequence
  chemically synthesized
ctaggagacaaattccattcac

SEQ ID NO: 1181517 - DNA, 22 bp, Artificial Sequence
  chemically synthesized
tttggtgctcttgtgaatggaa

SEQ ID NO: 1181518 - DNA, 22 bp, Artificial Sequence
  chemically synthesized
taggagacaaattccattcaca

SEQ ID NO: 1181519 - DNA, 22 bp, Artificial Sequence
  chemically synthesized
tttttggtgctcttgtgaatgg

SEQ ID NO: 1181520 - DNA, 22 bp, Artificial Sequence
  chemically synthesized
ggagacaaattccattcacaag

SEQ ID NO: 1181521 - DNA, 22 bp, Artificial Sequence
  chemically synthesized
ctttttggtgctcttgtgaatg

SEQ ID NO: 1181522 - DNA, 22 bp, Artificial Sequence
  chemically synthesized
tctttttggtgctcttgtgaat

SEQ ID NO: 1181523 - DNA, 22 bp, Artificial Sequence
  chemically synthesized
ttttctttttggtgctcttgtg

SEQ ID NO: 1181524 - DNA, 22 bp, Artificial Sequence
  chemically synthesized
ctgttttctttttggtgctctt

SEQ ID NO: 1181525 - DNA, 22 bp, Artificial Sequence
  chemically synthesized
ttactgttttctttttggtgct

SEQ ID NO: 1181526 - DNA, 22 bp, Artificial Sequence
  chemically synthesized
attactgttttctttttggtgc

SEQ ID NO: 1181527 - DNA, 22 bp, Artificial Sequence
  chemically synthesized
cattcacaagagcaccaaaaag

SEQ ID NO: 1181528 - DNA, 22 bp, Artificial Sequence
  chemically synthesized
gtttattactgttttctttttg

SEQ ID NO: 1181529 - DNA, 22 bp, Artificial Sequence
  chemically synthesized
agtttattactgttttcttttt

SEQ ID NO: 1181530 - DNA, 22 bp, Artificial Sequence
  chemically synthesized
acaagagcaccaaaaagaaaac

SEQ ID NO: 1181531 - DNA, 22 bp, Artificial Sequence
  chemically synthesized
tagtttattactgttttctttt

SEQ ID NO: 1181532 - DNA, 22 bp, Artificial Sequence
  chemically synthesized
tttagtttattactgttttctt

SEQ ID NO: 1181533 - DNA, 22 bp, Artificial Sequence
  chemically synthesized
acctctttagtttattactgtt

SEQ ID NO: 1181534 - DNA, 22 bp, Artificial Sequence
  chemically synthesized
gacctctttagtttattactgt

SEQ ID NO: 1181535 - DNA, 22 bp, Artificial Sequence
  chemically synthesized
tgacctctttagtttattactg

SEQ ID NO: 1181536 - DNA, 22 bp, Artificial Sequence
  chemically synthesized
tttgacctctttagtttattac

SEQ ID NO: 1181537 - DNA, 22 bp, Artificial Sequence
  chemically synthesized
agtacatactctttgacctctt

SEQ ID NO: 1181538 - DNA, 22 bp, Artificial Sequence
  chemically synthesized
cagtacatactctttgacctct

SEQ ID NO: 1181539 - DNA, 22 bp, Artificial Sequence
  chemically synthesized
tcagtacatactctttgacctc

SEQ ID NO: 1181540 - DNA, 22 bp, Artificial Sequence
  chemically synthesized
tagttttcagtacatactcttt

SEQ ID NO: 1181541 - DNA, 22 bp, Artificial Sequence
  chemically synthesized
atagttttcagtacatactctt

SEQ ID NO: 1181542 - DNA, 22 bp, Artificial Sequence
  chemically synthesized
tatagttttcagtacatactct

SEQ ID NO: 1181543 - DNA, 22 bp, Artificial Sequence
  chemically synthesized
aagaggtcaaagagtatgtact

SEQ ID NO: 1181544 - DNA, 22 bp, Artificial Sequence
  chemically synthesized
atcaatgttttatagttttcag

SEQ ID NO: 1181545 - DNA, 22 bp, Artificial Sequence
  chemically synthesized
catcaatgttttatagttttca

SEQ ID NO: 1181546 - DNA, 22 bp, Artificial Sequence
  chemically synthesized
tcatcaatgttttatagttttc

SEQ ID NO: 1181547 - DNA, 22 bp, Artificial Sequence
  chemically synthesized
tttcatcaatgttttatagttt

SEQ ID NO: 1181548 - DNA, 22 bp, Artificial Sequence
  chemically synthesized
ctttcatcaatgttttatagtt

SEQ ID NO: 1181549 - DNA, 22 bp, Artificial Sequence
  chemically synthesized
atttctttcatcaatgttttat

SEQ ID NO: 1181550 - DNA, 22 bp, Artificial Sequence
  chemically synthesized
aatttctttcatcaatgtttta

SEQ ID NO: 1181551 - DNA, 22 bp, Artificial Sequence
  chemically synthesized
taatttctttcatcaatgtttt

SEQ ID NO: 1181552 - DNA, 22 bp, Artificial Sequence
  chemically synthesized
aaaactataaaacattgatgaa

SEQ ID NO: 1181553 - DNA, 22 bp, Artificial Sequence
  chemically synthesized
tcatctttaatttctttcatca

SEQ ID NO: 1181554 - DNA, 22 bp, Artificial Sequence
  chemically synthesized
gtcatctttaatttctttcatc

SEQ ID NO: 1181555 - DNA, 22 bp, Artificial Sequence
  chemically synthesized
tgtcatctttaatttctttcat

SEQ ID NO: 1181556 - DNA, 22 bp, Artificial Sequence
  chemically synthesized
taaaacattgatgaaagaaatt

SEQ ID NO: 1181557 - DNA, 22 bp, Artificial Sequence
  chemically synthesized
attttgtcatctttaatttctt

SEQ ID NO: 1181558 - DNA, 22 bp, Artificial Sequence
  chemically synthesized
gattttgtcatctttaatttct

SEQ ID NO: 1181559 - DNA, 22 bp, Artificial Sequence
  chemically synthesized
catttgattttgtcatctttaa

SEQ ID NO: 1181560 - DNA, 22 bp, Artificial Sequence
  chemically synthesized
ccatttgattttgtcatcttta

SEQ ID NO: 1181561 - DNA, 22 bp, Artificial Sequence
  chemically synthesized
atgaaagaaattaaagatgaca

SEQ ID NO: 1181562 - DNA, 22 bp, Artificial Sequence
  chemically synthesized
tccatttgattttgtcatcttt

SEQ ID NO: 1181563 - DNA, 22 bp, Artificial Sequence
  chemically synthesized
aagatgacaaaatcaaatggaa

SEQ ID NO: 1181564 - DNA, 22 bp, Artificial Sequence
  chemically synthesized
gatccatgaatgtaggatgtct

SEQ ID NO: 1181565 - DNA, 22 bp, Artificial Sequence
  chemically synthesized
cgatccatgaatgtaggatgtc

SEQ ID NO: 1181566 - DNA, 22 bp, Artificial Sequence
  chemically synthesized
agtccttcgatccatgaatgta

SEQ ID NO: 1181567 - DNA, 22 bp, Artificial Sequence
  chemically synthesized
aagtccttcgatccatgaatgt

SEQ ID NO: 1181568 - DNA, 22 bp, Artificial Sequence
  chemically synthesized
taagtccttcgatccatgaatg

SEQ ID NO: 1181569 - DNA, 22 bp, Artificial Sequence
  chemically synthesized
cattcatggatcgaaggactta

SEQ ID NO: 1181570 - DNA, 22 bp, Artificial Sequence
  chemically synthesized
aatgtaatgacaattttaagtc

SEQ ID NO: 1181571 - DNA, 22 bp, Artificial Sequence
  chemically synthesized
atggatcgaaggacttaaaatt

SEQ ID NO: 1181572 - DNA, 22 bp, Artificial Sequence
  chemically synthesized
gaatgtaatgacaattttaagt

SEQ ID NO: 1181573 - DNA, 22 bp, Artificial Sequence
  chemically synthesized
tgaatgtaatgacaattttaag

SEQ ID NO: 1181574 - DNA, 22 bp, Artificial Sequence
  chemically synthesized
tttgaatgtaatgacaatttta

SEQ ID NO: 1181575 - DNA, 22 bp, Artificial Sequence
  chemically synthesized
ctttgaatgtaatgacaatttt

SEQ ID NO: 1181576 - DNA, 22 bp, Artificial Sequence
  chemically synthesized
tagatttctttgaatgtaatga

SEQ ID NO: 1181577 - DNA, 22 bp, Artificial Sequence
  chemically synthesized
tgtagatttctttgaatgtaat

SEQ ID NO: 1181578 - DNA, 22 bp, Artificial Sequence
  chemically synthesized
aaaattgtcattacattcaaag

SEQ ID NO: 1181579 - DNA, 22 bp, Artificial Sequence
  chemically synthesized
aaattgtcattacattcaaaga

SEQ ID NO: 1181580 - DNA, 22 bp, Artificial Sequence
  chemically synthesized
gttctgtagatttctttgaatg

SEQ ID NO: 1181581 - DNA, 22 bp, Artificial Sequence
  chemically synthesized
tattagttctgtagatttcttt

SEQ ID NO: 1181582 - DNA, 22 bp, Artificial Sequence
  chemically synthesized
tcattacattcaaagaaatcta

SEQ ID NO: 1181583 - DNA, 22 bp, Artificial Sequence
  chemically synthesized
cattcaaagaaatctacagaac

SEQ ID NO: 1181584 - DNA, 22 bp, Artificial Sequence
  chemically synthesized
ataaagattatattagttctgt

SEQ ID NO: 1181585 - DNA, 22 bp, Artificial Sequence
  chemically synthesized
gataaagattatattagttctg

SEQ ID NO: 1181586 - DNA, 22 bp, Artificial Sequence
  chemically synthesized
aaagaaatctacagaactaata

SEQ ID NO: 1181587 - DNA, 22 bp, Artificial Sequence
  chemically synthesized
tgataaagattatattagttct

SEQ ID NO: 1181588 - DNA, 22 bp, Artificial Sequence
  chemically synthesized
gaattttgataaagattatatt

SEQ ID NO: 1181589 - DNA, 22 bp, Artificial Sequence
  chemically synthesized
cagaactaatataatctttatc

SEQ ID NO: 1181590 - DNA, 22 bp, Artificial Sequence
  chemically synthesized
atataatctttatcaaaattcc

SEQ ID NO: 1181591 - DNA, 22 bp, Artificial Sequence
  chemically synthesized
tgaaaaatgccattggaatttt

SEQ ID NO: 1181592 - DNA, 22 bp, Artificial Sequence
  chemically synthesized
tgtgaaaaatgccattggaatt

SEQ ID NO: 1181593 - DNA, 22 bp, Artificial Sequence
  chemically synthesized
ctgtgaaaaatgccattggaat

SEQ ID NO: 1181594 - DNA, 22 bp, Artificial Sequence
  chemically synthesized
tttctgtgaaaaatgccattgg

SEQ ID NO: 1181595 - DNA, 22 bp, Artificial Sequence
  chemically synthesized
tatcaaaattccaatggcattt

SEQ ID NO: 1181596 - DNA, 22 bp, Artificial Sequence
  chemically synthesized
tgtttctgtgaaaaatgccatt

SEQ ID NO: 1181597 - DNA, 22 bp, Artificial Sequence
  chemically synthesized
atcaaaattccaatggcatttt

SEQ ID NO: 1181598 - DNA, 22 bp, Artificial Sequence
  chemically synthesized
tcaaaattccaatggcattttt

SEQ ID NO: 1181599 - DNA, 22 bp, Artificial Sequence
  chemically synthesized
tctgtttctgtgaaaaatgcca

SEQ ID NO: 1181600 - DNA, 22 bp, Artificial Sequence
  chemically synthesized
ctctgtttctgtgaaaaatgcc

SEQ ID NO: 1181601 - DNA, 22 bp, Artificial Sequence
  chemically synthesized
tctctgtttctgtgaaaaatgc

SEQ ID NO: 1181602 - DNA, 22 bp, Artificial Sequence
  chemically synthesized
ttctctgtttctgtgaaaaatg

SEQ ID NO: 1181603 - DNA, 22 bp, Artificial Sequence
  chemically synthesized
caatggcatttttcacagaaac

SEQ ID NO: 1181604 - DNA, 22 bp, Artificial Sequence
  chemically synthesized
agagtttttctctgtttctgtg

SEQ ID NO: 1181605 - DNA, 22 bp, Artificial Sequence
  chemically synthesized
cagagtttttctctgtttctgt

SEQ ID NO: 1181606 - DNA, 22 bp, Artificial Sequence
  chemically synthesized
ttcacagaaacagagaaaaact

SEQ ID NO: 1181607 - DNA, 22 bp, Artificial Sequence
  chemically synthesized
tcacagaaacagagaaaaactc

SEQ ID NO: 1181608 - DNA, 22 bp, Artificial Sequence
  chemically synthesized
cacagaaacagagaaaaactct

SEQ ID NO: 1181609 - DNA, 22 bp, Artificial Sequence
  chemically synthesized
catatgaatttcagagtttttc

SEQ ID NO: 1181610 - DNA, 22 bp, Artificial Sequence
  chemically synthesized
acagaaacagagaaaaactctg

SEQ ID NO: 1181611 - DNA, 22 bp, Artificial Sequence
  chemically synthesized
tggttccatatgaatttcagag

SEQ ID NO: 1181612 - DNA, 22 bp, Artificial Sequence
  chemically synthesized
gtggttccatatgaatttcaga

SEQ ID NO: 1181613 - DNA, 22 bp, Artificial Sequence
  chemically synthesized
tgtggttccatatgaatttcag

SEQ ID NO: 1181614 - DNA, 22 bp, Artificial Sequence
  chemically synthesized
tttgtggttccatatgaatttc

SEQ ID NO: 1181615 - DNA, 22 bp, Artificial Sequence
  chemically synthesized
ggattctttgtggttccatatg

SEQ ID NO: 1181616 - DNA, 22 bp, Artificial Sequence
  chemically synthesized
gggattctttgtggttccatat

SEQ ID NO: 1181617 - DNA, 22 bp, Artificial Sequence
  chemically synthesized
tgaaattcatatggaaccacaa

SEQ ID NO: 1181618 - DNA, 22 bp, Artificial Sequence
  chemically synthesized
aaattcatatggaaccacaaag

SEQ ID NO: 1181619 - DNA, 22 bp, Artificial Sequence
  chemically synthesized
gccatttgggattctttgtggt

SEQ ID NO: 1181620 - DNA, 22 bp, Artificial Sequence
  chemically synthesized
agccatttgggattctttgtgg

SEQ ID NO: 1181621 - DNA, 22 bp, Artificial Sequence
  chemically synthesized
atatggaaccacaaagaatccc

SEQ ID NO: 1181622 - DNA, 22 bp, Artificial Sequence
  chemically synthesized
atttagccatttgggattcttt

SEQ ID NO: 1181623 - DNA, 22 bp, Artificial Sequence
  chemically synthesized
aaggttgatttagccatttggg

SEQ ID NO: 1181624 - DNA, 22 bp, Artificial Sequence
  chemically synthesized
tcaaggttgatttagccatttg

SEQ ID NO: 1181625 - DNA, 22 bp, Artificial Sequence
  chemically synthesized
ctcaaggttgatttagccattt

SEQ ID NO: 1181626 - DNA, 22 bp, Artificial Sequence
  chemically synthesized
tctcaaggttgatttagccatt

SEQ ID NO: 1181627 - DNA, 22 bp, Artificial Sequence
  chemically synthesized
tttctcaaggttgatttagcca

SEQ ID NO: 1181628 - DNA, 22 bp, Artificial Sequence
  chemically synthesized
ctttctcaaggttgatttagcc

SEQ ID NO: 1181629 - DNA, 22 bp, Artificial Sequence
  chemically synthesized
tacttctttctcaaggttgatt

SEQ ID NO: 1181630 - DNA, 22 bp, Artificial Sequence
  chemically synthesized
gtacttctttctcaaggttgat

SEQ ID NO: 1181631 - DNA, 22 bp, Artificial Sequence
  chemically synthesized
tgtacttctttctcaaggttga

SEQ ID NO: 1181632 - DNA, 22 bp, Artificial Sequence
  chemically synthesized
caattttgtacttctttctcaa

SEQ ID NO: 1181633 - DNA, 22 bp, Artificial Sequence
  chemically synthesized
aatcaaccttgagaaagaagta

SEQ ID NO: 1181634 - DNA, 22 bp, Artificial Sequence
  chemically synthesized
gagaaagaagtacaaaattgga

SEQ ID NO: 1181635 - DNA, 22 bp, Artificial Sequence
  chemically synthesized
agaaagaagtacaaaattggag

SEQ ID NO: 1181636 - DNA, 22 bp, Artificial Sequence
  chemically synthesized
aaatcaggaagtgtgatacctc

SEQ ID NO: 1181637 - DNA, 22 bp, Artificial Sequence
  chemically synthesized
gaaatcaggaagtgtgatacct

SEQ ID NO: 1181638 - DNA, 22 bp, Artificial Sequence
  chemically synthesized
tgaaatcaggaagtgtgatacc

SEQ ID NO: 1181639 - DNA, 22 bp, Artificial Sequence
  chemically synthesized
gaggtatcacacttcctgattt

SEQ ID NO: 1181640 - DNA, 22 bp, Artificial Sequence
  chemically synthesized
gtaatatattttgaaatcagga

SEQ ID NO: 1181641 - DNA, 22 bp, Artificial Sequence
  chemically synthesized
agtaatatattttgaaatcagg

SEQ ID NO: 1181642 - DNA, 22 bp, Artificial Sequence
  chemically synthesized
tagtttagtaatatattttgaa

SEQ ID NO: 1181643 - DNA, 22 bp, Artificial Sequence
  chemically synthesized
ctgtagtttagtaatatatttt

SEQ ID NO: 1181644 - DNA, 22 bp, Artificial Sequence
  chemically synthesized
cctgatttcaaaatatattact

SEQ ID NO: 1181645 - DNA, 22 bp, Artificial Sequence
  chemically synthesized
ctgatttcaaaatatattacta

SEQ ID NO: 1181646 - DNA, 22 bp, Artificial Sequence
  chemically synthesized
attactgtagtttagtaatata

SEQ ID NO: 1181647 - DNA, 22 bp, Artificial Sequence
  chemically synthesized
aattactgtagtttagtaatat

SEQ ID NO: 1181648 - DNA, 22 bp, Artificial Sequence
  chemically synthesized
taattactgtagtttagtaata

SEQ ID NO: 1181649 - DNA, 22 bp, Artificial Sequence
  chemically synthesized
atttcaaaatatattactaaac

SEQ ID NO: 1181650 - DNA, 22 bp, Artificial Sequence
  chemically synthesized
ttaattactgtagtttagtaat

SEQ ID NO: 1181651 - DNA, 22 bp, Artificial Sequence
  chemically synthesized
tttttaattactgtagtttagt

SEQ ID NO: 1181652 - DNA, 22 bp, Artificial Sequence
  chemically synthesized
caaaatatattactaaactaca

SEQ ID NO: 1181653 - DNA, 22 bp, Artificial Sequence
  chemically synthesized
atttttaattactgtagtttag

SEQ ID NO: 1181654 - DNA, 22 bp, Artificial Sequence
  chemically synthesized
aaaatatattactaaactacag

SEQ ID NO: 1181655 - DNA, 22 bp, Artificial Sequence
  chemically synthesized
ctaaactacagtaattaaaaat

SEQ ID NO: 1181656 - DNA, 22 bp, Artificial Sequence
  chemically synthesized
aactacagtaattaaaaataaa

SEQ ID NO: 1181657 - DNA, 22 bp, Artificial Sequence
  chemically synthesized
atgacaatacaatttattttta

SEQ ID NO: 1181658 - DNA, 22 bp, Artificial Sequence
  chemically synthesized
catgacaatacaatttattttt

SEQ ID NO: 1181659 - DNA, 22 bp, Artificial Sequence
  chemically synthesized
cagtaattaaaaataaattgta

SEQ ID NO: 1181660 - DNA, 22 bp, Artificial Sequence
  chemically synthesized
tcttcatgacaatacaatttat

SEQ ID NO: 1181661 - DNA, 22 bp, Artificial Sequence
  chemically synthesized
tatgtctgtcttcatgacaata

SEQ ID NO: 1181662 - DNA, 22 bp, Artificial Sequence
  chemically synthesized
aaaataaattgtattgtcatga

SEQ ID NO: 1181663 - DNA, 22 bp, Artificial Sequence
  chemically synthesized
gtctatatgtctgtcttcatga

SEQ ID NO: 1181664 - DNA, 22 bp, Artificial Sequence
  chemically synthesized
ttggtctatatgtctgtcttca

SEQ ID NO: 1181665 - DNA, 22 bp, Artificial Sequence
  chemically synthesized
tattggtctatatgtctgtctt

SEQ ID NO: 1181666 - DNA, 22 bp, Artificial Sequence
  chemically synthesized
tattgtcatgaagacagacata

SEQ ID NO: 1181667 - DNA, 22 bp, Artificial Sequence
  chemically synthesized
ttctattggtctatatgtctgt

SEQ ID NO: 1181668 - DNA, 22 bp, Artificial Sequence
  chemically synthesized
tgttctattggtctatatgtct

SEQ ID NO: 1181669 - DNA, 22 bp, Artificial Sequence
  chemically synthesized
tcatgaagacagacatatagac

SEQ ID NO: 1181670 - DNA, 22 bp, Artificial Sequence
  chemically synthesized
ttctgttctattggtctatatg

SEQ ID NO: 1181671 - DNA, 22 bp, Artificial Sequence
  chemically synthesized
tattctgttctattggtctata

SEQ ID NO: 1181672 - DNA, 22 bp, Artificial Sequence
  chemically synthesized
ggctctattctgttctattggt

SEQ ID NO: 1181673 - DNA, 22 bp, Artificial Sequence
  chemically synthesized
tatctgggctctattctgttct

SEQ ID NO: 1181674 - DNA, 22 bp, Artificial Sequence
  chemically synthesized
atatctgggctctattctgttc

SEQ ID NO: 1181675 - DNA, 22 bp, Artificial Sequence
  chemically synthesized
tatgtgtagatttatatctggg

SEQ ID NO: 1181676 - DNA, 22 bp, Artificial Sequence
  chemically synthesized
accctatatgtgtagatttata

SEQ ID NO: 1181677 - DNA, 22 bp, Artificial Sequence
  chemically synthesized
tcgtggaacatcagttaaccct

SEQ ID NO: 1181678 - DNA, 22 bp, Artificial Sequence
  chemically synthesized
tatcgtggaacatcagttaacc

SEQ ID NO: 1181679 - DNA, 22 bp, Artificial Sequence
  chemically synthesized
cacatatagggttaactgatgt

SEQ ID NO: 1181680 - DNA, 22 bp, Artificial Sequence
  chemically synthesized
gctctatcgtggaacatcagtt

SEQ ID NO: 1181681 - DNA, 22 bp, Artificial Sequence
  chemically synthesized
ggctctatcgtggaacatcagt

SEQ ID NO: 1181682 - DNA, 22 bp, Artificial Sequence
  chemically synthesized
tgtatgcttggctctatcgtgg

SEQ ID NO: 1181683 - DNA, 22 bp, Artificial Sequence
  chemically synthesized
gtgtatgcttggctctatcgtg

SEQ ID NO: 1181684 - DNA, 22 bp, Artificial Sequence
  chemically synthesized
actgatgttccacgatagagcc

SEQ ID NO: 1181685 - DNA, 22 bp, Artificial Sequence
  chemically synthesized
cttgtgtatgcttggctctatc

SEQ ID NO: 1181686 - DNA, 22 bp, Artificial Sequence
  chemically synthesized
atgttccacgatagagccaagc

SEQ ID NO: 1181687 - DNA, 22 bp, Artificial Sequence
  chemically synthesized
ctccttgtgtatgcttggctct

SEQ ID NO: 1181688 - DNA, 22 bp, Artificial Sequence
  chemically synthesized
cctccttgtgtatgcttggctc

SEQ ID NO: 1181689 - DNA, 22 bp, Artificial Sequence
  chemically synthesized
tcctccttgtgtatgcttggct

SEQ ID NO: 1181690 - DNA, 22 bp, Artificial Sequence
  chemically synthesized
cacgatagagccaagcatacac

SEQ ID NO: 1181691 - DNA, 22 bp, Artificial Sequence
  chemically synthesized
tcctttcctccttgtgtatgct

SEQ ID NO: 1181692 - DNA, 22 bp, Artificial Sequence
  chemically synthesized
aagagattatcctttcctcctt

SEQ ID NO: 1181693 - DNA, 22 bp, Artificial Sequence
  chemically synthesized
ttgaagagattatcctttcctc

SEQ ID NO: 1181694 - DNA, 22 bp, Artificial Sequence
  chemically synthesized
gttgaagagattatcctttcct

SEQ ID NO: 1181695 - DNA, 22 bp, Artificial Sequence
  chemically synthesized
caacaccatttgttgaagagat

SEQ ID NO: 1181696 - DNA, 22 bp, Artificial Sequence
  chemically synthesized
ccaacaccatttgttgaagaga

SEQ ID NO: 1181697 - DNA, 22 bp, Artificial Sequence
  chemically synthesized
tccaacaccatttgttgaagag

SEQ ID NO: 1181698 - DNA, 22 bp, Artificial Sequence
  chemically synthesized
ttccaacaccatttgttgaaga

SEQ ID NO: 1181699 - DNA, 22 bp, Artificial Sequence
  chemically synthesized
ttcaacaaatggtgttggaaaa

SEQ ID NO: 1181700 - DNA, 22 bp, Artificial Sequence
  chemically synthesized
caacaaatggtgttggaaaaac

SEQ ID NO: 1181701 - DNA, 22 bp, Artificial Sequence
  chemically synthesized
aacaaatggtgttggaaaaact

SEQ ID NO: 1181702 - DNA, 22 bp, Artificial Sequence
  chemically synthesized
cacgtggatatccagtttttcc

SEQ ID NO: 1181703 - DNA, 22 bp, Artificial Sequence
  chemically synthesized
gcacgtggatatccagtttttc

SEQ ID NO: 1181704 - DNA, 22 bp, Artificial Sequence
  chemically synthesized
tgcacgtggatatccagttttt

SEQ ID NO: 1181705 - DNA, 22 bp, Artificial Sequence
  chemically synthesized
ttttgcacgtggatatccagtt

SEQ ID NO: 1181706 - DNA, 22 bp, Artificial Sequence
  chemically synthesized
attattttgcacgtggatatcc

SEQ ID NO: 1181707 - DNA, 22 bp, Artificial Sequence
  chemically synthesized
cattattttgcacgtggatatc

SEQ ID NO: 1181708 - DNA, 22 bp, Artificial Sequence
  chemically synthesized
gaaaaactggatatccacgtgc

SEQ ID NO: 1181709 - DNA, 22 bp, Artificial Sequence
  chemically synthesized
gatatccacgtgcaaaataatg

SEQ ID NO: 1181710 - DNA, 22 bp, Artificial Sequence
  chemically synthesized
catatggcataagataagcacc

SEQ ID NO: 1181711 - DNA, 22 bp, Artificial Sequence
  chemically synthesized
gcatatggcataagataagcac

SEQ ID NO: 1181712 - DNA, 22 bp, Artificial Sequence
  chemically synthesized
atatttgcatatggcataagat

SEQ ID NO: 1181713 - DNA, 22 bp, Artificial Sequence
  chemically synthesized
gtgcttatcttatgccatatgc

SEQ ID NO: 1181714 - DNA, 22 bp, Artificial Sequence
  chemically synthesized
gagttgatatttgcatatggca

SEQ ID NO: 1181715 - DNA, 22 bp, Artificial Sequence
  chemically synthesized
ggagttgatatttgcatatggc

SEQ ID NO: 1181716 - DNA, 22 bp, Artificial Sequence
  chemically synthesized
atcttatgccatatgcaaatat

SEQ ID NO: 1181717 - DNA, 22 bp, Artificial Sequence
  chemically synthesized
tcttatgccatatgcaaatatc

SEQ ID NO: 1181718 - DNA, 22 bp, Artificial Sequence
  chemically synthesized
tccgtttggagttgatatttgc

SEQ ID NO: 1181719 - DNA, 22 bp, Artificial Sequence
  chemically synthesized
atccgtttggagttgatatttg

SEQ ID NO: 1181720 - DNA, 22 bp, Artificial Sequence
  chemically synthesized
tatccgtttggagttgatattt

SEQ ID NO: 1181721 - DNA, 22 bp, Artificial Sequence
  chemically synthesized
atgccatatgcaaatatcaact

SEQ ID NO: 1181722 - DNA, 22 bp, Artificial Sequence
  chemically synthesized
tgccatatgcaaatatcaactc

SEQ ID NO: 1181723 - DNA, 22 bp, Artificial Sequence
  chemically synthesized
catattttatccgtttggagtt

SEQ ID NO: 1181724 - DNA, 22 bp, Artificial Sequence
  chemically synthesized
acatattttatccgtttggagt

SEQ ID NO: 1181725 - DNA, 22 bp, Artificial Sequence
  chemically synthesized
catttacatattttatccgttt

SEQ ID NO: 1181726 - DNA, 22 bp, Artificial Sequence
  chemically synthesized
acatttacatattttatccgtt

SEQ ID NO: 1181727 - DNA, 22 bp, Artificial Sequence
  chemically synthesized
tacatttacatattttatccgt

SEQ ID NO: 1181728 - DNA, 22 bp, Artificial Sequence
  chemically synthesized
aggttttacatttacatatttt

SEQ ID NO: 1181729 - DNA, 22 bp, Artificial Sequence
  chemically synthesized
caaacggataaaatatgtaaat

SEQ ID NO: 1181730 - DNA, 22 bp, Artificial Sequence
  chemically synthesized
tggattgaggttttacatttac

SEQ ID NO: 1181731 - DNA, 22 bp, Artificial Sequence
  chemically synthesized
atggattgaggttttacattta

SEQ ID NO: 1181732 - DNA, 22 bp, Artificial Sequence
  chemically synthesized
tatggattgaggttttacattt

SEQ ID NO: 1181733 - DNA, 22 bp, Artificial Sequence
  chemically synthesized
ggagttttatggattgaggttt

SEQ ID NO: 1181734 - DNA, 22 bp, Artificial Sequence
  chemically synthesized
taggagttttatggattgaggt

SEQ ID NO: 1181735 - DNA, 22 bp, Artificial Sequence
  chemically synthesized
ctaggagttttatggattgagg

SEQ ID NO: 1181736 - DNA, 22 bp, Artificial Sequence
  chemically synthesized
ttctaggagttttatggattga

SEQ ID NO: 1181737 - DNA, 22 bp, Artificial Sequence
  chemically synthesized
cttctaggagttttatggattg

SEQ ID NO: 1181738 - DNA, 22 bp, Artificial Sequence
  chemically synthesized
tcttctaggagttttatggatt

SEQ ID NO: 1181739 - DNA, 22 bp, Artificial Sequence
  chemically synthesized
caatgttttcttctaggagttt

SEQ ID NO: 1181740 - DNA, 22 bp, Artificial Sequence
  chemically synthesized
ccaatgttttcttctaggagtt

SEQ ID NO: 1181741 - DNA, 22 bp, Artificial Sequence
  chemically synthesized
tccaatgttttcttctaggagt

SEQ ID NO: 1181742 - DNA, 22 bp, Artificial Sequence
  chemically synthesized
ttccaatgttttcttctaggag

SEQ ID NO: 1181743 - DNA, 22 bp, Artificial Sequence
  chemically synthesized
aatccataaaactcctagaaga

SEQ ID NO: 1181744 - DNA, 22 bp, Artificial Sequence
  chemically synthesized
ctagaagaaaacattggaaaaa

SEQ ID NO: 1181745 - DNA, 22 bp, Artificial Sequence
  chemically synthesized
gaagaaaacattggaaaaatct

SEQ ID NO: 1181746 - DNA, 22 bp, Artificial Sequence
  chemically synthesized
cgaggatgaatgtcacaagatt

SEQ ID NO: 1181747 - DNA, 22 bp, Artificial Sequence
  chemically synthesized
gaaaaatcttgtgacattcatc

SEQ ID NO: 1181748 - DNA, 22 bp, Artificial Sequence
  chemically synthesized
gaaataattgcgaggatgaatg

SEQ ID NO: 1181749 - DNA, 22 bp, Artificial Sequence
  chemically synthesized
ggaaataattgcgaggatgaat

SEQ ID NO: 1181750 - DNA, 22 bp, Artificial Sequence
  chemically synthesized
tggaaataattgcgaggatgaa

SEQ ID NO: 1181751 - DNA, 22 bp, Artificial Sequence
  chemically synthesized
ttggaaataattgcgaggatga

SEQ ID NO: 1181752 - DNA, 22 bp, Artificial Sequence
  chemically synthesized
gtgacattcatcctcgcaatta

SEQ ID NO: 1181753 - DNA, 22 bp, Artificial Sequence
  chemically synthesized
tgcttttggaaataattgcgag

SEQ ID NO: 1181754 - DNA, 22 bp, Artificial Sequence
  chemically synthesized
tgacattcatcctcgcaattat

SEQ ID NO: 1181755 - DNA, 22 bp, Artificial Sequence
  chemically synthesized
gtgcttttggaaataattgcga

SEQ ID NO: 1181756 - DNA, 22 bp, Artificial Sequence
  chemically synthesized
cttgtgcttttggaaataattg

SEQ ID NO: 1181757 - DNA, 22 bp, Artificial Sequence
  chemically synthesized
ttgcttgtgcttttggaaataa

SEQ ID NO: 1181758 - DNA, 22 bp, Artificial Sequence
  chemically synthesized
attgcttgtgcttttggaaata

SEQ ID NO: 1181759 - DNA, 22 bp, Artificial Sequence
  chemically synthesized
atcctcgcaattatttccaaaa

SEQ ID NO: 1181760 - DNA, 22 bp, Artificial Sequence
  chemically synthesized
tattgcttgtgcttttggaaat

SEQ ID NO: 1181761 - DNA, 22 bp, Artificial Sequence
  chemically synthesized
ttattgcttgtgcttttggaaa

SEQ ID NO: 1181762 - DNA, 22 bp, Artificial Sequence
  chemically synthesized
cttttattgcttgtgcttttgg

SEQ ID NO: 1181763 - DNA, 22 bp, Artificial Sequence
  chemically synthesized
gcttttattgcttgtgcttttg

SEQ ID NO: 1181764 - DNA, 22 bp, Artificial Sequence
  chemically synthesized
gcaattatttccaaaagcacaa

SEQ ID NO: 1181765 - DNA, 22 bp, Artificial Sequence
  chemically synthesized
tgcttttattgcttgtgctttt

SEQ ID NO: 1181766 - DNA, 22 bp, Artificial Sequence
  chemically synthesized
ttgcttttattgcttgtgcttt

SEQ ID NO: 1181767 - DNA, 22 bp, Artificial Sequence
  chemically synthesized
tttgcttttattgcttgtgctt

SEQ ID NO: 1181768 - DNA, 22 bp, Artificial Sequence
  chemically synthesized
ttttgcttttattgcttgtgct

SEQ ID NO: 1181769 - DNA, 22 bp, Artificial Sequence
  chemically synthesized
tttttgcttttattgcttgtgc

SEQ ID NO: 1181770 - DNA, 22 bp, Artificial Sequence
  chemically synthesized
tttccaaaagcacaagcaataa

SEQ ID NO: 1181771 - DNA, 22 bp, Artificial Sequence
  chemically synthesized
ttttttttgcttttattgcttg

SEQ ID NO: 1181772 - DNA, 22 bp, Artificial Sequence
  chemically synthesized
tattttttttgcttttattgct

SEQ ID NO: 1181773 - DNA, 22 bp, Artificial Sequence
  chemically synthesized
ccaaaagcacaagcaataaaag

SEQ ID NO: 1181774 - DNA, 22 bp, Artificial Sequence
  chemically synthesized
caaaagcacaagcaataaaagc

SEQ ID NO: 1181775 - DNA, 22 bp, Artificial Sequence
  chemically synthesized
attctattttttttgcttttat

SEQ ID NO: 1181776 - DNA, 22 bp, Artificial Sequence
  chemically synthesized
aattctattttttttgctttta

SEQ ID NO: 1181777 - DNA, 22 bp, Artificial Sequence
  chemically synthesized
tgtagtcttaattctatttttt

SEQ ID NO: 1181778 - DNA, 22 bp, Artificial Sequence
  chemically synthesized
atgtagtcttaattctattttt

SEQ ID NO: 1181779 - DNA, 22 bp, Artificial Sequence
  chemically synthesized
tatgtagtcttaattctatttt

SEQ ID NO: 1181780 - DNA, 22 bp, Artificial Sequence
  chemically synthesized
gttttatgtagtcttaattcta

SEQ ID NO: 1181781 - DNA, 22 bp, Artificial Sequence
  chemically synthesized
agttttatgtagtcttaattct

SEQ ID NO: 1181782 - DNA, 22 bp, Artificial Sequence
  chemically synthesized
tagttttatgtagtcttaattc

SEQ ID NO: 1181783 - DNA, 22 bp, Artificial Sequence
  chemically synthesized
ttagttttatgtagtcttaatt

SEQ ID NO: 1181784 - DNA, 22 bp, Artificial Sequence
  chemically synthesized
aacagaagatttttagttttat

SEQ ID NO: 1181785 - DNA, 22 bp, Artificial Sequence
  chemically synthesized
taaacagaagatttttagtttt

SEQ ID NO: 1181786 - DNA, 22 bp, Artificial Sequence
  chemically synthesized
ctaaacagaagatttttagttt

SEQ ID NO: 1181787 - DNA, 22 bp, Artificial Sequence
  chemically synthesized
tctaaacagaagatttttagtt

SEQ ID NO: 1181788 - DNA, 22 bp, Artificial Sequence
  chemically synthesized
agactacataaaactaaaaatc

SEQ ID NO: 1181789 - DNA, 22 bp, Artificial Sequence
  chemically synthesized
ttctaaacagaagatttttagt

SEQ ID NO: 1181790 - DNA, 22 bp, Artificial Sequence
  chemically synthesized
ccttttctaaacagaagatttt

SEQ ID NO: 1181791 - DNA, 22 bp, Artificial Sequence
  chemically synthesized
cataaaactaaaaatcttctgt

SEQ ID NO: 1181792 - DNA, 22 bp, Artificial Sequence
  chemically synthesized
ttcccttttctaaacagaagat

SEQ ID NO: 1181793 - DNA, 22 bp, Artificial Sequence
  chemically synthesized
gttcccttttctaaacagaaga

SEQ ID NO: 1181794 - DNA, 22 bp, Artificial Sequence
  chemically synthesized
atttgttcccttttctaaacag

SEQ ID NO: 1181795 - DNA, 22 bp, Artificial Sequence
  chemically synthesized
aaaatcttctgtttagaaaagg

SEQ ID NO: 1181796 - DNA, 22 bp, Artificial Sequence
  chemically synthesized
acagtgttgatttgttcccttt

SEQ ID NO: 1181797 - DNA, 22 bp, Artificial Sequence
  chemically synthesized
cacagtgttgatttgttccctt

SEQ ID NO: 1181798 - DNA, 22 bp, Artificial Sequence
  chemically synthesized
tcacagtgttgatttgttccct

SEQ ID NO: 1181799 - DNA, 22 bp, Artificial Sequence
  chemically synthesized
ctgtttagaaaagggaacaaat

SEQ ID NO: 1181800 - DNA, 22 bp, Artificial Sequence
  chemically synthesized
ttcacagtgttgatttgttccc

SEQ ID NO: 1181801 - DNA, 22 bp, Artificial Sequence
  chemically synthesized
tgtttagaaaagggaacaaatc

SEQ ID NO: 1181802 - DNA, 22 bp, Artificial Sequence
  chemically synthesized
tttagaaaagggaacaaatcaa

SEQ ID NO: 1181803 - DNA, 22 bp, Artificial Sequence
  chemically synthesized
ccttttcacagtgttgatttgt

SEQ ID NO: 1181804 - DNA, 22 bp, Artificial Sequence
  chemically synthesized
agaaaagggaacaaatcaacac

SEQ ID NO: 1181805 - DNA, 22 bp, Artificial Sequence
  chemically synthesized
gaaaagggaacaaatcaacact

SEQ ID NO: 1181806 - DNA, 22 bp, Artificial Sequence
  chemically synthesized
catagattgccttttcacagtg

SEQ ID NO: 1181807 - DNA, 22 bp, Artificial Sequence
  chemically synthesized
ccattccatagattgccttttc

SEQ ID NO: 1181808 - DNA, 22 bp, Artificial Sequence
  chemically synthesized
cccattccatagattgcctttt

SEQ ID NO: 1181809 - DNA, 22 bp, Artificial Sequence
  chemically synthesized
tcccattccatagattgccttt

SEQ ID NO: 1181810 - DNA, 22 bp, Artificial Sequence
  chemically synthesized
tattttcccattccatagattg

SEQ ID NO: 1181811 - DNA, 22 bp, Artificial Sequence
  chemically synthesized
gtattttcccattccatagatt

SEQ ID NO: 1181812 - DNA, 22 bp, Artificial Sequence
  chemically synthesized
tgaaaaggcaatctatggaatg

SEQ ID NO: 1181813 - DNA, 22 bp, Artificial Sequence
  chemically synthesized
tggaatgggaaaatacaaacca

SEQ ID NO: 1181814 - DNA, 22 bp, Artificial Sequence
  chemically synthesized
ataatatatatatatggtttgt

SEQ ID NO: 1181815 - DNA, 22 bp, Artificial Sequence
  chemically synthesized
tcataatatatatatatggttt

SEQ ID NO: 1181816 - DNA, 22 bp, Artificial Sequence
  chemically synthesized
gaaataattctcataatatata

SEQ ID NO: 1181817 - DNA, 22 bp, Artificial Sequence
  chemically synthesized
agttagaaataattctcataat

SEQ ID NO: 1181818 - DNA, 22 bp, Artificial Sequence
  chemically synthesized
tgagttagaaataattctcata

SEQ ID NO: 1181819 - DNA, 22 bp, Artificial Sequence
  chemically synthesized
atagctctgagttagaaataat

SEQ ID NO: 1181820 - DNA, 22 bp, Artificial Sequence
  chemically synthesized
ctaatagctctgagttagaaat

SEQ ID NO: 1181821 - DNA, 22 bp, Artificial Sequence
  chemically synthesized
tgagaattatttctaactcaga

SEQ ID NO: 1181822 - DNA, 22 bp, Artificial Sequence
  chemically synthesized
accctcctaatagctctgagtt

SEQ ID NO: 1181823 - DNA, 22 bp, Artificial Sequence
  chemically synthesized
aaccctcctaatagctctgagt

SEQ ID NO: 1181824 - DNA, 22 bp, Artificial Sequence
  chemically synthesized
tttaaccctcctaatagctctg

SEQ ID NO: 1181825 - DNA, 22 bp, Artificial Sequence
  chemically synthesized
atttaaccctcctaatagctct

SEQ ID NO: 1181826 - DNA, 22 bp, Artificial Sequence
  chemically synthesized
tatttaaccctcctaatagctc

SEQ ID NO: 1181827 - DNA, 22 bp, Artificial Sequence
  chemically synthesized
tttctaactcagagctattagg

SEQ ID NO: 1181828 - DNA, 22 bp, Artificial Sequence
  chemically synthesized
ctaactcagagctattaggagg

SEQ ID NO: 1181829 - DNA, 22 bp, Artificial Sequence
  chemically synthesized
attttatttaaccctcctaata

SEQ ID NO: 1181830 - DNA, 22 bp, Artificial Sequence
  chemically synthesized
taactcagagctattaggaggg

SEQ ID NO: 1181831 - DNA, 22 bp, Artificial Sequence
  chemically synthesized
actcagagctattaggagggtt

SEQ ID NO: 1181832 - DNA, 22 bp, Artificial Sequence
  chemically synthesized
agagctattaggagggttaaat

SEQ ID NO: 1181833 - DNA, 22 bp, Artificial Sequence
  chemically synthesized
tataattcattttatttaaccc

SEQ ID NO: 1181834 - DNA, 22 bp, Artificial Sequence
  chemically synthesized
atataattcattttatttaacc

SEQ ID NO: 1181835 - DNA, 22 bp, Artificial Sequence
  chemically synthesized
tatataattcattttatttaac

SEQ ID NO: 1181836 - DNA, 22 bp, Artificial Sequence
  chemically synthesized
tttatataattcattttattta

SEQ ID NO: 1181837 - DNA, 22 bp, Artificial Sequence
  chemically synthesized
ttaggagggttaaataaaatga

SEQ ID NO: 1181838 - DNA, 22 bp, Artificial Sequence
  chemically synthesized
ggagggttaaataaaatgaatt

SEQ ID NO: 1181839 - DNA, 22 bp, Artificial Sequence
  chemically synthesized
aataaaatgaattatataaaga

SEQ ID NO: 1181840 - DNA, 22 bp, Artificial Sequence
  chemically synthesized
taccatgaagtattctttatat

SEQ ID NO: 1181841 - DNA, 22 bp, Artificial Sequence
  chemically synthesized
gaatgtagctataccatgaagt

SEQ ID NO: 1181842 - DNA, 22 bp, Artificial Sequence
  chemically synthesized
agaatgtagctataccatgaag

SEQ ID NO: 1181843 - DNA, 22 bp, Artificial Sequence
  chemically synthesized
tataaagaatacttcatggtat

SEQ ID NO: 1181844 - DNA, 22 bp, Artificial Sequence
  chemically synthesized
ataacttagaatgtagctatac

SEQ ID NO: 1181845 - DNA, 22 bp, Artificial Sequence
  chemically synthesized
gataacttagaatgtagctata

SEQ ID NO: 1181846 - DNA, 22 bp, Artificial Sequence
  chemically synthesized
tgataacttagaatgtagctat

SEQ ID NO: 1181847 - DNA, 22 bp, Artificial Sequence
  chemically synthesized
ttgataacttagaatgtagcta

SEQ ID NO: 1181848 - DNA, 22 bp, Artificial Sequence
  chemically synthesized
tttgataacttagaatgtagct

SEQ ID NO: 1181849 - DNA, 22 bp, Artificial Sequence
  chemically synthesized
catggtatagctacattctaag

SEQ ID NO: 1181850 - DNA, 22 bp, Artificial Sequence
  chemically synthesized
tctttttgataacttagaatgt

SEQ ID NO: 1181851 - DNA, 22 bp, Artificial Sequence
  chemically synthesized
atggtatagctacattctaagt

SEQ ID NO: 1181852 - DNA, 22 bp, Artificial Sequence
  chemically synthesized
ctgtctttttgataacttagaa

SEQ ID NO: 1181853 - DNA, 22 bp, Artificial Sequence
  chemically synthesized
gttgctgtctttttgataactt

SEQ ID NO: 1181854 - DNA, 22 bp, Artificial Sequence
  chemically synthesized
cattctaagttatcaaaaagac

SEQ ID NO: 1181855 - DNA, 22 bp, Artificial Sequence
  chemically synthesized
taagttatcaaaaagacagcaa

SEQ ID NO: 1181856 - DNA, 22 bp, Artificial Sequence
  chemically synthesized
agttatcaaaaagacagcaacc

SEQ ID NO: 1181857 - DNA, 22 bp, Artificial Sequence
  chemically synthesized
tcaaaaagacagcaaccaatat

SEQ ID NO: 1181858 - DNA, 22 bp, Artificial Sequence
  chemically synthesized
aaatagtaatcatgatattggt

SEQ ID NO: 1181859 - DNA, 22 bp, Artificial Sequence
  chemically synthesized
aaaatagtaatcatgatattgg

SEQ ID NO: 1181860 - DNA, 22 bp, Artificial Sequence
  chemically synthesized
atgtatttaaaatagtaatcat

SEQ ID NO: 1181861 - DNA, 22 bp, Artificial Sequence
  chemically synthesized
agccctgatgtatttaaaatag

SEQ ID NO: 1181862 - DNA, 22 bp, Artificial Sequence
  chemically synthesized
cctaagccctgatgtatttaaa

SEQ ID NO: 1181863 - DNA, 22 bp, Artificial Sequence
  chemically synthesized
acctaagccctgatgtatttaa

SEQ ID NO: 1181864 - DNA, 22 bp, Artificial Sequence
  chemically synthesized
ctattttaaatacatcagggct

SEQ ID NO: 1181865 - DNA, 22 bp, Artificial Sequence
  chemically synthesized
ttttaaatacatcagggcttag

SEQ ID NO: 1181866 - DNA, 22 bp, Artificial Sequence
  chemically synthesized
taaatacatcagggcttaggta

SEQ ID NO: 1181867 - DNA, 22 bp, Artificial Sequence
  chemically synthesized
atcacaaaatcttacctaagcc

SEQ ID NO: 1181868 - DNA, 22 bp, Artificial Sequence
  chemically synthesized
aaatacatcagggcttaggtaa

SEQ ID NO: 1181869 - DNA, 22 bp, Artificial Sequence
  chemically synthesized
aatacatcagggcttaggtaag

SEQ ID NO: 1181870 - DNA, 22 bp, Artificial Sequence
  chemically synthesized
aggtctgatcacaaaatcttac

SEQ ID NO: 1181871 - DNA, 22 bp, Artificial Sequence
  chemically synthesized
caggtctgatcacaaaatctta

SEQ ID NO: 1181872 - DNA, 22 bp, Artificial Sequence
  chemically synthesized
aggtaagattttgtgatcagac

SEQ ID NO: 1181873 - DNA, 22 bp, Artificial Sequence
  chemically synthesized
ggtaagattttgtgatcagacc

SEQ ID NO: 1181874 - DNA, 22 bp, Artificial Sequence
  chemically synthesized
atataatataaggtcttcaggt

SEQ ID NO: 1181875 - DNA, 22 bp, Artificial Sequence
  chemically synthesized
tgtgatcagacctgaagacctt

SEQ ID NO: 1181876 - DNA, 22 bp, Artificial Sequence
  chemically synthesized
ttaatataatataaggtcttca

SEQ ID NO: 1181877 - DNA, 22 bp, Artificial Sequence
  chemically synthesized
gtgatcagacctgaagacctta

SEQ ID NO: 1181878 - DNA, 22 bp, Artificial Sequence
  chemically synthesized
tgatcagacctgaagaccttat

SEQ ID NO: 1181879 - DNA, 22 bp, Artificial Sequence
  chemically synthesized
aagaccttatattatattaaca

SEQ ID NO: 1181880 - DNA, 22 bp, Artificial Sequence
  chemically synthesized
gaagataaccagttgttaatat

SEQ ID NO: 1181881 - DNA, 22 bp, Artificial Sequence
  chemically synthesized
agaagataaccagttgttaata

SEQ ID NO: 1181882 - DNA, 22 bp, Artificial Sequence
  chemically synthesized
tagaagataaccagttgttaat

SEQ ID NO: 1181883 - DNA, 22 bp, Artificial Sequence
  chemically synthesized
atattatattaacaactggtta

SEQ ID NO: 1181884 - DNA, 22 bp, Artificial Sequence
  chemically synthesized
tattatattaacaactggttat

SEQ ID NO: 1181885 - DNA, 22 bp, Artificial Sequence
  chemically synthesized
tatattttagaagataaccagt

SEQ ID NO: 1181886 - DNA, 22 bp, Artificial Sequence
  chemically synthesized
atatattttagaagataaccag

SEQ ID NO: 1181887 - DNA, 22 bp, Artificial Sequence
  chemically synthesized
tatatattttagaagataacca

SEQ ID NO: 1181888 - DNA, 22 bp, Artificial Sequence
  chemically synthesized
tattaacaactggttatcttct

SEQ ID NO: 1181889 - DNA, 22 bp, Artificial Sequence
  chemically synthesized
tttatatattttagaagataac

SEQ ID NO: 1181890 - DNA, 22 bp, Artificial Sequence
  chemically synthesized
acaactggttatcttctaaaat

SEQ ID NO: 1181891 - DNA, 22 bp, Artificial Sequence
  chemically synthesized
taggaattctttatatatttta

SEQ ID NO: 1181892 - DNA, 22 bp, Artificial Sequence
  chemically synthesized
gttatcttctaaaatatataaa

SEQ ID NO: 1181893 - DNA, 22 bp, Artificial Sequence
  chemically synthesized
tcttctaaaatatataaagaat

SEQ ID NO: 1181894 - DNA, 22 bp, Artificial Sequence
  chemically synthesized
ctaaaatatataaagaattcct

SEQ ID NO: 1181895 - DNA, 22 bp, Artificial Sequence
  chemically synthesized
ccaatgagttgtaggaattctt

SEQ ID NO: 1181896 - DNA, 22 bp, Artificial Sequence
  chemically synthesized
taaaatatataaagaattccta

SEQ ID NO: 1181897 - DNA, 22 bp, Artificial Sequence
  chemically synthesized
gccaatgagttgtaggaattct

SEQ ID NO: 1181898 - DNA, 22 bp, Artificial Sequence
  chemically synthesized
tgccaatgagttgtaggaattc

SEQ ID NO: 1181899 - DNA, 22 bp, Artificial Sequence
  chemically synthesized
aaatatataaagaattcctaca

SEQ ID NO: 1181900 - DNA, 22 bp, Artificial Sequence
  chemically synthesized
ttgccaatgagttgtaggaatt

SEQ ID NO: 1181901 - DNA, 22 bp, Artificial Sequence
  chemically synthesized
tttgccaatgagttgtaggaat

SEQ ID NO: 1181902 - DNA, 22 bp, Artificial Sequence
  chemically synthesized
ttttgccaatgagttgtaggaa

SEQ ID NO: 1181903 - DNA, 22 bp, Artificial Sequence
  chemically synthesized
tttttgccaatgagttgtagga

SEQ ID NO: 1181904 - DNA, 22 bp, Artificial Sequence
  chemically synthesized
ttttttgccaatgagttgtagg

SEQ ID NO: 1181905 - DNA, 22 bp, Artificial Sequence
  chemically synthesized
tttttttgccaatgagttgtag

SEQ ID NO: 1181906 - DNA, 22 bp, Artificial Sequence
  chemically synthesized
ttttttttgccaatgagttgta

SEQ ID NO: 1181907 - DNA, 22 bp, Artificial Sequence
  chemically synthesized
tttttttttgccaatgagttgt

SEQ ID NO: 1181908 - DNA, 22 bp, Artificial Sequence
  chemically synthesized
ttttttttttgccaatgagttg

SEQ ID NO: 1181909 - DNA, 22 bp, Artificial Sequence
  chemically synthesized
gtttttttttttttgccaatga

SEQ ID NO: 1181910 - DNA, 22 bp, Artificial Sequence
  chemically synthesized
agtttttttttttttgccaatg

SEQ ID NO: 1181911 - DNA, 22 bp, Artificial Sequence
  chemically synthesized
tagtttttttttttttgccaat

SEQ ID NO: 1181912 - DNA, 22 bp, Artificial Sequence
  chemically synthesized
ttagtttttttttttttgccaa

SEQ ID NO: 1181913 - DNA, 22 bp, Artificial Sequence
  chemically synthesized
ctacaactcattggcaaaaaaa

SEQ ID NO: 1181914 - DNA, 22 bp, Artificial Sequence
  chemically synthesized
caactcattggcaaaaaaaaaa

SEQ ID NO: 1181915 - DNA, 22 bp, Artificial Sequence
  chemically synthesized
cgtttttagttttttttttttt

SEQ ID NO: 1181916 - DNA, 22 bp, Artificial Sequence
  chemically synthesized
attgcgtttttagttttttttt

SEQ ID NO: 1181917 - DNA, 22 bp, Artificial Sequence
  chemically synthesized
aattgcgtttttagtttttttt

SEQ ID NO: 1181918 - DNA, 22 bp, Artificial Sequence
  chemically synthesized
attggcaaaaaaaaaaaaacta

SEQ ID NO: 1181919 - DNA, 22 bp, Artificial Sequence
  chemically synthesized
taattgcgtttttagttttttt

SEQ ID NO: 1181920 - DNA, 22 bp, Artificial Sequence
  chemically synthesized
ttaattgcgtttttagtttttt

SEQ ID NO: 1181921 - DNA, 22 bp, Artificial Sequence
  chemically synthesized
gcaaaaaaaaaaaaactaaaaa

SEQ ID NO: 1181922 - DNA, 22 bp, Artificial Sequence
  chemically synthesized
gcccatttttaattgcgttttt

SEQ ID NO: 1181923 - DNA, 22 bp, Artificial Sequence
  chemically synthesized
agcccatttttaattgcgtttt

SEQ ID NO: 1181924 - DNA, 22 bp, Artificial Sequence
  chemically synthesized
tagcccatttttaattgcgttt

SEQ ID NO: 1181925 - DNA, 22 bp, Artificial Sequence
  chemically synthesized
aagcctttagcccatttttaat

SEQ ID NO: 1181926 - DNA, 22 bp, Artificial Sequence
  chemically synthesized
ttcaagcctttagcccattttt

SEQ ID NO: 1181927 - DNA, 22 bp, Artificial Sequence
  chemically synthesized
aaaacgcaattaaaaatgggct

SEQ ID NO: 1181928 - DNA, 22 bp, Artificial Sequence
  chemically synthesized
gagaaatgtctgttcaagcctt

SEQ ID NO: 1181929 - DNA, 22 bp, Artificial Sequence
  chemically synthesized
aaaatgggctaaaggcttgaac

SEQ ID NO: 1181930 - DNA, 22 bp, Artificial Sequence
  chemically synthesized
ggagaaatgtctgttcaagcct

SEQ ID NO: 1181931 - DNA, 22 bp, Artificial Sequence
  chemically synthesized
tggagaaatgtctgttcaagcc

SEQ ID NO: 1181932 - DNA, 22 bp, Artificial Sequence
  chemically synthesized
aaggcttgaacagacatttctc

SEQ ID NO: 1181933 - DNA, 22 bp, Artificial Sequence
  chemically synthesized
ggtgtcgtctttggagaaatgt

SEQ ID NO: 1181934 - DNA, 22 bp, Artificial Sequence
  chemically synthesized
gggtgtcgtctttggagaaatg

SEQ ID NO: 1181935 - DNA, 22 bp, Artificial Sequence
  chemically synthesized
gaacagacatttctccaaagac

SEQ ID NO: 1181936 - DNA, 22 bp, Artificial Sequence
  chemically synthesized
aacagacatttctccaaagacg

SEQ ID NO: 1181937 - DNA, 22 bp, Artificial Sequence
  chemically synthesized
accatttgggtgtcgtctttgg

SEQ ID NO: 1181938 - DNA, 22 bp, Artificial Sequence
  chemically synthesized
ttgaccatttgggtgtcgtctt

SEQ ID NO: 1181939 - DNA, 22 bp, Artificial Sequence
  chemically synthesized
ctccaaagacgacacccaaatg

SEQ ID NO: 1181940 - DNA, 22 bp, Artificial Sequence
  chemically synthesized
tccaaagacgacacccaaatgg

SEQ ID NO: 1181941 - DNA, 22 bp, Artificial Sequence
  chemically synthesized
atacacctgttgaccatttggg

SEQ ID NO: 1181942 - DNA, 22 bp, Artificial Sequence
  chemically synthesized
caaagacgacacccaaatggtc

SEQ ID NO: 1181943 - DNA, 22 bp, Artificial Sequence
  chemically synthesized
catacacctgttgaccatttgg

SEQ ID NO: 1181944 - DNA, 22 bp, Artificial Sequence
  chemically synthesized
tcatacacctgttgaccatttg

SEQ ID NO: 1181945 - DNA, 22 bp, Artificial Sequence
  chemically synthesized
aacatattttcatacacctgtt

SEQ ID NO: 1181946 - DNA, 22 bp, Artificial Sequence
  chemically synthesized
ataatgttgaacatattttcat

SEQ ID NO: 1181947 - DNA, 22 bp, Artificial Sequence
  chemically synthesized
ataattcataatgttgaacata

SEQ ID NO: 1181948 - DNA, 22 bp, Artificial Sequence
  chemically synthesized
cctgataattcataatgttgaa

SEQ ID NO: 1181949 - DNA, 22 bp, Artificial Sequence
  chemically synthesized
ccctgataattcataatgttga

SEQ ID NO: 1181950 - DNA, 22 bp, Artificial Sequence
  chemically synthesized
catttccctgataattcataat

SEQ ID NO: 1181951 - DNA, 22 bp, Artificial Sequence
  chemically synthesized
acatttccctgataattcataa

SEQ ID NO: 1181952 - DNA, 22 bp, Artificial Sequence
  chemically synthesized
atttacatttccctgataattc

SEQ ID NO: 1181953 - DNA, 22 bp, Artificial Sequence
  chemically synthesized
catttacatttccctgataatt

SEQ ID NO: 1181954 - DNA, 22 bp, Artificial Sequence
  chemically synthesized
tcatttacatttccctgataat

SEQ ID NO: 1181955 - DNA, 22 bp, Artificial Sequence
  chemically synthesized
ttcatttacatttccctgataa

SEQ ID NO: 1181956 - DNA, 22 bp, Artificial Sequence
  chemically synthesized
aacattatgaattatcagggaa

SEQ ID NO: 1181957 - DNA, 22 bp, Artificial Sequence
  chemically synthesized
cttttcatttacatttccctga

SEQ ID NO: 1181958 - DNA, 22 bp, Artificial Sequence
  chemically synthesized
tgcttttcatttacatttccct

SEQ ID NO: 1181959 - DNA, 22 bp, Artificial Sequence
  chemically synthesized
tgaattatcagggaaatgtaaa

SEQ ID NO: 1181960 - DNA, 22 bp, Artificial Sequence
  chemically synthesized
attctgcttttcatttacattt

SEQ ID NO: 1181961 - DNA, 22 bp, Artificial Sequence
  chemically synthesized
tcagggaaatgtaaatgaaaag

SEQ ID NO: 1181962 - DNA, 22 bp, Artificial Sequence
  chemically synthesized
atagtaggcatccaacaggtat

SEQ ID NO: 1181963 - DNA, 22 bp, Artificial Sequence
  chemically synthesized
aatagtaggcatccaacaggta

SEQ ID NO: 1181964 - DNA, 22 bp, Artificial Sequence
  chemically synthesized
taatagtaggcatccaacaggt

SEQ ID NO: 1181965 - DNA, 22 bp, Artificial Sequence
  chemically synthesized
ttaatagtaggcatccaacagg

SEQ ID NO: 1181966 - DNA, 22 bp, Artificial Sequence
  chemically synthesized
tcacatttatacctgttggatg

SEQ ID NO: 1181967 - DNA, 22 bp, Artificial Sequence
  chemically synthesized
tttaatagtaggcatccaacag

SEQ ID NO: 1181968 - DNA, 22 bp, Artificial Sequence
  chemically synthesized
atacctgttggatgcctactat

SEQ ID NO: 1181969 - DNA, 22 bp, Artificial Sequence
  chemically synthesized
atccattttttaatagtaggca

SEQ ID NO: 1181970 - DNA, 22 bp, Artificial Sequence
  chemically synthesized
tacctgttggatgcctactatt

SEQ ID NO: 1181971 - DNA, 22 bp, Artificial Sequence
  chemically synthesized
ctaatccattttttaatagtag

SEQ ID NO: 1181972 - DNA, 22 bp, Artificial Sequence
  chemically synthesized
actaatccattttttaatagta

SEQ ID NO: 1181973 - DNA, 22 bp, Artificial Sequence
  chemically synthesized
ttggatgcctactattaaaaaa

SEQ ID NO: 1181974 - DNA, 22 bp, Artificial Sequence
  chemically synthesized
gatgcctactattaaaaaatgg

SEQ ID NO: 1181975 - DNA, 22 bp, Artificial Sequence
  chemically synthesized
cacatccttactaatccatttt

SEQ ID NO: 1181976 - DNA, 22 bp, Artificial Sequence
  chemically synthesized
ttccacatccttactaatccat

SEQ ID NO: 1181977 - DNA, 22 bp, Artificial Sequence
  chemically synthesized
ctattaaaaaatggattagtaa

SEQ ID NO: 1181978 - DNA, 22 bp, Artificial Sequence
  chemically synthesized
ttaaaaaatggattagtaagga

SEQ ID NO: 1181979 - DNA, 22 bp, Artificial Sequence
  chemically synthesized
caattattccacatccttacta

SEQ ID NO: 1181980 - DNA, 22 bp, Artificial Sequence
  chemically synthesized
aaaaatggattagtaaggatgt

SEQ ID NO: 1181981 - DNA, 22 bp, Artificial Sequence
  chemically synthesized
gtaaggatgtggaataattgga

SEQ ID NO: 1181982 - DNA, 22 bp, Artificial Sequence
  chemically synthesized
accaacggtgtacaatagttcc

SEQ ID NO: 1181983 - DNA, 22 bp, Artificial Sequence
  chemically synthesized
caccaacggtgtacaatagttc

SEQ ID NO: 1181984 - DNA, 22 bp, Artificial Sequence
  chemically synthesized
cttcaccaacggtgtacaatag

SEQ ID NO: 1181985 - DNA, 22 bp, Artificial Sequence
  chemically synthesized
acttcaccaacggtgtacaata

SEQ ID NO: 1181986 - DNA, 22 bp, Artificial Sequence
  chemically synthesized
tacttcaccaacggtgtacaat

SEQ ID NO: 1181987 - DNA, 22 bp, Artificial Sequence
  chemically synthesized
ttacttcaccaacggtgtacaa

SEQ ID NO: 1181988 - DNA, 22 bp, Artificial Sequence
  chemically synthesized
tttacttcaccaacggtgtaca

SEQ ID NO: 1181989 - DNA, 22 bp, Artificial Sequence
  chemically synthesized
gaactattgtacaccgttggtg

SEQ ID NO: 1181990 - DNA, 22 bp, Artificial Sequence
  chemically synthesized
ttgtacaccgttggtgaagtaa

SEQ ID NO: 1181991 - DNA, 22 bp, Artificial Sequence
  chemically synthesized
tacaccgttggtgaagtaaaaa

SEQ ID NO: 1181992 - DNA, 22 bp, Artificial Sequence
  chemically synthesized
cataatagccatgccatttttt

SEQ ID NO: 1181993 - DNA, 22 bp, Artificial Sequence
  chemically synthesized
ccataatagccatgccattttt

SEQ ID NO: 1181994 - DNA, 22 bp, Artificial Sequence
  chemically synthesized
tccataatagccatgccatttt

SEQ ID NO: 1181995 - DNA, 22 bp, Artificial Sequence
  chemically synthesized
gtgaagtaaaaaatggcatggc

SEQ ID NO: 1181996 - DNA, 22 bp, Artificial Sequence
  chemically synthesized
ttttccataatagccatgccat

SEQ ID NO: 1181997 - DNA, 22 bp, Artificial Sequence
  chemically synthesized
tattattttccataatagccat

SEQ ID NO: 1181998 - DNA, 22 bp, Artificial Sequence
  chemically synthesized
aggagcaactatattattttcc

SEQ ID NO: 1181999 - DNA, 22 bp, Artificial Sequence
  chemically synthesized
gaggagcaactatattattttc

SEQ ID NO: 1182000 - DNA, 22 bp, Artificial Sequence
  chemically synthesized
tgaggagcaactatattatttt

SEQ ID NO: 1182001 - DNA, 22 bp, Artificial Sequence
  chemically synthesized
ttgaggagcaactatattattt

SEQ ID NO: 1182002 - DNA, 22 bp, Artificial Sequence
  chemically synthesized
atttttgaggagcaactatatt

SEQ ID NO: 1182003 - DNA, 22 bp, Artificial Sequence
  chemically synthesized
ttatggaaaataatatagttgc

SEQ ID NO: 1182004 - DNA, 22 bp, Artificial Sequence
  chemically synthesized
aatttttgaggagcaactatat

SEQ ID NO: 1182005 - DNA, 22 bp, Artificial Sequence
  chemically synthesized
taatttttgaggagcaactata

SEQ ID NO: 1182006 - DNA, 22 bp, Artificial Sequence
  chemically synthesized
ttaatttttgaggagcaactat

SEQ ID NO: 1182007 - DNA, 22 bp, Artificial Sequence
  chemically synthesized
tggaaaataatatagttgctcc

SEQ ID NO: 1182008 - DNA, 22 bp, Artificial Sequence
  chemically synthesized
tttttaatttttgaggagcaac

SEQ ID NO: 1182009 - DNA, 22 bp, Artificial Sequence
  chemically synthesized
tgtttttaatttttgaggagca

SEQ ID NO: 1182010 - DNA, 22 bp, Artificial Sequence
  chemically synthesized
ctcctcaaaaattaaaaacaga

SEQ ID NO: 1182011 - DNA, 22 bp, Artificial Sequence
  chemically synthesized
gatcaagtgggagttctgtttt

SEQ ID NO: 1182012 - DNA, 22 bp, Artificial Sequence
  chemically synthesized
ctcaaaaattaaaaacagaact

SEQ ID NO: 1182013 - DNA, 22 bp, Artificial Sequence
  chemically synthesized
ctagatcaagtgggagttctgt

SEQ ID NO: 1182014 - DNA, 22 bp, Artificial Sequence
  chemically synthesized
aaaaattaaaaacagaactccc

SEQ ID NO: 1182015 - DNA, 22 bp, Artificial Sequence
  chemically synthesized
aaaacagaactcccacttgatc

SEQ ID NO: 1182016 - DNA, 22 bp, Artificial Sequence
  chemically synthesized
ccacttgatctagcaatctcac

SEQ ID NO: 1182017 - DNA, 22 bp, Artificial Sequence
  chemically synthesized
gataaatatccaaaagtgagat

SEQ ID NO: 1182018 - DNA, 22 bp, Artificial Sequence
  chemically synthesized
ggataaatatccaaaagtgaga

SEQ ID NO: 1182019 - DNA, 22 bp, Artificial Sequence
  chemically synthesized
tggataaatatccaaaagtgag

SEQ ID NO: 1182020 - DNA, 22 bp, Artificial Sequence
  chemically synthesized
gatctagcaatctcacttttgg

SEQ ID NO: 1182021 - DNA, 22 bp, Artificial Sequence
  chemically synthesized
ttggataaatatccaaaagtga

SEQ ID NO: 1182022 - DNA, 22 bp, Artificial Sequence
  chemically synthesized
atctagcaatctcacttttgga

SEQ ID NO: 1182023 - DNA, 22 bp, Artificial Sequence
  chemically synthesized
ttttggataaatatccaaaagt

SEQ ID NO: 1182024 - DNA, 22 bp, Artificial Sequence
  chemically synthesized
gcaatctcacttttggatattt

SEQ ID NO: 1182025 - DNA, 22 bp, Artificial Sequence
  chemically synthesized
aattcttttggataaatatcca

SEQ ID NO: 1182026 - DNA, 22 bp, Artificial Sequence
  chemically synthesized
caattcttttggataaatatcc

SEQ ID NO: 1182027 - DNA, 22 bp, Artificial Sequence
  chemically synthesized
atttcaattcttttggataaat

SEQ ID NO: 1182028 - DNA, 22 bp, Artificial Sequence
  chemically synthesized
acttttggatatttatccaaaa

SEQ ID NO: 1182029 - DNA, 22 bp, Artificial Sequence
  chemically synthesized
ttggatatttatccaaaagaat

SEQ ID NO: 1182030 - DNA, 22 bp, Artificial Sequence
  chemically synthesized
tggatatttatccaaaagaatt

SEQ ID NO: 1182031 - DNA, 22 bp, Artificial Sequence
  chemically synthesized
ggatatttatccaaaagaattg

SEQ ID NO: 1182032 - DNA, 22 bp, Artificial Sequence
  chemically synthesized
gatatttatccaaaagaattga

SEQ ID NO: 1182033 - DNA, 22 bp, Artificial Sequence
  chemically synthesized
aagatcctgatttcaattcttt

SEQ ID NO: 1182034 - DNA, 22 bp, Artificial Sequence
  chemically synthesized
caagatcctgatttcaattctt

SEQ ID NO: 1182035 - DNA, 22 bp, Artificial Sequence
  chemically synthesized
atccaaaagaattgaaatcagg

SEQ ID NO: 1182036 - DNA, 22 bp, Artificial Sequence
  chemically synthesized
tccaaaagaattgaaatcagga

SEQ ID NO: 1182037 - DNA, 22 bp, Artificial Sequence
  chemically synthesized
caggtatcccttcaagatcctg

SEQ ID NO: 1182038 - DNA, 22 bp, Artificial Sequence
  chemically synthesized
aaatcaggatcttgaagggata

SEQ ID NO: 1182039 - DNA, 22 bp, Artificial Sequence
  chemically synthesized
caatgaacatggcattgcaggt

SEQ ID NO: 1182040 - DNA, 22 bp, Artificial Sequence
  chemically synthesized
gaagggatacctgcaatgccat

SEQ ID NO: 1182041 - DNA, 22 bp, Artificial Sequence
  chemically synthesized
aagggatacctgcaatgccatg

SEQ ID NO: 1182042 - DNA, 22 bp, Artificial Sequence
  chemically synthesized
tgaatggtgttgcaatgaacat

SEQ ID NO: 1182043 - DNA, 22 bp, Artificial Sequence
  chemically synthesized
gtgaatggtgttgcaatgaaca

SEQ ID NO: 1182044 - DNA, 22 bp, Artificial Sequence
  chemically synthesized
ttgtgaatggtgttgcaatgaa

SEQ ID NO: 1182045 - DNA, 22 bp, Artificial Sequence
  chemically synthesized
caatgccatgttcattgcaaca

SEQ ID NO: 1182046 - DNA, 22 bp, Artificial Sequence
  chemically synthesized
gctcttgtgaatggtgttgcaa

SEQ ID NO: 1182047 - DNA, 22 bp, Artificial Sequence
  chemically synthesized
ggctcttgtgaatggtgttgca

SEQ ID NO: 1182048 - DNA, 22 bp, Artificial Sequence
  chemically synthesized
cacatcttggctcttgtgaatg

SEQ ID NO: 1182049 - DNA, 22 bp, Artificial Sequence
  chemically synthesized
ccacatcttggctcttgtgaat

SEQ ID NO: 1182050 - DNA, 22 bp, Artificial Sequence
  chemically synthesized
attgcaacaccattcacaagag

SEQ ID NO: 1182051 - DNA, 22 bp, Artificial Sequence
  chemically synthesized
caacaccattcacaagagccaa

SEQ ID NO: 1182052 - DNA, 22 bp, Artificial Sequence
  chemically synthesized
aggatgtttccacatcttggct

SEQ ID NO: 1182053 - DNA, 22 bp, Artificial Sequence
  chemically synthesized
acaagagccaagatgtggaaac

SEQ ID NO: 1182054 - DNA, 22 bp, Artificial Sequence
  chemically synthesized
atccatcagtggacactgagga

SEQ ID NO: 1182055 - DNA, 22 bp, Artificial Sequence
  chemically synthesized
tcccctcatccatcagtggaca

SEQ ID NO: 1182056 - DNA, 22 bp, Artificial Sequence
  chemically synthesized
atcccctcatccatcagtggac

SEQ ID NO: 1182057 - DNA, 22 bp, Artificial Sequence
  chemically synthesized
tatcccctcatccatcagtgga

SEQ ID NO: 1182058 - DNA, 22 bp, Artificial Sequence
  chemically synthesized
tttatcccctcatccatcagtg

SEQ ID NO: 1182059 - DNA, 22 bp, Artificial Sequence
  chemically synthesized
ctttatcccctcatccatcagt

SEQ ID NO: 1182060 - DNA, 22 bp, Artificial Sequence
  chemically synthesized
tctttatcccctcatccatcag

SEQ ID NO: 1182061 - DNA, 22 bp, Artificial Sequence
  chemically synthesized
agtgtccactgatggatgaggg

SEQ ID NO: 1182062 - DNA, 22 bp, Artificial Sequence
  chemically synthesized
atggatgaggggataaagaaaa

SEQ ID NO: 1182063 - DNA, 22 bp, Artificial Sequence
  chemically synthesized
tatgtatataccacattttctt

SEQ ID NO: 1182064 - DNA, 22 bp, Artificial Sequence
  chemically synthesized
gtatgtatataccacattttct

SEQ ID NO: 1182065 - DNA, 22 bp, Artificial Sequence
  chemically synthesized
ttgtatgtatataccacatttt

SEQ ID NO: 1182066 - DNA, 22 bp, Artificial Sequence
  chemically synthesized
atagtaatctcttgtatgtata

SEQ ID NO: 1182067 - DNA, 22 bp, Artificial Sequence
  chemically synthesized
aatattaatagtaatctcttgt

SEQ ID NO: 1182068 - DNA, 22 bp, Artificial Sequence
  chemically synthesized
gaatattaatagtaatctcttg

SEQ ID NO: 1182069 - DNA, 22 bp, Artificial Sequence
  chemically synthesized
tgaatattaatagtaatctctt

SEQ ID NO: 1182070 - DNA, 22 bp, Artificial Sequence
  chemically synthesized
ttgaatattaatagtaatctct

SEQ ID NO: 1182071 - DNA, 22 bp, Artificial Sequence
  chemically synthesized
tttgaatattaatagtaatctc

SEQ ID NO: 1182072 - DNA, 22 bp, Artificial Sequence
  chemically synthesized
tttttgaatattaatagtaatc

SEQ ID NO: 1182073 - DNA, 22 bp, Artificial Sequence
  chemically synthesized
ctttttgaatattaatagtaat

SEQ ID NO: 1182074 - DNA, 22 bp, Artificial Sequence
  chemically synthesized
tctttttgaatattaatagtaa

SEQ ID NO: 1182075 - DNA, 22 bp, Artificial Sequence
  chemically synthesized
tttctttttgaatattaatagt

SEQ ID NO: 1182076 - DNA, 22 bp, Artificial Sequence
  chemically synthesized
ctattaatattcaaaaagaaag

SEQ ID NO: 1182077 - DNA, 22 bp, Artificial Sequence
  chemically synthesized
atgtggcaggatctctttcttt

SEQ ID NO: 1182078 - DNA, 22 bp, Artificial Sequence
  chemically synthesized
ttaatattcaaaaagaaagaga

SEQ ID NO: 1182079 - DNA, 22 bp, Artificial Sequence
  chemically synthesized
ttaatgtggcaggatctctttc

SEQ ID NO: 1182080 - DNA, 22 bp, Artificial Sequence
  chemically synthesized
atattcaaaaagaaagagatcc

SEQ ID NO: 1182081 - DNA, 22 bp, Artificial Sequence
  chemically synthesized
aaaaagaaagagatcctgccac

SEQ ID NO: 1182082 - DNA, 22 bp, Artificial Sequence
  chemically synthesized
atccatgttgttaatgtggcag

SEQ ID NO: 1182083 - DNA, 22 bp, Artificial Sequence
  chemically synthesized
gggttcatccatgttgttaatg

SEQ ID NO: 1182084 - DNA, 22 bp, Artificial Sequence
  chemically synthesized
agggttcatccatgttgttaat

SEQ ID NO: 1182085 - DNA, 22 bp, Artificial Sequence
  chemically synthesized
ccacattaacaacatggatgaa

SEQ ID NO: 1182086 - DNA, 22 bp, Artificial Sequence
  chemically synthesized
ccataatgtccttagggttcat

SEQ ID NO: 1182087 - DNA, 22 bp, Artificial Sequence
  chemically synthesized
cccataatgtccttagggttca

SEQ ID NO: 1182088 - DNA, 22 bp, Artificial Sequence
  chemically synthesized
acaacatggatgaaccctaagg

SEQ ID NO: 1182089 - DNA, 22 bp, Artificial Sequence
  chemically synthesized
acttcccataatgtccttaggg

SEQ ID NO: 1182090 - DNA, 22 bp, Artificial Sequence
  chemically synthesized
cacttcccataatgtccttagg

SEQ ID NO: 1182091 - DNA, 22 bp, Artificial Sequence
  chemically synthesized
tttcacttcccataatgtcctt

SEQ ID NO: 1182092 - DNA, 22 bp, Artificial Sequence
  chemically synthesized
atttcacttcccataatgtcct

SEQ ID NO: 1182093 - DNA, 22 bp, Artificial Sequence
  chemically synthesized
tcttatttcacttcccataatg

SEQ ID NO: 1182094 - DNA, 22 bp, Artificial Sequence
  chemically synthesized
aggacattatgggaagtgaaat

SEQ ID NO: 1182095 - DNA, 22 bp, Artificial Sequence
  chemically synthesized
tgtgactgtcttatttcacttc

SEQ ID NO: 1182096 - DNA, 22 bp, Artificial Sequence
  chemically synthesized
atgtgactgtcttatttcactt

SEQ ID NO: 1182097 - DNA, 22 bp, Artificial Sequence
  chemically synthesized
tccttatgtgactgtcttattt

SEQ ID NO: 1182098 - DNA, 22 bp, Artificial Sequence
  chemically synthesized
gtccttatgtgactgtcttatt

SEQ ID NO: 1182099 - DNA, 22 bp, Artificial Sequence
  chemically synthesized
tgggaagtgaaataagacagtc

SEQ ID NO: 1182100 - DNA, 22 bp, Artificial Sequence
  chemically synthesized
taagtagaatcatggagtgttt

SEQ ID NO: 1182101 - DNA, 22 bp, Artificial Sequence
  chemically synthesized
ataagtagaatcatggagtgtt

SEQ ID NO: 1182102 - DNA, 22 bp, Artificial Sequence
  chemically synthesized
ttataagtagaatcatggagtg

SEQ ID NO: 1182103 - DNA, 22 bp, Artificial Sequence
  chemically synthesized
catacctcttataagtagaatc

SEQ ID NO: 1182104 - DNA, 22 bp, Artificial Sequence
  chemically synthesized
acatacctcttataagtagaat

SEQ ID NO: 1182105 - DNA, 22 bp, Artificial Sequence
  chemically synthesized
tacatacctcttataagtagaa

SEQ ID NO: 1182106 - DNA, 22 bp, Artificial Sequence
  chemically synthesized
catgattctacttataagaggt

SEQ ID NO: 1182107 - DNA, 22 bp, Artificial Sequence
  chemically synthesized
agtattttacatacctcttata

SEQ ID NO: 1182108 - DNA, 22 bp, Artificial Sequence
  chemically synthesized
gagtattttacatacctcttat

SEQ ID NO: 1182109 - DNA, 22 bp, Artificial Sequence
  chemically synthesized
tacttataagaggtatgtaaaa

SEQ ID NO: 1182110 - DNA, 22 bp, Artificial Sequence
  chemically synthesized
atcagcttgagtattttacata

SEQ ID NO: 1182111 - DNA, 22 bp, Artificial Sequence
  chemically synthesized
cttataagaggtatgtaaaata

SEQ ID NO: 1182112 - DNA, 22 bp, Artificial Sequence
  chemically synthesized
gatcagcttgagtattttacat

SEQ ID NO: 1182113 - DNA, 22 bp, Artificial Sequence
  chemically synthesized
ataagaggtatgtaaaatactc

SEQ ID NO: 1182114 - DNA, 22 bp, Artificial Sequence
  chemically synthesized
taagaggtatgtaaaatactca

SEQ ID NO: 1182115 - DNA, 22 bp, Artificial Sequence
  chemically synthesized
atttgatcagcttgagtatttt

SEQ ID NO: 1182116 - DNA, 22 bp, Artificial Sequence
  chemically synthesized
tgatttgatcagcttgagtatt

SEQ ID NO: 1182117 - DNA, 22 bp, Artificial Sequence
  chemically synthesized
tctgatttgatcagcttgagta

SEQ ID NO: 1182118 - DNA, 22 bp, Artificial Sequence
  chemically synthesized
actctctgatttgatcagcttg

SEQ ID NO: 1182119 - DNA, 22 bp, Artificial Sequence
  chemically synthesized
cactctctgatttgatcagctt

SEQ ID NO: 1182120 - DNA, 22 bp, Artificial Sequence
  chemically synthesized
tttcactctctgatttgatcag

SEQ ID NO: 1182121 - DNA, 22 bp, Artificial Sequence
  chemically synthesized
ctatttcactctctgatttgat

SEQ ID NO: 1182122 - DNA, 22 bp, Artificial Sequence
  chemically synthesized
aagctgatcaaatcagagagtg

SEQ ID NO: 1182123 - DNA, 22 bp, Artificial Sequence
  chemically synthesized
gcaactactatttcactctctg

SEQ ID NO: 1182124 - DNA, 22 bp, Artificial Sequence
  chemically synthesized
tagcaactactatttcactctc

SEQ ID NO: 1182125 - DNA, 22 bp, Artificial Sequence
  chemically synthesized
atcaaatcagagagtgaaatag

SEQ ID NO: 1182126 - DNA, 22 bp, Artificial Sequence
  chemically synthesized
cacagcctctagcaactactat

SEQ ID NO: 1182127 - DNA, 22 bp, Artificial Sequence
  chemically synthesized
tccacagcctctagcaactact

SEQ ID NO: 1182128 - DNA, 22 bp, Artificial Sequence
  chemically synthesized
ctctccacagcctctagcaact

SEQ ID NO: 1182129 - DNA, 22 bp, Artificial Sequence
  chemically synthesized
ctcctctccacagcctctagca

SEQ ID NO: 1182130 - DNA, 22 bp, Artificial Sequence
  chemically synthesized
cctcctctccacagcctctagc

SEQ ID NO: 1182131 - DNA, 22 bp, Artificial Sequence
  chemically synthesized
ccacttcctcctctccacagcc

SEQ ID NO: 1182132 - DNA, 22 bp, Artificial Sequence
  chemically synthesized
cccacttcctcctctccacagc

SEQ ID NO: 1182133 - DNA, 22 bp, Artificial Sequence
  chemically synthesized
ctagaggctgtggagaggagga

SEQ ID NO: 1182134 - DNA, 22 bp, Artificial Sequence
  chemically synthesized
gcagcttcccacttcctcctct

SEQ ID NO: 1182135 - DNA, 22 bp, Artificial Sequence
  chemically synthesized
gaggctgtggagaggaggaagt

SEQ ID NO: 1182136 - DNA, 22 bp, Artificial Sequence
  chemically synthesized
attagcagcttcccacttcctc

SEQ ID NO: 1182137 - DNA, 22 bp, Artificial Sequence
  chemically synthesized
gttaattagcagcttcccactt

SEQ ID NO: 1182138 - DNA, 22 bp, Artificial Sequence
  chemically synthesized
tggagaggaggaagtgggaagc

SEQ ID NO: 1182139 - DNA, 22 bp, Artificial Sequence
  chemically synthesized
cgttaattagcagcttcccact

SEQ ID NO: 1182140 - DNA, 22 bp, Artificial Sequence
  chemically synthesized
aaccttcgttaattagcagctt

SEQ ID NO: 1182141 - DNA, 22 bp, Artificial Sequence
  chemically synthesized
atagctgaaccttcgttaatta

SEQ ID NO: 1182142 - DNA, 22 bp, Artificial Sequence
  chemically synthesized
catagctgaaccttcgttaatt

SEQ ID NO: 1182143 - DNA, 22 bp, Artificial Sequence
  chemically synthesized
tcatagctgaaccttcgttaat

SEQ ID NO: 1182144 - DNA, 22 bp, Artificial Sequence
  chemically synthesized
atctttcatagctgaaccttcg

SEQ ID NO: 1182145 - DNA, 22 bp, Artificial Sequence
  chemically synthesized
tcatctttcatagctgaacctt

SEQ ID NO: 1182146 - DNA, 22 bp, Artificial Sequence
  chemically synthesized
ctcatctttcatagctgaacct

SEQ ID NO: 1182147 - DNA, 22 bp, Artificial Sequence
  chemically synthesized
ctaattaacgaaggttcagcta

SEQ ID NO: 1182148 - DNA, 22 bp, Artificial Sequence
  chemically synthesized
tctcatctttcatagctgaacc

SEQ ID NO: 1182149 - DNA, 22 bp, Artificial Sequence
  chemically synthesized
attaacgaaggttcagctatga

SEQ ID NO: 1182150 - DNA, 22 bp, Artificial Sequence
  chemically synthesized
acgaaggttcagctatgaaaga

SEQ ID NO: 1182151 - DNA, 22 bp, Artificial Sequence
  chemically synthesized
agaattttctcatctttcatag

SEQ ID NO: 1182152 - DNA, 22 bp, Artificial Sequence
  chemically synthesized
gagaattttctcatctttcata

SEQ ID NO: 1182153 - DNA, 22 bp, Artificial Sequence
  chemically synthesized
agctatgaaagatgagaaaatt

SEQ ID NO: 1182154 - DNA, 22 bp, Artificial Sequence
  chemically synthesized
tacaacagatcttgagaatttt

SEQ ID NO: 1182155 - DNA, 22 bp, Artificial Sequence
  chemically synthesized
tgaaagatgagaaaattctcaa

SEQ ID NO: 1182156 - DNA, 22 bp, Artificial Sequence
  chemically synthesized
agtataggtacaagttgtacaa

SEQ ID NO: 1182157 - DNA, 22 bp, Artificial Sequence
  chemically synthesized
tcaagatctgttgtacaacttg

SEQ ID NO: 1182158 - DNA, 22 bp, Artificial Sequence
  chemically synthesized
ttcagtataggtacaagttgta

SEQ ID NO: 1182159 - DNA, 22 bp, Artificial Sequence
  chemically synthesized
aagatctgttgtacaacttgta

SEQ ID NO: 1182160 - DNA, 22 bp, Artificial Sequence
  chemically synthesized
ttgtacaacttgtacctatact

SEQ ID NO: 1182161 - DNA, 22 bp, Artificial Sequence
  chemically synthesized
tacaacttgtacctatactgaa

SEQ ID NO: 1182162 - DNA, 22 bp, Artificial Sequence
  chemically synthesized
agtgtaaaatacagcattgttc

SEQ ID NO: 1182163 - DNA, 22 bp, Artificial Sequence
  chemically synthesized
gtacctatactgaacaatgctg

SEQ ID NO: 1182164 - DNA, 22 bp, Artificial Sequence
  chemically synthesized
aagtgtaaaatacagcattgtt

SEQ ID NO: 1182165 - DNA, 22 bp, Artificial Sequence
  chemically synthesized
tacctatactgaacaatgctgt

SEQ ID NO: 1182166 - DNA, 22 bp, Artificial Sequence
  chemically synthesized
taagtgtaaaatacagcattgt

SEQ ID NO: 1182167 - DNA, 22 bp, Artificial Sequence
  chemically synthesized
ttaagtgtaaaatacagcattg

SEQ ID NO: 1182168 - DNA, 22 bp, Artificial Sequence
  chemically synthesized
atttttaagtgtaaaatacagc

SEQ ID NO: 1182169 - DNA, 22 bp, Artificial Sequence
  chemically synthesized
tactgaacaatgctgtatttta

SEQ ID NO: 1182170 - DNA, 22 bp, Artificial Sequence
  chemically synthesized
actgatttttaagtgtaaaata

SEQ ID NO: 1182171 - DNA, 22 bp, Artificial Sequence
  chemically synthesized
aactgatttttaagtgtaaaat

SEQ ID NO: 1182172 - DNA, 22 bp, Artificial Sequence
  chemically synthesized
aacaatgctgtattttacactt

SEQ ID NO: 1182173 - DNA, 22 bp, Artificial Sequence
  chemically synthesized
ttaactgatttttaagtgtaaa

SEQ ID NO: 1182174 - DNA, 22 bp, Artificial Sequence
  chemically synthesized
accctcttaactgatttttaag

SEQ ID NO: 1182175 - DNA, 22 bp, Artificial Sequence
  chemically synthesized
tattttacacttaaaaatcagt

SEQ ID NO: 1182176 - DNA, 22 bp, Artificial Sequence
  chemically synthesized
tacacttaaaaatcagttaaga

SEQ ID NO: 1182177 - DNA, 22 bp, Artificial Sequence
  chemically synthesized
acacttaaaaatcagttaagag

SEQ ID NO: 1182178 - DNA, 22 bp, Artificial Sequence
  chemically synthesized
cacttaaaaatcagttaagagg

SEQ ID NO: 1182179 - DNA, 22 bp, Artificial Sequence
  chemically synthesized
acatgggattcaccctcttaac

SEQ ID NO: 1182180 - DNA, 22 bp, Artificial Sequence
  chemically synthesized
aacatgggattcaccctcttaa

SEQ ID NO: 1182181 - DNA, 22 bp, Artificial Sequence
  chemically synthesized
aaaaatcagttaagagggtgaa

SEQ ID NO: 1182182 - DNA, 22 bp, Artificial Sequence
  chemically synthesized
aaaatcagttaagagggtgaat

SEQ ID NO: 1182183 - DNA, 22 bp, Artificial Sequence
  chemically synthesized
agagggtgaatcccatgttaag

SEQ ID NO: 1182184 - DNA, 22 bp, Artificial Sequence
  chemically synthesized
tgtgtaagaacacttaacatgg

SEQ ID NO: 1182185 - DNA, 22 bp, Artificial Sequence
  chemically synthesized
ttgtgtgtaagaacacttaaca

SEQ ID NO: 1182186 - DNA, 22 bp, Artificial Sequence
  chemically synthesized
attgtgtgtaagaacacttaac

SEQ ID NO: 1182187 - DNA, 22 bp, Artificial Sequence
  chemically synthesized
tattgtgtgtaagaacacttaa

SEQ ID NO: 1182188 - DNA, 22 bp, Artificial Sequence
  chemically synthesized
ctttattgtgtgtaagaacact

SEQ ID NO: 1182189 - DNA, 22 bp, Artificial Sequence
  chemically synthesized
actttattgtgtgtaagaacac

SEQ ID NO: 1182190 - DNA, 22 bp, Artificial Sequence
  chemically synthesized
aaatttactttattgtgtgtaa

SEQ ID NO: 1182191 - DNA, 22 bp, Artificial Sequence
  chemically synthesized
gaaatttactttattgtgtgta

SEQ ID NO: 1182192 - DNA, 22 bp, Artificial Sequence
  chemically synthesized
tgaaatttactttattgtgtgt

SEQ ID NO: 1182193 - DNA, 22 bp, Artificial Sequence
  chemically synthesized
ttgaaatttactttattgtgtg

SEQ ID NO: 1182194 - DNA, 22 bp, Artificial Sequence
  chemically synthesized
agtgttcttacacacaataaag

SEQ ID NO: 1182195 - DNA, 22 bp, Artificial Sequence
  chemically synthesized
ttttgaaatttactttattgtg

SEQ ID NO: 1182196 - DNA, 22 bp, Artificial Sequence
  chemically synthesized
cttttgaaatttactttattgt

SEQ ID NO: 1182197 - DNA, 22 bp, Artificial Sequence
  chemically synthesized
acttcttttgaaatttacttta

SEQ ID NO: 1182198 - DNA, 22 bp, Artificial Sequence
  chemically synthesized
aacttcttttgaaatttacttt

SEQ ID NO: 1182199 - DNA, 22 bp, Artificial Sequence
  chemically synthesized
ttacacacaataaagtaaattt

SEQ ID NO: 1182200 - DNA, 22 bp, Artificial Sequence
  chemically synthesized
acacacaataaagtaaatttca

SEQ ID NO: 1182201 - DNA, 22 bp, Artificial Sequence
  chemically synthesized
cacacaataaagtaaatttcaa

SEQ ID NO: 1182202 - DNA, 22 bp, Artificial Sequence
  chemically synthesized
tcgtttaacttcttttgaaatt

SEQ ID NO: 1182203 - DNA, 22 bp, Artificial Sequence
  chemically synthesized
atcgtttaacttcttttgaaat

SEQ ID NO: 1182204 - DNA, 22 bp, Artificial Sequence
  chemically synthesized
ttatcgtttaacttcttttgaa

SEQ ID NO: 1182205 - DNA, 22 bp, Artificial Sequence
  chemically synthesized
cactcttatcgtttaacttctt

SEQ ID NO: 1182206 - DNA, 22 bp, Artificial Sequence
  chemically synthesized
aacagttacactcttatcgttt

SEQ ID NO: 1182207 - DNA, 22 bp, Artificial Sequence
  chemically synthesized
caaaagaagttaaacgataaga

SEQ ID NO: 1182208 - DNA, 22 bp, Artificial Sequence
  chemically synthesized
caacagttacactcttatcgtt

SEQ ID NO: 1182209 - DNA, 22 bp, Artificial Sequence
  chemically synthesized
aaaagaagttaaacgataagag

SEQ ID NO: 1182210 - DNA, 22 bp, Artificial Sequence
  chemically synthesized
tcaacagttacactcttatcgt

SEQ ID NO: 1182211 - DNA, 22 bp, Artificial Sequence
  chemically synthesized
ttttcaacagttacactcttat

SEQ ID NO: 1182212 - DNA, 22 bp, Artificial Sequence
  chemically synthesized
aacgataagagtgtaactgttg

SEQ ID NO: 1182213 - DNA, 22 bp, Artificial Sequence
  chemically synthesized
aagtgaatatatgtgatgatgt

SEQ ID NO: 1182214 - DNA, 22 bp, Artificial Sequence
  chemically synthesized
gaagtgaatatatgtgatgatg

SEQ ID NO: 1182215 - DNA, 22 bp, Artificial Sequence
  chemically synthesized
ttgaaaataacatcatcacata

SEQ ID NO: 1182216 - DNA, 22 bp, Artificial Sequence
  chemically synthesized
aaaataacatcatcacatatat

SEQ ID NO: 1182217 - DNA, 22 bp, Artificial Sequence
  chemically synthesized
gaaggaaccttgaagtgaatat

SEQ ID NO: 1182218 - DNA, 22 bp, Artificial Sequence
  chemically synthesized
aaactggaaggaaccttgaagt

SEQ ID NO: 1182219 - DNA, 22 bp, Artificial Sequence
  chemically synthesized
aaaactggaaggaaccttgaag

SEQ ID NO: 1182220 - DNA, 22 bp, Artificial Sequence
  chemically synthesized
taaaactggaaggaaccttgaa

SEQ ID NO: 1182221 - DNA, 22 bp, Artificial Sequence
  chemically synthesized
acttcaaggttccttccagttt

SEQ ID NO: 1182222 - DNA, 22 bp, Artificial Sequence
  chemically synthesized
agtagaattttaaaactggaag

SEQ ID NO: 1182223 - DNA, 22 bp, Artificial Sequence
  chemically synthesized
tgagtagaattttaaaactgga

SEQ ID NO: 1182224 - DNA, 22 bp, Artificial Sequence
  chemically synthesized
ctgagtagaattttaaaactgg

SEQ ID NO: 1182225 - DNA, 22 bp, Artificial Sequence
  chemically synthesized
caaggttccttccagttttaaa

SEQ ID NO: 1182226 - DNA, 22 bp, Artificial Sequence
  chemically synthesized
aaggttccttccagttttaaaa

SEQ ID NO: 1182227 - DNA, 22 bp, Artificial Sequence
  chemically synthesized
aagacttctgagtagaatttta

SEQ ID NO: 1182228 - DNA, 22 bp, Artificial Sequence
  chemically synthesized
cttccagttttaaaattctact

SEQ ID NO: 1182229 - DNA, 22 bp, Artificial Sequence
  chemically synthesized
ccagttttaaaattctactcag

SEQ ID NO: 1182230 - DNA, 22 bp, Artificial Sequence
  chemically synthesized
cagttttaaaattctactcaga

SEQ ID NO: 1182231 - DNA, 22 bp, Artificial Sequence
  chemically synthesized
gtacactgaagacttctgagta

SEQ ID NO: 1182232 - DNA, 22 bp, Artificial Sequence
  chemically synthesized
taaaattctactcagaagtctt

SEQ ID NO: 1182233 - DNA, 22 bp, Artificial Sequence
  chemically synthesized
aaaattctactcagaagtcttc

SEQ ID NO: 1182234 - DNA, 22 bp, Artificial Sequence
  chemically synthesized
aaattctactcagaagtcttca

SEQ ID NO: 1182235 - DNA, 22 bp, Artificial Sequence
  chemically synthesized
taaattggtacactgaagactt

SEQ ID NO: 1182236 - DNA, 22 bp, Artificial Sequence
  chemically synthesized
tataaattggtacactgaagac

SEQ ID NO: 1182237 - DNA, 22 bp, Artificial Sequence
  chemically synthesized
tactcagaagtcttcagtgtac

SEQ ID NO: 1182238 - DNA, 22 bp, Artificial Sequence
  chemically synthesized
ctcagaagtcttcagtgtacca

SEQ ID NO: 1182239 - DNA, 22 bp, Artificial Sequence
  chemically synthesized
aactctataaattggtacactg

SEQ ID NO: 1182240 - DNA, 22 bp, Artificial Sequence
  chemically synthesized
agaagtcttcagtgtaccaatt

SEQ ID NO: 1182241 - DNA, 22 bp, Artificial Sequence
  chemically synthesized
gctcaactctataaattggtac

SEQ ID NO: 1182242 - DNA, 22 bp, Artificial Sequence
  chemically synthesized
agctcaactctataaattggta

SEQ ID NO: 1182243 - DNA, 22 bp, Artificial Sequence
  chemically synthesized
tagctcaactctataaattggt

SEQ ID NO: 1182244 - DNA, 22 bp, Artificial Sequence
  chemically synthesized
ggttttagctcaactctataaa

SEQ ID NO: 1182245 - DNA, 22 bp, Artificial Sequence
  chemically synthesized
cagtgtaccaatttatagagtt

SEQ ID NO: 1182246 - DNA, 22 bp, Artificial Sequence
  chemically synthesized
agtgtaccaatttatagagttg

SEQ ID NO: 1182247 - DNA, 22 bp, Artificial Sequence
  chemically synthesized
ttaggttttagctcaactctat

SEQ ID NO: 1182248 - DNA, 22 bp, Artificial Sequence
  chemically synthesized
atagagttgagctaaaacctaa

SEQ ID NO: 1182249 - DNA, 22 bp, Artificial Sequence
  chemically synthesized
tagagttgagctaaaacctaac

SEQ ID NO: 1182250 - DNA, 22 bp, Artificial Sequence
  chemically synthesized
cccagaaacagaattgttaggt

SEQ ID NO: 1182251 - DNA, 22 bp, Artificial Sequence
  chemically synthesized
agctaaaacctaacaattctgt

SEQ ID NO: 1182252 - DNA, 22 bp, Artificial Sequence
  chemically synthesized
aacaaattacccagaaacagaa

SEQ ID NO: 1182253 - DNA, 22 bp, Artificial Sequence
  chemically synthesized
aaacctaacaattctgtttctg

SEQ ID NO: 1182254 - DNA, 22 bp, Artificial Sequence
  chemically synthesized
acaattctgtttctgggtaatt

SEQ ID NO: 1182255 - DNA, 22 bp, Artificial Sequence
  chemically synthesized
atgtgactgaacaaattaccca

SEQ ID NO: 1182256 - DNA, 22 bp, Artificial Sequence
  chemically synthesized
tgtttctgggtaatttgttcag

SEQ ID NO: 1182257 - DNA, 22 bp, Artificial Sequence
  chemically synthesized
tttctgggtaatttgttcagtc

SEQ ID NO: 1182258 - DNA, 22 bp, Artificial Sequence
  chemically synthesized
tacatcctgatgtgactgaaca

SEQ ID NO: 1182259 - DNA, 22 bp, Artificial Sequence
  chemically synthesized
atacatcctgatgtgactgaac

SEQ ID NO: 1182260 - DNA, 22 bp, Artificial Sequence
  chemically synthesized
ctgggtaatttgttcagtcaca

SEQ ID NO: 1182261 - DNA, 22 bp, Artificial Sequence
  chemically synthesized
tatacatcctgatgtgactgaa

SEQ ID NO: 1182262 - DNA, 22 bp, Artificial Sequence
  chemically synthesized
tgggtaatttgttcagtcacat

SEQ ID NO: 1182263 - DNA, 22 bp, Artificial Sequence
  chemically synthesized
ggtaatttgttcagtcacatca

SEQ ID NO: 1182264 - DNA, 22 bp, Artificial Sequence
  chemically synthesized
gttcagtcacatcaggatgtat

SEQ ID NO: 1182265 - DNA, 22 bp, Artificial Sequence
  chemically synthesized
gaggaagcctttatacatcctg

SEQ ID NO: 1182266 - DNA, 22 bp, Artificial Sequence
  chemically synthesized
ttcagtcacatcaggatgtata

SEQ ID NO: 1182267 - DNA, 22 bp, Artificial Sequence
  chemically synthesized
cgaggaagcctttatacatcct

SEQ ID NO: 1182268 - DNA, 22 bp, Artificial Sequence
  chemically synthesized
agtcacatcaggatgtataaag

SEQ ID NO: 1182269 - DNA, 22 bp, Artificial Sequence
  chemically synthesized
cttcgaggaagcctttatacat

SEQ ID NO: 1182270 - DNA, 22 bp, Artificial Sequence
  chemically synthesized
gcttcgaggaagcctttataca

SEQ ID NO: 1182271 - DNA, 22 bp, Artificial Sequence
  chemically synthesized
atttgcttcgaggaagccttta

SEQ ID NO: 1182272 - DNA, 22 bp, Artificial Sequence
  chemically synthesized
aaagtatcactaatttgcttcg

SEQ ID NO: 1182273 - DNA, 22 bp, Artificial Sequence
  chemically synthesized
gattaaaagtatcactaatttg

SEQ ID NO: 1182274 - DNA, 22 bp, Artificial Sequence
  chemically synthesized
agattaaaagtatcactaattt

SEQ ID NO: 1182275 - DNA, 22 bp, Artificial Sequence
  chemically synthesized
cctcgaagcaaattagtgatac

SEQ ID NO: 1182276 - DNA, 22 bp, Artificial Sequence
  chemically synthesized
cttagattaaaagtatcactaa

SEQ ID NO: 1182277 - DNA, 22 bp, Artificial Sequence
  chemically synthesized
ctcgaagcaaattagtgatact

SEQ ID NO: 1182278 - DNA, 22 bp, Artificial Sequence
  chemically synthesized
gaagcaaattagtgatactttt

SEQ ID NO: 1182279 - DNA, 22 bp, Artificial Sequence
  chemically synthesized
gtgatacttttaatctaaggag

SEQ ID NO: 1182280 - DNA, 22 bp, Artificial Sequence
  chemically synthesized
ttaatctaaggagtggtctccc

SEQ ID NO: 1182281 - DNA, 22 bp, Artificial Sequence
  chemically synthesized
taatctaaggagtggtctccct

SEQ ID NO: 1182282 - DNA, 22 bp, Artificial Sequence
  chemically synthesized
aatctaaggagtggtctccctg

SEQ ID NO: 1182283 - DNA, 22 bp, Artificial Sequence
  chemically synthesized
atctaaggagtggtctccctgg

SEQ ID NO: 1182284 - DNA, 22 bp, Artificial Sequence
  chemically synthesized
aggagtggtctccctggctggc

SEQ ID NO: 1182285 - DNA, 22 bp, Artificial Sequence
  chemically synthesized
gcaaacagaggatgggaagcca

SEQ ID NO: 1182286 - DNA, 22 bp, Artificial Sequence
  chemically synthesized
cctggctggcttcccatcctct

SEQ ID NO: 1182287 - DNA, 22 bp, Artificial Sequence
  chemically synthesized
gctggcttcccatcctctgttt

SEQ ID NO: 1182288 - DNA, 22 bp, Artificial Sequence
  chemically synthesized
tagaaagtaattggcaaacaga

SEQ ID NO: 1182289 - DNA, 22 bp, Artificial Sequence
  chemically synthesized
gcttcccatcctctgtttgcca

SEQ ID NO: 1182290 - DNA, 22 bp, Artificial Sequence
  chemically synthesized
cccatcctctgtttgccaatta

SEQ ID NO: 1182291 - DNA, 22 bp, Artificial Sequence
  chemically synthesized
ccatcctctgtttgccaattac

SEQ ID NO: 1182292 - DNA, 22 bp, Artificial Sequence
  chemically synthesized
tccacatattgtagaaagtaat

SEQ ID NO: 1182293 - DNA, 22 bp, Artificial Sequence
  chemically synthesized
tgtttgccaattactttctaca

SEQ ID NO: 1182294 - DNA, 22 bp, Artificial Sequence
  chemically synthesized
tttgccaattactttctacaat

SEQ ID NO: 1182295 - DNA, 22 bp, Artificial Sequence
  chemically synthesized
agactgtccacatattgtagaa

SEQ ID NO: 1182296 - DNA, 22 bp, Artificial Sequence
  chemically synthesized
gccaattactttctacaatatg

SEQ ID NO: 1182297 - DNA, 22 bp, Artificial Sequence
  chemically synthesized
ccaattactttctacaatatgt

SEQ ID NO: 1182298 - DNA, 22 bp, Artificial Sequence
  chemically synthesized
tccctcagactgtccacatatt

SEQ ID NO: 1182299 - DNA, 22 bp, Artificial Sequence
  chemically synthesized
gtccctcagactgtccacatat

SEQ ID NO: 1182300 - DNA, 22 bp, Artificial Sequence
  chemically synthesized
ctttctacaatatgtggacagt

SEQ ID NO: 1182301 - DNA, 22 bp, Artificial Sequence
  chemically synthesized
tctacaatatgtggacagtctg

SEQ ID NO: 1182302 - DNA, 22 bp, Artificial Sequence
  chemically synthesized
ctacaatatgtggacagtctga

SEQ ID NO: 1182303 - DNA, 22 bp, Artificial Sequence
  chemically synthesized
tacaatatgtggacagtctgag

SEQ ID NO: 1182304 - DNA, 22 bp, Artificial Sequence
  chemically synthesized
gcacaacttgtccctcagactg

SEQ ID NO: 1182305 - DNA, 22 bp, Artificial Sequence
  chemically synthesized
caatatgtggacagtctgaggg

SEQ ID NO: 1182306 - DNA, 22 bp, Artificial Sequence
  chemically synthesized
ctggcacaacttgtccctcaga

SEQ ID NO: 1182307 - DNA, 22 bp, Artificial Sequence
  chemically synthesized
ccccctcctggcacaacttgtc

SEQ ID NO: 1182308 - DNA, 22 bp, Artificial Sequence
  chemically synthesized
gccccctcctggcacaacttgt

SEQ ID NO: 1182309 - DNA, 22 bp, Artificial Sequence
  chemically synthesized
tgccccctcctggcacaacttg

SEQ ID NO: 1182310 - DNA, 22 bp, Artificial Sequence
  chemically synthesized
cctttgccccctcctggcacaa

SEQ ID NO: 1182311 - DNA, 22 bp, Artificial Sequence
  chemically synthesized
tgcctttgccccctcctggcac

SEQ ID NO: 1182312 - DNA, 22 bp, Artificial Sequence
  chemically synthesized
agggacaagttgtgccaggagg

SEQ ID NO: 1182313 - DNA, 22 bp, Artificial Sequence
  chemically synthesized
tctctgcctttgccccctcctg

SEQ ID NO: 1182314 - DNA, 22 bp, Artificial Sequence
  chemically synthesized
tatctctgcctttgccccctcc

SEQ ID NO: 1182315 - DNA, 22 bp, Artificial Sequence
  chemically synthesized
actctatctctgcctttgcccc

SEQ ID NO: 1182316 - DNA, 22 bp, Artificial Sequence
  chemically synthesized
cactctatctctgcctttgccc

SEQ ID NO: 1182317 - DNA, 22 bp, Artificial Sequence
  chemically synthesized
tcactctatctctgcctttgcc

SEQ ID NO: 1182318 - DNA, 22 bp, Artificial Sequence
  chemically synthesized
tgccaggagggggcaaaggcag

SEQ ID NO: 1182319 - DNA, 22 bp, Artificial Sequence
  chemically synthesized
ttcactctatctctgcctttgc

SEQ ID NO: 1182320 - DNA, 22 bp, Artificial Sequence
  chemically synthesized
ggaggggatgaggcagaggaga

SEQ ID NO: 1182321 - DNA, 22 bp, Artificial Sequence
  chemically synthesized
tgttgggaggggatgaggcaga

SEQ ID NO: 1182322 - DNA, 22 bp, Artificial Sequence
  chemically synthesized
ctctgcctcatcccctcccaac

SEQ ID NO: 1182323 - DNA, 22 bp, Artificial Sequence
  chemically synthesized
tgcctcatcccctcccaacaca

SEQ ID NO: 1182324 - DNA, 22 bp, Artificial Sequence
  chemically synthesized
catccagcaatcctgtgttggg

SEQ ID NO: 1182325 - DNA, 22 bp, Artificial Sequence
  chemically synthesized
cctcatcccctcccaacacagg

SEQ ID NO: 1182326 - DNA, 22 bp, Artificial Sequence
  chemically synthesized
acatccagcaatcctgtgttgg

SEQ ID NO: 1182327 - DNA, 22 bp, Artificial Sequence
  chemically synthesized
tacatccagcaatcctgtgttg

SEQ ID NO: 1182328 - DNA, 22 bp, Artificial Sequence
  chemically synthesized
atcccctcccaacacaggattg

SEQ ID NO: 1182329 - DNA, 22 bp, Artificial Sequence
  chemically synthesized
ggtgattttacatccagcaatc

SEQ ID NO: 1182330 - DNA, 22 bp, Artificial Sequence
  chemically synthesized
tgggtgattttacatccagcaa

SEQ ID NO: 1182331 - DNA, 22 bp, Artificial Sequence
  chemically synthesized
ccaacacaggattgctggatgt

SEQ ID NO: 1182332 - DNA, 22 bp, Artificial Sequence
  chemically synthesized
ctgggtgattttacatccagca

SEQ ID NO: 1182333 - DNA, 22 bp, Artificial Sequence
  chemically synthesized
ctggatgtaaaatcacccagaa

SEQ ID NO: 1182334 - DNA, 22 bp, Artificial Sequence
  chemically synthesized
gatgtaaaatcacccagaagtg

SEQ ID NO: 1182335 - DNA, 22 bp, Artificial Sequence
  chemically synthesized
taaagcagaaaaagcacttctg

SEQ ID NO: 1182336 - DNA, 22 bp, Artificial Sequence
  chemically synthesized
ataaagcagaaaaagcacttct

SEQ ID NO: 1182337 - DNA, 22 bp, Artificial Sequence
  chemically synthesized
tataaagcagaaaaagcacttc

SEQ ID NO: 1182338 - DNA, 22 bp, Artificial Sequence
  chemically synthesized
ttataaagcagaaaaagcactt

SEQ ID NO: 1182339 - DNA, 22 bp, Artificial Sequence
  chemically synthesized
tttctgctttataaaaggcatt

SEQ ID NO: 1182340 - DNA, 22 bp, Artificial Sequence
  chemically synthesized
ttctgctttataaaaggcatta

SEQ ID NO: 1182341 - DNA, 22 bp, Artificial Sequence
  chemically synthesized
tctgctttataaaaggcattac

SEQ ID NO: 1182342 - DNA, 22 bp, Artificial Sequence
  chemically synthesized
ctgctttataaaaggcattact

SEQ ID NO: 1182343 - DNA, 22 bp, Artificial Sequence
  chemically synthesized
tgctttataaaaggcattacta

SEQ ID NO: 1182344 - DNA, 22 bp, Artificial Sequence
  chemically synthesized
ctttataaaaggcattactatg

SEQ ID NO: 1182345 - DNA, 22 bp, Artificial Sequence
  chemically synthesized
tataaaaggcattactatgttc

SEQ ID NO: 1182346 - DNA, 22 bp, Artificial Sequence
  chemically synthesized
ataaaaggcattactatgttct

SEQ ID NO: 1182347 - DNA, 22 bp, Artificial Sequence
  chemically synthesized
taaaaggcattactatgttctg

SEQ ID NO: 1182348 - DNA, 22 bp, Artificial Sequence
  chemically synthesized
gaaccatgcagagcagaacata

SEQ ID NO: 1182349 - DNA, 22 bp, Artificial Sequence
  chemically synthesized
ggaaccatgcagagcagaacat

SEQ ID NO: 1182350 - DNA, 22 bp, Artificial Sequence
  chemically synthesized
ctatgttctgctctgcatggtt

SEQ ID NO: 1182351 - DNA, 22 bp, Artificial Sequence
  chemically synthesized
aggaacaatcttggaaccatgc

SEQ ID NO: 1182352 - DNA, 22 bp, Artificial Sequence
  chemically synthesized
tgttctgctctgcatggttcca

SEQ ID NO: 1182353 - DNA, 22 bp, Artificial Sequence
  chemically synthesized
ctgaggaacaatcttggaacca

SEQ ID NO: 1182354 - DNA, 22 bp, Artificial Sequence
  chemically synthesized
tgctctgcatggttccaagatt

SEQ ID NO: 1182355 - DNA, 22 bp, Artificial Sequence
  chemically synthesized
ctctgcatggttccaagattgt

SEQ ID NO: 1182356 - DNA, 22 bp, Artificial Sequence
  chemically synthesized
aggttgctgaggaacaatcttg

SEQ ID NO: 1182357 - DNA, 22 bp, Artificial Sequence
  chemically synthesized
tgcatggttccaagattgttcc

SEQ ID NO: 1182358 - DNA, 22 bp, Artificial Sequence
  chemically synthesized
tgaggttgctgaggaacaatct

SEQ ID NO: 1182359 - DNA, 22 bp, Artificial Sequence
  chemically synthesized
catggttccaagattgttcctc

SEQ ID NO: 1182360 - DNA, 22 bp, Artificial Sequence
  chemically synthesized
ttctgaggttgctgaggaacaa

SEQ ID NO: 1182361 - DNA, 22 bp, Artificial Sequence
  chemically synthesized
gttctgaggttgctgaggaaca

SEQ ID NO: 1182362 - DNA, 22 bp, Artificial Sequence
  chemically synthesized
tgttctgaggttgctgaggaac

SEQ ID NO: 1182363 - DNA, 22 bp, Artificial Sequence
  chemically synthesized
ttgttctgaggttgctgaggaa

SEQ ID NO: 1182364 - DNA, 22 bp, Artificial Sequence
  chemically synthesized
tttgttctgaggttgctgagga

SEQ ID NO: 1182365 - DNA, 22 bp, Artificial Sequence
  chemically synthesized
ttttgttctgaggttgctgagg

SEQ ID NO: 1182366 - DNA, 22 bp, Artificial Sequence
  chemically synthesized
caagattgttcctcagcaacct

SEQ ID NO: 1182367 - DNA, 22 bp, Artificial Sequence
  chemically synthesized
ttcctcagcaacctcagaacaa

SEQ ID NO: 1182368 - DNA, 22 bp, Artificial Sequence
  chemically synthesized
ctcagcaacctcagaacaaaaa

SEQ ID NO: 1182369 - DNA, 22 bp, Artificial Sequence
  chemically synthesized
agcaacctcagaacaaaaaagg

SEQ ID NO: 1182370 - DNA, 22 bp, Artificial Sequence
  chemically synthesized
aggaaaaggatatccttttttg

SEQ ID NO: 1182371 - DNA, 22 bp, Artificial Sequence
  chemically synthesized
taaggaaaaggatatccttttt

SEQ ID NO: 1182372 - DNA, 22 bp, Artificial Sequence
  chemically synthesized
agaacaaaaaaggatatccttt

SEQ ID NO: 1182373 - DNA, 22 bp, Artificial Sequence
  chemically synthesized
atataccgagtaaaagattcta

SEQ ID NO: 1182374 - DNA, 22 bp, Artificial Sequence
  chemically synthesized
ttccttagaatcttttactcgg

SEQ ID NO: 1182375 - DNA, 22 bp, Artificial Sequence
  chemically synthesized
tccttagaatcttttactcggt

SEQ ID NO: 1182376 - DNA, 22 bp, Artificial Sequence
  chemically synthesized
ccttagaatcttttactcggta

SEQ ID NO: 1182377 - DNA, 22 bp, Artificial Sequence
  chemically synthesized
ggcaagttaatataccgagtaa

SEQ ID NO: 1182378 - DNA, 22 bp, Artificial Sequence
  chemically synthesized
cttagaatcttttactcggtat

SEQ ID NO: 1182379 - DNA, 22 bp, Artificial Sequence
  chemically synthesized
agaatcttttactcggtatatt

SEQ ID NO: 1182380 - DNA, 22 bp, Artificial Sequence
  chemically synthesized
gaatcttttactcggtatatta

SEQ ID NO: 1182381 - DNA, 22 bp, Artificial Sequence
  chemically synthesized
tatagagttcggcaagttaata

SEQ ID NO: 1182382 - DNA, 22 bp, Artificial Sequence
  chemically synthesized
ttactcggtatattaacttgcc

SEQ ID NO: 1182383 - DNA, 22 bp, Artificial Sequence
  chemically synthesized
tactcggtatattaacttgccg

SEQ ID NO: 1182384 - DNA, 22 bp, Artificial Sequence
  chemically synthesized
actcggtatattaacttgccga

SEQ ID NO: 1182385 - DNA, 22 bp, Artificial Sequence
  chemically synthesized
ctcggtatattaacttgccgaa

SEQ ID NO: 1182386 - DNA, 22 bp, Artificial Sequence
  chemically synthesized
ggtatattaacttgccgaactc

SEQ ID NO: 1182387 - DNA, 22 bp, Artificial Sequence
  chemically synthesized
acaacctgtatagagttcggca

SEQ ID NO: 1182388 - DNA, 22 bp, Artificial Sequence
  chemically synthesized
acttgccgaactctatacaggt

SEQ ID NO: 1182389 - DNA, 22 bp, Artificial Sequence
  chemically synthesized
taaacaaactcacaacctgtat

SEQ ID NO: 1182390 - DNA, 22 bp, Artificial Sequence
  chemically synthesized
ataaacaaactcacaacctgta

SEQ ID NO: 1182391 - DNA, 22 bp, Artificial Sequence
  chemically synthesized
gccgaactctatacaggttgtg

SEQ ID NO: 1182392 - DNA, 22 bp, Artificial Sequence
  chemically synthesized
ccgaactctatacaggttgtga

SEQ ID NO: 1182393 - DNA, 22 bp, Artificial Sequence
  chemically synthesized
atttataaacaaactcacaacc

SEQ ID NO: 1182394 - DNA, 22 bp, Artificial Sequence
  chemically synthesized
tgatttataaacaaactcacaa

SEQ ID NO: 1182395 - DNA, 22 bp, Artificial Sequence
  chemically synthesized
tatacaggttgtgagtttgttt

SEQ ID NO: 1182396 - DNA, 22 bp, Artificial Sequence
  chemically synthesized
gattctgatttataaacaaact

SEQ ID NO: 1182397 - DNA, 22 bp, Artificial Sequence
  chemically synthesized
tacaggttgtgagtttgtttat

SEQ ID NO: 1182398 - DNA, 22 bp, Artificial Sequence
  chemically synthesized
tgagtttgtttataaatcagaa

SEQ ID NO: 1182399 - DNA, 22 bp, Artificial Sequence
  chemically synthesized
gtttataaatcagaatccaggc

SEQ ID NO: 1182400 - DNA, 22 bp, Artificial Sequence
  chemically synthesized
tgagaagagatagcctggattc

SEQ ID NO: 1182401 - DNA, 22 bp, Artificial Sequence
  chemically synthesized
tttataaatcagaatccaggct

SEQ ID NO: 1182402 - DNA, 22 bp, Artificial Sequence
  chemically synthesized
atgagaagagatagcctggatt

SEQ ID NO: 1182403 - DNA, 22 bp, Artificial Sequence
  chemically synthesized
tatgagaagagatagcctggat

SEQ ID NO: 1182404 - DNA, 22 bp, Artificial Sequence
  chemically synthesized
ttatgagaagagatagcctgga

SEQ ID NO: 1182405 - DNA, 22 bp, Artificial Sequence
  chemically synthesized
ataaatcagaatccaggctatc

SEQ ID NO: 1182406 - DNA, 22 bp, Artificial Sequence
  chemically synthesized
taaatcagaatccaggctatct

SEQ ID NO: 1182407 - DNA, 22 bp, Artificial Sequence
  chemically synthesized
gcacttttatgagaagagatag

SEQ ID NO: 1182408 - DNA, 22 bp, Artificial Sequence
  chemically synthesized
ttagcacttttatgagaagaga

SEQ ID NO: 1182409 - DNA, 22 bp, Artificial Sequence
  chemically synthesized
attagcacttttatgagaagag

SEQ ID NO: 1182410 - DNA, 22 bp, Artificial Sequence
  chemically synthesized
tattagcacttttatgagaaga

SEQ ID NO: 1182411 - DNA, 22 bp, Artificial Sequence
  chemically synthesized
ttattagcacttttatgagaag

SEQ ID NO: 1182412 - DNA, 22 bp, Artificial Sequence
  chemically synthesized
tgtttttattagcacttttatg

SEQ ID NO: 1182413 - DNA, 22 bp, Artificial Sequence
  chemically synthesized
atgtttttattagcacttttat

SEQ ID NO: 1182414 - DNA, 22 bp, Artificial Sequence
  chemically synthesized
tatgtttttattagcactttta

SEQ ID NO: 1182415 - DNA, 22 bp, Artificial Sequence
  chemically synthesized
ttatgtttttattagcactttt

SEQ ID NO: 1182416 - DNA, 22 bp, Artificial Sequence
  chemically synthesized
tctcttctcataaaagtgctaa

SEQ ID NO: 1182417 - DNA, 22 bp, Artificial Sequence
  chemically synthesized
ttctcataaaagtgctaataaa

SEQ ID NO: 1182418 - DNA, 22 bp, Artificial Sequence
  chemically synthesized
ctcataaaagtgctaataaaaa

SEQ ID NO: 1182419 - DNA, 22 bp, Artificial Sequence
  chemically synthesized
tcataaaagtgctaataaaaac

SEQ ID NO: 1182420 - DNA, 22 bp, Artificial Sequence
  chemically synthesized
agaaaatttttatgtttttatt

SEQ ID NO: 1182421 - DNA, 22 bp, Artificial Sequence
  chemically synthesized
ataaaagtgctaataaaaacat

SEQ ID NO: 1182422 - DNA, 22 bp, Artificial Sequence
  chemically synthesized
atctgagaaaatttttatgttt

SEQ ID NO: 1182423 - DNA, 22 bp, Artificial Sequence
  chemically synthesized
tggtctgatctgagaaaatttt

SEQ ID NO: 1182424 - DNA, 22 bp, Artificial Sequence
  chemically synthesized
ataaaaacataaaaattttctc

SEQ ID NO: 1182425 - DNA, 22 bp, Artificial Sequence
  chemically synthesized
gtggtctgatctgagaaaattt

SEQ ID NO: 1182426 - DNA, 22 bp, Artificial Sequence
  chemically synthesized
tgtggtctgatctgagaaaatt

SEQ ID NO: 1182427 - DNA, 22 bp, Artificial Sequence
  chemically synthesized
gataagattttgtggtctgatc

SEQ ID NO: 1182428 - DNA, 22 bp, Artificial Sequence
  chemically synthesized
tctcagatcagaccacaaaatc

SEQ ID NO: 1182429 - DNA, 22 bp, Artificial Sequence
  chemically synthesized
ctcagatcagaccacaaaatct

SEQ ID NO: 1182430 - DNA, 22 bp, Artificial Sequence
  chemically synthesized
tcagatcagaccacaaaatctt

SEQ ID NO: 1182431 - DNA, 22 bp, Artificial Sequence
  chemically synthesized
agatcagaccacaaaatcttat

SEQ ID NO: 1182432 - DNA, 22 bp, Artificial Sequence
  chemically synthesized
gatacatcaggggttagataag

SEQ ID NO: 1182433 - DNA, 22 bp, Artificial Sequence
  chemically synthesized
agatacatcaggggttagataa

SEQ ID NO: 1182434 - DNA, 22 bp, Artificial Sequence
  chemically synthesized
tagatacatcaggggttagata

SEQ ID NO: 1182435 - DNA, 22 bp, Artificial Sequence
  chemically synthesized
ctttagatacatcaggggttag

SEQ ID NO: 1182436 - DNA, 22 bp, Artificial Sequence
  chemically synthesized
ctactttagatacatcaggggt

SEQ ID NO: 1182437 - DNA, 22 bp, Artificial Sequence
  chemically synthesized
atctaacccctgatgtatctaa

SEQ ID NO: 1182438 - DNA, 22 bp, Artificial Sequence
  chemically synthesized
tctaacccctgatgtatctaaa

SEQ ID NO: 1182439 - DNA, 22 bp, Artificial Sequence
  chemically synthesized
acccctgatgtatctaaagtag

SEQ ID NO: 1182440 - DNA, 22 bp, Artificial Sequence
  chemically synthesized
atgtatctaaagtagtaatcat

SEQ ID NO: 1182441 - DNA, 22 bp, Artificial Sequence
  chemically synthesized
aaaacccggcaaccaatatgat

SEQ ID NO: 1182442 - DNA, 22 bp, Artificial Sequence
  chemically synthesized
tcaaaacccggcaaccaatatg

SEQ ID NO: 1182443 - DNA, 22 bp, Artificial Sequence
  chemically synthesized
aagtagtaatcatattggttgc

SEQ ID NO: 1182444 - DNA, 22 bp, Artificial Sequence
  chemically synthesized
taagttctcaaaacccggcaac

SEQ ID NO: 1182445 - DNA, 22 bp, Artificial Sequence
  chemically synthesized
gttgccgggttttgagaactta

SEQ ID NO: 1182446 - DNA, 22 bp, Artificial Sequence
  chemically synthesized
ccgggttttgagaacttacaat

SEQ ID NO: 1182447 - DNA, 22 bp, Artificial Sequence
  chemically synthesized
catggtataagcacattgtaag

SEQ ID NO: 1182448 - DNA, 22 bp, Artificial Sequence
  chemically synthesized
tgagaacttacaatgtgcttat

SEQ ID NO: 1182449 - DNA, 22 bp, Artificial Sequence
  chemically synthesized
gagaacttacaatgtgcttata

SEQ ID NO: 1182450 - DNA, 22 bp, Artificial Sequence
  chemically synthesized
agaacttacaatgtgcttatac

SEQ ID NO: 1182451 - DNA, 22 bp, Artificial Sequence
  chemically synthesized
taaagaacattgcatggtataa

SEQ ID NO: 1182452 - DNA, 22 bp, Artificial Sequence
  chemically synthesized
ataaagaacattgcatggtata

SEQ ID NO: 1182453 - DNA, 22 bp, Artificial Sequence
  chemically synthesized
tataaagaacattgcatggtat

SEQ ID NO: 1182454 - DNA, 22 bp, Artificial Sequence
  chemically synthesized
acaatgtgcttataccatgcaa

SEQ ID NO: 1182455 - DNA, 22 bp, Artificial Sequence
  chemically synthesized
caatgtgcttataccatgcaat

SEQ ID NO: 1182456 - DNA, 22 bp, Artificial Sequence
  chemically synthesized
attttataaagaacattgcatg

SEQ ID NO: 1182457 - DNA, 22 bp, Artificial Sequence
  chemically synthesized
ataccatgcaatgttctttata

SEQ ID NO: 1182458 - DNA, 22 bp, Artificial Sequence
  chemically synthesized
taccatgcaatgttctttataa

SEQ ID NO: 1182459 - DNA, 22 bp, Artificial Sequence
  chemically synthesized
aatgagattaattttataaaga

SEQ ID NO: 1182460 - DNA, 22 bp, Artificial Sequence
  chemically synthesized
ggagtgttaaatgagattaatt

SEQ ID NO: 1182461 - DNA, 22 bp, Artificial Sequence
  chemically synthesized
ttaggagtgttaaatgagatta

SEQ ID NO: 1182462 - DNA, 22 bp, Artificial Sequence
  chemically synthesized
tttataaaattaatctcattta

SEQ ID NO: 1182463 - DNA, 22 bp, Artificial Sequence
  chemically synthesized
tataaaattaatctcatttaac

SEQ ID NO: 1182464 - DNA, 22 bp, Artificial Sequence
  chemically synthesized
ataaaattaatctcatttaaca

SEQ ID NO: 1182465 - DNA, 22 bp, Artificial Sequence
  chemically synthesized
taaaattaatctcatttaacac

SEQ ID NO: 1182466 - DNA, 22 bp, Artificial Sequence
  chemically synthesized
atatagttattaggagtgttaa

SEQ ID NO: 1182467 - DNA, 22 bp, Artificial Sequence
  chemically synthesized
actcatatagttattaggagtg

SEQ ID NO: 1182468 - DNA, 22 bp, Artificial Sequence
  chemically synthesized
atctcatttaacactcctaata

SEQ ID NO: 1182469 - DNA, 22 bp, Artificial Sequence
  chemically synthesized
taactcatatagttattaggag

SEQ ID NO: 1182470 - DNA, 22 bp, Artificial Sequence
  chemically synthesized
ctaactcatatagttattagga

SEQ ID NO: 1182471 - DNA, 22 bp, Artificial Sequence
  chemically synthesized
atttaacactcctaataactat

SEQ ID NO: 1182472 - DNA, 22 bp, Artificial Sequence
  chemically synthesized
tttctaactcatatagttatta

SEQ ID NO: 1182473 - DNA, 22 bp, Artificial Sequence
  chemically synthesized
aacactcctaataactatatga

SEQ ID NO: 1182474 - DNA, 22 bp, Artificial Sequence
  chemically synthesized
acactcctaataactatatgag

SEQ ID NO: 1182475 - DNA, 22 bp, Artificial Sequence
  chemically synthesized
aaactgtttctaactcatatag

SEQ ID NO: 1182476 - DNA, 22 bp, Artificial Sequence
  chemically synthesized
ttgaaactgtttctaactcata

SEQ ID NO: 1182477 - DNA, 22 bp, Artificial Sequence
  chemically synthesized
ctaataactatatgagttagaa

SEQ ID NO: 1182478 - DNA, 22 bp, Artificial Sequence
  chemically synthesized
ataactatatgagttagaaaca

SEQ ID NO: 1182479 - DNA, 22 bp, Artificial Sequence
  chemically synthesized
atgtgtattattgaaactgttt

SEQ ID NO: 1182480 - DNA, 22 bp, Artificial Sequence
  chemically synthesized
tatgagttagaaacagtttcaa

SEQ ID NO: 1182481 - DNA, 22 bp, Artificial Sequence
  chemically synthesized
ctcatgtgtattattgaaactg

SEQ ID NO: 1182482 - DNA, 22 bp, Artificial Sequence
  chemically synthesized
cctcatgtgtattattgaaact

SEQ ID NO: 1182483 - DNA, 22 bp, Artificial Sequence
  chemically synthesized
agtttcctcatgtgtattattg

SEQ ID NO: 1182484 - DNA, 22 bp, Artificial Sequence
  chemically synthesized
gaaacagtttcaataatacaca

SEQ ID NO: 1182485 - DNA, 22 bp, Artificial Sequence
  chemically synthesized
ggcctcagtttcctcatgtgta

SEQ ID NO: 1182486 - DNA, 22 bp, Artificial Sequence
  chemically synthesized
tgggcctcagtttcctcatgtg

SEQ ID NO: 1182487 - DNA, 22 bp, Artificial Sequence
  chemically synthesized
caataatacacatgaggaaact

SEQ ID NO: 1182488 - DNA, 22 bp, Artificial Sequence
  chemically synthesized
aataatacacatgaggaaactg

SEQ ID NO: 1182489 - DNA, 22 bp, Artificial Sequence
  chemically synthesized
aactctgggcctcagtttcctc

SEQ ID NO: 1182490 - DNA, 22 bp, Artificial Sequence
  chemically synthesized
gaactctgggcctcagtttcct

SEQ ID NO: 1182491 - DNA, 22 bp, Artificial Sequence
  chemically synthesized
ttgaactctgggcctcagtttc

SEQ ID NO: 1182492 - DNA, 22 bp, Artificial Sequence
  chemically synthesized
cttgaactctgggcctcagttt

SEQ ID NO: 1182493 - DNA, 22 bp, Artificial Sequence
  chemically synthesized
agagaatttcttgaactctggg

SEQ ID NO: 1182494 - DNA, 22 bp, Artificial Sequence
  chemically synthesized
cagagaatttcttgaactctgg

SEQ ID NO: 1182495 - DNA, 22 bp, Artificial Sequence
  chemically synthesized
aggcccagagttcaagaaattc

SEQ ID NO: 1182496 - DNA, 22 bp, Artificial Sequence
  chemically synthesized
tgtgaccttcagagaatttctt

SEQ ID NO: 1182497 - DNA, 22 bp, Artificial Sequence
  chemically synthesized
ctatgtgaccttcagagaattt

SEQ ID NO: 1182498 - DNA, 22 bp, Artificial Sequence
  chemically synthesized
gctatgtgaccttcagagaatt

SEQ ID NO: 1182499 - DNA, 22 bp, Artificial Sequence
  chemically synthesized
cttgctatgtgaccttcagaga

SEQ ID NO: 1182500 - DNA, 22 bp, Artificial Sequence
  chemically synthesized
acttgctatgtgaccttcagag

SEQ ID NO: 1182501 - DNA, 22 bp, Artificial Sequence
  chemically synthesized
cttacttgctatgtgaccttca

SEQ ID NO: 1182502 - DNA, 22 bp, Artificial Sequence
  chemically synthesized
aagaaattctctgaaggtcaca

SEQ ID NO: 1182503 - DNA, 22 bp, Artificial Sequence
  chemically synthesized
ttacttacttgctatgtgacct

SEQ ID NO: 1182504 - DNA, 22 bp, Artificial Sequence
  chemically synthesized
attattacttacttgctatgtg

SEQ ID NO: 1182505 - DNA, 22 bp, Artificial Sequence
  chemically synthesized
cattattacttacttgctatgt

SEQ ID NO: 1182506 - DNA, 22 bp, Artificial Sequence
  chemically synthesized
tctgaaggtcacatagcaagta

SEQ ID NO: 1182507 - DNA, 22 bp, Artificial Sequence
  chemically synthesized
tgaaggtcacatagcaagtaag

SEQ ID NO: 1182508 - DNA, 22 bp, Artificial Sequence
  chemically synthesized
aaggtcacatagcaagtaagta

SEQ ID NO: 1182509 - DNA, 22 bp, Artificial Sequence
  chemically synthesized
agagccttcattattacttact

SEQ ID NO: 1182510 - DNA, 22 bp, Artificial Sequence
  chemically synthesized
aagagccttcattattacttac

SEQ ID NO: 1182511 - DNA, 22 bp, Artificial Sequence
  chemically synthesized
taagagccttcattattactta

SEQ ID NO: 1182512 - DNA, 22 bp, Artificial Sequence
  chemically synthesized
ttaagagccttcattattactt

SEQ ID NO: 1182513 - DNA, 22 bp, Artificial Sequence
  chemically synthesized
cttttaagagccttcattatta

SEQ ID NO: 1182514 - DNA, 22 bp, Artificial Sequence
  chemically synthesized
catctacttttaagagccttca

SEQ ID NO: 1182515 - DNA, 22 bp, Artificial Sequence
  chemically synthesized
cccccctacatctacttttaag

SEQ ID NO: 1182516 - DNA, 22 bp, Artificial Sequence
  chemically synthesized
tgcccccctacatctactttta

SEQ ID NO: 1182517 - DNA, 22 bp, Artificial Sequence
  chemically synthesized
ctgcccccctacatctactttt

SEQ ID NO: 1182518 - DNA, 22 bp, Artificial Sequence
  chemically synthesized
ttctgcccccctacatctactt

SEQ ID NO: 1182519 - DNA, 22 bp, Artificial Sequence
  chemically synthesized
tactcttctgcccccctacatc

SEQ ID NO: 1182520 - DNA, 22 bp, Artificial Sequence
  chemically synthesized
ttaaaagtagatgtaggggggc

SEQ ID NO: 1182521 - DNA, 22 bp, Artificial Sequence
  chemically synthesized
cctatactcttctgccccccta

SEQ ID NO: 1182522 - DNA, 22 bp, Artificial Sequence
  chemically synthesized
aaaagtagatgtaggggggcag

SEQ ID NO: 1182523 - DNA, 22 bp, Artificial Sequence
  chemically synthesized
acctatactcttctgcccccct

SEQ ID NO: 1182524 - DNA, 22 bp, Artificial Sequence
  chemically synthesized
aaagtagatgtaggggggcaga

SEQ ID NO: 1182525 - DNA, 22 bp, Artificial Sequence
  chemically synthesized
ttacctatactcttctgccccc

SEQ ID NO: 1182526 - DNA, 22 bp, Artificial Sequence
  chemically synthesized
atatgacatcactcttacctat

SEQ ID NO: 1182527 - DNA, 22 bp, Artificial Sequence
  chemically synthesized
tcatatgacatcactcttacct

SEQ ID NO: 1182528 - DNA, 22 bp, Artificial Sequence
  chemically synthesized
ctcatatgacatcactcttacc

SEQ ID NO: 1182529 - DNA, 22 bp, Artificial Sequence
  chemically synthesized
tctcatatgacatcactcttac

SEQ ID NO: 1182530 - DNA, 22 bp, Artificial Sequence
  chemically synthesized
agtctttctcatatgacatcac

SEQ ID NO: 1182531 - DNA, 22 bp, Artificial Sequence
  chemically synthesized
acaagggcaaattgagtctttc

SEQ ID NO: 1182532 - DNA, 22 bp, Artificial Sequence
  chemically synthesized
aaagctaacaagggcaaattga

SEQ ID NO: 1182533 - DNA, 22 bp, Artificial Sequence
  chemically synthesized
caaagctaacaagggcaaattg

SEQ ID NO: 1182534 - DNA, 22 bp, Artificial Sequence
  chemically synthesized
aacttcaaagctaacaagggca

SEQ ID NO: 1182535 - DNA, 22 bp, Artificial Sequence
  chemically synthesized
caacttcaaagctaacaagggc

SEQ ID NO: 1182536 - DNA, 22 bp, Artificial Sequence
  chemically synthesized
tcaacttcaaagctaacaaggg

SEQ ID NO: 1182537 - DNA, 22 bp, Artificial Sequence
  chemically synthesized
aatttgcccttgttagctttga

SEQ ID NO: 1182538 - DNA, 22 bp, Artificial Sequence
  chemically synthesized
ccccctttcaacttcaaagcta

SEQ ID NO: 1182539 - DNA, 22 bp, Artificial Sequence
  chemically synthesized
gcccttgttagctttgaagttg

SEQ ID NO: 1182540 - DNA, 22 bp, Artificial Sequence
  chemically synthesized
attgccccctttcaacttcaaa

SEQ ID NO: 1182541 - DNA, 22 bp, Artificial Sequence
  chemically synthesized
cccttgttagctttgaagttga

SEQ ID NO: 1182542 - DNA, 22 bp, Artificial Sequence
  chemically synthesized
gctcattgccccctttcaactt

SEQ ID NO: 1182543 - DNA, 22 bp, Artificial Sequence
  chemically synthesized
gttagctttgaagttgaaaggg

SEQ ID NO: 1182544 - DNA, 22 bp, Artificial Sequence
  chemically synthesized
ttagctttgaagttgaaagggg

SEQ ID NO: 1182545 - DNA, 22 bp, Artificial Sequence
  chemically synthesized
actggctcattgccccctttca

SEQ ID NO: 1182546 - DNA, 22 bp, Artificial Sequence
  chemically synthesized
gctttgaagttgaaagggggca

SEQ ID NO: 1182547 - DNA, 22 bp, Artificial Sequence
  chemically synthesized
tgaagttgaaagggggcaatga

SEQ ID NO: 1182548 - DNA, 22 bp, Artificial Sequence
  chemically synthesized
gaagttgaaagggggcaatgag

SEQ ID NO: 1182549 - DNA, 22 bp, Artificial Sequence
  chemically synthesized
aagttgaaagggggcaatgagc

SEQ ID NO: 1182550 - DNA, 22 bp, Artificial Sequence
  chemically synthesized
accacattcactggctcattgc

SEQ ID NO: 1182551 - DNA, 22 bp, Artificial Sequence
  chemically synthesized
aaagggggcaatgagccagtga

SEQ ID NO: 1182552 - DNA, 22 bp, Artificial Sequence
  chemically synthesized
gaggctgaccacattcactggc

SEQ ID NO: 1182553 - DNA, 22 bp, Artificial Sequence
  chemically synthesized
tagaggctgaccacattcactg

SEQ ID NO: 1182554 - DNA, 22 bp, Artificial Sequence
  chemically synthesized
ctagaggctgaccacattcact

SEQ ID NO: 1182555 - DNA, 22 bp, Artificial Sequence
  chemically synthesized
gcttctagaggctgaccacatt

SEQ ID NO: 1182556 - DNA, 22 bp, Artificial Sequence
  chemically synthesized
tagcttctagaggctgaccaca

SEQ ID NO: 1182557 - DNA, 22 bp, Artificial Sequence
  chemically synthesized
ctagcttctagaggctgaccac

SEQ ID NO: 1182558 - DNA, 22 bp, Artificial Sequence
  chemically synthesized
tctagcttctagaggctgacca

SEQ ID NO: 1182559 - DNA, 22 bp, Artificial Sequence
  chemically synthesized
ttctagcttctagaggctgacc

SEQ ID NO: 1182560 - DNA, 22 bp, Artificial Sequence
  chemically synthesized
catgccttttctagcttctaga

SEQ ID NO: 1182561 - DNA, 22 bp, Artificial Sequence
  chemically synthesized
ccatgccttttctagcttctag

SEQ ID NO: 1182562 - DNA, 22 bp, Artificial Sequence
  chemically synthesized
tagaagctagaaaaggcatgga

SEQ ID NO: 1182563 - DNA, 22 bp, Artificial Sequence
  chemically synthesized
gaagctagaaaaggcatggaaa

SEQ ID NO: 1182564 - DNA, 22 bp, Artificial Sequence
  chemically synthesized
tagaggagaatccatttccatg

SEQ ID NO: 1182565 - DNA, 22 bp, Artificial Sequence
  chemically synthesized
gaaaaggcatggaaatggattc

SEQ ID NO: 1182566 - DNA, 22 bp, Artificial Sequence
  chemically synthesized
gaggctgtagaggagaatccat

SEQ ID NO: 1182567 - DNA, 22 bp, Artificial Sequence
  chemically synthesized
ggaggctgtagaggagaatcca

SEQ ID NO: 1182568 - DNA, 22 bp, Artificial Sequence
  chemically synthesized
tggaggctgtagaggagaatcc

SEQ ID NO: 1182569 - DNA, 22 bp, Artificial Sequence
  chemically synthesized
ttggaggctgtagaggagaatc

SEQ ID NO: 1182570 - DNA, 22 bp, Artificial Sequence
  chemically synthesized
cttttggaggctgtagaggaga

SEQ ID NO: 1182571 - DNA, 22 bp, Artificial Sequence
  chemically synthesized
ccttttggaggctgtagaggag

SEQ ID NO: 1182572 - DNA, 22 bp, Artificial Sequence
  chemically synthesized
ccttccttttggaggctgtaga

SEQ ID NO: 1182573 - DNA, 22 bp, Artificial Sequence
  chemically synthesized
tcctctacagcctccaaaagga

SEQ ID NO: 1182574 - DNA, 22 bp, Artificial Sequence
  chemically synthesized
ctctacagcctccaaaaggaag

SEQ ID NO: 1182575 - DNA, 22 bp, Artificial Sequence
  chemically synthesized
tacagcctccaaaaggaaggca

SEQ ID NO: 1182576 - DNA, 22 bp, Artificial Sequence
  chemically synthesized
cagcctccaaaaggaaggcagc

SEQ ID NO: 1182577 - DNA, 22 bp, Artificial Sequence
  chemically synthesized
acatatcagcagggctgccttc

SEQ ID NO: 1182578 - DNA, 22 bp, Artificial Sequence
  chemically synthesized
caaaaggaaggcagccctgctg

SEQ ID NO: 1182579 - DNA, 22 bp, Artificial Sequence
  chemically synthesized
acattaacatatcagcagggct

SEQ ID NO: 1182580 - DNA, 22 bp, Artificial Sequence
  chemically synthesized
agctaacattaacatatcagca

SEQ ID NO: 1182581 - DNA, 22 bp, Artificial Sequence
  chemically synthesized
attcagctaacattaacatatc

SEQ ID NO: 1182582 - DNA, 22 bp, Artificial Sequence
  chemically synthesized
ctgatatgttaatgttagctga

SEQ ID NO: 1182583 - DNA, 22 bp, Artificial Sequence
  chemically synthesized
aaacaggtctcattcagctaac

SEQ ID NO: 1182584 - DNA, 22 bp, Artificial Sequence
  chemically synthesized
aaaacaggtctcattcagctaa

SEQ ID NO: 1182585 - DNA, 22 bp, Artificial Sequence
  chemically synthesized
atatgttaatgttagctgaatg

SEQ ID NO: 1182586 - DNA, 22 bp, Artificial Sequence
  chemically synthesized
agatgtttaaaacaggtctcat

SEQ ID NO: 1182587 - DNA, 22 bp, Artificial Sequence
  chemically synthesized
atgttagctgaatgagacctgt

SEQ ID NO: 1182588 - DNA, 22 bp, Artificial Sequence
  chemically synthesized
gttcagatgtttaaaacaggtc

SEQ ID NO: 1182589 - DNA, 22 bp, Artificial Sequence
  chemically synthesized
agttcagatgtttaaaacaggt

SEQ ID NO: 1182590 - DNA, 22 bp, Artificial Sequence
  chemically synthesized
tagttcagatgtttaaaacagg

SEQ ID NO: 1182591 - DNA, 22 bp, Artificial Sequence
  chemically synthesized
gctgaatgagacctgttttaaa

SEQ ID NO: 1182592 - DNA, 22 bp, Artificial Sequence
  chemically synthesized
tttagttcagatgtttaaaaca

SEQ ID NO: 1182593 - DNA, 22 bp, Artificial Sequence
  chemically synthesized
aatgagacctgttttaaacatc

SEQ ID NO: 1182594 - DNA, 22 bp, Artificial Sequence
  chemically synthesized
cagttctttagttcagatgttt

SEQ ID NO: 1182595 - DNA, 22 bp, Artificial Sequence
  chemically synthesized
acagttctttagttcagatgtt

SEQ ID NO: 1182596 - DNA, 22 bp, Artificial Sequence
  chemically synthesized
tacagttctttagttcagatgt

SEQ ID NO: 1182597 - DNA, 22 bp, Artificial Sequence
  chemically synthesized
ttttacagttctttagttcaga

SEQ ID NO: 1182598 - DNA, 22 bp, Artificial Sequence
  chemically synthesized
ttttaaacatctgaactaaaga

SEQ ID NO: 1182599 - DNA, 22 bp, Artificial Sequence
  chemically synthesized
attattttacagttctttagtt

SEQ ID NO: 1182600 - DNA, 22 bp, Artificial Sequence
  chemically synthesized
taaacatctgaactaaagaact

SEQ ID NO: 1182601 - DNA, 22 bp, Artificial Sequence
  chemically synthesized
aaacatctgaactaaagaactg

SEQ ID NO: 1182602 - DNA, 22 bp, Artificial Sequence
  chemically synthesized
aacatctgaactaaagaactgt

SEQ ID NO: 1182603 - DNA, 22 bp, Artificial Sequence
  chemically synthesized
aactaaagaactgtaaaataat

SEQ ID NO: 1182604 - DNA, 22 bp, Artificial Sequence
  chemically synthesized
atcaacacatattcattatttt

SEQ ID NO: 1182605 - DNA, 22 bp, Artificial Sequence
  chemically synthesized
aagaactgtaaaataatgaata

SEQ ID NO: 1182606 - DNA, 22 bp, Artificial Sequence
  chemically synthesized
gtgcccctaatcaacacatatt

SEQ ID NO: 1182607 - DNA, 22 bp, Artificial Sequence
  chemically synthesized
taaaataatgaatatgtgttga

SEQ ID NO: 1182608 - DNA, 22 bp, Artificial Sequence
  chemically synthesized
caaacctagtgcccctaatcaa

SEQ ID NO: 1182609 - DNA, 22 bp, Artificial Sequence
  chemically synthesized
atgcaacaactacaaacctagt

SEQ ID NO: 1182610 - DNA, 22 bp, Artificial Sequence
  chemically synthesized
gatgcaacaactacaaacctag

SEQ ID NO: 1182611 - DNA, 22 bp, Artificial Sequence
  chemically synthesized
tgatgcaacaactacaaaccta

SEQ ID NO: 1182612 - DNA, 22 bp, Artificial Sequence
  chemically synthesized
attaggggcactaggtttgtag

SEQ ID NO: 1182613 - DNA, 22 bp, Artificial Sequence
  chemically synthesized
ttgatgcaacaactacaaacct

SEQ ID NO: 1182614 - DNA, 22 bp, Artificial Sequence
  chemically synthesized
ggggcactaggtttgtagttgt

SEQ ID NO: 1182615 - DNA, 22 bp, Artificial Sequence
  chemically synthesized
gatttttgatgcaacaactaca

SEQ ID NO: 1182616 - DNA, 22 bp, Artificial Sequence
  chemically synthesized
gttcgatttttgatgcaacaac

SEQ ID NO: 1182617 - DNA, 22 bp, Artificial Sequence
  chemically synthesized
ggtttgtagttgttgcatcaaa

SEQ ID NO: 1182618 - DNA, 22 bp, Artificial Sequence
  chemically synthesized
gtagttgttgcatcaaaaatcg

SEQ ID NO: 1182619 - DNA, 22 bp, Artificial Sequence
  chemically synthesized
tatgtattagttcgatttttga

SEQ ID NO: 1182620 - DNA, 22 bp, Artificial Sequence
  chemically synthesized
tagttgttgcatcaaaaatcga

SEQ ID NO: 1182621 - DNA, 22 bp, Artificial Sequence
  chemically synthesized
ttgcatcaaaaatcgaactaat

SEQ ID NO: 1182622 - DNA, 22 bp, Artificial Sequence
  chemically synthesized
catcaaaaatcgaactaataca

SEQ ID NO: 1182623 - DNA, 22 bp, Artificial Sequence
  chemically synthesized
atcatgtgtctatatgtattag

SEQ ID NO: 1182624 - DNA, 22 bp, Artificial Sequence
  chemically synthesized
ataactaatcatgtgtctatat

SEQ ID NO: 1182625 - DNA, 22 bp, Artificial Sequence
  chemically synthesized
atacatatagacacatgattag

SEQ ID NO: 1182626 - DNA, 22 bp, Artificial Sequence
  chemically synthesized
acccatcctgataactaatcat

SEQ ID NO: 1182627 - DNA, 22 bp, Artificial Sequence
  chemically synthesized
aattaacccatcctgataacta

SEQ ID NO: 1182628 - DNA, 22 bp, Artificial Sequence
  chemically synthesized
aaattaacccatcctgataact

SEQ ID NO: 1182629 - DNA, 22 bp, Artificial Sequence
  chemically synthesized
taaattaacccatcctgataac

SEQ ID NO: 1182630 - DNA, 22 bp, Artificial Sequence
  chemically synthesized
ttaaattaacccatcctgataa

SEQ ID NO: 1182631 - DNA, 22 bp, Artificial Sequence
  chemically synthesized
ttttaaattaacccatcctgat

SEQ ID NO: 1182632 - DNA, 22 bp, Artificial Sequence
  chemically synthesized
cttttaaattaacccatcctga

SEQ ID NO: 1182633 - DNA, 22 bp, Artificial Sequence
  chemically synthesized
gttatcaggatgggttaattta

SEQ ID NO: 1182634 - DNA, 22 bp, Artificial Sequence
  chemically synthesized
tcaggatgggttaatttaaaag

SEQ ID NO: 1182635 - DNA, 22 bp, Artificial Sequence
  chemically synthesized
atttaaaagaagtatgtttttg

SEQ ID NO: 1182636 - DNA, 22 bp, Artificial Sequence
  chemically synthesized
atggccacagggacaaaaacat

SEQ ID NO: 1182637 - DNA, 22 bp, Artificial Sequence
  chemically synthesized
aaaagaagtatgtttttgtccc

SEQ ID NO: 1182638 - DNA, 22 bp, Artificial Sequence
  chemically synthesized
aaagaagtatgtttttgtccct

SEQ ID NO: 1182639 - DNA, 22 bp, Artificial Sequence
  chemically synthesized
aatagttgatggccacagggac

SEQ ID NO: 1182640 - DNA, 22 bp, Artificial Sequence
  chemically synthesized
ccctgaatagttgatggccaca

SEQ ID NO: 1182641 - DNA, 22 bp, Artificial Sequence
  chemically synthesized
ttgtccctgtggccatcaacta

SEQ ID NO: 1182642 - DNA, 22 bp, Artificial Sequence
  chemically synthesized
tgtccctgtggccatcaactat

SEQ ID NO: 1182643 - DNA, 22 bp, Artificial Sequence
  chemically synthesized
gtccctgtggccatcaactatt

SEQ ID NO: 1182644 - DNA, 22 bp, Artificial Sequence
  chemically synthesized
tccctgtggccatcaactattc

SEQ ID NO: 1182645 - DNA, 22 bp, Artificial Sequence
  chemically synthesized
aaaacactaccctgaatagttg

SEQ ID NO: 1182646 - DNA, 22 bp, Artificial Sequence
  chemically synthesized
tggccatcaactattcagggta

SEQ ID NO: 1182647 - DNA, 22 bp, Artificial Sequence
  chemically synthesized
ggtctcaaaacactaccctgaa

SEQ ID NO: 1182648 - DNA, 22 bp, Artificial Sequence
  chemically synthesized
ttcagggtagtgttttgagacc

SEQ ID NO: 1182649 - DNA, 22 bp, Artificial Sequence
  chemically synthesized
agggtagtgttttgagaccgag

SEQ ID NO: 1182650 - DNA, 22 bp, Artificial Sequence
  chemically synthesized
ggtgacagggcaagactcggtc

SEQ ID NO: 1182651 - DNA, 22 bp, Artificial Sequence
  chemically synthesized
cagcctgggtgacagggcaaga

SEQ ID NO: 1182652 - DNA, 22 bp, Artificial Sequence
  chemically synthesized
tgagaccgagtcttgccctgtc

SEQ ID NO: 1182653 - DNA, 22 bp, Artificial Sequence
  chemically synthesized
gagaccgagtcttgccctgtca

SEQ ID NO: 1182654 - DNA, 22 bp, Artificial Sequence
  chemically synthesized
agaccgagtcttgccctgtcac

SEQ ID NO: 1182655 - DNA, 22 bp, Artificial Sequence
  chemically synthesized
cactccagcctgggtgacaggg

SEQ ID NO: 1182656 - DNA, 22 bp, Artificial Sequence
  chemically synthesized
gccctgtcacccaggctggagt

SEQ ID NO: 1182657 - DNA, 22 bp, Artificial Sequence
  chemically synthesized
ccctgtcacccaggctggagtg

SEQ ID NO: 1182658 - DNA, 22 bp, Artificial Sequence
  chemically synthesized
agatcggccactgcactccagc

SEQ ID NO: 1182659 - DNA, 22 bp, Artificial Sequence
  chemically synthesized
tcacccaggctggagtgcagtg

SEQ ID NO: 1182660 - DNA, 22 bp, Artificial Sequence
  chemically synthesized
cagtgagctgagatcggccact

SEQ ID NO: 1182661 - DNA, 22 bp, Artificial Sequence
  chemically synthesized
gagtgcagtggccgatctcagc

SEQ ID NO: 1182662 - DNA, 22 bp, Artificial Sequence
  chemically synthesized
aagccaggaggtggaggttgca

SEQ ID NO: 1182663 - DNA, 22 bp, Artificial Sequence
  chemically synthesized
gaagccaggaggtggaggttgc

SEQ ID NO: 1182664 - DNA, 22 bp, Artificial Sequence
  chemically synthesized
cttgaagccaggaggtggaggt

SEQ ID NO: 1182665 - DNA, 22 bp, Artificial Sequence
  chemically synthesized
agctcactgcaacctccacctc

SEQ ID NO: 1182666 - DNA, 22 bp, Artificial Sequence
  chemically synthesized
actgcaacctccacctcctggc

SEQ ID NO: 1182667 - DNA, 22 bp, Artificial Sequence
  chemically synthesized
caacctccacctcctggcttca

SEQ ID NO: 1182668 - DNA, 22 bp, Artificial Sequence
  chemically synthesized
aggcatgaggattgcttgaagc

SEQ ID NO: 1182669 - DNA, 22 bp, Artificial Sequence
  chemically synthesized
cacctcctggcttcaagcaatc

SEQ ID NO: 1182670 - DNA, 22 bp, Artificial Sequence
  chemically synthesized
ggaagctgaggcatgaggattg

SEQ ID NO: 1182671 - DNA, 22 bp, Artificial Sequence
  chemically synthesized
ctggcttcaagcaatcctcatg

SEQ ID NO: 1182672 - DNA, 22 bp, Artificial Sequence
  chemically synthesized
gggaagctgaggcatgaggatt

SEQ ID NO: 1182673 - DNA, 22 bp, Artificial Sequence
  chemically synthesized
gcttcaagcaatcctcatgcct

SEQ ID NO: 1182674 - DNA, 22 bp, Artificial Sequence
  chemically synthesized
cttgggaagctgaggcatgagg

SEQ ID NO: 1182675 - DNA, 22 bp, Artificial Sequence
  chemically synthesized
caagcaatcctcatgcctcagc

SEQ ID NO: 1182676 - DNA, 22 bp, Artificial Sequence
  chemically synthesized
aagcaatcctcatgcctcagct

SEQ ID NO: 1182677 - DNA, 22 bp, Artificial Sequence
  chemically synthesized
taatcccagctacttgggaagc

SEQ ID NO: 1182678 - DNA, 22 bp, Artificial Sequence
  chemically synthesized
atgcctcagcttcccaagtagc

SEQ ID NO: 1182679 - DNA, 22 bp, Artificial Sequence
  chemically synthesized
agcttcccaagtagctgggatt

SEQ ID NO: 1182680 - DNA, 22 bp, Artificial Sequence
  chemically synthesized
cccaagtagctgggattacagg

SEQ ID NO: 1182681 - DNA, 22 bp, Artificial Sequence
  chemically synthesized
ccaagtagctgggattacaggt

SEQ ID NO: 1182682 - DNA, 22 bp, Artificial Sequence
  chemically synthesized
agcgagtgtggtggcacacacc

SEQ ID NO: 1182683 - DNA, 22 bp, Artificial Sequence
  chemically synthesized
ggattacaggtgtgtgccacca

SEQ ID NO: 1182684 - DNA, 22 bp, Artificial Sequence
  chemically synthesized
caggtgtgtgccaccacactcg

SEQ ID NO: 1182685 - DNA, 22 bp, Artificial Sequence
  chemically synthesized
aaaacacaaaaattaagcgagt

SEQ ID NO: 1182686 - DNA, 22 bp, Artificial Sequence
  chemically synthesized
ctgaaaacacaaaaattaagcg

SEQ ID NO: 1182687 - DNA, 22 bp, Artificial Sequence
  chemically synthesized
tactgaaaacacaaaaattaag

SEQ ID NO: 1182688 - DNA, 22 bp, Artificial Sequence
  chemically synthesized
ctactgaaaacacaaaaattaa

SEQ ID NO: 1182689 - DNA, 22 bp, Artificial Sequence
  chemically synthesized
tttctactgaaaacacaaaaat

SEQ ID NO: 1182690 - DNA, 22 bp, Artificial Sequence
  chemically synthesized
gcttaatttttgtgttttcagt

SEQ ID NO: 1182691 - DNA, 22 bp, Artificial Sequence
  chemically synthesized
aatttttgtgttttcagtagaa

SEQ ID NO: 1182692 - DNA, 22 bp, Artificial Sequence
  chemically synthesized
atttttgtgttttcagtagaaa

SEQ ID NO: 1182693 - DNA, 22 bp, Artificial Sequence
  chemically synthesized
ttgtgttttcagtagaaacagc

SEQ ID NO: 1182694 - DNA, 22 bp, Artificial Sequence
  chemically synthesized
tgtgttttcagtagaaacagca

SEQ ID NO: 1182695 - DNA, 22 bp, Artificial Sequence
  chemically synthesized
gtgttttcagtagaaacagcat

SEQ ID NO: 1182696 - DNA, 22 bp, Artificial Sequence
  chemically synthesized
tgttttcagtagaaacagcatt

SEQ ID NO: 1182697 - DNA, 22 bp, Artificial Sequence
  chemically synthesized
gccaacatggcaaaatgctgtt

SEQ ID NO: 1182698 - DNA, 22 bp, Artificial Sequence
  chemically synthesized
tcagtagaaacagcattttgcc

SEQ ID NO: 1182699 - DNA, 22 bp, Artificial Sequence
  chemically synthesized
cagtagaaacagcattttgcca

SEQ ID NO: 1182700 - DNA, 22 bp, Artificial Sequence
  chemically synthesized
agtagaaacagcattttgccat

SEQ ID NO: 1182701 - DNA, 22 bp, Artificial Sequence
  chemically synthesized
agaccagcctggccaacatggc

SEQ ID NO: 1182702 - DNA, 22 bp, Artificial Sequence
  chemically synthesized
gagaccagcctggccaacatgg

SEQ ID NO: 1182703 - DNA, 22 bp, Artificial Sequence
  chemically synthesized
ggagtttgagaccagcctggcc

SEQ ID NO: 1182704 - DNA, 22 bp, Artificial Sequence
  chemically synthesized
tgccatgttggccaggctggtc

SEQ ID NO: 1182705 - DNA, 22 bp, Artificial Sequence
  chemically synthesized
gccatgttggccaggctggtct

SEQ ID NO: 1182706 - DNA, 22 bp, Artificial Sequence
  chemically synthesized
ccatgttggccaggctggtctc

SEQ ID NO: 1182707 - DNA, 22 bp, Artificial Sequence
  chemically synthesized
aggctaggagtttgagaccagc

SEQ ID NO: 1182708 - DNA, 22 bp, Artificial Sequence
  chemically synthesized
gaggctaggagtttgagaccag

SEQ ID NO: 1182709 - DNA, 22 bp, Artificial Sequence
  chemically synthesized
gccaggctggtctcaaactcct

SEQ ID NO: 1182710 - DNA, 22 bp, Artificial Sequence
  chemically synthesized
gtctcaaactcctagcctcaag

SEQ ID NO: 1182711 - DNA, 22 bp, Artificial Sequence
  chemically synthesized
aaactcctagcctcaagtgatc

SEQ ID NO: 1182712 - DNA, 22 bp, Artificial Sequence
  chemically synthesized
gaggatgacgcggggagatcac

SEQ ID NO: 1182713 - DNA, 22 bp, Artificial Sequence
  chemically synthesized
ggaggatgacgcggggagatca

SEQ ID NO: 1182714 - DNA, 22 bp, Artificial Sequence
  chemically synthesized
ctagcctcaagtgatctccccg

SEQ ID NO: 1182715 - DNA, 22 bp, Artificial Sequence
  chemically synthesized
tggaggatgacgcggggagatc

SEQ ID NO: 1182716 - DNA, 22 bp, Artificial Sequence
  chemically synthesized
ttggaggatgacgcggggagat

SEQ ID NO: 1182717 - DNA, 22 bp, Artificial Sequence
  chemically synthesized
gcctcaagtgatctccccgcgt

SEQ ID NO: 1182718 - DNA, 22 bp, Artificial Sequence
  chemically synthesized
ttttggaggatgacgcggggag

SEQ ID NO: 1182719 - DNA, 22 bp, Artificial Sequence
  chemically synthesized
aagtgatctccccgcgtcatcc

SEQ ID NO: 1182720 - DNA, 22 bp, Artificial Sequence
  chemically synthesized
taatcccgcctcttttggagga

SEQ ID NO: 1182721 - DNA, 22 bp, Artificial Sequence
  chemically synthesized
cccgcgtcatcctccaaaagag

SEQ ID NO: 1182722 - DNA, 22 bp, Artificial Sequence
  chemically synthesized
atgcctgtaatcccgcctcttt

SEQ ID NO: 1182723 - DNA, 22 bp, Artificial Sequence
  chemically synthesized
caaaagaggcgggattacaggc

SEQ ID NO: 1182724 - DNA, 22 bp, Artificial Sequence
  chemically synthesized
ggtgtagtggctcatgcctgta

SEQ ID NO: 1182725 - DNA, 22 bp, Artificial Sequence
  chemically synthesized
caccgcgagctgggtgtagtgg

SEQ ID NO: 1182726 - DNA, 22 bp, Artificial Sequence
  chemically synthesized
caggcatgagccactacaccca

SEQ ID NO: 1182727 - DNA, 22 bp, Artificial Sequence
  chemically synthesized
aaaaaacaaactacaccgcgag

SEQ ID NO: 1182728 - DNA, 22 bp, Artificial Sequence
  chemically synthesized
aaaaaaacaaactacaccgcga

SEQ ID NO: 1182729 - DNA, 22 bp, Artificial Sequence
  chemically synthesized
cacccagctcgcggtgtagttt

SEQ ID NO: 1182730 - DNA, 22 bp, Artificial Sequence
  chemically synthesized
taacacttaaaaaaacaaacta

SEQ ID NO: 1182731 - DNA, 22 bp, Artificial Sequence
  chemically synthesized
attgtaacacttaaaaaaacaa

SEQ ID NO: 1182732 - DNA, 22 bp, Artificial Sequence
  chemically synthesized
gcggtgtagtttgtttttttaa

SEQ ID NO: 1182733 - DNA, 22 bp, Artificial Sequence
  chemically synthesized
ccctcattgtaacacttaaaaa

SEQ ID NO: 1182734 - DNA, 22 bp, Artificial Sequence
  chemically synthesized
gtttttttaagtgttacaatga

SEQ ID NO: 1182735 - DNA, 22 bp, Artificial Sequence
  chemically synthesized
tttttttaagtgttacaatgag

SEQ ID NO: 1182736 - DNA, 22 bp, Artificial Sequence
  chemically synthesized
ttttaagtgttacaatgagggt

SEQ ID NO: 1182737 - DNA, 22 bp, Artificial Sequence
  chemically synthesized
tttaagtgttacaatgagggta

SEQ ID NO: 1182738 - DNA, 22 bp, Artificial Sequence
  chemically synthesized
ttaagtgttacaatgagggtag

SEQ ID NO: 1182739 - DNA, 22 bp, Artificial Sequence
  chemically synthesized
taagtgttacaatgagggtagc

SEQ ID NO: 1182740 - DNA, 22 bp, Artificial Sequence
  chemically synthesized
aagtgttacaatgagggtagcc

SEQ ID NO: 1182741 - DNA, 22 bp, Artificial Sequence
  chemically synthesized
agtgttacaatgagggtagcct

SEQ ID NO: 1182742 - DNA, 22 bp, Artificial Sequence
  chemically synthesized
aaacgacagtaaaagtgaaggc

SEQ ID NO: 1182743 - DNA, 22 bp, Artificial Sequence
  chemically synthesized
caatgagggtagccttcacttt

SEQ ID NO: 1182744 - DNA, 22 bp, Artificial Sequence
  chemically synthesized
gagtaggttcaaacgacagtaa

SEQ ID NO: 1182745 - DNA, 22 bp, Artificial Sequence
  chemically synthesized
attagagtaggttcaaacgaca

SEQ ID NO: 1182746 - DNA, 22 bp, Artificial Sequence
  chemically synthesized
cacttttactgtcgtttgaacc

SEQ ID NO: 1182747 - DNA, 22 bp, Artificial Sequence
  chemically synthesized
ctgattagagtaggttcaaacg

SEQ ID NO: 1182748 - DNA, 22 bp, Artificial Sequence
  chemically synthesized
acttttactgtcgtttgaacct

SEQ ID NO: 1182749 - DNA, 22 bp, Artificial Sequence
  chemically synthesized
ttactgtcgtttgaacctactc

SEQ ID NO: 1182750 - DNA, 22 bp, Artificial Sequence
  chemically synthesized
tactgtcgtttgaacctactct

SEQ ID NO: 1182751 - DNA, 22 bp, Artificial Sequence
  chemically synthesized
actgtcgtttgaacctactcta

SEQ ID NO: 1182752 - DNA, 22 bp, Artificial Sequence
  chemically synthesized
ctgtcgtttgaacctactctaa

SEQ ID NO: 1182753 - DNA, 22 bp, Artificial Sequence
  chemically synthesized
gaggtgttgctgattagagtag

SEQ ID NO: 1182754 - DNA, 22 bp, Artificial Sequence
  chemically synthesized
ggaggtgttgctgattagagta

SEQ ID NO: 1182755 - DNA, 22 bp, Artificial Sequence
  chemically synthesized
tcgtttgaacctactctaatca

SEQ ID NO: 1182756 - DNA, 22 bp, Artificial Sequence
  chemically synthesized
gaacctactctaatcagcaaca

SEQ ID NO: 1182757 - DNA, 22 bp, Artificial Sequence
  chemically synthesized
aacctactctaatcagcaacac

SEQ ID NO: 1182758 - DNA, 22 bp, Artificial Sequence
  chemically synthesized
ctctaatcagcaacacctccaa

SEQ ID NO: 1182759 - DNA, 22 bp, Artificial Sequence
  chemically synthesized
taatcagcaacacctccaaata

SEQ ID NO: 1182760 - DNA, 22 bp, Artificial Sequence
  chemically synthesized
atcagcaacacctccaaataca

SEQ ID NO: 1182761 - DNA, 22 bp, Artificial Sequence
  chemically synthesized
agtggtgtgtgcatgtgtgtgt

SEQ ID NO: 1182762 - DNA, 22 bp, Artificial Sequence
  chemically synthesized
cagtggtgtgtgcatgtgtgtg

SEQ ID NO: 1182763 - DNA, 22 bp, Artificial Sequence
  chemically synthesized
caaatacacacacatgcacaca

SEQ ID NO: 1182764 - DNA, 22 bp, Artificial Sequence
  chemically synthesized
ataagaacaatttcagtggtgt

SEQ ID NO: 1182765 - DNA, 22 bp, Artificial Sequence
  chemically synthesized
aataagaacaatttcagtggtg

SEQ ID NO: 1182766 - DNA, 22 bp, Artificial Sequence
  chemically synthesized
taataagaacaatttcagtggt

SEQ ID NO: 1182767 - DNA, 22 bp, Artificial Sequence
  chemically synthesized
tatcccctttaataagaacaat

SEQ ID NO: 1182768 - DNA, 22 bp, Artificial Sequence
  chemically synthesized
atatcccctttaataagaacaa

SEQ ID NO: 1182769 - DNA, 22 bp, Artificial Sequence
  chemically synthesized
gtttatatcccctttaataaga

SEQ ID NO: 1182770 - DNA, 22 bp, Artificial Sequence
  chemically synthesized
tagtttatatcccctttaataa

SEQ ID NO: 1182771 - DNA, 22 bp, Artificial Sequence
  chemically synthesized
tctagtttatatcccctttaat

SEQ ID NO: 1182772 - DNA, 22 bp, Artificial Sequence
  chemically synthesized
aaattgttcttattaaagggga

SEQ ID NO: 1182773 - DNA, 22 bp, Artificial Sequence
  chemically synthesized
tctctagtttatatccccttta

SEQ ID NO: 1182774 - DNA, 22 bp, Artificial Sequence
  chemically synthesized
ttcttattaaaggggatataaa

SEQ ID NO: 1182775 - DNA, 22 bp, Artificial Sequence
  chemically synthesized
catgctctctctagtttatatc

SEQ ID NO: 1182776 - DNA, 22 bp, Artificial Sequence
  chemically synthesized
ttattaaaggggatataaacta

SEQ ID NO: 1182777 - DNA, 22 bp, Artificial Sequence
  chemically synthesized
attaaaggggatataaactaga

SEQ ID NO: 1182778 - DNA, 22 bp, Artificial Sequence
  chemically synthesized
ttaaaggggatataaactagag

SEQ ID NO: 1182779 - DNA, 22 bp, Artificial Sequence
  chemically synthesized
aaggggatataaactagagaga

SEQ ID NO: 1182780 - DNA, 22 bp, Artificial Sequence
  chemically synthesized
accgataaagttacatgctctc

SEQ ID NO: 1182781 - DNA, 22 bp, Artificial Sequence
  chemically synthesized
gaccgataaagttacatgctct

SEQ ID NO: 1182782 - DNA, 22 bp, Artificial Sequence
  chemically synthesized
tgaccgataaagttacatgctc

SEQ ID NO: 1182783 - DNA, 22 bp, Artificial Sequence
  chemically synthesized
ccattttgaccgataaagttac

SEQ ID NO: 1182784 - DNA, 22 bp, Artificial Sequence
  chemically synthesized
cccattttgaccgataaagtta

SEQ ID NO: 1182785 - DNA, 22 bp, Artificial Sequence
  chemically synthesized
gagagagcatgtaactttatcg

SEQ ID NO: 1182786 - DNA, 22 bp, Artificial Sequence
  chemically synthesized
tcccattttgaccgataaagtt

SEQ ID NO: 1182787 - DNA, 22 bp, Artificial Sequence
  chemically synthesized
aaactttcccattttgaccgat

SEQ ID NO: 1182788 - DNA, 22 bp, Artificial Sequence
  chemically synthesized
aaaactttcccattttgaccga

SEQ ID NO: 1182789 - DNA, 22 bp, Artificial Sequence
  chemically synthesized
ttaaaactttcccattttgacc

SEQ ID NO: 1182790 - DNA, 22 bp, Artificial Sequence
  chemically synthesized
actcttaaaactttcccatttt

SEQ ID NO: 1182791 - DNA, 22 bp, Artificial Sequence
  chemically synthesized
ttcactcttaaaactttcccat

SEQ ID NO: 1182792 - DNA, 22 bp, Artificial Sequence
  chemically synthesized
tatcggtcaaaatgggaaagtt

SEQ ID NO: 1182793 - DNA, 22 bp, Artificial Sequence
  chemically synthesized
atcggtcaaaatgggaaagttt

SEQ ID NO: 1182794 - DNA, 22 bp, Artificial Sequence
  chemically synthesized
tcggtcaaaatgggaaagtttt

SEQ ID NO: 1182795 - DNA, 22 bp, Artificial Sequence
  chemically synthesized
ctattcactcttaaaactttcc

SEQ ID NO: 1182796 - DNA, 22 bp, Artificial Sequence
  chemically synthesized
acactcctattcactcttaaaa

SEQ ID NO: 1182797 - DNA, 22 bp, Artificial Sequence
  chemically synthesized
ctaacactcctattcactctta

SEQ ID NO: 1182798 - DNA, 22 bp, Artificial Sequence
  chemically synthesized
cagtggaattactaacactcct

SEQ ID NO: 1182799 - DNA, 22 bp, Artificial Sequence
  chemically synthesized
taagagtgaataggagtgttag

SEQ ID NO: 1182800 - DNA, 22 bp, Artificial Sequence
  chemically synthesized
aagagtgaataggagtgttagt

SEQ ID NO: 1182801 - DNA, 22 bp, Artificial Sequence
  chemically synthesized
agagtgaataggagtgttagta

SEQ ID NO: 1182802 - DNA, 22 bp, Artificial Sequence
  chemically synthesized
ctacagtggaattactaacact

SEQ ID NO: 1182803 - DNA, 22 bp, Artificial Sequence
  chemically synthesized
atatatagcagttactacagtg

SEQ ID NO: 1182804 - DNA, 22 bp, Artificial Sequence
  chemically synthesized
gtaattccactgtagtaactgc

SEQ ID NO: 1182805 - DNA, 22 bp, Artificial Sequence
  chemically synthesized
ggaaatcctaatatatagcagt

SEQ ID NO: 1182806 - DNA, 22 bp, Artificial Sequence
  chemically synthesized
cactgtagtaactgctatatat

SEQ ID NO: 1182807 - DNA, 22 bp, Artificial Sequence
  chemically synthesized
tagtaactgctatatattagga

SEQ ID NO: 1182808 - DNA, 22 bp, Artificial Sequence
  chemically synthesized
ctatatattaggatttcccaga

SEQ ID NO: 1182809 - DNA, 22 bp, Artificial Sequence
  chemically synthesized
tatattaggatttcccagacat

SEQ ID NO: 1182810 - DNA, 22 bp, Artificial Sequence
  chemically synthesized
ggaaaacagtagggtacgatgt

SEQ ID NO: 1182811 - DNA, 22 bp, Artificial Sequence
  chemically synthesized
ggatttcccagacatcgtaccc

SEQ ID NO: 1182812 - DNA, 22 bp, Artificial Sequence
  chemically synthesized
aggaaaacagtagggtacgatg

SEQ ID NO: 1182813 - DNA, 22 bp, Artificial Sequence
  chemically synthesized
cccagacatcgtaccctactgt

SEQ ID NO: 1182814 - DNA, 22 bp, Artificial Sequence
  chemically synthesized
ccagacatcgtaccctactgtt

SEQ ID NO: 1182815 - DNA, 22 bp, Artificial Sequence
  chemically synthesized
agtgaatttaggaaaacagtag

SEQ ID NO: 1182816 - DNA, 22 bp, Artificial Sequence
  chemically synthesized
ttcagtgaatttaggaaaacag

SEQ ID NO: 1182817 - DNA, 22 bp, Artificial Sequence
  chemically synthesized
aaaattattcagtgaatttagg

SEQ ID NO: 1182818 - DNA, 22 bp, Artificial Sequence
  chemically synthesized
ctgttttcctaaattcactgaa

SEQ ID NO: 1182819 - DNA, 22 bp, Artificial Sequence
  chemically synthesized
ttttcctaaattcactgaataa

SEQ ID NO: 1182820 - DNA, 22 bp, Artificial Sequence
  chemically synthesized
tcctaaattcactgaataattt

SEQ ID NO: 1182821 - DNA, 22 bp, Artificial Sequence
  chemically synthesized
cctaaattcactgaataatttt

SEQ ID NO: 1182822 - DNA, 22 bp, Artificial Sequence
  chemically synthesized
ctaaattcactgaataattttc

SEQ ID NO: 1182823 - DNA, 22 bp, Artificial Sequence
  chemically synthesized
aattcactgaataattttcaat

SEQ ID NO: 1182824 - DNA, 22 bp, Artificial Sequence
  chemically synthesized
aaataacatgatgattgaaaat

SEQ ID NO: 1182825 - DNA, 22 bp, Artificial Sequence
  chemically synthesized
actgaataattttcaatcatca

SEQ ID NO: 1182826 - DNA, 22 bp, Artificial Sequence
  chemically synthesized
aataattttcaatcatcatgtt

SEQ ID NO: 1182827 - DNA, 22 bp, Artificial Sequence
  chemically synthesized
atgagttcaaataacatgatga

SEQ ID NO: 1182828 - DNA, 22 bp, Artificial Sequence
  chemically synthesized
ctgatgagttcaaataacatga

SEQ ID NO: 1182829 - DNA, 22 bp, Artificial Sequence
  chemically synthesized
tcaatcatcatgttatttgaac

SEQ ID NO: 1182830 - DNA, 22 bp, Artificial Sequence
  chemically synthesized
caatcatcatgttatttgaact

SEQ ID NO: 1182831 - DNA, 22 bp, Artificial Sequence
  chemically synthesized
aatcatcatgttatttgaactc

SEQ ID NO: 1182832 - DNA, 22 bp, Artificial Sequence
  chemically synthesized
aatattgctgatgagttcaaat

SEQ ID NO: 1182833 - DNA, 22 bp, Artificial Sequence
  chemically synthesized
cattaaatattgctgatgagtt

SEQ ID NO: 1182834 - DNA, 22 bp, Artificial Sequence
  chemically synthesized
actacattaaatattgctgatg

SEQ ID NO: 1182835 - DNA, 22 bp, Artificial Sequence
  chemically synthesized
tttgaactcatcagcaatattt

SEQ ID NO: 1182836 - DNA, 22 bp, Artificial Sequence
  chemically synthesized
gaactcatcagcaatatttaat

SEQ ID NO: 1182837 - DNA, 22 bp, Artificial Sequence
  chemically synthesized
aactcatcagcaatatttaatg

SEQ ID NO: 1182838 - DNA, 22 bp, Artificial Sequence
  chemically synthesized
atcagcaatatttaatgtagtt

SEQ ID NO: 1182839 - DNA, 22 bp, Artificial Sequence
  chemically synthesized
agagaaaggaagatacctaact

SEQ ID NO: 1182840 - DNA, 22 bp, Artificial Sequence
  chemically synthesized
cagagaaaggaagatacctaac

SEQ ID NO: 1182841 - DNA, 22 bp, Artificial Sequence
  chemically synthesized
tcagagaaaggaagatacctaa

SEQ ID NO: 1182842 - DNA, 22 bp, Artificial Sequence
  chemically synthesized
aatgtagttaggtatcttcctt

SEQ ID NO: 1182843 - DNA, 22 bp, Artificial Sequence
  chemically synthesized
atgtagttaggtatcttccttt

SEQ ID NO: 1182844 - DNA, 22 bp, Artificial Sequence
  chemically synthesized
ggtatcttcctttctctgaaaa

SEQ ID NO: 1182845 - DNA, 22 bp, Artificial Sequence
  chemically synthesized
gaatccagaagaaagtgttttc

SEQ ID NO: 1182846 - DNA, 22 bp, Artificial Sequence
  chemically synthesized
tggaatccagaagaaagtgttt

SEQ ID NO: 1182847 - DNA, 22 bp, Artificial Sequence
  chemically synthesized
cctttctctgaaaacactttct

SEQ ID NO: 1182848 - DNA, 22 bp, Artificial Sequence
  chemically synthesized
ctttctctgaaaacactttctt

SEQ ID NO: 1182849 - DNA, 22 bp, Artificial Sequence
  chemically synthesized
tctctgaaaacactttcttctg

SEQ ID NO: 1182850 - DNA, 22 bp, Artificial Sequence
  chemically synthesized
ctctgaaaacactttcttctgg

SEQ ID NO: 1182851 - DNA, 22 bp, Artificial Sequence
  chemically synthesized
tctgaaaacactttcttctgga

SEQ ID NO: 1182852 - DNA, 22 bp, Artificial Sequence
  chemically synthesized
tgaaaacactttcttctggatt

SEQ ID NO: 1182853 - DNA, 22 bp, Artificial Sequence
  chemically synthesized
aaaacactttcttctggattcc

SEQ ID NO: 1182854 - DNA, 22 bp, Artificial Sequence
  chemically synthesized
tcttctggattccagaatgcca

SEQ ID NO: 1182855 - DNA, 22 bp, Artificial Sequence
  chemically synthesized
cttctggattccagaatgccac

SEQ ID NO: 1182856 - DNA, 22 bp, Artificial Sequence
  chemically synthesized
ttctggattccagaatgccaca

SEQ ID NO: 1182857 - DNA, 22 bp, Artificial Sequence
  chemically synthesized
ctggattccagaatgccacatc

SEQ ID NO: 1182858 - DNA, 22 bp, Artificial Sequence
  chemically synthesized
tggattccagaatgccacatct

SEQ ID NO: 1182859 - DNA, 22 bp, Artificial Sequence
  chemically synthesized
gattccagaatgccacatctat

SEQ ID NO: 1182860 - DNA, 22 bp, Artificial Sequence
  chemically synthesized
cagaatgccacatctatcttct

SEQ ID NO: 1182861 - DNA, 22 bp, Artificial Sequence
  chemically synthesized
gaaaggggagagaaaaaggaga

SEQ ID NO: 1182862 - DNA, 22 bp, Artificial Sequence
  chemically synthesized
tcttctcctttttctctcccct

SEQ ID NO: 1182863 - DNA, 22 bp, Artificial Sequence
  chemically synthesized
ctcctttttctctcccctttct

SEQ ID NO: 1182864 - DNA, 22 bp, Artificial Sequence
  chemically synthesized
aaaaaggtggctagaaagggga

SEQ ID NO: 1182865 - DNA, 22 bp, Artificial Sequence
  chemically synthesized
tcctttttctctcccctttcta

SEQ ID NO: 1182866 - DNA, 22 bp, Artificial Sequence
  chemically synthesized
ctttttctctcccctttctagc

SEQ ID NO: 1182867 - DNA, 22 bp, Artificial Sequence
  chemically synthesized
tttctctcccctttctagccac

SEQ ID NO: 1182868 - DNA, 22 bp, Artificial Sequence
  chemically synthesized
ttctctcccctttctagccacc

SEQ ID NO: 1182869 - DNA, 22 bp, Artificial Sequence
  chemically synthesized
tctctcccctttctagccacct

SEQ ID NO: 1182870 - DNA, 22 bp, Artificial Sequence
  chemically synthesized
ctctcccctttctagccacctt

SEQ ID NO: 1182871 - DNA, 22 bp, Artificial Sequence
  chemically synthesized
tctcccctttctagccaccttt

SEQ ID NO: 1182872 - DNA, 22 bp, Artificial Sequence
  chemically synthesized
tcccctttctagccaccttttt

SEQ ID NO: 1182873 - DNA, 22 bp, Artificial Sequence
  chemically synthesized
ccctttctagccacctttttca

SEQ ID NO: 1182874 - DNA, 22 bp, Artificial Sequence
  chemically synthesized
tctagccacctttttcagcccc

SEQ ID NO: 1182875 - DNA, 22 bp, Artificial Sequence
  chemically synthesized
ctagccacctttttcagcccct

SEQ ID NO: 1182876 - DNA, 22 bp, Artificial Sequence
  chemically synthesized
tagccacctttttcagcccctt

SEQ ID NO: 1182877 - DNA, 22 bp, Artificial Sequence
  chemically synthesized
gccacctttttcagcccctttg

SEQ ID NO: 1182878 - DNA, 22 bp, Artificial Sequence
  chemically synthesized
tttcagcccctttgctgatgcc

SEQ ID NO: 1182879 - DNA, 22 bp, Artificial Sequence
  chemically synthesized
ttcagcccctttgctgatgcct

SEQ ID NO: 1182880 - DNA, 22 bp, Artificial Sequence
  chemically synthesized
tcagcccctttgctgatgcctc

SEQ ID NO: 1182881 - DNA, 22 bp, Artificial Sequence
  chemically synthesized
cagcccctttgctgatgcctca

SEQ ID NO: 1182882 - DNA, 22 bp, Artificial Sequence
  chemically synthesized
agcccctttgctgatgcctcat

SEQ ID NO: 1182883 - DNA, 22 bp, Artificial Sequence
  chemically synthesized
gatgtatatatgatgaggcatc

SEQ ID NO: 1182884 - DNA, 22 bp, Artificial Sequence
  chemically synthesized
tagatgtatatatgatgaggca

SEQ ID NO: 1182885 - DNA, 22 bp, Artificial Sequence
  chemically synthesized
tgctgatgcctcatcatatata

SEQ ID NO: 1182886 - DNA, 22 bp, Artificial Sequence
  chemically synthesized
gctgatgcctcatcatatatac

SEQ ID NO: 1182887 - DNA, 22 bp, Artificial Sequence
  chemically synthesized
ctgatgcctcatcatatataca

SEQ ID NO: 1182888 - DNA, 22 bp, Artificial Sequence
  chemically synthesized
atgcctcatcatatatacatct

SEQ ID NO: 1182889 - DNA, 22 bp, Artificial Sequence
  chemically synthesized
atcatatatacatctagagatc

SEQ ID NO: 1182890 - DNA, 22 bp, Artificial Sequence
  chemically synthesized
ccaaggaaaaatgtgtagacag

SEQ ID NO: 1182891 - DNA, 22 bp, Artificial Sequence
  chemically synthesized
gagatctcatctgtctacacat

SEQ ID NO: 1182892 - DNA, 22 bp, Artificial Sequence
  chemically synthesized
atctgtctacacatttttcctt

SEQ ID NO: 1182893 - DNA, 22 bp, Artificial Sequence
  chemically synthesized
tctacacatttttccttggcaa

SEQ ID NO: 1182894 - DNA, 22 bp, Artificial Sequence
  chemically synthesized
cacatttttccttggcaatctt

SEQ ID NO: 1182895 - DNA, 22 bp, Artificial Sequence
  chemically synthesized
aatccatcggccaggataagat

SEQ ID NO: 1182896 - DNA, 22 bp, Artificial Sequence
  chemically synthesized
aaatccatcggccaggataaga

SEQ ID NO: 1182897 - DNA, 22 bp, Artificial Sequence
  chemically synthesized
ttccttggcaatcttatcctgg

SEQ ID NO: 1182898 - DNA, 22 bp, Artificial Sequence
  chemically synthesized
tccttggcaatcttatcctggc

SEQ ID NO: 1182899 - DNA, 22 bp, Artificial Sequence
  chemically synthesized
ccttggcaatcttatcctggcc

SEQ ID NO: 1182900 - DNA, 22 bp, Artificial Sequence
  chemically synthesized
tttaaatccatcggccaggata

SEQ ID NO: 1182901 - DNA, 22 bp, Artificial Sequence
  chemically synthesized
cttggcaatcttatcctggccg

SEQ ID NO: 1182902 - DNA, 22 bp, Artificial Sequence
  chemically synthesized
ggcaatcttatcctggccgatg

SEQ ID NO: 1182903 - DNA, 22 bp, Artificial Sequence
  chemically synthesized
gcaatcttatcctggccgatgg

SEQ ID NO: 1182904 - DNA, 22 bp, Artificial Sequence
  chemically synthesized
atcctggccgatggatttaaat

SEQ ID NO: 1182905 - DNA, 22 bp, Artificial Sequence
  chemically synthesized
tcctggccgatggatttaaata

SEQ ID NO: 1182906 - DNA, 22 bp, Artificial Sequence
  chemically synthesized
gccgatggatttaaataacatc

SEQ ID NO: 1182907 - DNA, 22 bp, Artificial Sequence
  chemically synthesized
gaagtcaacacatagatgttat

SEQ ID NO: 1182908 - DNA, 22 bp, Artificial Sequence
  chemically synthesized
agaagtcaacacatagatgtta

SEQ ID NO: 1182909 - DNA, 22 bp, Artificial Sequence
  chemically synthesized
aaataacatctatgtgttgact

SEQ ID NO: 1182910 - DNA, 22 bp, Artificial Sequence
  chemically synthesized
aataacatctatgtgttgactt

SEQ ID NO: 1182911 - DNA, 22 bp, Artificial Sequence
  chemically synthesized
aggataataatttagaagtcaa

SEQ ID NO: 1182912 - DNA, 22 bp, Artificial Sequence
  chemically synthesized
tgtgttgacttctaaattatta

SEQ ID NO: 1182913 - DNA, 22 bp, Artificial Sequence
  chemically synthesized
agatcagagttgaggataataa

SEQ ID NO: 1182914 - DNA, 22 bp, Artificial Sequence
  chemically synthesized
taagatcagagttgaggataat

SEQ ID NO: 1182915 - DNA, 22 bp, Artificial Sequence
  chemically synthesized
acttctaaattattatcctcaa

SEQ ID NO: 1182916 - DNA, 22 bp, Artificial Sequence
  chemically synthesized
ctaaattattatcctcaactct

SEQ ID NO: 1182917 - DNA, 22 bp, Artificial Sequence
  chemically synthesized
taaattattatcctcaactctg

SEQ ID NO: 1182918 - DNA, 22 bp, Artificial Sequence
  chemically synthesized
aattattatcctcaactctgat

SEQ ID NO: 1182919 - DNA, 22 bp, Artificial Sequence
  chemically synthesized
ttatcctcaactctgatcttag

SEQ ID NO: 1182920 - DNA, 22 bp, Artificial Sequence
  chemically synthesized
tcctcaactctgatcttagaac

SEQ ID NO: 1182921 - DNA, 22 bp, Artificial Sequence
  chemically synthesized
aactctgatcttagaacccctt

SEQ ID NO: 1182922 - DNA, 22 bp, Artificial Sequence
  chemically synthesized
tgaatgcatgtaaagaaggggt

SEQ ID NO: 1182923 - DNA, 22 bp, Artificial Sequence
  chemically synthesized
tgatcttagaaccccttcttta

SEQ ID NO: 1182924 - DNA, 22 bp, Artificial Sequence
  chemically synthesized
atcttagaaccccttctttaca

SEQ ID NO: 1182925 - DNA, 22 bp, Artificial Sequence
  chemically synthesized
tgaggctatgaatgcatgtaaa

SEQ ID NO: 1182926 - DNA, 22 bp, Artificial Sequence
  chemically synthesized
agaaccccttctttacatgcat

SEQ ID NO: 1182927 - DNA, 22 bp, Artificial Sequence
  chemically synthesized
gaaccccttctttacatgcatt

SEQ ID NO: 1182928 - DNA, 22 bp, Artificial Sequence
  chemically synthesized
aggtgcctatgaggctatgaat

SEQ ID NO: 1182929 - DNA, 22 bp, Artificial Sequence
  chemically synthesized
gaggtgcctatgaggctatgaa

SEQ ID NO: 1182930 - DNA, 22 bp, Artificial Sequence
  chemically synthesized
ctttacatgcattcatagcctc

SEQ ID NO: 1182931 - DNA, 22 bp, Artificial Sequence
  chemically synthesized
tttacatgcattcatagcctca

SEQ ID NO: 1182932 - DNA, 22 bp, Artificial Sequence
  chemically synthesized
tacatgcattcatagcctcata

SEQ ID NO: 1182933 - DNA, 22 bp, Artificial Sequence
  chemically synthesized
acatgcattcatagcctcatag

SEQ ID NO: 1182934 - DNA, 22 bp, Artificial Sequence
  chemically synthesized
atcttgaggtgcctatgaggct

SEQ ID NO: 1182935 - DNA, 22 bp, Artificial Sequence
  chemically synthesized
catgcattcatagcctcatagg

SEQ ID NO: 1182936 - DNA, 22 bp, Artificial Sequence
  chemically synthesized
aacatattaatcttgaggtgcc

SEQ ID NO: 1182937 - DNA, 22 bp, Artificial Sequence
  chemically synthesized
atagcctcataggcacctcaag

SEQ ID NO: 1182938 - DNA, 22 bp, Artificial Sequence
  chemically synthesized
aaacatattaatcttgaggtgc

SEQ ID NO: 1182939 - DNA, 22 bp, Artificial Sequence
  chemically synthesized
taaacatattaatcttgaggtg

SEQ ID NO: 1182940 - DNA, 22 bp, Artificial Sequence
  chemically synthesized
agttttaaacatattaatcttg

SEQ ID NO: 1182941 - DNA, 22 bp, Artificial Sequence
  chemically synthesized
cagttttaaacatattaatctt

SEQ ID NO: 1182942 - DNA, 22 bp, Artificial Sequence
  chemically synthesized
ataggcacctcaagattaatat

SEQ ID NO: 1182943 - DNA, 22 bp, Artificial Sequence
  chemically synthesized
ggatttcagttttaaacatatt

SEQ ID NO: 1182944 - DNA, 22 bp, Artificial Sequence
  chemically synthesized
aagattaatatgtttaaaactg

SEQ ID NO: 1182945 - DNA, 22 bp, Artificial Sequence
  chemically synthesized
atatgtttaaaactgaaatcct

SEQ ID NO: 1182946 - DNA, 22 bp, Artificial Sequence
  chemically synthesized
ggagtgaacgttaggatttcag

SEQ ID NO: 1182947 - DNA, 22 bp, Artificial Sequence
  chemically synthesized
gggagtgaacgttaggatttca

SEQ ID NO: 1182948 - DNA, 22 bp, Artificial Sequence
  chemically synthesized
aaaactgaaatcctaacgttca

SEQ ID NO: 1182949 - DNA, 22 bp, Artificial Sequence
  chemically synthesized
aaactgaaatcctaacgttcac

SEQ ID NO: 1182950 - DNA, 22 bp, Artificial Sequence
  chemically synthesized
aaatcctaacgttcactcccaa

SEQ ID NO: 1182951 - DNA, 22 bp, Artificial Sequence
  chemically synthesized
tagaaggaacaggtttgggagt

SEQ ID NO: 1182952 - DNA, 22 bp, Artificial Sequence
  chemically synthesized
acgttcactcccaaacctgttc

SEQ ID NO: 1182953 - DNA, 22 bp, Artificial Sequence
  chemically synthesized
actcccaaacctgttccttcta

SEQ ID NO: 1182954 - DNA, 22 bp, Artificial Sequence
  chemically synthesized
ccaaacctgttccttctacagt

SEQ ID NO: 1182955 - DNA, 22 bp, Artificial Sequence
  chemically synthesized
ttccttctacagtctcacccat

SEQ ID NO: 1182956 - DNA, 22 bp, Artificial Sequence
  chemically synthesized
ccacaaaccaagatgggtgaga

SEQ ID NO: 1182957 - DNA, 22 bp, Artificial Sequence
  chemically synthesized
cttctacagtctcacccatctt

SEQ ID NO: 1182958 - DNA, 22 bp, Artificial Sequence
  chemically synthesized
ctacagtctcacccatcttggt

SEQ ID NO: 1182959 - DNA, 22 bp, Artificial Sequence
  chemically synthesized
tacagtctcacccatcttggtt

SEQ ID NO: 1182960 - DNA, 22 bp, Artificial Sequence
  chemically synthesized
cagtctcacccatcttggtttg

SEQ ID NO: 1182961 - DNA, 22 bp, Artificial Sequence
  chemically synthesized
gccaaatagagttgccacaaac

SEQ ID NO: 1182962 - DNA, 22 bp, Artificial Sequence
  chemically synthesized
acccatcttggtttgtggcaac

SEQ ID NO: 1182963 - DNA, 22 bp, Artificial Sequence
  chemically synthesized
agcaactggccaaatagagttg

SEQ ID NO: 1182964 - DNA, 22 bp, Artificial Sequence
  chemically synthesized
aagcaactggccaaatagagtt

SEQ ID NO: 1182965 - DNA, 22 bp, Artificial Sequence
  chemically synthesized
ggtttgtggcaactctatttgg

SEQ ID NO: 1182966 - DNA, 22 bp, Artificial Sequence
  chemically synthesized
gtttgtggcaactctatttggc

SEQ ID NO: 1182967 - DNA, 22 bp, Artificial Sequence
  chemically synthesized
cttaagcaactggccaaataga

SEQ ID NO: 1182968 - DNA, 22 bp, Artificial Sequence
  chemically synthesized
acttaagcaactggccaaatag

SEQ ID NO: 1182969 - DNA, 22 bp, Artificial Sequence
  chemically synthesized
ttacttaagcaactggccaaat

SEQ ID NO: 1182970 - DNA, 22 bp, Artificial Sequence
  chemically synthesized
gtggcaactctatttggccagt

SEQ ID NO: 1182971 - DNA, 22 bp, Artificial Sequence
  chemically synthesized
cttacttaagcaactggccaaa

SEQ ID NO: 1182972 - DNA, 22 bp, Artificial Sequence
  chemically synthesized
tggcaactctatttggccagtt

SEQ ID NO: 1182973 - DNA, 22 bp, Artificial Sequence
  chemically synthesized
tatttggccagttgcttaagta

SEQ ID NO: 1182974 - DNA, 22 bp, Artificial Sequence
  chemically synthesized
ccgtgaggtttcttacttaagc

SEQ ID NO: 1182975 - DNA, 22 bp, Artificial Sequence
  chemically synthesized
tttggccagttgcttaagtaag

SEQ ID NO: 1182976 - DNA, 22 bp, Artificial Sequence
  chemically synthesized
ggccagttgcttaagtaagaaa

SEQ ID NO: 1182977 - DNA, 22 bp, Artificial Sequence
  chemically synthesized
gccagttgcttaagtaagaaac

SEQ ID NO: 1182978 - DNA, 22 bp, Artificial Sequence
  chemically synthesized
cttaagtaagaaacctcacggt

SEQ ID NO: 1182979 - DNA, 22 bp, Artificial Sequence
  chemically synthesized
aagtaagaaacctcacggtaat

SEQ ID NO: 1182980 - DNA, 22 bp, Artificial Sequence
  chemically synthesized
gagaaatcaaggattaccgtga

SEQ ID NO: 1182981 - DNA, 22 bp, Artificial Sequence
  chemically synthesized
agtaagaaacctcacggtaatc

SEQ ID NO: 1182982 - DNA, 22 bp, Artificial Sequence
  chemically synthesized
tgaaataattagagaaatcaag

SEQ ID NO: 1182983 - DNA, 22 bp, Artificial Sequence
  chemically synthesized
atgaaataattagagaaatcaa

SEQ ID NO: 1182984 - DNA, 22 bp, Artificial Sequence
  chemically synthesized
acggtaatccttgatttctcta

SEQ ID NO: 1182985 - DNA, 22 bp, Artificial Sequence
  chemically synthesized
gatttctctaattatttcataa

SEQ ID NO: 1182986 - DNA, 22 bp, Artificial Sequence
  chemically synthesized
atttctctaattatttcataag

SEQ ID NO: 1182987 - DNA, 22 bp, Artificial Sequence
  chemically synthesized
atgcagtagatgtgacttatga

SEQ ID NO: 1182988 - DNA, 22 bp, Artificial Sequence
  chemically synthesized
ctctaattatttcataagtcac

SEQ ID NO: 1182989 - DNA, 22 bp, Artificial Sequence
  chemically synthesized
tctaattatttcataagtcaca

SEQ ID NO: 1182990 - DNA, 22 bp, Artificial Sequence
  chemically synthesized
ctgatgcagtagatgtgactta

SEQ ID NO: 1182991 - DNA, 22 bp, Artificial Sequence
  chemically synthesized
taattatttcataagtcacatc

SEQ ID NO: 1182992 - DNA, 22 bp, Artificial Sequence
  chemically synthesized
attatttcataagtcacatcta

SEQ ID NO: 1182993 - DNA, 22 bp, Artificial Sequence
  chemically synthesized
cctcctgatgcagtagatgtga

SEQ ID NO: 1182994 - DNA, 22 bp, Artificial Sequence
  chemically synthesized
ccctcctgatgcagtagatgtg

SEQ ID NO: 1182995 - DNA, 22 bp, Artificial Sequence
  chemically synthesized
tttcataagtcacatctactgc

SEQ ID NO: 1182996 - DNA, 22 bp, Artificial Sequence
  chemically synthesized
cataagtcacatctactgcatc

SEQ ID NO: 1182997 - DNA, 22 bp, Artificial Sequence
  chemically synthesized
ataagtcacatctactgcatca

SEQ ID NO: 1182998 - DNA, 22 bp, Artificial Sequence
  chemically synthesized
atcaaagtcatttccctcctga

SEQ ID NO: 1182999 - DNA, 22 bp, Artificial Sequence
  chemically synthesized
catcaaagtcatttccctcctg

SEQ ID NO: 1183000 - DNA, 22 bp, Artificial Sequence
  chemically synthesized
ctgcatcaggagggaaatgact

SEQ ID NO: 1183001 - DNA, 22 bp, Artificial Sequence
  chemically synthesized
catcaggagggaaatgactttg

SEQ ID NO: 1183002 - DNA, 22 bp, Artificial Sequence
  chemically synthesized
gaggccaatatttcatcaaagt

SEQ ID NO: 1183003 - DNA, 22 bp, Artificial Sequence
  chemically synthesized
gtagcagaattggaggccaata

SEQ ID NO: 1183004 - DNA, 22 bp, Artificial Sequence
  chemically synthesized
tgatgaaatattggcctccaat

SEQ ID NO: 1183005 - DNA, 22 bp, Artificial Sequence
  chemically synthesized
gatgaaatattggcctccaatt

SEQ ID NO: 1183006 - DNA, 22 bp, Artificial Sequence
  chemically synthesized
atgaaatattggcctccaattc

SEQ ID NO: 1183007 - DNA, 22 bp, Artificial Sequence
  chemically synthesized
gcatagcatatctggtagcaga

SEQ ID NO: 1183008 - DNA, 22 bp, Artificial Sequence
  chemically synthesized
tagcatagcatatctggtagca

SEQ ID NO: 1183009 - DNA, 22 bp, Artificial Sequence
  chemically synthesized
gcctccaattctgctaccagat

SEQ ID NO: 1183010 - DNA, 22 bp, Artificial Sequence
  chemically synthesized
caattctgctaccagatatgct

SEQ ID NO: 1183011 - DNA, 22 bp, Artificial Sequence
  chemically synthesized
atgatcctctagcatagcatat

SEQ ID NO: 1183012 - DNA, 22 bp, Artificial Sequence
  chemically synthesized
catgatcctctagcatagcata

SEQ ID NO: 1183013 - DNA, 22 bp, Artificial Sequence
  chemically synthesized
tgctaccagatatgctatgcta

SEQ ID NO: 1183014 - DNA, 22 bp, Artificial Sequence
  chemically synthesized
tttcatgatcctctagcatagc

SEQ ID NO: 1183015 - DNA, 22 bp, Artificial Sequence
  chemically synthesized
ctaccagatatgctatgctaga

SEQ ID NO: 1183016 - DNA, 22 bp, Artificial Sequence
  chemically synthesized
tgtttcatgatcctctagcata

SEQ ID NO: 1183017 - DNA, 22 bp, Artificial Sequence
  chemically synthesized
ctgtttcatgatcctctagcat

SEQ ID NO: 1183018 - DNA, 22 bp, Artificial Sequence
  chemically synthesized
ccagatatgctatgctagagga

SEQ ID NO: 1183019 - DNA, 22 bp, Artificial Sequence
  chemically synthesized
tctgtttcatgatcctctagca

SEQ ID NO: 1183020 - DNA, 22 bp, Artificial Sequence
  chemically synthesized
ttctgtttcatgatcctctagc

SEQ ID NO: 1183021 - DNA, 22 bp, Artificial Sequence
  chemically synthesized
tgagcttttctgtttcatgatc

SEQ ID NO: 1183022 - DNA, 22 bp, Artificial Sequence
  chemically synthesized
tgctagaggatcatgaaacaga

SEQ ID NO: 1183023 - DNA, 22 bp, Artificial Sequence
  chemically synthesized
tctgtgagcttttctgtttcat

SEQ ID NO: 1183024 - DNA, 22 bp, Artificial Sequence
  chemically synthesized
atctgtgagcttttctgtttca

SEQ ID NO: 1183025 - DNA, 22 bp, Artificial Sequence
  chemically synthesized
tatctgtgagcttttctgtttc

SEQ ID NO: 1183026 - DNA, 22 bp, Artificial Sequence
  chemically synthesized
gaggatcatgaaacagaaaagc

SEQ ID NO: 1183027 - DNA, 22 bp, Artificial Sequence
  chemically synthesized
attttatctgtgagcttttctg

SEQ ID NO: 1183028 - DNA, 22 bp, Artificial Sequence
  chemically synthesized
aattttatctgtgagcttttct

SEQ ID NO: 1183029 - DNA, 22 bp, Artificial Sequence
  chemically synthesized
taattttatctgtgagcttttc

SEQ ID NO: 1183030 - DNA, 22 bp, Artificial Sequence
  chemically synthesized
ttaattttatctgtgagctttt

SEQ ID NO: 1183031 - DNA, 22 bp, Artificial Sequence
  chemically synthesized
acagataaaattaaaaggctca

SEQ ID NO: 1183032 - DNA, 22 bp, Artificial Sequence
  chemically synthesized
aaaggctcatatcataccattt

SEQ ID NO: 1183033 - DNA, 22 bp, Artificial Sequence
  chemically synthesized
atatcataccatttattttttt

SEQ ID NO: 1183034 - DNA, 22 bp, Artificial Sequence
  chemically synthesized
aaaaatacataaataaaaaaaa

SEQ ID NO: 1183035 - DNA, 22 bp, Artificial Sequence
  chemically synthesized
tctcaaaaatacataaataaaa

SEQ ID NO: 1183036 - DNA, 22 bp, Artificial Sequence
  chemically synthesized
tgtctcaaaaatacataaataa

SEQ ID NO: 1183037 - DNA, 22 bp, Artificial Sequence
  chemically synthesized
attttttttatttatgtatttt

SEQ ID NO: 1183038 - DNA, 22 bp, Artificial Sequence
  chemically synthesized
ttttttttatttatgtattttt

SEQ ID NO: 1183039 - DNA, 22 bp, Artificial Sequence
  chemically synthesized
tttttatttatgtatttttgag

SEQ ID NO: 1183040 - DNA, 22 bp, Artificial Sequence
  chemically synthesized
ttttatttatgtatttttgaga

SEQ ID NO: 1183041 - DNA, 22 bp, Artificial Sequence
  chemically synthesized
tttatttatgtatttttgagac

SEQ ID NO: 1183042 - DNA, 22 bp, Artificial Sequence
  chemically synthesized
ttatttatgtatttttgagaca

SEQ ID NO: 1183043 - DNA, 22 bp, Artificial Sequence
  chemically synthesized
tatttatgtatttttgagacag

SEQ ID NO: 1183044 - DNA, 22 bp, Artificial Sequence
  chemically synthesized
atttatgtatttttgagacaga

SEQ ID NO: 1183045 - DNA, 22 bp, Artificial Sequence
  chemically synthesized
tttatgtatttttgagacagag

SEQ ID NO: 1183046 - DNA, 22 bp, Artificial Sequence
  chemically synthesized
atgtatttttgagacagagttt

SEQ ID NO: 1183047 - DNA, 22 bp, Artificial Sequence
  chemically synthesized
tgtatttttgagacagagtttc

SEQ ID NO: 1183048 - DNA, 22 bp, Artificial Sequence
  chemically synthesized
ttgagacagagtttcactcttg

SEQ ID NO: 1183049 - DNA, 22 bp, Artificial Sequence
  chemically synthesized
cagcatgggcaacaagagtgaa

SEQ ID NO: 1183050 - DNA, 22 bp, Artificial Sequence
  chemically synthesized
tgagacagagtttcactcttgt

SEQ ID NO: 1183051 - DNA, 22 bp, Artificial Sequence
  chemically synthesized
gagacagagtttcactcttgtt

SEQ ID NO: 1183052 - DNA, 22 bp, Artificial Sequence
  chemically synthesized
agacagagtttcactcttgttg

SEQ ID NO: 1183053 - DNA, 22 bp, Artificial Sequence
  chemically synthesized
cactacagcatgggcaacaaga

SEQ ID NO: 1183054 - DNA, 22 bp, Artificial Sequence
  chemically synthesized
cactcttgttgcccatgctgta

SEQ ID NO: 1183055 - DNA, 22 bp, Artificial Sequence
  chemically synthesized
actcttgttgcccatgctgtag

SEQ ID NO: 1183056 - DNA, 22 bp, Artificial Sequence
  chemically synthesized
ttgttgcccatgctgtagtgca

SEQ ID NO: 1183057 - DNA, 22 bp, Artificial Sequence
  chemically synthesized
aaatcatgccattgcactacag

SEQ ID NO: 1183058 - DNA, 22 bp, Artificial Sequence
  chemically synthesized
gttgcccatgctgtagtgcaat

SEQ ID NO: 1183059 - DNA, 22 bp, Artificial Sequence
  chemically synthesized
ttgcccatgctgtagtgcaatg

SEQ ID NO: 1183060 - DNA, 22 bp, Artificial Sequence
  chemically synthesized
cccatgctgtagtgcaatggca

SEQ ID NO: 1183061 - DNA, 22 bp, Artificial Sequence
  chemically synthesized
cagtgagttgaaatcatgccat

SEQ ID NO: 1183062 - DNA, 22 bp, Artificial Sequence
  chemically synthesized
tagtgcaatggcatgatttcaa

SEQ ID NO: 1183063 - DNA, 22 bp, Artificial Sequence
  chemically synthesized
aacccgggaggtggaggttgca

SEQ ID NO: 1183064 - DNA, 22 bp, Artificial Sequence
  chemically synthesized
gaacccgggaggtggaggttgc

SEQ ID NO: 1183065 - DNA, 22 bp, Artificial Sequence
  chemically synthesized
caactcactgcaacctccacct

SEQ ID NO: 1183066 - DNA, 22 bp, Artificial Sequence
  chemically synthesized
aactcactgcaacctccacctc

SEQ ID NO: 1183067 - DNA, 22 bp, Artificial Sequence
  chemically synthesized
actgcaacctccacctcccggg

SEQ ID NO: 1183068 - DNA, 22 bp, Artificial Sequence
  chemically synthesized
caacctccacctcccgggttca

SEQ ID NO: 1183069 - DNA, 22 bp, Artificial Sequence
  chemically synthesized
aggcaggagaatcacttgaacc

SEQ ID NO: 1183070 - DNA, 22 bp, Artificial Sequence
  chemically synthesized
cacctcccgggttcaagtgatt

SEQ ID NO: 1183071 - DNA, 22 bp, Artificial Sequence
  chemically synthesized
ccgggttcaagtgattctcctg

SEQ ID NO: 1183072 - DNA, 22 bp, Artificial Sequence
  chemically synthesized
gggaggctgaggcaggagaatc

SEQ ID NO: 1183073 - DNA, 22 bp, Artificial Sequence
  chemically synthesized
ctcgggaggctgaggcaggaga

SEQ ID NO: 1183074 - DNA, 22 bp, Artificial Sequence
  chemically synthesized
aagtgattctcctgcctcagcc

SEQ ID NO: 1183075 - DNA, 22 bp, Artificial Sequence
  chemically synthesized
taatcccagctactcgggaggc

SEQ ID NO: 1183076 - DNA, 22 bp, Artificial Sequence
  chemically synthesized
tcctgcctcagcctcccgagta

SEQ ID NO: 1183077 - DNA, 22 bp, Artificial Sequence
  chemically synthesized
ctgcctcagcctcccgagtagc

SEQ ID NO: 1183078 - DNA, 22 bp, Artificial Sequence
  chemically synthesized
cctcagcctcccgagtagctgg

SEQ ID NO: 1183079 - DNA, 22 bp, Artificial Sequence
  chemically synthesized
agcctcccgagtagctgggatt

SEQ ID NO: 1183080 - DNA, 22 bp, Artificial Sequence
  chemically synthesized
ccgagtagctgggattacaggt

SEQ ID NO: 1183081 - DNA, 22 bp, Artificial Sequence
  chemically synthesized
ggtgtggtggcgcacacctgta

SEQ ID NO: 1183082 - DNA, 22 bp, Artificial Sequence
  chemically synthesized
gctgggtgtggtggcgcacacc

SEQ ID NO: 1183083 - DNA, 22 bp, Artificial Sequence
  chemically synthesized
ggattacaggtgtgcgccacca

SEQ ID NO: 1183084 - DNA, 22 bp, Artificial Sequence
  chemically synthesized
caggtgtgcgccaccacaccca

SEQ ID NO: 1183085 - DNA, 22 bp, Artificial Sequence
  chemically synthesized
aaaatacaaaattagctgggtg

SEQ ID NO: 1183086 - DNA, 22 bp, Artificial Sequence
  chemically synthesized
ctaaaaatacaaaattagctgg

SEQ ID NO: 1183087 - DNA, 22 bp, Artificial Sequence
  chemically synthesized
tactaaaaatacaaaattagct

SEQ ID NO: 1183088 - DNA, 22 bp, Artificial Sequence
  chemically synthesized
attttgtatttttagtagagat

SEQ ID NO: 1183089 - DNA, 22 bp, Artificial Sequence
  chemically synthesized
tgtatttttagtagagatgggg

SEQ ID NO: 1183090 - DNA, 22 bp, Artificial Sequence
  chemically synthesized
gtatttttagtagagatggggt

SEQ ID NO: 1183091 - DNA, 22 bp, Artificial Sequence
  chemically synthesized
tatttttagtagagatggggtt

SEQ ID NO: 1183092 - DNA, 22 bp, Artificial Sequence
  chemically synthesized
ttagtagagatggggttttacc

SEQ ID NO: 1183093 - DNA, 22 bp, Artificial Sequence
  chemically synthesized
tagtagagatggggttttacca

SEQ ID NO: 1183094 - DNA, 22 bp, Artificial Sequence
  chemically synthesized
agtagagatggggttttaccat

SEQ ID NO: 1183095 - DNA, 22 bp, Artificial Sequence
  chemically synthesized
gtagagatggggttttaccatg

SEQ ID NO: 1183096 - DNA, 22 bp, Artificial Sequence
  chemically synthesized
gagaccaaccgaaccaacatgg

SEQ ID NO: 1183097 - DNA, 22 bp, Artificial Sequence
  chemically synthesized
taccatgttggttcggttggtc

SEQ ID NO: 1183098 - DNA, 22 bp, Artificial Sequence
  chemically synthesized
accatgttggttcggttggtct

SEQ ID NO: 1183099 - DNA, 22 bp, Artificial Sequence
  chemically synthesized
ccatgttggttcggttggtctc

SEQ ID NO: 1183100 - DNA, 22 bp, Artificial Sequence
  chemically synthesized
aggtcagagttcgagaccaacc

SEQ ID NO: 1183101 - DNA, 22 bp, Artificial Sequence
  chemically synthesized
gttcggttggtctcgaactctg

SEQ ID NO: 1183102 - DNA, 22 bp, Artificial Sequence
  chemically synthesized
ggttggtctcgaactctgacct

SEQ ID NO: 1183103 - DNA, 22 bp, Artificial Sequence
  chemically synthesized
gtctcgaactctgacctcaggt

SEQ ID NO: 1183104 - DNA, 22 bp, Artificial Sequence
  chemically synthesized
gaactctgacctcaggtgatcc

SEQ ID NO: 1183105 - DNA, 22 bp, Artificial Sequence
  chemically synthesized
ggaggccaaggtgggtggatca

SEQ ID NO: 1183106 - DNA, 22 bp, Artificial Sequence
  chemically synthesized
gggaggccaaggtgggtggatc

SEQ ID NO: 1183107 - DNA, 22 bp, Artificial Sequence
  chemically synthesized
tgacctcaggtgatccacccac

SEQ ID NO: 1183108 - DNA, 22 bp, Artificial Sequence
  chemically synthesized
tgggaggccaaggtgggtggat

SEQ ID NO: 1183109 - DNA, 22 bp, Artificial Sequence
  chemically synthesized
acctcaggtgatccacccacct

SEQ ID NO: 1183110 - DNA, 22 bp, Artificial Sequence
  chemically synthesized
aggtgatccacccaccttggcc

SEQ ID NO: 1183111 - DNA, 22 bp, Artificial Sequence
  chemically synthesized
ccagtactttgggaggccaagg

SEQ ID NO: 1183112 - DNA, 22 bp, Artificial Sequence
  chemically synthesized
tactcccagtactttgggaggc

SEQ ID NO: 1183113 - DNA, 22 bp, Artificial Sequence
  chemically synthesized
atgcctgtactcccagtacttt

SEQ ID NO: 1183114 - DNA, 22 bp, Artificial Sequence
  chemically synthesized
ggcctcccaaagtactgggagt

SEQ ID NO: 1183115 - DNA, 22 bp, Artificial Sequence
  chemically synthesized
gcctcccaaagtactgggagta

SEQ ID NO: 1183116 - DNA, 22 bp, Artificial Sequence
  chemically synthesized
ccaaagtactgggagtacaggc

SEQ ID NO: 1183117 - DNA, 22 bp, Artificial Sequence
  chemically synthesized
ggagtacaggcatgagccacca

SEQ ID NO: 1183118 - DNA, 22 bp, Artificial Sequence
  chemically synthesized
ataaatggtaaggccgggcgtg

SEQ ID NO: 1183119 - DNA, 22 bp, Artificial Sequence
  chemically synthesized
aataaatggtaaggccgggcgt

SEQ ID NO: 1183120 - DNA, 22 bp, Artificial Sequence
  chemically synthesized
atttaataaatggtaaggccgg

SEQ ID NO: 1183121 - DNA, 22 bp, Artificial Sequence
  chemically synthesized
actcatttaataaatggtaagg

SEQ ID NO: 1183122 - DNA, 22 bp, Artificial Sequence
  chemically synthesized
aactcatttaataaatggtaag

SEQ ID NO: 1183123 - DNA, 22 bp, Artificial Sequence
  chemically synthesized
taactcatttaataaatggtaa

SEQ ID NO: 1183124 - DNA, 22 bp, Artificial Sequence
  chemically synthesized
ttaactcatttaataaatggta

SEQ ID NO: 1183125 - DNA, 22 bp, Artificial Sequence
  chemically synthesized
accatttattaaatgagttaaa

SEQ ID NO: 1183126 - DNA, 22 bp, Artificial Sequence
  chemically synthesized
atgccatacgtttttaactcat

SEQ ID NO: 1183127 - DNA, 22 bp, Artificial Sequence
  chemically synthesized
ccatttattaaatgagttaaaa

SEQ ID NO: 1183128 - DNA, 22 bp, Artificial Sequence
  chemically synthesized
cctcatgccatacgtttttaac

SEQ ID NO: 1183129 - DNA, 22 bp, Artificial Sequence
  chemically synthesized
ccctcatgccatacgtttttaa

SEQ ID NO: 1183130 - DNA, 22 bp, Artificial Sequence
  chemically synthesized
attaaatgagttaaaaacgtat

SEQ ID NO: 1183131 - DNA, 22 bp, Artificial Sequence
  chemically synthesized
ttaaatgagttaaaaacgtatg

SEQ ID NO: 1183132 - DNA, 22 bp, Artificial Sequence
  chemically synthesized
tcttccctcatgccatacgttt

SEQ ID NO: 1183133 - DNA, 22 bp, Artificial Sequence
  chemically synthesized
aatgagttaaaaacgtatggca

SEQ ID NO: 1183134 - DNA, 22 bp, Artificial Sequence
  chemically synthesized
ctgtcttccctcatgccatacg

SEQ ID NO: 1183135 - DNA, 22 bp, Artificial Sequence
  chemically synthesized
ctgctgtcttccctcatgccat

SEQ ID NO: 1183136 - DNA, 22 bp, Artificial Sequence
  chemically synthesized
aaaacgtatggcatgagggaag

SEQ ID NO: 1183137 - DNA, 22 bp, Artificial Sequence
  chemically synthesized
tcctcctgctgtcttccctcat

SEQ ID NO: 1183138 - DNA, 22 bp, Artificial Sequence
  chemically synthesized
ttatcctcctgctgtcttccct

SEQ ID NO: 1183139 - DNA, 22 bp, Artificial Sequence
  chemically synthesized
attatcctcctgctgtcttccc

SEQ ID NO: 1183140 - DNA, 22 bp, Artificial Sequence
  chemically synthesized
tattatcctcctgctgtcttcc

SEQ ID NO: 1183141 - DNA, 22 bp, Artificial Sequence
  chemically synthesized
attttattatcctcctgctgtc

SEQ ID NO: 1183142 - DNA, 22 bp, Artificial Sequence
  chemically synthesized
taattttattatcctcctgctg

SEQ ID NO: 1183143 - DNA, 22 bp, Artificial Sequence
  chemically synthesized
aaagtattctaattttattatc

SEQ ID NO: 1183144 - DNA, 22 bp, Artificial Sequence
  chemically synthesized
tgtctgaaagtattctaatttt

SEQ ID NO: 1183145 - DNA, 22 bp, Artificial Sequence
  chemically synthesized
gaatactttcagacacagattg

SEQ ID NO: 1183146 - DNA, 22 bp, Artificial Sequence
  chemically synthesized
tcagacacagattgttttgcat

SEQ ID NO: 1183147 - DNA, 22 bp, Artificial Sequence
  chemically synthesized
cagacacagattgttttgcatg

SEQ ID NO: 1183148 - DNA, 22 bp, Artificial Sequence
  chemically synthesized
agacacagattgttttgcatgt

SEQ ID NO: 1183149 - DNA, 22 bp, Artificial Sequence
  chemically synthesized
aagcaagtgacacataaacatg

SEQ ID NO: 1183150 - DNA, 22 bp, Artificial Sequence
  chemically synthesized
ttgaagcaagtgacacataaac

SEQ ID NO: 1183151 - DNA, 22 bp, Artificial Sequence
  chemically synthesized
ttattgaagcaagtgacacata

SEQ ID NO: 1183152 - DNA, 22 bp, Artificial Sequence
  chemically synthesized
ttttgcatgtttatgtgtcact

SEQ ID NO: 1183153 - DNA, 22 bp, Artificial Sequence
  chemically synthesized
tgcatgtttatgtgtcacttgc

SEQ ID NO: 1183154 - DNA, 22 bp, Artificial Sequence
  chemically synthesized
gcatgtttatgtgtcacttgct

SEQ ID NO: 1183155 - DNA, 22 bp, Artificial Sequence
  chemically synthesized
catgtttatgtgtcacttgctt

SEQ ID NO: 1183156 - DNA, 22 bp, Artificial Sequence
  chemically synthesized
atgtgtcacttgcttcaataac

SEQ ID NO: 1183157 - DNA, 22 bp, Artificial Sequence
  chemically synthesized
tgtgtcacttgcttcaataaca

SEQ ID NO: 1183158 - DNA, 22 bp, Artificial Sequence
  chemically synthesized
tgtgccaggtactgttattgaa

SEQ ID NO: 1183159 - DNA, 22 bp, Artificial Sequence
  chemically synthesized
ttatgtgccaggtactgttatt

SEQ ID NO: 1183160 - DNA, 22 bp, Artificial Sequence
  chemically synthesized
gcttcaataacagtacctggca

SEQ ID NO: 1183161 - DNA, 22 bp, Artificial Sequence
  chemically synthesized
cttcaataacagtacctggcac

SEQ ID NO: 1183162 - DNA, 22 bp, Artificial Sequence
  chemically synthesized
aatcacctattatgtgccaggt

SEQ ID NO: 1183163 - DNA, 22 bp, Artificial Sequence
  chemically synthesized
gaatcacctattatgtgccagg

SEQ ID NO: 1183164 - DNA, 22 bp, Artificial Sequence
  chemically synthesized
caataacagtacctggcacata

SEQ ID NO: 1183165 - DNA, 22 bp, Artificial Sequence
  chemically synthesized
aataacagtacctggcacataa

SEQ ID NO: 1183166 - DNA, 22 bp, Artificial Sequence
  chemically synthesized
tgtttgaatcacctattatgtg

SEQ ID NO: 1183167 - DNA, 22 bp, Artificial Sequence
  chemically synthesized
gtgtttgaatcacctattatgt

SEQ ID NO: 1183168 - DNA, 22 bp, Artificial Sequence
  chemically synthesized
gcgcttgtgtttgaatcaccta

SEQ ID NO: 1183169 - DNA, 22 bp, Artificial Sequence
  chemically synthesized
agcgcttgtgtttgaatcacct

SEQ ID NO: 1183170 - DNA, 22 bp, Artificial Sequence
  chemically synthesized
gcacataataggtgattcaaac

SEQ ID NO: 1183171 - DNA, 22 bp, Artificial Sequence
  chemically synthesized
tttagcgcttgtgtttgaatca

SEQ ID NO: 1183172 - DNA, 22 bp, Artificial Sequence
  chemically synthesized
attatttagcgcttgtgtttga

SEQ ID NO: 1183173 - DNA, 22 bp, Artificial Sequence
  chemically synthesized
gattatttagcgcttgtgtttg

SEQ ID NO: 1183174 - DNA, 22 bp, Artificial Sequence
  chemically synthesized
atacatttgattatttagcgct

SEQ ID NO: 1183175 - DNA, 22 bp, Artificial Sequence
  chemically synthesized
aaacacaagcgctaaataatca

SEQ ID NO: 1183176 - DNA, 22 bp, Artificial Sequence
  chemically synthesized
aataatcaaatgtatgaatact

SEQ ID NO: 1183177 - DNA, 22 bp, Artificial Sequence
  chemically synthesized
cgcacacatagagcagtattca

SEQ ID NO: 1183178 - DNA, 22 bp, Artificial Sequence
  chemically synthesized
cgttacgcacacatagagcagt

SEQ ID NO: 1183179 - DNA, 22 bp, Artificial Sequence
  chemically synthesized
tatattgcgttacgcacacata

SEQ ID NO: 1183180 - DNA, 22 bp, Artificial Sequence
  chemically synthesized
atatattgcgttacgcacacat

SEQ ID NO: 1183181 - DNA, 22 bp, Artificial Sequence
  chemically synthesized
ttatatattgcgttacgcacac

SEQ ID NO: 1183182 - DNA, 22 bp, Artificial Sequence
  chemically synthesized
ctctatgtgtgcgtaacgcaat

SEQ ID NO: 1183183 - DNA, 22 bp, Artificial Sequence
  chemically synthesized
tatgtgtgcgtaacgcaatata

SEQ ID NO: 1183184 - DNA, 22 bp, Artificial Sequence
  chemically synthesized
tgtgtgcgtaacgcaatatata

SEQ ID NO: 1183185 - DNA, 22 bp, Artificial Sequence
  chemically synthesized
gacggtgattcttatatattgc

SEQ ID NO: 1183186 - DNA, 22 bp, Artificial Sequence
  chemically synthesized
tcgacggtgattcttatatatt

SEQ ID NO: 1183187 - DNA, 22 bp, Artificial Sequence
  chemically synthesized
ctcgacggtgattcttatatat

SEQ ID NO: 1183188 - DNA, 22 bp, Artificial Sequence
  chemically synthesized
tctcgacggtgattcttatata

SEQ ID NO: 1183189 - DNA, 22 bp, Artificial Sequence
  chemically synthesized
cactttctcgacggtgattctt

SEQ ID NO: 1183190 - DNA, 22 bp, Artificial Sequence
  chemically synthesized
tagtagggtgacgctgcacttt

SEQ ID NO: 1183191 - DNA, 22 bp, Artificial Sequence
  chemically synthesized
attatagtagggtgacgctgca

SEQ ID NO: 1183192 - DNA, 22 bp, Artificial Sequence
  chemically synthesized
catgcccatgctcattatagta

SEQ ID NO: 1183193 - DNA, 22 bp, Artificial Sequence
  chemically synthesized
aactccatgcccatgctcatta

SEQ ID NO: 1183194 - DNA, 22 bp, Artificial Sequence
  chemically synthesized
ttcaactccatgcccatgctca

SEQ ID NO: 1183195 - DNA, 22 bp, Artificial Sequence
  chemically synthesized
attcaactccatgcccatgctc

SEQ ID NO: 1183196 - DNA, 22 bp, Artificial Sequence
  chemically synthesized
ctataatgagcatgggcatgga

SEQ ID NO: 1183197 - DNA, 22 bp, Artificial Sequence
  chemically synthesized
catttattcaactccatgccca

SEQ ID NO: 1183198 - DNA, 22 bp, Artificial Sequence
  chemically synthesized
gcatttattcaactccatgccc

SEQ ID NO: 1183199 - DNA, 22 bp, Artificial Sequence
  chemically synthesized
taatgagcatgggcatggagtt

SEQ ID NO: 1183200 - DNA, 22 bp, Artificial Sequence
  chemically synthesized
aaatttgcatttattcaactcc

SEQ ID NO: 1183201 - DNA, 22 bp, Artificial Sequence
  chemically synthesized
aattcaaatttgcatttattca

SEQ ID NO: 1183202 - DNA, 22 bp, Artificial Sequence
  chemically synthesized
aataaatgcaaatttgaattca

SEQ ID NO: 1183203 - DNA, 22 bp, Artificial Sequence
  chemically synthesized
gtaagtggcagaacctgaattc

SEQ ID NO: 1183204 - DNA, 22 bp, Artificial Sequence
  chemically synthesized
attagtaagtggcagaacctga

SEQ ID NO: 1183205 - DNA, 22 bp, Artificial Sequence
  chemically synthesized
ggcctaattagtaagtggcaga

SEQ ID NO: 1183206 - DNA, 22 bp, Artificial Sequence
  chemically synthesized
gaattcaggttctgccacttac

SEQ ID NO: 1183207 - DNA, 22 bp, Artificial Sequence
  chemically synthesized
taggcctaattagtaagtggca

SEQ ID NO: 1183208 - DNA, 22 bp, Artificial Sequence
  chemically synthesized
aattcaggttctgccacttact

SEQ ID NO: 1183209 - DNA, 22 bp, Artificial Sequence
  chemically synthesized
ctaggcctaattagtaagtggc

SEQ ID NO: 1183210 - DNA, 22 bp, Artificial Sequence
  chemically synthesized
aggttctgccacttactaatta

SEQ ID NO: 1183211 - DNA, 22 bp, Artificial Sequence
  chemically synthesized
tatttctaggcctaattagtaa

SEQ ID NO: 1183212 - DNA, 22 bp, Artificial Sequence
  chemically synthesized
gtatttctaggcctaattagta

SEQ ID NO: 1183213 - DNA, 22 bp, Artificial Sequence
  chemically synthesized
atttgtatttctaggcctaatt

SEQ ID NO: 1183214 - DNA, 22 bp, Artificial Sequence
  chemically synthesized
tgccacttactaattaggccta

SEQ ID NO: 1183215 - DNA, 22 bp, Artificial Sequence
  chemically synthesized
aatttgtatttctaggcctaat

SEQ ID NO: 1183216 - DNA, 22 bp, Artificial Sequence
  chemically synthesized
ccacttactaattaggcctaga

SEQ ID NO: 1183217 - DNA, 22 bp, Artificial Sequence
  chemically synthesized
actaattaggcctagaaataca

SEQ ID NO: 1183218 - DNA, 22 bp, Artificial Sequence
  chemically synthesized
gccaacttaatttgtatttcta

SEQ ID NO: 1183219 - DNA, 22 bp, Artificial Sequence
  chemically synthesized
ctaattaggcctagaaatacaa

SEQ ID NO: 1183220 - DNA, 22 bp, Artificial Sequence
  chemically synthesized
attaggcctagaaatacaaatt

SEQ ID NO: 1183221 - DNA, 22 bp, Artificial Sequence
  chemically synthesized
aattggccaacttaatttgtat

SEQ ID NO: 1183222 - DNA, 22 bp, Artificial Sequence
  chemically synthesized
aaattggccaacttaatttgta

SEQ ID NO: 1183223 - DNA, 22 bp, Artificial Sequence
  chemically synthesized
taaattggccaacttaatttgt

SEQ ID NO: 1183224 - DNA, 22 bp, Artificial Sequence
  chemically synthesized
ggcctagaaatacaaattaagt

SEQ ID NO: 1183225 - DNA, 22 bp, Artificial Sequence
  chemically synthesized
ttttaaattggccaacttaatt

SEQ ID NO: 1183226 - DNA, 22 bp, Artificial Sequence
  chemically synthesized
tgttttaaattggccaacttaa

SEQ ID NO: 1183227 - DNA, 22 bp, Artificial Sequence
  chemically synthesized
gaaatacaaattaagttggcca

SEQ ID NO: 1183228 - DNA, 22 bp, Artificial Sequence
  chemically synthesized
tctctgttttaaattggccaac

SEQ ID NO: 1183229 - DNA, 22 bp, Artificial Sequence
  chemically synthesized
gtctctgttttaaattggccaa

SEQ ID NO: 1183230 - DNA, 22 bp, Artificial Sequence
  chemically synthesized
tgtctctgttttaaattggcca

SEQ ID NO: 1183231 - DNA, 22 bp, Artificial Sequence
  chemically synthesized
ttgtctctgttttaaattggcc

SEQ ID NO: 1183232 - DNA, 22 bp, Artificial Sequence
  chemically synthesized
agttggccaatttaaaacagag

SEQ ID NO: 1183233 - DNA, 22 bp, Artificial Sequence
  chemically synthesized
agagtgcttttgtctctgtttt

SEQ ID NO: 1183234 - DNA, 22 bp, Artificial Sequence
  chemically synthesized
gccaatttaaaacagagacaaa

SEQ ID NO: 1183235 - DNA, 22 bp, Artificial Sequence
  chemically synthesized
gctcagagtgcttttgtctctg

SEQ ID NO: 1183236 - DNA, 22 bp, Artificial Sequence
  chemically synthesized
agctcagagtgcttttgtctct

SEQ ID NO: 1183237 - DNA, 22 bp, Artificial Sequence
  chemically synthesized
ccttagctcagagtgcttttgt

SEQ ID NO: 1183238 - DNA, 22 bp, Artificial Sequence
  chemically synthesized
cccttagctcagagtgcttttg

SEQ ID NO: 1183239 - DNA, 22 bp, Artificial Sequence
  chemically synthesized
aaaacagagacaaaagcactct

SEQ ID NO: 1183240 - DNA, 22 bp, Artificial Sequence
  chemically synthesized
aaacagagacaaaagcactctg

SEQ ID NO: 1183241 - DNA, 22 bp, Artificial Sequence
  chemically synthesized
tgcttcccttagctcagagtgc

SEQ ID NO: 1183242 - DNA, 22 bp, Artificial Sequence
  chemically synthesized
atgcttcccttagctcagagtg

SEQ ID NO: 1183243 - DNA, 22 bp, Artificial Sequence
  chemically synthesized
tatgcttcccttagctcagagt

SEQ ID NO: 1183244 - DNA, 22 bp, Artificial Sequence
  chemically synthesized
ttatgcttcccttagctcagag

SEQ ID NO: 1183245 - DNA, 22 bp, Artificial Sequence
  chemically synthesized
gcttttatgcttcccttagctc

SEQ ID NO: 1183246 - DNA, 22 bp, Artificial Sequence
  chemically synthesized
catattagcttttatgcttccc

SEQ ID NO: 1183247 - DNA, 22 bp, Artificial Sequence
  chemically synthesized
ccatattagcttttatgcttcc

SEQ ID NO: 1183248 - DNA, 22 bp, Artificial Sequence
  chemically synthesized
tccatattagcttttatgcttc

SEQ ID NO: 1183249 - DNA, 22 bp, Artificial Sequence
  chemically synthesized
tgagctaagggaagcataaaag

SEQ ID NO: 1183250 - DNA, 22 bp, Artificial Sequence
  chemically synthesized
agctaagggaagcataaaagct

SEQ ID NO: 1183251 - DNA, 22 bp, Artificial Sequence
  chemically synthesized
agggaagcataaaagctaatat

SEQ ID NO: 1183252 - DNA, 22 bp, Artificial Sequence
  chemically synthesized
ccacacaggtgccccaaaattt

SEQ ID NO: 1183253 - DNA, 22 bp, Artificial Sequence
  chemically synthesized
tcccacacaggtgccccaaaat

SEQ ID NO: 1183254 - DNA, 22 bp, Artificial Sequence
  chemically synthesized
atatggaaaattttggggcacc

SEQ ID NO: 1183255 - DNA, 22 bp, Artificial Sequence
  chemically synthesized
gttctcccacacaggtgcccca

SEQ ID NO: 1183256 - DNA, 22 bp, Artificial Sequence
  chemically synthesized
catcactcgttctcccacacag

SEQ ID NO: 1183257 - DNA, 22 bp, Artificial Sequence
  chemically synthesized
tggggcacctgtgtgggagaac

SEQ ID NO: 1183258 - DNA, 22 bp, Artificial Sequence
  chemically synthesized
ggggcacctgtgtgggagaacg

SEQ ID NO: 1183259 - DNA, 22 bp, Artificial Sequence
  chemically synthesized
gggcacctgtgtgggagaacga

SEQ ID NO: 1183260 - DNA, 22 bp, Artificial Sequence
  chemically synthesized
aaccaaattacatcactcgttc

SEQ ID NO: 1183261 - DNA, 22 bp, Artificial Sequence
  chemically synthesized
caaccaaattacatcactcgtt

SEQ ID NO: 1183262 - DNA, 22 bp, Artificial Sequence
  chemically synthesized
cttcaaccaaattacatcactc

SEQ ID NO: 1183263 - DNA, 22 bp, Artificial Sequence
  chemically synthesized
tgtgggagaacgagtgatgtaa

SEQ ID NO: 1183264 - DNA, 22 bp, Artificial Sequence
  chemically synthesized
atgttccttcaaccaaattaca

SEQ ID NO: 1183265 - DNA, 22 bp, Artificial Sequence
  chemically synthesized
catgttccttcaaccaaattac

SEQ ID NO: 1183266 - DNA, 22 bp, Artificial Sequence
  chemically synthesized
cacacgtatttcatgttccttc

SEQ ID NO: 1183267 - DNA, 22 bp, Artificial Sequence
  chemically synthesized
attacacacgtatttcatgttc

SEQ ID NO: 1183268 - DNA, 22 bp, Artificial Sequence
  chemically synthesized
ggttgaaggaacatgaaatacg

SEQ ID NO: 1183269 - DNA, 22 bp, Artificial Sequence
  chemically synthesized
gttgaaggaacatgaaatacgt

SEQ ID NO: 1183270 - DNA, 22 bp, Artificial Sequence
  chemically synthesized
tgctcattacacacgtatttca

SEQ ID NO: 1183271 - DNA, 22 bp, Artificial Sequence
  chemically synthesized
atgctcattacacacgtatttc

SEQ ID NO: 1183272 - DNA, 22 bp, Artificial Sequence
  chemically synthesized
tatgctcattacacacgtattt

SEQ ID NO: 1183273 - DNA, 22 bp, Artificial Sequence
  chemically synthesized
ttatgctcattacacacgtatt

SEQ ID NO: 1183274 - DNA, 22 bp, Artificial Sequence
  chemically synthesized
aaggaacatgaaatacgtgtgt

SEQ ID NO: 1183275 - DNA, 22 bp, Artificial Sequence
  chemically synthesized
tatttttatgctcattacacac

SEQ ID NO: 1183276 - DNA, 22 bp, Artificial Sequence
  chemically synthesized
atatttttatgctcattacaca

SEQ ID NO: 1183277 - DNA, 22 bp, Artificial Sequence
  chemically synthesized
tatatttttatgctcattacac

SEQ ID NO: 1183278 - DNA, 22 bp, Artificial Sequence
  chemically synthesized
atattttatatttttatgctca

SEQ ID NO: 1183279 - DNA, 22 bp, Artificial Sequence
  chemically synthesized
tgatatattaatattttatatt

SEQ ID NO: 1183280 - DNA, 22 bp, Artificial Sequence
  chemically synthesized
atgatatattaatattttatat

SEQ ID NO: 1183281 - DNA, 22 bp, Artificial Sequence
  chemically synthesized
gaaaagatttatgatatattaa

SEQ ID NO: 1183282 - DNA, 22 bp, Artificial Sequence
  chemically synthesized
cctcgaaaagatttatgatata

SEQ ID NO: 1183283 - DNA, 22 bp, Artificial Sequence
  chemically synthesized
aactgcctcgaaaagatttatg

SEQ ID NO: 1183284 - DNA, 22 bp, Artificial Sequence
  chemically synthesized
ctaaactgcctcgaaaagattt

SEQ ID NO: 1183285 - DNA, 22 bp, Artificial Sequence
  chemically synthesized
tcctaaactgcctcgaaaagat

SEQ ID NO: 1183286 - DNA, 22 bp, Artificial Sequence
  chemically synthesized
atatatcataaatcttttcgag

SEQ ID NO: 1183287 - DNA, 22 bp, Artificial Sequence
  chemically synthesized
ctctcctaaactgcctcgaaaa

SEQ ID NO: 1183288 - DNA, 22 bp, Artificial Sequence
  chemically synthesized
ttcgaggcagtttaggagagta

SEQ ID NO: 1183289 - DNA, 22 bp, Artificial Sequence
  chemically synthesized
tcgaggcagtttaggagagtag

SEQ ID NO: 1183290 - DNA, 22 bp, Artificial Sequence
  chemically synthesized
cgaggcagtttaggagagtagc

SEQ ID NO: 1183291 - DNA, 22 bp, Artificial Sequence
  chemically synthesized
gaggcagtttaggagagtagcc

SEQ ID NO: 1183292 - DNA, 22 bp, Artificial Sequence
  chemically synthesized
tccatataacaaggctactctc

SEQ ID NO: 1183293 - DNA, 22 bp, Artificial Sequence
  chemically synthesized
gtccatataacaaggctactct

SEQ ID NO: 1183294 - DNA, 22 bp, Artificial Sequence
  chemically synthesized
tgtccatataacaaggctactc

SEQ ID NO: 1183295 - DNA, 22 bp, Artificial Sequence
  chemically synthesized
attttgtccatataacaaggct

SEQ ID NO: 1183296 - DNA, 22 bp, Artificial Sequence
  chemically synthesized
aattttgtccatataacaaggc

SEQ ID NO: 1183297 - DNA, 22 bp, Artificial Sequence
  chemically synthesized
aggagagtagccttgttatatg

SEQ ID NO: 1183298 - DNA, 22 bp, Artificial Sequence
  chemically synthesized
ggagagtagccttgttatatgg

SEQ ID NO: 1183299 - DNA, 22 bp, Artificial Sequence
  chemically synthesized
gcttaattttgtccatataaca

SEQ ID NO: 1183300 - DNA, 22 bp, Artificial Sequence
  chemically synthesized
cgcttaattttgtccatataac

SEQ ID NO: 1183301 - DNA, 22 bp, Artificial Sequence
  chemically synthesized
tcgcttaattttgtccatataa

SEQ ID NO: 1183302 - DNA, 22 bp, Artificial Sequence
  chemically synthesized
ttcgcttaattttgtccatata

SEQ ID NO: 1183303 - DNA, 22 bp, Artificial Sequence
  chemically synthesized
tttcgcttaattttgtccatat

SEQ ID NO: 1183304 - DNA, 22 bp, Artificial Sequence
  chemically synthesized
ttttcgcttaattttgtccata

SEQ ID NO: 1183305 - DNA, 22 bp, Artificial Sequence
  chemically synthesized
gttatatggacaaaattaagcg

SEQ ID NO: 1183306 - DNA, 22 bp, Artificial Sequence
  chemically synthesized
ttatatggacaaaattaagcga

SEQ ID NO: 1183307 - DNA, 22 bp, Artificial Sequence
  chemically synthesized
tatggacaaaattaagcgaaaa

SEQ ID NO: 1183308 - DNA, 22 bp, Artificial Sequence
  chemically synthesized
ataatacaatttttttcgctta

SEQ ID NO: 1183309 - DNA, 22 bp, Artificial Sequence
  chemically synthesized
agagccctaataatacaatttt

SEQ ID NO: 1183310 - DNA, 22 bp, Artificial Sequence
  chemically synthesized
ttcagagccctaataatacaat

SEQ ID NO: 1183311 - DNA, 22 bp, Artificial Sequence
  chemically synthesized
agcgaaaaaaattgtattatta

SEQ ID NO: 1183312 - DNA, 22 bp, Artificial Sequence
  chemically synthesized
atgttattcagagccctaataa

SEQ ID NO: 1183313 - DNA, 22 bp, Artificial Sequence
  chemically synthesized
aatgttattcagagccctaata

SEQ ID NO: 1183314 - DNA, 22 bp, Artificial Sequence
  chemically synthesized
taatgttattcagagccctaat

SEQ ID NO: 1183315 - DNA, 22 bp, Artificial Sequence
  chemically synthesized
ttaatgttattcagagccctaa

SEQ ID NO: 1183316 - DNA, 22 bp, Artificial Sequence
  chemically synthesized
tttaatgttattcagagcccta

SEQ ID NO: 1183317 - DNA, 22 bp, Artificial Sequence
  chemically synthesized
tattattagggctctgaataac

SEQ ID NO: 1183318 - DNA, 22 bp, Artificial Sequence
  chemically synthesized
tccattttttaatgttattcag

SEQ ID NO: 1183319 - DNA, 22 bp, Artificial Sequence
  chemically synthesized
gtccattttttaatgttattca

SEQ ID NO: 1183320 - DNA, 22 bp, Artificial Sequence
  chemically synthesized
ttgtccattttttaatgttatt

SEQ ID NO: 1183321 - DNA, 22 bp, Artificial Sequence
  chemically synthesized
ttagggctctgaataacattaa

SEQ ID NO: 1183322 - DNA, 22 bp, Artificial Sequence
  chemically synthesized
cttgtccattttttaatgttat

SEQ ID NO: 1183323 - DNA, 22 bp, Artificial Sequence
  chemically synthesized
gggctctgaataacattaaaaa

SEQ ID NO: 1183324 - DNA, 22 bp, Artificial Sequence
  chemically synthesized
tgaagtttcttgtccatttttt

SEQ ID NO: 1183325 - DNA, 22 bp, Artificial Sequence
  chemically synthesized
tgaataacattaaaaaatggac

SEQ ID NO: 1183326 - DNA, 22 bp, Artificial Sequence
  chemically synthesized
aataacattaaaaaatggacaa

SEQ ID NO: 1183327 - DNA, 22 bp, Artificial Sequence
  chemically synthesized
ttatgaagtttcttgtccattt

SEQ ID NO: 1183328 - DNA, 22 bp, Artificial Sequence
  chemically synthesized
attatgaagtttcttgtccatt

SEQ ID NO: 1183329 - DNA, 22 bp, Artificial Sequence
  chemically synthesized
aaaaatggacaagaaacttcat

SEQ ID NO: 1183330 - DNA, 22 bp, Artificial Sequence
  chemically synthesized
caagtgaagtttattatgaagt

SEQ ID NO: 1183331 - DNA, 22 bp, Artificial Sequence
  chemically synthesized
gtatgtctccaagtgaagttta

SEQ ID NO: 1183332 - DNA, 22 bp, Artificial Sequence
  chemically synthesized
cataataaacttcacttggaga

SEQ ID NO: 1183333 - DNA, 22 bp, Artificial Sequence
  chemically synthesized
aaacctagtatgtctccaagtg

SEQ ID NO: 1183334 - DNA, 22 bp, Artificial Sequence
  chemically synthesized
ataataaacttcacttggagac

SEQ ID NO: 1183335 - DNA, 22 bp, Artificial Sequence
  chemically synthesized
atatctcaaacctagtatgtct

SEQ ID NO: 1183336 - DNA, 22 bp, Artificial Sequence
  chemically synthesized
cacttggagacatactaggttt

SEQ ID NO: 1183337 - DNA, 22 bp, Artificial Sequence
  chemically synthesized
acttggagacatactaggtttg

SEQ ID NO: 1183338 - DNA, 22 bp, Artificial Sequence
  chemically synthesized
ggagacatactaggtttgagat

SEQ ID NO: 1183339 - DNA, 22 bp, Artificial Sequence
  chemically synthesized
atatccactaatatctcaaacc

SEQ ID NO: 1183340 - DNA, 22 bp, Artificial Sequence
  chemically synthesized
gagacatactaggtttgagata

SEQ ID NO: 1183341 - DNA, 22 bp, Artificial Sequence
  chemically synthesized
gatatccactaatatctcaaac

SEQ ID NO: 1183342 - DNA, 22 bp, Artificial Sequence
  chemically synthesized
taccttgatatccactaatatc

SEQ ID NO: 1183343 - DNA, 22 bp, Artificial Sequence
  chemically synthesized
ggtttgagatattagtggatat

SEQ ID NO: 1183344 - DNA, 22 bp, Artificial Sequence
  chemically synthesized
gagatattagtggatatcaagg

SEQ ID NO: 1183345 - DNA, 22 bp, Artificial Sequence
  chemically synthesized
tatgtatctataccttgatatc

SEQ ID NO: 1183346 - DNA, 22 bp, Artificial Sequence
  chemically synthesized
agatattagtggatatcaaggt

SEQ ID NO: 1183347 - DNA, 22 bp, Artificial Sequence
  chemically synthesized
gtatgtatctataccttgatat

SEQ ID NO: 1183348 - DNA, 22 bp, Artificial Sequence
  chemically synthesized
tgtatgtatctataccttgata

SEQ ID NO: 1183349 - DNA, 22 bp, Artificial Sequence
  chemically synthesized
tttgtatgtatctataccttga

SEQ ID NO: 1183350 - DNA, 22 bp, Artificial Sequence
  chemically synthesized
gtggatatcaaggtatagatac

SEQ ID NO: 1183351 - DNA, 22 bp, Artificial Sequence
  chemically synthesized
aactctttgtatgtatctatac

SEQ ID NO: 1183352 - DNA, 22 bp, Artificial Sequence
  chemically synthesized
caactctttgtatgtatctata

SEQ ID NO: 1183353 - DNA, 22 bp, Artificial Sequence
  chemically synthesized
tcaactctttgtatgtatctat

SEQ ID NO: 1183354 - DNA, 22 bp, Artificial Sequence
  chemically synthesized
attttcaactctttgtatgtat

SEQ ID NO: 1183355 - DNA, 22 bp, Artificial Sequence
  chemically synthesized
caattaattttcaactctttgt

SEQ ID NO: 1183356 - DNA, 22 bp, Artificial Sequence
  chemically synthesized
ccaattaattttcaactctttg

SEQ ID NO: 1183357 - DNA, 22 bp, Artificial Sequence
  chemically synthesized
tagccacatttccaattaattt

SEQ ID NO: 1183358 - DNA, 22 bp, Artificial Sequence
  chemically synthesized
agttatagccacatttccaatt

SEQ ID NO: 1183359 - DNA, 22 bp, Artificial Sequence
  chemically synthesized
gagttatagccacatttccaat

SEQ ID NO: 1183360 - DNA, 22 bp, Artificial Sequence
  chemically synthesized
cttgagttatagccacatttcc

SEQ ID NO: 1183361 - DNA, 22 bp, Artificial Sequence
  chemically synthesized
acttgagttatagccacatttc

SEQ ID NO: 1183362 - DNA, 22 bp, Artificial Sequence
  chemically synthesized
aaaattaattggaaatgtggct

SEQ ID NO: 1183363 - DNA, 22 bp, Artificial Sequence
  chemically synthesized
caatcttacttgagttatagcc

SEQ ID NO: 1183364 - DNA, 22 bp, Artificial Sequence
  chemically synthesized
attggaaatgtggctataactc

SEQ ID NO: 1183365 - DNA, 22 bp, Artificial Sequence
  chemically synthesized
ccaatcttacttgagttatagc

SEQ ID NO: 1183366 - DNA, 22 bp, Artificial Sequence
  chemically synthesized
gaaatgtggctataactcaagt

SEQ ID NO: 1183367 - DNA, 22 bp, Artificial Sequence
  chemically synthesized
accacttccaatcttacttgag

SEQ ID NO: 1183368 - DNA, 22 bp, Artificial Sequence
  chemically synthesized
caccacttccaatcttacttga

SEQ ID NO: 1183369 - DNA, 22 bp, Artificial Sequence
  chemically synthesized
tcttcaccacttccaatcttac

SEQ ID NO: 1183370 - DNA, 22 bp, Artificial Sequence
  chemically synthesized
tgtcttcaccacttccaatctt

SEQ ID NO: 1183371 - DNA, 22 bp, Artificial Sequence
  chemically synthesized
taactcaagtaagattggaagt

SEQ ID NO: 1183372 - DNA, 22 bp, Artificial Sequence
  chemically synthesized
tatctctgtcttcaccacttcc

SEQ ID NO: 1183373 - DNA, 22 bp, Artificial Sequence
  chemically synthesized
aagtaagattggaagtggtgaa

SEQ ID NO: 1183374 - DNA, 22 bp, Artificial Sequence
  chemically synthesized
gaagtggtgaagacagagatac

SEQ ID NO: 1183375 - DNA, 22 bp, Artificial Sequence
  chemically synthesized
tatgcaaatgatcattgtatct

SEQ ID NO: 1183376 - DNA, 22 bp, Artificial Sequence
  chemically synthesized
aatctgtatgcaaatgatcatt

SEQ ID NO: 1183377 - DNA, 22 bp, Artificial Sequence
  chemically synthesized
tattcaatctgtatgcaaatga

SEQ ID NO: 1183378 - DNA, 22 bp, Artificial Sequence
  chemically synthesized
aatctgtattcaatctgtatgc

SEQ ID NO: 1183379 - DNA, 22 bp, Artificial Sequence
  chemically synthesized
caatctgtattcaatctgtatg

SEQ ID NO: 1183380 - DNA, 22 bp, Artificial Sequence
  chemically synthesized
gcttcaatctgtattcaatctg

SEQ ID NO: 1183381 - DNA, 22 bp, Artificial Sequence
  chemically synthesized
gcatacagattgaatacagatt

SEQ ID NO: 1183382 - DNA, 22 bp, Artificial Sequence
  chemically synthesized
catacagattgaatacagattg

SEQ ID NO: 1183383 - DNA, 22 bp, Artificial Sequence
  chemically synthesized
ataacctggcttcaatctgtat

SEQ ID NO: 1183384 - DNA, 22 bp, Artificial Sequence
  chemically synthesized
aataacctggcttcaatctgta

SEQ ID NO: 1183385 - DNA, 22 bp, Artificial Sequence
  chemically synthesized
aatacagattgaagccaggtta

SEQ ID NO: 1183386 - DNA, 22 bp, Artificial Sequence
  chemically synthesized
ataataatttaataacctggct

SEQ ID NO: 1183387 - DNA, 22 bp, Artificial Sequence
  chemically synthesized
aataataatttaataacctggc

SEQ ID NO: 1183388 - DNA, 22 bp, Artificial Sequence
  chemically synthesized
aagccaggttattaaattatta

SEQ ID NO: 1183389 - DNA, 22 bp, Artificial Sequence
  chemically synthesized
tcaacataatttaataataatt

SEQ ID NO: 1183390 - DNA, 22 bp, Artificial Sequence
  chemically synthesized
atcaacataatttaataataat

SEQ ID NO: 1183391 - DNA, 22 bp, Artificial Sequence
  chemically synthesized
tatcaacataatttaataataa

SEQ ID NO: 1183392 - DNA, 22 bp, Artificial Sequence
  chemically synthesized
ttatcaacataatttaataata

SEQ ID NO: 1183393 - DNA, 22 bp, Artificial Sequence
  chemically synthesized
ttttatcaacataatttaataa

SEQ ID NO: 1183394 - DNA, 22 bp, Artificial Sequence
  chemically synthesized
ttcttttatcaacataatttaa

SEQ ID NO: 1183395 - DNA, 22 bp, Artificial Sequence
  chemically synthesized
ttaaattattattaaattatgt

SEQ ID NO: 1183396 - DNA, 22 bp, Artificial Sequence
  chemically synthesized
gttcttttatcaacataattta

SEQ ID NO: 1183397 - DNA, 22 bp, Artificial Sequence
  chemically synthesized
aattattattaaattatgttga

SEQ ID NO: 1183398 - DNA, 22 bp, Artificial Sequence
  chemically synthesized
tacttgttcttttatcaacata

SEQ ID NO: 1183399 - DNA, 22 bp, Artificial Sequence
  chemically synthesized
tgtacttgttcttttatcaaca

SEQ ID NO: 1183400 - DNA, 22 bp, Artificial Sequence
  chemically synthesized
ttattaaattatgttgataaaa

SEQ ID NO: 1183401 - DNA, 22 bp, Artificial Sequence
  chemically synthesized
ttaaattatgttgataaaagaa

SEQ ID NO: 1183402 - DNA, 22 bp, Artificial Sequence
  chemically synthesized
tctctgtacttgttcttttatc

SEQ ID NO: 1183403 - DNA, 22 bp, Artificial Sequence
  chemically synthesized
atctctgtacttgttcttttat

SEQ ID NO: 1183404 - DNA, 22 bp, Artificial Sequence
  chemically synthesized
aattatgttgataaaagaacaa

SEQ ID NO: 1183405 - DNA, 22 bp, Artificial Sequence
  chemically synthesized
ttatctctgtacttgttctttt

SEQ ID NO: 1183406 - DNA, 22 bp, Artificial Sequence
  chemically synthesized
tgttgataaaagaacaagtaca

SEQ ID NO: 1183407 - DNA, 22 bp, Artificial Sequence
  chemically synthesized
gcattcttatctctgtacttgt

SEQ ID NO: 1183408 - DNA, 22 bp, Artificial Sequence
  chemically synthesized
ggcattcttatctctgtacttg

SEQ ID NO: 1183409 - DNA, 22 bp, Artificial Sequence
  chemically synthesized
ataaaagaacaagtacagagat

SEQ ID NO: 1183410 - DNA, 22 bp, Artificial Sequence
  chemically synthesized
atgggaaatatcttggcattct

SEQ ID NO: 1183411 - DNA, 22 bp, Artificial Sequence
  chemically synthesized
tgaaactcatgggaaatatctt

SEQ ID NO: 1183412 - DNA, 22 bp, Artificial Sequence
  chemically synthesized
atgaaactcatgggaaatatct

SEQ ID NO: 1183413 - DNA, 22 bp, Artificial Sequence
  chemically synthesized
gcttatgaaactcatgggaaat

SEQ ID NO: 1183414 - DNA, 22 bp, Artificial Sequence
  chemically synthesized
agcttatgaaactcatgggaaa

SEQ ID NO: 1183415 - DNA, 22 bp, Artificial Sequence
  chemically synthesized
tagcttatgaaactcatgggaa

SEQ ID NO: 1183416 - DNA, 22 bp, Artificial Sequence
  chemically synthesized
tttagcttatgaaactcatggg

SEQ ID NO: 1183417 - DNA, 22 bp, Artificial Sequence
  chemically synthesized
ctttagcttatgaaactcatgg

SEQ ID NO: 1183418 - DNA, 22 bp, Artificial Sequence
  chemically synthesized
caacttctttagcttatgaaac

SEQ ID NO: 1183419 - DNA, 22 bp, Artificial Sequence
  chemically synthesized
ccaacttctttagcttatgaaa

SEQ ID NO: 1183420 - DNA, 22 bp, Artificial Sequence
  chemically synthesized
ttccaacttctttagcttatga

SEQ ID NO: 1183421 - DNA, 22 bp, Artificial Sequence
  chemically synthesized
cccatgagtttcataagctaaa

SEQ ID NO: 1183422 - DNA, 22 bp, Artificial Sequence
  chemically synthesized
ccatgagtttcataagctaaag

SEQ ID NO: 1183423 - DNA, 22 bp, Artificial Sequence
  chemically synthesized
ttcttccaacttctttagctta

SEQ ID NO: 1183424 - DNA, 22 bp, Artificial Sequence
  chemically synthesized
tgttcttccaacttctttagct

SEQ ID NO: 1183425 - DNA, 22 bp, Artificial Sequence
  chemically synthesized
ctgttcttccaacttctttagc

SEQ ID NO: 1183426 - DNA, 22 bp, Artificial Sequence
  chemically synthesized
tctgttcttccaacttctttag

SEQ ID NO: 1183427 - DNA, 22 bp, Artificial Sequence
  chemically synthesized
tttctgttcttccaacttcttt

SEQ ID NO: 1183428 - DNA, 22 bp, Artificial Sequence
  chemically synthesized
cataagctaaagaagttggaag

SEQ ID NO: 1183429 - DNA, 22 bp, Artificial Sequence
  chemically synthesized
gctctttctgttcttccaactt

SEQ ID NO: 1183430 - DNA, 22 bp, Artificial Sequence
  chemically synthesized
ataagctaaagaagttggaaga

SEQ ID NO: 1183431 - DNA, 22 bp, Artificial Sequence
  chemically synthesized
cctggctctttctgttcttcca

SEQ ID NO: 1183432 - DNA, 22 bp, Artificial Sequence
  chemically synthesized
attacctggctctttctgttct

SEQ ID NO: 1183433 - DNA, 22 bp, Artificial Sequence
  chemically synthesized
aagaagttggaagaacagaaag

SEQ ID NO: 1183434 - DNA, 22 bp, Artificial Sequence
  chemically synthesized
cattacctggctctttctgttc

SEQ ID NO: 1183435 - DNA, 22 bp, Artificial Sequence
  chemically synthesized
tcattacctggctctttctgtt

SEQ ID NO: 1183436 - DNA, 22 bp, Artificial Sequence
  chemically synthesized
tgtctttcattacctggctctt

SEQ ID NO: 1183437 - DNA, 22 bp, Artificial Sequence
  chemically synthesized
gaagaacagaaagagccaggta

SEQ ID NO: 1183438 - DNA, 22 bp, Artificial Sequence
  chemically synthesized
tgtgtctttcattacctggctc

SEQ ID NO: 1183439 - DNA, 22 bp, Artificial Sequence
  chemically synthesized
ttctgtgtctttcattacctgg

SEQ ID NO: 1183440 - DNA, 22 bp, Artificial Sequence
  chemically synthesized
actattctgtgtctttcattac

SEQ ID NO: 1183441 - DNA, 22 bp, Artificial Sequence
  chemically synthesized
tgactattctgtgtctttcatt

SEQ ID NO: 1183442 - DNA, 22 bp, Artificial Sequence
  chemically synthesized
tctgactattctgtgtctttca

SEQ ID NO: 1183443 - DNA, 22 bp, Artificial Sequence
  chemically synthesized
ctctctgactattctgtgtctt

SEQ ID NO: 1183444 - DNA, 22 bp, Artificial Sequence
  chemically synthesized
cctctctgactattctgtgtct

SEQ ID NO: 1183445 - DNA, 22 bp, Artificial Sequence
  chemically synthesized
ttcctctctgactattctgtgt

SEQ ID NO: 1183446 - DNA, 22 bp, Artificial Sequence
  chemically synthesized
agcgggttcttcctctctgact

SEQ ID NO: 1183447 - DNA, 22 bp, Artificial Sequence
  chemically synthesized
cactcagcgggttcttcctctc

SEQ ID NO: 1183448 - DNA, 22 bp, Artificial Sequence
  chemically synthesized
tacactcagcgggttcttcctc

SEQ ID NO: 1183449 - DNA, 22 bp, Artificial Sequence
  chemically synthesized
agcctctacactcagcgggttc

SEQ ID NO: 1183450 - DNA, 22 bp, Artificial Sequence
  chemically synthesized
tcagcctctacactcagcgggt

SEQ ID NO: 1183451 - DNA, 22 bp, Artificial Sequence
  chemically synthesized
ctcagcctctacactcagcggg

SEQ ID NO: 1183452 - DNA, 22 bp, Artificial Sequence
  chemically synthesized
tctcagcctctacactcagcgg

SEQ ID NO: 1183453 - DNA, 22 bp, Artificial Sequence
  chemically synthesized
ttctcagcctctacactcagcg

SEQ ID NO: 1183454 - DNA, 22 bp, Artificial Sequence
  chemically synthesized
atgaaacatttttctcagcctc

SEQ ID NO: 1183455 - DNA, 22 bp, Artificial Sequence
  chemically synthesized
agtgtagaggctgagaaaaatg

SEQ ID NO: 1183456 - DNA, 22 bp, Artificial Sequence
  chemically synthesized
ccactgatgaaacatttttctc

SEQ ID NO: 1183457 - DNA, 22 bp, Artificial Sequence
  chemically synthesized
taccactgatgaaacatttttc

SEQ ID NO: 1183458 - DNA, 22 bp, Artificial Sequence
  chemically synthesized
ctaccactgatgaaacattttt

SEQ ID NO: 1183459 - DNA, 22 bp, Artificial Sequence
  chemically synthesized
tctaccactgatgaaacatttt

SEQ ID NO: 1183460 - DNA, 22 bp, Artificial Sequence
  chemically synthesized
actttctaccactgatgaaaca

SEQ ID NO: 1183461 - DNA, 22 bp, Artificial Sequence
  chemically synthesized
ctaactttctaccactgatgaa

SEQ ID NO: 1183462 - DNA, 22 bp, Artificial Sequence
  chemically synthesized
agaaaaatgtttcatcagtggt

SEQ ID NO: 1183463 - DNA, 22 bp, Artificial Sequence
  chemically synthesized
tcctaactttctaccactgatg

SEQ ID NO: 1183464 - DNA, 22 bp, Artificial Sequence
  chemically synthesized
agctctcctaactttctaccac

SEQ ID NO: 1183465 - DNA, 22 bp, Artificial Sequence
  chemically synthesized
ttcagctctcctaactttctac

SEQ ID NO: 1183466 - DNA, 22 bp, Artificial Sequence
  chemically synthesized
attcagctctcctaactttcta

SEQ ID NO: 1183467 - DNA, 22 bp, Artificial Sequence
  chemically synthesized
tattcagctctcctaactttct

SEQ ID NO: 1183468 - DNA, 22 bp, Artificial Sequence
  chemically synthesized
ttattcagctctcctaactttc

SEQ ID NO: 1183469 - DNA, 22 bp, Artificial Sequence
  chemically synthesized
catcagtggtagaaagttagga

SEQ ID NO: 1183470 - DNA, 22 bp, Artificial Sequence
  chemically synthesized
atcagtggtagaaagttaggag

SEQ ID NO: 1183471 - DNA, 22 bp, Artificial Sequence
  chemically synthesized
ggagagctgaataaaagccatt

SEQ ID NO: 1183472 - DNA, 22 bp, Artificial Sequence
  chemically synthesized
atcacagagacaaatggctttt

SEQ ID NO: 1183473 - DNA, 22 bp, Artificial Sequence
  chemically synthesized
aatcacagagacaaatggcttt

SEQ ID NO: 1183474 - DNA, 22 bp, Artificial Sequence
  chemically synthesized
ttaatcacagagacaaatggct

SEQ ID NO: 1183475 - DNA, 22 bp, Artificial Sequence
  chemically synthesized
aataaaagccatttgtctctgt

SEQ ID NO: 1183476 - DNA, 22 bp, Artificial Sequence
  chemically synthesized
aacaaataagtattcttaatca

SEQ ID NO: 1183477 - DNA, 22 bp, Artificial Sequence
  chemically synthesized
ttcaacaaataagtattcttaa

SEQ ID NO: 1183478 - DNA, 22 bp, Artificial Sequence
  chemically synthesized
attcaacaaataagtattctta

SEQ ID NO: 1183479 - DNA, 22 bp, Artificial Sequence
  chemically synthesized
gtctctgtgattaagaatactt

SEQ ID NO: 1183480 - DNA, 22 bp, Artificial Sequence
  chemically synthesized
tctctgtgattaagaatactta

SEQ ID NO: 1183481 - DNA, 22 bp, Artificial Sequence
  chemically synthesized
tttattcaacaaataagtattc

SEQ ID NO: 1183482 - DNA, 22 bp, Artificial Sequence
  chemically synthesized
atttattcaacaaataagtatt

SEQ ID NO: 1183483 - DNA, 22 bp, Artificial Sequence
  chemically synthesized
tgtgattaagaatacttatttg

SEQ ID NO: 1183484 - DNA, 22 bp, Artificial Sequence
  chemically synthesized
tgattaagaatacttatttgtt

SEQ ID NO: 1183485 - DNA, 22 bp, Artificial Sequence
  chemically synthesized
atttatttattcaacaaataag

SEQ ID NO: 1183486 - DNA, 22 bp, Artificial Sequence
  chemically synthesized
catttatttattcaacaaataa

SEQ ID NO: 1183487 - DNA, 22 bp, Artificial Sequence
  chemically synthesized
acttcatttatttattcaacaa

SEQ ID NO: 1183488 - DNA, 22 bp, Artificial Sequence
  chemically synthesized
agaatacttatttgttgaataa

SEQ ID NO: 1183489 - DNA, 22 bp, Artificial Sequence
  chemically synthesized
aacttcatttatttattcaaca

SEQ ID NO: 1183490 - DNA, 22 bp, Artificial Sequence
  chemically synthesized
taacttcatttatttattcaac

SEQ ID NO: 1183491 - DNA, 22 bp, Artificial Sequence
  chemically synthesized
ctttaacttcatttatttattc

SEQ ID NO: 1183492 - DNA, 22 bp, Artificial Sequence
  chemically synthesized
tgctttaacttcatttatttat

SEQ ID NO: 1183493 - DNA, 22 bp, Artificial Sequence
  chemically synthesized
atttgttgaataaataaatgaa

SEQ ID NO: 1183494 - DNA, 22 bp, Artificial Sequence
  chemically synthesized
tttgttgaataaataaatgaag

SEQ ID NO: 1183495 - DNA, 22 bp, Artificial Sequence
  chemically synthesized
gttgaataaataaatgaagtta

SEQ ID NO: 1183496 - DNA, 22 bp, Artificial Sequence
  chemically synthesized
ttgaataaataaatgaagttaa

SEQ ID NO: 1183497 - DNA, 22 bp, Artificial Sequence
  chemically synthesized
aataaataaatgaagttaaagc

SEQ ID NO: 1183498 - DNA, 22 bp, Artificial Sequence
  chemically synthesized
cccagacacatcactctgcttt

SEQ ID NO: 1183499 - DNA, 22 bp, Artificial Sequence
  chemically synthesized
actccccagacacatcactctg

SEQ ID NO: 1183500 - DNA, 22 bp, Artificial Sequence
  chemically synthesized
aagcagagtgatgtgtctgggg

SEQ ID NO: 1183501 - DNA, 22 bp, Artificial Sequence
  chemically synthesized
tggaaaacacgtgcatgccctc

SEQ ID NO: 1183502 - DNA, 22 bp, Artificial Sequence
  chemically synthesized
gggagtgagggcatgcacgtgt

SEQ ID NO: 1183503 - DNA, 22 bp, Artificial Sequence
  chemically synthesized
tcccctatggaaaacacgtgca

SEQ ID NO: 1183504 - DNA, 22 bp, Artificial Sequence
  chemically synthesized
tccataggggacagtcacccac

SEQ ID NO: 1183505 - DNA, 22 bp, Artificial Sequence
  chemically synthesized
ccataggggacagtcacccaca

SEQ ID NO: 1183506 - DNA, 22 bp, Artificial Sequence
  chemically synthesized
cataggggacagtcacccacat

SEQ ID NO: 1183507 - DNA, 22 bp, Artificial Sequence
  chemically synthesized
taagaggagagagccatgtggg

SEQ ID NO: 1183508 - DNA, 22 bp, Artificial Sequence
  chemically synthesized
tataagaggagagagccatgtg

SEQ ID NO: 1183509 - DNA, 22 bp, Artificial Sequence
  chemically synthesized
tctataagaggagagagccatg

SEQ ID NO: 1183510 - DNA, 22 bp, Artificial Sequence
  chemically synthesized
cagagaaaaataacgttctcta

SEQ ID NO: 1183511 - DNA, 22 bp, Artificial Sequence
  chemically synthesized
tctcctcttatagagaacgtta

SEQ ID NO: 1183512 - DNA, 22 bp, Artificial Sequence
  chemically synthesized
tcctcttatagagaacgttatt

SEQ ID NO: 1183513 - DNA, 22 bp, Artificial Sequence
  chemically synthesized
gtctacagagaaaaataacgtt

SEQ ID NO: 1183514 - DNA, 22 bp, Artificial Sequence
  chemically synthesized
ctcttatagagaacgttatttt

SEQ ID NO: 1183515 - DNA, 22 bp, Artificial Sequence
  chemically synthesized
ctggtctacagagaaaaataac

SEQ ID NO: 1183516 - DNA, 22 bp, Artificial Sequence
  chemically synthesized
ttatagagaacgttatttttct

SEQ ID NO: 1183517 - DNA, 22 bp, Artificial Sequence
  chemically synthesized
gctggtctacagagaaaaataa

SEQ ID NO: 1183518 - DNA, 22 bp, Artificial Sequence
  chemically synthesized
atagagaacgttatttttctct

SEQ ID NO: 1183519 - DNA, 22 bp, Artificial Sequence
  chemically synthesized
tagagaacgttatttttctctg

SEQ ID NO: 1183520 - DNA, 22 bp, Artificial Sequence
  chemically synthesized
cttgctggtctacagagaaaaa

SEQ ID NO: 1183521 - DNA, 22 bp, Artificial Sequence
  chemically synthesized
acttgctggtctacagagaaaa

SEQ ID NO: 1183522 - DNA, 22 bp, Artificial Sequence
  chemically synthesized
aagtgtttacttgctggtctac

SEQ ID NO: 1183523 - DNA, 22 bp, Artificial Sequence
  chemically synthesized
tttttctctgtagaccagcaag

SEQ ID NO: 1183524 - DNA, 22 bp, Artificial Sequence
  chemically synthesized
ttaaagtgtttacttgctggtc

SEQ ID NO: 1183525 - DNA, 22 bp, Artificial Sequence
  chemically synthesized
attaaagtgtttacttgctggt

SEQ ID NO: 1183526 - DNA, 22 bp, Artificial Sequence
  chemically synthesized
tattaaagtgtttacttgctgg

SEQ ID NO: 1183527 - DNA, 22 bp, Artificial Sequence
  chemically synthesized
ttctctgtagaccagcaagtaa

SEQ ID NO: 1183528 - DNA, 22 bp, Artificial Sequence
  chemically synthesized
tctctgtagaccagcaagtaaa

SEQ ID NO: 1183529 - DNA, 22 bp, Artificial Sequence
  chemically synthesized
ctctgtagaccagcaagtaaac

SEQ ID NO: 1183530 - DNA, 22 bp, Artificial Sequence
  chemically synthesized
tctgtagaccagcaagtaaaca

SEQ ID NO: 1183531 - DNA, 22 bp, Artificial Sequence
  chemically synthesized
tgtagaccagcaagtaaacact

SEQ ID NO: 1183532 - DNA, 22 bp, Artificial Sequence
  chemically synthesized
tagaccagcaagtaaacacttt

SEQ ID NO: 1183533 - DNA, 22 bp, Artificial Sequence
  chemically synthesized
catcagaaagctttattaaagt

SEQ ID NO: 1183534 - DNA, 22 bp, Artificial Sequence
  chemically synthesized
attccatcagaaagctttatta

SEQ ID NO: 1183535 - DNA, 22 bp, Artificial Sequence
  chemically synthesized
gatctgattccatcagaaagct

SEQ ID NO: 1183536 - DNA, 22 bp, Artificial Sequence
  chemically synthesized
taataaagctttctgatggaat

SEQ ID NO: 1183537 - DNA, 22 bp, Artificial Sequence
  chemically synthesized
aataaagctttctgatggaatc

SEQ ID NO: 1183538 - DNA, 22 bp, Artificial Sequence
  chemically synthesized
ataaagctttctgatggaatca

SEQ ID NO: 1183539 - DNA, 22 bp, Artificial Sequence
  chemically synthesized
aagacaggctggatctgattcc

SEQ ID NO: 1183540 - DNA, 22 bp, Artificial Sequence
  chemically synthesized
tctgatggaatcagatccagcc

SEQ ID NO: 1183541 - DNA, 22 bp, Artificial Sequence
  chemically synthesized
ctgatggaatcagatccagcct

SEQ ID NO: 1183542 - DNA, 22 bp, Artificial Sequence
  chemically synthesized
tgatggaatcagatccagcctg

SEQ ID NO: 1183543 - DNA, 22 bp, Artificial Sequence
  chemically synthesized
atggaatcagatccagcctgtc

SEQ ID NO: 1183544 - DNA, 22 bp, Artificial Sequence
  chemically synthesized
aaaggaactcaagacaggctgg

SEQ ID NO: 1183545 - DNA, 22 bp, Artificial Sequence
  chemically synthesized
caaaggaactcaagacaggctg

SEQ ID NO: 1183546 - DNA, 22 bp, Artificial Sequence
  chemically synthesized
cttcaaaggaactcaagacagg

SEQ ID NO: 1183547 - DNA, 22 bp, Artificial Sequence
  chemically synthesized
tacttcaaaggaactcaagaca

SEQ ID NO: 1183548 - DNA, 22 bp, Artificial Sequence
  chemically synthesized
ctctacttcaaaggaactcaag

SEQ ID NO: 1183549 - DNA, 22 bp, Artificial Sequence
  chemically synthesized
tacctgctctacttcaaaggaa

SEQ ID NO: 1183550 - DNA, 22 bp, Artificial Sequence
  chemically synthesized
tcttgagttcctttgaagtaga

SEQ ID NO: 1183551 - DNA, 22 bp, Artificial Sequence
  chemically synthesized
caggctgtacctgctctacttc

SEQ ID NO: 1183552 - DNA, 22 bp, Artificial Sequence
  chemically synthesized
gagttcctttgaagtagagcag

SEQ ID NO: 1183553 - DNA, 22 bp, Artificial Sequence
  chemically synthesized
agttcctttgaagtagagcagg

SEQ ID NO: 1183554 - DNA, 22 bp, Artificial Sequence
  chemically synthesized
cccctacaggctgtacctgctc

SEQ ID NO: 1183555 - DNA, 22 bp, Artificial Sequence
  chemically synthesized
ctttgaagtagagcaggtacag

SEQ ID NO: 1183556 - DNA, 22 bp, Artificial Sequence
  chemically synthesized
actgcccctacaggctgtacct

SEQ ID NO: 1183557 - DNA, 22 bp, Artificial Sequence
  chemically synthesized
tgaagtagagcaggtacagcct

SEQ ID NO: 1183558 - DNA, 22 bp, Artificial Sequence
  chemically synthesized
cactgcccctacaggctgtacc

SEQ ID NO: 1183559 - DNA, 22 bp, Artificial Sequence
  chemically synthesized
gaagtagagcaggtacagcctg

SEQ ID NO: 1183560 - DNA, 22 bp, Artificial Sequence
  chemically synthesized
tcactgcccctacaggctgtac

SEQ ID NO: 1183561 - DNA, 22 bp, Artificial Sequence
  chemically synthesized
aagtagagcaggtacagcctgt

SEQ ID NO: 1183562 - DNA, 22 bp, Artificial Sequence
  chemically synthesized
agctttcactgcccctacaggc

SEQ ID NO: 1183563 - DNA, 22 bp, Artificial Sequence
  chemically synthesized
taggggcagtgaaagctcagtc

SEQ ID NO: 1183564 - DNA, 22 bp, Artificial Sequence
  chemically synthesized
aaaagtgtcaaaaggactgagc

SEQ ID NO: 1183565 - DNA, 22 bp, Artificial Sequence
  chemically synthesized
caaaagtgtcaaaaggactgag

SEQ ID NO: 1183566 - DNA, 22 bp, Artificial Sequence
  chemically synthesized
tttcaaaagtgtcaaaaggact

SEQ ID NO: 1183567 - DNA, 22 bp, Artificial Sequence
  chemically synthesized
atttcaaaagtgtcaaaaggac

SEQ ID NO: 1183568 - DNA, 22 bp, Artificial Sequence
  chemically synthesized
agaacatttatttcaaaagtgt

SEQ ID NO: 1183569 - DNA, 22 bp, Artificial Sequence
  chemically synthesized
agtccttttgacacttttgaaa

SEQ ID NO: 1183570 - DNA, 22 bp, Artificial Sequence
  chemically synthesized
acactaagaacatttatttcaa

SEQ ID NO: 1183571 - DNA, 22 bp, Artificial Sequence
  chemically synthesized
ttgacacttttgaaataaatgt

SEQ ID NO: 1183572 - DNA, 22 bp, Artificial Sequence
  chemically synthesized
ttcacactaagaacatttattt

SEQ ID NO: 1183573 - DNA, 22 bp, Artificial Sequence
  chemically synthesized
tgacacttttgaaataaatgtt

SEQ ID NO: 1183574 - DNA, 22 bp, Artificial Sequence
  chemically synthesized
gacacttttgaaataaatgttc

SEQ ID NO: 1183575 - DNA, 22 bp, Artificial Sequence
  chemically synthesized
acacttttgaaataaatgttct

SEQ ID NO: 1183576 - DNA, 22 bp, Artificial Sequence
  chemically synthesized
attattcacactaagaacattt

SEQ ID NO: 1183577 - DNA, 22 bp, Artificial Sequence
  chemically synthesized
aattattcacactaagaacatt

SEQ ID NO: 1183578 - DNA, 22 bp, Artificial Sequence
  chemically synthesized
ttgaaataaatgttcttagtgt

SEQ ID NO: 1183579 - DNA, 22 bp, Artificial Sequence
  chemically synthesized
tgaaataaatgttcttagtgtg

SEQ ID NO: 1183580 - DNA, 22 bp, Artificial Sequence
  chemically synthesized
gaaataaatgttcttagtgtga

SEQ ID NO: 1183581 - DNA, 22 bp, Artificial Sequence
  chemically synthesized
aaataaatgttcttagtgtgaa

SEQ ID NO: 1183582 - DNA, 22 bp, Artificial Sequence
  chemically synthesized
ataagtgtatgccttaattatt

SEQ ID NO: 1183583 - DNA, 22 bp, Artificial Sequence
  chemically synthesized
gataagtgtatgccttaattat

SEQ ID NO: 1183584 - DNA, 22 bp, Artificial Sequence
  chemically synthesized
ttagtgtgaataattaaggcat

SEQ ID NO: 1183585 - DNA, 22 bp, Artificial Sequence
  chemically synthesized
agtgtgaataattaaggcatac

SEQ ID NO: 1183586 - DNA, 22 bp, Artificial Sequence
  chemically synthesized
ggtttgataagtgtatgcctta

SEQ ID NO: 1183587 - DNA, 22 bp, Artificial Sequence
  chemically synthesized
gtgtgaataattaaggcataca

SEQ ID NO: 1183588 - DNA, 22 bp, Artificial Sequence
  chemically synthesized
catgtagttaggtttgataagt

SEQ ID NO: 1183589 - DNA, 22 bp, Artificial Sequence
  chemically synthesized
aggcatacacttatcaaaccta

SEQ ID NO: 1183590 - DNA, 22 bp, Artificial Sequence
  chemically synthesized
atcaaacctaactacatgtaac

SEQ ID NO: 1183591 - DNA, 22 bp, Artificial Sequence
  chemically synthesized
tcaaacctaactacatgtaaca

SEQ ID NO: 1183592 - DNA, 22 bp, Artificial Sequence
  chemically synthesized
actacatgtaacatcatcttct

SEQ ID NO: 1183593 - DNA, 22 bp, Artificial Sequence
  chemically synthesized
aaggaagcatatcagaagatga

SEQ ID NO: 1183594 - DNA, 22 bp, Artificial Sequence
  chemically synthesized
catgtaacatcatcttctgata

SEQ ID NO: 1183595 - DNA, 22 bp, Artificial Sequence
  chemically synthesized
tcactaaaggaagcatatcaga

SEQ ID NO: 1183596 - DNA, 22 bp, Artificial Sequence
  chemically synthesized
tgtcactaaaggaagcatatca

SEQ ID NO: 1183597 - DNA, 22 bp, Artificial Sequence
  chemically synthesized
ctgatatgcttcctttagtgac

SEQ ID NO: 1183598 - DNA, 22 bp, Artificial Sequence
  chemically synthesized
tgatatgcttcctttagtgaca

SEQ ID NO: 1183599 - DNA, 22 bp, Artificial Sequence
  chemically synthesized
atatgcttcctttagtgacaga

SEQ ID NO: 1183600 - DNA, 22 bp, Artificial Sequence
  chemically synthesized
cctttagtgacagaatatatca

SEQ ID NO: 1183601 - DNA, 22 bp, Artificial Sequence
  chemically synthesized
ctttagtgacagaatatatcat

SEQ ID NO: 1183602 - DNA, 22 bp, Artificial Sequence
  chemically synthesized
tagtgacagaatatatcattcc

SEQ ID NO: 1183603 - DNA, 22 bp, Artificial Sequence
  chemically synthesized
agtgacagaatatatcattccc

SEQ ID NO: 1183604 - DNA, 22 bp, Artificial Sequence
  chemically synthesized
gtgacagaatatatcattcccc

SEQ ID NO: 1183605 - DNA, 22 bp, Artificial Sequence
  chemically synthesized
cccatcccccatctcttgtgat

SEQ ID NO: 1183606 - DNA, 22 bp, Artificial Sequence
  chemically synthesized
aaaaagacacagcacaaatcac

SEQ ID NO: 1183607 - DNA, 22 bp, Artificial Sequence
  chemically synthesized
aaaaaagacacagcacaaatca

SEQ ID NO: 1183608 - DNA, 22 bp, Artificial Sequence
  chemically synthesized
tcatttaaaaaagacacagcac

SEQ ID NO: 1183609 - DNA, 22 bp, Artificial Sequence
  chemically synthesized
atcatttaaaaaagacacagca

SEQ ID NO: 1183610 - DNA, 22 bp, Artificial Sequence
  chemically synthesized
ttgtgatttgtgctgtgtcttt

SEQ ID NO: 1183611 - DNA, 22 bp, Artificial Sequence
  chemically synthesized
gtgatttgtgctgtgtcttttt

SEQ ID NO: 1183612 - DNA, 22 bp, Artificial Sequence
  chemically synthesized
tgatttgtgctgtgtctttttt

SEQ ID NO: 1183613 - DNA, 22 bp, Artificial Sequence
  chemically synthesized
gtgctgtgtcttttttaaatga

SEQ ID NO: 1183614 - DNA, 22 bp, Artificial Sequence
  chemically synthesized
tgctgtgtcttttttaaatgat

SEQ ID NO: 1183615 - DNA, 22 bp, Artificial Sequence
  chemically synthesized
tgtcttttttaaatgataaaca

SEQ ID NO: 1183616 - DNA, 22 bp, Artificial Sequence
  chemically synthesized
aaataaatgtaatgtttatcat

SEQ ID NO: 1183617 - DNA, 22 bp, Artificial Sequence
  chemically synthesized
ttttaaatgataaacattacat

SEQ ID NO: 1183618 - DNA, 22 bp, Artificial Sequence
  chemically synthesized
tttaaatgataaacattacatt

SEQ ID NO: 1183619 - DNA, 22 bp, Artificial Sequence
  chemically synthesized
ttaaatgataaacattacattt

SEQ ID NO: 1183620 - DNA, 22 bp, Artificial Sequence
  chemically synthesized
taaatgataaacattacattta

SEQ ID NO: 1183621 - DNA, 22 bp, Artificial Sequence
  chemically synthesized
aaatgataaacattacatttat

SEQ ID NO: 1183622 - DNA, 22 bp, Artificial Sequence
  chemically synthesized
aatgataaacattacatttatt

SEQ ID NO: 1183623 - DNA, 22 bp, Artificial Sequence
  chemically synthesized
aaataagccattcaaataaatg

SEQ ID NO: 1183624 - DNA, 22 bp, Artificial Sequence
  chemically synthesized
aaaataagccattcaaataaat

SEQ ID NO: 1183625 - DNA, 22 bp, Artificial Sequence
  chemically synthesized
tttaaaataagccattcaaata

SEQ ID NO: 1183626 - DNA, 22 bp, Artificial Sequence
  chemically synthesized
atttaaaataagccattcaaat

SEQ ID NO: 1183627 - DNA, 22 bp, Artificial Sequence
  chemically synthesized
tatttaaaataagccattcaaa

SEQ ID NO: 1183628 - DNA, 22 bp, Artificial Sequence
  chemically synthesized
ttttatttaaaataagccattc

SEQ ID NO: 1183629 - DNA, 22 bp, Artificial Sequence
  chemically synthesized
gttttatttaaaataagccatt

SEQ ID NO: 1183630 - DNA, 22 bp, Artificial Sequence
  chemically synthesized
catttatttgaatggcttattt

SEQ ID NO: 1183631 - DNA, 22 bp, Artificial Sequence
  chemically synthesized
cttgttttatttaaaataagcc

SEQ ID NO: 1183632 - DNA, 22 bp, Artificial Sequence
  chemically synthesized
acttgttttatttaaaataagc

SEQ ID NO: 1183633 - DNA, 22 bp, Artificial Sequence
  chemically synthesized
atttgaatggcttattttaaat

SEQ ID NO: 1183634 - DNA, 22 bp, Artificial Sequence
  chemically synthesized
tttgaatggcttattttaaata

SEQ ID NO: 1183635 - DNA, 22 bp, Artificial Sequence
  chemically synthesized
acttacttgttttatttaaaat

SEQ ID NO: 1183636 - DNA, 22 bp, Artificial Sequence
  chemically synthesized
gaatggcttattttaaataaaa

SEQ ID NO: 1183637 - DNA, 22 bp, Artificial Sequence
  chemically synthesized
aatggcttattttaaataaaac

SEQ ID NO: 1183638 - DNA, 22 bp, Artificial Sequence
  chemically synthesized
aacaaattcacttacttgtttt

SEQ ID NO: 1183639 - DNA, 22 bp, Artificial Sequence
  chemically synthesized
attttaaataaaacaagtaagt

SEQ ID NO: 1183640 - DNA, 22 bp, Artificial Sequence
  chemically synthesized
ttttaaataaaacaagtaagtg

SEQ ID NO: 1183641 - DNA, 22 bp, Artificial Sequence
  chemically synthesized
taaataaaacaagtaagtgaat

SEQ ID NO: 1183642 - DNA, 22 bp, Artificial Sequence
  chemically synthesized
aaataaaacaagtaagtgaatt

SEQ ID NO: 1183643 - DNA, 22 bp, Artificial Sequence
  chemically synthesized
aataaaacaagtaagtgaattt

SEQ ID NO: 1183644 - DNA, 22 bp, Artificial Sequence
  chemically synthesized
gttgaattatctgtgatttatg

SEQ ID NO: 1183645 - DNA, 22 bp, Artificial Sequence
  chemically synthesized
ttgaattatctgtgatttatga

SEQ ID NO: 1183646 - DNA, 22 bp, Artificial Sequence
  chemically synthesized
aattatctgtgatttatgacat

SEQ ID NO: 1183647 - DNA, 22 bp, Artificial Sequence
  chemically synthesized
ccaaatacataatatgtcataa

SEQ ID NO: 1183648 - DNA, 22 bp, Artificial Sequence
  chemically synthesized
tctgtgatttatgacatattat

SEQ ID NO: 1183649 - DNA, 22 bp, Artificial Sequence
  chemically synthesized
tgatttatgacatattatgtat

SEQ ID NO: 1183650 - DNA, 22 bp, Artificial Sequence
  chemically synthesized
tgtaaatattaccaaatacata

SEQ ID NO: 1183651 - DNA, 22 bp, Artificial Sequence
  chemically synthesized
gtgtaaatattaccaaatacat

SEQ ID NO: 1183652 - DNA, 22 bp, Artificial Sequence
  chemically synthesized
tgtgtaaatattaccaaataca

SEQ ID NO: 1183653 - DNA, 22 bp, Artificial Sequence
  chemically synthesized
atgacatattatgtatttggta

SEQ ID NO: 1183654 - DNA, 22 bp, Artificial Sequence
  chemically synthesized
tgacatattatgtatttggtaa

SEQ ID NO: 1183655 - DNA, 22 bp, Artificial Sequence
  chemically synthesized
cctttgtgtaaatattaccaaa

SEQ ID NO: 1183656 - DNA, 22 bp, Artificial Sequence
  chemically synthesized
tacctttgtgtaaatattacca

SEQ ID NO: 1183657 - DNA, 22 bp, Artificial Sequence
  chemically synthesized
attctacctttgtgtaaatatt

SEQ ID NO: 1183658 - DNA, 22 bp, Artificial Sequence
  chemically synthesized
tgtatttggtaatatttacaca

SEQ ID NO: 1183659 - DNA, 22 bp, Artificial Sequence
  chemically synthesized
ctcattctacctttgtgtaaat

SEQ ID NO: 1183660 - DNA, 22 bp, Artificial Sequence
  chemically synthesized
tgctcattctacctttgtgtaa

SEQ ID NO: 1183661 - DNA, 22 bp, Artificial Sequence
  chemically synthesized
ggtaatatttacacaaaggtag

SEQ ID NO: 1183662 - DNA, 22 bp, Artificial Sequence
  chemically synthesized
gtaatatttacacaaaggtaga

SEQ ID NO: 1183663 - DNA, 22 bp, Artificial Sequence
  chemically synthesized
ggctctgctcattctacctttg

SEQ ID NO: 1183664 - DNA, 22 bp, Artificial Sequence
  chemically synthesized
ctaggctctgctcattctacct

SEQ ID NO: 1183665 - DNA, 22 bp, Artificial Sequence
  chemically synthesized
gctaggctctgctcattctacc

SEQ ID NO: 1183666 - DNA, 22 bp, Artificial Sequence
  chemically synthesized
acacaaaggtagaatgagcaga

SEQ ID NO: 1183667 - DNA, 22 bp, Artificial Sequence
  chemically synthesized
cacaaaggtagaatgagcagag

SEQ ID NO: 1183668 - DNA, 22 bp, Artificial Sequence
  chemically synthesized
catcttgctaggctctgctcat

SEQ ID NO: 1183669 - DNA, 22 bp, Artificial Sequence
  chemically synthesized
acatcttgctaggctctgctca

SEQ ID NO: 1183670 - DNA, 22 bp, Artificial Sequence
  chemically synthesized
caaatggacttacatcttgcta

SEQ ID NO: 1183671 - DNA, 22 bp, Artificial Sequence
  chemically synthesized
atgaagtaattacaaatggact

SEQ ID NO: 1183672 - DNA, 22 bp, Artificial Sequence
  chemically synthesized
aatgaagtaattacaaatggac

SEQ ID NO: 1183673 - DNA, 22 bp, Artificial Sequence
  chemically synthesized
gcaagatgtaagtccatttgta

SEQ ID NO: 1183674 - DNA, 22 bp, Artificial Sequence
  chemically synthesized
cttaatgaagtaattacaaatg

SEQ ID NO: 1183675 - DNA, 22 bp, Artificial Sequence
  chemically synthesized
aggtatgactccttaatgaagt

SEQ ID NO: 1183676 - DNA, 22 bp, Artificial Sequence
  chemically synthesized
gtaattacttcattaaggagtc

SEQ ID NO: 1183677 - DNA, 22 bp, Artificial Sequence
  chemically synthesized
taattacttcattaaggagtca

SEQ ID NO: 1183678 - DNA, 22 bp, Artificial Sequence
  chemically synthesized
aggcatcgctcaggtatgactc

SEQ ID NO: 1183679 - DNA, 22 bp, Artificial Sequence
  chemically synthesized
cttcattaaggagtcatacctg

SEQ ID NO: 1183680 - DNA, 22 bp, Artificial Sequence
  chemically synthesized
attaaggcatcgctcaggtatg

SEQ ID NO: 1183681 - DNA, 22 bp, Artificial Sequence
  chemically synthesized
cattaaggagtcatacctgagc

SEQ ID NO: 1183682 - DNA, 22 bp, Artificial Sequence
  chemically synthesized
cattaaggcatcgctcaggtat

SEQ ID NO: 1183683 - DNA, 22 bp, Artificial Sequence
  chemically synthesized
attaaggagtcatacctgagcg

SEQ ID NO: 1183684 - DNA, 22 bp, Artificial Sequence
  chemically synthesized
aggagtcatacctgagcgatgc

SEQ ID NO: 1183685 - DNA, 22 bp, Artificial Sequence
  chemically synthesized
atcaccaccttcattaaggcat

SEQ ID NO: 1183686 - DNA, 22 bp, Artificial Sequence
  chemically synthesized
acctcatcaccaccttcattaa

SEQ ID NO: 1183687 - DNA, 22 bp, Artificial Sequence
  chemically synthesized
cacctcatcaccaccttcatta

SEQ ID NO: 1183688 - DNA, 22 bp, Artificial Sequence
  chemically synthesized
tcacctcatcaccaccttcatt

SEQ ID NO: 1183689 - DNA, 22 bp, Artificial Sequence
  chemically synthesized
agcgatgccttaatgaaggtgg

SEQ ID NO: 1183690 - DNA, 22 bp, Artificial Sequence
  chemically synthesized
gtagcacattttcacctcatca

SEQ ID NO: 1183691 - DNA, 22 bp, Artificial Sequence
  chemically synthesized
aatgaaggtggtgatgaggtga

SEQ ID NO: 1183692 - DNA, 22 bp, Artificial Sequence
  chemically synthesized
atgaaggtggtgatgaggtgaa

SEQ ID NO: 1183693 - DNA, 22 bp, Artificial Sequence
  chemically synthesized
tggtagcacattttcacctcat

SEQ ID NO: 1183694 - DNA, 22 bp, Artificial Sequence
  chemically synthesized
ttctggtagcacattttcacct

SEQ ID NO: 1183695 - DNA, 22 bp, Artificial Sequence
  chemically synthesized
caatgcctattctggtagcaca

SEQ ID NO: 1183696 - DNA, 22 bp, Artificial Sequence
  chemically synthesized
tccaatgcctattctggtagca

SEQ ID NO: 1183697 - DNA, 22 bp, Artificial Sequence
  chemically synthesized
ctccaatgcctattctggtagc

SEQ ID NO: 1183698 - DNA, 22 bp, Artificial Sequence
  chemically synthesized
tctccaatgcctattctggtag

SEQ ID NO: 1183699 - DNA, 22 bp, Artificial Sequence
  chemically synthesized
ggttttctccaatgcctattct

SEQ ID NO: 1183700 - DNA, 22 bp, Artificial Sequence
  chemically synthesized
taggttttctccaatgcctatt

SEQ ID NO: 1183701 - DNA, 22 bp, Artificial Sequence
  chemically synthesized
ctaggttttctccaatgcctat

SEQ ID NO: 1183702 - DNA, 22 bp, Artificial Sequence
  chemically synthesized
tctaggttttctccaatgccta

SEQ ID NO: 1183703 - DNA, 22 bp, Artificial Sequence
  chemically synthesized
ttctaggttttctccaatgcct

SEQ ID NO: 1183704 - DNA, 22 bp, Artificial Sequence
  chemically synthesized
ccttttctaggttttctccaat

SEQ ID NO: 1183705 - DNA, 22 bp, Artificial Sequence
  chemically synthesized
ccagaataggcattggagaaaa

SEQ ID NO: 1183706 - DNA, 22 bp, Artificial Sequence
  chemically synthesized
agctgccttttctaggttttct

SEQ ID NO: 1183707 - DNA, 22 bp, Artificial Sequence
  chemically synthesized
ttgagctgccttttctaggttt

SEQ ID NO: 1183708 - DNA, 22 bp, Artificial Sequence
  chemically synthesized
attgagctgccttttctaggtt

SEQ ID NO: 1183709 - DNA, 22 bp, Artificial Sequence
  chemically synthesized
tattgagctgccttttctaggt

SEQ ID NO: 1183710 - DNA, 22 bp, Artificial Sequence
  chemically synthesized
gagaaaacctagaaaaggcagc

SEQ ID NO: 1183711 - DNA, 22 bp, Artificial Sequence
  chemically synthesized
tcactttattgagctgcctttt

SEQ ID NO: 1183712 - DNA, 22 bp, Artificial Sequence
  chemically synthesized
attatcactttattgagctgcc

SEQ ID NO: 1183713 - DNA, 22 bp, Artificial Sequence
  chemically synthesized
tcattatcactttattgagctg

SEQ ID NO: 1183714 - DNA, 22 bp, Artificial Sequence
  chemically synthesized
gaaaaggcagctcaataaagtg

SEQ ID NO: 1183715 - DNA, 22 bp, Artificial Sequence
  chemically synthesized
cccctctcattatcactttatt

SEQ ID NO: 1183716 - DNA, 22 bp, Artificial Sequence
  chemically synthesized
ccccctctcattatcactttat

SEQ ID NO: 1183717 - DNA, 22 bp, Artificial Sequence
  chemically synthesized
tccccctctcattatcacttta

SEQ ID NO: 1183718 - DNA, 22 bp, Artificial Sequence
  chemically synthesized
ttccccctctcattatcacttt

SEQ ID NO: 1183719 - DNA, 22 bp, Artificial Sequence
  chemically synthesized
tttccccctctcattatcactt

SEQ ID NO: 1183720 - DNA, 22 bp, Artificial Sequence
  chemically synthesized
ttttccccctctcattatcact

SEQ ID NO: 1183721 - DNA, 22 bp, Artificial Sequence
  chemically synthesized
aataaagtgataatgagagggg

SEQ ID NO: 1183722 - DNA, 22 bp, Artificial Sequence
  chemically synthesized
aggagcatacaccaagcaaaga

SEQ ID NO: 1183723 - DNA, 22 bp, Artificial Sequence
  chemically synthesized
agattaaggagcatacaccaag

SEQ ID NO: 1183724 - DNA, 22 bp, Artificial Sequence
  chemically synthesized
ctaagattaaggagcatacacc

SEQ ID NO: 1183725 - DNA, 22 bp, Artificial Sequence
  chemically synthesized
tatctttgcttggtgtatgctc

SEQ ID NO: 1183726 - DNA, 22 bp, Artificial Sequence
  chemically synthesized
tgcttggtgtatgctccttaat

SEQ ID NO: 1183727 - DNA, 22 bp, Artificial Sequence
  chemically synthesized
gcttggtgtatgctccttaatc

SEQ ID NO: 1183728 - DNA, 22 bp, Artificial Sequence
  chemically synthesized
cttggtgtatgctccttaatct

SEQ ID NO: 1183729 - DNA, 22 bp, Artificial Sequence
  chemically synthesized
ggtgtatgctccttaatcttag

SEQ ID NO: 1183730 - DNA, 22 bp, Artificial Sequence
  chemically synthesized
gtgtatgctccttaatcttagg

SEQ ID NO: 1183731 - DNA, 22 bp, Artificial Sequence
  chemically synthesized
aggaataagtgccacctcctaa

SEQ ID NO: 1183732 - DNA, 22 bp, Artificial Sequence
  chemically synthesized
aaggaataagtgccacctccta

SEQ ID NO: 1183733 - DNA, 22 bp, Artificial Sequence
  chemically synthesized
cttaatcttaggaggtggcact

SEQ ID NO: 1183734 - DNA, 22 bp, Artificial Sequence
  chemically synthesized
aatcttaggaggtggcacttat

SEQ ID NO: 1183735 - DNA, 22 bp, Artificial Sequence
  chemically synthesized
atcttaggaggtggcacttatt

SEQ ID NO: 1183736 - DNA, 22 bp, Artificial Sequence
  chemically synthesized
aggaggtggcacttattcctta

SEQ ID NO: 1183737 - DNA, 22 bp, Artificial Sequence
  chemically synthesized
ggaggtggcacttattccttaa

SEQ ID NO: 1183738 - DNA, 22 bp, Artificial Sequence
  chemically synthesized
aaatcaccaagacttaaggaat

SEQ ID NO: 1183739 - DNA, 22 bp, Artificial Sequence
  chemically synthesized
cgttgaaatcaccaagacttaa

SEQ ID NO: 1183740 - DNA, 22 bp, Artificial Sequence
  chemically synthesized
cctccgttgaaatcaccaagac

SEQ ID NO: 1183741 - DNA, 22 bp, Artificial Sequence
  chemically synthesized
attccttaagtcttggtgattt

SEQ ID NO: 1183742 - DNA, 22 bp, Artificial Sequence
  chemically synthesized
ttccttaagtcttggtgatttc

SEQ ID NO: 1183743 - DNA, 22 bp, Artificial Sequence
  chemically synthesized
cttaagtcttggtgatttcaac

SEQ ID NO: 1183744 - DNA, 22 bp, Artificial Sequence
  chemically synthesized
tcaccattccctccgttgaaat

SEQ ID NO: 1183745 - DNA, 22 bp, Artificial Sequence
  chemically synthesized
aagtcttggtgatttcaacgga

SEQ ID NO: 1183746 - DNA, 22 bp, Artificial Sequence
  chemically synthesized
atcaccattccctccgttgaaa

SEQ ID NO: 1183747 - DNA, 22 bp, Artificial Sequence
  chemically synthesized
agtcttggtgatttcaacggag

SEQ ID NO: 1183748 - DNA, 22 bp, Artificial Sequence
  chemically synthesized
aatttatcaccattccctccgt

SEQ ID NO: 1183749 - DNA, 22 bp, Artificial Sequence
  chemically synthesized
ggtgatttcaacggagggaatg

SEQ ID NO: 1183750 - DNA, 22 bp, Artificial Sequence
  chemically synthesized
gtgatttcaacggagggaatgg

SEQ ID NO: 1183751 - DNA, 22 bp, Artificial Sequence
  chemically synthesized
gactcaatttatcaccattccc

SEQ ID NO: 1183752 - DNA, 22 bp, Artificial Sequence
  chemically synthesized
tagactcaatttatcaccattc

SEQ ID NO: 1183753 - DNA, 22 bp, Artificial Sequence
  chemically synthesized
tctagactcaatttatcaccat

SEQ ID NO: 1183754 - DNA, 22 bp, Artificial Sequence
  chemically synthesized
caacggagggaatggtgataaa

SEQ ID NO: 1183755 - DNA, 22 bp, Artificial Sequence
  chemically synthesized
aacggagggaatggtgataaat

SEQ ID NO: 1183756 - DNA, 22 bp, Artificial Sequence
  chemically synthesized
catcgactctctagactcaatt

SEQ ID NO: 1183757 - DNA, 22 bp, Artificial Sequence
  chemically synthesized
tccatcgactctctagactcaa

SEQ ID NO: 1183758 - DNA, 22 bp, Artificial Sequence
  chemically synthesized
actctccatcgactctctagac

SEQ ID NO: 1183759 - DNA, 22 bp, Artificial Sequence
  chemically synthesized
gactctccatcgactctctaga

SEQ ID NO: 1183760 - DNA, 22 bp, Artificial Sequence
  chemically synthesized
ttgactctccatcgactctcta

SEQ ID NO: 1183761 - DNA, 22 bp, Artificial Sequence
  chemically synthesized
gacctcttgactctccatcgac

SEQ ID NO: 1183762 - DNA, 22 bp, Artificial Sequence
  chemically synthesized
agtctagagagtcgatggagag

SEQ ID NO: 1183763 - DNA, 22 bp, Artificial Sequence
  chemically synthesized
tggacctcttgactctccatcg

SEQ ID NO: 1183764 - DNA, 22 bp, Artificial Sequence
  chemically synthesized
attctggacctcttgactctcc

SEQ ID NO: 1183765 - DNA, 22 bp, Artificial Sequence
  chemically synthesized
gagagtcgatggagagtcaaga

SEQ ID NO: 1183766 - DNA, 22 bp, Artificial Sequence
  chemically synthesized
tcattctggacctcttgactct

SEQ ID NO: 1183767 - DNA, 22 bp, Artificial Sequence
  chemically synthesized
tctcattctggacctcttgact

SEQ ID NO: 1183768 - DNA, 22 bp, Artificial Sequence
  chemically synthesized
tctctcattctggacctcttga

SEQ ID NO: 1183769 - DNA, 22 bp, Artificial Sequence
  chemically synthesized
actctctctcattctggacctc

SEQ ID NO: 1183770 - DNA, 22 bp, Artificial Sequence
  chemically synthesized
tcactctctctcattctggacc

SEQ ID NO: 1183771 - DNA, 22 bp, Artificial Sequence
  chemically synthesized
ctcactctctctcattctggac

SEQ ID NO: 1183772 - DNA, 22 bp, Artificial Sequence
  chemically synthesized
ttctcactctctctcattctgg

SEQ ID NO: 1183773 - DNA, 22 bp, Artificial Sequence
  chemically synthesized
tcttctcactctctctcattct

SEQ ID NO: 1183774 - DNA, 22 bp, Artificial Sequence
  chemically synthesized
caaagctctcttctcactctct

SEQ ID NO: 1183775 - DNA, 22 bp, Artificial Sequence
  chemically synthesized
gcaaagctctcttctcactctc

SEQ ID NO: 1183776 - DNA, 22 bp, Artificial Sequence
  chemically synthesized
cttgcaaagctctcttctcact

SEQ ID NO: 1183777 - DNA, 22 bp, Artificial Sequence
  chemically synthesized
acttgcaaagctctcttctcac

SEQ ID NO: 1183778 - DNA, 22 bp, Artificial Sequence
  chemically synthesized
gtttacttgcaaagctctcttc

SEQ ID NO: 1183779 - DNA, 22 bp, Artificial Sequence
  chemically synthesized
gctagtttacttgcaaagctct

SEQ ID NO: 1183780 - DNA, 22 bp, Artificial Sequence
  chemically synthesized
ggctagtttacttgcaaagctc

SEQ ID NO: 1183781 - DNA, 22 bp, Artificial Sequence
  chemically synthesized
catccttggctagtttacttgc

SEQ ID NO: 1183782 - DNA, 22 bp, Artificial Sequence
  chemically synthesized
tgacctccatccttggctagtt

SEQ ID NO: 1183783 - DNA, 22 bp, Artificial Sequence
  chemically synthesized
tgcaagtaaactagccaaggat

SEQ ID NO: 1183784 - DNA, 22 bp, Artificial Sequence
  chemically synthesized
gcaagtaaactagccaaggatg

SEQ ID NO: 1183785 - DNA, 22 bp, Artificial Sequence
  chemically synthesized
caagtaaactagccaaggatgg

SEQ ID NO: 1183786 - DNA, 22 bp, Artificial Sequence
  chemically synthesized
aaatagttatgacctccatcct

SEQ ID NO: 1183787 - DNA, 22 bp, Artificial Sequence
  chemically synthesized
gaaatagttatgacctccatcc

SEQ ID NO: 1183788 - DNA, 22 bp, Artificial Sequence
  chemically synthesized
tgaaatagttatgacctccatc

SEQ ID NO: 1183789 - DNA, 22 bp, Artificial Sequence
  chemically synthesized
agctttgaaatagttatgacct

SEQ ID NO: 1183790 - DNA, 22 bp, Artificial Sequence
  chemically synthesized
gccaaggatggaggtcataact

SEQ ID NO: 1183791 - DNA, 22 bp, Artificial Sequence
  chemically synthesized
taagctttgaaatagttatgac

SEQ ID NO: 1183792 - DNA, 22 bp, Artificial Sequence
  chemically synthesized
aaaattctaagctttgaaatag

SEQ ID NO: 1183793 - DNA, 22 bp, Artificial Sequence
  chemically synthesized
gctgaaaattctaagctttgaa

SEQ ID NO: 1183794 - DNA, 22 bp, Artificial Sequence
  chemically synthesized
tttcaaagcttagaattttcag

SEQ ID NO: 1183795 - DNA, 22 bp, Artificial Sequence
  chemically synthesized
atcgatgcattagctgaaaatt

SEQ ID NO: 1183796 - DNA, 22 bp, Artificial Sequence
  chemically synthesized
caaagcttagaattttcagcta

SEQ ID NO: 1183797 - DNA, 22 bp, Artificial Sequence
  chemically synthesized
aaagcttagaattttcagctaa

SEQ ID NO: 1183798 - DNA, 22 bp, Artificial Sequence
  chemically synthesized
gcagttaatcgatgcattagct

SEQ ID NO: 1183799 - DNA, 22 bp, Artificial Sequence
  chemically synthesized
ggcagttaatcgatgcattagc

SEQ ID NO: 1183800 - DNA, 22 bp, Artificial Sequence
  chemically synthesized
agaattttcagctaatgcatcg

SEQ ID NO: 1183801 - DNA, 22 bp, Artificial Sequence
  chemically synthesized
gaattttcagctaatgcatcga

SEQ ID NO: 1183802 - DNA, 22 bp, Artificial Sequence
  chemically synthesized
tttggcagttaatcgatgcatt

SEQ ID NO: 1183803 - DNA, 22 bp, Artificial Sequence
  chemically synthesized
atttggcagttaatcgatgcat

SEQ ID NO: 1183804 - DNA, 22 bp, Artificial Sequence
  chemically synthesized
tcagctaatgcatcgattaact

SEQ ID NO: 1183805 - DNA, 22 bp, Artificial Sequence
  chemically synthesized
cagctaatgcatcgattaactg

SEQ ID NO: 1183806 - DNA, 22 bp, Artificial Sequence
  chemically synthesized
agctaatgcatcgattaactgc

SEQ ID NO: 1183807 - DNA, 22 bp, Artificial Sequence
  chemically synthesized
gtaatttatttggcagttaatc

SEQ ID NO: 1183808 - DNA, 22 bp, Artificial Sequence
  chemically synthesized
attagtaatttatttggcagtt

SEQ ID NO: 1183809 - DNA, 22 bp, Artificial Sequence
  chemically synthesized
atgcatcgattaactgccaaat

SEQ ID NO: 1183810 - DNA, 22 bp, Artificial Sequence
  chemically synthesized
aattagtaatttatttggcagt

SEQ ID NO: 1183811 - DNA, 22 bp, Artificial Sequence
  chemically synthesized
actgccaaataaattactaatt

SEQ ID NO: 1183812 - DNA, 22 bp, Artificial Sequence
  chemically synthesized
ccaaataaattactaattaaat

SEQ ID NO: 1183813 - DNA, 22 bp, Artificial Sequence
  chemically synthesized
agatagtggtgtgcatttaatt

SEQ ID NO: 1183814 - DNA, 22 bp, Artificial Sequence
  chemically synthesized
ttaagatagtggtgtgcattta

SEQ ID NO: 1183815 - DNA, 22 bp, Artificial Sequence
  chemically synthesized
gttaagatagtggtgtgcattt

SEQ ID NO: 1183816 - DNA, 22 bp, Artificial Sequence
  chemically synthesized
tgttaagatagtggtgtgcatt

SEQ ID NO: 1183817 - DNA, 22 bp, Artificial Sequence
  chemically synthesized
ttgttaagatagtggtgtgcat

SEQ ID NO: 1183818 - DNA, 22 bp, Artificial Sequence
  chemically synthesized
tttgttaagatagtggtgtgca

SEQ ID NO: 1183819 - DNA, 22 bp, Artificial Sequence
  chemically synthesized
ctaattaaatgcacaccactat

SEQ ID NO: 1183820 - DNA, 22 bp, Artificial Sequence
  chemically synthesized
aattttttgttaagatagtggt

SEQ ID NO: 1183821 - DNA, 22 bp, Artificial Sequence
  chemically synthesized
attaaatgcacaccactatctt

SEQ ID NO: 1183822 - DNA, 22 bp, Artificial Sequence
  chemically synthesized
aatgcacaccactatcttaaca

SEQ ID NO: 1183823 - DNA, 22 bp, Artificial Sequence
  chemically synthesized
gagactcaattttttgttaaga

SEQ ID NO: 1183824 - DNA, 22 bp, Artificial Sequence
  chemically synthesized
ggagactcaattttttgttaag

SEQ ID NO: 1183825 - DNA, 22 bp, Artificial Sequence
  chemically synthesized
tggagactcaattttttgttaa

SEQ ID NO: 1183826 - DNA, 22 bp, Artificial Sequence
  chemically synthesized
ttggagactcaattttttgtta

SEQ ID NO: 1183827 - DNA, 22 bp, Artificial Sequence
  chemically synthesized
tcttaacaaaaaattgagtctc

SEQ ID NO: 1183828 - DNA, 22 bp, Artificial Sequence
  chemically synthesized
aacaaaaaattgagtctccaaa

SEQ ID NO: 1183829 - DNA, 22 bp, Artificial Sequence
  chemically synthesized
acaaaaaattgagtctccaaaa

SEQ ID NO: 1183830 - DNA, 22 bp, Artificial Sequence
  chemically synthesized
aaaaatgtgtacatttttggag

SEQ ID NO: 1183831 - DNA, 22 bp, Artificial Sequence
  chemically synthesized
tcggctaaaaaatgtgtacatt

SEQ ID NO: 1183832 - DNA, 22 bp, Artificial Sequence
  chemically synthesized
agtctccaaaaatgtacacatt

SEQ ID NO: 1183833 - DNA, 22 bp, Artificial Sequence
  chemically synthesized
atcctatcggctaaaaaatgtg

SEQ ID NO: 1183834 - DNA, 22 bp, Artificial Sequence
  chemically synthesized
caaaaatgtacacattttttag

SEQ ID NO: 1183835 - DNA, 22 bp, Artificial Sequence
  chemically synthesized
aaaatgatagacctgatcctat

SEQ ID NO: 1183836 - DNA, 22 bp, Artificial Sequence
  chemically synthesized
aaaaatgatagacctgatccta

SEQ ID NO: 1183837 - DNA, 22 bp, Artificial Sequence
  chemically synthesized
tttagccgataggatcaggtct

SEQ ID NO: 1183838 - DNA, 22 bp, Artificial Sequence
  chemically synthesized
ttagccgataggatcaggtcta

SEQ ID NO: 1183839 - DNA, 22 bp, Artificial Sequence
  chemically synthesized
tagccgataggatcaggtctat

SEQ ID NO: 1183840 - DNA, 22 bp, Artificial Sequence
  chemically synthesized
agccgataggatcaggtctatc

SEQ ID NO: 1183841 - DNA, 22 bp, Artificial Sequence
  chemically synthesized
gccgataggatcaggtctatca

SEQ ID NO: 1183842 - DNA, 22 bp, Artificial Sequence
  chemically synthesized
tgaatgggagtttaaaaatgat

SEQ ID NO: 1183843 - DNA, 22 bp, Artificial Sequence
  chemically synthesized
cactatgaatgggagtttaaaa

SEQ ID NO: 1183844 - DNA, 22 bp, Artificial Sequence
  chemically synthesized
tcatttttaaactcccattcat

SEQ ID NO: 1183845 - DNA, 22 bp, Artificial Sequence
  chemically synthesized
tcaaaactacactatgaatggg

SEQ ID NO: 1183846 - DNA, 22 bp, Artificial Sequence
  chemically synthesized
atcaaaactacactatgaatgg

SEQ ID NO: 1183847 - DNA, 22 bp, Artificial Sequence
  chemically synthesized
tatcaaaactacactatgaatg

SEQ ID NO: 1183848 - DNA, 22 bp, Artificial Sequence
  chemically synthesized
ttatcaaaactacactatgaat

SEQ ID NO: 1183849 - DNA, 22 bp, Artificial Sequence
  chemically synthesized
ttaaactcccattcatagtgta

SEQ ID NO: 1183850 - DNA, 22 bp, Artificial Sequence
  chemically synthesized
taaactcccattcatagtgtag

SEQ ID NO: 1183851 - DNA, 22 bp, Artificial Sequence
  chemically synthesized
aaactcccattcatagtgtagt

SEQ ID NO: 1183852 - DNA, 22 bp, Artificial Sequence
  chemically synthesized
aactcccattcatagtgtagtt

SEQ ID NO: 1183853 - DNA, 22 bp, Artificial Sequence
  chemically synthesized
ccattcatagtgtagttttgat

SEQ ID NO: 1183854 - DNA, 22 bp, Artificial Sequence
  chemically synthesized
gaggatgtgatttttatcaaaa

SEQ ID NO: 1183855 - DNA, 22 bp, Artificial Sequence
  chemically synthesized
atagtgtagttttgataaaaat

SEQ ID NO: 1183856 - DNA, 22 bp, Artificial Sequence
  chemically synthesized
gaaacgtgctagaggatgtgat

SEQ ID NO: 1183857 - DNA, 22 bp, Artificial Sequence
  chemically synthesized
tgataaaaatcacatcctctag

SEQ ID NO: 1183858 - DNA, 22 bp, Artificial Sequence
  chemically synthesized
gataaaaatcacatcctctagc

SEQ ID NO: 1183859 - DNA, 22 bp, Artificial Sequence
  chemically synthesized
ataaaaatcacatcctctagca

SEQ ID NO: 1183860 - DNA, 22 bp, Artificial Sequence
  chemically synthesized
aatggagccaattcgaaacgtg

SEQ ID NO: 1183861 - DNA, 22 bp, Artificial Sequence
  chemically synthesized
ctcaatggagccaattcgaaac

SEQ ID NO: 1183862 - DNA, 22 bp, Artificial Sequence
  chemically synthesized
gctcaatggagccaattcgaaa

SEQ ID NO: 1183863 - DNA, 22 bp, Artificial Sequence
  chemically synthesized
tgctcaatggagccaattcgaa

SEQ ID NO: 1183864 - DNA, 22 bp, Artificial Sequence
  chemically synthesized
ttttgctcaatggagccaattc

SEQ ID NO: 1183865 - DNA, 22 bp, Artificial Sequence
  chemically synthesized
tagcacgtttcgaattggctcc

SEQ ID NO: 1183866 - DNA, 22 bp, Artificial Sequence
  chemically synthesized
attttgctcaatggagccaatt

SEQ ID NO: 1183867 - DNA, 22 bp, Artificial Sequence
  chemically synthesized
gcacgtttcgaattggctccat

SEQ ID NO: 1183868 - DNA, 22 bp, Artificial Sequence
  chemically synthesized
cgaattggctccattgagcaaa

SEQ ID NO: 1183869 - DNA, 22 bp, Artificial Sequence
  chemically synthesized
gaattggctccattgagcaaaa

SEQ ID NO: 1183870 - DNA, 22 bp, Artificial Sequence
  chemically synthesized
acaaaaatgatttattttgctc

SEQ ID NO: 1183871 - DNA, 22 bp, Artificial Sequence
  chemically synthesized
aacaaaaatgatttattttgct

SEQ ID NO: 1183872 - DNA, 22 bp, Artificial Sequence
  chemically synthesized
taacaaaaatgatttattttgc

SEQ ID NO: 1183873 - DNA, 22 bp, Artificial Sequence
  chemically synthesized
ttaacaaaaatgatttattttg

SEQ ID NO: 1183874 - DNA, 22 bp, Artificial Sequence
  chemically synthesized
gctccattgagcaaaataaatc

SEQ ID NO: 1183875 - DNA, 22 bp, Artificial Sequence
  chemically synthesized
tttaacaaaaatgatttatttt

SEQ ID NO: 1183876 - DNA, 22 bp, Artificial Sequence
  chemically synthesized
ctttttaacaaaaatgatttat

SEQ ID NO: 1183877 - DNA, 22 bp, Artificial Sequence
  chemically synthesized
cattgagcaaaataaatcattt

SEQ ID NO: 1183878 - DNA, 22 bp, Artificial Sequence
  chemically synthesized
agcaaaataaatcatttttgtt

SEQ ID NO: 1183879 - DNA, 22 bp, Artificial Sequence
  chemically synthesized
caagaattactttttaacaaaa

SEQ ID NO: 1183880 - DNA, 22 bp, Artificial Sequence
  chemically synthesized
gcaagaattactttttaacaaa

SEQ ID NO: 1183881 - DNA, 22 bp, Artificial Sequence
  chemically synthesized
gatttgcaagaattacttttta

SEQ ID NO: 1183882 - DNA, 22 bp, Artificial Sequence
  chemically synthesized
ctagatttgcaagaattacttt

SEQ ID NO: 1183883 - DNA, 22 bp, Artificial Sequence
  chemically synthesized
ttgttaaaaagtaattcttgca

SEQ ID NO: 1183884 - DNA, 22 bp, Artificial Sequence
  chemically synthesized
tgttaaaaagtaattcttgcaa

SEQ ID NO: 1183885 - DNA, 22 bp, Artificial Sequence
  chemically synthesized
ggattgctagatttgcaagaat

SEQ ID NO: 1183886 - DNA, 22 bp, Artificial Sequence
  chemically synthesized
gttaaaaagtaattcttgcaaa

SEQ ID NO: 1183887 - DNA, 22 bp, Artificial Sequence
  chemically synthesized
ttaaaaagtaattcttgcaaat

SEQ ID NO: 1183888 - DNA, 22 bp, Artificial Sequence
  chemically synthesized
aaaagtaattcttgcaaatcta

SEQ ID NO: 1183889 - DNA, 22 bp, Artificial Sequence
  chemically synthesized
ttgcaaatctagcaatcctagc

SEQ ID NO: 1183890 - DNA, 22 bp, Artificial Sequence
  chemically synthesized
gcaaatctagcaatcctagcac

SEQ ID NO: 1183891 - DNA, 22 bp, Artificial Sequence
  chemically synthesized
caaatctagcaatcctagcaca

SEQ ID NO: 1183892 - DNA, 22 bp, Artificial Sequence
  chemically synthesized
cagcgtgggaatgaaatgtgct

SEQ ID NO: 1183893 - DNA, 22 bp, Artificial Sequence
  chemically synthesized
gcaatcctagcacatttcattc

SEQ ID NO: 1183894 - DNA, 22 bp, Artificial Sequence
  chemically synthesized
taaatgttacagcgtgggaatg

SEQ ID NO: 1183895 - DNA, 22 bp, Artificial Sequence
  chemically synthesized
ataaatgttacagcgtgggaat

SEQ ID NO: 1183896 - DNA, 22 bp, Artificial Sequence
  chemically synthesized
gcacatttcattcccacgctgt

SEQ ID NO: 1183897 - DNA, 22 bp, Artificial Sequence
  chemically synthesized
cattcccacgctgtaacattta

SEQ ID NO: 1183898 - DNA, 22 bp, Artificial Sequence
  chemically synthesized
attcccacgctgtaacatttat

SEQ ID NO: 1183899 - DNA, 22 bp, Artificial Sequence
  chemically synthesized
ccacgctgtaacatttataagg

SEQ ID NO: 1183900 - DNA, 22 bp, Artificial Sequence
  chemically synthesized
taacatttataaggctatttct

SEQ ID NO: 1183901 - DNA, 22 bp, Artificial Sequence
  chemically synthesized
tatggaacccaatatacaagaa

SEQ ID NO: 1183902 - DNA, 22 bp, Artificial Sequence
  chemically synthesized
ataaggctatttcttgtatatt

SEQ ID NO: 1183903 - DNA, 22 bp, Artificial Sequence
  chemically synthesized
taaggctatttcttgtatattg

SEQ ID NO: 1183904 - DNA, 22 bp, Artificial Sequence
  chemically synthesized
aatattgtatggaacccaatat

SEQ ID NO: 1183905 - DNA, 22 bp, Artificial Sequence
  chemically synthesized
caatattgtatggaacccaata

SEQ ID NO: 1183906 - DNA, 22 bp, Artificial Sequence
  chemically synthesized
tcaatattgtatggaacccaat

SEQ ID NO: 1183907 - DNA, 22 bp, Artificial Sequence
  chemically synthesized
tttcttgtatattgggttccat

SEQ ID NO: 1183908 - DNA, 22 bp, Artificial Sequence
  chemically synthesized
cttgtatattgggttccataca

SEQ ID NO: 1183909 - DNA, 22 bp, Artificial Sequence
  chemically synthesized
ttgtatattgggttccatacaa

SEQ ID NO: 1183910 - DNA, 22 bp, Artificial Sequence
  chemically synthesized
caccctttcaatattgtatgga

SEQ ID NO: 1183911 - DNA, 22 bp, Artificial Sequence
  chemically synthesized
gtatattgggttccatacaata

SEQ ID NO: 1183912 - DNA, 22 bp, Artificial Sequence
  chemically synthesized
ccaccctttcaatattgtatgg

SEQ ID NO: 1183913 - DNA, 22 bp, Artificial Sequence
  chemically synthesized
tatattgggttccatacaatat

SEQ ID NO: 1183914 - DNA, 22 bp, Artificial Sequence
  chemically synthesized
tccaccctttcaatattgtatg

SEQ ID NO: 1183915 - DNA, 22 bp, Artificial Sequence
  chemically synthesized
ggttccatacaatattgaaagg

SEQ ID NO: 1183916 - DNA, 22 bp, Artificial Sequence
  chemically synthesized
agtggagttttccaccctttca

SEQ ID NO: 1183917 - DNA, 22 bp, Artificial Sequence
  chemically synthesized
catacaatattgaaagggtgga

SEQ ID NO: 1183918 - DNA, 22 bp, Artificial Sequence
  chemically synthesized
aaagggtggaaaactccactga

SEQ ID NO: 1183919 - DNA, 22 bp, Artificial Sequence
  chemically synthesized
tatgaggaagactcagtggagt

SEQ ID NO: 1183920 - DNA, 22 bp, Artificial Sequence
  chemically synthesized
tatatgaggaagactcagtgga

SEQ ID NO: 1183921 - DNA, 22 bp, Artificial Sequence
  chemically synthesized
ctatatgaggaagactcagtgg

SEQ ID NO: 1183922 - DNA, 22 bp, Artificial Sequence
  chemically synthesized
tctatatgaggaagactcagtg

SEQ ID NO: 1183923 - DNA, 22 bp, Artificial Sequence
  chemically synthesized
gtactttctatatgaggaagac

SEQ ID NO: 1183924 - DNA, 22 bp, Artificial Sequence
  chemically synthesized
agtactttctatatgaggaaga

SEQ ID NO: 1183925 - DNA, 22 bp, Artificial Sequence
  chemically synthesized
cactgagtcttcctcatataga

SEQ ID NO: 1183926 - DNA, 22 bp, Artificial Sequence
  chemically synthesized
agtcttcctcatatagaaagta

SEQ ID NO: 1183927 - DNA, 22 bp, Artificial Sequence
  chemically synthesized
ggcaatgtttagtactttctat

SEQ ID NO: 1183928 - DNA, 22 bp, Artificial Sequence
  chemically synthesized
tcggcaatgtttagtactttct

SEQ ID NO: 1183929 - DNA, 22 bp, Artificial Sequence
  chemically synthesized
cctcatatagaaagtactaaac

SEQ ID NO: 1183930 - DNA, 22 bp, Artificial Sequence
  chemically synthesized
ctcatatagaaagtactaaaca

SEQ ID NO: 1183931 - DNA, 22 bp, Artificial Sequence
  chemically synthesized
atatagaaagtactaaacattg

SEQ ID NO: 1183932 - DNA, 22 bp, Artificial Sequence
  chemically synthesized
aaaccaggtcatattctcggca

SEQ ID NO: 1183933 - DNA, 22 bp, Artificial Sequence
  chemically synthesized
aacattgccgagaatatgacct

SEQ ID NO: 1183934 - DNA, 22 bp, Artificial Sequence
  chemically synthesized
ccgagaatatgacctggtttca

SEQ ID NO: 1183935 - DNA, 22 bp, Artificial Sequence
  chemically synthesized
taagaaaaagtcacactgaaac

SEQ ID NO: 1183936 - DNA, 22 bp, Artificial Sequence
  chemically synthesized
ataagaaaaagtcacactgaaa

SEQ ID NO: 1183937 - DNA, 22 bp, Artificial Sequence
  chemically synthesized
tagtatttataagaaaaagtca

SEQ ID NO: 1183938 - DNA, 22 bp, Artificial Sequence
  chemically synthesized
tgtagtatttataagaaaaagt

SEQ ID NO: 1183939 - DNA, 22 bp, Artificial Sequence
  chemically synthesized
gtttcagtgtgactttttctta

SEQ ID NO: 1183940 - DNA, 22 bp, Artificial Sequence
  chemically synthesized
cagtgtgactttttcttataaa

SEQ ID NO: 1183941 - DNA, 22 bp, Artificial Sequence
  chemically synthesized
agtgtgactttttcttataaat

SEQ ID NO: 1183942 - DNA, 22 bp, Artificial Sequence
  chemically synthesized
tgtatagcaggctctgtagtat

SEQ ID NO: 1183943 - DNA, 22 bp, Artificial Sequence
  chemically synthesized
gtgtatagcaggctctgtagta

SEQ ID NO: 1183944 - DNA, 22 bp, Artificial Sequence
  chemically synthesized
tttcttataaatactacagagc

SEQ ID NO: 1183945 - DNA, 22 bp, Artificial Sequence
  chemically synthesized
ttcttataaatactacagagcc

SEQ ID NO: 1183946 - DNA, 22 bp, Artificial Sequence
  chemically synthesized
tcttataaatactacagagcct

SEQ ID NO: 1183947 - DNA, 22 bp, Artificial Sequence
  chemically synthesized
cttataaatactacagagcctg

SEQ ID NO: 1183948 - DNA, 22 bp, Artificial Sequence
  chemically synthesized
ttataaatactacagagcctgc

SEQ ID NO: 1183949 - DNA, 22 bp, Artificial Sequence
  chemically synthesized
aacttgtgtatagcaggctctg

SEQ ID NO: 1183950 - DNA, 22 bp, Artificial Sequence
  chemically synthesized
aaacttgtgtatagcaggctct

SEQ ID NO: 1183951 - DNA, 22 bp, Artificial Sequence
  chemically synthesized
ataaatactacagagcctgcta

SEQ ID NO: 1183952 - DNA, 22 bp, Artificial Sequence
  chemically synthesized
taaatactacagagcctgctat

SEQ ID NO: 1183953 - DNA, 22 bp, Artificial Sequence
  chemically synthesized
atttaaacttgtgtatagcagg

SEQ ID NO: 1183954 - DNA, 22 bp, Artificial Sequence
  chemically synthesized
ctaatttaaacttgtgtatagc

SEQ ID NO: 1183955 - DNA, 22 bp, Artificial Sequence
  chemically synthesized
gctaatttaaacttgtgtatag

SEQ ID NO: 1183956 - DNA, 22 bp, Artificial Sequence
  chemically synthesized
tgctaatttaaacttgtgtata

SEQ ID NO: 1183957 - DNA, 22 bp, Artificial Sequence
  chemically synthesized
cagagcctgctatacacaagtt

SEQ ID NO: 1183958 - DNA, 22 bp, Artificial Sequence
  chemically synthesized
attttgctaatttaaacttgtg

SEQ ID NO: 1183959 - DNA, 22 bp, Artificial Sequence
  chemically synthesized
aattttgctaatttaaacttgt

SEQ ID NO: 1183960 - DNA, 22 bp, Artificial Sequence
  chemically synthesized
taattttgctaatttaaacttg

SEQ ID NO: 1183961 - DNA, 22 bp, Artificial Sequence
  chemically synthesized
ctttaattttgctaatttaaac

SEQ ID NO: 1183962 - DNA, 22 bp, Artificial Sequence
  chemically synthesized
ctatacacaagtttaaattagc

SEQ ID NO: 1183963 - DNA, 22 bp, Artificial Sequence
  chemically synthesized
tcctttaattttgctaatttaa

SEQ ID NO: 1183964 - DNA, 22 bp, Artificial Sequence
  chemically synthesized
tacacaagtttaaattagcaaa

SEQ ID NO: 1183965 - DNA, 22 bp, Artificial Sequence
  chemically synthesized
atatgctctcctttaattttgc

SEQ ID NO: 1183966 - DNA, 22 bp, Artificial Sequence
  chemically synthesized
catatgctctcctttaattttg

SEQ ID NO: 1183967 - DNA, 22 bp, Artificial Sequence
  chemically synthesized
ttcatatgctctcctttaattt

SEQ ID NO: 1183968 - DNA, 22 bp, Artificial Sequence
  chemically synthesized
cttcatatgctctcctttaatt

SEQ ID NO: 1183969 - DNA, 22 bp, Artificial Sequence
  chemically synthesized
aaattagcaaaattaaaggaga

SEQ ID NO: 1183970 - DNA, 22 bp, Artificial Sequence
  chemically synthesized
aattagcaaaattaaaggagag

SEQ ID NO: 1183971 - DNA, 22 bp, Artificial Sequence
  chemically synthesized
caagcttcttcatatgctctcc

SEQ ID NO: 1183972 - DNA, 22 bp, Artificial Sequence
  chemically synthesized
gcaaaattaaaggagagcatat

SEQ ID NO: 1183973 - DNA, 22 bp, Artificial Sequence
  chemically synthesized
aaggagagcatatgaagaagct

SEQ ID NO: 1183974 - DNA, 22 bp, Artificial Sequence
  chemically synthesized
tgtaagaaaaatataactgcaa

SEQ ID NO: 1183975 - DNA, 22 bp, Artificial Sequence
  chemically synthesized
tatgtaagaaaaatataactgc

SEQ ID NO: 1183976 - DNA, 22 bp, Artificial Sequence
  chemically synthesized
gcagttatatttttcttacata

SEQ ID NO: 1183977 - DNA, 22 bp, Artificial Sequence
  chemically synthesized
aaatatatattctatgtaagaa

SEQ ID NO: 1183978 - DNA, 22 bp, Artificial Sequence
  chemically synthesized
cagttatatttttcttacatag

SEQ ID NO: 1183979 - DNA, 22 bp, Artificial Sequence
  chemically synthesized
taaaatatatattctatgtaag

SEQ ID NO: 1183980 - DNA, 22 bp, Artificial Sequence
  chemically synthesized
attctaaaatatatattctatg

SEQ ID NO: 1183981 - DNA, 22 bp, Artificial Sequence
  chemically synthesized
tatttttcttacatagaatata

SEQ ID NO: 1183982 - DNA, 22 bp, Artificial Sequence
  chemically synthesized
ttcattctaaaatatatattct

SEQ ID NO: 1183983 - DNA, 22 bp, Artificial Sequence
  chemically synthesized
ttcttacatagaatatatattt

SEQ ID NO: 1183984 - DNA, 22 bp, Artificial Sequence
  chemically synthesized
tcttacatagaatatatatttt

SEQ ID NO: 1183985 - DNA, 22 bp, Artificial Sequence
  chemically synthesized
tctattcattctaaaatatata

SEQ ID NO: 1183986 - DNA, 22 bp, Artificial Sequence
  chemically synthesized
cttacatagaatatatatttta

SEQ ID NO: 1183987 - DNA, 22 bp, Artificial Sequence
  chemically synthesized
atctattcattctaaaatatat

SEQ ID NO: 1183988 - DNA, 22 bp, Artificial Sequence
  chemically synthesized
ttacatagaatatatattttag

SEQ ID NO: 1183989 - DNA, 22 bp, Artificial Sequence
  chemically synthesized
tatctattcattctaaaatata

SEQ ID NO: 1183990 - DNA, 22 bp, Artificial Sequence
  chemically synthesized
acatagaatatatattttagaa

SEQ ID NO: 1183991 - DNA, 22 bp, Artificial Sequence
  chemically synthesized
catagaatatatattttagaat

SEQ ID NO: 1183992 - DNA, 22 bp, Artificial Sequence
  chemically synthesized
ttttatctattcattctaaaat

SEQ ID NO: 1183993 - DNA, 22 bp, Artificial Sequence
  chemically synthesized
agtgaattattttatctattca

SEQ ID NO: 1183994 - DNA, 22 bp, Artificial Sequence
  chemically synthesized
taagtgaattattttatctatt

SEQ ID NO: 1183995 - DNA, 22 bp, Artificial Sequence
  chemically synthesized
tagaatgaatagataaaataat

SEQ ID NO: 1183996 - DNA, 22 bp, Artificial Sequence
  chemically synthesized
agaatgaatagataaaataatt

SEQ ID NO: 1183997 - DNA, 22 bp, Artificial Sequence
  chemically synthesized
gaatgaatagataaaataattc

SEQ ID NO: 1183998 - DNA, 22 bp, Artificial Sequence
  chemically synthesized
cgtaaaggaaatacatacattc

SEQ ID NO: 1183999 - DNA, 22 bp, Artificial Sequence
  chemically synthesized
gatctacgtaaaggaaatacat

SEQ ID NO: 1184000 - DNA, 22 bp, Artificial Sequence
  chemically synthesized
acttagaatgtatgtatttcct

SEQ ID NO: 1184001 - DNA, 22 bp, Artificial Sequence
  chemically synthesized
tggatctacgtaaaggaaatac

SEQ ID NO: 1184002 - DNA, 22 bp, Artificial Sequence
  chemically synthesized
ctggatctacgtaaaggaaata

SEQ ID NO: 1184003 - DNA, 22 bp, Artificial Sequence
  chemically synthesized
tctggatctacgtaaaggaaat

SEQ ID NO: 1184004 - DNA, 22 bp, Artificial Sequence
  chemically synthesized
agaatgtatgtatttcctttac

SEQ ID NO: 1184005 - DNA, 22 bp, Artificial Sequence
  chemically synthesized
ttctggatctacgtaaaggaaa

SEQ ID NO: 1184006 - DNA, 22 bp, Artificial Sequence
  chemically synthesized
gaatgtatgtatttcctttacg

SEQ ID NO: 1184007 - DNA, 22 bp, Artificial Sequence
  chemically synthesized
gggagatttttctggatctacg

SEQ ID NO: 1184008 - DNA, 22 bp, Artificial Sequence
  chemically synthesized
ggggagatttttctggatctac

SEQ ID NO: 1184009 - DNA, 22 bp, Artificial Sequence
  chemically synthesized
tttggggagatttttctggatc

SEQ ID NO: 1184010 - DNA, 22 bp, Artificial Sequence
  chemically synthesized
cctttacgtagatccagaaaaa

SEQ ID NO: 1184011 - DNA, 22 bp, Artificial Sequence
  chemically synthesized
ctttacgtagatccagaaaaat

SEQ ID NO: 1184012 - DNA, 22 bp, Artificial Sequence
  chemically synthesized
cactatttggggagatttttct

SEQ ID NO: 1184013 - DNA, 22 bp, Artificial Sequence
  chemically synthesized
tacgtagatccagaaaaatctc

SEQ ID NO: 1184014 - DNA, 22 bp, Artificial Sequence
  chemically synthesized
acgtagatccagaaaaatctcc

SEQ ID NO: 1184015 - DNA, 22 bp, Artificial Sequence
  chemically synthesized
cgtagatccagaaaaatctccc

SEQ ID NO: 1184016 - DNA, 22 bp, Artificial Sequence
  chemically synthesized
attacactatttggggagattt

SEQ ID NO: 1184017 - DNA, 22 bp, Artificial Sequence
  chemically synthesized
ctaattacactatttggggaga

SEQ ID NO: 1184018 - DNA, 22 bp, Artificial Sequence
  chemically synthesized
tgaaaattgctaattacactat

SEQ ID NO: 1184019 - DNA, 22 bp, Artificial Sequence
  chemically synthesized
cccaaatagtgtaattagcaat

SEQ ID NO: 1184020 - DNA, 22 bp, Artificial Sequence
  chemically synthesized
gaaaagtgtaggtacatctgtg

SEQ ID NO: 1184021 - DNA, 22 bp, Artificial Sequence
  chemically synthesized
cgaaaagtgtaggtacatctgt

SEQ ID NO: 1184022 - DNA, 22 bp, Artificial Sequence
  chemically synthesized
gcaattttcacagatgtaccta

SEQ ID NO: 1184023 - DNA, 22 bp, Artificial Sequence
  chemically synthesized
tcacagatgtacctacactttt

SEQ ID NO: 1184024 - DNA, 22 bp, Artificial Sequence
  chemically synthesized
cacagatgtacctacacttttc

SEQ ID NO: 1184025 - DNA, 22 bp, Artificial Sequence
  chemically synthesized
acagatgtacctacacttttcg

SEQ ID NO: 1184026 - DNA, 22 bp, Artificial Sequence
  chemically synthesized
tatatgtaacttcgaaaagtgt

SEQ ID NO: 1184027 - DNA, 22 bp, Artificial Sequence
  chemically synthesized
atatatgtaacttcgaaaagtg

SEQ ID NO: 1184028 - DNA, 22 bp, Artificial Sequence
  chemically synthesized
tatatatgtaacttcgaaaagt

SEQ ID NO: 1184029 - DNA, 22 bp, Artificial Sequence
  chemically synthesized
cacttttcgaagttacatatat

SEQ ID NO: 1184030 - DNA, 22 bp, Artificial Sequence
  chemically synthesized
atgaaaagttttatatatgtaa

SEQ ID NO: 1184031 - DNA, 22 bp, Artificial Sequence
  chemically synthesized
ttcgaagttacatatataaaac

SEQ ID NO: 1184032 - DNA, 22 bp, Artificial Sequence
  chemically synthesized
tcgaagttacatatataaaact

SEQ ID NO: 1184033 - DNA, 22 bp, Artificial Sequence
  chemically synthesized
cgaagttacatatataaaactt

SEQ ID NO: 1184034 - DNA, 22 bp, Artificial Sequence
  chemically synthesized
gaagttacatatataaaacttt

SEQ ID NO: 1184035 - DNA, 22 bp, Artificial Sequence
  chemically synthesized
catatataaaacttttcatgag

SEQ ID NO: 1184036 - DNA, 22 bp, Artificial Sequence
  chemically synthesized
taaaaaacatgaggctcatgaa

SEQ ID NO: 1184037 - DNA, 22 bp, Artificial Sequence
  chemically synthesized
atggttataaaaaacatgaggc

SEQ ID NO: 1184038 - DNA, 22 bp, Artificial Sequence
  chemically synthesized
ctaatggttataaaaaacatga

SEQ ID NO: 1184039 - DNA, 22 bp, Artificial Sequence
  chemically synthesized
ttcatgagcctcatgtttttta

SEQ ID NO: 1184040 - DNA, 22 bp, Artificial Sequence
  chemically synthesized
tcatgagcctcatgttttttat

SEQ ID NO: 1184041 - DNA, 22 bp, Artificial Sequence
  chemically synthesized
catgagcctcatgttttttata

SEQ ID NO: 1184042 - DNA, 22 bp, Artificial Sequence
  chemically synthesized
atgagcctcatgttttttataa

SEQ ID NO: 1184043 - DNA, 22 bp, Artificial Sequence
  chemically synthesized
acaaaggctgctaatggttata

SEQ ID NO: 1184044 - DNA, 22 bp, Artificial Sequence
  chemically synthesized
gacaaaggctgctaatggttat

SEQ ID NO: 1184045 - DNA, 22 bp, Artificial Sequence
  chemically synthesized
tgacaaaggctgctaatggtta

SEQ ID NO: 1184046 - DNA, 22 bp, Artificial Sequence
  chemically synthesized
atgttttttataaccattagca

SEQ ID NO: 1184047 - DNA, 22 bp, Artificial Sequence
  chemically synthesized
tttgacaaaggctgctaatggt

SEQ ID NO: 1184048 - DNA, 22 bp, Artificial Sequence
  chemically synthesized
tctttgacaaaggctgctaatg

SEQ ID NO: 1184049 - DNA, 22 bp, Artificial Sequence
  chemically synthesized
tttataaccattagcagccttt

SEQ ID NO: 1184050 - DNA, 22 bp, Artificial Sequence
  chemically synthesized
ttataaccattagcagcctttg

SEQ ID NO: 1184051 - DNA, 22 bp, Artificial Sequence
  chemically synthesized
tataaccattagcagcctttgt

SEQ ID NO: 1184052 - DNA, 22 bp, Artificial Sequence
  chemically synthesized
aggttctctttgacaaaggctg

SEQ ID NO: 1184053 - DNA, 22 bp, Artificial Sequence
  chemically synthesized
ataaccattagcagcctttgtc

SEQ ID NO: 1184054 - DNA, 22 bp, Artificial Sequence
  chemically synthesized
taaccattagcagcctttgtca

SEQ ID NO: 1184055 - DNA, 22 bp, Artificial Sequence
  chemically synthesized
taaggttctctttgacaaaggc

SEQ ID NO: 1184056 - DNA, 22 bp, Artificial Sequence
  chemically synthesized
gcagcctttgtcaaagagaacc

SEQ ID NO: 1184057 - DNA, 22 bp, Artificial Sequence
  chemically synthesized
tgtaataacctctaaggttctc

SEQ ID NO: 1184058 - DNA, 22 bp, Artificial Sequence
  chemically synthesized
attatgtaataacctctaaggt

SEQ ID NO: 1184059 - DNA, 22 bp, Artificial Sequence
  chemically synthesized
tgtcaaagagaaccttagaggt

SEQ ID NO: 1184060 - DNA, 22 bp, Artificial Sequence
  chemically synthesized
cattatgtaataacctctaagg

SEQ ID NO: 1184061 - DNA, 22 bp, Artificial Sequence
  chemically synthesized
gtcaaagagaaccttagaggtt

SEQ ID NO: 1184062 - DNA, 22 bp, Artificial Sequence
  chemically synthesized
tcattatgtaataacctctaag

SEQ ID NO: 1184063 - DNA, 22 bp, Artificial Sequence
  chemically synthesized
tcaaagagaaccttagaggtta

SEQ ID NO: 1184064 - DNA, 22 bp, Artificial Sequence
  chemically synthesized
ctttcattatgtaataacctct

SEQ ID NO: 1184065 - DNA, 22 bp, Artificial Sequence
  chemically synthesized
tactttcattatgtaataacct

SEQ ID NO: 1184066 - DNA, 22 bp, Artificial Sequence
  chemically synthesized
ctactttcattatgtaataacc

SEQ ID NO: 1184067 - DNA, 22 bp, Artificial Sequence
  chemically synthesized
agaggttattacataatgaaag

SEQ ID NO: 1184068 - DNA, 22 bp, Artificial Sequence
  chemically synthesized
gaggttattacataatgaaagt

SEQ ID NO: 1184069 - DNA, 22 bp, Artificial Sequence
  chemically synthesized
ccgtaatggtttctactttcat

SEQ ID NO: 1184070 - DNA, 22 bp, Artificial Sequence
  chemically synthesized
ttacataatgaaagtagaaacc

SEQ ID NO: 1184071 - DNA, 22 bp, Artificial Sequence
  chemically synthesized
cataatgaaagtagaaaccatt

SEQ ID NO: 1184072 - DNA, 22 bp, Artificial Sequence
  chemically synthesized
ataaatatgaattcccgtaatg

SEQ ID NO: 1184073 - DNA, 22 bp, Artificial Sequence
  chemically synthesized
cataaatatgaattcccgtaat

SEQ ID NO: 1184074 - DNA, 22 bp, Artificial Sequence
  chemically synthesized
ttcataaatatgaattcccgta

SEQ ID NO: 1184075 - DNA, 22 bp, Artificial Sequence
  chemically synthesized
attcttcataaatatgaattcc

SEQ ID NO: 1184076 - DNA, 22 bp, Artificial Sequence
  chemically synthesized
tacgttgattcttcataaatat

SEQ ID NO: 1184077 - DNA, 22 bp, Artificial Sequence
  chemically synthesized
cgggaattcatatttatgaaga

SEQ ID NO: 1184078 - DNA, 22 bp, Artificial Sequence
  chemically synthesized
ctatacgttgattcttcataaa

SEQ ID NO: 1184079 - DNA, 22 bp, Artificial Sequence
  chemically synthesized
actatacgttgattcttcataa

SEQ ID NO: 1184080 - DNA, 22 bp, Artificial Sequence
  chemically synthesized
ggtttactatacgttgattctt

SEQ ID NO: 1184081 - DNA, 22 bp, Artificial Sequence
  chemically synthesized
taggtttactatacgttgattc

SEQ ID NO: 1184082 - DNA, 22 bp, Artificial Sequence
  chemically synthesized
atatttatgaagaatcaacgta

SEQ ID NO: 1184083 - DNA, 22 bp, Artificial Sequence
  chemically synthesized
tctaggtttactatacgttgat

SEQ ID NO: 1184084 - DNA, 22 bp, Artificial Sequence
  chemically synthesized
ctctaggtttactatacgttga

SEQ ID NO: 1184085 - DNA, 22 bp, Artificial Sequence
  chemically synthesized
atgaagaatcaacgtatagtaa

SEQ ID NO: 1184086 - DNA, 22 bp, Artificial Sequence
  chemically synthesized
tgaagaatcaacgtatagtaaa

SEQ ID NO: 1184087 - DNA, 22 bp, Artificial Sequence
  chemically synthesized
agtcttctctaggtttactata

SEQ ID NO: 1184088 - DNA, 22 bp, Artificial Sequence
  chemically synthesized
ttgagtcttctctaggtttact

SEQ ID NO: 1184089 - DNA, 22 bp, Artificial Sequence
  chemically synthesized
ttattgagtcttctctaggttt

SEQ ID NO: 1184090 - DNA, 22 bp, Artificial Sequence
  chemically synthesized
gttattgagtcttctctaggtt

SEQ ID NO: 1184091 - DNA, 22 bp, Artificial Sequence
  chemically synthesized
tgttattgagtcttctctaggt

SEQ ID NO: 1184092 - DNA, 22 bp, Artificial Sequence
  chemically synthesized
ctttgttattgagtcttctcta

SEQ ID NO: 1184093 - DNA, 22 bp, Artificial Sequence
  chemically synthesized
tgctttgttattgagtcttctc

SEQ ID NO: 1184094 - DNA, 22 bp, Artificial Sequence
  chemically synthesized
atgtgattctgctttgttattg

SEQ ID NO: 1184095 - DNA, 22 bp, Artificial Sequence
  chemically synthesized
gagaagactcaataacaaagca

SEQ ID NO: 1184096 - DNA, 22 bp, Artificial Sequence
  chemically synthesized
cctcatgtgattctgctttgtt

SEQ ID NO: 1184097 - DNA, 22 bp, Artificial Sequence
  chemically synthesized
attccctcatgtgattctgctt

SEQ ID NO: 1184098 - DNA, 22 bp, Artificial Sequence
  chemically synthesized
ttgattccctcatgtgattctg

SEQ ID NO: 1184099 - DNA, 22 bp, Artificial Sequence
  chemically synthesized
attgattccctcatgtgattct

SEQ ID NO: 1184100 - DNA, 22 bp, Artificial Sequence
  chemically synthesized
aataacaaagcagaatcacatg

SEQ ID NO: 1184101 - DNA, 22 bp, Artificial Sequence
  chemically synthesized
tattgattccctcatgtgattc

SEQ ID NO: 1184102 - DNA, 22 bp, Artificial Sequence
  chemically synthesized
caagttttattgattccctcat

SEQ ID NO: 1184103 - DNA, 22 bp, Artificial Sequence
  chemically synthesized
ccaagttttattgattccctca

SEQ ID NO: 1184104 - DNA, 22 bp, Artificial Sequence
  chemically synthesized
tccaagttttattgattccctc

SEQ ID NO: 1184105 - DNA, 22 bp, Artificial Sequence
  chemically synthesized
ttccaagttttattgattccct

SEQ ID NO: 1184106 - DNA, 22 bp, Artificial Sequence
  chemically synthesized
tttttccaagttttattgattc

SEQ ID NO: 1184107 - DNA, 22 bp, Artificial Sequence
  chemically synthesized
gtttttccaagttttattgatt

SEQ ID NO: 1184108 - DNA, 22 bp, Artificial Sequence
  chemically synthesized
gtttgtttttccaagttttatt

SEQ ID NO: 1184109 - DNA, 22 bp, Artificial Sequence
  chemically synthesized
gtgaagagctggtttgtttttc

SEQ ID NO: 1184110 - DNA, 22 bp, Artificial Sequence
  chemically synthesized
ctcgtgaagagctggtttgttt

SEQ ID NO: 1184111 - DNA, 22 bp, Artificial Sequence
  chemically synthesized
tctcctcgtgaagagctggttt

SEQ ID NO: 1184112 - DNA, 22 bp, Artificial Sequence
  chemically synthesized
atctcctcgtgaagagctggtt

SEQ ID NO: 1184113 - DNA, 22 bp, Artificial Sequence
  chemically synthesized
tatctcctcgtgaagagctggt

SEQ ID NO: 1184114 - DNA, 22 bp, Artificial Sequence
  chemically synthesized
ttatctcctcgtgaagagctgg

SEQ ID NO: 1184115 - DNA, 22 bp, Artificial Sequence
  chemically synthesized
ggaaaaacaaaccagctcttca

SEQ ID NO: 1184116 - DNA, 22 bp, Artificial Sequence
  chemically synthesized
gaaaaacaaaccagctcttcac

SEQ ID NO: 1184117 - DNA, 22 bp, Artificial Sequence
  chemically synthesized
agtgccttttatctcctcgtga

SEQ ID NO: 1184118 - DNA, 22 bp, Artificial Sequence
  chemically synthesized
cagtgccttttatctcctcgtg

SEQ ID NO: 1184119 - DNA, 22 bp, Artificial Sequence
  chemically synthesized
tcagtgccttttatctcctcgt

SEQ ID NO: 1184120 - DNA, 22 bp, Artificial Sequence
  chemically synthesized
ttcagtgccttttatctcctcg

SEQ ID NO: 1184121 - DNA, 22 bp, Artificial Sequence
  chemically synthesized
aatttttcagtgccttttatct

SEQ ID NO: 1184122 - DNA, 22 bp, Artificial Sequence
  chemically synthesized
gaatttttcagtgccttttatc

SEQ ID NO: 1184123 - DNA, 22 bp, Artificial Sequence
  chemically synthesized
ttcacgaggagataaaaggcac

SEQ ID NO: 1184124 - DNA, 22 bp, Artificial Sequence
  chemically synthesized
cttgaatttttcagtgcctttt

SEQ ID NO: 1184125 - DNA, 22 bp, Artificial Sequence
  chemically synthesized
cacgaggagataaaaggcactg

SEQ ID NO: 1184126 - DNA, 22 bp, Artificial Sequence
  chemically synthesized
gcttgaatttttcagtgccttt

SEQ ID NO: 1184127 - DNA, 22 bp, Artificial Sequence
  chemically synthesized
acgaggagataaaaggcactga

SEQ ID NO: 1184128 - DNA, 22 bp, Artificial Sequence
  chemically synthesized
cttgcttgaatttttcagtgcc

SEQ ID NO: 1184129 - DNA, 22 bp, Artificial Sequence
  chemically synthesized
acttgcttgaatttttcagtgc

SEQ ID NO: 1184130 - DNA, 22 bp, Artificial Sequence
  chemically synthesized
tacttgcttgaatttttcagtg

SEQ ID NO: 1184131 - DNA, 22 bp, Artificial Sequence
  chemically synthesized
ttacttgcttgaatttttcagt

SEQ ID NO: 1184132 - DNA, 22 bp, Artificial Sequence
  chemically synthesized
cttttacttgcttgaatttttc

SEQ ID NO: 1184133 - DNA, 22 bp, Artificial Sequence
  chemically synthesized
acactgcttttacttgcttgaa

SEQ ID NO: 1184134 - DNA, 22 bp, Artificial Sequence
  chemically synthesized
aaaaattcaagcaagtaaaagc

SEQ ID NO: 1184135 - DNA, 22 bp, Artificial Sequence
  chemically synthesized
caagataatctaacactgcttt

SEQ ID NO: 1184136 - DNA, 22 bp, Artificial Sequence
  chemically synthesized
ccaagataatctaacactgctt

SEQ ID NO: 1184137 - DNA, 22 bp, Artificial Sequence
  chemically synthesized
aagcaagtaaaagcagtgttag

SEQ ID NO: 1184138 - DNA, 22 bp, Artificial Sequence
  chemically synthesized
cttccaagataatctaacactg

SEQ ID NO: 1184139 - DNA, 22 bp, Artificial Sequence
  chemically synthesized
tacaaaccagagaactgcttcc

SEQ ID NO: 1184140 - DNA, 22 bp, Artificial Sequence
  chemically synthesized
gattatcttggaagcagttctc

SEQ ID NO: 1184141 - DNA, 22 bp, Artificial Sequence
  chemically synthesized
ttgtacaaaccagagaactgct

SEQ ID NO: 1184142 - DNA, 22 bp, Artificial Sequence
  chemically synthesized
tgttgtacaaaccagagaactg

SEQ ID NO: 1184143 - DNA, 22 bp, Artificial Sequence
  chemically synthesized
tctgttgtacaaaccagagaac

SEQ ID NO: 1184144 - DNA, 22 bp, Artificial Sequence
  chemically synthesized
tcttggaagcagttctctggtt

SEQ ID NO: 1184145 - DNA, 22 bp, Artificial Sequence
  chemically synthesized
ctctctgttgtacaaaccagag

SEQ ID NO: 1184146 - DNA, 22 bp, Artificial Sequence
  chemically synthesized
actctctgttgtacaaaccaga

SEQ ID NO: 1184147 - DNA, 22 bp, Artificial Sequence
  chemically synthesized
ggaagcagttctctggtttgta

SEQ ID NO: 1184148 - DNA, 22 bp, Artificial Sequence
  chemically synthesized
gaagcagttctctggtttgtac

SEQ ID NO: 1184149 - DNA, 22 bp, Artificial Sequence
  chemically synthesized
tcaacatttactctctgttgta

SEQ ID NO: 1184150 - DNA, 22 bp, Artificial Sequence
  chemically synthesized
tctggtttgtacaacagagagt

SEQ ID NO: 1184151 - DNA, 22 bp, Artificial Sequence
  chemically synthesized
tggtttgtacaacagagagtaa

SEQ ID NO: 1184152 - DNA, 22 bp, Artificial Sequence
  chemically synthesized
gtttgtacaacagagagtaaat

SEQ ID NO: 1184153 - DNA, 22 bp, Artificial Sequence
  chemically synthesized
acaggtctgtcaacatttactc

SEQ ID NO: 1184154 - DNA, 22 bp, Artificial Sequence
  chemically synthesized
cacaggtctgtcaacatttact

SEQ ID NO: 1184155 - DNA, 22 bp, Artificial Sequence
  chemically synthesized
gtacaacagagagtaaatgttg

SEQ ID NO: 1184156 - DNA, 22 bp, Artificial Sequence
  chemically synthesized
tacaacagagagtaaatgttga

SEQ ID NO: 1184157 - DNA, 22 bp, Artificial Sequence
  chemically synthesized
cttcacaggtctgtcaacattt

SEQ ID NO: 1184158 - DNA, 22 bp, Artificial Sequence
  chemically synthesized
ccttcacaggtctgtcaacatt

SEQ ID NO: 1184159 - DNA, 22 bp, Artificial Sequence
  chemically synthesized
cacggagcccatttccttcaca

SEQ ID NO: 1184160 - DNA, 22 bp, Artificial Sequence
  chemically synthesized
acagacctgtgaaggaaatggg

SEQ ID NO: 1184161 - DNA, 22 bp, Artificial Sequence
  chemically synthesized
accctacacggagcccatttcc

SEQ ID NO: 1184162 - DNA, 22 bp, Artificial Sequence
  chemically synthesized
tgaccctacacggagcccattt

SEQ ID NO: 1184163 - DNA, 22 bp, Artificial Sequence
  chemically synthesized
tgaaggaaatgggctccgtgta

SEQ ID NO: 1184164 - DNA, 22 bp, Artificial Sequence
  chemically synthesized
tgtcaccacctctgaccctaca

SEQ ID NO: 1184165 - DNA, 22 bp, Artificial Sequence
  chemically synthesized
atgtcaccacctctgaccctac

SEQ ID NO: 1184166 - DNA, 22 bp, Artificial Sequence
  chemically synthesized
cttatgtcaccacctctgaccc

SEQ ID NO: 1184167 - DNA, 22 bp, Artificial Sequence
  chemically synthesized
cgtgtagggtcagaggtggtga

SEQ ID NO: 1184168 - DNA, 22 bp, Artificial Sequence
  chemically synthesized
cacacaggctgcttatgtcacc

SEQ ID NO: 1184169 - DNA, 22 bp, Artificial Sequence
  chemically synthesized
tgcctacacacaggctgcttat

SEQ ID NO: 1184170 - DNA, 22 bp, Artificial Sequence
  chemically synthesized
aagagctatgcctacacacagg

SEQ ID NO: 1184171 - DNA, 22 bp, Artificial Sequence
  chemically synthesized
gattcaagagctatgcctacac

SEQ ID NO: 1184172 - DNA, 22 bp, Artificial Sequence
  chemically synthesized
agcctcgattcaagagctatgc

SEQ ID NO: 1184173 - DNA, 22 bp, Artificial Sequence
  chemically synthesized
tgtgtaggcatagctcttgaat

SEQ ID NO: 1184174 - DNA, 22 bp, Artificial Sequence
  chemically synthesized
ccctaagcctcgattcaagagc

SEQ ID NO: 1184175 - DNA, 22 bp, Artificial Sequence
  chemically synthesized
cccctaagcctcgattcaagag

SEQ ID NO: 1184176 - DNA, 22 bp, Artificial Sequence
  chemically synthesized
ttcccctaagcctcgattcaag

SEQ ID NO: 1184177 - DNA, 22 bp, Artificial Sequence
  chemically synthesized
cttcccctaagcctcgattcaa

SEQ ID NO: 1184178 - DNA, 22 bp, Artificial Sequence
  chemically synthesized
ttgaatcgaggcttaggggaag

SEQ ID NO: 1184179 - DNA, 22 bp, Artificial Sequence
  chemically synthesized
gaatcgaggcttaggggaagaa

SEQ ID NO: 1184180 - DNA, 22 bp, Artificial Sequence
  chemically synthesized
aatcgaggcttaggggaagaag

SEQ ID NO: 1184181 - DNA, 22 bp, Artificial Sequence
  chemically synthesized
gcacagggatatgagagaactt

SEQ ID NO: 1184182 - DNA, 22 bp, Artificial Sequence
  chemically synthesized
aggggaagaagttctctcatat

SEQ ID NO: 1184183 - DNA, 22 bp, Artificial Sequence
  chemically synthesized
ggggaagaagttctctcatatc

SEQ ID NO: 1184184 - DNA, 22 bp, Artificial Sequence
  chemically synthesized
tctcatatccctgtgctagact

SEQ ID NO: 1184185 - DNA, 22 bp, Artificial Sequence
  chemically synthesized
cagatcacggtcagtctagcac

SEQ ID NO: 1184186 - DNA, 22 bp, Artificial Sequence
  chemically synthesized
tcatatccctgtgctagactga

SEQ ID NO: 1184187 - DNA, 22 bp, Artificial Sequence
  chemically synthesized
tgcagatcacggtcagtctagc

SEQ ID NO: 1184188 - DNA, 22 bp, Artificial Sequence
  chemically synthesized
atatccctgtgctagactgacc

SEQ ID NO: 1184189 - DNA, 22 bp, Artificial Sequence
  chemically synthesized
tctgcagatcacggtcagtcta

SEQ ID NO: 1184190 - DNA, 22 bp, Artificial Sequence
  chemically synthesized
ctctgcagatcacggtcagtct

SEQ ID NO: 1184191 - DNA, 22 bp, Artificial Sequence
  chemically synthesized
tgctagactgaccgtgatctgc

SEQ ID NO: 1184192 - DNA, 22 bp, Artificial Sequence
  chemically synthesized
ccccaaacccttctctgcagat

SEQ ID NO: 1184193 - DNA, 22 bp, Artificial Sequence
  chemically synthesized
gactgaccgtgatctgcagaga

SEQ ID NO: 1184194 - DNA, 22 bp, Artificial Sequence
  chemically synthesized
accgtgatctgcagagaagggt

SEQ ID NO: 1184195 - DNA, 22 bp, Artificial Sequence
  chemically synthesized
tccactcccccaaacccttctc

SEQ ID NO: 1184196 - DNA, 22 bp, Artificial Sequence
  chemically synthesized
tatccactcccccaaacccttc

SEQ ID NO: 1184197 - DNA, 22 bp, Artificial Sequence
  chemically synthesized
tctatccactcccccaaaccct

SEQ ID NO: 1184198 - DNA, 22 bp, Artificial Sequence
  chemically synthesized
ctctctatccactcccccaaac

SEQ ID NO: 1184199 - DNA, 22 bp, Artificial Sequence
  chemically synthesized
cagagaagggtttgggggagtg

SEQ ID NO: 1184200 - DNA, 22 bp, Artificial Sequence
  chemically synthesized
cccctcctctctatccactccc

SEQ ID NO: 1184201 - DNA, 22 bp, Artificial Sequence
  chemically synthesized
ccccctcctctctatccactcc

SEQ ID NO: 1184202 - DNA, 22 bp, Artificial Sequence
  chemically synthesized
tccccctcctctctatccactc

SEQ ID NO: 1184203 - DNA, 22 bp, Artificial Sequence
  chemically synthesized
ttccccctcctctctatccact

SEQ ID NO: 1184204 - DNA, 22 bp, Artificial Sequence
  chemically synthesized
tggtttttccccctcctctcta

SEQ ID NO: 1184205 - DNA, 22 bp, Artificial Sequence
  chemically synthesized
gggggagtggatagagaggagg

SEQ ID NO: 1184206 - DNA, 22 bp, Artificial Sequence
  chemically synthesized
atggtttttccccctcctctct

SEQ ID NO: 1184207 - DNA, 22 bp, Artificial Sequence
  chemically synthesized
ggggagtggatagagaggaggg

SEQ ID NO: 1184208 - DNA, 22 bp, Artificial Sequence
  chemically synthesized
cttatggtttttccccctcctc

SEQ ID NO: 1184209 - DNA, 22 bp, Artificial Sequence
  chemically synthesized
gggttacttatggtttttcccc

SEQ ID NO: 1184210 - DNA, 22 bp, Artificial Sequence
  chemically synthesized
cgggttacttatggtttttccc

SEQ ID NO: 1184211 - DNA, 22 bp, Artificial Sequence
  chemically synthesized
tcgggttacttatggtttttcc

SEQ ID NO: 1184212 - DNA, 22 bp, Artificial Sequence
  chemically synthesized
gaaagtagtcctttcgggttac

SEQ ID NO: 1184213 - DNA, 22 bp, Artificial Sequence
  chemically synthesized
ccatgttggaaagtagtccttt

SEQ ID NO: 1184214 - DNA, 22 bp, Artificial Sequence
  chemically synthesized
taccatgttggaaagtagtcct

SEQ ID NO: 1184215 - DNA, 22 bp, Artificial Sequence
  chemically synthesized
ctaccatgttggaaagtagtcc

SEQ ID NO: 1184216 - DNA, 22 bp, Artificial Sequence
  chemically synthesized
tctaccatgttggaaagtagtc

SEQ ID NO: 1184217 - DNA, 22 bp, Artificial Sequence
  chemically synthesized
ttttctaccatgttggaaagta

SEQ ID NO: 1184218 - DNA, 22 bp, Artificial Sequence
  chemically synthesized
tgttttctaccatgttggaaag

SEQ ID NO: 1184219 - DNA, 22 bp, Artificial Sequence
  chemically synthesized
atgttctgttttctaccatgtt

SEQ ID NO: 1184220 - DNA, 22 bp, Artificial Sequence
  chemically synthesized
aatgttctgttttctaccatgt

SEQ ID NO: 1184221 - DNA, 22 bp, Artificial Sequence
  chemically synthesized
ctttccaacatggtagaaaaca

SEQ ID NO: 1184222 - DNA, 22 bp, Artificial Sequence
  chemically synthesized
catttaatgttctgttttctac

SEQ ID NO: 1184223 - DNA, 22 bp, Artificial Sequence
  chemically synthesized
ccatttaatgttctgttttcta

SEQ ID NO: 1184224 - DNA, 22 bp, Artificial Sequence
  chemically synthesized
tccaacatggtagaaaacagaa

SEQ ID NO: 1184225 - DNA, 22 bp, Artificial Sequence
  chemically synthesized
ccaacatggtagaaaacagaac

SEQ ID NO: 1184226 - DNA, 22 bp, Artificial Sequence
  chemically synthesized
caacatggtagaaaacagaaca

SEQ ID NO: 1184227 - DNA, 22 bp, Artificial Sequence
  chemically synthesized
accatttccatttaatgttctg

SEQ ID NO: 1184228 - DNA, 22 bp, Artificial Sequence
  chemically synthesized
aatctcaccatttccatttaat

SEQ ID NO: 1184229 - DNA, 22 bp, Artificial Sequence
  chemically synthesized
aacattgaatctcaccatttcc

SEQ ID NO: 1184230 - DNA, 22 bp, Artificial Sequence
  chemically synthesized
gtattaaacattgaatctcacc

SEQ ID NO: 1184231 - DNA, 22 bp, Artificial Sequence
  chemically synthesized
agtattaaacattgaatctcac

SEQ ID NO: 1184232 - DNA, 22 bp, Artificial Sequence
  chemically synthesized
aatggaaatggtgagattcaat

SEQ ID NO: 1184233 - DNA, 22 bp, Artificial Sequence
  chemically synthesized
tatatgtttagtattaaacatt

SEQ ID NO: 1184234 - DNA, 22 bp, Artificial Sequence
  chemically synthesized
atatatgtttagtattaaacat

SEQ ID NO: 1184235 - DNA, 22 bp, Artificial Sequence
  chemically synthesized
aatgtttaatactaaacatata

SEQ ID NO: 1184236 - DNA, 22 bp, Artificial Sequence
  chemically synthesized
gaatatcatttatatatgttta

SEQ ID NO: 1184237 - DNA, 22 bp, Artificial Sequence
  chemically synthesized
cgaatatcatttatatatgttt

SEQ ID NO: 1184238 - DNA, 22 bp, Artificial Sequence
  chemically synthesized
aatactaaacatatataaatga

SEQ ID NO: 1184239 - DNA, 22 bp, Artificial Sequence
  chemically synthesized
atactaaacatatataaatgat

SEQ ID NO: 1184240 - DNA, 22 bp, Artificial Sequence
  chemically synthesized
aacatatataaatgatattcga

SEQ ID NO: 1184241 - DNA, 22 bp, Artificial Sequence
  chemically synthesized
ggagtataccaatttcgaatat

SEQ ID NO: 1184242 - DNA, 22 bp, Artificial Sequence
  chemically synthesized
tgggagtataccaatttcgaat

SEQ ID NO: 1184243 - DNA, 22 bp, Artificial Sequence
  chemically synthesized
attctgggagtataccaatttc

SEQ ID NO: 1184244 - DNA, 22 bp, Artificial Sequence
  chemically synthesized
cattctgggagtataccaattt

SEQ ID NO: 1184245 - DNA, 22 bp, Artificial Sequence
  chemically synthesized
agtgccttcattctgggagtat

SEQ ID NO: 1184246 - DNA, 22 bp, Artificial Sequence
  chemically synthesized
gaaattggtatactcccagaat

SEQ ID NO: 1184247 - DNA, 22 bp, Artificial Sequence
  chemically synthesized
gtatactcccagaatgaaggca

SEQ ID NO: 1184248 - DNA, 22 bp, Artificial Sequence
  chemically synthesized
caacatgatattaagtgccttc

SEQ ID NO: 1184249 - DNA, 22 bp, Artificial Sequence
  chemically synthesized
tccaacatgatattaagtgcct

SEQ ID NO: 1184250 - DNA, 22 bp, Artificial Sequence
  chemically synthesized
ccagaatgaaggcacttaatat

SEQ ID NO: 1184251 - DNA, 22 bp, Artificial Sequence
  chemically synthesized
ctctccaacatgatattaagtg

SEQ ID NO: 1184252 - DNA, 22 bp, Artificial Sequence
  chemically synthesized
actctccaacatgatattaagt

SEQ ID NO: 1184253 - DNA, 22 bp, Artificial Sequence
  chemically synthesized
ccagatcatttactctccaaca

SEQ ID NO: 1184254 - DNA, 22 bp, Artificial Sequence
  chemically synthesized
cccagatcatttactctccaac

SEQ ID NO: 1184255 - DNA, 22 bp, Artificial Sequence
  chemically synthesized
aatatcatgttggagagtaaat

SEQ ID NO: 1184256 - DNA, 22 bp, Artificial Sequence
  chemically synthesized
atatcatgttggagagtaaatg

SEQ ID NO: 1184257 - DNA, 22 bp, Artificial Sequence
  chemically synthesized
atatcttcccagatcatttact

SEQ ID NO: 1184258 - DNA, 22 bp, Artificial Sequence
  chemically synthesized
gagagtaaatgatctgggaaga

SEQ ID NO: 1184259 - DNA, 22 bp, Artificial Sequence
  chemically synthesized
aatagcatgctcatatcttccc

SEQ ID NO: 1184260 - DNA, 22 bp, Artificial Sequence
  chemically synthesized
atggctaaatagcatgctcata

SEQ ID NO: 1184261 - DNA, 22 bp, Artificial Sequence
  chemically synthesized
ggaagatatgagcatgctattt

SEQ ID NO: 1184262 - DNA, 22 bp, Artificial Sequence
  chemically synthesized
gaatcctcatggctaaatagca

SEQ ID NO: 1184263 - DNA, 22 bp, Artificial Sequence
  chemically synthesized
ggaatcctcatggctaaatagc

SEQ ID NO: 1184264 - DNA, 22 bp, Artificial Sequence
  chemically synthesized
tggaatcctcatggctaaatag

SEQ ID NO: 1184265 - DNA, 22 bp, Artificial Sequence
  chemically synthesized
ctttggaatcctcatggctaaa

SEQ ID NO: 1184266 - DNA, 22 bp, Artificial Sequence
  chemically synthesized
tgttactttggaatcctcatgg

SEQ ID NO: 1184267 - DNA, 22 bp, Artificial Sequence
  chemically synthesized
gagttgtgttactttggaatcc

SEQ ID NO: 1184268 - DNA, 22 bp, Artificial Sequence
  chemically synthesized
tttagccatgaggattccaaag

SEQ ID NO: 1184269 - DNA, 22 bp, Artificial Sequence
  chemically synthesized
agccatgaggattccaaagtaa

SEQ ID NO: 1184270 - DNA, 22 bp, Artificial Sequence
  chemically synthesized
gccatgaggattccaaagtaac

SEQ ID NO: 1184271 - DNA, 22 bp, Artificial Sequence
  chemically synthesized
caaagtaacacaactccaacat

SEQ ID NO: 1184272 - DNA, 22 bp, Artificial Sequence
  chemically synthesized
aagagtaccatcccatataaat

SEQ ID NO: 1184273 - DNA, 22 bp, Artificial Sequence
  chemically synthesized
caacatttatatgggatggtac

SEQ ID NO: 1184274 - DNA, 22 bp, Artificial Sequence
  chemically synthesized
ccggattgaagagtaccatccc

SEQ ID NO: 1184275 - DNA, 22 bp, Artificial Sequence
  chemically synthesized
gccggattgaagagtaccatcc

SEQ ID NO: 1184276 - DNA, 22 bp, Artificial Sequence
  chemically synthesized
tgccggattgaagagtaccatc

SEQ ID NO: 1184277 - DNA, 22 bp, Artificial Sequence
  chemically synthesized
ttgccggattgaagagtaccat

SEQ ID NO: 1184278 - DNA, 22 bp, Artificial Sequence
  chemically synthesized
tttttgccggattgaagagtac

SEQ ID NO: 1184279 - DNA, 22 bp, Artificial Sequence
  chemically synthesized
atatgggatggtactcttcaat

SEQ ID NO: 1184280 - DNA, 22 bp, Artificial Sequence
  chemically synthesized
tatgggatggtactcttcaatc

SEQ ID NO: 1184281 - DNA, 22 bp, Artificial Sequence
  chemically synthesized
tggatgcctgtttttgccggat

SEQ ID NO: 1184282 - DNA, 22 bp, Artificial Sequence
  chemically synthesized
atggatgcctgtttttgccgga

SEQ ID NO: 1184283 - DNA, 22 bp, Artificial Sequence
  chemically synthesized
cttatggatgcctgtttttgcc

SEQ ID NO: 1184284 - DNA, 22 bp, Artificial Sequence
  chemically synthesized
ttcaatccggcaaaaacaggca

SEQ ID NO: 1184285 - DNA, 22 bp, Artificial Sequence
  chemically synthesized
caatccggcaaaaacaggcatc

SEQ ID NO: 1184286 - DNA, 22 bp, Artificial Sequence
  chemically synthesized
aatccggcaaaaacaggcatcc

SEQ ID NO: 1184287 - DNA, 22 bp, Artificial Sequence
  chemically synthesized
gagaaaattgcttatggatgcc

SEQ ID NO: 1184288 - DNA, 22 bp, Artificial Sequence
  chemically synthesized
agagaaaattgcttatggatgc

SEQ ID NO: 1184289 - DNA, 22 bp, Artificial Sequence
  chemically synthesized
gatttagagaaaattgcttatg

SEQ ID NO: 1184290 - DNA, 22 bp, Artificial Sequence
  chemically synthesized
ggatttagagaaaattgcttat

SEQ ID NO: 1184291 - DNA, 22 bp, Artificial Sequence
  chemically synthesized
tggatttagagaaaattgctta

SEQ ID NO: 1184292 - DNA, 22 bp, Artificial Sequence
  chemically synthesized
ctttggatttagagaaaattgc

SEQ ID NO: 1184293 - DNA, 22 bp, Artificial Sequence
  chemically synthesized
actttggatttagagaaaattg

SEQ ID NO: 1184294 - DNA, 22 bp, Artificial Sequence
  chemically synthesized
tttactttggatttagagaaaa

SEQ ID NO: 1184295 - DNA, 22 bp, Artificial Sequence
  chemically synthesized
atttactttggatttagagaaa

SEQ ID NO: 1184296 - DNA, 22 bp, Artificial Sequence
  chemically synthesized
tatttactttggatttagagaa

SEQ ID NO: 1184297 - DNA, 22 bp, Artificial Sequence
  chemically synthesized
ttatttactttggatttagaga

SEQ ID NO: 1184298 - DNA, 22 bp, Artificial Sequence
  chemically synthesized
tttttatttactttggatttag

SEQ ID NO: 1184299 - DNA, 22 bp, Artificial Sequence
  chemically synthesized
tgtttttatttactttggattt

SEQ ID NO: 1184300 - DNA, 22 bp, Artificial Sequence
  chemically synthesized
tctctaaatccaaagtaaataa

SEQ ID NO: 1184301 - DNA, 22 bp, Artificial Sequence
  chemically synthesized
ctctaaatccaaagtaaataaa

SEQ ID NO: 1184302 - DNA, 22 bp, Artificial Sequence
  chemically synthesized
atgaattctgtttttatttact

SEQ ID NO: 1184303 - DNA, 22 bp, Artificial Sequence
  chemically synthesized
tctaaatccaaagtaaataaaa

SEQ ID NO: 1184304 - DNA, 22 bp, Artificial Sequence
  chemically synthesized
taaatccaaagtaaataaaaac

SEQ ID NO: 1184305 - DNA, 22 bp, Artificial Sequence
  chemically synthesized
aatccaaagtaaataaaaacag

SEQ ID NO: 1184306 - DNA, 22 bp, Artificial Sequence
  chemically synthesized
cagggtatggacctgatgaatt

SEQ ID NO: 1184307 - DNA, 22 bp, Artificial Sequence
  chemically synthesized
ccagggtatggacctgatgaat

SEQ ID NO: 1184308 - DNA, 22 bp, Artificial Sequence
  chemically synthesized
tccagggtatggacctgatgaa

SEQ ID NO: 1184309 - DNA, 22 bp, Artificial Sequence
  chemically synthesized
gtcctttccagggtatggacct

SEQ ID NO: 1184310 - DNA, 22 bp, Artificial Sequence
  chemically synthesized
agtcctttccagggtatggacc

SEQ ID NO: 1184311 - DNA, 22 bp, Artificial Sequence
  chemically synthesized
tagtcctttccagggtatggac

SEQ ID NO: 1184312 - DNA, 22 bp, Artificial Sequence
  chemically synthesized
ttagtcctttccagggtatgga

SEQ ID NO: 1184313 - DNA, 22 bp, Artificial Sequence
  chemically synthesized
atcaggtccataccctggaaag

SEQ ID NO: 1184314 - DNA, 22 bp, Artificial Sequence
  chemically synthesized
tgaaatttttagtcctttccag

SEQ ID NO: 1184315 - DNA, 22 bp, Artificial Sequence
  chemically synthesized
atgaaatttttagtcctttcca

SEQ ID NO: 1184316 - DNA, 22 bp, Artificial Sequence
  chemically synthesized
gcttatgaaatttttagtcctt

SEQ ID NO: 1184317 - DNA, 22 bp, Artificial Sequence
  chemically synthesized
tattagcttatgaaatttttag

SEQ ID NO: 1184318 - DNA, 22 bp, Artificial Sequence
  chemically synthesized
tgtattagcttatgaaattttt

SEQ ID NO: 1184319 - DNA, 22 bp, Artificial Sequence
  chemically synthesized
gaaaggactaaaaatttcataa

SEQ ID NO: 1184320 - DNA, 22 bp, Artificial Sequence
  chemically synthesized
gctctgtattagcttatgaaat

SEQ ID NO: 1184321 - DNA, 22 bp, Artificial Sequence
  chemically synthesized
agctagctctgtattagcttat

SEQ ID NO: 1184322 - DNA, 22 bp, Artificial Sequence
  chemically synthesized
ctgagctagctctgtattagct

SEQ ID NO: 1184323 - DNA, 22 bp, Artificial Sequence
  chemically synthesized
aaaatttcataagctaatacag

SEQ ID NO: 1184324 - DNA, 22 bp, Artificial Sequence
  chemically synthesized
gctgagctagctctgtattagc

SEQ ID NO: 1184325 - DNA, 22 bp, Artificial Sequence
  chemically synthesized
tgctgagctagctctgtattag

SEQ ID NO: 1184326 - DNA, 22 bp, Artificial Sequence
  chemically synthesized
actttgctgagctagctctgta

SEQ ID NO: 1184327 - DNA, 22 bp, Artificial Sequence
  chemically synthesized
cataagctaatacagagctagc

SEQ ID NO: 1184328 - DNA, 22 bp, Artificial Sequence
  chemically synthesized
tcactttgctgagctagctctg

SEQ ID NO: 1184329 - DNA, 22 bp, Artificial Sequence
  chemically synthesized
ataagctaatacagagctagct

SEQ ID NO: 1184330 - DNA, 22 bp, Artificial Sequence
  chemically synthesized
tctcactttgctgagctagctc

SEQ ID NO: 1184331 - DNA, 22 bp, Artificial Sequence
  chemically synthesized
atacagagctagctcagcaaag

SEQ ID NO: 1184332 - DNA, 22 bp, Artificial Sequence
  chemically synthesized
ggccaaactctctcactttgct

SEQ ID NO: 1184333 - DNA, 22 bp, Artificial Sequence
  chemically synthesized
aggccaaactctctcactttgc

SEQ ID NO: 1184334 - DNA, 22 bp, Artificial Sequence
  chemically synthesized
ttaggccaaactctctcacttt

SEQ ID NO: 1184335 - DNA, 22 bp, Artificial Sequence
  chemically synthesized
gctcagcaaagtgagagagttt

SEQ ID NO: 1184336 - DNA, 22 bp, Artificial Sequence
  chemically synthesized
agcaaagtgagagagtttggcc

SEQ ID NO: 1184337 - DNA, 22 bp, Artificial Sequence
  chemically synthesized
aatgtgtggagagctcttaggc

SEQ ID NO: 1184338 - DNA, 22 bp, Artificial Sequence
  chemically synthesized
ctgaatgtgtggagagctctta

SEQ ID NO: 1184339 - DNA, 22 bp, Artificial Sequence
  chemically synthesized
tgctgaatgtgtggagagctct

SEQ ID NO: 1184340 - DNA, 22 bp, Artificial Sequence
  chemically synthesized
ctgctgaatgtgtggagagctc

SEQ ID NO: 1184341 - DNA, 22 bp, Artificial Sequence
  chemically synthesized
ggcctaagagctctccacacat

SEQ ID NO: 1184342 - DNA, 22 bp, Artificial Sequence
  chemically synthesized
gcctaagagctctccacacatt

SEQ ID NO: 1184343 - DNA, 22 bp, Artificial Sequence
  chemically synthesized
gcaacatttctgctgaatgtgt

SEQ ID NO: 1184344 - DNA, 22 bp, Artificial Sequence
  chemically synthesized
agcaacatttctgctgaatgtg

SEQ ID NO: 1184345 - DNA, 22 bp, Artificial Sequence
  chemically synthesized
agagctctccacacattcagca

SEQ ID NO: 1184346 - DNA, 22 bp, Artificial Sequence
  chemically synthesized
tagcaacatttctgctgaatgt

SEQ ID NO: 1184347 - DNA, 22 bp, Artificial Sequence
  chemically synthesized
tccacacattcagcagaaatgt

SEQ ID NO: 1184348 - DNA, 22 bp, Artificial Sequence
  chemically synthesized
cacacattcagcagaaatgttg

SEQ ID NO: 1184349 - DNA, 22 bp, Artificial Sequence
  chemically synthesized
agcagaaatgttgctaaaggtt

SEQ ID NO: 1184350 - DNA, 22 bp, Artificial Sequence
  chemically synthesized
aggcacaaacaacagtgaagaa

SEQ ID NO: 1184351 - DNA, 22 bp, Artificial Sequence
  chemically synthesized
tcaggcacaaacaacagtgaag

SEQ ID NO: 1184352 - DNA, 22 bp, Artificial Sequence
  chemically synthesized
ctcaggcacaaacaacagtgaa

SEQ ID NO: 1184353 - DNA, 22 bp, Artificial Sequence
  chemically synthesized
ctaaaggtttcttcactgttgt

SEQ ID NO: 1184354 - DNA, 22 bp, Artificial Sequence
  chemically synthesized
tctcaggcacaaacaacagtga

SEQ ID NO: 1184355 - DNA, 22 bp, Artificial Sequence
  chemically synthesized
aaggtttcttcactgttgtttg

SEQ ID NO: 1184356 - DNA, 22 bp, Artificial Sequence
  chemically synthesized
tgctttctcaggcacaaacaac

SEQ ID NO: 1184357 - DNA, 22 bp, Artificial Sequence
  chemically synthesized
ctatgctttctcaggcacaaac

SEQ ID NO: 1184358 - DNA, 22 bp, Artificial Sequence
  chemically synthesized
cctatgctttctcaggcacaaa

SEQ ID NO: 1184359 - DNA, 22 bp, Artificial Sequence
  chemically synthesized
cttcactgttgtttgtgcctga

SEQ ID NO: 1184360 - DNA, 22 bp, Artificial Sequence
  chemically synthesized
tcctatgctttctcaggcacaa

SEQ ID NO: 1184361 - DNA, 22 bp, Artificial Sequence
  chemically synthesized
ttcactgttgtttgtgcctgag

SEQ ID NO: 1184362 - DNA, 22 bp, Artificial Sequence
  chemically synthesized
cactgttgtttgtgcctgagaa

SEQ ID NO: 1184363 - DNA, 22 bp, Artificial Sequence
  chemically synthesized
actgttgtttgtgcctgagaaa

SEQ ID NO: 1184364 - DNA, 22 bp, Artificial Sequence
  chemically synthesized
gatgttttcctatgctttctca

SEQ ID NO: 1184365 - DNA, 22 bp, Artificial Sequence
  chemically synthesized
ttgtttgtgcctgagaaagcat

SEQ ID NO: 1184366 - DNA, 22 bp, Artificial Sequence
  chemically synthesized
ggatgttttcctatgctttctc

SEQ ID NO: 1184367 - DNA, 22 bp, Artificial Sequence
  chemically synthesized
tttgtgcctgagaaagcatagg

SEQ ID NO: 1184368 - DNA, 22 bp, Artificial Sequence
  chemically synthesized
gtgcctgagaaagcataggaaa

SEQ ID NO: 1184369 - DNA, 22 bp, Artificial Sequence
  chemically synthesized
tgcctgagaaagcataggaaaa

SEQ ID NO: 1184370 - DNA, 22 bp, Artificial Sequence
  chemically synthesized
agaaagcataggaaaacatcca

SEQ ID NO: 1184371 - DNA, 22 bp, Artificial Sequence
  chemically synthesized
aacagtgggtggtttggatgtt

SEQ ID NO: 1184372 - DNA, 22 bp, Artificial Sequence
  chemically synthesized
tcaacagtgggtggtttggatg

SEQ ID NO: 1184373 - DNA, 22 bp, Artificial Sequence
  chemically synthesized
tctcaacagtgggtggtttgga

SEQ ID NO: 1184374 - DNA, 22 bp, Artificial Sequence
  chemically synthesized
ctctcaacagtgggtggtttgg

SEQ ID NO: 1184375 - DNA, 22 bp, Artificial Sequence
  chemically synthesized
tctctcaacagtgggtggtttg

SEQ ID NO: 1184376 - DNA, 22 bp, Artificial Sequence
  chemically synthesized
tttctctcaacagtgggtggtt

SEQ ID NO: 1184377 - DNA, 22 bp, Artificial Sequence
  chemically synthesized
ttctttctctcaacagtgggtg

SEQ ID NO: 1184378 - DNA, 22 bp, Artificial Sequence
  chemically synthesized
gttctttctctcaacagtgggt

SEQ ID NO: 1184379 - DNA, 22 bp, Artificial Sequence
  chemically synthesized
gcttgttctttctctcaacagt

SEQ ID NO: 1184380 - DNA, 22 bp, Artificial Sequence
  chemically synthesized
catgacattggcttgttctttc

SEQ ID NO: 1184381 - DNA, 22 bp, Artificial Sequence
  chemically synthesized
ccatgacattggcttgttcttt

SEQ ID NO: 1184382 - DNA, 22 bp, Artificial Sequence
  chemically synthesized
ttccatgacattggcttgttct

SEQ ID NO: 1184383 - DNA, 22 bp, Artificial Sequence
  chemically synthesized
ttgagagaaagaacaagccaat

SEQ ID NO: 1184384 - DNA, 22 bp, Artificial Sequence
  chemically synthesized
agagaaagaacaagccaatgtc

SEQ ID NO: 1184385 - DNA, 22 bp, Artificial Sequence
  chemically synthesized
gtggggttcttccatgacattg

SEQ ID NO: 1184386 - DNA, 22 bp, Artificial Sequence
  chemically synthesized
agtggggttcttccatgacatt

SEQ ID NO: 1184387 - DNA, 22 bp, Artificial Sequence
  chemically synthesized
tatagaatttagtggggttctt

SEQ ID NO: 1184388 - DNA, 22 bp, Artificial Sequence
  chemically synthesized
cataattgtatagaatttagtg

SEQ ID NO: 1184389 - DNA, 22 bp, Artificial Sequence
  chemically synthesized
gttacataattgtatagaattt

SEQ ID NO: 1184390 - DNA, 22 bp, Artificial Sequence
  chemically synthesized
cgttacataattgtatagaatt

SEQ ID NO: 1184391 - DNA, 22 bp, Artificial Sequence
  chemically synthesized
ttcgttacataattgtatagaa

SEQ ID NO: 1184392 - DNA, 22 bp, Artificial Sequence
  chemically synthesized
aattctatacaattatgtaacg

SEQ ID NO: 1184393 - DNA, 22 bp, Artificial Sequence
  chemically synthesized
tatacaattatgtaacgaagaa

SEQ ID NO: 1184394 - DNA, 22 bp, Artificial Sequence
  chemically synthesized
tacaattatgtaacgaagaatt

SEQ ID NO: 1184395 - DNA, 22 bp, Artificial Sequence
  chemically synthesized
tgtaacgaagaatttcatcatg

SEQ ID NO: 1184396 - DNA, 22 bp, Artificial Sequence
  chemically synthesized
aaataaacaataaagaaaaaca

SEQ ID NO: 1184397 - DNA, 22 bp, Artificial Sequence
  chemically synthesized
caaataaacaataaagaaaaac

SEQ ID NO: 1184398 - DNA, 22 bp, Artificial Sequence
  chemically synthesized
tttcaaataaacaataaagaaa

SEQ ID NO: 1184399 - DNA, 22 bp, Artificial Sequence
  chemically synthesized
catcatgtttttctttattgtt

SEQ ID NO: 1184400 - DNA, 22 bp, Artificial Sequence
  chemically synthesized
atcatgtttttctttattgttt

SEQ ID NO: 1184401 - DNA, 22 bp, Artificial Sequence
  chemically synthesized
aactatttcaaataaacaataa

SEQ ID NO: 1184402 - DNA, 22 bp, Artificial Sequence
  chemically synthesized
aaactatttcaaataaacaata

SEQ ID NO: 1184403 - DNA, 22 bp, Artificial Sequence
  chemically synthesized
taaactatttcaaataaacaat

SEQ ID NO: 1184404 - DNA, 22 bp, Artificial Sequence
  chemically synthesized
ttctttattgtttatttgaaat

SEQ ID NO: 1184405 - DNA, 22 bp, Artificial Sequence
  chemically synthesized
tctttattgtttatttgaaata

SEQ ID NO: 1184406 - DNA, 22 bp, Artificial Sequence
  chemically synthesized
ctttattgtttatttgaaatag

SEQ ID NO: 1184407 - DNA, 22 bp, Artificial Sequence
  chemically synthesized
tttattgtttatttgaaatagt

SEQ ID NO: 1184408 - DNA, 22 bp, Artificial Sequence
  chemically synthesized
tattgtttatttgaaatagttt

SEQ ID NO: 1184409 - DNA, 22 bp, Artificial Sequence
  chemically synthesized
attgtttatttgaaatagttta

SEQ ID NO: 1184410 - DNA, 22 bp, Artificial Sequence
  chemically synthesized
ttgtttatttgaaatagtttaa

SEQ ID NO: 1184411 - DNA, 22 bp, Artificial Sequence
  chemically synthesized
tttatttgaaatagtttaaaac

SEQ ID NO: 1184412 - DNA, 22 bp, Artificial Sequence
  chemically synthesized
aaaatagaaaagtgttttaaac

SEQ ID NO: 1184413 - DNA, 22 bp, Artificial Sequence
  chemically synthesized
gaaaatagaaaagtgttttaaa

SEQ ID NO: 1184414 - DNA, 22 bp, Artificial Sequence
  chemically synthesized
atttgaaatagtttaaaacact

SEQ ID NO: 1184415 - DNA, 22 bp, Artificial Sequence
  chemically synthesized
tgaaaatagaaaagtgttttaa

SEQ ID NO: 1184416 - DNA, 22 bp, Artificial Sequence
  chemically synthesized
tttgaaatagtttaaaacactt

SEQ ID NO: 1184417 - DNA, 22 bp, Artificial Sequence
  chemically synthesized
gaaatagtttaaaacacttttc

SEQ ID NO: 1184418 - DNA, 22 bp, Artificial Sequence
  chemically synthesized
aaatagtttaaaacacttttct

SEQ ID NO: 1184419 - DNA, 22 bp, Artificial Sequence
  chemically synthesized
aggataacaattttgaaaatag

SEQ ID NO: 1184420 - DNA, 22 bp, Artificial Sequence
  chemically synthesized
aaaacacttttctattttcaaa

SEQ ID NO: 1184421 - DNA, 22 bp, Artificial Sequence
  chemically synthesized
aaacacttttctattttcaaaa

SEQ ID NO: 1184422 - DNA, 22 bp, Artificial Sequence
  chemically synthesized
ttcaggataacaattttgaaaa

SEQ ID NO: 1184423 - DNA, 22 bp, Artificial Sequence
  chemically synthesized
attattcaggataacaattttg

SEQ ID NO: 1184424 - DNA, 22 bp, Artificial Sequence
  chemically synthesized
gattattcaggataacaatttt

SEQ ID NO: 1184425 - DNA, 22 bp, Artificial Sequence
  chemically synthesized
tgattattcaggataacaattt

SEQ ID NO: 1184426 - DNA, 22 bp, Artificial Sequence
  chemically synthesized
ttctattttcaaaattgttatc

SEQ ID NO: 1184427 - DNA, 22 bp, Artificial Sequence
  chemically synthesized
tctattttcaaaattgttatcc

SEQ ID NO: 1184428 - DNA, 22 bp, Artificial Sequence
  chemically synthesized
ctattttcaaaattgttatcct

SEQ ID NO: 1184429 - DNA, 22 bp, Artificial Sequence
  chemically synthesized
tattttcaaaattgttatcctg

SEQ ID NO: 1184430 - DNA, 22 bp, Artificial Sequence
  chemically synthesized
ttttcaaaattgttatcctgaa

SEQ ID NO: 1184431 - DNA, 22 bp, Artificial Sequence
  chemically synthesized
tcaaaattgttatcctgaataa

SEQ ID NO: 1184432 - DNA, 22 bp, Artificial Sequence
  chemically synthesized
caaaattgttatcctgaataat

SEQ ID NO: 1184433 - DNA, 22 bp, Artificial Sequence
  chemically synthesized
aaaattgttatcctgaataatc

SEQ ID NO: 1184434 - DNA, 22 bp, Artificial Sequence
  chemically synthesized
ttatcctgaataatcaaaatct

SEQ ID NO: 1184435 - DNA, 22 bp, Artificial Sequence
  chemically synthesized
tcctgaataatcaaaatctgac

SEQ ID NO: 1184436 - DNA, 22 bp, Artificial Sequence
  chemically synthesized
aataatcaaaatctgactttgt

SEQ ID NO: 1184437 - DNA, 22 bp, Artificial Sequence
  chemically synthesized
tgacaatatgatgtacaaagtc

SEQ ID NO: 1184438 - DNA, 22 bp, Artificial Sequence
  chemically synthesized
atgacaatatgatgtacaaagt

SEQ ID NO: 1184439 - DNA, 22 bp, Artificial Sequence
  chemically synthesized
tatgacaatatgatgtacaaag

SEQ ID NO: 1184440 - DNA, 22 bp, Artificial Sequence
  chemically synthesized
aaaaatactttatgacaatatg

SEQ ID NO: 1184441 - DNA, 22 bp, Artificial Sequence
  chemically synthesized
actttgtacatcatattgtcat

SEQ ID NO: 1184442 - DNA, 22 bp, Artificial Sequence
  chemically synthesized
tgtacatcatattgtcataaag

SEQ ID NO: 1184443 - DNA, 22 bp, Artificial Sequence
  chemically synthesized
gtacatcatattgtcataaagt

SEQ ID NO: 1184444 - DNA, 22 bp, Artificial Sequence
  chemically synthesized
tacatcatattgtcataaagta

SEQ ID NO: 1184445 - DNA, 22 bp, Artificial Sequence
  chemically synthesized
atcattaaaaaatactttatga

SEQ ID NO: 1184446 - DNA, 22 bp, Artificial Sequence
  chemically synthesized
aatcattaaaaaatactttatg

SEQ ID NO: 1184447 - DNA, 22 bp, Artificial Sequence
  chemically synthesized
taatcattaaaaaatactttat

SEQ ID NO: 1184448 - DNA, 22 bp, Artificial Sequence
  chemically synthesized
ttaatcattaaaaaatacttta

SEQ ID NO: 1184449 - DNA, 22 bp, Artificial Sequence
  chemically synthesized
tcataaagtattttttaatgat

SEQ ID NO: 1184450 - DNA, 22 bp, Artificial Sequence
  chemically synthesized
aaggcaaatacagtttttaatc

SEQ ID NO: 1184451 - DNA, 22 bp, Artificial Sequence
  chemically synthesized
tttaatgattaaaaactgtatt

SEQ ID NO: 1184452 - DNA, 22 bp, Artificial Sequence
  chemically synthesized
ttaatgattaaaaactgtattt

SEQ ID NO: 1184453 - DNA, 22 bp, Artificial Sequence
  chemically synthesized
taatgattaaaaactgtatttg

SEQ ID NO: 1184454 - DNA, 22 bp, Artificial Sequence
  chemically synthesized
aatgattaaaaactgtatttgc

SEQ ID NO: 1184455 - DNA, 22 bp, Artificial Sequence
  chemically synthesized
atgattaaaaactgtatttgcc

SEQ ID NO: 1184456 - DNA, 22 bp, Artificial Sequence
  chemically synthesized
gagaaagattaaaggcaaatac

SEQ ID NO: 1184457 - DNA, 22 bp, Artificial Sequence
  chemically synthesized
aaaactgtatttgcctttaatc

SEQ ID NO: 1184458 - DNA, 22 bp, Artificial Sequence
  chemically synthesized
tatttgcctttaatctttctct

SEQ ID NO: 1184459 - DNA, 22 bp, Artificial Sequence
  chemically synthesized
gaacaaagagctagagaaagat

SEQ ID NO: 1184460 - DNA, 22 bp, Artificial Sequence
  chemically synthesized
gcctttaatctttctctagctc

SEQ ID NO: 1184461 - DNA, 22 bp, Artificial Sequence
  chemically synthesized
cctttaatctttctctagctct

SEQ ID NO: 1184462 - DNA, 22 bp, Artificial Sequence
  chemically synthesized
atcaactagaacaaagagctag

SEQ ID NO: 1184463 - DNA, 22 bp, Artificial Sequence
  chemically synthesized
catcaactagaacaaagagcta

SEQ ID NO: 1184464 - DNA, 22 bp, Artificial Sequence
  chemically synthesized
taatctttctctagctctttgt

SEQ ID NO: 1184465 - DNA, 22 bp, Artificial Sequence
  chemically synthesized
aatctttctctagctctttgtt

SEQ ID NO: 1184466 - DNA, 22 bp, Artificial Sequence
  chemically synthesized
atctttctctagctctttgttc

SEQ ID NO: 1184467 - DNA, 22 bp, Artificial Sequence
  chemically synthesized
aaatcttcatcaactagaacaa

SEQ ID NO: 1184468 - DNA, 22 bp, Artificial Sequence
  chemically synthesized
tctctagctctttgttctagtt

SEQ ID NO: 1184469 - DNA, 22 bp, Artificial Sequence
  chemically synthesized
ctctagctctttgttctagttg

SEQ ID NO: 1184470 - DNA, 22 bp, Artificial Sequence
  chemically synthesized
taaaatcttcatcaactagaac

SEQ ID NO: 1184471 - DNA, 22 bp, Artificial Sequence
  chemically synthesized
tctagctctttgttctagttga

SEQ ID NO: 1184472 - DNA, 22 bp, Artificial Sequence
  chemically synthesized
tagctctttgttctagttgatg

SEQ ID NO: 1184473 - DNA, 22 bp, Artificial Sequence
  chemically synthesized
gctctttgttctagttgatgaa

SEQ ID NO: 1184474 - DNA, 22 bp, Artificial Sequence
  chemically synthesized
aactctaaaatcttcatcaact

SEQ ID NO: 1184475 - DNA, 22 bp, Artificial Sequence
  chemically synthesized
tttgttctagttgatgaagatt

SEQ ID NO: 1184476 - DNA, 22 bp, Artificial Sequence
  chemically synthesized
tgttctagttgatgaagatttt

SEQ ID NO: 1184477 - DNA, 22 bp, Artificial Sequence
  chemically synthesized
gttctagttgatgaagatttta

SEQ ID NO: 1184478 - DNA, 22 bp, Artificial Sequence
  chemically synthesized
ttctagttgatgaagattttag

SEQ ID NO: 1184479 - DNA, 22 bp, Artificial Sequence
  chemically synthesized
tagttgatgaagattttagagt

SEQ ID NO: 1184480 - DNA, 22 bp, Artificial Sequence
  chemically synthesized
cgtacatattaaactctaaaat

SEQ ID NO: 1184481 - DNA, 22 bp, Artificial Sequence
  chemically synthesized
acgtacatattaaactctaaaa

SEQ ID NO: 1184482 - DNA, 22 bp, Artificial Sequence
  chemically synthesized
gttgatgaagattttagagttt

SEQ ID NO: 1184483 - DNA, 22 bp, Artificial Sequence
  chemically synthesized
atgaagattttagagtttaata

SEQ ID NO: 1184484 - DNA, 22 bp, Artificial Sequence
  chemically synthesized
tagagtttaatatgtacgtaag

SEQ ID NO: 1184485 - DNA, 22 bp, Artificial Sequence
  chemically synthesized
agagtttaatatgtacgtaagt

SEQ ID NO: 1184486 - DNA, 22 bp, Artificial Sequence
  chemically synthesized
gagtttaatatgtacgtaagtt

SEQ ID NO: 1184487 - DNA, 22 bp, Artificial Sequence
  chemically synthesized
aatatgtacgtaagtttgcctt

SEQ ID NO: 1184488 - DNA, 22 bp, Artificial Sequence
  chemically synthesized
atatgtacgtaagtttgccttt

SEQ ID NO: 1184489 - DNA, 22 bp, Artificial Sequence
  chemically synthesized
tgtaacacacaatgaaatgaaa

SEQ ID NO: 1184490 - DNA, 22 bp, Artificial Sequence
  chemically synthesized
cattgtgtaacacacaatgaaa

SEQ ID NO: 1184491 - DNA, 22 bp, Artificial Sequence
  chemically synthesized
ccattgtgtaacacacaatgaa

SEQ ID NO: 1184492 - DNA, 22 bp, Artificial Sequence
  chemically synthesized
gcctttcatttcattgtgtgtt

SEQ ID NO: 1184493 - DNA, 22 bp, Artificial Sequence
  chemically synthesized
cctttcatttcattgtgtgtta

SEQ ID NO: 1184494 - DNA, 22 bp, Artificial Sequence
  chemically synthesized
aatttccattgtgtaacacaca

SEQ ID NO: 1184495 - DNA, 22 bp, Artificial Sequence
  chemically synthesized
tcatttcattgtgtgttacaca

SEQ ID NO: 1184496 - DNA, 22 bp, Artificial Sequence
  chemically synthesized
catttcattgtgtgttacacaa

SEQ ID NO: 1184497 - DNA, 22 bp, Artificial Sequence
  chemically synthesized
atttcattgtgtgttacacaat

SEQ ID NO: 1184498 - DNA, 22 bp, Artificial Sequence
  chemically synthesized
cattgtgtgttacacaatggaa

SEQ ID NO: 1184499 - DNA, 22 bp, Artificial Sequence
  chemically synthesized
attgtgtgttacacaatggaaa

SEQ ID NO: 1184500 - DNA, 22 bp, Artificial Sequence
  chemically synthesized
tgtgttacacaatggaaattta

SEQ ID NO: 1184501 - DNA, 22 bp, Artificial Sequence
  chemically synthesized
cacaatggaaatttaatatatt

SEQ ID NO: 1184502 - DNA, 22 bp, Artificial Sequence
  chemically synthesized
aatatattatgttctatattcc

SEQ ID NO: 1184503 - DNA, 22 bp, Artificial Sequence
  chemically synthesized
atatattatgttctatattcct

SEQ ID NO: 1184504 - DNA, 22 bp, Artificial Sequence
  chemically synthesized
atatgtaccatatcataggaat

SEQ ID NO: 1184505 - DNA, 22 bp, Artificial Sequence
  chemically synthesized
ttcatatgtaccatatcatagg

SEQ ID NO: 1184506 - DNA, 22 bp, Artificial Sequence
  chemically synthesized
tgttctatattcctatgatatg

SEQ ID NO: 1184507 - DNA, 22 bp, Artificial Sequence
  chemically synthesized
tatattcctatgatatggtaca

SEQ ID NO: 1184508 - DNA, 22 bp, Artificial Sequence
  chemically synthesized
tattcctatgatatggtacata

SEQ ID NO: 1184509 - DNA, 22 bp, Artificial Sequence
  chemically synthesized
aaaatactattcatatgtacca

SEQ ID NO: 1184510 - DNA, 22 bp, Artificial Sequence
  chemically synthesized
aaaaatactattcatatgtacc

SEQ ID NO: 1184511 - DNA, 22 bp, Artificial Sequence
  chemically synthesized
taaaaatactattcatatgtac

SEQ ID NO: 1184512 - DNA, 22 bp, Artificial Sequence
  chemically synthesized
ctatgatatggtacatatgaat

SEQ ID NO: 1184513 - DNA, 22 bp, Artificial Sequence
  chemically synthesized
tgatatggtacatatgaatagt

SEQ ID NO: 1184514 - DNA, 22 bp, Artificial Sequence
  chemically synthesized
aaaacatattttaaaaatacta

SEQ ID NO: 1184515 - DNA, 22 bp, Artificial Sequence
  chemically synthesized
caaaacatattttaaaaatact

SEQ ID NO: 1184516 - DNA, 22 bp, Artificial Sequence
  chemically synthesized
atttcaaaacatattttaaaaa

SEQ ID NO: 1184517 - DNA, 22 bp, Artificial Sequence
  chemically synthesized
caatattcatttcaaaacatat

SEQ ID NO: 1184518 - DNA, 22 bp, Artificial Sequence
  chemically synthesized
actacaatattcatttcaaaac

SEQ ID NO: 1184519 - DNA, 22 bp, Artificial Sequence
  chemically synthesized
ttaaaatatgttttgaaatgaa

SEQ ID NO: 1184520 - DNA, 22 bp, Artificial Sequence
  chemically synthesized
taaaatatgttttgaaatgaat

SEQ ID NO: 1184521 - DNA, 22 bp, Artificial Sequence
  chemically synthesized
attgactacaatattcatttca

SEQ ID NO: 1184522 - DNA, 22 bp, Artificial Sequence
  chemically synthesized
aaaatatgttttgaaatgaata

SEQ ID NO: 1184523 - DNA, 22 bp, Artificial Sequence
  chemically synthesized
cattgactacaatattcatttc

SEQ ID NO: 1184524 - DNA, 22 bp, Artificial Sequence
  chemically synthesized
aaatatgttttgaaatgaatat

SEQ ID NO: 1184525 - DNA, 22 bp, Artificial Sequence
  chemically synthesized
cttcattgactacaatattcat

SEQ ID NO: 1184526 - DNA, 22 bp, Artificial Sequence
  chemically synthesized
gcttcattgactacaatattca

SEQ ID NO: 1184527 - DNA, 22 bp, Artificial Sequence
  chemically synthesized
tgcttcattgactacaatattc

SEQ ID NO: 1184528 - DNA, 22 bp, Artificial Sequence
  chemically synthesized
aattttgcttcattgactacaa

SEQ ID NO: 1184529 - DNA, 22 bp, Artificial Sequence
  chemically synthesized
tgaaatgaatattgtagtcaat

SEQ ID NO: 1184530 - DNA, 22 bp, Artificial Sequence
  chemically synthesized
caattttgcttcattgactaca

SEQ ID NO: 1184531 - DNA, 22 bp, Artificial Sequence
  chemically synthesized
gaaatgaatattgtagtcaatg

SEQ ID NO: 1184532 - DNA, 22 bp, Artificial Sequence
  chemically synthesized
tcaattttgcttcattgactac

SEQ ID NO: 1184533 - DNA, 22 bp, Artificial Sequence
  chemically synthesized
aaatgaatattgtagtcaatga

SEQ ID NO: 1184534 - DNA, 22 bp, Artificial Sequence
  chemically synthesized
ttcaattttgcttcattgacta

SEQ ID NO: 1184535 - DNA, 22 bp, Artificial Sequence
  chemically synthesized
aaccttttcaattttgcttcat

SEQ ID NO: 1184536 - DNA, 22 bp, Artificial Sequence
  chemically synthesized
tagtcaatgaagcaaaattgaa

SEQ ID NO: 1184537 - DNA, 22 bp, Artificial Sequence
  chemically synthesized
aaaaggtttagtctgtctcttt

SEQ ID NO: 1184538 - DNA, 22 bp, Artificial Sequence
  chemically synthesized
atgtatgtatatgtacaaaaag

SEQ ID NO: 1184539 - DNA, 22 bp, Artificial Sequence
  chemically synthesized
agtctgtctctttttgtacata

SEQ ID NO: 1184540 - DNA, 22 bp, Artificial Sequence
  chemically synthesized
gtctgtctctttttgtacatat

SEQ ID NO: 1184541 - DNA, 22 bp, Artificial Sequence
  chemically synthesized
tctctttttgtacatatacata

SEQ ID NO: 1184542 - DNA, 22 bp, Artificial Sequence
  chemically synthesized
tttttgtacatatacatacatt

SEQ ID NO: 1184543 - DNA, 22 bp, Artificial Sequence
  chemically synthesized
tttgtacatatacatacattag

SEQ ID NO: 1184544 - DNA, 22 bp, Artificial Sequence
  chemically synthesized
ttgtacatatacatacattagg

SEQ ID NO: 1184545 - DNA, 22 bp, Artificial Sequence
  chemically synthesized
tgtacatatacatacattaggc

SEQ ID NO: 1184546 - DNA, 22 bp, Artificial Sequence
  chemically synthesized
gtacatatacatacattaggct

SEQ ID NO: 1184547 - DNA, 22 bp, Artificial Sequence
  chemically synthesized
tacatatacatacattaggctt

SEQ ID NO: 1184548 - DNA, 22 bp, Artificial Sequence
  chemically synthesized
tatgtatatacacgtgtatata

SEQ ID NO: 1184549 - DNA, 22 bp, Artificial Sequence
  chemically synthesized
atatgtatatacacgtgtatat

SEQ ID NO: 1184550 - DNA, 22 bp, Artificial Sequence
  chemically synthesized
ggctttgtatatatacacgtgt

SEQ ID NO: 1184551 - DNA, 22 bp, Artificial Sequence
  chemically synthesized
tgtatatatacacgtgtatata

SEQ ID NO: 1184552 - DNA, 22 bp, Artificial Sequence
  chemically synthesized
gtatatatacacgtgtatatac

SEQ ID NO: 1184553 - DNA, 22 bp, Artificial Sequence
  chemically synthesized
tatatatacacgtgtatataca

SEQ ID NO: 1184554 - DNA, 22 bp, Artificial Sequence
  chemically synthesized
cgtgcacatatatatataactt

SEQ ID NO: 1184555 - DNA, 22 bp, Artificial Sequence
  chemically synthesized
ggtattacgtgcacatatatat

SEQ ID NO: 1184556 - DNA, 22 bp, Artificial Sequence
  chemically synthesized
aggtattacgtgcacatatata

SEQ ID NO: 1184557 - DNA, 22 bp, Artificial Sequence
  chemically synthesized
taggtattacgtgcacatatat

SEQ ID NO: 1184558 - DNA, 22 bp, Artificial Sequence
  chemically synthesized
ttaggtattacgtgcacatata

SEQ ID NO: 1184559 - DNA, 22 bp, Artificial Sequence
  chemically synthesized
tatatatatgtgcacgtaatac

SEQ ID NO: 1184560 - DNA, 22 bp, Artificial Sequence
  chemically synthesized
tatgcatttttaggtattacgt

SEQ ID NO: 1184561 - DNA, 22 bp, Artificial Sequence
  chemically synthesized
atatgcatttttaggtattacg

SEQ ID NO: 1184562 - DNA, 22 bp, Artificial Sequence
  chemically synthesized
tatatgcatttttaggtattac

SEQ ID NO: 1184563 - DNA, 22 bp, Artificial Sequence
  chemically synthesized
ttttatatgcatttttaggtat

SEQ ID NO: 1184564 - DNA, 22 bp, Artificial Sequence
  chemically synthesized
tgttttatatgcatttttaggt

SEQ ID NO: 1184565 - DNA, 22 bp, Artificial Sequence
  chemically synthesized
ctgttttatatgcatttttagg

SEQ ID NO: 1184566 - DNA, 22 bp, Artificial Sequence
  chemically synthesized
tctgttttatatgcatttttag

SEQ ID NO: 1184567 - DNA, 22 bp, Artificial Sequence
  chemically synthesized
aagatgttttctgttttatatg

SEQ ID NO: 1184568 - DNA, 22 bp, Artificial Sequence
  chemically synthesized
ttcaagatgttttctgttttat

SEQ ID NO: 1184569 - DNA, 22 bp, Artificial Sequence
  chemically synthesized
aaaatgcatataaaacagaaaa

SEQ ID NO: 1184570 - DNA, 22 bp, Artificial Sequence
  chemically synthesized
ctattcaagatgttttctgttt

SEQ ID NO: 1184571 - DNA, 22 bp, Artificial Sequence
  chemically synthesized
gaatagtagctgtcctttacac

SEQ ID NO: 1184572 - DNA, 22 bp, Artificial Sequence
  chemically synthesized
aacaggtaaagtgtgtaaagga

SEQ ID NO: 1184573 - DNA, 22 bp, Artificial Sequence
  chemically synthesized
aatagtagctgtcctttacaca

SEQ ID NO: 1184574 - DNA, 22 bp, Artificial Sequence
  chemically synthesized
tcaacaggtaaagtgtgtaaag

SEQ ID NO: 1184575 - DNA, 22 bp, Artificial Sequence
  chemically synthesized
ttctcaacaggtaaagtgtgta

SEQ ID NO: 1184576 - DNA, 22 bp, Artificial Sequence
  chemically synthesized
tcctttacacactttacctgtt

SEQ ID NO: 1184577 - DNA, 22 bp, Artificial Sequence
  chemically synthesized
tacacactttacctgttgagaa

SEQ ID NO: 1184578 - DNA, 22 bp, Artificial Sequence
  chemically synthesized
acacactttacctgttgagaat

SEQ ID NO: 1184579 - DNA, 22 bp, Artificial Sequence
  chemically synthesized
cacactttacctgttgagaata

SEQ ID NO: 1184580 - DNA, 22 bp, Artificial Sequence
  chemically synthesized
catcatcaaatgcactattctc

SEQ ID NO: 1184581 - DNA, 22 bp, Artificial Sequence
  chemically synthesized
tacctgttgagaatagtgcatt

SEQ ID NO: 1184582 - DNA, 22 bp, Artificial Sequence
  chemically synthesized
acctgttgagaatagtgcattt

SEQ ID NO: 1184583 - DNA, 22 bp, Artificial Sequence
  chemically synthesized
agttacatcatcaaatgcacta

SEQ ID NO: 1184584 - DNA, 22 bp, Artificial Sequence
  chemically synthesized
cctgttgagaatagtgcatttg

SEQ ID NO: 1184585 - DNA, 22 bp, Artificial Sequence
  chemically synthesized
cagttacatcatcaaatgcact

SEQ ID NO: 1184586 - DNA, 22 bp, Artificial Sequence
  chemically synthesized
tcagttacatcatcaaatgcac

SEQ ID NO: 1184587 - DNA, 22 bp, Artificial Sequence
  chemically synthesized
ttgagaatagtgcatttgatga

SEQ ID NO: 1184588 - DNA, 22 bp, Artificial Sequence
  chemically synthesized
agaatagtgcatttgatgatgt

SEQ ID NO: 1184589 - DNA, 22 bp, Artificial Sequence
  chemically synthesized
aagaagaacattttcagttaca

SEQ ID NO: 1184590 - DNA, 22 bp, Artificial Sequence
  chemically synthesized
gatgatgtaactgaaaatgttc

SEQ ID NO: 1184591 - DNA, 22 bp, Artificial Sequence
  chemically synthesized
atgatgtaactgaaaatgttct

SEQ ID NO: 1184592 - DNA, 22 bp, Artificial Sequence
  chemically synthesized
aagtgactaaagaagaacattt

SEQ ID NO: 1184593 - DNA, 22 bp, Artificial Sequence
  chemically synthesized
aaaatgttcttctttagtcact

SEQ ID NO: 1184594 - DNA, 22 bp, Artificial Sequence
  chemically synthesized
ccaaggccacctaaagtgacta

SEQ ID NO: 1184595 - DNA, 22 bp, Artificial Sequence
  chemically synthesized
ttctttagtcactttaggtggc

SEQ ID NO: 1184596 - DNA, 22 bp, Artificial Sequence
  chemically synthesized
ctttagtcactttaggtggcct

SEQ ID NO: 1184597 - DNA, 22 bp, Artificial Sequence
  chemically synthesized
tttagtcactttaggtggcctt

SEQ ID NO: 1184598 - DNA, 22 bp, Artificial Sequence
  chemically synthesized
tagtcactttaggtggccttgg

SEQ ID NO: 1184599 - DNA, 22 bp, Artificial Sequence
  chemically synthesized
agtcactttaggtggccttggc

SEQ ID NO: 1184600 - DNA, 22 bp, Artificial Sequence
  chemically synthesized
gtcactttaggtggccttggca

SEQ ID NO: 1184601 - DNA, 22 bp, Artificial Sequence
  chemically synthesized
taggtggccttggcaacatttc

SEQ ID NO: 1184602 - DNA, 22 bp, Artificial Sequence
  chemically synthesized
aggtggccttggcaacatttcc

SEQ ID NO: 1184603 - DNA, 22 bp, Artificial Sequence
  chemically synthesized
ggtggccttggcaacatttcca

SEQ ID NO: 1184604 - DNA, 22 bp, Artificial Sequence
  chemically synthesized
aagccatccaggaagtggaaat

SEQ ID NO: 1184605 - DNA, 22 bp, Artificial Sequence
  chemically synthesized
ggcaacatttccacttcctgga

SEQ ID NO: 1184606 - DNA, 22 bp, Artificial Sequence
  chemically synthesized
gcaacatttccacttcctggat

SEQ ID NO: 1184607 - DNA, 22 bp, Artificial Sequence
  chemically synthesized
aacaagtgagcattgaagccat

SEQ ID NO: 1184608 - DNA, 22 bp, Artificial Sequence
  chemically synthesized
ccacttcctggatggcttcaat

SEQ ID NO: 1184609 - DNA, 22 bp, Artificial Sequence
  chemically synthesized
cacttcctggatggcttcaatg

SEQ ID NO: 1184610 - DNA, 22 bp, Artificial Sequence
  chemically synthesized
cctcaacaagtgagcattgaag

SEQ ID NO: 1184611 - DNA, 22 bp, Artificial Sequence
  chemically synthesized
gcctcaacaagtgagcattgaa

SEQ ID NO: 1184612 - DNA, 22 bp, Artificial Sequence
  chemically synthesized
tgcctcaacaagtgagcattga

SEQ ID NO: 1184613 - DNA, 22 bp, Artificial Sequence
  chemically synthesized
cctggatggcttcaatgctcac

SEQ ID NO: 1184614 - DNA, 22 bp, Artificial Sequence
  chemically synthesized
ctggatggcttcaatgctcact

SEQ ID NO: 1184615 - DNA, 22 bp, Artificial Sequence
  chemically synthesized
gatggcttcaatgctcacttgt

SEQ ID NO: 1184616 - DNA, 22 bp, Artificial Sequence
  chemically synthesized
caagttttgcctcaacaagtga

SEQ ID NO: 1184617 - DNA, 22 bp, Artificial Sequence
  chemically synthesized
ccaagttttgcctcaacaagtg

SEQ ID NO: 1184618 - DNA, 22 bp, Artificial Sequence
  chemically synthesized
ttccaagttttgcctcaacaag

SEQ ID NO: 1184619 - DNA, 22 bp, Artificial Sequence
  chemically synthesized
caatgctcacttgttgaggcaa

SEQ ID NO: 1184620 - DNA, 22 bp, Artificial Sequence
  chemically synthesized
aatgctcacttgttgaggcaaa

SEQ ID NO: 1184621 - DNA, 22 bp, Artificial Sequence
  chemically synthesized
acttgttgaggcaaaacttgga

SEQ ID NO: 1184622 - DNA, 22 bp, Artificial Sequence
  chemically synthesized
gttgaggcaaaacttggaagag

SEQ ID NO: 1184623 - DNA, 22 bp, Artificial Sequence
  chemically synthesized
ttgaggcaaaacttggaagagt

SEQ ID NO: 1184624 - DNA, 22 bp, Artificial Sequence
  chemically synthesized
atgtacatcacatcactcttcc

SEQ ID NO: 1184625 - DNA, 22 bp, Artificial Sequence
  chemically synthesized
aggcaaaacttggaagagtgat

SEQ ID NO: 1184626 - DNA, 22 bp, Artificial Sequence
  chemically synthesized
aatgtacatcacatcactcttc

SEQ ID NO: 1184627 - DNA, 22 bp, Artificial Sequence
  chemically synthesized
ggaagagtgatgtgatgtacat

SEQ ID NO: 1184628 - DNA, 22 bp, Artificial Sequence
  chemically synthesized
gaagagtgatgtgatgtacatt

SEQ ID NO: 1184629 - DNA, 22 bp, Artificial Sequence
  chemically synthesized
tccagataagaagtccatctta

SEQ ID NO: 1184630 - DNA, 22 bp, Artificial Sequence
  chemically synthesized
ataccacctatccagataagaa

SEQ ID NO: 1184631 - DNA, 22 bp, Artificial Sequence
  chemically synthesized
agatggacttcttatctggata

SEQ ID NO: 1184632 - DNA, 22 bp, Artificial Sequence
  chemically synthesized
cagatgttgataccacctatcc

SEQ ID NO: 1184633 - DNA, 22 bp, Artificial Sequence
  chemically synthesized
acagatgttgataccacctatc

SEQ ID NO: 1184634 - DNA, 22 bp, Artificial Sequence
  chemically synthesized
cttatctggataggtggtatca

SEQ ID NO: 1184635 - DNA, 22 bp, Artificial Sequence
  chemically synthesized
ttatctggataggtggtatcaa

SEQ ID NO: 1184636 - DNA, 22 bp, Artificial Sequence
  chemically synthesized
atctggataggtggtatcaaca

SEQ ID NO: 1184637 - DNA, 22 bp, Artificial Sequence
  chemically synthesized
tctggataggtggtatcaacat

SEQ ID NO: 1184638 - DNA, 22 bp, Artificial Sequence
  chemically synthesized
atgtgcttacagatgttgatac

SEQ ID NO: 1184639 - DNA, 22 bp, Artificial Sequence
  chemically synthesized
gataggtggtatcaacatctgt

SEQ ID NO: 1184640 - DNA, 22 bp, Artificial Sequence
  chemically synthesized
atgtgtagtgttaatgtgctta

SEQ ID NO: 1184641 - DNA, 22 bp, Artificial Sequence
  chemically synthesized
taagcacattaacactacacat

SEQ ID NO: 1184642 - DNA, 22 bp, Artificial Sequence
  chemically synthesized
aaatatagaaaccaaaaattga

SEQ ID NO: 1184643 - DNA, 22 bp, Artificial Sequence
  chemically synthesized
acactacacatcaatttttggt

SEQ ID NO: 1184644 - DNA, 22 bp, Artificial Sequence
  chemically synthesized
gagtctcaaatatagaaaccaa

SEQ ID NO: 1184645 - DNA, 22 bp, Artificial Sequence
  chemically synthesized
cacatcaatttttggtttctat

SEQ ID NO: 1184646 - DNA, 22 bp, Artificial Sequence
  chemically synthesized
agagtctcaaatatagaaacca

SEQ ID NO: 1184647 - DNA, 22 bp, Artificial Sequence
  chemically synthesized
tagagtctcaaatatagaaacc

SEQ ID NO: 1184648 - DNA, 22 bp, Artificial Sequence
  chemically synthesized
ttagagtctcaaatatagaaac

SEQ ID NO: 1184649 - DNA, 22 bp, Artificial Sequence
  chemically synthesized
tccttttagagtctcaaatata

SEQ ID NO: 1184650 - DNA, 22 bp, Artificial Sequence
  chemically synthesized
ttggtttctatatttgagactc

SEQ ID NO: 1184651 - DNA, 22 bp, Artificial Sequence
  chemically synthesized
attatccttttagagtctcaaa

SEQ ID NO: 1184652 - DNA, 22 bp, Artificial Sequence
  chemically synthesized
tggtttctatatttgagactct

SEQ ID NO: 1184653 - DNA, 22 bp, Artificial Sequence
  chemically synthesized
ggtttctatatttgagactcta

SEQ ID NO: 1184654 - DNA, 22 bp, Artificial Sequence
  chemically synthesized
gtttctatatttgagactctaa

SEQ ID NO: 1184655 - DNA, 22 bp, Artificial Sequence
  chemically synthesized
ttcattatccttttagagtctc

SEQ ID NO: 1184656 - DNA, 22 bp, Artificial Sequence
  chemically synthesized
gttcattatccttttagagtct

SEQ ID NO: 1184657 - DNA, 22 bp, Artificial Sequence
  chemically synthesized
ctatatttgagactctaaaagg

SEQ ID NO: 1184658 - DNA, 22 bp, Artificial Sequence
  chemically synthesized
tatatttgagactctaaaagga

SEQ ID NO: 1184659 - DNA, 22 bp, Artificial Sequence
  chemically synthesized
atttgttcattatccttttaga

SEQ ID NO: 1184660 - DNA, 22 bp, Artificial Sequence
  chemically synthesized
gatttgttcattatccttttag

SEQ ID NO: 1184661 - DNA, 22 bp, Artificial Sequence
  chemically synthesized
tatttgagactctaaaaggata

SEQ ID NO: 1184662 - DNA, 22 bp, Artificial Sequence
  chemically synthesized
tgatttgttcattatcctttta

SEQ ID NO: 1184663 - DNA, 22 bp, Artificial Sequence
  chemically synthesized
actttgatttgttcattatcct

SEQ ID NO: 1184664 - DNA, 22 bp, Artificial Sequence
  chemically synthesized
gagactctaaaaggataatgaa

SEQ ID NO: 1184665 - DNA, 22 bp, Artificial Sequence
  chemically synthesized
aactttgatttgttcattatcc

SEQ ID NO: 1184666 - DNA, 22 bp, Artificial Sequence
  chemically synthesized
agactctaaaaggataatgaac

SEQ ID NO: 1184667 - DNA, 22 bp, Artificial Sequence
  chemically synthesized
taactttgatttgttcattatc

SEQ ID NO: 1184668 - DNA, 22 bp, Artificial Sequence
  chemically synthesized
ctttaactttgatttgttcatt

SEQ ID NO: 1184669 - DNA, 22 bp, Artificial Sequence
  chemically synthesized
cctttaactttgatttgttcat

SEQ ID NO: 1184670 - DNA, 22 bp, Artificial Sequence
  chemically synthesized
taaaaggataatgaacaaatca

SEQ ID NO: 1184671 - DNA, 22 bp, Artificial Sequence
  chemically synthesized
aaaggataatgaacaaatcaaa

SEQ ID NO: 1184672 - DNA, 22 bp, Artificial Sequence
  chemically synthesized
tcgtcttcctttaactttgatt

SEQ ID NO: 1184673 - DNA, 22 bp, Artificial Sequence
  chemically synthesized
atctatcgtcttcctttaactt

SEQ ID NO: 1184674 - DNA, 22 bp, Artificial Sequence
  chemically synthesized
attaatctatcgtcttccttta

SEQ ID NO: 1184675 - DNA, 22 bp, Artificial Sequence
  chemically synthesized
ttcattaatctatcgtcttcct

SEQ ID NO: 1184676 - DNA, 22 bp, Artificial Sequence
  chemically synthesized
actgttcattaatctatcgtct

SEQ ID NO: 1184677 - DNA, 22 bp, Artificial Sequence
  chemically synthesized
aaggaagacgatagattaatga

SEQ ID NO: 1184678 - DNA, 22 bp, Artificial Sequence
  chemically synthesized
atggacaattcactgttcatta

SEQ ID NO: 1184679 - DNA, 22 bp, Artificial Sequence
  chemically synthesized
gaggacattcatggacaattca

SEQ ID NO: 1184680 - DNA, 22 bp, Artificial Sequence
  chemically synthesized
tggaggacattcatggacaatt

SEQ ID NO: 1184681 - DNA, 22 bp, Artificial Sequence
  chemically synthesized
atgaacagtgaattgtccatga

SEQ ID NO: 1184682 - DNA, 22 bp, Artificial Sequence
  chemically synthesized
gtctctggaggacattcatgga

SEQ ID NO: 1184683 - DNA, 22 bp, Artificial Sequence
  chemically synthesized
attagtctctggaggacattca

SEQ ID NO: 1184684 - DNA, 22 bp, Artificial Sequence
  chemically synthesized
taattagtctctggaggacatt

SEQ ID NO: 1184685 - DNA, 22 bp, Artificial Sequence
  chemically synthesized
tccatgaatgtcctccagagac

SEQ ID NO: 1184686 - DNA, 22 bp, Artificial Sequence
  chemically synthesized
atgttctaattagtctctggag

SEQ ID NO: 1184687 - DNA, 22 bp, Artificial Sequence
  chemically synthesized
tcatgttctaattagtctctgg

SEQ ID NO: 1184688 - DNA, 22 bp, Artificial Sequence
  chemically synthesized
attctcatgttctaattagtct

SEQ ID NO: 1184689 - DNA, 22 bp, Artificial Sequence
  chemically synthesized
ggcctcattctcatgttctaat

SEQ ID NO: 1184690 - DNA, 22 bp, Artificial Sequence
  chemically synthesized
aggcctcattctcatgttctaa

SEQ ID NO: 1184691 - DNA, 22 bp, Artificial Sequence
  chemically synthesized
taggcctcattctcatgttcta

SEQ ID NO: 1184692 - DNA, 22 bp, Artificial Sequence
  chemically synthesized
cagagactaattagaacatgag

SEQ ID NO: 1184693 - DNA, 22 bp, Artificial Sequence
  chemically synthesized
attagaacatgagaatgaggcc

SEQ ID NO: 1184694 - DNA, 22 bp, Artificial Sequence
  chemically synthesized
gaaagacattttaggcctcatt

SEQ ID NO: 1184695 - DNA, 22 bp, Artificial Sequence
  chemically synthesized
gaacatgagaatgaggcctaaa

SEQ ID NO: 1184696 - DNA, 22 bp, Artificial Sequence
  chemically synthesized
ccaaattggaaagacattttag

SEQ ID NO: 1184697 - DNA, 22 bp, Artificial Sequence
  chemically synthesized
gtctgccaaattggaaagacat

SEQ ID NO: 1184698 - DNA, 22 bp, Artificial Sequence
  chemically synthesized
attggtctgccaaattggaaag

SEQ ID NO: 1184699 - DNA, 22 bp, Artificial Sequence
  chemically synthesized
atctcattggtctgccaaattg

SEQ ID NO: 1184700 - DNA, 22 bp, Artificial Sequence
  chemically synthesized
aaatgtctttccaatttggcag

SEQ ID NO: 1184701 - DNA, 22 bp, Artificial Sequence
  chemically synthesized
ctcatctcattggtctgccaaa

SEQ ID NO: 1184702 - DNA, 22 bp, Artificial Sequence
  chemically synthesized
ctgctcatctcattggtctgcc

SEQ ID NO: 1184703 - DNA, 22 bp, Artificial Sequence
  chemically synthesized
actgctcatctcattggtctgc

SEQ ID NO: 1184704 - DNA, 22 bp, Artificial Sequence
  chemically synthesized
tactgctcatctcattggtctg

SEQ ID NO: 1184705 - DNA, 22 bp, Artificial Sequence
  chemically synthesized
tccaatttggcagaccaatgag

SEQ ID NO: 1184706 - DNA, 22 bp, Artificial Sequence
  chemically synthesized
ccaatttggcagaccaatgaga

SEQ ID NO: 1184707 - DNA, 22 bp, Artificial Sequence
  chemically synthesized
caatttggcagaccaatgagat

SEQ ID NO: 1184708 - DNA, 22 bp, Artificial Sequence
  chemically synthesized
actttactgctcatctcattgg

SEQ ID NO: 1184709 - DNA, 22 bp, Artificial Sequence
  chemically synthesized
ggcagaccaatgagatgagcag

SEQ ID NO: 1184710 - DNA, 22 bp, Artificial Sequence
  chemically synthesized
gcagaccaatgagatgagcagt

SEQ ID NO: 1184711 - DNA, 22 bp, Artificial Sequence
  chemically synthesized
tatgaacaaggaaaataaatta

SEQ ID NO: 1184712 - DNA, 22 bp, Artificial Sequence
  chemically synthesized
atatgaacaaggaaaataaatt

SEQ ID NO: 1184713 - DNA, 22 bp, Artificial Sequence
  chemically synthesized
tatatgaacaaggaaaataaat

SEQ ID NO: 1184714 - DNA, 22 bp, Artificial Sequence
  chemically synthesized
ttatatgaacaaggaaaataaa

SEQ ID NO: 1184715 - DNA, 22 bp, Artificial Sequence
  chemically synthesized
atttattttccttgttcatata

SEQ ID NO: 1184716 - DNA, 22 bp, Artificial Sequence
  chemically synthesized
attttccttgttcatataaaaa

SEQ ID NO: 1184717 - DNA, 22 bp, Artificial Sequence
  chemically synthesized
ttttccttgttcatataaaaac

SEQ ID NO: 1184718 - DNA, 22 bp, Artificial Sequence
  chemically synthesized
tccttgttcatataaaaacttc

SEQ ID NO: 1184719 - DNA, 22 bp, Artificial Sequence
  chemically synthesized
ccttgttcatataaaaacttca

SEQ ID NO: 1184720 - DNA, 22 bp, Artificial Sequence
  chemically synthesized
cttgttcatataaaaacttcat

SEQ ID NO: 1184721 - DNA, 22 bp, Artificial Sequence
  chemically synthesized
gttcatataaaaacttcattcc

SEQ ID NO: 1184722 - DNA, 22 bp, Artificial Sequence
  chemically synthesized
ttcatataaaaacttcattcca

SEQ ID NO: 1184723 - DNA, 22 bp, Artificial Sequence
  chemically synthesized
ggaaaaagtaatatggaatgaa

SEQ ID NO: 1184724 - DNA, 22 bp, Artificial Sequence
  chemically synthesized
aggaaaaagtaatatggaatga

SEQ ID NO: 1184725 - DNA, 22 bp, Artificial Sequence
  chemically synthesized
atataaaaacttcattccatat

SEQ ID NO: 1184726 - DNA, 22 bp, Artificial Sequence
  chemically synthesized
acttaggaaaaagtaatatgga

SEQ ID NO: 1184727 - DNA, 22 bp, Artificial Sequence
  chemically synthesized
gacttaggaaaaagtaatatgg

SEQ ID NO: 1184728 - DNA, 22 bp, Artificial Sequence
  chemically synthesized
gcaatttgacttaggaaaaagt

SEQ ID NO: 1184729 - DNA, 22 bp, Artificial Sequence
  chemically synthesized
cattccatattactttttccta

SEQ ID NO: 1184730 - DNA, 22 bp, Artificial Sequence
  chemically synthesized
ggcaatttgacttaggaaaaag

SEQ ID NO: 1184731 - DNA, 22 bp, Artificial Sequence
  chemically synthesized
attccatattactttttcctaa

SEQ ID NO: 1184732 - DNA, 22 bp, Artificial Sequence
  chemically synthesized
gtttggcaatttgacttaggaa

SEQ ID NO: 1184733 - DNA, 22 bp, Artificial Sequence
  chemically synthesized
catattactttttcctaagtca

SEQ ID NO: 1184734 - DNA, 22 bp, Artificial Sequence
  chemically synthesized
ctttttcctaagtcaaattgcc

SEQ ID NO: 1184735 - DNA, 22 bp, Artificial Sequence
  chemically synthesized
gatgggctagtttggcaatttg

SEQ ID NO: 1184736 - DNA, 22 bp, Artificial Sequence
  chemically synthesized
tttcctaagtcaaattgccaaa

SEQ ID NO: 1184737 - DNA, 22 bp, Artificial Sequence
  chemically synthesized
ttcctaagtcaaattgccaaac

SEQ ID NO: 1184738 - DNA, 22 bp, Artificial Sequence
  chemically synthesized
ttagatgggctagtttggcaat

SEQ ID NO: 1184739 - DNA, 22 bp, Artificial Sequence
  chemically synthesized
tcctaagtcaaattgccaaact

SEQ ID NO: 1184740 - DNA, 22 bp, Artificial Sequence
  chemically synthesized
cctaagtcaaattgccaaacta

SEQ ID NO: 1184741 - DNA, 22 bp, Artificial Sequence
  chemically synthesized
tgttagatgggctagtttggca

SEQ ID NO: 1184742 - DNA, 22 bp, Artificial Sequence
  chemically synthesized
ctaagtcaaattgccaaactag

SEQ ID NO: 1184743 - DNA, 22 bp, Artificial Sequence
  chemically synthesized
ctctgttagatgggctagtttg

SEQ ID NO: 1184744 - DNA, 22 bp, Artificial Sequence
  chemically synthesized
agtcaaattgccaaactagccc

SEQ ID NO: 1184745 - DNA, 22 bp, Artificial Sequence
  chemically synthesized
atgaaagctactctgttagatg

SEQ ID NO: 1184746 - DNA, 22 bp, Artificial Sequence
  chemically synthesized
ccaaactagcccatctaacaga

SEQ ID NO: 1184747 - DNA, 22 bp, Artificial Sequence
  chemically synthesized
tctaatgaaagctactctgtta

SEQ ID NO: 1184748 - DNA, 22 bp, Artificial Sequence
  chemically synthesized
atctaatgaaagctactctgtt

SEQ ID NO: 1184749 - DNA, 22 bp, Artificial Sequence
  chemically synthesized
ttatctaatgaaagctactctg

SEQ ID NO: 1184750 - DNA, 22 bp, Artificial Sequence
  chemically synthesized
cttatctaatgaaagctactct

SEQ ID NO: 1184751 - DNA, 22 bp, Artificial Sequence
  chemically synthesized
gcccatctaacagagtagcttt

SEQ ID NO: 1184752 - DNA, 22 bp, Artificial Sequence
  chemically synthesized
tttcttatctaatgaaagctac

SEQ ID NO: 1184753 - DNA, 22 bp, Artificial Sequence
  chemically synthesized
gtttcttatctaatgaaagcta

SEQ ID NO: 1184754 - DNA, 22 bp, Artificial Sequence
  chemically synthesized
tgtttcttatctaatgaaagct

SEQ ID NO: 1184755 - DNA, 22 bp, Artificial Sequence
  chemically synthesized
ttgtttcttatctaatgaaagc

SEQ ID NO: 1184756 - DNA, 22 bp, Artificial Sequence
  chemically synthesized
tttttgtttcttatctaatgaa

SEQ ID NO: 1184757 - DNA, 22 bp, Artificial Sequence
  chemically synthesized
acagagtagctttcattagata

SEQ ID NO: 1184758 - DNA, 22 bp, Artificial Sequence
  chemically synthesized
atttttgtttcttatctaatga

SEQ ID NO: 1184759 - DNA, 22 bp, Artificial Sequence
  chemically synthesized
tatttttgtttcttatctaatg

SEQ ID NO: 1184760 - DNA, 22 bp, Artificial Sequence
  chemically synthesized
ttatttttgtttcttatctaat

SEQ ID NO: 1184761 - DNA, 22 bp, Artificial Sequence
  chemically synthesized
tcattagataagaaacaaaaat

SEQ ID NO: 1184762 - DNA, 22 bp, Artificial Sequence
  chemically synthesized
cattagataagaaacaaaaata

SEQ ID NO: 1184763 - DNA, 22 bp, Artificial Sequence
  chemically synthesized
attagataagaaacaaaaataa

SEQ ID NO: 1184764 - DNA, 22 bp, Artificial Sequence
  chemically synthesized
gataagaaacaaaaataaaaga

SEQ ID NO: 1184765 - DNA, 22 bp, Artificial Sequence
  chemically synthesized
gagggaaaatgtaatcttttat

SEQ ID NO: 1184766 - DNA, 22 bp, Artificial Sequence
  chemically synthesized
cattggagggaaaatgtaatct

SEQ ID NO: 1184767 - DNA, 22 bp, Artificial Sequence
  chemically synthesized
ccattggagggaaaatgtaatc

SEQ ID NO: 1184768 - DNA, 22 bp, Artificial Sequence
  chemically synthesized
tccattggagggaaaatgtaat

SEQ ID NO: 1184769 - DNA, 22 bp, Artificial Sequence
  chemically synthesized
atataactttccattggaggga

SEQ ID NO: 1184770 - DNA, 22 bp, Artificial Sequence
  chemically synthesized
cattttccctccaatggaaagt

SEQ ID NO: 1184771 - DNA, 22 bp, Artificial Sequence
  chemically synthesized
acatgttaatataactttccat

SEQ ID NO: 1184772 - DNA, 22 bp, Artificial Sequence
  chemically synthesized
tccctccaatggaaagttatat

SEQ ID NO: 1184773 - DNA, 22 bp, Artificial Sequence
  chemically synthesized
ccctccaatggaaagttatatt

SEQ ID NO: 1184774 - DNA, 22 bp, Artificial Sequence
  chemically synthesized
aattgacatgttaatataactt

SEQ ID NO: 1184775 - DNA, 22 bp, Artificial Sequence
  chemically synthesized
cctccaatggaaagttatatta

SEQ ID NO: 1184776 - DNA, 22 bp, Artificial Sequence
  chemically synthesized
gaattgacatgttaatataact

SEQ ID NO: 1184777 - DNA, 22 bp, Artificial Sequence
  chemically synthesized
caatggaaagttatattaacat

SEQ ID NO: 1184778 - DNA, 22 bp, Artificial Sequence
  chemically synthesized
ccagtgcaccatttgaattgac

SEQ ID NO: 1184779 - DNA, 22 bp, Artificial Sequence
  chemically synthesized
tattaacatgtcaattcaaatg

SEQ ID NO: 1184780 - DNA, 22 bp, Artificial Sequence
  chemically synthesized
attaccagtgcaccatttgaat

SEQ ID NO: 1184781 - DNA, 22 bp, Artificial Sequence
  chemically synthesized
aattaccagtgcaccatttgaa

SEQ ID NO: 1184782 - DNA, 22 bp, Artificial Sequence
  chemically synthesized
acatgtcaattcaaatggtgca

SEQ ID NO: 1184783 - DNA, 22 bp, Artificial Sequence
  chemically synthesized
tttaattaccagtgcaccattt

SEQ ID NO: 1184784 - DNA, 22 bp, Artificial Sequence
  chemically synthesized
gtttaattaccagtgcaccatt

SEQ ID NO: 1184785 - DNA, 22 bp, Artificial Sequence
  chemically synthesized
tgtatttgtttaattaccagtg

SEQ ID NO: 1184786 - DNA, 22 bp, Artificial Sequence
  chemically synthesized
gtgtatttgtttaattaccagt

SEQ ID NO: 1184787 - DNA, 22 bp, Artificial Sequence
  chemically synthesized
tgtgtatttgtttaattaccag

SEQ ID NO: 1184788 - DNA, 22 bp, Artificial Sequence
  chemically synthesized
aaatggtgcactggtaattaaa

SEQ ID NO: 1184789 - DNA, 22 bp, Artificial Sequence
  chemically synthesized
gtaattaaacaaatacacaaaa

SEQ ID NO: 1184790 - DNA, 22 bp, Artificial Sequence
  chemically synthesized
aacaaatacacaaaatggttta

SEQ ID NO: 1184791 - DNA, 22 bp, Artificial Sequence
  chemically synthesized
agaaccaaagcggtaaaccatt

SEQ ID NO: 1184792 - DNA, 22 bp, Artificial Sequence
  chemically synthesized
ctgagaaccaaagcggtaaacc

SEQ ID NO: 1184793 - DNA, 22 bp, Artificial Sequence
  chemically synthesized
actgagaaccaaagcggtaaac

SEQ ID NO: 1184794 - DNA, 22 bp, Artificial Sequence
  chemically synthesized
tactgagaaccaaagcggtaaa

SEQ ID NO: 1184795 - DNA, 22 bp, Artificial Sequence
  chemically synthesized
tttactgagaaccaaagcggta

SEQ ID NO: 1184796 - DNA, 22 bp, Artificial Sequence
  chemically synthesized
ctttactgagaaccaaagcggt

SEQ ID NO: 1184797 - DNA, 22 bp, Artificial Sequence
  chemically synthesized
accgctttggttctcagtaaag

SEQ ID NO: 1184798 - DNA, 22 bp, Artificial Sequence
  chemically synthesized
ccgctttggttctcagtaaaga

SEQ ID NO: 1184799 - DNA, 22 bp, Artificial Sequence
  chemically synthesized
aaaggtatcaggtttctttact

SEQ ID NO: 1184800 - DNA, 22 bp, Artificial Sequence
  chemically synthesized
tggttctcagtaaagaaacctg

SEQ ID NO: 1184801 - DNA, 22 bp, Artificial Sequence
  chemically synthesized
ggttctcagtaaagaaacctga

SEQ ID NO: 1184802 - DNA, 22 bp, Artificial Sequence
  chemically synthesized
agttaaaaggtatcaggtttct

SEQ ID NO: 1184803 - DNA, 22 bp, Artificial Sequence
  chemically synthesized
gttctcagtaaagaaacctgat

SEQ ID NO: 1184804 - DNA, 22 bp, Artificial Sequence
  chemically synthesized
tcagtaaagaaacctgatacct

SEQ ID NO: 1184805 - DNA, 22 bp, Artificial Sequence
  chemically synthesized
agtaaagaaacctgataccttt

SEQ ID NO: 1184806 - DNA, 22 bp, Artificial Sequence
  chemically synthesized
atatcagcaacattcagttaaa

SEQ ID NO: 1184807 - DNA, 22 bp, Artificial Sequence
  chemically synthesized
aatatcagcaacattcagttaa

SEQ ID NO: 1184808 - DNA, 22 bp, Artificial Sequence
  chemically synthesized
taatatcagcaacattcagtta

SEQ ID NO: 1184809 - DNA, 22 bp, Artificial Sequence
  chemically synthesized
ataccttttaactgaatgttgc

SEQ ID NO: 1184810 - DNA, 22 bp, Artificial Sequence
  chemically synthesized
catactttaatatcagcaacat

SEQ ID NO: 1184811 - DNA, 22 bp, Artificial Sequence
  chemically synthesized
tgcatactttaatatcagcaac

SEQ ID NO: 1184812 - DNA, 22 bp, Artificial Sequence
  chemically synthesized
ttaactgaatgttgctgatatt

SEQ ID NO: 1184813 - DNA, 22 bp, Artificial Sequence
  chemically synthesized
tctgcatactttaatatcagca

SEQ ID NO: 1184814 - DNA, 22 bp, Artificial Sequence
  chemically synthesized
taactgaatgttgctgatatta

SEQ ID NO: 1184815 - DNA, 22 bp, Artificial Sequence
  chemically synthesized
aactgaatgttgctgatattaa

SEQ ID NO: 1184816 - DNA, 22 bp, Artificial Sequence
  chemically synthesized
actgaatgttgctgatattaaa

SEQ ID NO: 1184817 - DNA, 22 bp, Artificial Sequence
  chemically synthesized
gctctctgcatactttaatatc

SEQ ID NO: 1184818 - DNA, 22 bp, Artificial Sequence
  chemically synthesized
agctctctgcatactttaatat

SEQ ID NO: 1184819 - DNA, 22 bp, Artificial Sequence
  chemically synthesized
aatgttgctgatattaaagtat

SEQ ID NO: 1184820 - DNA, 22 bp, Artificial Sequence
  chemically synthesized
tttagctctctgcatactttaa

SEQ ID NO: 1184821 - DNA, 22 bp, Artificial Sequence
  chemically synthesized
atttagctctctgcatacttta

SEQ ID NO: 1184822 - DNA, 22 bp, Artificial Sequence
  chemically synthesized
ctgatattaaagtatgcagaga

SEQ ID NO: 1184823 - DNA, 22 bp, Artificial Sequence
  chemically synthesized
atattaaagtatgcagagagct

SEQ ID NO: 1184824 - DNA, 22 bp, Artificial Sequence
  chemically synthesized
agcagagacttatttagctctc

SEQ ID NO: 1184825 - DNA, 22 bp, Artificial Sequence
  chemically synthesized
cagcagagacttatttagctct

SEQ ID NO: 1184826 - DNA, 22 bp, Artificial Sequence
  chemically synthesized
aagtatgcagagagctaaataa

SEQ ID NO: 1184827 - DNA, 22 bp, Artificial Sequence
  chemically synthesized
atttcagcagagacttatttag

SEQ ID NO: 1184828 - DNA, 22 bp, Artificial Sequence
  chemically synthesized
tggatacatgactcatttcagc

SEQ ID NO: 1184829 - DNA, 22 bp, Artificial Sequence
  chemically synthesized
aataagtctctgctgaaatgag

SEQ ID NO: 1184830 - DNA, 22 bp, Artificial Sequence
  chemically synthesized
tattgtggatacatgactcatt

SEQ ID NO: 1184831 - DNA, 22 bp, Artificial Sequence
  chemically synthesized
atattgtggatacatgactcat

SEQ ID NO: 1184832 - DNA, 22 bp, Artificial Sequence
  chemically synthesized
atttatattgtggatacatgac

SEQ ID NO: 1184833 - DNA, 22 bp, Artificial Sequence
  chemically synthesized
tgctgaaatgagtcatgtatcc

SEQ ID NO: 1184834 - DNA, 22 bp, Artificial Sequence
  chemically synthesized
aatttatattgtggatacatga

SEQ ID NO: 1184835 - DNA, 22 bp, Artificial Sequence
  chemically synthesized
ctgaaatgagtcatgtatccac

SEQ ID NO: 1184836 - DNA, 22 bp, Artificial Sequence
  chemically synthesized
tttaatttatattgtggataca

SEQ ID NO: 1184837 - DNA, 22 bp, Artificial Sequence
  chemically synthesized
aaatgagtcatgtatccacaat

SEQ ID NO: 1184838 - DNA, 22 bp, Artificial Sequence
  chemically synthesized
tgtttaatttatattgtggata

SEQ ID NO: 1184839 - DNA, 22 bp, Artificial Sequence
  chemically synthesized
ctgtttaatttatattgtggat

SEQ ID NO: 1184840 - DNA, 22 bp, Artificial Sequence
  chemically synthesized
tctgtttaatttatattgtgga

SEQ ID NO: 1184841 - DNA, 22 bp, Artificial Sequence
  chemically synthesized
ttctgtttaatttatattgtgg

SEQ ID NO: 1184842 - DNA, 22 bp, Artificial Sequence
  chemically synthesized
tatggtatttttctgtttaatt

SEQ ID NO: 1184843 - DNA, 22 bp, Artificial Sequence
  chemically synthesized
aacagaaaaataccatataatg

SEQ ID NO: 1184844 - DNA, 22 bp, Artificial Sequence
  chemically synthesized
acatacacggaatagtaaaaat

SEQ ID NO: 1184845 - DNA, 22 bp, Artificial Sequence
  chemically synthesized
aacatacacggaatagtaaaaa

SEQ ID NO: 1184846 - DNA, 22 bp, Artificial Sequence
  chemically synthesized
taacatacacggaatagtaaaa

SEQ ID NO: 1184847 - DNA, 22 bp, Artificial Sequence
  chemically synthesized
ttaacatacacggaatagtaaa

SEQ ID NO: 1184848 - DNA, 22 bp, Artificial Sequence
  chemically synthesized
ttactattccgtgtatgttaaa

SEQ ID NO: 1184849 - DNA, 22 bp, Artificial Sequence
  chemically synthesized
tactattccgtgtatgttaaaa

SEQ ID NO: 1184850 - DNA, 22 bp, Artificial Sequence
  chemically synthesized
actattccgtgtatgttaaaaa

SEQ ID NO: 1184851 - DNA, 22 bp, Artificial Sequence
  chemically synthesized
ctattccgtgtatgttaaaaat

SEQ ID NO: 1184852 - DNA, 22 bp, Artificial Sequence
  chemically synthesized
ttccgtgtatgttaaaaatatt

SEQ ID NO: 1184853 - DNA, 22 bp, Artificial Sequence
  chemically synthesized
cgtgtatgttaaaaatatttgt

SEQ ID NO: 1184854 - DNA, 22 bp, Artificial Sequence
  chemically synthesized
tcccatgcaccacaatgtaaac

SEQ ID NO: 1184855 - DNA, 22 bp, Artificial Sequence
  chemically synthesized
atcccatgcaccacaatgtaaa

SEQ ID NO: 1184856 - DNA, 22 bp, Artificial Sequence
  chemically synthesized
tatcccatgcaccacaatgtaa

SEQ ID NO: 1184857 - DNA, 22 bp, Artificial Sequence
  chemically synthesized
aaaatatttgtttacattgtgg

SEQ ID NO: 1184858 - DNA, 22 bp, Artificial Sequence
  chemically synthesized
ctttatcccatgcaccacaatg

SEQ ID NO: 1184859 - DNA, 22 bp, Artificial Sequence
  chemically synthesized
tactttatcccatgcaccacaa

SEQ ID NO: 1184860 - DNA, 22 bp, Artificial Sequence
  chemically synthesized
gtttacattgtggtgcatggga

SEQ ID NO: 1184861 - DNA, 22 bp, Artificial Sequence
  chemically synthesized
tttacattgtggtgcatgggat

SEQ ID NO: 1184862 - DNA, 22 bp, Artificial Sequence
  chemically synthesized
acattgtggtgcatgggataaa

SEQ ID NO: 1184863 - DNA, 22 bp, Artificial Sequence
  chemically synthesized
cattgtggtgcatgggataaag

SEQ ID NO: 1184864 - DNA, 22 bp, Artificial Sequence
  chemically synthesized
tggtgcatgggataaagtagaa

SEQ ID NO: 1184865 - DNA, 22 bp, Artificial Sequence
  chemically synthesized
agaaggaaagtgatattctact

SEQ ID NO: 1184866 - DNA, 22 bp, Artificial Sequence
  chemically synthesized
atgtctgagaaggaaagtgata

SEQ ID NO: 1184867 - DNA, 22 bp, Artificial Sequence
  chemically synthesized
taatgtctgagaaggaaagtga

SEQ ID NO: 1184868 - DNA, 22 bp, Artificial Sequence
  chemically synthesized
tctctaatgtctgagaaggaaa

SEQ ID NO: 1184869 - DNA, 22 bp, Artificial Sequence
  chemically synthesized
gtctctaatgtctgagaaggaa

SEQ ID NO: 1184870 - DNA, 22 bp, Artificial Sequence
  chemically synthesized
catttgtctctaatgtctgaga

SEQ ID NO: 1184871 - DNA, 22 bp, Artificial Sequence
  chemically synthesized
acatttgtctctaatgtctgag

SEQ ID NO: 1184872 - DNA, 22 bp, Artificial Sequence
  chemically synthesized
tacatttgtctctaatgtctga

SEQ ID NO: 1184873 - DNA, 22 bp, Artificial Sequence
  chemically synthesized
ttacatttgtctctaatgtctg

SEQ ID NO: 1184874 - DNA, 22 bp, Artificial Sequence
  chemically synthesized
tccttctcagacattagagaca

SEQ ID NO: 1184875 - DNA, 22 bp, Artificial Sequence
  chemically synthesized
ccttctcagacattagagacaa

SEQ ID NO: 1184876 - DNA, 22 bp, Artificial Sequence
  chemically synthesized
cttctcagacattagagacaaa

SEQ ID NO: 1184877 - DNA, 22 bp, Artificial Sequence
  chemically synthesized
ctcagacattagagacaaatgt

SEQ ID NO: 1184878 - DNA, 22 bp, Artificial Sequence
  chemically synthesized
tcagacattagagacaaatgta

SEQ ID NO: 1184879 - DNA, 22 bp, Artificial Sequence
  chemically synthesized
agacattagagacaaatgtaaa

SEQ ID NO: 1184880 - DNA, 22 bp, Artificial Sequence
  chemically synthesized
atgtgcgggacttttacatttg

SEQ ID NO: 1184881 - DNA, 22 bp, Artificial Sequence
  chemically synthesized
aatgtgcgggacttttacattt

SEQ ID NO: 1184882 - DNA, 22 bp, Artificial Sequence
  chemically synthesized
gagacaaatgtaaaagtcccgc

SEQ ID NO: 1184883 - DNA, 22 bp, Artificial Sequence
  chemically synthesized
gatgtggcaaaggatatgaagt

SEQ ID NO: 1184884 - DNA, 22 bp, Artificial Sequence
  chemically synthesized
agttgatctgacttcatatcct

SEQ ID NO: 1184885 - DNA, 22 bp, Artificial Sequence
  chemically synthesized
tggatgtggcaaaggatatgaa

SEQ ID NO: 1184886 - DNA, 22 bp, Artificial Sequence
  chemically synthesized
ctggatgtggcaaaggatatga

SEQ ID NO: 1184887 - DNA, 22 bp, Artificial Sequence
  chemically synthesized
tctggatgtggcaaaggatatg

SEQ ID NO: 1184888 - DNA, 22 bp, Artificial Sequence
  chemically synthesized
atctgacttcatatcctttgcc

SEQ ID NO: 1184889 - DNA, 22 bp, Artificial Sequence
  chemically synthesized
actttctggatgtggcaaagga

SEQ ID NO: 1184890 - DNA, 22 bp, Artificial Sequence
  chemically synthesized
acttcatatcctttgccacatc

SEQ ID NO: 1184891 - DNA, 22 bp, Artificial Sequence
  chemically synthesized
attcactttctggatgtggcaa

SEQ ID NO: 1184892 - DNA, 22 bp, Artificial Sequence
  chemically synthesized
cattcactttctggatgtggca

SEQ ID NO: 1184893 - DNA, 22 bp, Artificial Sequence
  chemically synthesized
catatcctttgccacatccaga

SEQ ID NO: 1184894 - DNA, 22 bp, Artificial Sequence
  chemically synthesized
atatcctttgccacatccagaa

SEQ ID NO: 1184895 - DNA, 22 bp, Artificial Sequence
  chemically synthesized
cgtttcattcactttctggatg

SEQ ID NO: 1184896 - DNA, 22 bp, Artificial Sequence
  chemically synthesized
tgccacatccagaaagtgaatg

SEQ ID NO: 1184897 - DNA, 22 bp, Artificial Sequence
  chemically synthesized
aatgctgcgtttcattcacttt

SEQ ID NO: 1184898 - DNA, 22 bp, Artificial Sequence
  chemically synthesized
gccacatccagaaagtgaatga

SEQ ID NO: 1184899 - DNA, 22 bp, Artificial Sequence
  chemically synthesized
aaatgctgcgtttcattcactt

SEQ ID NO: 1184900 - DNA, 22 bp, Artificial Sequence
  chemically synthesized
ccacatccagaaagtgaatgaa

SEQ ID NO: 1184901 - DNA, 22 bp, Artificial Sequence
  chemically synthesized
taaatgctgcgtttcattcact

SEQ ID NO: 1184902 - DNA, 22 bp, Artificial Sequence
  chemically synthesized
actttaaatgctgcgtttcatt

SEQ ID NO: 1184903 - DNA, 22 bp, Artificial Sequence
  chemically synthesized
ttgactttaaatgctgcgtttc

SEQ ID NO: 1184904 - DNA, 22 bp, Artificial Sequence
  chemically synthesized
caaagtattattgactttaaat

SEQ ID NO: 1184905 - DNA, 22 bp, Artificial Sequence
  chemically synthesized
ttacaaagtattattgacttta

SEQ ID NO: 1184906 - DNA, 22 bp, Artificial Sequence
  chemically synthesized
tatgtgttattacaaagtatta

SEQ ID NO: 1184907 - DNA, 22 bp, Artificial Sequence
  chemically synthesized
atatgtgttattacaaagtatt

SEQ ID NO: 1184908 - DNA, 22 bp, Artificial Sequence
  chemically synthesized
tatatgtgttattacaaagtat

SEQ ID NO: 1184909 - DNA, 22 bp, Artificial Sequence
  chemically synthesized
aaagtcaataatactttgtaat

SEQ ID NO: 1184910 - DNA, 22 bp, Artificial Sequence
  chemically synthesized
aagtcaataatactttgtaata

SEQ ID NO: 1184911 - DNA, 22 bp, Artificial Sequence
  chemically synthesized
ccactttatatgtgttattaca

SEQ ID NO: 1184912 - DNA, 22 bp, Artificial Sequence
  chemically synthesized
aaggagctgccactttatatgt

SEQ ID NO: 1184913 - DNA, 22 bp, Artificial Sequence
  chemically synthesized
gaaggagctgccactttatatg

SEQ ID NO: 1184914 - DNA, 22 bp, Artificial Sequence
  chemically synthesized
tgaaggagctgccactttatat

SEQ ID NO: 1184915 - DNA, 22 bp, Artificial Sequence
  chemically synthesized
tgtaataacacatataaagtgg

SEQ ID NO: 1184916 - DNA, 22 bp, Artificial Sequence
  chemically synthesized
ttgaaggagctgccactttata

SEQ ID NO: 1184917 - DNA, 22 bp, Artificial Sequence
  chemically synthesized
gtaataacacatataaagtggc

SEQ ID NO: 1184918 - DNA, 22 bp, Artificial Sequence
  chemically synthesized
taataacacatataaagtggca

SEQ ID NO: 1184919 - DNA, 22 bp, Artificial Sequence
  chemically synthesized
atgccaagtagcaaatgaatct

SEQ ID NO: 1184920 - DNA, 22 bp, Artificial Sequence
  chemically synthesized
aatgccaagtagcaaatgaatc

SEQ ID NO: 1184921 - DNA, 22 bp, Artificial Sequence
  chemically synthesized
taatgccaagtagcaaatgaat

SEQ ID NO: 1184922 - DNA, 22 bp, Artificial Sequence
  chemically synthesized
cttcaaaagattcatttgctac

SEQ ID NO: 1184923 - DNA, 22 bp, Artificial Sequence
  chemically synthesized
caaaagattcatttgctacttg

SEQ ID NO: 1184924 - DNA, 22 bp, Artificial Sequence
  chemically synthesized
aaaagattcatttgctacttgg

SEQ ID NO: 1184925 - DNA, 22 bp, Artificial Sequence
  chemically synthesized
atttgctacttggcattaaaat

SEQ ID NO: 1184926 - DNA, 22 bp, Artificial Sequence
  chemically synthesized
gctacttggcattaaaatttac

SEQ ID NO: 1184927 - DNA, 22 bp, Artificial Sequence
  chemically synthesized
ctacttggcattaaaatttact

SEQ ID NO: 1184928 - DNA, 22 bp, Artificial Sequence
  chemically synthesized
gaatgagtgcagtaagtaaatt

SEQ ID NO: 1184929 - DNA, 22 bp, Artificial Sequence
  chemically synthesized
cttggcattaaaatttacttac

SEQ ID NO: 1184930 - DNA, 22 bp, Artificial Sequence
  chemically synthesized
ggcattaaaatttacttactgc

SEQ ID NO: 1184931 - DNA, 22 bp, Artificial Sequence
  chemically synthesized
actggaatgagtgcagtaagta

SEQ ID NO: 1184932 - DNA, 22 bp, Artificial Sequence
  chemically synthesized
gcattaaaatttacttactgca

SEQ ID NO: 1184933 - DNA, 22 bp, Artificial Sequence
  chemically synthesized
gttcactggaatgagtgcagta

SEQ ID NO: 1184934 - DNA, 22 bp, Artificial Sequence
  chemically synthesized
ggttcactggaatgagtgcagt

SEQ ID NO: 1184935 - DNA, 22 bp, Artificial Sequence
  chemically synthesized
aaatttacttactgcactcatt

SEQ ID NO: 1184936 - DNA, 22 bp, Artificial Sequence
  chemically synthesized
catcttggttcactggaatgag

SEQ ID NO: 1184937 - DNA, 22 bp, Artificial Sequence
  chemically synthesized
acatcttggttcactggaatga

SEQ ID NO: 1184938 - DNA, 22 bp, Artificial Sequence
  chemically synthesized
acttactgcactcattccagtg

SEQ ID NO: 1184939 - DNA, 22 bp, Artificial Sequence
  chemically synthesized
tacatcttggttcactggaatg

SEQ ID NO: 1184940 - DNA, 22 bp, Artificial Sequence
  chemically synthesized
cttactgcactcattccagtga

SEQ ID NO: 1184941 - DNA, 22 bp, Artificial Sequence
  chemically synthesized
ctttacatcttggttcactgga

SEQ ID NO: 1184942 - DNA, 22 bp, Artificial Sequence
  chemically synthesized
actgcactcattccagtgaacc

SEQ ID NO: 1184943 - DNA, 22 bp, Artificial Sequence
  chemically synthesized
ctgcactcattccagtgaacca

SEQ ID NO: 1184944 - DNA, 22 bp, Artificial Sequence
  chemically synthesized
cactcattccagtgaaccaaga

SEQ ID NO: 1184945 - DNA, 22 bp, Artificial Sequence
  chemically synthesized
attccagtgaaccaagatgtaa

SEQ ID NO: 1184946 - DNA, 22 bp, Artificial Sequence
  chemically synthesized
acataaaggattactttacatc

SEQ ID NO: 1184947 - DNA, 22 bp, Artificial Sequence
  chemically synthesized
cagtgaaccaagatgtaaagta

SEQ ID NO: 1184948 - DNA, 22 bp, Artificial Sequence
  chemically synthesized
cacataaaggattactttacat

SEQ ID NO: 1184949 - DNA, 22 bp, Artificial Sequence
  chemically synthesized
atgacatacttcacataaagga

SEQ ID NO: 1184950 - DNA, 22 bp, Artificial Sequence
  chemically synthesized
gtactaatgacatacttcacat

SEQ ID NO: 1184951 - DNA, 22 bp, Artificial Sequence
  chemically synthesized
tagtactaatgacatacttcac

SEQ ID NO: 1184952 - DNA, 22 bp, Artificial Sequence
  chemically synthesized
ctagtactaatgacatacttca

SEQ ID NO: 1184953 - DNA, 22 bp, Artificial Sequence
  chemically synthesized
acatttctagtactaatgacat

SEQ ID NO: 1184954 - DNA, 22 bp, Artificial Sequence
  chemically synthesized
tatgtgaagtatgtcattagta

SEQ ID NO: 1184955 - DNA, 22 bp, Artificial Sequence
  chemically synthesized
atgtgaagtatgtcattagtac

SEQ ID NO: 1184956 - DNA, 22 bp, Artificial Sequence
  chemically synthesized
tgtgaagtatgtcattagtact

SEQ ID NO: 1184957 - DNA, 22 bp, Artificial Sequence
  chemically synthesized
tgtgttaacatttctagtacta

SEQ ID NO: 1184958 - DNA, 22 bp, Artificial Sequence
  chemically synthesized
atgtgttaacatttctagtact

SEQ ID NO: 1184959 - DNA, 22 bp, Artificial Sequence
  chemically synthesized
gtactagaaatgttaacacata

SEQ ID NO: 1184960 - DNA, 22 bp, Artificial Sequence
  chemically synthesized
atagtcagaacttatgtgttaa

SEQ ID NO: 1184961 - DNA, 22 bp, Artificial Sequence
  chemically synthesized
catagtcagaacttatgtgtta

SEQ ID NO: 1184962 - DNA, 22 bp, Artificial Sequence
  chemically synthesized
gaaatgttaacacataagttct

SEQ ID NO: 1184963 - DNA, 22 bp, Artificial Sequence
  chemically synthesized
gcatttcatagtcagaacttat

SEQ ID NO: 1184964 - DNA, 22 bp, Artificial Sequence
  chemically synthesized
acacataagttctgactatgaa

SEQ ID NO: 1184965 - DNA, 22 bp, Artificial Sequence
  chemically synthesized
tgactatgaaatgctagcattt

SEQ ID NO: 1184966 - DNA, 22 bp, Artificial Sequence
  chemically synthesized
actatgaaatgctagcatttca

SEQ ID NO: 1184967 - DNA, 22 bp, Artificial Sequence
  chemically synthesized
tgaaatgctagcatttcattgt

SEQ ID NO: 1184968 - DNA, 22 bp, Artificial Sequence
  chemically synthesized
aaggatgaaaaaggatgacaat

SEQ ID NO: 1184969 - DNA, 22 bp, Artificial Sequence
  chemically synthesized
aaaggatgaaaaaggatgacaa

SEQ ID NO: 1184970 - DNA, 22 bp, Artificial Sequence
  chemically synthesized
taaaggatgaaaaaggatgaca

SEQ ID NO: 1184971 - DNA, 22 bp, Artificial Sequence
  chemically synthesized
ttaaaggatgaaaaaggatgac

SEQ ID NO: 1184972 - DNA, 22 bp, Artificial Sequence
  chemically synthesized
tttaaaggatgaaaaaggatga

SEQ ID NO: 1184973 - DNA, 22 bp, Artificial Sequence
  chemically synthesized
gcatttcattgtcatccttttt

SEQ ID NO: 1184974 - DNA, 22 bp, Artificial Sequence
  chemically synthesized
tttttaaaggatgaaaaaggat

SEQ ID NO: 1184975 - DNA, 22 bp, Artificial Sequence
  chemically synthesized
ctttttaaaggatgaaaaagga

SEQ ID NO: 1184976 - DNA, 22 bp, Artificial Sequence
  chemically synthesized
cttctttttaaaggatgaaaaa

SEQ ID NO: 1184977 - DNA, 22 bp, Artificial Sequence
  chemically synthesized
cattgtcatcctttttcatcct

SEQ ID NO: 1184978 - DNA, 22 bp, Artificial Sequence
  chemically synthesized
ccttctttttaaaggatgaaaa

SEQ ID NO: 1184979 - DNA, 22 bp, Artificial Sequence
  chemically synthesized
attgtcatcctttttcatcctt

SEQ ID NO: 1184980 - DNA, 22 bp, Artificial Sequence
  chemically synthesized
tcatcctttttcatcctttaaa

SEQ ID NO: 1184981 - DNA, 22 bp, Artificial Sequence
  chemically synthesized
tttcatcctttaaaaagaagga

SEQ ID NO: 1184982 - DNA, 22 bp, Artificial Sequence
  chemically synthesized
aatgacaaaatttccttctttt

SEQ ID NO: 1184983 - DNA, 22 bp, Artificial Sequence
  chemically synthesized
ttcatcctttaaaaagaaggaa

SEQ ID NO: 1184984 - DNA, 22 bp, Artificial Sequence
  chemically synthesized
tcatcctttaaaaagaaggaaa

SEQ ID NO: 1184985 - DNA, 22 bp, Artificial Sequence
  chemically synthesized
catcctttaaaaagaaggaaat

SEQ ID NO: 1184986 - DNA, 22 bp, Artificial Sequence
  chemically synthesized
atcctttaaaaagaaggaaatt

SEQ ID NO: 1184987 - DNA, 22 bp, Artificial Sequence
  chemically synthesized
tctcaatgacaaaatttccttc

SEQ ID NO: 1184988 - DNA, 22 bp, Artificial Sequence
  chemically synthesized
taaaaagaaggaaattttgtca

SEQ ID NO: 1184989 - DNA, 22 bp, Artificial Sequence
  chemically synthesized
aaaaagaaggaaattttgtcat

SEQ ID NO: 1184990 - DNA, 22 bp, Artificial Sequence
  chemically synthesized
aaaagaaggaaattttgtcatt

SEQ ID NO: 1184991 - DNA, 22 bp, Artificial Sequence
  chemically synthesized
cacatgctgtctcaatgacaaa

SEQ ID NO: 1184992 - DNA, 22 bp, Artificial Sequence
  chemically synthesized
acacatgctgtctcaatgacaa

SEQ ID NO: 1184993 - DNA, 22 bp, Artificial Sequence
  chemically synthesized
cagatttacacatgctgtctca

SEQ ID NO: 1184994 - DNA, 22 bp, Artificial Sequence
  chemically synthesized
tgtcattgagacagcatgtgta

SEQ ID NO: 1184995 - DNA, 22 bp, Artificial Sequence
  chemically synthesized
gtcattgagacagcatgtgtaa

SEQ ID NO: 1184996 - DNA, 22 bp, Artificial Sequence
  chemically synthesized
tcattgagacagcatgtgtaaa

SEQ ID NO: 1184997 - DNA, 22 bp, Artificial Sequence
  chemically synthesized
atatcctccagatttacacatg

SEQ ID NO: 1184998 - DNA, 22 bp, Artificial Sequence
  chemically synthesized
aatatcctccagatttacacat

SEQ ID NO: 1184999 - DNA, 22 bp, Artificial Sequence
  chemically synthesized
acttaatatcctccagatttac

SEQ ID NO: 1185000 - DNA, 22 bp, Artificial Sequence
  chemically synthesized
agacagcatgtgtaaatctgga

SEQ ID NO: 1185001 - DNA, 22 bp, Artificial Sequence
  chemically synthesized
cacttaatatcctccagattta

SEQ ID NO: 1185002 - DNA, 22 bp, Artificial Sequence
  chemically synthesized
tttcacttaatatcctccagat

SEQ ID NO: 1185003 - DNA, 22 bp, Artificial Sequence
  chemically synthesized
atttcacttaatatcctccaga

SEQ ID NO: 1185004 - DNA, 22 bp, Artificial Sequence
  chemically synthesized
gcttatttcacttaatatcctc

SEQ ID NO: 1185005 - DNA, 22 bp, Artificial Sequence
  chemically synthesized
tgcctggcttatttcacttaat

SEQ ID NO: 1185006 - DNA, 22 bp, Artificial Sequence
  chemically synthesized
tgtgcctggcttatttcactta

SEQ ID NO: 1185007 - DNA, 22 bp, Artificial Sequence
  chemically synthesized
ctgtgcctggcttatttcactt

SEQ ID NO: 1185008 - DNA, 22 bp, Artificial Sequence
  chemically synthesized
tctgtgcctggcttatttcact

SEQ ID NO: 1185009 - DNA, 22 bp, Artificial Sequence
  chemically synthesized
gaggatattaagtgaaataagc

SEQ ID NO: 1185010 - DNA, 22 bp, Artificial Sequence
  chemically synthesized
tctttctgtgcctggcttattt

SEQ ID NO: 1185011 - DNA, 22 bp, Artificial Sequence
  chemically synthesized
atctttctgtgcctggcttatt

SEQ ID NO: 1185012 - DNA, 22 bp, Artificial Sequence
  chemically synthesized
agtgaaataagccaggcacaga

SEQ ID NO: 1185013 - DNA, 22 bp, Artificial Sequence
  chemically synthesized
gtgagatcatgtggtacttatc

SEQ ID NO: 1185014 - DNA, 22 bp, Artificial Sequence
  chemically synthesized
catgtgttagtgagatcatgtg

SEQ ID NO: 1185015 - DNA, 22 bp, Artificial Sequence
  chemically synthesized
gattccatgtgttagtgagatc

SEQ ID NO: 1185016 - DNA, 22 bp, Artificial Sequence
  chemically synthesized
agattccatgtgttagtgagat

SEQ ID NO: 1185017 - DNA, 22 bp, Artificial Sequence
  chemically synthesized
tagattccatgtgttagtgaga

SEQ ID NO: 1185018 - DNA, 22 bp, Artificial Sequence
  chemically synthesized
ttagattccatgtgttagtgag

SEQ ID NO: 1185019 - DNA, 22 bp, Artificial Sequence
  chemically synthesized
tttagattccatgtgttagtga

SEQ ID NO: 1185020 - DNA, 22 bp, Artificial Sequence
  chemically synthesized
aactttttagattccatgtgtt

SEQ ID NO: 1185021 - DNA, 22 bp, Artificial Sequence
  chemically synthesized
tgaattcaactttttagattcc

SEQ ID NO: 1185022 - DNA, 22 bp, Artificial Sequence
  chemically synthesized
actaacacatggaatctaaaaa

SEQ ID NO: 1185023 - DNA, 22 bp, Artificial Sequence
  chemically synthesized
tatgaattcaactttttagatt

SEQ ID NO: 1185024 - DNA, 22 bp, Artificial Sequence
  chemically synthesized
ctatgaattcaactttttagat

SEQ ID NO: 1185025 - DNA, 22 bp, Artificial Sequence
  chemically synthesized
acacatggaatctaaaaagttg

SEQ ID NO: 1185026 - DNA, 22 bp, Artificial Sequence
  chemically synthesized
cttctatgaattcaacttttta

SEQ ID NO: 1185027 - DNA, 22 bp, Artificial Sequence
  chemically synthesized
tacttctatgaattcaactttt

SEQ ID NO: 1185028 - DNA, 22 bp, Artificial Sequence
  chemically synthesized
tctacttctatgaattcaactt

SEQ ID NO: 1185029 - DNA, 22 bp, Artificial Sequence
  chemically synthesized
ctctctacttctatgaattcaa

SEQ ID NO: 1185030 - DNA, 22 bp, Artificial Sequence
  chemically synthesized
tactctctacttctatgaattc

SEQ ID NO: 1185031 - DNA, 22 bp, Artificial Sequence
  chemically synthesized
aaaagttgaattcatagaagta

SEQ ID NO: 1185032 - DNA, 22 bp, Artificial Sequence
  chemically synthesized
aattcatagaagtagagagtag

SEQ ID NO: 1185033 - DNA, 22 bp, Artificial Sequence
  chemically synthesized
gtaaacaccattctactctcta

SEQ ID NO: 1185034 - DNA, 22 bp, Artificial Sequence
  chemically synthesized
atagaagtagagagtagaatgg

SEQ ID NO: 1185035 - DNA, 22 bp, Artificial Sequence
  chemically synthesized
ccccacagcccctggtaaacac

SEQ ID NO: 1185036 - DNA, 22 bp, Artificial Sequence
  chemically synthesized
ccaacccctgccccacagcccc

SEQ ID NO: 1185037 - DNA, 22 bp, Artificial Sequence
  chemically synthesized
cccaacccctgccccacagccc

SEQ ID NO: 1185038 - DNA, 22 bp, Artificial Sequence
  chemically synthesized
accaggggctgtggggcagggg

SEQ ID NO: 1185039 - DNA, 22 bp, Artificial Sequence
  chemically synthesized
ccaggggctgtggggcaggggt

SEQ ID NO: 1185040 - DNA, 22 bp, Artificial Sequence
  chemically synthesized
accaacatcttcccaacccctg

SEQ ID NO: 1185041 - DNA, 22 bp, Artificial Sequence
  chemically synthesized
gaccaacatcttcccaacccct

SEQ ID NO: 1185042 - DNA, 22 bp, Artificial Sequence
  chemically synthesized
tgaccaacatcttcccaacccc

SEQ ID NO: 1185043 - DNA, 22 bp, Artificial Sequence
  chemically synthesized
tggggcaggggttgggaagatg

SEQ ID NO: 1185044 - DNA, 22 bp, Artificial Sequence
  chemically synthesized
tgtcctttgaccaacatcttcc

SEQ ID NO: 1185045 - DNA, 22 bp, Artificial Sequence
  chemically synthesized
gtgtcctttgaccaacatcttc

SEQ ID NO: 1185046 - DNA, 22 bp, Artificial Sequence
  chemically synthesized
tgtgtcctttgaccaacatctt

SEQ ID NO: 1185047 - DNA, 22 bp, Artificial Sequence
  chemically synthesized
aaattttgtgtcctttgaccaa

SEQ ID NO: 1185048 - DNA, 22 bp, Artificial Sequence
  chemically synthesized
ggaagatgttggtcaaaggaca

SEQ ID NO: 1185049 - DNA, 22 bp, Artificial Sequence
  chemically synthesized
actgaaattttgtgtcctttga

SEQ ID NO: 1185050 - DNA, 22 bp, Artificial Sequence
  chemically synthesized
tctaactgaaattttgtgtcct

SEQ ID NO: 1185051 - DNA, 22 bp, Artificial Sequence
  chemically synthesized
ctatctaactgaaattttgtgt

SEQ ID NO: 1185052 - DNA, 22 bp, Artificial Sequence
  chemically synthesized
cctatctaactgaaattttgtg

SEQ ID NO: 1185053 - DNA, 22 bp, Artificial Sequence
  chemically synthesized
tcctatctaactgaaattttgt

SEQ ID NO: 1185054 - DNA, 22 bp, Artificial Sequence
  chemically synthesized
ttcctatctaactgaaattttg

SEQ ID NO: 1185055 - DNA, 22 bp, Artificial Sequence
  chemically synthesized
gtcaaaggacacaaaatttcag

SEQ ID NO: 1185056 - DNA, 22 bp, Artificial Sequence
  chemically synthesized
tttttcctatctaactgaaatt

SEQ ID NO: 1185057 - DNA, 22 bp, Artificial Sequence
  chemically synthesized
atttttcctatctaactgaaat

SEQ ID NO: 1185058 - DNA, 22 bp, Artificial Sequence
  chemically synthesized
aacttatttttcctatctaact

SEQ ID NO: 1185059 - DNA, 22 bp, Artificial Sequence
  chemically synthesized
ctgaacttatttttcctatcta

SEQ ID NO: 1185060 - DNA, 22 bp, Artificial Sequence
  chemically synthesized
cagttagataggaaaaataagt

SEQ ID NO: 1185061 - DNA, 22 bp, Artificial Sequence
  chemically synthesized
agttagataggaaaaataagtt

SEQ ID NO: 1185062 - DNA, 22 bp, Artificial Sequence
  chemically synthesized
tacaatagatctcctgaactta

SEQ ID NO: 1185063 - DNA, 22 bp, Artificial Sequence
  chemically synthesized
gataggaaaaataagttcagga

SEQ ID NO: 1185064 - DNA, 22 bp, Artificial Sequence
  chemically synthesized
ggttgtacaatagatctcctga

SEQ ID NO: 1185065 - DNA, 22 bp, Artificial Sequence
  chemically synthesized
taaactaggttgtacaatagat

SEQ ID NO: 1185066 - DNA, 22 bp, Artificial Sequence
  chemically synthesized
ttataaactaggttgtacaata

SEQ ID NO: 1185067 - DNA, 22 bp, Artificial Sequence
  chemically synthesized
aggagatctattgtacaaccta

SEQ ID NO: 1185068 - DNA, 22 bp, Artificial Sequence
  chemically synthesized
ttgtacaacctagtttataaca

SEQ ID NO: 1185069 - DNA, 22 bp, Artificial Sequence
  chemically synthesized
ggaatacaatacattgttataa

SEQ ID NO: 1185070 - DNA, 22 bp, Artificial Sequence
  chemically synthesized
tacaacctagtttataacaatg

SEQ ID NO: 1185071 - DNA, 22 bp, Artificial Sequence
  chemically synthesized
aggaatacaatacattgttata

SEQ ID NO: 1185072 - DNA, 22 bp, Artificial Sequence
  chemically synthesized
taggaatacaatacattgttat

SEQ ID NO: 1185073 - DNA, 22 bp, Artificial Sequence
  chemically synthesized
ttaggaatacaatacattgtta

SEQ ID NO: 1185074 - DNA, 22 bp, Artificial Sequence
  chemically synthesized
gtttataacaatgtattgtatt

SEQ ID NO: 1185075 - DNA, 22 bp, Artificial Sequence
  chemically synthesized
gcagcaatttttaggaatacaa

SEQ ID NO: 1185076 - DNA, 22 bp, Artificial Sequence
  chemically synthesized
ataacaatgtattgtattccta

SEQ ID NO: 1185077 - DNA, 22 bp, Artificial Sequence
  chemically synthesized
taacaatgtattgtattcctaa

SEQ ID NO: 1185078 - DNA, 22 bp, Artificial Sequence
  chemically synthesized
tcgcagcaatttttaggaatac

SEQ ID NO: 1185079 - DNA, 22 bp, Artificial Sequence
  chemically synthesized
ctctcgcagcaatttttaggaa

SEQ ID NO: 1185080 - DNA, 22 bp, Artificial Sequence
  chemically synthesized
atatctactctcgcagcaattt

SEQ ID NO: 1185081 - DNA, 22 bp, Artificial Sequence
  chemically synthesized
aatatctactctcgcagcaatt

SEQ ID NO: 1185082 - DNA, 22 bp, Artificial Sequence
  chemically synthesized
tattcctaaaaattgctgcgag

SEQ ID NO: 1185083 - DNA, 22 bp, Artificial Sequence
  chemically synthesized
ctaaaaattgctgcgagagtag

SEQ ID NO: 1185084 - DNA, 22 bp, Artificial Sequence
  chemically synthesized
aaaattgctgcgagagtagata

SEQ ID NO: 1185085 - DNA, 22 bp, Artificial Sequence
  chemically synthesized
atggtgagtatacttaatatct

SEQ ID NO: 1185086 - DNA, 22 bp, Artificial Sequence
  chemically synthesized
catggtgagtatacttaatatc

SEQ ID NO: 1185087 - DNA, 22 bp, Artificial Sequence
  chemically synthesized
ctgcgagagtagatattaagta

SEQ ID NO: 1185088 - DNA, 22 bp, Artificial Sequence
  chemically synthesized
cgagagtagatattaagtatac

SEQ ID NO: 1185089 - DNA, 22 bp, Artificial Sequence
  chemically synthesized
gcatgtttcatggtgagtatac

SEQ ID NO: 1185090 - DNA, 22 bp, Artificial Sequence
  chemically synthesized
agcatgtttcatggtgagtata

SEQ ID NO: 1185091 - DNA, 22 bp, Artificial Sequence
  chemically synthesized
atatgcttagcatgtttcatgg

SEQ ID NO: 1185092 - DNA, 22 bp, Artificial Sequence
  chemically synthesized
catatgcttagcatgtttcatg

SEQ ID NO: 1185093 - DNA, 22 bp, Artificial Sequence
  chemically synthesized
agtatactcaccatgaaacatg

SEQ ID NO: 1185094 - DNA, 22 bp, Artificial Sequence
  chemically synthesized
cttcatatgcttagcatgtttc

SEQ ID NO: 1185095 - DNA, 22 bp, Artificial Sequence
  chemically synthesized
acttcatatgcttagcatgttt

SEQ ID NO: 1185096 - DNA, 22 bp, Artificial Sequence
  chemically synthesized
tacttcatatgcttagcatgtt

SEQ ID NO: 1185097 - DNA, 22 bp, Artificial Sequence
  chemically synthesized
accatgaaacatgctaagcata

SEQ ID NO: 1185098 - DNA, 22 bp, Artificial Sequence
  chemically synthesized
atacatgttttacttcatatgc

SEQ ID NO: 1185099 - DNA, 22 bp, Artificial Sequence
  chemically synthesized
attaatacatgttttacttcat

SEQ ID NO: 1185100 - DNA, 22 bp, Artificial Sequence
  chemically synthesized
aactaattaatacatgttttac

SEQ ID NO: 1185101 - DNA, 22 bp, Artificial Sequence
  chemically synthesized
agcatatgaagtaaaacatgta

SEQ ID NO: 1185102 - DNA, 22 bp, Artificial Sequence
  chemically synthesized
cattgaactaattaatacatgt

SEQ ID NO: 1185103 - DNA, 22 bp, Artificial Sequence
  chemically synthesized
gaatggctacattgaactaatt

SEQ ID NO: 1185104 - DNA, 22 bp, Artificial Sequence
  chemically synthesized
tggaatggctacattgaactaa

SEQ ID NO: 1185105 - DNA, 22 bp, Artificial Sequence
  chemically synthesized
attagttcaatgtagccattcc

SEQ ID NO: 1185106 - DNA, 22 bp, Artificial Sequence
  chemically synthesized
gttcaatgtagccattccagaa

SEQ ID NO: 1185107 - DNA, 22 bp, Artificial Sequence
  chemically synthesized
aaatatgtatacgttctggaat

SEQ ID NO: 1185108 - DNA, 22 bp, Artificial Sequence
  chemically synthesized
gaaatatgtatacgttctggaa

SEQ ID NO: 1185109 - DNA, 22 bp, Artificial Sequence
  chemically synthesized
tgaaatatgtatacgttctgga

SEQ ID NO: 1185110 - DNA, 22 bp, Artificial Sequence
  chemically synthesized
aatgtagccattccagaacgta

SEQ ID NO: 1185111 - DNA, 22 bp, Artificial Sequence
  chemically synthesized
cagaacgtatacatatttcaaa

SEQ ID NO: 1185112 - DNA, 22 bp, Artificial Sequence
  chemically synthesized
tcatgtacaacacgatgttttg

SEQ ID NO: 1185113 - DNA, 22 bp, Artificial Sequence
  chemically synthesized
atcatgtacaacacgatgtttt

SEQ ID NO: 1185114 - DNA, 22 bp, Artificial Sequence
  chemically synthesized
catacatttatcatgtacaaca

SEQ ID NO: 1185115 - DNA, 22 bp, Artificial Sequence
  chemically synthesized
caaaacatcgtgttgtacatga

SEQ ID NO: 1185116 - DNA, 22 bp, Artificial Sequence
  chemically synthesized
aaaacatcgtgttgtacatgat

SEQ ID NO: 1185117 - DNA, 22 bp, Artificial Sequence
  chemically synthesized
aaattgcatacatttatcatgt

SEQ ID NO: 1185118 - DNA, 22 bp, Artificial Sequence
  chemically synthesized
aaaaactaaaattgcatacatt

SEQ ID NO: 1185119 - DNA, 22 bp, Artificial Sequence
  chemically synthesized
tacatgataaatgtatgcaatt

SEQ ID NO: 1185120 - DNA, 22 bp, Artificial Sequence
  chemically synthesized
atgattaaaaaactaaaattgc

SEQ ID NO: 1185121 - DNA, 22 bp, Artificial Sequence
  chemically synthesized
attaatgattaaaaaactaaaa

SEQ ID NO: 1185122 - DNA, 22 bp, Artificial Sequence
  chemically synthesized
tattcattaatgattaaaaaac

SEQ ID NO: 1185123 - DNA, 22 bp, Artificial Sequence
  chemically synthesized
atattcattaatgattaaaaaa

SEQ ID NO: 1185124 - DNA, 22 bp, Artificial Sequence
  chemically synthesized
tatattcattaatgattaaaaa

SEQ ID NO: 1185125 - DNA, 22 bp, Artificial Sequence
  chemically synthesized
ttatattcattaatgattaaaa

SEQ ID NO: 1185126 - DNA, 22 bp, Artificial Sequence
  chemically synthesized
atttttatattcattaatgatt

SEQ ID NO: 1185127 - DNA, 22 bp, Artificial Sequence
  chemically synthesized
gatttttatattcattaatgat

SEQ ID NO: 1185128 - DNA, 22 bp, Artificial Sequence
  chemically synthesized
tgatttttatattcattaatga

SEQ ID NO: 1185129 - DNA, 22 bp, Artificial Sequence
  chemically synthesized
tagttttttaatcattaatgaa

SEQ ID NO: 1185130 - DNA, 22 bp, Artificial Sequence
  chemically synthesized
agttttttaatcattaatgaat

SEQ ID NO: 1185131 - DNA, 22 bp, Artificial Sequence
  chemically synthesized
gttttttaatcattaatgaata

SEQ ID NO: 1185132 - DNA, 22 bp, Artificial Sequence
  chemically synthesized
tctttgatttttatattcatta

SEQ ID NO: 1185133 - DNA, 22 bp, Artificial Sequence
  chemically synthesized
atctttgatttttatattcatt

SEQ ID NO: 1185134 - DNA, 22 bp, Artificial Sequence
  chemically synthesized
tatctttgatttttatattcat

SEQ ID NO: 1185135 - DNA, 22 bp, Artificial Sequence
  chemically synthesized
tttaatcattaatgaatataaa

SEQ ID NO: 1185136 - DNA, 22 bp, Artificial Sequence
  chemically synthesized
ttatctttgatttttatattca

SEQ ID NO: 1185137 - DNA, 22 bp, Artificial Sequence
  chemically synthesized
ttaatcattaatgaatataaaa

SEQ ID NO: 1185138 - DNA, 22 bp, Artificial Sequence
  chemically synthesized
taatcattaatgaatataaaaa

SEQ ID NO: 1185139 - DNA, 22 bp, Artificial Sequence
  chemically synthesized
aatcattaatgaatataaaaat

SEQ ID NO: 1185140 - DNA, 22 bp, Artificial Sequence
  chemically synthesized
atcattaatgaatataaaaatc

SEQ ID NO: 1185141 - DNA, 22 bp, Artificial Sequence
  chemically synthesized
tcttttatctttgatttttata

SEQ ID NO: 1185142 - DNA, 22 bp, Artificial Sequence
  chemically synthesized
atcttttatctttgatttttat

SEQ ID NO: 1185143 - DNA, 22 bp, Artificial Sequence
  chemically synthesized
tgtttatcttttatctttgatt

SEQ ID NO: 1185144 - DNA, 22 bp, Artificial Sequence
  chemically synthesized
atgaatataaaaatcaaagata

SEQ ID NO: 1185145 - DNA, 22 bp, Artificial Sequence
  chemically synthesized
atgtttatcttttatctttgat

SEQ ID NO: 1185146 - DNA, 22 bp, Artificial Sequence
  chemically synthesized
ccaggatttatgtttatctttt

SEQ ID NO: 1185147 - DNA, 22 bp, Artificial Sequence
  chemically synthesized
ctgccaggatttatgtttatct

SEQ ID NO: 1185148 - DNA, 22 bp, Artificial Sequence
  chemically synthesized
acctcctgccaggatttatgtt

SEQ ID NO: 1185149 - DNA, 22 bp, Artificial Sequence
  chemically synthesized
gacctcctgccaggatttatgt

SEQ ID NO: 1185150 - DNA, 22 bp, Artificial Sequence
  chemically synthesized
ccttgacctcctgccaggattt

SEQ ID NO: 1185151 - DNA, 22 bp, Artificial Sequence
  chemically synthesized
ccacattaccttgacctcctgc

SEQ ID NO: 1185152 - DNA, 22 bp, Artificial Sequence
  chemically synthesized
gcaggaggtcaaggtaatgtgg

SEQ ID NO: 1185153 - DNA, 22 bp, Artificial Sequence
  chemically synthesized
tatggcaaggaaaatacattgc

SEQ ID NO: 1185154 - DNA, 22 bp, Artificial Sequence
  chemically synthesized
agataaattgtatggcaaggaa

SEQ ID NO: 1185155 - DNA, 22 bp, Artificial Sequence
  chemically synthesized
agctaagataaattgtatggca

SEQ ID NO: 1185156 - DNA, 22 bp, Artificial Sequence
  chemically synthesized
tccttgccatacaatttatctt

SEQ ID NO: 1185157 - DNA, 22 bp, Artificial Sequence
  chemically synthesized
ccttgccatacaatttatctta

SEQ ID NO: 1185158 - DNA, 22 bp, Artificial Sequence
  chemically synthesized
cttgccatacaatttatcttag

SEQ ID NO: 1185159 - DNA, 22 bp, Artificial Sequence
  chemically synthesized
atagtagttaagctaagataaa

SEQ ID NO: 1185160 - DNA, 22 bp, Artificial Sequence
  chemically synthesized
aatagtagttaagctaagataa

SEQ ID NO: 1185161 - DNA, 22 bp, Artificial Sequence
  chemically synthesized
gccatacaatttatcttagctt

SEQ ID NO: 1185162 - DNA, 22 bp, Artificial Sequence
  chemically synthesized
ccatacaatttatcttagctta

SEQ ID NO: 1185163 - DNA, 22 bp, Artificial Sequence
  chemically synthesized
atcttagcttaactactattaa

SEQ ID NO: 1185164 - DNA, 22 bp, Artificial Sequence
  chemically synthesized
aatacagatatcttaatagtag

SEQ ID NO: 1185165 - DNA, 22 bp, Artificial Sequence
  chemically synthesized
tcttagcttaactactattaag

SEQ ID NO: 1185166 - DNA, 22 bp, Artificial Sequence
  chemically synthesized
agcttaactactattaagatat

SEQ ID NO: 1185167 - DNA, 22 bp, Artificial Sequence
  chemically synthesized
gcttaactactattaagatatc

SEQ ID NO: 1185168 - DNA, 22 bp, Artificial Sequence
  chemically synthesized
aactactattaagatatctgta

SEQ ID NO: 1185169 - DNA, 22 bp, Artificial Sequence
  chemically synthesized
actactattaagatatctgtat

SEQ ID NO: 1185170 - DNA, 22 bp, Artificial Sequence
  chemically synthesized
ctattaagatatctgtattcag

SEQ ID NO: 1185171 - DNA, 22 bp, Artificial Sequence
  chemically synthesized
ttaagatatctgtattcagtat

SEQ ID NO: 1185172 - DNA, 22 bp, Artificial Sequence
  chemically synthesized
atcagaatatacatactgaata

SEQ ID NO: 1185173 - DNA, 22 bp, Artificial Sequence
  chemically synthesized
agatatctgtattcagtatgta

SEQ ID NO: 1185174 - DNA, 22 bp, Artificial Sequence
  chemically synthesized
tattcagtatgtatattctgat

SEQ ID NO: 1185175 - DNA, 22 bp, Artificial Sequence
  chemically synthesized
taatcagaacacctgatcagaa

SEQ ID NO: 1185176 - DNA, 22 bp, Artificial Sequence
  chemically synthesized
ataatcagaacacctgatcaga

SEQ ID NO: 1185177 - DNA, 22 bp, Artificial Sequence
  chemically synthesized
agtatgtatattctgatcaggt

SEQ ID NO: 1185178 - DNA, 22 bp, Artificial Sequence
  chemically synthesized
acttataatcagaacacctgat

SEQ ID NO: 1185179 - DNA, 22 bp, Artificial Sequence
  chemically synthesized
cacttataatcagaacacctga

SEQ ID NO: 1185180 - DNA, 22 bp, Artificial Sequence
  chemically synthesized
tcacttataatcagaacacctg

SEQ ID NO: 1185181 - DNA, 22 bp, Artificial Sequence
  chemically synthesized
ttcacttataatcagaacacct

SEQ ID NO: 1185182 - DNA, 22 bp, Artificial Sequence
  chemically synthesized
tttcacttataatcagaacacc

SEQ ID NO: 1185183 - DNA, 22 bp, Artificial Sequence
  chemically synthesized
gctttttcacttataatcagaa

SEQ ID NO: 1185184 - DNA, 22 bp, Artificial Sequence
  chemically synthesized
ggctttttcacttataatcaga

SEQ ID NO: 1185185 - DNA, 22 bp, Artificial Sequence
  chemically synthesized
tgatcaggtgttctgattataa

SEQ ID NO: 1185186 - DNA, 22 bp, Artificial Sequence
  chemically synthesized
ttggctttttcacttataatca

SEQ ID NO: 1185187 - DNA, 22 bp, Artificial Sequence
  chemically synthesized
atcaggtgttctgattataagt

SEQ ID NO: 1185188 - DNA, 22 bp, Artificial Sequence
  chemically synthesized
ctcttggctttttcacttataa

SEQ ID NO: 1185189 - DNA, 22 bp, Artificial Sequence
  chemically synthesized
actcttggctttttcacttata

SEQ ID NO: 1185190 - DNA, 22 bp, Artificial Sequence
  chemically synthesized
tactcttggctttttcacttat

SEQ ID NO: 1185191 - DNA, 22 bp, Artificial Sequence
  chemically synthesized
agactttactcttggctttttc

SEQ ID NO: 1185192 - DNA, 22 bp, Artificial Sequence
  chemically synthesized
tgattataagtgaaaaagccaa

SEQ ID NO: 1185193 - DNA, 22 bp, Artificial Sequence
  chemically synthesized
gagactttactcttggcttttt

SEQ ID NO: 1185194 - DNA, 22 bp, Artificial Sequence
  chemically synthesized
attataagtgaaaaagccaaga

SEQ ID NO: 1185195 - DNA, 22 bp, Artificial Sequence
  chemically synthesized
taagtgaaaaagccaagagtaa

SEQ ID NO: 1185196 - DNA, 22 bp, Artificial Sequence
  chemically synthesized
acggacttgagactttactctt

SEQ ID NO: 1185197 - DNA, 22 bp, Artificial Sequence
  chemically synthesized
tgctaacggacttgagacttta

SEQ ID NO: 1185198 - DNA, 22 bp, Artificial Sequence
  chemically synthesized
gtgctaacggacttgagacttt

SEQ ID NO: 1185199 - DNA, 22 bp, Artificial Sequence
  chemically synthesized
tgtgctaacggacttgagactt

SEQ ID NO: 1185200 - DNA, 22 bp, Artificial Sequence
  chemically synthesized
ttgtgctaacggacttgagact

SEQ ID NO: 1185201 - DNA, 22 bp, Artificial Sequence
  chemically synthesized
cttttgtgctaacggacttgag

SEQ ID NO: 1185202 - DNA, 22 bp, Artificial Sequence
  chemically synthesized
aacctgcttttgtgctaacgga

SEQ ID NO: 1185203 - DNA, 22 bp, Artificial Sequence
  chemically synthesized
ttcaacctgcttttgtgctaac

SEQ ID NO: 1185204 - DNA, 22 bp, Artificial Sequence
  chemically synthesized
gttcaacctgcttttgtgctaa

SEQ ID NO: 1185205 - DNA, 22 bp, Artificial Sequence
  chemically synthesized
aagtccgttagcacaaaagcag

SEQ ID NO: 1185206 - DNA, 22 bp, Artificial Sequence
  chemically synthesized
atgaagtcacttgttcaacctg

SEQ ID NO: 1185207 - DNA, 22 bp, Artificial Sequence
  chemically synthesized
gcacaaaagcaggttgaacaag

SEQ ID NO: 1185208 - DNA, 22 bp, Artificial Sequence
  chemically synthesized
caaaagaattgatgaagtcact

SEQ ID NO: 1185209 - DNA, 22 bp, Artificial Sequence
  chemically synthesized
gcaaaagaattgatgaagtcac

SEQ ID NO: 1185210 - DNA, 22 bp, Artificial Sequence
  chemically synthesized
atacttgcaaaagaattgatga

SEQ ID NO: 1185211 - DNA, 22 bp, Artificial Sequence
  chemically synthesized
aacaagtgacttcatcaattct

SEQ ID NO: 1185212 - DNA, 22 bp, Artificial Sequence
  chemically synthesized
tgatacttgcaaaagaattgat

SEQ ID NO: 1185213 - DNA, 22 bp, Artificial Sequence
  chemically synthesized
atcatggttctgatacttgcaa

SEQ ID NO: 1185214 - DNA, 22 bp, Artificial Sequence
  chemically synthesized
catcaattcttttgcaagtatc

SEQ ID NO: 1185215 - DNA, 22 bp, Artificial Sequence
  chemically synthesized
atcaattcttttgcaagtatca

SEQ ID NO: 1185216 - DNA, 22 bp, Artificial Sequence
  chemically synthesized
attaatcatggttctgatactt

SEQ ID NO: 1185217 - DNA, 22 bp, Artificial Sequence
  chemically synthesized
tgattaatcatggttctgatac

SEQ ID NO: 1185218 - DNA, 22 bp, Artificial Sequence
  chemically synthesized
ttctgattaatcatggttctga

SEQ ID NO: 1185219 - DNA, 22 bp, Artificial Sequence
  chemically synthesized
ttttgcaagtatcagaaccatg

SEQ ID NO: 1185220 - DNA, 22 bp, Artificial Sequence
  chemically synthesized
ttgcaagtatcagaaccatgat

SEQ ID NO: 1185221 - DNA, 22 bp, Artificial Sequence
  chemically synthesized
tgcaagtatcagaaccatgatt

SEQ ID NO: 1185222 - DNA, 22 bp, Artificial Sequence
  chemically synthesized
gcaagtatcagaaccatgatta

SEQ ID NO: 1185223 - DNA, 22 bp, Artificial Sequence
  chemically synthesized
caagtatcagaaccatgattaa

SEQ ID NO: 1185224 - DNA, 22 bp, Artificial Sequence
  chemically synthesized
aaaatagctgttctgattaatc

SEQ ID NO: 1185225 - DNA, 22 bp, Artificial Sequence
  chemically synthesized
aaaaatagctgttctgattaat

SEQ ID NO: 1185226 - DNA, 22 bp, Artificial Sequence
  chemically synthesized
taaaaatagctgttctgattaa

SEQ ID NO: 1185227 - DNA, 22 bp, Artificial Sequence
  chemically synthesized
aaaatactttaaaaatagctgt

SEQ ID NO: 1185228 - DNA, 22 bp, Artificial Sequence
  chemically synthesized
aaaaatactttaaaaatagctg

SEQ ID NO: 1185229 - DNA, 22 bp, Artificial Sequence
  chemically synthesized
taaaaatactttaaaaatagct

SEQ ID NO: 1185230 - DNA, 22 bp, Artificial Sequence
  chemically synthesized
ttaaaaatactttaaaaatagc

SEQ ID NO: 1185231 - DNA, 22 bp, Artificial Sequence
  chemically synthesized
tttaaaaatactttaaaaatag

SEQ ID NO: 1185232 - DNA, 22 bp, Artificial Sequence
  chemically synthesized
atcagaacagctatttttaaag

SEQ ID NO: 1185233 - DNA, 22 bp, Artificial Sequence
  chemically synthesized
tttttaaaaatactttaaaaat

SEQ ID NO: 1185234 - DNA, 22 bp, Artificial Sequence
  chemically synthesized
taactctttttaaaaatacttt

SEQ ID NO: 1185235 - DNA, 22 bp, Artificial Sequence
  chemically synthesized
gtaactctttttaaaaatactt

SEQ ID NO: 1185236 - DNA, 22 bp, Artificial Sequence
  chemically synthesized
ttgtaactctttttaaaaatac

SEQ ID NO: 1185237 - DNA, 22 bp, Artificial Sequence
  chemically synthesized
tttttaaagtatttttaaaaag

SEQ ID NO: 1185238 - DNA, 22 bp, Artificial Sequence
  chemically synthesized
gtctcttgtaactctttttaaa

SEQ ID NO: 1185239 - DNA, 22 bp, Artificial Sequence
  chemically synthesized
cgtctcttgtaactctttttaa

SEQ ID NO: 1185240 - DNA, 22 bp, Artificial Sequence
  chemically synthesized
ttaaagtatttttaaaaagagt

SEQ ID NO: 1185241 - DNA, 22 bp, Artificial Sequence
  chemically synthesized
tcgtctcttgtaactcttttta

SEQ ID NO: 1185242 - DNA, 22 bp, Artificial Sequence
  chemically synthesized
taaagtatttttaaaaagagtt

SEQ ID NO: 1185243 - DNA, 22 bp, Artificial Sequence
  chemically synthesized
ttcgtctcttgtaactcttttt

SEQ ID NO: 1185244 - DNA, 22 bp, Artificial Sequence
  chemically synthesized
aaagtatttttaaaaagagtta

SEQ ID NO: 1185245 - DNA, 22 bp, Artificial Sequence
  chemically synthesized
tttcgtctcttgtaactctttt

SEQ ID NO: 1185246 - DNA, 22 bp, Artificial Sequence
  chemically synthesized
aagtatttttaaaaagagttac

SEQ ID NO: 1185247 - DNA, 22 bp, Artificial Sequence
  chemically synthesized
attttttcgtctcttgtaactc

SEQ ID NO: 1185248 - DNA, 22 bp, Artificial Sequence
  chemically synthesized
ttaaaaagagttacaagagacg

SEQ ID NO: 1185249 - DNA, 22 bp, Artificial Sequence
  chemically synthesized
taaaaagagttacaagagacga

SEQ ID NO: 1185250 - DNA, 22 bp, Artificial Sequence
  chemically synthesized
aaaaagagttacaagagacgaa

SEQ ID NO: 1185251 - DNA, 22 bp, Artificial Sequence
  chemically synthesized
aaaagagttacaagagacgaaa

SEQ ID NO: 1185252 - DNA, 22 bp, Artificial Sequence
  chemically synthesized
caagagacgaaaaaattaatgt

SEQ ID NO: 1185253 - DNA, 22 bp, Artificial Sequence
  chemically synthesized
cggatagaagtagaccaaggaa

SEQ ID NO: 1185254 - DNA, 22 bp, Artificial Sequence
  chemically synthesized
tacggatagaagtagaccaagg

SEQ ID NO: 1185255 - DNA, 22 bp, Artificial Sequence
  chemically synthesized
ttctacggatagaagtagacca

SEQ ID NO: 1185256 - DNA, 22 bp, Artificial Sequence
  chemically synthesized
atgttccttggtctacttctat

SEQ ID NO: 1185257 - DNA, 22 bp, Artificial Sequence
  chemically synthesized
tattgttctacggatagaagta

SEQ ID NO: 1185258 - DNA, 22 bp, Artificial Sequence
  chemically synthesized
cttggtctacttctatccgtag

SEQ ID NO: 1185259 - DNA, 22 bp, Artificial Sequence
  chemically synthesized
ggtctacttctatccgtagaac

SEQ ID NO: 1185260 - DNA, 22 bp, Artificial Sequence
  chemically synthesized
gtctacttctatccgtagaaca

SEQ ID NO: 1185261 - DNA, 22 bp, Artificial Sequence
  chemically synthesized
agaagcactgtattgttctacg

SEQ ID NO: 1185262 - DNA, 22 bp, Artificial Sequence
  chemically synthesized
cttctatccgtagaacaataca

SEQ ID NO: 1185263 - DNA, 22 bp, Artificial Sequence
  chemically synthesized
ctatccgtagaacaatacagtg

SEQ ID NO: 1185264 - DNA, 22 bp, Artificial Sequence
  chemically synthesized
agaattgagaagcactgtattg

SEQ ID NO: 1185265 - DNA, 22 bp, Artificial Sequence
  chemically synthesized
tatccgtagaacaatacagtgc

SEQ ID NO: 1185266 - DNA, 22 bp, Artificial Sequence
  chemically synthesized
tccgtagaacaatacagtgctt

SEQ ID NO: 1185267 - DNA, 22 bp, Artificial Sequence
  chemically synthesized
atatgtacattaagaattgaga

SEQ ID NO: 1185268 - DNA, 22 bp, Artificial Sequence
  chemically synthesized
ctcaattcttaatgtacatatg

SEQ ID NO: 1185269 - DNA, 22 bp, Artificial Sequence
  chemically synthesized
tcaattcttaatgtacatatga

SEQ ID NO: 1185270 - DNA, 22 bp, Artificial Sequence
  chemically synthesized
aattcttaatgtacatatgaat

SEQ ID NO: 1185271 - DNA, 22 bp, Artificial Sequence
  chemically synthesized
aaagatccccaggtgattcata

SEQ ID NO: 1185272 - DNA, 22 bp, Artificial Sequence
  chemically synthesized
aaaagatccccaggtgattcat

SEQ ID NO: 1185273 - DNA, 22 bp, Artificial Sequence
  chemically synthesized
ttaatgtacatatgaatcacct

SEQ ID NO: 1185274 - DNA, 22 bp, Artificial Sequence
  chemically synthesized
taaaagatccccaggtgattca

SEQ ID NO: 1185275 - DNA, 22 bp, Artificial Sequence
  chemically synthesized
aatgtacatatgaatcacctgg

SEQ ID NO: 1185276 - DNA, 22 bp, Artificial Sequence
  chemically synthesized
atgtacatatgaatcacctggg

SEQ ID NO: 1185277 - DNA, 22 bp, Artificial Sequence
  chemically synthesized
tagttttaaaagatccccaggt

SEQ ID NO: 1185278 - DNA, 22 bp, Artificial Sequence
  chemically synthesized
tgtagttttaaaagatccccag

SEQ ID NO: 1185279 - DNA, 22 bp, Artificial Sequence
  chemically synthesized
aatcagattctgtagttttaaa

SEQ ID NO: 1185280 - DNA, 22 bp, Artificial Sequence
  chemically synthesized
ttgaatcagattctgtagtttt

SEQ ID NO: 1185281 - DNA, 22 bp, Artificial Sequence
  chemically synthesized
gggatcttttaaaactacagaa

SEQ ID NO: 1185282 - DNA, 22 bp, Artificial Sequence
  chemically synthesized
ttaaaactacagaatctgattc

SEQ ID NO: 1185283 - DNA, 22 bp, Artificial Sequence
  chemically synthesized
ccccgatctattgaatcagatt

SEQ ID NO: 1185284 - DNA, 22 bp, Artificial Sequence
  chemically synthesized
taaaactacagaatctgattca

SEQ ID NO: 1185285 - DNA, 22 bp, Artificial Sequence
  chemically synthesized
aaaactacagaatctgattcaa

SEQ ID NO: 1185286 - DNA, 22 bp, Artificial Sequence
  chemically synthesized
taccccgatctattgaatcaga

SEQ ID NO: 1185287 - DNA, 22 bp, Artificial Sequence
  chemically synthesized
aaactacagaatctgattcaat

SEQ ID NO: 1185288 - DNA, 22 bp, Artificial Sequence
  chemically synthesized
cagaatctgattcaatagatcg

SEQ ID NO: 1185289 - DNA, 22 bp, Artificial Sequence
  chemically synthesized
caggctctaccccgatctattg

SEQ ID NO: 1185290 - DNA, 22 bp, Artificial Sequence
  chemically synthesized
attcaatagatcggggtagagc

SEQ ID NO: 1185291 - DNA, 22 bp, Artificial Sequence
  chemically synthesized
aatagatcggggtagagcctgg

SEQ ID NO: 1185292 - DNA, 22 bp, Artificial Sequence
  chemically synthesized
caaatgcagagctccaggctct

SEQ ID NO: 1185293 - DNA, 22 bp, Artificial Sequence
  chemically synthesized
ttgcaaatgcagagctccaggc

SEQ ID NO: 1185294 - DNA, 22 bp, Artificial Sequence
  chemically synthesized
ggagactattgcaaatgcagag

SEQ ID NO: 1185295 - DNA, 22 bp, Artificial Sequence
  chemically synthesized
gggagactattgcaaatgcaga

SEQ ID NO: 1185296 - DNA, 22 bp, Artificial Sequence
  chemically synthesized
gagctctgcatttgcaatagtc

SEQ ID NO: 1185297 - DNA, 22 bp, Artificial Sequence
  chemically synthesized
agcatcacttgggagactattg

SEQ ID NO: 1185298 - DNA, 22 bp, Artificial Sequence
  chemically synthesized
cagcatcacttgggagactatt

SEQ ID NO: 1185299 - DNA, 22 bp, Artificial Sequence
  chemically synthesized
tgcatttgcaatagtctcccaa

SEQ ID NO: 1185300 - DNA, 22 bp, Artificial Sequence
  chemically synthesized
catttgcaatagtctcccaagt

SEQ ID NO: 1185301 - DNA, 22 bp, Artificial Sequence
  chemically synthesized
gcagtttcagcatcacttggga

SEQ ID NO: 1185302 - DNA, 22 bp, Artificial Sequence
  chemically synthesized
gcaatagtctcccaagtgatgc

SEQ ID NO: 1185303 - DNA, 22 bp, Artificial Sequence
  chemically synthesized
caatagtctcccaagtgatgct

SEQ ID NO: 1185304 - DNA, 22 bp, Artificial Sequence
  chemically synthesized
ccaagtgatgctgaaactgcta

SEQ ID NO: 1185305 - DNA, 22 bp, Artificial Sequence
  chemically synthesized
aaaatgtagcagactagcagtt

SEQ ID NO: 1185306 - DNA, 22 bp, Artificial Sequence
  chemically synthesized
ttcaaaatgtagcagactagca

SEQ ID NO: 1185307 - DNA, 22 bp, Artificial Sequence
  chemically synthesized
attcaaaatgtagcagactagc

SEQ ID NO: 1185308 - DNA, 22 bp, Artificial Sequence
  chemically synthesized
gcccttattcaaaatgtagcag

SEQ ID NO: 1185309 - DNA, 22 bp, Artificial Sequence
  chemically synthesized
aaactgctagtctgctacattt

SEQ ID NO: 1185310 - DNA, 22 bp, Artificial Sequence
  chemically synthesized
ggcccttattcaaaatgtagca

SEQ ID NO: 1185311 - DNA, 22 bp, Artificial Sequence
  chemically synthesized
tggcccttattcaaaatgtagc

SEQ ID NO: 1185312 - DNA, 22 bp, Artificial Sequence
  chemically synthesized
ttggcccttattcaaaatgtag

SEQ ID NO: 1185313 - DNA, 22 bp, Artificial Sequence
  chemically synthesized
ctagtctgctacattttgaata

SEQ ID NO: 1185314 - DNA, 22 bp, Artificial Sequence
  chemically synthesized
gtctgctacattttgaataagg

SEQ ID NO: 1185315 - DNA, 22 bp, Artificial Sequence
  chemically synthesized
ctacattttgaataagggccaa

SEQ ID NO: 1185316 - DNA, 22 bp, Artificial Sequence
  chemically synthesized
taagtaatgtttttggccctta

SEQ ID NO: 1185317 - DNA, 22 bp, Artificial Sequence
  chemically synthesized
ataagtaatgtttttggccctt

SEQ ID NO: 1185318 - DNA, 22 bp, Artificial Sequence
  chemically synthesized
cattttgaataagggccaaaaa

SEQ ID NO: 1185319 - DNA, 22 bp, Artificial Sequence
  chemically synthesized
cttataagtaatgtttttggcc

SEQ ID NO: 1185320 - DNA, 22 bp, Artificial Sequence
  chemically synthesized
tgaataagggccaaaaacatta

SEQ ID NO: 1185321 - DNA, 22 bp, Artificial Sequence
  chemically synthesized
gaataagggccaaaaacattac

SEQ ID NO: 1185322 - DNA, 22 bp, Artificial Sequence
  chemically synthesized
aataagggccaaaaacattact

SEQ ID NO: 1185323 - DNA, 22 bp, Artificial Sequence
  chemically synthesized
cttataagcagactgttacatc

SEQ ID NO: 1185324 - DNA, 22 bp, Artificial Sequence
  chemically synthesized
ataagcagactgttacatcatc

SEQ ID NO: 1185325 - DNA, 22 bp, Artificial Sequence
  chemically synthesized
taagcagactgttacatcatct

SEQ ID NO: 1185326 - DNA, 22 bp, Artificial Sequence
  chemically synthesized
ttacatcatctcccgttttatt

SEQ ID NO: 1185327 - DNA, 22 bp, Artificial Sequence
  chemically synthesized
catcatctcccgttttattgtt

SEQ ID NO: 1185328 - DNA, 22 bp, Artificial Sequence
  chemically synthesized
aataaatgaataaaacaataaa

SEQ ID NO: 1185329 - DNA, 22 bp, Artificial Sequence
  chemically synthesized
gaataaatgaataaaacaataa

SEQ ID NO: 1185330 - DNA, 22 bp, Artificial Sequence
  chemically synthesized
ccgttttattgttttattcatt

SEQ ID NO: 1185331 - DNA, 22 bp, Artificial Sequence
  chemically synthesized
atatcatttgaataaatgaata

SEQ ID NO: 1185332 - DNA, 22 bp, Artificial Sequence
  chemically synthesized
tattgttttattcatttattca

SEQ ID NO: 1185333 - DNA, 22 bp, Artificial Sequence
  chemically synthesized
attgttttattcatttattcaa

SEQ ID NO: 1185334 - DNA, 22 bp, Artificial Sequence
  chemically synthesized
ttgttttattcatttattcaaa

SEQ ID NO: 1185335 - DNA, 22 bp, Artificial Sequence
  chemically synthesized
ttttattcatttattcaaatga

SEQ ID NO: 1185336 - DNA, 22 bp, Artificial Sequence
  chemically synthesized
aaatgtctaatatcatttgaat

SEQ ID NO: 1185337 - DNA, 22 bp, Artificial Sequence
  chemically synthesized
tattcatttattcaaatgatat

SEQ ID NO: 1185338 - DNA, 22 bp, Artificial Sequence
  chemically synthesized
attcatttattcaaatgatatt

SEQ ID NO: 1185339 - DNA, 22 bp, Artificial Sequence
  chemically synthesized
ttcatttattcaaatgatatta

SEQ ID NO: 1185340 - DNA, 22 bp, Artificial Sequence
  chemically synthesized
tgcattgaaatgtctaatatca

SEQ ID NO: 1185341 - DNA, 22 bp, Artificial Sequence
  chemically synthesized
atttattcaaatgatattagac

SEQ ID NO: 1185342 - DNA, 22 bp, Artificial Sequence
  chemically synthesized
gtgcattgaaatgtctaatatc

SEQ ID NO: 1185343 - DNA, 22 bp, Artificial Sequence
  chemically synthesized
attcaaatgatattagacattt

SEQ ID NO: 1185344 - DNA, 22 bp, Artificial Sequence
  chemically synthesized
ttcaaatgatattagacatttc

SEQ ID NO: 1185345 - DNA, 22 bp, Artificial Sequence
  chemically synthesized
agccttgtgcattgaaatgtct

SEQ ID NO: 1185346 - DNA, 22 bp, Artificial Sequence
  chemically synthesized
cagccttgtgcattgaaatgtc

SEQ ID NO: 1185347 - DNA, 22 bp, Artificial Sequence
  chemically synthesized
aaatgatattagacatttcaat

SEQ ID NO: 1185348 - DNA, 22 bp, Artificial Sequence
  chemically synthesized
tcagccttgtgcattgaaatgt

SEQ ID NO: 1185349 - DNA, 22 bp, Artificial Sequence
  chemically synthesized
tacctttcagccttgtgcattg

SEQ ID NO: 1185350 - DNA, 22 bp, Artificial Sequence
  chemically synthesized
gtacctttcagccttgtgcatt

SEQ ID NO: 1185351 - DNA, 22 bp, Artificial Sequence
  chemically synthesized
tgtacctttcagccttgtgcat

SEQ ID NO: 1185352 - DNA, 22 bp, Artificial Sequence
  chemically synthesized
gacatttcaatgcacaaggctg

SEQ ID NO: 1185353 - DNA, 22 bp, Artificial Sequence
  chemically synthesized
tataactttgtacctttcagcc

SEQ ID NO: 1185354 - DNA, 22 bp, Artificial Sequence
  chemically synthesized
caatgcacaaggctgaaaggta

SEQ ID NO: 1185355 - DNA, 22 bp, Artificial Sequence
  chemically synthesized
aatgcacaaggctgaaaggtac

SEQ ID NO: 1185356 - DNA, 22 bp, Artificial Sequence
  chemically synthesized
agccatatgtgttgtataactt

SEQ ID NO: 1185357 - DNA, 22 bp, Artificial Sequence
  chemically synthesized
aaaggtacaaagttatacaaca

SEQ ID NO: 1185358 - DNA, 22 bp, Artificial Sequence
  chemically synthesized
aagtgtaataagttgagccata

SEQ ID NO: 1185359 - DNA, 22 bp, Artificial Sequence
  chemically synthesized
tacaacacatatggctcaactt

SEQ ID NO: 1185360 - DNA, 22 bp, Artificial Sequence
  chemically synthesized
ataattaaagtgtaataagttg

SEQ ID NO: 1185361 - DNA, 22 bp, Artificial Sequence
  chemically synthesized
attaataattaaagtgtaataa

SEQ ID NO: 1185362 - DNA, 22 bp, Artificial Sequence
  chemically synthesized
ttgattaataattaaagtgtaa

SEQ ID NO: 1185363 - DNA, 22 bp, Artificial Sequence
  chemically synthesized
aacttattacactttaattatt

SEQ ID NO: 1185364 - DNA, 22 bp, Artificial Sequence
  chemically synthesized
accatctgttgattaataatta

SEQ ID NO: 1185365 - DNA, 22 bp, Artificial Sequence
  chemically synthesized
gaccatctgttgattaataatt

SEQ ID NO: 1185366 - DNA, 22 bp, Artificial Sequence
  chemically synthesized
tgaccatctgttgattaataat

SEQ ID NO: 1185367 - DNA, 22 bp, Artificial Sequence
  chemically synthesized
attacactttaattattaatca

SEQ ID NO: 1185368 - DNA, 22 bp, Artificial Sequence
  chemically synthesized
ttacactttaattattaatcaa

SEQ ID NO: 1185369 - DNA, 22 bp, Artificial Sequence
  chemically synthesized
ctttgaccatctgttgattaat

SEQ ID NO: 1185370 - DNA, 22 bp, Artificial Sequence
  chemically synthesized
cactttaattattaatcaacag

SEQ ID NO: 1185371 - DNA, 22 bp, Artificial Sequence
  chemically synthesized
taattattaatcaacagatggt

SEQ ID NO: 1185372 - DNA, 22 bp, Artificial Sequence
  chemically synthesized
aattattaatcaacagatggtc

SEQ ID NO: 1185373 - DNA, 22 bp, Artificial Sequence
  chemically synthesized
attattaatcaacagatggtca

SEQ ID NO: 1185374 - DNA, 22 bp, Artificial Sequence
  chemically synthesized
caaaaattactttgaccatctg

SEQ ID NO: 1185375 - DNA, 22 bp, Artificial Sequence
  chemically synthesized
gcaaaaattactttgaccatct

SEQ ID NO: 1185376 - DNA, 22 bp, Artificial Sequence
  chemically synthesized
ttaatcaacagatggtcaaagt

SEQ ID NO: 1185377 - DNA, 22 bp, Artificial Sequence
  chemically synthesized
atcaacagatggtcaaagtaat

SEQ ID NO: 1185378 - DNA, 22 bp, Artificial Sequence
  chemically synthesized
aaaagtacttgcaaaaattact

SEQ ID NO: 1185379 - DNA, 22 bp, Artificial Sequence
  chemically synthesized
aaaaagtacttgcaaaaattac

SEQ ID NO: 1185380 - DNA, 22 bp, Artificial Sequence
  chemically synthesized
taaaaagtacttgcaaaaatta

SEQ ID NO: 1185381 - DNA, 22 bp, Artificial Sequence
  chemically synthesized
tttaaaaagtacttgcaaaaat

SEQ ID NO: 1185382 - DNA, 22 bp, Artificial Sequence
  chemically synthesized
ctttaaaaagtacttgcaaaaa

SEQ ID NO: 1185383 - DNA, 22 bp, Artificial Sequence
  chemically synthesized
ttctttaaaaagtacttgcaaa

SEQ ID NO: 1185384 - DNA, 22 bp, Artificial Sequence
  chemically synthesized
gttcttctttaaaaagtacttg

SEQ ID NO: 1185385 - DNA, 22 bp, Artificial Sequence
  chemically synthesized
agttcttctttaaaaagtactt

SEQ ID NO: 1185386 - DNA, 22 bp, Artificial Sequence
  chemically synthesized
tttagttcttctttaaaaagta

SEQ ID NO: 1185387 - DNA, 22 bp, Artificial Sequence
  chemically synthesized
ttgcaagtactttttaaagaag

SEQ ID NO: 1185388 - DNA, 22 bp, Artificial Sequence
  chemically synthesized
tgcaagtactttttaaagaaga

SEQ ID NO: 1185389 - DNA, 22 bp, Artificial Sequence
  chemically synthesized
gcaagtactttttaaagaagaa

SEQ ID NO: 1185390 - DNA, 22 bp, Artificial Sequence
  chemically synthesized
caagtactttttaaagaagaac

SEQ ID NO: 1185391 - DNA, 22 bp, Artificial Sequence
  chemically synthesized
atgcacaaaatattatttagtt

SEQ ID NO: 1185392 - DNA, 22 bp, Artificial Sequence
  chemically synthesized
tttaaagaagaactaaataata

SEQ ID NO: 1185393 - DNA, 22 bp, Artificial Sequence
  chemically synthesized
ttaaagaagaactaaataatat

SEQ ID NO: 1185394 - DNA, 22 bp, Artificial Sequence
  chemically synthesized
taaagaagaactaaataatatt

SEQ ID NO: 1185395 - DNA, 22 bp, Artificial Sequence
  chemically synthesized
aaagaagaactaaataatattt

SEQ ID NO: 1185396 - DNA, 22 bp, Artificial Sequence
  chemically synthesized
aagaagaactaaataatatttt

SEQ ID NO: 1185397 - DNA, 22 bp, Artificial Sequence
  chemically synthesized
aggaaggcagtgttcatgcaca

SEQ ID NO: 1185398 - DNA, 22 bp, Artificial Sequence
  chemically synthesized
aataatattttgtgcatgaaca

SEQ ID NO: 1185399 - DNA, 22 bp, Artificial Sequence
  chemically synthesized
ttaaggaaggcagtgttcatgc

SEQ ID NO: 1185400 - DNA, 22 bp, Artificial Sequence
  chemically synthesized
taagattattaaggaaggcagt

SEQ ID NO: 1185401 - DNA, 22 bp, Artificial Sequence
  chemically synthesized
tgtgcatgaacactgccttcct

SEQ ID NO: 1185402 - DNA, 22 bp, Artificial Sequence
  chemically synthesized
gtaagattattaaggaaggcag

SEQ ID NO: 1185403 - DNA, 22 bp, Artificial Sequence
  chemically synthesized
gtgcatgaacactgccttcctt

SEQ ID NO: 1185404 - DNA, 22 bp, Artificial Sequence
  chemically synthesized
tgcatgaacactgccttcctta

SEQ ID NO: 1185405 - DNA, 22 bp, Artificial Sequence
  chemically synthesized
agtttgtaagattattaaggaa

SEQ ID NO: 1185406 - DNA, 22 bp, Artificial Sequence
  chemically synthesized
caaagctaagtttgtaagatta

SEQ ID NO: 1185407 - DNA, 22 bp, Artificial Sequence
  chemically synthesized
ccttccttaataatcttacaaa

SEQ ID NO: 1185408 - DNA, 22 bp, Artificial Sequence
  chemically synthesized
ccttaataatcttacaaactta

SEQ ID NO: 1185409 - DNA, 22 bp, Artificial Sequence
  chemically synthesized
cttaataatcttacaaacttag

SEQ ID NO: 1185410 - DNA, 22 bp, Artificial Sequence
  chemically synthesized
agaattccaaagctaagtttgt

SEQ ID NO: 1185411 - DNA, 22 bp, Artificial Sequence
  chemically synthesized
cagaattccaaagctaagtttg

SEQ ID NO: 1185412 - DNA, 22 bp, Artificial Sequence
  chemically synthesized
aataatcttacaaacttagctt

SEQ ID NO: 1185413 - DNA, 22 bp, Artificial Sequence
  chemically synthesized
ataatcttacaaacttagcttt

SEQ ID NO: 1185414 - DNA, 22 bp, Artificial Sequence
  chemically synthesized
ggcttcagaattccaaagctaa

SEQ ID NO: 1185415 - DNA, 22 bp, Artificial Sequence
  chemically synthesized
taggcttcagaattccaaagct

SEQ ID NO: 1185416 - DNA, 22 bp, Artificial Sequence
  chemically synthesized
ctaggcttcagaattccaaagc

SEQ ID NO: 1185417 - DNA, 22 bp, Artificial Sequence
  chemically synthesized
acaaacttagctttggaattct

SEQ ID NO: 1185418 - DNA, 22 bp, Artificial Sequence
  chemically synthesized
caaacttagctttggaattctg

SEQ ID NO: 1185419 - DNA, 22 bp, Artificial Sequence
  chemically synthesized
gagatttctaggcttcagaatt

SEQ ID NO: 1185420 - DNA, 22 bp, Artificial Sequence
  chemically synthesized
agctttggaattctgaagccta

SEQ ID NO: 1185421 - DNA, 22 bp, Artificial Sequence
  chemically synthesized
gctttggaattctgaagcctag

SEQ ID NO: 1185422 - DNA, 22 bp, Artificial Sequence
  chemically synthesized
tggaattctgaagcctagaaat

SEQ ID NO: 1185423 - DNA, 22 bp, Artificial Sequence
  chemically synthesized
ggaattctgaagcctagaaatc

SEQ ID NO: 1185424 - DNA, 22 bp, Artificial Sequence
  chemically synthesized
gaattctgaagcctagaaatct

SEQ ID NO: 1185425 - DNA, 22 bp, Artificial Sequence
  chemically synthesized
tcaaatgaattggagatttcta

SEQ ID NO: 1185426 - DNA, 22 bp, Artificial Sequence
  chemically synthesized
tgaagcctagaaatctccaatt

SEQ ID NO: 1185427 - DNA, 22 bp, Artificial Sequence
  chemically synthesized
aagcctagaaatctccaattca

SEQ ID NO: 1185428 - DNA, 22 bp, Artificial Sequence
  chemically synthesized
aaaaacaattatcaaatgaatt

SEQ ID NO: 1185429 - DNA, 22 bp, Artificial Sequence
  chemically synthesized
gaaaaacaattatcaaatgaat

SEQ ID NO: 1185430 - DNA, 22 bp, Artificial Sequence
  chemically synthesized
tgaaaaacaattatcaaatgaa

SEQ ID NO: 1185431 - DNA, 22 bp, Artificial Sequence
  chemically synthesized
gaaatctccaattcatttgata

SEQ ID NO: 1185432 - DNA, 22 bp, Artificial Sequence
  chemically synthesized
caattcatttgataattgtttt

SEQ ID NO: 1185433 - DNA, 22 bp, Artificial Sequence
  chemically synthesized
gtcaaatattttgaaaaacaat

SEQ ID NO: 1185434 - DNA, 22 bp, Artificial Sequence
  chemically synthesized
atttgataattgtttttcaaaa

SEQ ID NO: 1185435 - DNA, 22 bp, Artificial Sequence
  chemically synthesized
gataattgtttttcaaaatatt

SEQ ID NO: 1185436 - DNA, 22 bp, Artificial Sequence
  chemically synthesized
ataattgtttttcaaaatattt

SEQ ID NO: 1185437 - DNA, 22 bp, Artificial Sequence
  chemically synthesized
tataagaaacaattggtcaaat

SEQ ID NO: 1185438 - DNA, 22 bp, Artificial Sequence
  chemically synthesized
tttttcaaaatatttgaccaat

SEQ ID NO: 1185439 - DNA, 22 bp, Artificial Sequence
  chemically synthesized
ctatataagaaacaattggtca

SEQ ID NO: 1185440 - DNA, 22 bp, Artificial Sequence
  chemically synthesized
ttcaaaatatttgaccaattgt

SEQ ID NO: 1185441 - DNA, 22 bp, Artificial Sequence
  chemically synthesized
tcaaaatatttgaccaattgtt

SEQ ID NO: 1185442 - DNA, 22 bp, Artificial Sequence
  chemically synthesized
caaaatatttgaccaattgttt

SEQ ID NO: 1185443 - DNA, 22 bp, Artificial Sequence
  chemically synthesized
aaaatatttgaccaattgtttc

SEQ ID NO: 1185444 - DNA, 22 bp, Artificial Sequence
  chemically synthesized
gaccaattgtttcttatatagt

SEQ ID NO: 1185445 - DNA, 22 bp, Artificial Sequence
  chemically synthesized
accaattgtttcttatatagta

SEQ ID NO: 1185446 - DNA, 22 bp, Artificial Sequence
  chemically synthesized
tttcttatatagtagatactat

SEQ ID NO: 1185447 - DNA, 22 bp, Artificial Sequence
  chemically synthesized
cttatatagtagatactatact

SEQ ID NO: 1185448 - DNA, 22 bp, Artificial Sequence
  chemically synthesized
aagatacggtgaagtatagtat

SEQ ID NO: 1185449 - DNA, 22 bp, Artificial Sequence
  chemically synthesized
ttatatagtagatactatactt

SEQ ID NO: 1185450 - DNA, 22 bp, Artificial Sequence
  chemically synthesized
caagatacggtgaagtatagta

SEQ ID NO: 1185451 - DNA, 22 bp, Artificial Sequence
  chemically synthesized
atatagtagatactatacttca

SEQ ID NO: 1185452 - DNA, 22 bp, Artificial Sequence
  chemically synthesized
tatagtagatactatacttcac

SEQ ID NO: 1185453 - DNA, 22 bp, Artificial Sequence
  chemically synthesized
gaatttcaagatacggtgaagt

SEQ ID NO: 1185454 - DNA, 22 bp, Artificial Sequence
  chemically synthesized
tagaatttcaagatacggtgaa

SEQ ID NO: 1185455 - DNA, 22 bp, Artificial Sequence
  chemically synthesized
ctagaatttcaagatacggtga

SEQ ID NO: 1185456 - DNA, 22 bp, Artificial Sequence
  chemically synthesized
tctagaatttcaagatacggtg

SEQ ID NO: 1185457 - DNA, 22 bp, Artificial Sequence
  chemically synthesized
tacttcaccgtatcttgaaatt

SEQ ID NO: 1185458 - DNA, 22 bp, Artificial Sequence
  chemically synthesized
caccgtatcttgaaattctaga

SEQ ID NO: 1185459 - DNA, 22 bp, Artificial Sequence
  chemically synthesized
accgtatcttgaaattctagaa

SEQ ID NO: 1185460 - DNA, 22 bp, Artificial Sequence
  chemically synthesized
gtgagaaggaagaacattttct

SEQ ID NO: 1185461 - DNA, 22 bp, Artificial Sequence
  chemically synthesized
ctagtgagaaggaagaacattt

SEQ ID NO: 1185462 - DNA, 22 bp, Artificial Sequence
  chemically synthesized
gaaattctagaaaatgttcttc

SEQ ID NO: 1185463 - DNA, 22 bp, Artificial Sequence
  chemically synthesized
aaattctagaaaatgttcttcc

SEQ ID NO: 1185464 - DNA, 22 bp, Artificial Sequence
  chemically synthesized
gttactagtgagaaggaagaac

SEQ ID NO: 1185465 - DNA, 22 bp, Artificial Sequence
  chemically synthesized
tagaaaatgttcttccttctca

SEQ ID NO: 1185466 - DNA, 22 bp, Artificial Sequence
  chemically synthesized
actagttactagtgagaaggaa

SEQ ID NO: 1185467 - DNA, 22 bp, Artificial Sequence
  chemically synthesized
gaaaatgttcttccttctcact

SEQ ID NO: 1185468 - DNA, 22 bp, Artificial Sequence
  chemically synthesized
ttccttctcactagtaactagt

SEQ ID NO: 1185469 - DNA, 22 bp, Artificial Sequence
  chemically synthesized
ccttctcactagtaactagtca

SEQ ID NO: 1185470 - DNA, 22 bp, Artificial Sequence
  chemically synthesized
cttctcactagtaactagtcag

SEQ ID NO: 1185471 - DNA, 22 bp, Artificial Sequence
  chemically synthesized
atcacaggtacagctgactagt

SEQ ID NO: 1185472 - DNA, 22 bp, Artificial Sequence
  chemically synthesized
ctcactagtaactagtcagctg

SEQ ID NO: 1185473 - DNA, 22 bp, Artificial Sequence
  chemically synthesized
tcactagtaactagtcagctgt

SEQ ID NO: 1185474 - DNA, 22 bp, Artificial Sequence
  chemically synthesized
actagtaactagtcagctgtac

SEQ ID NO: 1185475 - DNA, 22 bp, Artificial Sequence
  chemically synthesized
tgctaatcacaggtacagctga

SEQ ID NO: 1185476 - DNA, 22 bp, Artificial Sequence
  chemically synthesized
gtaactagtcagctgtacctgt

SEQ ID NO: 1185477 - DNA, 22 bp, Artificial Sequence
  chemically synthesized
agttatgctaatcacaggtaca

SEQ ID NO: 1185478 - DNA, 22 bp, Artificial Sequence
  chemically synthesized
taagttatgctaatcacaggta

SEQ ID NO: 1185479 - DNA, 22 bp, Artificial Sequence
  chemically synthesized
gtcagctgtacctgtgattagc

SEQ ID NO: 1185480 - DNA, 22 bp, Artificial Sequence
  chemically synthesized
tacctgtgattagcataactta

SEQ ID NO: 1185481 - DNA, 22 bp, Artificial Sequence
  chemically synthesized
aaaatgaaagagctctaagtta

SEQ ID NO: 1185482 - DNA, 22 bp, Artificial Sequence
  chemically synthesized
tgattagcataacttagagctc

SEQ ID NO: 1185483 - DNA, 22 bp, Artificial Sequence
  chemically synthesized
atatactaaaaatgaaagagct

SEQ ID NO: 1185484 - DNA, 22 bp, Artificial Sequence
  chemically synthesized
gcataacttagagctctttcat

SEQ ID NO: 1185485 - DNA, 22 bp, Artificial Sequence
  chemically synthesized
aatatactaaaaatgaaagagc

SEQ ID NO: 1185486 - DNA, 22 bp, Artificial Sequence
  chemically synthesized
tttaatatactaaaaatgaaag

SEQ ID NO: 1185487 - DNA, 22 bp, Artificial Sequence
  chemically synthesized
atttaatatactaaaaatgaaa

SEQ ID NO: 1185488 - DNA, 22 bp, Artificial Sequence
  chemically synthesized
tatttaatatactaaaaatgaa

SEQ ID NO: 1185489 - DNA, 22 bp, Artificial Sequence
  chemically synthesized
agagctctttcatttttagtat

SEQ ID NO: 1185490 - DNA, 22 bp, Artificial Sequence
  chemically synthesized
gagctctttcatttttagtata

SEQ ID NO: 1185491 - DNA, 22 bp, Artificial Sequence
  chemically synthesized
tttcatttttagtatattaaat

SEQ ID NO: 1185492 - DNA, 22 bp, Artificial Sequence
  chemically synthesized
acatcatggttttatttaatat

SEQ ID NO: 1185493 - DNA, 22 bp, Artificial Sequence
  chemically synthesized
tcatttttagtatattaaataa

SEQ ID NO: 1185494 - DNA, 22 bp, Artificial Sequence
  chemically synthesized
catttttagtatattaaataaa

SEQ ID NO: 1185495 - DNA, 22 bp, Artificial Sequence
  chemically synthesized
tcacatcatggttttatttaat

SEQ ID NO: 1185496 - DNA, 22 bp, Artificial Sequence
  chemically synthesized
atttttagtatattaaataaaa

SEQ ID NO: 1185497 - DNA, 22 bp, Artificial Sequence
  chemically synthesized
ctcacatcatggttttatttaa

SEQ ID NO: 1185498 - DNA, 22 bp, Artificial Sequence
  chemically synthesized
tctcacatcatggttttattta

SEQ ID NO: 1185499 - DNA, 22 bp, Artificial Sequence
  chemically synthesized
ttagtatattaaataaaaccat

SEQ ID NO: 1185500 - DNA, 22 bp, Artificial Sequence
  chemically synthesized
ttttctcacatcatggttttat

SEQ ID NO: 1185501 - DNA, 22 bp, Artificial Sequence
  chemically synthesized
tagtatattaaataaaaccatg

SEQ ID NO: 1185502 - DNA, 22 bp, Artificial Sequence
  chemically synthesized
gttttctcacatcatggtttta

SEQ ID NO: 1185503 - DNA, 22 bp, Artificial Sequence
  chemically synthesized
agtatattaaataaaaccatga

SEQ ID NO: 1185504 - DNA, 22 bp, Artificial Sequence
  chemically synthesized
tgttttctcacatcatggtttt

SEQ ID NO: 1185505 - DNA, 22 bp, Artificial Sequence
  chemically synthesized
gtatattaaataaaaccatgat

SEQ ID NO: 1185506 - DNA, 22 bp, Artificial Sequence
  chemically synthesized
ttgttttctcacatcatggttt

SEQ ID NO: 1185507 - DNA, 22 bp, Artificial Sequence
  chemically synthesized
tttgttttctcacatcatggtt

SEQ ID NO: 1185508 - DNA, 22 bp, Artificial Sequence
  chemically synthesized
aataaaaccatgatgtgagaaa

SEQ ID NO: 1185509 - DNA, 22 bp, Artificial Sequence
  chemically synthesized
aaccctttttgttttctcacat

SEQ ID NO: 1185510 - DNA, 22 bp, Artificial Sequence
  chemically synthesized
tgtataacacagcagtgaatag

SEQ ID NO: 1185511 - DNA, 22 bp, Artificial Sequence
  chemically synthesized
agcctgtgcctattcactgctg

SEQ ID NO: 1185512 - DNA, 22 bp, Artificial Sequence
  chemically synthesized
tgcctattcactgctgtgttat

SEQ ID NO: 1185513 - DNA, 22 bp, Artificial Sequence
  chemically synthesized
ttcactgctgtgttatacatag

SEQ ID NO: 1185514 - DNA, 22 bp, Artificial Sequence
  chemically synthesized
actgctgtgttatacatagaca

SEQ ID NO: 1185515 - DNA, 22 bp, Artificial Sequence
  chemically synthesized
ctgtgttatacatagacacatg

SEQ ID NO: 1185516 - DNA, 22 bp, Artificial Sequence
  chemically synthesized
tgttatacatagacacatgcat

SEQ ID NO: 1185517 - DNA, 22 bp, Artificial Sequence
  chemically synthesized
agaccaaacatacatgcatgtg

SEQ ID NO: 1185518 - DNA, 22 bp, Artificial Sequence
  chemically synthesized
gagaccaaacatacatgcatgt

SEQ ID NO: 1185519 - DNA, 22 bp, Artificial Sequence
  chemically synthesized
tacatagacacatgcatgtatg

SEQ ID NO: 1185520 - DNA, 22 bp, Artificial Sequence
  chemically synthesized
taatggcatatatttgagacca

SEQ ID NO: 1185521 - DNA, 22 bp, Artificial Sequence
  chemically synthesized
ataatggcatatatttgagacc

SEQ ID NO: 1185522 - DNA, 22 bp, Artificial Sequence
  chemically synthesized
tataatggcatatatttgagac

SEQ ID NO: 1185523 - DNA, 22 bp, Artificial Sequence
  chemically synthesized
ttataatggcatatatttgaga

SEQ ID NO: 1185524 - DNA, 22 bp, Artificial Sequence
  chemically synthesized
tttataatggcatatatttgag

SEQ ID NO: 1185525 - DNA, 22 bp, Artificial Sequence
  chemically synthesized
ctttttataatggcatatattt

SEQ ID NO: 1185526 - DNA, 22 bp, Artificial Sequence
  chemically synthesized
actttttataatggcatatatt

SEQ ID NO: 1185527 - DNA, 22 bp, Artificial Sequence
  chemically synthesized
tactttttataatggcatatat

SEQ ID NO: 1185528 - DNA, 22 bp, Artificial Sequence
  chemically synthesized
ttactttttataatggcatata

SEQ ID NO: 1185529 - DNA, 22 bp, Artificial Sequence
  chemically synthesized
tttactttttataatggcatat

SEQ ID NO: 1185530 - DNA, 22 bp, Artificial Sequence
  chemically synthesized
ggtctcaaatatatgccattat

SEQ ID NO: 1185531 - DNA, 22 bp, Artificial Sequence
  chemically synthesized
gtctcaaatatatgccattata

SEQ ID NO: 1185532 - DNA, 22 bp, Artificial Sequence
  chemically synthesized
accattttttactttttataat

SEQ ID NO: 1185533 - DNA, 22 bp, Artificial Sequence
  chemically synthesized
aaatatatgccattataaaaag

SEQ ID NO: 1185534 - DNA, 22 bp, Artificial Sequence
  chemically synthesized
caccattttttactttttataa

SEQ ID NO: 1185535 - DNA, 22 bp, Artificial Sequence
  chemically synthesized
tcaccattttttactttttata

SEQ ID NO: 1185536 - DNA, 22 bp, Artificial Sequence
  chemically synthesized
ttcaccattttttactttttat

SEQ ID NO: 1185537 - DNA, 22 bp, Artificial Sequence
  chemically synthesized
gccaatttttcaccatttttta

SEQ ID NO: 1185538 - DNA, 22 bp, Artificial Sequence
  chemically synthesized
ggccaatttttcaccatttttt

SEQ ID NO: 1185539 - DNA, 22 bp, Artificial Sequence
  chemically synthesized
taaaaagtaaaaaatggtgaaa

SEQ ID NO: 1185540 - DNA, 22 bp, Artificial Sequence
  chemically synthesized
gggggcaataaaaataatgctt

SEQ ID NO: 1185541 - DNA, 22 bp, Artificial Sequence
  chemically synthesized
ggggggcaataaaaataatgct

SEQ ID NO: 1185542 - DNA, 22 bp, Artificial Sequence
  chemically synthesized
tggggggcaataaaaataatgc

SEQ ID NO: 1185543 - DNA, 22 bp, Artificial Sequence
  chemically synthesized
ttggggggcaataaaaataatg

SEQ ID NO: 1185544 - DNA, 22 bp, Artificial Sequence
  chemically synthesized
tttggggggcaataaaaataat

SEQ ID NO: 1185545 - DNA, 22 bp, Artificial Sequence
  chemically synthesized
gccaagcattatttttattgcc

SEQ ID NO: 1185546 - DNA, 22 bp, Artificial Sequence
  chemically synthesized
aaattttttggggggcaataaa

SEQ ID NO: 1185547 - DNA, 22 bp, Artificial Sequence
  chemically synthesized
gaaattttttggggggcaataa

SEQ ID NO: 1185548 - DNA, 22 bp, Artificial Sequence
  chemically synthesized
caatgtttgaaattttttgggg

SEQ ID NO: 1185549 - DNA, 22 bp, Artificial Sequence
  chemically synthesized
tttttattgccccccaaaaaat

SEQ ID NO: 1185550 - DNA, 22 bp, Artificial Sequence
  chemically synthesized
ttacaatgtttgaaattttttg

SEQ ID NO: 1185551 - DNA, 22 bp, Artificial Sequence
  chemically synthesized
ttattgccccccaaaaaatttc

SEQ ID NO: 1185552 - DNA, 22 bp, Artificial Sequence
  chemically synthesized
attacaatgtttgaaatttttt

SEQ ID NO: 1185553 - DNA, 22 bp, Artificial Sequence
  chemically synthesized
tattgccccccaaaaaatttca

SEQ ID NO: 1185554 - DNA, 22 bp, Artificial Sequence
  chemically synthesized
attgccccccaaaaaatttcaa

SEQ ID NO: 1185555 - DNA, 22 bp, Artificial Sequence
  chemically synthesized
ttgccccccaaaaaatttcaaa

SEQ ID NO: 1185556 - DNA, 22 bp, Artificial Sequence
  chemically synthesized
ccccccaaaaaatttcaaacat

SEQ ID NO: 1185557 - DNA, 22 bp, Artificial Sequence
  chemically synthesized
tgtaaatgaaatttattacaat

SEQ ID NO: 1185558 - DNA, 22 bp, Artificial Sequence
  chemically synthesized
atgtaaatgaaatttattacaa

SEQ ID NO: 1185559 - DNA, 22 bp, Artificial Sequence
  chemically synthesized
tatgtaaatgaaatttattaca

SEQ ID NO: 1185560 - DNA, 22 bp, Artificial Sequence
  chemically synthesized
caaacattgtaataaatttcat

SEQ ID NO: 1185561 - DNA, 22 bp, Artificial Sequence
  chemically synthesized
aaacattgtaataaatttcatt

SEQ ID NO: 1185562 - DNA, 22 bp, Artificial Sequence
  chemically synthesized
gtccacatgttttatgtaaatg

SEQ ID NO: 1185563 - DNA, 22 bp, Artificial Sequence
  chemically synthesized
agtccacatgttttatgtaaat

SEQ ID NO: 1185564 - DNA, 22 bp, Artificial Sequence
  chemically synthesized
taataaatttcatttacataaa

SEQ ID NO: 1185565 - DNA, 22 bp, Artificial Sequence
  chemically synthesized
catttagtccacatgttttatg

SEQ ID NO: 1185566 - DNA, 22 bp, Artificial Sequence
  chemically synthesized
catttacataaaacatgtggac

SEQ ID NO: 1185567 - DNA, 22 bp, Artificial Sequence
  chemically synthesized
atttacataaaacatgtggact

SEQ ID NO: 1185568 - DNA, 22 bp, Artificial Sequence
  chemically synthesized
tgaacagctgcatttagtccac

SEQ ID NO: 1185569 - DNA, 22 bp, Artificial Sequence
  chemically synthesized
acataaaacatgtggactaaat

SEQ ID NO: 1185570 - DNA, 22 bp, Artificial Sequence
  chemically synthesized
atgaacagctgcatttagtcca

SEQ ID NO: 1185571 - DNA, 22 bp, Artificial Sequence
  chemically synthesized
cataaaacatgtggactaaatg

SEQ ID NO: 1185572 - DNA, 22 bp, Artificial Sequence
  chemically synthesized
atatttatgaacagctgcattt

SEQ ID NO: 1185573 - DNA, 22 bp, Artificial Sequence
  chemically synthesized
taatgactgatatttatgaaca

SEQ ID NO: 1185574 - DNA, 22 bp, Artificial Sequence
  chemically synthesized
ttgtaatgactgatatttatga

SEQ ID NO: 1185575 - DNA, 22 bp, Artificial Sequence
  chemically synthesized
aatgcagctgttcataaatatc

SEQ ID NO: 1185576 - DNA, 22 bp, Artificial Sequence
  chemically synthesized
attgtaatgactgatatttatg

SEQ ID NO: 1185577 - DNA, 22 bp, Artificial Sequence
  chemically synthesized
ttcataaatatcagtcattaca

SEQ ID NO: 1185578 - DNA, 22 bp, Artificial Sequence
  chemically synthesized
ataaatatcagtcattacaata

SEQ ID NO: 1185579 - DNA, 22 bp, Artificial Sequence
  chemically synthesized
aataagtgcatatttattgtaa

SEQ ID NO: 1185580 - DNA, 22 bp, Artificial Sequence
  chemically synthesized
gttaaataagtgcatatttatt

SEQ ID NO: 1185581 - DNA, 22 bp, Artificial Sequence
  chemically synthesized
ggttaaataagtgcatatttat

SEQ ID NO: 1185582 - DNA, 22 bp, Artificial Sequence
  chemically synthesized
caataaatatgcacttatttaa

SEQ ID NO: 1185583 - DNA, 22 bp, Artificial Sequence
  chemically synthesized
gggcaaaatggcaatagtttgg

SEQ ID NO: 1185584 - DNA, 22 bp, Artificial Sequence
  chemically synthesized
ggggcaaaatggcaatagtttg

SEQ ID NO: 1185585 - DNA, 22 bp, Artificial Sequence
  chemically synthesized
atttaaccaaactattgccatt

SEQ ID NO: 1185586 - DNA, 22 bp, Artificial Sequence
  chemically synthesized
tttaaccaaactattgccattt

SEQ ID NO: 1185587 - DNA, 22 bp, Artificial Sequence
  chemically synthesized
aaccaaactattgccattttgc

SEQ ID NO: 1185588 - DNA, 22 bp, Artificial Sequence
  chemically synthesized
accaaactattgccattttgcc

SEQ ID NO: 1185589 - DNA, 22 bp, Artificial Sequence
  chemically synthesized
ttgccattttgccccaaactat

SEQ ID NO: 1185590 - DNA, 22 bp, Artificial Sequence
  chemically synthesized
ccattttgccccaaactattac

SEQ ID NO: 1185591 - DNA, 22 bp, Artificial Sequence
  chemically synthesized
agaagtgggatagtaatagttt

SEQ ID NO: 1185592 - DNA, 22 bp, Artificial Sequence
  chemically synthesized
tgccccaaactattactatccc

SEQ ID NO: 1185593 - DNA, 22 bp, Artificial Sequence
  chemically synthesized
gccccaaactattactatccca

SEQ ID NO: 1185594 - DNA, 22 bp, Artificial Sequence
  chemically synthesized
ccccaaactattactatcccac

SEQ ID NO: 1185595 - DNA, 22 bp, Artificial Sequence
  chemically synthesized
cacataatctcagaagtgggat

SEQ ID NO: 1185596 - DNA, 22 bp, Artificial Sequence
  chemically synthesized
aattccacataatctcagaagt

SEQ ID NO: 1185597 - DNA, 22 bp, Artificial Sequence
  chemically synthesized
gaattccacataatctcagaag

SEQ ID NO: 1185598 - DNA, 22 bp, Artificial Sequence
  chemically synthesized
ttactatcccacttctgagatt

SEQ ID NO: 1185599 - DNA, 22 bp, Artificial Sequence
  chemically synthesized
tgaattccacataatctcagaa

SEQ ID NO: 1185600 - DNA, 22 bp, Artificial Sequence
  chemically synthesized
ctatcccacttctgagattatg

SEQ ID NO: 1185601 - DNA, 22 bp, Artificial Sequence
  chemically synthesized
tcccacttctgagattatgtgg

SEQ ID NO: 1185602 - DNA, 22 bp, Artificial Sequence
  chemically synthesized
gcagttttgaattccacataat

SEQ ID NO: 1185603 - DNA, 22 bp, Artificial Sequence
  chemically synthesized
ctggcagttttgaattccacat

SEQ ID NO: 1185604 - DNA, 22 bp, Artificial Sequence
  chemically synthesized
ctgagattatgtggaattcaaa

SEQ ID NO: 1185605 - DNA, 22 bp, Artificial Sequence
  chemically synthesized
cctactggcagttttgaattcc

SEQ ID NO: 1185606 - DNA, 22 bp, Artificial Sequence
  chemically synthesized
tgagattatgtggaattcaaaa

SEQ ID NO: 1185607 - DNA, 22 bp, Artificial Sequence
  chemically synthesized
tacctactggcagttttgaatt

SEQ ID NO: 1185608 - DNA, 22 bp, Artificial Sequence
  chemically synthesized
agattatgtggaattcaaaact

SEQ ID NO: 1185609 - DNA, 22 bp, Artificial Sequence
  chemically synthesized
ctacctactggcagttttgaat

SEQ ID NO: 1185610 - DNA, 22 bp, Artificial Sequence
  chemically synthesized
tttctacctactggcagttttg

SEQ ID NO: 1185611 - DNA, 22 bp, Artificial Sequence
  chemically synthesized
atttctacctactggcagtttt

SEQ ID NO: 1185612 - DNA, 22 bp, Artificial Sequence
  chemically synthesized
tgtggaattcaaaactgccagt

SEQ ID NO: 1185613 - DNA, 22 bp, Artificial Sequence
  chemically synthesized
cttatttctacctactggcagt

SEQ ID NO: 1185614 - DNA, 22 bp, Artificial Sequence
  chemically synthesized
aaaaattacttatttctaccta

SEQ ID NO: 1185615 - DNA, 22 bp, Artificial Sequence
  chemically synthesized
aaaactgccagtaggtagaaat

SEQ ID NO: 1185616 - DNA, 22 bp, Artificial Sequence
  chemically synthesized
caaaaattacttatttctacct

SEQ ID NO: 1185617 - DNA, 22 bp, Artificial Sequence
  chemically synthesized
ttcaaaaattacttatttctac

SEQ ID NO: 1185618 - DNA, 22 bp, Artificial Sequence
  chemically synthesized
cttcaaaaattacttatttcta

SEQ ID NO: 1185619 - DNA, 22 bp, Artificial Sequence
  chemically synthesized
tcttcaaaaattacttatttct

SEQ ID NO: 1185620 - DNA, 22 bp, Artificial Sequence
  chemically synthesized
ccagtaggtagaaataagtaat

SEQ ID NO: 1185621 - DNA, 22 bp, Artificial Sequence
  chemically synthesized
ctttcttcaaaaattacttatt

SEQ ID NO: 1185622 - DNA, 22 bp, Artificial Sequence
  chemically synthesized
aattcctttcttcaaaaattac

SEQ ID NO: 1185623 - DNA, 22 bp, Artificial Sequence
  chemically synthesized
gaagacctaaattcctttcttc

SEQ ID NO: 1185624 - DNA, 22 bp, Artificial Sequence
  chemically synthesized
agaagacctaaattcctttctt

SEQ ID NO: 1185625 - DNA, 22 bp, Artificial Sequence
  chemically synthesized
tagaagacctaaattcctttct

SEQ ID NO: 1185626 - DNA, 22 bp, Artificial Sequence
  chemically synthesized
ttgaagaaaggaatttaggtct

SEQ ID NO: 1185627 - DNA, 22 bp, Artificial Sequence
  chemically synthesized
tgaagaaaggaatttaggtctt

SEQ ID NO: 1185628 - DNA, 22 bp, Artificial Sequence
  chemically synthesized
aaaatattttagaagacctaaa

SEQ ID NO: 1185629 - DNA, 22 bp, Artificial Sequence
  chemically synthesized
gaagaaaggaatttaggtcttc

SEQ ID NO: 1185630 - DNA, 22 bp, Artificial Sequence
  chemically synthesized
aagaaaggaatttaggtcttct

SEQ ID NO: 1185631 - DNA, 22 bp, Artificial Sequence
  chemically synthesized
atgaaattcaaaatattttaga

SEQ ID NO: 1185632 - DNA, 22 bp, Artificial Sequence
  chemically synthesized
aggtcttctaaaatattttgaa

SEQ ID NO: 1185633 - DNA, 22 bp, Artificial Sequence
  chemically synthesized
ggtcttctaaaatattttgaat

SEQ ID NO: 1185634 - DNA, 22 bp, Artificial Sequence
  chemically synthesized
ctaaaatattttgaatttcatc

SEQ ID NO: 1185635 - DNA, 22 bp, Artificial Sequence
  chemically synthesized
aaaatgtatgttgatgaaattc

SEQ ID NO: 1185636 - DNA, 22 bp, Artificial Sequence
  chemically synthesized
taaaatattttgaatttcatca

SEQ ID NO: 1185637 - DNA, 22 bp, Artificial Sequence
  chemically synthesized
gaaaatgtatgttgatgaaatt

SEQ ID NO: 1185638 - DNA, 22 bp, Artificial Sequence
  chemically synthesized
aaatattttgaatttcatcaac

SEQ ID NO: 1185639 - DNA, 22 bp, Artificial Sequence
  chemically synthesized
ttgaaaatgtatgttgatgaaa

SEQ ID NO: 1185640 - DNA, 22 bp, Artificial Sequence
  chemically synthesized
cttgaaaatgtatgttgatgaa

SEQ ID NO: 1185641 - DNA, 22 bp, Artificial Sequence
  chemically synthesized
tgaatttcatcaacatacattt

SEQ ID NO: 1185642 - DNA, 22 bp, Artificial Sequence
  chemically synthesized
gaatttcatcaacatacatttt

SEQ ID NO: 1185643 - DNA, 22 bp, Artificial Sequence
  chemically synthesized
aatttcatcaacatacattttc

SEQ ID NO: 1185644 - DNA, 22 bp, Artificial Sequence
  chemically synthesized
catcaacatacattttcaagaa

SEQ ID NO: 1185645 - DNA, 22 bp, Artificial Sequence
  chemically synthesized
aatataatagatttcttgaaaa

SEQ ID NO: 1185646 - DNA, 22 bp, Artificial Sequence
  chemically synthesized
atcaacatacattttcaagaaa

SEQ ID NO: 1185647 - DNA, 22 bp, Artificial Sequence
  chemically synthesized
gaatataatagatttcttgaaa

SEQ ID NO: 1185648 - DNA, 22 bp, Artificial Sequence
  chemically synthesized
tgaatataatagatttcttgaa

SEQ ID NO: 1185649 - DNA, 22 bp, Artificial Sequence
  chemically synthesized
aaatactttgaatataatagat

SEQ ID NO: 1185650 - DNA, 22 bp, Artificial Sequence
  chemically synthesized
tcaagaaatctattatattcaa

SEQ ID NO: 1185651 - DNA, 22 bp, Artificial Sequence
  chemically synthesized
caagaaatctattatattcaaa

SEQ ID NO: 1185652 - DNA, 22 bp, Artificial Sequence
  chemically synthesized
aagaaatctattatattcaaag

SEQ ID NO: 1185653 - DNA, 22 bp, Artificial Sequence
  chemically synthesized
gataatccattaaaatactttg

SEQ ID NO: 1185654 - DNA, 22 bp, Artificial Sequence
  chemically synthesized
ctggataatccattaaaatact

SEQ ID NO: 1185655 - DNA, 22 bp, Artificial Sequence
  chemically synthesized
cctggataatccattaaaatac

SEQ ID NO: 1185656 - DNA, 22 bp, Artificial Sequence
  chemically synthesized
ttatattcaaagtattttaatg

SEQ ID NO: 1185657 - DNA, 22 bp, Artificial Sequence
  chemically synthesized
tattcaaagtattttaatggat

SEQ ID NO: 1185658 - DNA, 22 bp, Artificial Sequence
  chemically synthesized
aaatttcctggataatccatta

SEQ ID NO: 1185659 - DNA, 22 bp, Artificial Sequence
  chemically synthesized
caaatttcctggataatccatt

SEQ ID NO: 1185660 - DNA, 22 bp, Artificial Sequence
  chemically synthesized
tcaaatttcctggataatccat

SEQ ID NO: 1185661 - DNA, 22 bp, Artificial Sequence
  chemically synthesized
aaagtattttaatggattatcc

SEQ ID NO: 1185662 - DNA, 22 bp, Artificial Sequence
  chemically synthesized
tctttcaaatttcctggataat

SEQ ID NO: 1185663 - DNA, 22 bp, Artificial Sequence
  chemically synthesized
tatctttcaaatttcctggata

SEQ ID NO: 1185664 - DNA, 22 bp, Artificial Sequence
  chemically synthesized
ctatctttcaaatttcctggat

SEQ ID NO: 1185665 - DNA, 22 bp, Artificial Sequence
  chemically synthesized
tctatctttcaaatttcctgga

SEQ ID NO: 1185666 - DNA, 22 bp, Artificial Sequence
  chemically synthesized
taatggattatccaggaaattt

SEQ ID NO: 1185667 - DNA, 22 bp, Artificial Sequence
  chemically synthesized
aatggattatccaggaaatttg

SEQ ID NO: 1185668 - DNA, 22 bp, Artificial Sequence
  chemically synthesized
atggattatccaggaaatttga

SEQ ID NO: 1185669 - DNA, 22 bp, Artificial Sequence
  chemically synthesized
atgaattttctatctttcaaat

SEQ ID NO: 1185670 - DNA, 22 bp, Artificial Sequence
  chemically synthesized
tccaggaaatttgaaagataga

SEQ ID NO: 1185671 - DNA, 22 bp, Artificial Sequence
  chemically synthesized
gaagcagaattcatgaattttc

SEQ ID NO: 1185672 - DNA, 22 bp, Artificial Sequence
  chemically synthesized
gaaagatagaaaattcatgaat

SEQ ID NO: 1185673 - DNA, 22 bp, Artificial Sequence
  chemically synthesized
aaagatagaaaattcatgaatt

SEQ ID NO: 1185674 - DNA, 22 bp, Artificial Sequence
  chemically synthesized
caaattagaagcagaattcatg

SEQ ID NO: 1185675 - DNA, 22 bp, Artificial Sequence
  chemically synthesized
ttccaaattagaagcagaattc

SEQ ID NO: 1185676 - DNA, 22 bp, Artificial Sequence
  chemically synthesized
attccaaattagaagcagaatt

SEQ ID NO: 1185677 - DNA, 22 bp, Artificial Sequence
  chemically synthesized
ttattccaaattagaagcagaa

SEQ ID NO: 1185678 - DNA, 22 bp, Artificial Sequence
  chemically synthesized
cttattccaaattagaagcaga

SEQ ID NO: 1185679 - DNA, 22 bp, Artificial Sequence
  chemically synthesized
tcttattccaaattagaagcag

SEQ ID NO: 1185680 - DNA, 22 bp, Artificial Sequence
  chemically synthesized
ctttcttattccaaattagaag

SEQ ID NO: 1185681 - DNA, 22 bp, Artificial Sequence
  chemically synthesized
actttcttattccaaattagaa

SEQ ID NO: 1185682 - DNA, 22 bp, Artificial Sequence
  chemically synthesized
atgaattctgcttctaatttgg

SEQ ID NO: 1185683 - DNA, 22 bp, Artificial Sequence
  chemically synthesized
tttactttcttattccaaatta

SEQ ID NO: 1185684 - DNA, 22 bp, Artificial Sequence
  chemically synthesized
ttatttactttcttattccaaa

SEQ ID NO: 1185685 - DNA, 22 bp, Artificial Sequence
  chemically synthesized
tattatttactttcttattcca

SEQ ID NO: 1185686 - DNA, 22 bp, Artificial Sequence
  chemically synthesized
tgcttctaatttggaataagaa

SEQ ID NO: 1185687 - DNA, 22 bp, Artificial Sequence
  chemically synthesized
ctattatttactttcttattcc

SEQ ID NO: 1185688 - DNA, 22 bp, Artificial Sequence
  chemically synthesized
cttctaatttggaataagaaag

SEQ ID NO: 1185689 - DNA, 22 bp, Artificial Sequence
  chemically synthesized
ctaatttggaataagaaagtaa

SEQ ID NO: 1185690 - DNA, 22 bp, Artificial Sequence
  chemically synthesized
tacttctattatttactttctt

SEQ ID NO: 1185691 - DNA, 22 bp, Artificial Sequence
  chemically synthesized
taatttggaataagaaagtaaa

SEQ ID NO: 1185692 - DNA, 22 bp, Artificial Sequence
  chemically synthesized
gtacttctattatttactttct

SEQ ID NO: 1185693 - DNA, 22 bp, Artificial Sequence
  chemically synthesized
tgtacttctattatttactttc

SEQ ID NO: 1185694 - DNA, 22 bp, Artificial Sequence
  chemically synthesized
atttggaataagaaagtaaata

SEQ ID NO: 1185695 - DNA, 22 bp, Artificial Sequence
  chemically synthesized
ctttgtacttctattatttact

SEQ ID NO: 1185696 - DNA, 22 bp, Artificial Sequence
  chemically synthesized
ggaataagaaagtaaataatag

SEQ ID NO: 1185697 - DNA, 22 bp, Artificial Sequence
  chemically synthesized
gaataagaaagtaaataataga

SEQ ID NO: 1185698 - DNA, 22 bp, Artificial Sequence
  chemically synthesized
agcaatgcaattactttgtact

SEQ ID NO: 1185699 - DNA, 22 bp, Artificial Sequence
  chemically synthesized
ttcagcaatgcaattactttgt

SEQ ID NO: 1185700 - DNA, 22 bp, Artificial Sequence
  chemically synthesized
tgttcagcaatgcaattacttt

SEQ ID NO: 1185701 - DNA, 22 bp, Artificial Sequence
  chemically synthesized
aattctgttcagcaatgcaatt

SEQ ID NO: 1185702 - DNA, 22 bp, Artificial Sequence
  chemically synthesized
aaattctgttcagcaatgcaat

SEQ ID NO: 1185703 - DNA, 22 bp, Artificial Sequence
  chemically synthesized
taaattctgttcagcaatgcaa

SEQ ID NO: 1185704 - DNA, 22 bp, Artificial Sequence
  chemically synthesized
gaggaacacattttaaattctg

SEQ ID NO: 1185705 - DNA, 22 bp, Artificial Sequence
  chemically synthesized
cattgctgaacagaatttaaaa

SEQ ID NO: 1185706 - DNA, 22 bp, Artificial Sequence
  chemically synthesized
ctgaacagaatttaaaatgtgt

SEQ ID NO: 1185707 - DNA, 22 bp, Artificial Sequence
  chemically synthesized
tgccaattagaggaacacattt

SEQ ID NO: 1185708 - DNA, 22 bp, Artificial Sequence
  chemically synthesized
aacagaatttaaaatgtgttcc

SEQ ID NO: 1185709 - DNA, 22 bp, Artificial Sequence
  chemically synthesized
gttgtgccaattagaggaacac

SEQ ID NO: 1185710 - DNA, 22 bp, Artificial Sequence
  chemically synthesized
aaaatgtgttcctctaattggc

SEQ ID NO: 1185711 - DNA, 22 bp, Artificial Sequence
  chemically synthesized
aaatgtgttcctctaattggca

SEQ ID NO: 1185712 - DNA, 22 bp, Artificial Sequence
  chemically synthesized
aacaactggttgtgccaattag

SEQ ID NO: 1185713 - DNA, 22 bp, Artificial Sequence
  chemically synthesized
aacatgttaaacaactggttgt

SEQ ID NO: 1185714 - DNA, 22 bp, Artificial Sequence
  chemically synthesized
ctctaattggcacaaccagttg

SEQ ID NO: 1185715 - DNA, 22 bp, Artificial Sequence
  chemically synthesized
taattggcacaaccagttgttt

SEQ ID NO: 1185716 - DNA, 22 bp, Artificial Sequence
  chemically synthesized
attggcacaaccagttgtttaa

SEQ ID NO: 1185717 - DNA, 22 bp, Artificial Sequence
  chemically synthesized
aaaatctgaacatgttaaacaa

SEQ ID NO: 1185718 - DNA, 22 bp, Artificial Sequence
  chemically synthesized
aaaaatctgaacatgttaaaca

SEQ ID NO: 1185719 - DNA, 22 bp, Artificial Sequence
  chemically synthesized
gcacaaccagttgtttaacatg

SEQ ID NO: 1185720 - DNA, 22 bp, Artificial Sequence
  chemically synthesized
taaaaatctgaacatgttaaac

SEQ ID NO: 1185721 - DNA, 22 bp, Artificial Sequence
  chemically synthesized
tatgattttaaaaatctgaaca

SEQ ID NO: 1185722 - DNA, 22 bp, Artificial Sequence
  chemically synthesized
tttaacatgttcagatttttaa

SEQ ID NO: 1185723 - DNA, 22 bp, Artificial Sequence
  chemically synthesized
aacatgttcagatttttaaaat

SEQ ID NO: 1185724 - DNA, 22 bp, Artificial Sequence
  chemically synthesized
caatattatatgattttaaaaa

SEQ ID NO: 1185725 - DNA, 22 bp, Artificial Sequence
  chemically synthesized
acatgttcagatttttaaaatc

SEQ ID NO: 1185726 - DNA, 22 bp, Artificial Sequence
  chemically synthesized
tcctccaatattatatgatttt

SEQ ID NO: 1185727 - DNA, 22 bp, Artificial Sequence
  chemically synthesized
atcctccaatattatatgattt

SEQ ID NO: 1185728 - DNA, 22 bp, Artificial Sequence
  chemically synthesized
agatttttaaaatcatataata

SEQ ID NO: 1185729 - DNA, 22 bp, Artificial Sequence
  chemically synthesized
ccttatcctccaatattatatg

SEQ ID NO: 1185730 - DNA, 22 bp, Artificial Sequence
  chemically synthesized
ttaaaatcatataatattggag

SEQ ID NO: 1185731 - DNA, 22 bp, Artificial Sequence
  chemically synthesized
taaaatcatataatattggagg

SEQ ID NO: 1185732 - DNA, 22 bp, Artificial Sequence
  chemically synthesized
aaaatcatataatattggagga

SEQ ID NO: 1185733 - DNA, 22 bp, Artificial Sequence
  chemically synthesized
aaatcatataatattggaggat

SEQ ID NO: 1185734 - DNA, 22 bp, Artificial Sequence
  chemically synthesized
aagagaattgccttatcctcca

SEQ ID NO: 1185735 - DNA, 22 bp, Artificial Sequence
  chemically synthesized
aaagagaattgccttatcctcc

SEQ ID NO: 1185736 - DNA, 22 bp, Artificial Sequence
  chemically synthesized
tttaaagagaattgccttatcc

SEQ ID NO: 1185737 - DNA, 22 bp, Artificial Sequence
  chemically synthesized
ctatttaaagagaattgcctta

SEQ ID NO: 1185738 - DNA, 22 bp, Artificial Sequence
  chemically synthesized
cctatttaaagagaattgcctt

SEQ ID NO: 1185739 - DNA, 22 bp, Artificial Sequence
  chemically synthesized
agtttcctatttaaagagaatt

SEQ ID NO: 1185740 - DNA, 22 bp, Artificial Sequence
  chemically synthesized
gaggataaggcaattctcttta

SEQ ID NO: 1185741 - DNA, 22 bp, Artificial Sequence
  chemically synthesized
attcagtttcctatttaaagag

SEQ ID NO: 1185742 - DNA, 22 bp, Artificial Sequence
  chemically synthesized
tgcataattaattcagtttcct

SEQ ID NO: 1185743 - DNA, 22 bp, Artificial Sequence
  chemically synthesized
tctttaaataggaaactgaatt

SEQ ID NO: 1185744 - DNA, 22 bp, Artificial Sequence
  chemically synthesized
tttaaataggaaactgaattaa

SEQ ID NO: 1185745 - DNA, 22 bp, Artificial Sequence
  chemically synthesized
taaataggaaactgaattaatt

SEQ ID NO: 1185746 - DNA, 22 bp, Artificial Sequence
  chemically synthesized
aaataggaaactgaattaatta

SEQ ID NO: 1185747 - DNA, 22 bp, Artificial Sequence
  chemically synthesized
aaatcctatgcataattaattc

SEQ ID NO: 1185748 - DNA, 22 bp, Artificial Sequence
  chemically synthesized
aataggaaactgaattaattat

SEQ ID NO: 1185749 - DNA, 22 bp, Artificial Sequence
  chemically synthesized
ttgaaatcctatgcataattaa

SEQ ID NO: 1185750 - DNA, 22 bp, Artificial Sequence
  chemically synthesized
cagctattgaaatcctatgcat

SEQ ID NO: 1185751 - DNA, 22 bp, Artificial Sequence
  chemically synthesized
ccagctattgaaatcctatgca

SEQ ID NO: 1185752 - DNA, 22 bp, Artificial Sequence
  chemically synthesized
aattaattatgcataggatttc

SEQ ID NO: 1185753 - DNA, 22 bp, Artificial Sequence
  chemically synthesized
atttccagctattgaaatccta

SEQ ID NO: 1185754 - DNA, 22 bp, Artificial Sequence
  chemically synthesized
attatgcataggatttcaatag

SEQ ID NO: 1185755 - DNA, 22 bp, Artificial Sequence
  chemically synthesized
cctcatttccagctattgaaat

SEQ ID NO: 1185756 - DNA, 22 bp, Artificial Sequence
  chemically synthesized
tgcataggatttcaatagctgg

SEQ ID NO: 1185757 - DNA, 22 bp, Artificial Sequence
  chemically synthesized
cccattccctcatttccagcta

SEQ ID NO: 1185758 - DNA, 22 bp, Artificial Sequence
  chemically synthesized
ccccattccctcatttccagct

SEQ ID NO: 1185759 - DNA, 22 bp, Artificial Sequence
  chemically synthesized
ttccccattccctcatttccag

SEQ ID NO: 1185760 - DNA, 22 bp, Artificial Sequence
  chemically synthesized
caatagctggaaatgagggaat

SEQ ID NO: 1185761 - DNA, 22 bp, Artificial Sequence
  chemically synthesized
aatagctggaaatgagggaatg

SEQ ID NO: 1185762 - DNA, 22 bp, Artificial Sequence
  chemically synthesized
ccccgaatactcttccccattc

SEQ ID NO: 1185763 - DNA, 22 bp, Artificial Sequence
  chemically synthesized
gaaatgagggaatggggaagag

SEQ ID NO: 1185764 - DNA, 22 bp, Artificial Sequence
  chemically synthesized
ccactgccccgaatactcttcc

SEQ ID NO: 1185765 - DNA, 22 bp, Artificial Sequence
  chemically synthesized
catattcccactgccccgaata

SEQ ID NO: 1185766 - DNA, 22 bp, Artificial Sequence
  chemically synthesized
tacatattcccactgccccgaa

SEQ ID NO: 1185767 - DNA, 22 bp, Artificial Sequence
  chemically synthesized
ttctacatattcccactgcccc

SEQ ID NO: 1185768 - DNA, 22 bp, Artificial Sequence
  chemically synthesized
attctacatattcccactgccc

SEQ ID NO: 1185769 - DNA, 22 bp, Artificial Sequence
  chemically synthesized
catgtttattctacatattccc

SEQ ID NO: 1185770 - DNA, 22 bp, Artificial Sequence
  chemically synthesized
tgcatgtttattctacatattc

SEQ ID NO: 1185771 - DNA, 22 bp, Artificial Sequence
  chemically synthesized
ggggcagtgggaatatgtagaa

SEQ ID NO: 1185772 - DNA, 22 bp, Artificial Sequence
  chemically synthesized
cctctgcatgtttattctacat

SEQ ID NO: 1185773 - DNA, 22 bp, Artificial Sequence
  chemically synthesized
atgtgtccctacctctgcatgt

SEQ ID NO: 1185774 - DNA, 22 bp, Artificial Sequence
  chemically synthesized
ccaagacatcgctaatgtgtcc

SEQ ID NO: 1185775 - DNA, 22 bp, Artificial Sequence
  chemically synthesized
ttgccaagacatcgctaatgtg

SEQ ID NO: 1185776 - DNA, 22 bp, Artificial Sequence
  chemically synthesized
agacacacaaagccactgttgc

SEQ ID NO: 1185777 - DNA, 22 bp, Artificial Sequence
  chemically synthesized
gcgatgtcttggcaacagtggc

SEQ ID NO: 1185778 - DNA, 22 bp, Artificial Sequence
  chemically synthesized
taagacacacaaagccactgtt

SEQ ID NO: 1185779 - DNA, 22 bp, Artificial Sequence
  chemically synthesized
tctaagacacacaaagccactg

SEQ ID NO: 1185780 - DNA, 22 bp, Artificial Sequence
  chemically synthesized
tctctaagacacacaaagccac

SEQ ID NO: 1185781 - DNA, 22 bp, Artificial Sequence
  chemically synthesized
ctctctctaagacacacaaagc

SEQ ID NO: 1185782 - DNA, 22 bp, Artificial Sequence
  chemically synthesized
ggcaacagtggctttgtgtgtc

SEQ ID NO: 1185783 - DNA, 22 bp, Artificial Sequence
  chemically synthesized
tactctctctaagacacacaaa

SEQ ID NO: 1185784 - DNA, 22 bp, Artificial Sequence
  chemically synthesized
gcaacagtggctttgtgtgtct

SEQ ID NO: 1185785 - DNA, 22 bp, Artificial Sequence
  chemically synthesized
ctctactctctctaagacacac

SEQ ID NO: 1185786 - DNA, 22 bp, Artificial Sequence
  chemically synthesized
actactctactctctctaagac

SEQ ID NO: 1185787 - DNA, 22 bp, Artificial Sequence
  chemically synthesized
cactactctactctctctaaga

SEQ ID NO: 1185788 - DNA, 22 bp, Artificial Sequence
  chemically synthesized
tcactactctactctctctaag

SEQ ID NO: 1185789 - DNA, 22 bp, Artificial Sequence
  chemically synthesized
gttttcactactctactctctc

SEQ ID NO: 1185790 - DNA, 22 bp, Artificial Sequence
  chemically synthesized
tgtgtgtcttagagagagtaga

SEQ ID NO: 1185791 - DNA, 22 bp, Artificial Sequence
  chemically synthesized
agttttcactactctactctct

SEQ ID NO: 1185792 - DNA, 22 bp, Artificial Sequence
  chemically synthesized
gtgtgtcttagagagagtagag

SEQ ID NO: 1185793 - DNA, 22 bp, Artificial Sequence
  chemically synthesized
tgtgtcttagagagagtagagt

SEQ ID NO: 1185794 - DNA, 22 bp, Artificial Sequence
  chemically synthesized
atcttagttttcactactctac

SEQ ID NO: 1185795 - DNA, 22 bp, Artificial Sequence
  chemically synthesized
catcttagttttcactactcta

SEQ ID NO: 1185796 - DNA, 22 bp, Artificial Sequence
  chemically synthesized
agagagagtagagtagtgaaaa

SEQ ID NO: 1185797 - DNA, 22 bp, Artificial Sequence
  chemically synthesized
gagagagtagagtagtgaaaac

SEQ ID NO: 1185798 - DNA, 22 bp, Artificial Sequence
  chemically synthesized
ccagtttcatcttagttttcac

SEQ ID NO: 1185799 - DNA, 22 bp, Artificial Sequence
  chemically synthesized
tgtacaatctaccagtttcatc

SEQ ID NO: 1185800 - DNA, 22 bp, Artificial Sequence
  chemically synthesized
tatgtacaatctaccagtttca

SEQ ID NO: 1185801 - DNA, 22 bp, Artificial Sequence
  chemically synthesized
ctatgtacaatctaccagtttc

SEQ ID NO: 1185802 - DNA, 22 bp, Artificial Sequence
  chemically synthesized
tctatgtacaatctaccagttt

SEQ ID NO: 1185803 - DNA, 22 bp, Artificial Sequence
  chemically synthesized
agttttctatgtacaatctacc

SEQ ID NO: 1185804 - DNA, 22 bp, Artificial Sequence
  chemically synthesized
agatgaaactggtagattgtac

SEQ ID NO: 1185805 - DNA, 22 bp, Artificial Sequence
  chemically synthesized
atgatccctcagttttctatgt

SEQ ID NO: 1185806 - DNA, 22 bp, Artificial Sequence
  chemically synthesized
gtagattgtacatagaaaactg

SEQ ID NO: 1185807 - DNA, 22 bp, Artificial Sequence
  chemically synthesized
ttgatgatccctcagttttcta

SEQ ID NO: 1185808 - DNA, 22 bp, Artificial Sequence
  chemically synthesized
ctgttgatgatccctcagtttt

SEQ ID NO: 1185809 - DNA, 22 bp, Artificial Sequence
  chemically synthesized
gctgttgatgatccctcagttt

SEQ ID NO: 1185810 - DNA, 22 bp, Artificial Sequence
  chemically synthesized
tacatagaaaactgagggatca

SEQ ID NO: 1185811 - DNA, 22 bp, Artificial Sequence
  chemically synthesized
gtttgctgttgatgatccctca

SEQ ID NO: 1185812 - DNA, 22 bp, Artificial Sequence
  chemically synthesized
tagtttgctgttgatgatccct

SEQ ID NO: 1185813 - DNA, 22 bp, Artificial Sequence
  chemically synthesized
ctagtttgctgttgatgatccc

SEQ ID NO: 1185814 - DNA, 22 bp, Artificial Sequence
  chemically synthesized
tctagtttgctgttgatgatcc

SEQ ID NO: 1185815 - DNA, 22 bp, Artificial Sequence
  chemically synthesized
agggatcatcaacagcaaacta

SEQ ID NO: 1185816 - DNA, 22 bp, Artificial Sequence
  chemically synthesized
aatgaaggccaggttttctagt

SEQ ID NO: 1185817 - DNA, 22 bp, Artificial Sequence
  chemically synthesized
ttgaatgaaggccaggttttct

SEQ ID NO: 1185818 - DNA, 22 bp, Artificial Sequence
  chemically synthesized
gtctattgaatgaaggccaggt

SEQ ID NO: 1185819 - DNA, 22 bp, Artificial Sequence
  chemically synthesized
tagtctattgaatgaaggccag

SEQ ID NO: 1185820 - DNA, 22 bp, Artificial Sequence
  chemically synthesized
tctagtctattgaatgaaggcc

SEQ ID NO: 1185821 - DNA, 22 bp, Artificial Sequence
  chemically synthesized
ctctctagtctattgaatgaag

SEQ ID NO: 1185822 - DNA, 22 bp, Artificial Sequence
  chemically synthesized
gaaaacctggccttcattcaat

SEQ ID NO: 1185823 - DNA, 22 bp, Artificial Sequence
  chemically synthesized
actctctagtctattgaatgaa

SEQ ID NO: 1185824 - DNA, 22 bp, Artificial Sequence
  chemically synthesized
gccttcattcaatagactagag

SEQ ID NO: 1185825 - DNA, 22 bp, Artificial Sequence
  chemically synthesized
aaaagtatttactctctagtct

SEQ ID NO: 1185826 - DNA, 22 bp, Artificial Sequence
  chemically synthesized
cattcaatagactagagagtaa

SEQ ID NO: 1185827 - DNA, 22 bp, Artificial Sequence
  chemically synthesized
attgaaaagtatttactctcta

SEQ ID NO: 1185828 - DNA, 22 bp, Artificial Sequence
  chemically synthesized
attcaatagactagagagtaaa

SEQ ID NO: 1185829 - DNA, 22 bp, Artificial Sequence
  chemically synthesized
tcattgaaaagtatttactctc

SEQ ID NO: 1185830 - DNA, 22 bp, Artificial Sequence
  chemically synthesized
aatagactagagagtaaatact

SEQ ID NO: 1185831 - DNA, 22 bp, Artificial Sequence
  chemically synthesized
gagagtaaatacttttcaatga

SEQ ID NO: 1185832 - DNA, 22 bp, Artificial Sequence
  chemically synthesized
atggtgtcaccctctcattgaa

SEQ ID NO: 1185833 - DNA, 22 bp, Artificial Sequence
  chemically synthesized
gatggtgtcaccctctcattga

SEQ ID NO: 1185834 - DNA, 22 bp, Artificial Sequence
  chemically synthesized
tgatggtgtcaccctctcattg

SEQ ID NO: 1185835 - DNA, 22 bp, Artificial Sequence
  chemically synthesized
ataaaattttgatggtgtcacc

SEQ ID NO: 1185836 - DNA, 22 bp, Artificial Sequence
  chemically synthesized
ttcaatgagagggtgacaccat

SEQ ID NO: 1185837 - DNA, 22 bp, Artificial Sequence
  chemically synthesized
aataaaattttgatggtgtcac

SEQ ID NO: 1185838 - DNA, 22 bp, Artificial Sequence
  chemically synthesized
tcaatgagagggtgacaccatc

SEQ ID NO: 1185839 - DNA, 22 bp, Artificial Sequence
  chemically synthesized
taataaaattttgatggtgtca

SEQ ID NO: 1185840 - DNA, 22 bp, Artificial Sequence
  chemically synthesized
caatgagagggtgacaccatca

SEQ ID NO: 1185841 - DNA, 22 bp, Artificial Sequence
  chemically synthesized
aatgagagggtgacaccatcaa

SEQ ID NO: 1185842 - DNA, 22 bp, Artificial Sequence
  chemically synthesized
ctttaataaaattttgatggtg

SEQ ID NO: 1185843 - DNA, 22 bp, Artificial Sequence
  chemically synthesized
actttaataaaattttgatggt

SEQ ID NO: 1185844 - DNA, 22 bp, Artificial Sequence
  chemically synthesized
aagaatttactttaataaaatt

SEQ ID NO: 1185845 - DNA, 22 bp, Artificial Sequence
  chemically synthesized
aaagaatttactttaataaaat

SEQ ID NO: 1185846 - DNA, 22 bp, Artificial Sequence
  chemically synthesized
tacttaaagaatttactttaat

SEQ ID NO: 1185847 - DNA, 22 bp, Artificial Sequence
  chemically synthesized
tgtacttaaagaatttacttta

SEQ ID NO: 1185848 - DNA, 22 bp, Artificial Sequence
  chemically synthesized
tattaaagtaaattctttaagt

SEQ ID NO: 1185849 - DNA, 22 bp, Artificial Sequence
  chemically synthesized
attaaagtaaattctttaagta

SEQ ID NO: 1185850 - DNA, 22 bp, Artificial Sequence
  chemically synthesized
ttaaagtaaattctttaagtac

SEQ ID NO: 1185851 - DNA, 22 bp, Artificial Sequence
  chemically synthesized
cagcaatccattctgtacttaa

SEQ ID NO: 1185852 - DNA, 22 bp, Artificial Sequence
  chemically synthesized
aagtaaattctttaagtacaga

SEQ ID NO: 1185853 - DNA, 22 bp, Artificial Sequence
  chemically synthesized
ctccagcaatccattctgtact

SEQ ID NO: 1185854 - DNA, 22 bp, Artificial Sequence
  chemically synthesized
cctccagcaatccattctgtac

SEQ ID NO: 1185855 - DNA, 22 bp, Artificial Sequence
  chemically synthesized
tcctccagcaatccattctgta

SEQ ID NO: 1185856 - DNA, 22 bp, Artificial Sequence
  chemically synthesized
tttaagtacagaatggattgct

SEQ ID NO: 1185857 - DNA, 22 bp, Artificial Sequence
  chemically synthesized
aagttttcctccagcaatccat

SEQ ID NO: 1185858 - DNA, 22 bp, Artificial Sequence
  chemically synthesized
taagtacagaatggattgctgg

SEQ ID NO: 1185859 - DNA, 22 bp, Artificial Sequence
  chemically synthesized
tcaagttttcctccagcaatcc

SEQ ID NO: 1185860 - DNA, 22 bp, Artificial Sequence
  chemically synthesized
aagtacagaatggattgctgga

SEQ ID NO: 1185861 - DNA, 22 bp, Artificial Sequence
  chemically synthesized
agtacagaatggattgctggag

SEQ ID NO: 1185862 - DNA, 22 bp, Artificial Sequence
  chemically synthesized
tctcaagttttcctccagcaat

SEQ ID NO: 1185863 - DNA, 22 bp, Artificial Sequence
  chemically synthesized
ctctcaagttttcctccagcaa

SEQ ID NO: 1185864 - DNA, 22 bp, Artificial Sequence
  chemically synthesized
tttctctcaagttttcctccag

SEQ ID NO: 1185865 - DNA, 22 bp, Artificial Sequence
  chemically synthesized
ctatttctctcaagttttcctc

SEQ ID NO: 1185866 - DNA, 22 bp, Artificial Sequence
  chemically synthesized
gcctcctatttctctcaagttt

SEQ ID NO: 1185867 - DNA, 22 bp, Artificial Sequence
  chemically synthesized
ctggaggaaaacttgagagaaa

SEQ ID NO: 1185868 - DNA, 22 bp, Artificial Sequence
  chemically synthesized
gaggaaaacttgagagaaatag

SEQ ID NO: 1185869 - DNA, 22 bp, Artificial Sequence
  chemically synthesized
tggtcctagcctcctatttctc

SEQ ID NO: 1185870 - DNA, 22 bp, Artificial Sequence
  chemically synthesized
gattatggtcctagcctcctat

SEQ ID NO: 1185871 - DNA, 22 bp, Artificial Sequence
  chemically synthesized
gagagaaataggaggctaggac

SEQ ID NO: 1185872 - DNA, 22 bp, Artificial Sequence
  chemically synthesized
agagaaataggaggctaggacc

SEQ ID NO: 1185873 - DNA, 22 bp, Artificial Sequence
  chemically synthesized
tatctggattatggtcctagcc

SEQ ID NO: 1185874 - DNA, 22 bp, Artificial Sequence
  chemically synthesized
atatctggattatggtcctagc

SEQ ID NO: 1185875 - DNA, 22 bp, Artificial Sequence
  chemically synthesized
tatatctggattatggtcctag

SEQ ID NO: 1185876 - DNA, 22 bp, Artificial Sequence
  chemically synthesized
aacactttatatctggattatg

SEQ ID NO: 1185877 - DNA, 22 bp, Artificial Sequence
  chemically synthesized
gaacactttatatctggattat

SEQ ID NO: 1185878 - DNA, 22 bp, Artificial Sequence
  chemically synthesized
gatcttgaacactttatatctg

SEQ ID NO: 1185879 - DNA, 22 bp, Artificial Sequence
  chemically synthesized
ggaccataatccagatataaag

SEQ ID NO: 1185880 - DNA, 22 bp, Artificial Sequence
  chemically synthesized
agatcttgaacactttatatct

SEQ ID NO: 1185881 - DNA, 22 bp, Artificial Sequence
  chemically synthesized
taccttagatcttgaacacttt

SEQ ID NO: 1185882 - DNA, 22 bp, Artificial Sequence
  chemically synthesized
ccccgtacacagttgtacctta

SEQ ID NO: 1185883 - DNA, 22 bp, Artificial Sequence
  chemically synthesized
cccccgtacacagttgtacctt

SEQ ID NO: 1185884 - DNA, 22 bp, Artificial Sequence
  chemically synthesized
atttcccccgtacacagttgta

SEQ ID NO: 1185885 - DNA, 22 bp, Artificial Sequence
  chemically synthesized
aagatctaaggtacaactgtgt

SEQ ID NO: 1185886 - DNA, 22 bp, Artificial Sequence
  chemically synthesized
catttcccccgtacacagttgt

SEQ ID NO: 1185887 - DNA, 22 bp, Artificial Sequence
  chemically synthesized
tcatttcccccgtacacagttg

SEQ ID NO: 1185888 - DNA, 22 bp, Artificial Sequence
  chemically synthesized
ttttcatttcccccgtacacag

SEQ ID NO: 1185889 - DNA, 22 bp, Artificial Sequence
  chemically synthesized
gttttcatttcccccgtacaca

SEQ ID NO: 1185890 - DNA, 22 bp, Artificial Sequence
  chemically synthesized
aggtacaactgtgtacggggga

SEQ ID NO: 1185891 - DNA, 22 bp, Artificial Sequence
  chemically synthesized
acttgttttcatttcccccgta

SEQ ID NO: 1185892 - DNA, 22 bp, Artificial Sequence
  chemically synthesized
attgacttgttttcatttcccc

SEQ ID NO: 1185893 - DNA, 22 bp, Artificial Sequence
  chemically synthesized
tgtacgggggaaatgaaaacaa

SEQ ID NO: 1185894 - DNA, 22 bp, Artificial Sequence
  chemically synthesized
tcattcattgacttgttttcat

SEQ ID NO: 1185895 - DNA, 22 bp, Artificial Sequence
  chemically synthesized
gtcattcattgacttgttttca

SEQ ID NO: 1185896 - DNA, 22 bp, Artificial Sequence
  chemically synthesized
tgtcattcattgacttgttttc

SEQ ID NO: 1185897 - DNA, 22 bp, Artificial Sequence
  chemically synthesized
ttgtcattcattgacttgtttt

SEQ ID NO: 1185898 - DNA, 22 bp, Artificial Sequence
  chemically synthesized
gaatttttgtcattcattgact

SEQ ID NO: 1185899 - DNA, 22 bp, Artificial Sequence
  chemically synthesized
agaatttttgtcattcattgac

SEQ ID NO: 1185900 - DNA, 22 bp, Artificial Sequence
  chemically synthesized
atccatcttagaatttttgtca

SEQ ID NO: 1185901 - DNA, 22 bp, Artificial Sequence
  chemically synthesized
gatccatcttagaatttttgtc

SEQ ID NO: 1185902 - DNA, 22 bp, Artificial Sequence
  chemically synthesized
tgatccatcttagaatttttgt

SEQ ID NO: 1185903 - DNA, 22 bp, Artificial Sequence
  chemically synthesized
ttgatccatcttagaatttttg

SEQ ID NO: 1185904 - DNA, 22 bp, Artificial Sequence
  chemically synthesized
aatgaagtcatttttgatccat

SEQ ID NO: 1185905 - DNA, 22 bp, Artificial Sequence
  chemically synthesized
aaaattgaatgaagtcattttt

SEQ ID NO: 1185906 - DNA, 22 bp, Artificial Sequence
  chemically synthesized
taagatggatcaaaaatgactt

SEQ ID NO: 1185907 - DNA, 22 bp, Artificial Sequence
  chemically synthesized
gaaaattgaatgaagtcatttt

SEQ ID NO: 1185908 - DNA, 22 bp, Artificial Sequence
  chemically synthesized
agatggatcaaaaatgacttca

SEQ ID NO: 1185909 - DNA, 22 bp, Artificial Sequence
  chemically synthesized
tggagtaaatgatttgaaaatt

SEQ ID NO: 1185910 - DNA, 22 bp, Artificial Sequence
  chemically synthesized
cattcaattttcaaatcattta

SEQ ID NO: 1185911 - DNA, 22 bp, Artificial Sequence
  chemically synthesized
attcaattttcaaatcatttac

SEQ ID NO: 1185912 - DNA, 22 bp, Artificial Sequence
  chemically synthesized
caaagactgtggagtaaatgat

SEQ ID NO: 1185913 - DNA, 22 bp, Artificial Sequence
  chemically synthesized
ccaaagactgtggagtaaatga

SEQ ID NO: 1185914 - DNA, 22 bp, Artificial Sequence
  chemically synthesized
aattttcaaatcatttactcca

SEQ ID NO: 1185915 - DNA, 22 bp, Artificial Sequence
  chemically synthesized
tcaaatcatttactccacagtc

SEQ ID NO: 1185916 - DNA, 22 bp, Artificial Sequence
  chemically synthesized
caaatcatttactccacagtct

SEQ ID NO: 1185917 - DNA, 22 bp, Artificial Sequence
  chemically synthesized
aaatcatttactccacagtctt

SEQ ID NO: 1185918 - DNA, 22 bp, Artificial Sequence
  chemically synthesized
tatataggcatttccaaagact

SEQ ID NO: 1185919 - DNA, 22 bp, Artificial Sequence
  chemically synthesized
gtatataggcatttccaaagac

SEQ ID NO: 1185920 - DNA, 22 bp, Artificial Sequence
  chemically synthesized
tgtatataggcatttccaaaga

SEQ ID NO: 1185921 - DNA, 22 bp, Artificial Sequence
  chemically synthesized
actccacagtctttggaaatgc

SEQ ID NO: 1185922 - DNA, 22 bp, Artificial Sequence
  chemically synthesized
ctccacagtctttggaaatgcc

SEQ ID NO: 1185923 - DNA, 22 bp, Artificial Sequence
  chemically synthesized
cacagtctttggaaatgcctat

SEQ ID NO: 1185924 - DNA, 22 bp, Artificial Sequence
  chemically synthesized
tagcacataactttgtatatag

SEQ ID NO: 1185925 - DNA, 22 bp, Artificial Sequence
  chemically synthesized
tggaaatgcctatatacaaagt

SEQ ID NO: 1185926 - DNA, 22 bp, Artificial Sequence
  chemically synthesized
ggaaatgcctatatacaaagtt

SEQ ID NO: 1185927 - DNA, 22 bp, Artificial Sequence
  chemically synthesized
gaaatgcctatatacaaagtta

SEQ ID NO: 1185928 - DNA, 22 bp, Artificial Sequence
  chemically synthesized
aggctgtagcacataactttgt

SEQ ID NO: 1185929 - DNA, 22 bp, Artificial Sequence
  chemically synthesized
tatcctaaggctgtagcacata

SEQ ID NO: 1185930 - DNA, 22 bp, Artificial Sequence
  chemically synthesized
atatcctaaggctgtagcacat

SEQ ID NO: 1185931 - DNA, 22 bp, Artificial Sequence
  chemically synthesized
tatacaaagttatgtgctacag

SEQ ID NO: 1185932 - DNA, 22 bp, Artificial Sequence
  chemically synthesized
tatatcctaaggctgtagcaca

SEQ ID NO: 1185933 - DNA, 22 bp, Artificial Sequence
  chemically synthesized
atctttatatcctaaggctgta

SEQ ID NO: 1185934 - DNA, 22 bp, Artificial Sequence
  chemically synthesized
ttaatctttatatcctaaggct

SEQ ID NO: 1185935 - DNA, 22 bp, Artificial Sequence
  chemically synthesized
attaatctttatatcctaaggc

SEQ ID NO: 1185936 - DNA, 22 bp, Artificial Sequence
  chemically synthesized
tgtgctacagccttaggatata

SEQ ID NO: 1185937 - DNA, 22 bp, Artificial Sequence
  chemically synthesized
tcagtttattaatctttatatc

SEQ ID NO: 1185938 - DNA, 22 bp, Artificial Sequence
  chemically synthesized
cagccttaggatataaagatta

SEQ ID NO: 1185939 - DNA, 22 bp, Artificial Sequence
  chemically synthesized
ttgtcagtttattaatctttat

SEQ ID NO: 1185940 - DNA, 22 bp, Artificial Sequence
  chemically synthesized
attgtcagtttattaatcttta

SEQ ID NO: 1185941 - DNA, 22 bp, Artificial Sequence
  chemically synthesized
tattgtcagtttattaatcttt

SEQ ID NO: 1185942 - DNA, 22 bp, Artificial Sequence
  chemically synthesized
ttttattgtcagtttattaatc

SEQ ID NO: 1185943 - DNA, 22 bp, Artificial Sequence
  chemically synthesized
gttttattgtcagtttattaat

SEQ ID NO: 1185944 - DNA, 22 bp, Artificial Sequence
  chemically synthesized
aggatataaagattaataaact

SEQ ID NO: 1185945 - DNA, 22 bp, Artificial Sequence
  chemically synthesized
tgttttattgtcagtttattaa

SEQ ID NO: 1185946 - DNA, 22 bp, Artificial Sequence
  chemically synthesized
ggatataaagattaataaactg

SEQ ID NO: 1185947 - DNA, 22 bp, Artificial Sequence
  chemically synthesized
ctttgttttattgtcagtttat

SEQ ID NO: 1185948 - DNA, 22 bp, Artificial Sequence
  chemically synthesized
ctcctttgttttattgtcagtt

SEQ ID NO: 1185949 - DNA, 22 bp, Artificial Sequence
  chemically synthesized
cctcctttgttttattgtcagt

SEQ ID NO: 1185950 - DNA, 22 bp, Artificial Sequence
  chemically synthesized
ttcctcctttgttttattgtca

SEQ ID NO: 1185951 - DNA, 22 bp, Artificial Sequence
  chemically synthesized
ataaactgacaataaaacaaag

SEQ ID NO: 1185952 - DNA, 22 bp, Artificial Sequence
  chemically synthesized
gtcctcttcctcctttgtttta

SEQ ID NO: 1185953 - DNA, 22 bp, Artificial Sequence
  chemically synthesized
cgtcctcttcctcctttgtttt

SEQ ID NO: 1185954 - DNA, 22 bp, Artificial Sequence
  chemically synthesized
tcgtcctcttcctcctttgttt

SEQ ID NO: 1185955 - DNA, 22 bp, Artificial Sequence
  chemically synthesized
tttcgtcctcttcctcctttgt

SEQ ID NO: 1185956 - DNA, 22 bp, Artificial Sequence
  chemically synthesized
acaataaaacaaaggaggaaga

SEQ ID NO: 1185957 - DNA, 22 bp, Artificial Sequence
  chemically synthesized
cagaacaatcagtgtcctcttt

SEQ ID NO: 1185958 - DNA, 22 bp, Artificial Sequence
  chemically synthesized
ccatggctgcagaacaatcagt

SEQ ID NO: 1185959 - DNA, 22 bp, Artificial Sequence
  chemically synthesized
ttaccatggctgcagaacaatc

SEQ ID NO: 1185960 - DNA, 22 bp, Artificial Sequence
  chemically synthesized
gttaccatggctgcagaacaat

SEQ ID NO: 1185961 - DNA, 22 bp, Artificial Sequence
  chemically synthesized
cttgttaccatggctgcagaac

SEQ ID NO: 1185962 - DNA, 22 bp, Artificial Sequence
  chemically synthesized
gtgtctacttgttaccatggct

SEQ ID NO: 1185963 - DNA, 22 bp, Artificial Sequence
  chemically synthesized
attgttctgcagccatggtaac

SEQ ID NO: 1185964 - DNA, 22 bp, Artificial Sequence
  chemically synthesized
ttggtgtctacttgttaccatg

SEQ ID NO: 1185965 - DNA, 22 bp, Artificial Sequence
  chemically synthesized
gttggtgtctacttgttaccat

SEQ ID NO: 1185966 - DNA, 22 bp, Artificial Sequence
  chemically synthesized
tgttggtgtctacttgttacca

SEQ ID NO: 1185967 - DNA, 22 bp, Artificial Sequence
  chemically synthesized
ttctgcagccatggtaacaagt

SEQ ID NO: 1185968 - DNA, 22 bp, Artificial Sequence
  chemically synthesized
ttgttggtgtctacttgttacc

SEQ ID NO: 1185969 - DNA, 22 bp, Artificial Sequence
  chemically synthesized
tgcagccatggtaacaagtaga

SEQ ID NO: 1185970 - DNA, 22 bp, Artificial Sequence
  chemically synthesized
cagccatggtaacaagtagaca

SEQ ID NO: 1185971 - DNA, 22 bp, Artificial Sequence
  chemically synthesized
aaacttttgttggtgtctactt

SEQ ID NO: 1185972 - DNA, 22 bp, Artificial Sequence
  chemically synthesized
aatgaataaatagggtagattg

SEQ ID NO: 1185973 - DNA, 22 bp, Artificial Sequence
  chemically synthesized
ttaaatgaataaatagggtaga

SEQ ID NO: 1185974 - DNA, 22 bp, Artificial Sequence
  chemically synthesized
attgttaaatgaataaataggg

SEQ ID NO: 1185975 - DNA, 22 bp, Artificial Sequence
  chemically synthesized
caatctaccctatttattcatt

SEQ ID NO: 1185976 - DNA, 22 bp, Artificial Sequence
  chemically synthesized
aatctaccctatttattcattt

SEQ ID NO: 1185977 - DNA, 22 bp, Artificial Sequence
  chemically synthesized
ccctatttattcatttaacaat

SEQ ID NO: 1185978 - DNA, 22 bp, Artificial Sequence
  chemically synthesized
tttattcatttaacaattagtt

SEQ ID NO: 1185979 - DNA, 22 bp, Artificial Sequence
  chemically synthesized
attcatttaacaattagttcct

SEQ ID NO: 1185980 - DNA, 22 bp, Artificial Sequence
  chemically synthesized
ttcatttaacaattagttcctc

SEQ ID NO: 1185981 - DNA, 22 bp, Artificial Sequence
  chemically synthesized
atttaacaattagttcctccat

SEQ ID NO: 1185982 - DNA, 22 bp, Artificial Sequence
  chemically synthesized
aacaattagttcctccatgatt

SEQ ID NO: 1185983 - DNA, 22 bp, Artificial Sequence
  chemically synthesized
acaattagttcctccatgattc

SEQ ID NO: 1185984 - DNA, 22 bp, Artificial Sequence
  chemically synthesized
ggggaagcatgataagaatcat

SEQ ID NO: 1185985 - DNA, 22 bp, Artificial Sequence
  chemically synthesized
gttcctccatgattcttatcat

SEQ ID NO: 1185986 - DNA, 22 bp, Artificial Sequence
  chemically synthesized
gctgggggaagcatgataagaa

SEQ ID NO: 1185987 - DNA, 22 bp, Artificial Sequence
  chemically synthesized
ctccatgattcttatcatgctt

SEQ ID NO: 1185988 - DNA, 22 bp, Artificial Sequence
  chemically synthesized
gttggctgggggaagcatgata

SEQ ID NO: 1185989 - DNA, 22 bp, Artificial Sequence
  chemically synthesized
catgattcttatcatgcttccc

SEQ ID NO: 1185990 - DNA, 22 bp, Artificial Sequence
  chemically synthesized
ctggttggctgggggaagcatg

SEQ ID NO: 1185991 - DNA, 22 bp, Artificial Sequence
  chemically synthesized
ctgctggttggctgggggaagc

SEQ ID NO: 1185992 - DNA, 22 bp, Artificial Sequence
  chemically synthesized
gctgctggttggctgggggaag

SEQ ID NO: 1185993 - DNA, 22 bp, Artificial Sequence
  chemically synthesized
ttatcatgcttcccccagccaa

SEQ ID NO: 1185994 - DNA, 22 bp, Artificial Sequence
  chemically synthesized
atcatgcttcccccagccaacc

SEQ ID NO: 1185995 - DNA, 22 bp, Artificial Sequence
  chemically synthesized
tcatgcttcccccagccaacca

SEQ ID NO: 1185996 - DNA, 22 bp, Artificial Sequence
  chemically synthesized
agaagggagtgtttgctgctgg

SEQ ID NO: 1185997 - DNA, 22 bp, Artificial Sequence
  chemically synthesized
cccccagccaaccagcagcaaa

SEQ ID NO: 1185998 - DNA, 22 bp, Artificial Sequence
  chemically synthesized
cagaagggagtgtttgctgctg

SEQ ID NO: 1185999 - DNA, 22 bp, Artificial Sequence
  chemically synthesized
ccccagccaaccagcagcaaac

SEQ ID NO: 1186000 - DNA, 22 bp, Artificial Sequence
  chemically synthesized
gcaaagtttcagaagggagtgt

SEQ ID NO: 1186001 - DNA, 22 bp, Artificial Sequence
  chemically synthesized
tggcaaagtttcagaagggagt

SEQ ID NO: 1186002 - DNA, 22 bp, Artificial Sequence
  chemically synthesized
aagtgaatccactctggcaaag

SEQ ID NO: 1186003 - DNA, 22 bp, Artificial Sequence
  chemically synthesized
ccttctgaaactttgccagagt

SEQ ID NO: 1186004 - DNA, 22 bp, Artificial Sequence
  chemically synthesized
attgaagtgaatccactctggc

SEQ ID NO: 1186005 - DNA, 22 bp, Artificial Sequence
  chemically synthesized
cattgaagtgaatccactctgg

SEQ ID NO: 1186006 - DNA, 22 bp, Artificial Sequence
  chemically synthesized
ctgaaactttgccagagtggat

SEQ ID NO: 1186007 - DNA, 22 bp, Artificial Sequence
  chemically synthesized
tgaaactttgccagagtggatt

SEQ ID NO: 1186008 - DNA, 22 bp, Artificial Sequence
  chemically synthesized
aaactttgccagagtggattca

SEQ ID NO: 1186009 - DNA, 22 bp, Artificial Sequence
  chemically synthesized
tcttcattgaagtgaatccact

SEQ ID NO: 1186010 - DNA, 22 bp, Artificial Sequence
  chemically synthesized
tgccagagtggattcacttcaa

SEQ ID NO: 1186011 - DNA, 22 bp, Artificial Sequence
  chemically synthesized
gccagagtggattcacttcaat

SEQ ID NO: 1186012 - DNA, 22 bp, Artificial Sequence
  chemically synthesized
agaattatcttcattgaagtga

SEQ ID NO: 1186013 - DNA, 22 bp, Artificial Sequence
  chemically synthesized
ccagagtggattcacttcaatg

SEQ ID NO: 1186014 - DNA, 22 bp, Artificial Sequence
  chemically synthesized
gagaattatcttcattgaagtg

SEQ ID NO: 1186015 - DNA, 22 bp, Artificial Sequence
  chemically synthesized
gtttgagaattatcttcattga

SEQ ID NO: 1186016 - DNA, 22 bp, Artificial Sequence
  chemically synthesized
attagtttgagaattatcttca

SEQ ID NO: 1186017 - DNA, 22 bp, Artificial Sequence
  chemically synthesized
ttaattagtttgagaattatct

SEQ ID NO: 1186018 - DNA, 22 bp, Artificial Sequence
  chemically synthesized
acttcaatgaagataattctca

SEQ ID NO: 1186019 - DNA, 22 bp, Artificial Sequence
  chemically synthesized
caatgaagataattctcaaact

SEQ ID NO: 1186020 - DNA, 22 bp, Artificial Sequence
  chemically synthesized
aatgaagataattctcaaacta

SEQ ID NO: 1186021 - DNA, 22 bp, Artificial Sequence
  chemically synthesized
aggtgagaccattgttaattag

SEQ ID NO: 1186022 - DNA, 22 bp, Artificial Sequence
  chemically synthesized
tcaaactaattaacaatggtct

SEQ ID NO: 1186023 - DNA, 22 bp, Artificial Sequence
  chemically synthesized
aaactaattaacaatggtctca

SEQ ID NO: 1186024 - DNA, 22 bp, Artificial Sequence
  chemically synthesized
attaacaatggtctcacctgag

SEQ ID NO: 1186025 - DNA, 22 bp, Artificial Sequence
  chemically synthesized
gaagcgtggtaactcaggtgag

SEQ ID NO: 1186026 - DNA, 22 bp, Artificial Sequence
  chemically synthesized
agaagcgtggtaactcaggtga

SEQ ID NO: 1186027 - DNA, 22 bp, Artificial Sequence
  chemically synthesized
tagaagcgtggtaactcaggtg

SEQ ID NO: 1186028 - DNA, 22 bp, Artificial Sequence
  chemically synthesized
acaatggtctcacctgagttac

SEQ ID NO: 1186029 - DNA, 22 bp, Artificial Sequence
  chemically synthesized
acctgagttaccacgcttctaa

SEQ ID NO: 1186030 - DNA, 22 bp, Artificial Sequence
  chemically synthesized
agttaccacgcttctaaagcta

SEQ ID NO: 1186031 - DNA, 22 bp, Artificial Sequence
  chemically synthesized
ggaataggatgatgatagcttt

SEQ ID NO: 1186032 - DNA, 22 bp, Artificial Sequence
  chemically synthesized
ccacgcttctaaagctatcatc

SEQ ID NO: 1186033 - DNA, 22 bp, Artificial Sequence
  chemically synthesized
agattgggaataggatgatgat

SEQ ID NO: 1186034 - DNA, 22 bp, Artificial Sequence
  chemically synthesized
cagattgggaataggatgatga

SEQ ID NO: 1186035 - DNA, 22 bp, Artificial Sequence
  chemically synthesized
ctaaagctatcatcatcctatt

SEQ ID NO: 1186036 - DNA, 22 bp, Artificial Sequence
  chemically synthesized
taaagctatcatcatcctattc

SEQ ID NO: 1186037 - DNA, 22 bp, Artificial Sequence
  chemically synthesized
aagctatcatcatcctattccc

SEQ ID NO: 1186038 - DNA, 22 bp, Artificial Sequence
  chemically synthesized
agaacatttcagattgggaata

SEQ ID NO: 1186039 - DNA, 22 bp, Artificial Sequence
  chemically synthesized
tcatcatcctattcccaatctg

SEQ ID NO: 1186040 - DNA, 22 bp, Artificial Sequence
  chemically synthesized
ttcccaatctgaaatgttctta

SEQ ID NO: 1186041 - DNA, 22 bp, Artificial Sequence
  chemically synthesized
ccaatctgaaatgttcttagat

SEQ ID NO: 1186042 - DNA, 22 bp, Artificial Sequence
  chemically synthesized
aaatgttcttagattgctggac

SEQ ID NO: 1186043 - DNA, 22 bp, Artificial Sequence
  chemically synthesized
cggggggagtcagaagtccagc

SEQ ID NO: 1186044 - DNA, 22 bp, Artificial Sequence
  chemically synthesized
gcggggggagtcagaagtccag

SEQ ID NO: 1186045 - DNA, 22 bp, Artificial Sequence
  chemically synthesized
tgcggggggagtcagaagtcca

SEQ ID NO: 1186046 - DNA, 22 bp, Artificial Sequence
  chemically synthesized
ttagattgctggacttctgact

SEQ ID NO: 1186047 - DNA, 22 bp, Artificial Sequence
  chemically synthesized
agattgctggacttctgactcc

SEQ ID NO: 1186048 - DNA, 22 bp, Artificial Sequence
  chemically synthesized
ggttttgcggggggagtcagaa

SEQ ID NO: 1186049 - DNA, 22 bp, Artificial Sequence
  chemically synthesized
gattgctggacttctgactccc

SEQ ID NO: 1186050 - DNA, 22 bp, Artificial Sequence
  chemically synthesized
aggttttgcggggggagtcaga

SEQ ID NO: 1186051 - DNA, 22 bp, Artificial Sequence
  chemically synthesized
ttaggttttgcggggggagtca

SEQ ID NO: 1186052 - DNA, 22 bp, Artificial Sequence
  chemically synthesized
ctggacttctgactccccccgc

SEQ ID NO: 1186053 - DNA, 22 bp, Artificial Sequence
  chemically synthesized
gacttctgactccccccgcaaa

SEQ ID NO: 1186054 - DNA, 22 bp, Artificial Sequence
  chemically synthesized
ctgactccccccgcaaaaccta

SEQ ID NO: 1186055 - DNA, 22 bp, Artificial Sequence
  chemically synthesized
tgactccccccgcaaaacctaa

SEQ ID NO: 1186056 - DNA, 22 bp, Artificial Sequence
  chemically synthesized
actccccccgcaaaacctaaga

SEQ ID NO: 1186057 - DNA, 22 bp, Artificial Sequence
  chemically synthesized
aaaggagcgtattcttaggttt

SEQ ID NO: 1186058 - DNA, 22 bp, Artificial Sequence
  chemically synthesized
tgaaaggagcgtattcttaggt

SEQ ID NO: 1186059 - DNA, 22 bp, Artificial Sequence
  chemically synthesized
cccccgcaaaacctaagaatac

SEQ ID NO: 1186060 - DNA, 22 bp, Artificial Sequence
  chemically synthesized
gtcaaccacagtctctgaaagg

SEQ ID NO: 1186061 - DNA, 22 bp, Artificial Sequence
  chemically synthesized
agaatacgctcctttcagagac

SEQ ID NO: 1186062 - DNA, 22 bp, Artificial Sequence
  chemically synthesized
ctggtcaaccacagtctctgaa

SEQ ID NO: 1186063 - DNA, 22 bp, Artificial Sequence
  chemically synthesized
ctttcagagactgtggttgacc

SEQ ID NO: 1186064 - DNA, 22 bp, Artificial Sequence
  chemically synthesized
tcagagactgtggttgaccagg

SEQ ID NO: 1186065 - DNA, 22 bp, Artificial Sequence
  chemically synthesized
cagagactgtggttgaccagga

SEQ ID NO: 1186066 - DNA, 22 bp, Artificial Sequence
  chemically synthesized
agagactgtggttgaccaggag

SEQ ID NO: 1186067 - DNA, 22 bp, Artificial Sequence
  chemically synthesized
aataagagggaatgctcctggt

SEQ ID NO: 1186068 - DNA, 22 bp, Artificial Sequence
  chemically synthesized
aaataagagggaatgctcctgg

SEQ ID NO: 1186069 - DNA, 22 bp, Artificial Sequence
  chemically synthesized
tggttgaccaggagcattccct

SEQ ID NO: 1186070 - DNA, 22 bp, Artificial Sequence
  chemically synthesized
ataacatcttaaataagaggga

SEQ ID NO: 1186071 - DNA, 22 bp, Artificial Sequence
  chemically synthesized
accaggagcattccctcttatt

SEQ ID NO: 1186072 - DNA, 22 bp, Artificial Sequence
  chemically synthesized
cataacatcttaaataagaggg

SEQ ID NO: 1186073 - DNA, 22 bp, Artificial Sequence
  chemically synthesized
ggcttcataacatcttaaataa

SEQ ID NO: 1186074 - DNA, 22 bp, Artificial Sequence
  chemically synthesized
gggcttcataacatcttaaata

SEQ ID NO: 1186075 - DNA, 22 bp, Artificial Sequence
  chemically synthesized
gatttgggcttcataacatctt

SEQ ID NO: 1186076 - DNA, 22 bp, Artificial Sequence
  chemically synthesized
cctcttatttaagatgttatga

SEQ ID NO: 1186077 - DNA, 22 bp, Artificial Sequence
  chemically synthesized
ttatttaagatgttatgaagcc

SEQ ID NO: 1186078 - DNA, 22 bp, Artificial Sequence
  chemically synthesized
aacattggatttgggcttcata

SEQ ID NO: 1186079 - DNA, 22 bp, Artificial Sequence
  chemically synthesized
atttaagatgttatgaagccca

SEQ ID NO: 1186080 - DNA, 22 bp, Artificial Sequence
  chemically synthesized
tttaagatgttatgaagcccaa

SEQ ID NO: 1186081 - DNA, 22 bp, Artificial Sequence
  chemically synthesized
ctaaacattggatttgggcttc

SEQ ID NO: 1186082 - DNA, 22 bp, Artificial Sequence
  chemically synthesized
actaaacattggatttgggctt

SEQ ID NO: 1186083 - DNA, 22 bp, Artificial Sequence
  chemically synthesized
aagatgttatgaagcccaaatc

SEQ ID NO: 1186084 - DNA, 22 bp, Artificial Sequence
  chemically synthesized
tactaaacattggatttgggct

SEQ ID NO: 1186085 - DNA, 22 bp, Artificial Sequence
  chemically synthesized
agatgttatgaagcccaaatcc

SEQ ID NO: 1186086 - DNA, 22 bp, Artificial Sequence
  chemically synthesized
cagttttactaaacattggatt

SEQ ID NO: 1186087 - DNA, 22 bp, Artificial Sequence
  chemically synthesized
acagttttactaaacattggat

SEQ ID NO: 1186088 - DNA, 22 bp, Artificial Sequence
  chemically synthesized
tacagttttactaaacattgga

SEQ ID NO: 1186089 - DNA, 22 bp, Artificial Sequence
  chemically synthesized
tgaagcccaaatccaatgttta

SEQ ID NO: 1186090 - DNA, 22 bp, Artificial Sequence
  chemically synthesized
aacaaactttacagttttacta

SEQ ID NO: 1186091 - DNA, 22 bp, Artificial Sequence
  chemically synthesized
aggttcaacaaactttacagtt

SEQ ID NO: 1186092 - DNA, 22 bp, Artificial Sequence
  chemically synthesized
agtaaaactgtaaagtttgttg

SEQ ID NO: 1186093 - DNA, 22 bp, Artificial Sequence
  chemically synthesized
gtaaaactgtaaagtttgttga

SEQ ID NO: 1186094 - DNA, 22 bp, Artificial Sequence
  chemically synthesized
taaagtttgttgaaccttaata

SEQ ID NO: 1186095 - DNA, 22 bp, Artificial Sequence
  chemically synthesized
gttgaaccttaataccattact

SEQ ID NO: 1186096 - DNA, 22 bp, Artificial Sequence
  chemically synthesized
ttgaaccttaataccattacta

SEQ ID NO: 1186097 - DNA, 22 bp, Artificial Sequence
  chemically synthesized
aaccttaataccattactatgt

SEQ ID NO: 1186098 - DNA, 22 bp, Artificial Sequence
  chemically synthesized
aataccattactatgttgcatt

SEQ ID NO: 1186099 - DNA, 22 bp, Artificial Sequence
  chemically synthesized
ataccattactatgttgcattt

SEQ ID NO: 1186100 - DNA, 22 bp, Artificial Sequence
  chemically synthesized
ctatgttgcatttttttgtcat

SEQ ID NO: 1186101 - DNA, 22 bp, Artificial Sequence
  chemically synthesized
tgttgcatttttttgtcatttt

SEQ ID NO: 1186102 - DNA, 22 bp, Artificial Sequence
  chemically synthesized
catttttttgtcatttttgtca

SEQ ID NO: 1186103 - DNA, 22 bp, Artificial Sequence
  chemically synthesized
ttttgtcatttttgtcatattt

SEQ ID NO: 1186104 - DNA, 22 bp, Artificial Sequence
  chemically synthesized
tttgtcatttttgtcatatttt

SEQ ID NO: 1186105 - DNA, 22 bp, Artificial Sequence
  chemically synthesized
ttgtcatttttgtcatattttt

SEQ ID NO: 1186106 - DNA, 22 bp, Artificial Sequence
  chemically synthesized
tgtcatttttgtcatatttttg

SEQ ID NO: 1186107 - DNA, 22 bp, Artificial Sequence
  chemically synthesized
gtcatttttgtcatatttttgc

SEQ ID NO: 1186108 - DNA, 22 bp, Artificial Sequence
  chemically synthesized
atgatagaaacagcaaaaatat

SEQ ID NO: 1186109 - DNA, 22 bp, Artificial Sequence
  chemically synthesized
tcatttttgtcatatttttgct

SEQ ID NO: 1186110 - DNA, 22 bp, Artificial Sequence
  chemically synthesized
tgttaatgatagaaacagcaaa

SEQ ID NO: 1186111 - DNA, 22 bp, Artificial Sequence
  chemically synthesized
gtgttaatgatagaaacagcaa

SEQ ID NO: 1186112 - DNA, 22 bp, Artificial Sequence
  chemically synthesized
ttgtcatatttttgctgtttct

SEQ ID NO: 1186113 - DNA, 22 bp, Artificial Sequence
  chemically synthesized
tgtgttaatgatagaaacagca

SEQ ID NO: 1186114 - DNA, 22 bp, Artificial Sequence
  chemically synthesized
tgtcatatttttgctgtttcta

SEQ ID NO: 1186115 - DNA, 22 bp, Artificial Sequence
  chemically synthesized
ttgtgttaatgatagaaacagc

SEQ ID NO: 1186116 - DNA, 22 bp, Artificial Sequence
  chemically synthesized
gtcatatttttgctgtttctat

SEQ ID NO: 1186117 - DNA, 22 bp, Artificial Sequence
  chemically synthesized
tcatatttttgctgtttctatc

SEQ ID NO: 1186118 - DNA, 22 bp, Artificial Sequence
  chemically synthesized
tttttgtgttaatgatagaaac

SEQ ID NO: 1186119 - DNA, 22 bp, Artificial Sequence
  chemically synthesized
gtttttgtgttaatgatagaaa

SEQ ID NO: 1186120 - DNA, 22 bp, Artificial Sequence
  chemically synthesized
ggtttgtttttgtgttaatgat

SEQ ID NO: 1186121 - DNA, 22 bp, Artificial Sequence
  chemically synthesized
ttgctgtttctatcattaacac

SEQ ID NO: 1186122 - DNA, 22 bp, Artificial Sequence
  chemically synthesized
tgctgtttctatcattaacaca

SEQ ID NO: 1186123 - DNA, 22 bp, Artificial Sequence
  chemically synthesized
gctgtttctatcattaacacaa

SEQ ID NO: 1186124 - DNA, 22 bp, Artificial Sequence
  chemically synthesized
ctgtttctatcattaacacaaa

SEQ ID NO: 1186125 - DNA, 22 bp, Artificial Sequence
  chemically synthesized
caactaggtttgtttttgtgtt

SEQ ID NO: 1186126 - DNA, 22 bp, Artificial Sequence
  chemically synthesized
tttctatcattaacacaaaaac

SEQ ID NO: 1186127 - DNA, 22 bp, Artificial Sequence
  chemically synthesized
ctacaactaggtttgtttttgt

SEQ ID NO: 1186128 - DNA, 22 bp, Artificial Sequence
  chemically synthesized
ctatcattaacacaaaaacaaa

SEQ ID NO: 1186129 - DNA, 22 bp, Artificial Sequence
  chemically synthesized
tatcattaacacaaaaacaaac

SEQ ID NO: 1186130 - DNA, 22 bp, Artificial Sequence
  chemically synthesized
tcattaacacaaaaacaaacct

SEQ ID NO: 1186131 - DNA, 22 bp, Artificial Sequence
  chemically synthesized
acacaaaaacaaacctagttgt

SEQ ID NO: 1186132 - DNA, 22 bp, Artificial Sequence
  chemically synthesized
atagtatacaaatggtctccta

SEQ ID NO: 1186133 - DNA, 22 bp, Artificial Sequence
  chemically synthesized
ttaatagtatacaaatggtctc

SEQ ID NO: 1186134 - DNA, 22 bp, Artificial Sequence
  chemically synthesized
ctgttaatagtatacaaatggt

SEQ ID NO: 1186135 - DNA, 22 bp, Artificial Sequence
  chemically synthesized
cctgttaatagtatacaaatgg

SEQ ID NO: 1186136 - DNA, 22 bp, Artificial Sequence
  chemically synthesized
gttgtaggagaccatttgtata

SEQ ID NO: 1186137 - DNA, 22 bp, Artificial Sequence
  chemically synthesized
gcttcctgttaatagtatacaa

SEQ ID NO: 1186138 - DNA, 22 bp, Artificial Sequence
  chemically synthesized
taggagaccatttgtatactat

SEQ ID NO: 1186139 - DNA, 22 bp, Artificial Sequence
  chemically synthesized
tggcttcctgttaatagtatac

SEQ ID NO: 1186140 - DNA, 22 bp, Artificial Sequence
  chemically synthesized
ctggcttcctgttaatagtata

SEQ ID NO: 1186141 - DNA, 22 bp, Artificial Sequence
  chemically synthesized
ttctggcttcctgttaatagta

SEQ ID NO: 1186142 - DNA, 22 bp, Artificial Sequence
  chemically synthesized
gtatactattaacaggaagcca

SEQ ID NO: 1186143 - DNA, 22 bp, Artificial Sequence
  chemically synthesized
agtaaattcttctggcttcctg

SEQ ID NO: 1186144 - DNA, 22 bp, Artificial Sequence
  chemically synthesized
tatactattaacaggaagccag

SEQ ID NO: 1186145 - DNA, 22 bp, Artificial Sequence
  chemically synthesized
taagtaaattcttctggcttcc

SEQ ID NO: 1186146 - DNA, 22 bp, Artificial Sequence
  chemically synthesized
ctaagtaaattcttctggcttc

SEQ ID NO: 1186147 - DNA, 22 bp, Artificial Sequence
  chemically synthesized
cttctaagtaaattcttctggc

SEQ ID NO: 1186148 - DNA, 22 bp, Artificial Sequence
  chemically synthesized
ccttctaagtaaattcttctgg

SEQ ID NO: 1186149 - DNA, 22 bp, Artificial Sequence
  chemically synthesized
ttaacaggaagccagaagaatt

SEQ ID NO: 1186150 - DNA, 22 bp, Artificial Sequence
  chemically synthesized
tccttctaagtaaattcttctg

SEQ ID NO: 1186151 - DNA, 22 bp, Artificial Sequence
  chemically synthesized
ttccttctaagtaaattcttct

SEQ ID NO: 1186152 - DNA, 22 bp, Artificial Sequence
  chemically synthesized
tttccttctaagtaaattcttc

SEQ ID NO: 1186153 - DNA, 22 bp, Artificial Sequence
  chemically synthesized
acaggaagccagaagaatttac

SEQ ID NO: 1186154 - DNA, 22 bp, Artificial Sequence
  chemically synthesized
acttagaaggaaaaagcattta

SEQ ID NO: 1186155 - DNA, 22 bp, Artificial Sequence
  chemically synthesized
cttagaaggaaaaagcatttat

SEQ ID NO: 1186156 - DNA, 22 bp, Artificial Sequence
  chemically synthesized
agaaggaaaaagcatttatcac

SEQ ID NO: 1186157 - DNA, 22 bp, Artificial Sequence
  chemically synthesized
gaaggaaaaagcatttatcact

SEQ ID NO: 1186158 - DNA, 22 bp, Artificial Sequence
  chemically synthesized
gcacatatggaataagtgataa

SEQ ID NO: 1186159 - DNA, 22 bp, Artificial Sequence
  chemically synthesized
agcacatatggaataagtgata

SEQ ID NO: 1186160 - DNA, 22 bp, Artificial Sequence
  chemically synthesized
atcacttattccatatgtgcta

SEQ ID NO: 1186161 - DNA, 22 bp, Artificial Sequence
  chemically synthesized
tcacttattccatatgtgctaa

SEQ ID NO: 1186162 - DNA, 22 bp, Artificial Sequence
  chemically synthesized
tagcacatgacaatcacttagc

SEQ ID NO: 1186163 - DNA, 22 bp, Artificial Sequence
  chemically synthesized
attccatatgtgctaagtgatt

SEQ ID NO: 1186164 - DNA, 22 bp, Artificial Sequence
  chemically synthesized
ttccatatgtgctaagtgattg

SEQ ID NO: 1186165 - DNA, 22 bp, Artificial Sequence
  chemically synthesized
tatagcacatgacaatcactta

SEQ ID NO: 1186166 - DNA, 22 bp, Artificial Sequence
  chemically synthesized
catatgtgctaagtgattgtca

SEQ ID NO: 1186167 - DNA, 22 bp, Artificial Sequence
  chemically synthesized
agtatattctatagcacatgac

SEQ ID NO: 1186168 - DNA, 22 bp, Artificial Sequence
  chemically synthesized
agtgattgtcatgtgctataga

SEQ ID NO: 1186169 - DNA, 22 bp, Artificial Sequence
  chemically synthesized
acatagtctaagtatattctat

SEQ ID NO: 1186170 - DNA, 22 bp, Artificial Sequence
  chemically synthesized
tcatgtgctatagaatatactt

SEQ ID NO: 1186171 - DNA, 22 bp, Artificial Sequence
  chemically synthesized
ataatctaacatagtctaagta

SEQ ID NO: 1186172 - DNA, 22 bp, Artificial Sequence
  chemically synthesized
tagaatatacttagactatgtt

SEQ ID NO: 1186173 - DNA, 22 bp, Artificial Sequence
  chemically synthesized
tatactcataatctaacatagt

SEQ ID NO: 1186174 - DNA, 22 bp, Artificial Sequence
  chemically synthesized
ctatatactcataatctaacat

SEQ ID NO: 1186175 - DNA, 22 bp, Artificial Sequence
  chemically synthesized
atctgctatatactcataatct

SEQ ID NO: 1186176 - DNA, 22 bp, Artificial Sequence
  chemically synthesized
agactatgttagattatgagta

SEQ ID NO: 1186177 - DNA, 22 bp, Artificial Sequence
  chemically synthesized
gactatgttagattatgagtat

SEQ ID NO: 1186178 - DNA, 22 bp, Artificial Sequence
  chemically synthesized
tgttagattatgagtatatagc

SEQ ID NO: 1186179 - DNA, 22 bp, Artificial Sequence
  chemically synthesized
tggggtggctcatctgctatat

SEQ ID NO: 1186180 - DNA, 22 bp, Artificial Sequence
  chemically synthesized
gattatgagtatatagcagatg

SEQ ID NO: 1186181 - DNA, 22 bp, Artificial Sequence
  chemically synthesized
taattatggggtggctcatctg

SEQ ID NO: 1186182 - DNA, 22 bp, Artificial Sequence
  chemically synthesized
tgagtatatagcagatgagcca

SEQ ID NO: 1186183 - DNA, 22 bp, Artificial Sequence
  chemically synthesized
ataattatggggtggctcatct

SEQ ID NO: 1186184 - DNA, 22 bp, Artificial Sequence
  chemically synthesized
ccataaaaagtaatgtttataa

SEQ ID NO: 1186185 - DNA, 22 bp, Artificial Sequence
  chemically synthesized
cccataaaaagtaatgtttata

SEQ ID NO: 1186186 - DNA, 22 bp, Artificial Sequence
  chemically synthesized
atttcccataaaaagtaatgtt

SEQ ID NO: 1186187 - DNA, 22 bp, Artificial Sequence
  chemically synthesized
gatttcccataaaaagtaatgt

SEQ ID NO: 1186188 - DNA, 22 bp, Artificial Sequence
  chemically synthesized
tgatttcccataaaaagtaatg

SEQ ID NO: 1186189 - DNA, 22 bp, Artificial Sequence
  chemically synthesized
ttttgatttcccataaaaagta

SEQ ID NO: 1186190 - DNA, 22 bp, Artificial Sequence
  chemically synthesized
attttgatttcccataaaaagt

SEQ ID NO: 1186191 - DNA, 22 bp, Artificial Sequence
  chemically synthesized
taaacattactttttatgggaa

SEQ ID NO: 1186192 - DNA, 22 bp, Artificial Sequence
  chemically synthesized
ctttttatgggaaatcaaaata

SEQ ID NO: 1186193 - DNA, 22 bp, Artificial Sequence
  chemically synthesized
tttatgggaaatcaaaataaat

SEQ ID NO: 1186194 - DNA, 22 bp, Artificial Sequence
  chemically synthesized
ttatgggaaatcaaaataaatg

SEQ ID NO: 1186195 - DNA, 22 bp, Artificial Sequence
  chemically synthesized
tatgggaaatcaaaataaatgt

SEQ ID NO: 1186196 - DNA, 22 bp, Artificial Sequence
  chemically synthesized
atgggaaatcaaaataaatgtt

SEQ ID NO: 1186197 - DNA, 22 bp, Artificial Sequence
  chemically synthesized
tgggaaatcaaaataaatgtta

SEQ ID NO: 1186198 - DNA, 22 bp, Artificial Sequence
  chemically synthesized
ccccgaagtccataacatttat

SEQ ID NO: 1186199 - DNA, 22 bp, Artificial Sequence
  chemically synthesized
tggacttcggggtaatcctcat

SEQ ID NO: 1186200 - DNA, 22 bp, Artificial Sequence
  chemically synthesized
gtgcagtcatcataaatgagga

SEQ ID NO: 1186201 - DNA, 22 bp, Artificial Sequence
  chemically synthesized
agtgcagtcatcataaatgagg

SEQ ID NO: 1186202 - DNA, 22 bp, Artificial Sequence
  chemically synthesized
cggggtaatcctcatttatgat

SEQ ID NO: 1186203 - DNA, 22 bp, Artificial Sequence
  chemically synthesized
ggggtaatcctcatttatgatg

SEQ ID NO: 1186204 - DNA, 22 bp, Artificial Sequence
  chemically synthesized
gccttagtgcagtcatcataaa

SEQ ID NO: 1186205 - DNA, 22 bp, Artificial Sequence
  chemically synthesized
atttatgatgactgcactaagg

SEQ ID NO: 1186206 - DNA, 22 bp, Artificial Sequence
  chemically synthesized
atgatgactgcactaaggccaa

SEQ ID NO: 1186207 - DNA, 22 bp, Artificial Sequence
  chemically synthesized
tgatgactgcactaaggccaat

SEQ ID NO: 1186208 - DNA, 22 bp, Artificial Sequence
  chemically synthesized
cactaaggccaattcctggcac

SEQ ID NO: 1186209 - DNA, 22 bp, Artificial Sequence
  chemically synthesized
ggtgatcacagagtgccaggaa

SEQ ID NO: 1186210 - DNA, 22 bp, Artificial Sequence
  chemically synthesized
aggtgatcacagagtgccagga

SEQ ID NO: 1186211 - DNA, 22 bp, Artificial Sequence
  chemically synthesized
aggccaattcctggcactctgt

SEQ ID NO: 1186212 - DNA, 22 bp, Artificial Sequence
  chemically synthesized
acaaatacttaggtgatcacag

SEQ ID NO: 1186213 - DNA, 22 bp, Artificial Sequence
  chemically synthesized
aacaaatacttaggtgatcaca

SEQ ID NO: 1186214 - DNA, 22 bp, Artificial Sequence
  chemically synthesized
ttaacaaatacttaggtgatca

SEQ ID NO: 1186215 - DNA, 22 bp, Artificial Sequence
  chemically synthesized
ctggcactctgtgatcacctaa

SEQ ID NO: 1186216 - DNA, 22 bp, Artificial Sequence
  chemically synthesized
cttaacaaatacttaggtgatc

SEQ ID NO: 1186217 - DNA, 22 bp, Artificial Sequence
  chemically synthesized
gcactctgtgatcacctaagta

SEQ ID NO: 1186218 - DNA, 22 bp, Artificial Sequence
  chemically synthesized
agtttcttaacaaatacttagg

SEQ ID NO: 1186219 - DNA, 22 bp, Artificial Sequence
  chemically synthesized
tgtgatcacctaagtatttgtt

SEQ ID NO: 1186220 - DNA, 22 bp, Artificial Sequence
  chemically synthesized
tattgagtttcttaacaaatac

SEQ ID NO: 1186221 - DNA, 22 bp, Artificial Sequence
  chemically synthesized
tgatcacctaagtatttgttaa

SEQ ID NO: 1186222 - DNA, 22 bp, Artificial Sequence
  chemically synthesized
tgtattgagtttcttaacaaat

SEQ ID NO: 1186223 - DNA, 22 bp, Artificial Sequence
  chemically synthesized
tcctctgtattgagtttcttaa

SEQ ID NO: 1186224 - DNA, 22 bp, Artificial Sequence
  chemically synthesized
agtatttgttaagaaactcaat

SEQ ID NO: 1186225 - DNA, 22 bp, Artificial Sequence
  chemically synthesized
actgtcctctgtattgagtttc

SEQ ID NO: 1186226 - DNA, 22 bp, Artificial Sequence
  chemically synthesized
aactgtcctctgtattgagttt

SEQ ID NO: 1186227 - DNA, 22 bp, Artificial Sequence
  chemically synthesized
taactgtcctctgtattgagtt

SEQ ID NO: 1186228 - DNA, 22 bp, Artificial Sequence
  chemically synthesized
gttaagaaactcaatacagagg

SEQ ID NO: 1186229 - DNA, 22 bp, Artificial Sequence
  chemically synthesized
ttaagaaactcaatacagagga

SEQ ID NO: 1186230 - DNA, 22 bp, Artificial Sequence
  chemically synthesized
tgactttaactgtcctctgtat

SEQ ID NO: 1186231 - DNA, 22 bp, Artificial Sequence
  chemically synthesized
tatgactttaactgtcctctgt

SEQ ID NO: 1186232 - DNA, 22 bp, Artificial Sequence
  chemically synthesized
agaaactcaatacagaggacag

SEQ ID NO: 1186233 - DNA, 22 bp, Artificial Sequence
  chemically synthesized
ctatgactttaactgtcctctg

SEQ ID NO: 1186234 - DNA, 22 bp, Artificial Sequence
  chemically synthesized
aatacagaggacagttaaagtc

SEQ ID NO: 1186235 - DNA, 22 bp, Artificial Sequence
  chemically synthesized
atcaatttctatgactttaact

SEQ ID NO: 1186236 - DNA, 22 bp, Artificial Sequence
  chemically synthesized
tcatcaatttctatgactttaa

SEQ ID NO: 1186237 - DNA, 22 bp, Artificial Sequence
  chemically synthesized
cataattctcatcaatttctat

SEQ ID NO: 1186238 - DNA, 22 bp, Artificial Sequence
  chemically synthesized
acataattctcatcaatttcta

SEQ ID NO: 1186239 - DNA, 22 bp, Artificial Sequence
  chemically synthesized
tcttacataattctcatcaatt

SEQ ID NO: 1186240 - DNA, 22 bp, Artificial Sequence
  chemically synthesized
aagtcatagaaattgatgagaa

SEQ ID NO: 1186241 - DNA, 22 bp, Artificial Sequence
  chemically synthesized
gtcactgtcttacataattctc

SEQ ID NO: 1186242 - DNA, 22 bp, Artificial Sequence
  chemically synthesized
agtcactgtcttacataattct

SEQ ID NO: 1186243 - DNA, 22 bp, Artificial Sequence
  chemically synthesized
tagtcactgtcttacataattc

SEQ ID NO: 1186244 - DNA, 22 bp, Artificial Sequence
  chemically synthesized
cctttagtcactgtcttacata

SEQ ID NO: 1186245 - DNA, 22 bp, Artificial Sequence
  chemically synthesized
atgagaattatgtaagacagtg

SEQ ID NO: 1186246 - DNA, 22 bp, Artificial Sequence
  chemically synthesized
tcataccattgcctttagtcac

SEQ ID NO: 1186247 - DNA, 22 bp, Artificial Sequence
  chemically synthesized
tgtaagacagtgactaaaggca

SEQ ID NO: 1186248 - DNA, 22 bp, Artificial Sequence
  chemically synthesized
attatcataccattgcctttag

SEQ ID NO: 1186249 - DNA, 22 bp, Artificial Sequence
  chemically synthesized
tagtactcattatcataccatt

SEQ ID NO: 1186250 - DNA, 22 bp, Artificial Sequence
  chemically synthesized
atagtactcattatcataccat

SEQ ID NO: 1186251 - DNA, 22 bp, Artificial Sequence
  chemically synthesized
tatagtactcattatcatacca

SEQ ID NO: 1186252 - DNA, 22 bp, Artificial Sequence
  chemically synthesized
aaggcaatggtatgataatgag

SEQ ID NO: 1186253 - DNA, 22 bp, Artificial Sequence
  chemically synthesized
aaatactttatagtactcatta

SEQ ID NO: 1186254 - DNA, 22 bp, Artificial Sequence
  chemically synthesized
ctcaaatactttatagtactca

SEQ ID NO: 1186255 - DNA, 22 bp, Artificial Sequence
  chemically synthesized
atactcctcaaatactttatag

SEQ ID NO: 1186256 - DNA, 22 bp, Artificial Sequence
  chemically synthesized
catactcctcaaatactttata

SEQ ID NO: 1186257 - DNA, 22 bp, Artificial Sequence
  chemically synthesized
tcatactcctcaaatactttat

SEQ ID NO: 1186258 - DNA, 22 bp, Artificial Sequence
  chemically synthesized
taaagtatttgaggagtatgaa

SEQ ID NO: 1186259 - DNA, 22 bp, Artificial Sequence
  chemically synthesized
catcccatcattttcatactcc

SEQ ID NO: 1186260 - DNA, 22 bp, Artificial Sequence
  chemically synthesized
gaggagtatgaaaatgatggga

SEQ ID NO: 1186261 - DNA, 22 bp, Artificial Sequence
  chemically synthesized
aggagtatgaaaatgatgggat

SEQ ID NO: 1186262 - DNA, 22 bp, Artificial Sequence
  chemically synthesized
atgtcgtgtaataagaagtata

SEQ ID NO: 1186263 - DNA, 22 bp, Artificial Sequence
  chemically synthesized
aatgtcgtgtaataagaagtat

SEQ ID NO: 1186264 - DNA, 22 bp, Artificial Sequence
  chemically synthesized
ataaaatcttaatgtcgtgtaa

SEQ ID NO: 1186265 - DNA, 22 bp, Artificial Sequence
  chemically synthesized
cataaaatcttaatgtcgtgta

SEQ ID NO: 1186266 - DNA, 22 bp, Artificial Sequence
  chemically synthesized
atacttcttattacacgacatt

SEQ ID NO: 1186267 - DNA, 22 bp, Artificial Sequence
  chemically synthesized
tacttcttattacacgacatta

SEQ ID NO: 1186268 - DNA, 22 bp, Artificial Sequence
  chemically synthesized
atttcataaaatcttaatgtcg

SEQ ID NO: 1186269 - DNA, 22 bp, Artificial Sequence
  chemically synthesized
tcatttcataaaatcttaatgt

SEQ ID NO: 1186270 - DNA, 22 bp, Artificial Sequence
  chemically synthesized
cttattacacgacattaagatt

SEQ ID NO: 1186271 - DNA, 22 bp, Artificial Sequence
  chemically synthesized
ttattacacgacattaagattt

SEQ ID NO: 1186272 - DNA, 22 bp, Artificial Sequence
  chemically synthesized
ctctcatttcataaaatcttaa

SEQ ID NO: 1186273 - DNA, 22 bp, Artificial Sequence
  chemically synthesized
attacacgacattaagatttta

SEQ ID NO: 1186274 - DNA, 22 bp, Artificial Sequence
  chemically synthesized
ttacacgacattaagattttat

SEQ ID NO: 1186275 - DNA, 22 bp, Artificial Sequence
  chemically synthesized
cacgacattaagattttatgaa

SEQ ID NO: 1186276 - DNA, 22 bp, Artificial Sequence
  chemically synthesized
agccactgctctcatttcataa

SEQ ID NO: 1186277 - DNA, 22 bp, Artificial Sequence
  chemically synthesized
agattttatgaaatgagagcag

SEQ ID NO: 1186278 - DNA, 22 bp, Artificial Sequence
  chemically synthesized
gggattcagccactgctctcat

SEQ ID NO: 1186279 - DNA, 22 bp, Artificial Sequence
  chemically synthesized
ggggattcagccactgctctca

SEQ ID NO: 1186280 - DNA, 22 bp, Artificial Sequence
  chemically synthesized
tggggattcagccactgctctc

SEQ ID NO: 1186281 - DNA, 22 bp, Artificial Sequence
  chemically synthesized
ctttggggattcagccactgct

SEQ ID NO: 1186282 - DNA, 22 bp, Artificial Sequence
  chemically synthesized
tatgaaatgagagcagtggctg

SEQ ID NO: 1186283 - DNA, 22 bp, Artificial Sequence
  chemically synthesized
actttggggattcagccactgc

SEQ ID NO: 1186284 - DNA, 22 bp, Artificial Sequence
  chemically synthesized
atgaaatgagagcagtggctga

SEQ ID NO: 1186285 - DNA, 22 bp, Artificial Sequence
  chemically synthesized
tgaaatgagagcagtggctgaa

SEQ ID NO: 1186286 - DNA, 22 bp, Artificial Sequence
  chemically synthesized
ttactttggggattcagccact

SEQ ID NO: 1186287 - DNA, 22 bp, Artificial Sequence
  chemically synthesized
agttcttactttggggattcag

SEQ ID NO: 1186288 - DNA, 22 bp, Artificial Sequence
  chemically synthesized
ttaagttcttactttggggatt

SEQ ID NO: 1186289 - DNA, 22 bp, Artificial Sequence
  chemically synthesized
atgtaattgttaagttcttact

SEQ ID NO: 1186290 - DNA, 22 bp, Artificial Sequence
  chemically synthesized
aatccccaaagtaagaacttaa

SEQ ID NO: 1186291 - DNA, 22 bp, Artificial Sequence
  chemically synthesized
cgttcatgtaattgttaagttc

SEQ ID NO: 1186292 - DNA, 22 bp, Artificial Sequence
  chemically synthesized
gtgtaaaattacgttcatgtaa

SEQ ID NO: 1186293 - DNA, 22 bp, Artificial Sequence
  chemically synthesized
ggtgtaaaattacgttcatgta

SEQ ID NO: 1186294 - DNA, 22 bp, Artificial Sequence
  chemically synthesized
aacaattacatgaacgtaattt

SEQ ID NO: 1186295 - DNA, 22 bp, Artificial Sequence
  chemically synthesized
acaattacatgaacgtaatttt

SEQ ID NO: 1186296 - DNA, 22 bp, Artificial Sequence
  chemically synthesized
catgaacgtaattttacaccaa

SEQ ID NO: 1186297 - DNA, 22 bp, Artificial Sequence
  chemically synthesized
tgtagtagagtcttggtgtaaa

SEQ ID NO: 1186298 - DNA, 22 bp, Artificial Sequence
  chemically synthesized
atgtagtagagtcttggtgtaa

SEQ ID NO: 1186299 - DNA, 22 bp, Artificial Sequence
  chemically synthesized
tatgtagtagagtcttggtgta

SEQ ID NO: 1186300 - DNA, 22 bp, Artificial Sequence
  chemically synthesized
tacaccaagactctactacata

SEQ ID NO: 1186301 - DNA, 22 bp, Artificial Sequence
  chemically synthesized
acaccaagactctactacataa

SEQ ID NO: 1186302 - DNA, 22 bp, Artificial Sequence
  chemically synthesized
caccaagactctactacataaa

SEQ ID NO: 1186303 - DNA, 22 bp, Artificial Sequence
  chemically synthesized
gtgtccgtgagcattttatgta

SEQ ID NO: 1186304 - DNA, 22 bp, Artificial Sequence
  chemically synthesized
aaatctggtgtccgtgagcatt

SEQ ID NO: 1186305 - DNA, 22 bp, Artificial Sequence
  chemically synthesized
tactacataaaatgctcacgga

SEQ ID NO: 1186306 - DNA, 22 bp, Artificial Sequence
  chemically synthesized
ttaaaatctggtgtccgtgagc

SEQ ID NO: 1186307 - DNA, 22 bp, Artificial Sequence
  chemically synthesized
ctacataaaatgctcacggaca

SEQ ID NO: 1186308 - DNA, 22 bp, Artificial Sequence
  chemically synthesized
cataaaatgctcacggacacca

SEQ ID NO: 1186309 - DNA, 22 bp, Artificial Sequence
  chemically synthesized
gataagcaattattaaaatctg

SEQ ID NO: 1186310 - DNA, 22 bp, Artificial Sequence
  chemically synthesized
acggacaccagattttaataat

SEQ ID NO: 1186311 - DNA, 22 bp, Artificial Sequence
  chemically synthesized
aaagattggataagcaattatt

SEQ ID NO: 1186312 - DNA, 22 bp, Artificial Sequence
  chemically synthesized
caaagattggataagcaattat

SEQ ID NO: 1186313 - DNA, 22 bp, Artificial Sequence
  chemically synthesized
agacggcttcaaagattggata

SEQ ID NO: 1186314 - DNA, 22 bp, Artificial Sequence
  chemically synthesized
taataattgcttatccaatctt

SEQ ID NO: 1186315 - DNA, 22 bp, Artificial Sequence
  chemically synthesized
aataattgcttatccaatcttt

SEQ ID NO: 1186316 - DNA, 22 bp, Artificial Sequence
  chemically synthesized
tgagacggcttcaaagattgga

SEQ ID NO: 1186317 - DNA, 22 bp, Artificial Sequence
  chemically synthesized
ataattgcttatccaatctttg

SEQ ID NO: 1186318 - DNA, 22 bp, Artificial Sequence
  chemically synthesized
attctgagacggcttcaaagat

SEQ ID NO: 1186319 - DNA, 22 bp, Artificial Sequence
  chemically synthesized
cattctgagacggcttcaaaga

SEQ ID NO: 1186320 - DNA, 22 bp, Artificial Sequence
  chemically synthesized
tcattctgagacggcttcaaag

SEQ ID NO: 1186321 - DNA, 22 bp, Artificial Sequence
  chemically synthesized
cttatccaatctttgaagccgt

SEQ ID NO: 1186322 - DNA, 22 bp, Artificial Sequence
  chemically synthesized
ttttcattctgagacggcttca

SEQ ID NO: 1186323 - DNA, 22 bp, Artificial Sequence
  chemically synthesized
atccaatctttgaagccgtctc

SEQ ID NO: 1186324 - DNA, 22 bp, Artificial Sequence
  chemically synthesized
tccaatctttgaagccgtctca

SEQ ID NO: 1186325 - DNA, 22 bp, Artificial Sequence
  chemically synthesized
actattttcattctgagacggc

SEQ ID NO: 1186326 - DNA, 22 bp, Artificial Sequence
  chemically synthesized
tcactattttcattctgagacg

SEQ ID NO: 1186327 - DNA, 22 bp, Artificial Sequence
  chemically synthesized
tgaagccgtctcagaatgaaaa

SEQ ID NO: 1186328 - DNA, 22 bp, Artificial Sequence
  chemically synthesized
gaagccgtctcagaatgaaaat

SEQ ID NO: 1186329 - DNA, 22 bp, Artificial Sequence
  chemically synthesized
tgagttctcactattttcattc

SEQ ID NO: 1186330 - DNA, 22 bp, Artificial Sequence
  chemically synthesized
aagccgtctcagaatgaaaata

SEQ ID NO: 1186331 - DNA, 22 bp, Artificial Sequence
  chemically synthesized
gcagtattgtgagttctcacta

SEQ ID NO: 1186332 - DNA, 22 bp, Artificial Sequence
  chemically synthesized
agaatgaaaatagtgagaactc

SEQ ID NO: 1186333 - DNA, 22 bp, Artificial Sequence
  chemically synthesized
tagcagtattgtgagttctcac

SEQ ID NO: 1186334 - DNA, 22 bp, Artificial Sequence
  chemically synthesized
ataaagtaaaatctctagcagt

SEQ ID NO: 1186335 - DNA, 22 bp, Artificial Sequence
  chemically synthesized
ttcataaagtaaaatctctagc

SEQ ID NO: 1186336 - DNA, 22 bp, Artificial Sequence
  chemically synthesized
ttgttcataaagtaaaatctct

SEQ ID NO: 1186337 - DNA, 22 bp, Artificial Sequence
  chemically synthesized
acaatactgctagagattttac

SEQ ID NO: 1186338 - DNA, 22 bp, Artificial Sequence
  chemically synthesized
ctagagattttactttatgaac

SEQ ID NO: 1186339 - DNA, 22 bp, Artificial Sequence
  chemically synthesized
gagattttactttatgaacaat

SEQ ID NO: 1186340 - DNA, 22 bp, Artificial Sequence
  chemically synthesized
atcagaaacggtgttattgttc

SEQ ID NO: 1186341 - DNA, 22 bp, Artificial Sequence
  chemically synthesized
tactttatgaacaataacaccg

SEQ ID NO: 1186342 - DNA, 22 bp, Artificial Sequence
  chemically synthesized
actttatgaacaataacaccgt

SEQ ID NO: 1186343 - DNA, 22 bp, Artificial Sequence
  chemically synthesized
ctttatgaacaataacaccgtt

SEQ ID NO: 1186344 - DNA, 22 bp, Artificial Sequence
  chemically synthesized
tatgaacaataacaccgtttct

SEQ ID NO: 1186345 - DNA, 22 bp, Artificial Sequence
  chemically synthesized
atgaacaataacaccgtttctg

SEQ ID NO: 1186346 - DNA, 22 bp, Artificial Sequence
  chemically synthesized
tgaacaataacaccgtttctga

SEQ ID NO: 1186347 - DNA, 22 bp, Artificial Sequence
  chemically synthesized
aaatatgaaacactcatcagaa

SEQ ID NO: 1186348 - DNA, 22 bp, Artificial Sequence
  chemically synthesized
catagtatcctcaaatatgaaa

SEQ ID NO: 1186349 - DNA, 22 bp, Artificial Sequence
  chemically synthesized
ctgatgagtgtttcatatttga

SEQ ID NO: 1186350 - DNA, 22 bp, Artificial Sequence
  chemically synthesized
tgatgagtgtttcatatttgag

SEQ ID NO: 1186351 - DNA, 22 bp, Artificial Sequence
  chemically synthesized
ttccatagtatcctcaaatatg

SEQ ID NO: 1186352 - DNA, 22 bp, Artificial Sequence
  chemically synthesized
gttccatagtatcctcaaatat

SEQ ID NO: 1186353 - DNA, 22 bp, Artificial Sequence
  chemically synthesized
atgagtgtttcatatttgagga

SEQ ID NO: 1186354 - DNA, 22 bp, Artificial Sequence
  chemically synthesized
tttgttccatagtatcctcaaa

SEQ ID NO: 1186355 - DNA, 22 bp, Artificial Sequence
  chemically synthesized
atttgttccatagtatcctcaa

SEQ ID NO: 1186356 - DNA, 22 bp, Artificial Sequence
  chemically synthesized
catatttgaggatactatggaa

SEQ ID NO: 1186357 - DNA, 22 bp, Artificial Sequence
  chemically synthesized
atatttgaggatactatggaac

SEQ ID NO: 1186358 - DNA, 22 bp, Artificial Sequence
  chemically synthesized
aatgatttatttgttccatagt

SEQ ID NO: 1186359 - DNA, 22 bp, Artificial Sequence
  chemically synthesized
gctaaatgatttatttgttcca

SEQ ID NO: 1186360 - DNA, 22 bp, Artificial Sequence
  chemically synthesized
cgctaaatgatttatttgttcc

SEQ ID NO: 1186361 - DNA, 22 bp, Artificial Sequence
  chemically synthesized
gaggatactatggaacaaataa

SEQ ID NO: 1186362 - DNA, 22 bp, Artificial Sequence
  chemically synthesized
aggatactatggaacaaataaa

SEQ ID NO: 1186363 - DNA, 22 bp, Artificial Sequence
  chemically synthesized
tggaacaaataaatcatttagc

SEQ ID NO: 1186364 - DNA, 22 bp, Artificial Sequence
  chemically synthesized
gaaaaatgatcaaatttcgcta

SEQ ID NO: 1186365 - DNA, 22 bp, Artificial Sequence
  chemically synthesized
ttcgaaaaatgatcaaatttcg

SEQ ID NO: 1186366 - DNA, 22 bp, Artificial Sequence
  chemically synthesized
attcgaaaaatgatcaaatttc

SEQ ID NO: 1186367 - DNA, 22 bp, Artificial Sequence
  chemically synthesized
tattcgaaaaatgatcaaattt

SEQ ID NO: 1186368 - DNA, 22 bp, Artificial Sequence
  chemically synthesized
tttattcgaaaaatgatcaaat

SEQ ID NO: 1186369 - DNA, 22 bp, Artificial Sequence
  chemically synthesized
ctttattcgaaaaatgatcaaa

SEQ ID NO: 1186370 - DNA, 22 bp, Artificial Sequence
  chemically synthesized
agcgaaatttgatcatttttcg

SEQ ID NO: 1186371 - DNA, 22 bp, Artificial Sequence
  chemically synthesized
aacttctttattcgaaaaatga

SEQ ID NO: 1186372 - DNA, 22 bp, Artificial Sequence
  chemically synthesized
gcgaaatttgatcatttttcga

SEQ ID NO: 1186373 - DNA, 22 bp, Artificial Sequence
  chemically synthesized
gatcatttttcgaataaagaag

SEQ ID NO: 1186374 - DNA, 22 bp, Artificial Sequence
  chemically synthesized
atcatttttcgaataaagaagt

SEQ ID NO: 1186375 - DNA, 22 bp, Artificial Sequence
  chemically synthesized
agaccgccatgaggttcaactt

SEQ ID NO: 1186376 - DNA, 22 bp, Artificial Sequence
  chemically synthesized
ttcgaataaagaagttgaacct

SEQ ID NO: 1186377 - DNA, 22 bp, Artificial Sequence
  chemically synthesized
cagaccgccatgaggttcaact

SEQ ID NO: 1186378 - DNA, 22 bp, Artificial Sequence
  chemically synthesized
tcgaataaagaagttgaacctc

SEQ ID NO: 1186379 - DNA, 22 bp, Artificial Sequence
  chemically synthesized
cgaataaagaagttgaacctca

SEQ ID NO: 1186380 - DNA, 22 bp, Artificial Sequence
  chemically synthesized
gaataaagaagttgaacctcat

SEQ ID NO: 1186381 - DNA, 22 bp, Artificial Sequence
  chemically synthesized
ccttcagaccgccatgaggttc

SEQ ID NO: 1186382 - DNA, 22 bp, Artificial Sequence
  chemically synthesized
gccttcagaccgccatgaggtt

SEQ ID NO: 1186383 - DNA, 22 bp, Artificial Sequence
  chemically synthesized
aatttgccttcagaccgccatg

SEQ ID NO: 1186384 - DNA, 22 bp, Artificial Sequence
  chemically synthesized
gaatttgccttcagaccgccat

SEQ ID NO: 1186385 - DNA, 22 bp, Artificial Sequence
  chemically synthesized
tgaatttgccttcagaccgcca

SEQ ID NO: 1186386 - DNA, 22 bp, Artificial Sequence
  chemically synthesized
aacctcatggcggtctgaaggc

SEQ ID NO: 1186387 - DNA, 22 bp, Artificial Sequence
  chemically synthesized
gcctttgaatttgccttcagac

SEQ ID NO: 1186388 - DNA, 22 bp, Artificial Sequence
  chemically synthesized
actagcctttgaatttgccttc

SEQ ID NO: 1186389 - DNA, 22 bp, Artificial Sequence
  chemically synthesized
gactagcctttgaatttgcctt

SEQ ID NO: 1186390 - DNA, 22 bp, Artificial Sequence
  chemically synthesized
atggcggtctgaaggcaaattc

SEQ ID NO: 1186391 - DNA, 22 bp, Artificial Sequence
  chemically synthesized
tgactagcctttgaatttgcct

SEQ ID NO: 1186392 - DNA, 22 bp, Artificial Sequence
  chemically synthesized
attttgactagcctttgaattt

SEQ ID NO: 1186393 - DNA, 22 bp, Artificial Sequence
  chemically synthesized
atctgattttgactagcctttg

SEQ ID NO: 1186394 - DNA, 22 bp, Artificial Sequence
  chemically synthesized
aaggcaaattcaaaggctagtc

SEQ ID NO: 1186395 - DNA, 22 bp, Artificial Sequence
  chemically synthesized
taatctgattttgactagcctt

SEQ ID NO: 1186396 - DNA, 22 bp, Artificial Sequence
  chemically synthesized
ctaatctgattttgactagcct

SEQ ID NO: 1186397 - DNA, 22 bp, Artificial Sequence
  chemically synthesized
gtttctaatctgattttgacta

SEQ ID NO: 1186398 - DNA, 22 bp, Artificial Sequence
  chemically synthesized
aaaggctagtcaaaatcagatt

SEQ ID NO: 1186399 - DNA, 22 bp, Artificial Sequence
  chemically synthesized
gtcaaaatcagattagaaacca

SEQ ID NO: 1186400 - DNA, 22 bp, Artificial Sequence
  chemically synthesized
gaaaccagtcattgcactacac

SEQ ID NO: 1186401 - DNA, 22 bp, Artificial Sequence
  chemically synthesized
aggtaccatggcagtgtagtgc

SEQ ID NO: 1186402 - DNA, 22 bp, Artificial Sequence
  chemically synthesized
cactacactgccatggtacctt

SEQ ID NO: 1186403 - DNA, 22 bp, Artificial Sequence
  chemically synthesized
agagaatgaggttaaggtacca

SEQ ID NO: 1186404 - DNA, 22 bp, Artificial Sequence
  chemically synthesized
cactgccatggtaccttaacct

SEQ ID NO: 1186405 - DNA, 22 bp, Artificial Sequence
  chemically synthesized
ccatggtaccttaacctcattc

SEQ ID NO: 1186406 - DNA, 22 bp, Artificial Sequence
  chemically synthesized
agatagtatctgagagaatgag

SEQ ID NO: 1186407 - DNA, 22 bp, Artificial Sequence
  chemically synthesized
aacctcattctctcagatacta

SEQ ID NO: 1186408 - DNA, 22 bp, Artificial Sequence
  chemically synthesized
acctcattctctcagatactat

SEQ ID NO: 1186409 - DNA, 22 bp, Artificial Sequence
  chemically synthesized
aaatacactgagatagtatctg

SEQ ID NO: 1186410 - DNA, 22 bp, Artificial Sequence
  chemically synthesized
caaatacactgagatagtatct

SEQ ID NO: 1186411 - DNA, 22 bp, Artificial Sequence
  chemically synthesized
attctctcagatactatctcag

SEQ ID NO: 1186412 - DNA, 22 bp, Artificial Sequence
  chemically synthesized
gtcttcaaatacactgagatag

SEQ ID NO: 1186413 - DNA, 22 bp, Artificial Sequence
  chemically synthesized
ggtcttcaaatacactgagata

SEQ ID NO: 1186414 - DNA, 22 bp, Artificial Sequence
  chemically synthesized
tctcagatactatctcagtgta

SEQ ID NO: 1186415 - DNA, 22 bp, Artificial Sequence
  chemically synthesized
tcagatactatctcagtgtatt

SEQ ID NO: 1186416 - DNA, 22 bp, Artificial Sequence
  chemically synthesized
agatactatctcagtgtatttg

SEQ ID NO: 1186417 - DNA, 22 bp, Artificial Sequence
  chemically synthesized
tgcgatacttggtcttcaaata

SEQ ID NO: 1186418 - DNA, 22 bp, Artificial Sequence
  chemically synthesized
gtgcgatacttggtcttcaaat

SEQ ID NO: 1186419 - DNA, 22 bp, Artificial Sequence
  chemically synthesized
tgtgcgatacttggtcttcaaa

SEQ ID NO: 1186420 - DNA, 22 bp, Artificial Sequence
  chemically synthesized
tctcagtgtatttgaagaccaa

SEQ ID NO: 1186421 - DNA, 22 bp, Artificial Sequence
  chemically synthesized
agtgtatttgaagaccaagtat

SEQ ID NO: 1186422 - DNA, 22 bp, Artificial Sequence
  chemically synthesized
aaagcaaactttgtgcgatact

SEQ ID NO: 1186423 - DNA, 22 bp, Artificial Sequence
  chemically synthesized
gaagaccaagtatcgcacaaag

SEQ ID NO: 1186424 - DNA, 22 bp, Artificial Sequence
  chemically synthesized
aagaccaagtatcgcacaaagt

SEQ ID NO: 1186425 - DNA, 22 bp, Artificial Sequence
  chemically synthesized
gggtgagggcatgttgaaagca

SEQ ID NO: 1186426 - DNA, 22 bp, Artificial Sequence
  chemically synthesized
ggggtgagggcatgttgaaagc

SEQ ID NO: 1186427 - DNA, 22 bp, Artificial Sequence
  chemically synthesized
ttggggtgagggcatgttgaaa

SEQ ID NO: 1186428 - DNA, 22 bp, Artificial Sequence
  chemically synthesized
cttggggtgagggcatgttgaa

SEQ ID NO: 1186429 - DNA, 22 bp, Artificial Sequence
  chemically synthesized
tcttggggtgagggcatgttga

SEQ ID NO: 1186430 - DNA, 22 bp, Artificial Sequence
  chemically synthesized
actttcttggggtgagggcatg

SEQ ID NO: 1186431 - DNA, 22 bp, Artificial Sequence
  chemically synthesized
gctttcaacatgccctcacccc

SEQ ID NO: 1186432 - DNA, 22 bp, Artificial Sequence
  chemically synthesized
ctttcaacatgccctcacccca

SEQ ID NO: 1186433 - DNA, 22 bp, Artificial Sequence
  chemically synthesized
acattgactttcttggggtgag

SEQ ID NO: 1186434 - DNA, 22 bp, Artificial Sequence
  chemically synthesized
tcaacatgccctcaccccaaga

SEQ ID NO: 1186435 - DNA, 22 bp, Artificial Sequence
  chemically synthesized
caacatgccctcaccccaagaa

SEQ ID NO: 1186436 - DNA, 22 bp, Artificial Sequence
  chemically synthesized
ctcacattgactttcttggggt

SEQ ID NO: 1186437 - DNA, 22 bp, Artificial Sequence
  chemically synthesized
aacatgccctcaccccaagaaa

SEQ ID NO: 1186438 - DNA, 22 bp, Artificial Sequence
  chemically synthesized
actcacattgactttcttgggg

SEQ ID NO: 1186439 - DNA, 22 bp, Artificial Sequence
  chemically synthesized
cttactcacattgactttcttg

SEQ ID NO: 1186440 - DNA, 22 bp, Artificial Sequence
  chemically synthesized
acttactcacattgactttctt

SEQ ID NO: 1186441 - DNA, 22 bp, Artificial Sequence
  chemically synthesized
atcttacttactcacattgact

SEQ ID NO: 1186442 - DNA, 22 bp, Artificial Sequence
  chemically synthesized
catcttacttactcacattgac

SEQ ID NO: 1186443 - DNA, 22 bp, Artificial Sequence
  chemically synthesized
accccaagaaagtcaatgtgag

SEQ ID NO: 1186444 - DNA, 22 bp, Artificial Sequence
  chemically synthesized
tcatcttacttactcacattga

SEQ ID NO: 1186445 - DNA, 22 bp, Artificial Sequence
  chemically synthesized
ctttcatcttacttactcacat

SEQ ID NO: 1186446 - DNA, 22 bp, Artificial Sequence
  chemically synthesized
aaggcactgctttcatcttact

SEQ ID NO: 1186447 - DNA, 22 bp, Artificial Sequence
  chemically synthesized
ttgaaggcactgctttcatctt

SEQ ID NO: 1186448 - DNA, 22 bp, Artificial Sequence
  chemically synthesized
gttgaaggcactgctttcatct

SEQ ID NO: 1186449 - DNA, 22 bp, Artificial Sequence
  chemically synthesized
tgttgaaggcactgctttcatc

SEQ ID NO: 1186450 - DNA, 22 bp, Artificial Sequence
  chemically synthesized
gttttgttgaaggcactgcttt

SEQ ID NO: 1186451 - DNA, 22 bp, Artificial Sequence
  chemically synthesized
cccaagattagttttgttgaag

SEQ ID NO: 1186452 - DNA, 22 bp, Artificial Sequence
  chemically synthesized
actgcccaagattagttttgtt

SEQ ID NO: 1186453 - DNA, 22 bp, Artificial Sequence
  chemically synthesized
aggttgactgcccaagattagt

SEQ ID NO: 1186454 - DNA, 22 bp, Artificial Sequence
  chemically synthesized
cctgaggttgactgcccaagat

SEQ ID NO: 1186455 - DNA, 22 bp, Artificial Sequence
  chemically synthesized
caacaaaactaatcttgggcag

SEQ ID NO: 1186456 - DNA, 22 bp, Artificial Sequence
  chemically synthesized
ccctgaggttgactgcccaaga

SEQ ID NO: 1186457 - DNA, 22 bp, Artificial Sequence
  chemically synthesized
aacaaaactaatcttgggcagt

SEQ ID NO: 1186458 - DNA, 22 bp, Artificial Sequence
  chemically synthesized
atcggacttccctgaggttgac

SEQ ID NO: 1186459 - DNA, 22 bp, Artificial Sequence
  chemically synthesized
atcttgggcagtcaacctcagg

SEQ ID NO: 1186460 - DNA, 22 bp, Artificial Sequence
  chemically synthesized
gctaatcggacttccctgaggt

SEQ ID NO: 1186461 - DNA, 22 bp, Artificial Sequence
  chemically synthesized
gggcagtcaacctcagggaagt

SEQ ID NO: 1186462 - DNA, 22 bp, Artificial Sequence
  chemically synthesized
ggcagtcaacctcagggaagtc

SEQ ID NO: 1186463 - DNA, 22 bp, Artificial Sequence
  chemically synthesized
cacccagcgactggctaatcgg

SEQ ID NO: 1186464 - DNA, 22 bp, Artificial Sequence
  chemically synthesized
agggaagtccgattagccagtc

SEQ ID NO: 1186465 - DNA, 22 bp, Artificial Sequence
  chemically synthesized
aaggttacacccagcgactggc

SEQ ID NO: 1186466 - DNA, 22 bp, Artificial Sequence
  chemically synthesized
gaaggttacacccagcgactgg

SEQ ID NO: 1186467 - DNA, 22 bp, Artificial Sequence
  chemically synthesized
gccagtcgctgggtgtaacctt

SEQ ID NO: 1186468 - DNA, 22 bp, Artificial Sequence
  chemically synthesized
ccagcggtgtttgaaggttaca

SEQ ID NO: 1186469 - DNA, 22 bp, Artificial Sequence
  chemically synthesized
cccagcggtgtttgaaggttac

SEQ ID NO: 1186470 - DNA, 22 bp, Artificial Sequence
  chemically synthesized
gatttcccagcggtgtttgaag

SEQ ID NO: 1186471 - DNA, 22 bp, Artificial Sequence
  chemically synthesized
agatttcccagcggtgtttgaa

SEQ ID NO: 1186472 - DNA, 22 bp, Artificial Sequence
  chemically synthesized
tagatttcccagcggtgtttga

SEQ ID NO: 1186473 - DNA, 22 bp, Artificial Sequence
  chemically synthesized
ggtgtaaccttcaaacaccgct

SEQ ID NO: 1186474 - DNA, 22 bp, Artificial Sequence
  chemically synthesized
tttagatttcccagcggtgttt

SEQ ID NO: 1186475 - DNA, 22 bp, Artificial Sequence
  chemically synthesized
ctttagatttcccagcggtgtt

SEQ ID NO: 1186476 - DNA, 22 bp, Artificial Sequence
  chemically synthesized
ttctttagatttcccagcggtg

SEQ ID NO: 1186477 - DNA, 22 bp, Artificial Sequence
  chemically synthesized
caaacaccgctgggaaatctaa

SEQ ID NO: 1186478 - DNA, 22 bp, Artificial Sequence
  chemically synthesized
aaacaccgctgggaaatctaaa

SEQ ID NO: 1186479 - DNA, 22 bp, Artificial Sequence
  chemically synthesized
gacagtagagcctcttctttag

SEQ ID NO: 1186480 - DNA, 22 bp, Artificial Sequence
  chemically synthesized
agacagtagagcctcttcttta

SEQ ID NO: 1186481 - DNA, 22 bp, Artificial Sequence
  chemically synthesized
ggaaatctaaagaagaggctct

SEQ ID NO: 1186482 - DNA, 22 bp, Artificial Sequence
  chemically synthesized
aaatttagacagtagagcctct

SEQ ID NO: 1186483 - DNA, 22 bp, Artificial Sequence
  chemically synthesized
gcctgaaatttagacagtagag

SEQ ID NO: 1186484 - DNA, 22 bp, Artificial Sequence
  chemically synthesized
ggcctgaaatttagacagtaga

SEQ ID NO: 1186485 - DNA, 22 bp, Artificial Sequence
  chemically synthesized
aagaagaggctctactgtctaa

SEQ ID NO: 1186486 - DNA, 22 bp, Artificial Sequence
  chemically synthesized
gcagaaacttggcctgaaattt

SEQ ID NO: 1186487 - DNA, 22 bp, Artificial Sequence
  chemically synthesized
ggcagaaacttggcctgaaatt

SEQ ID NO: 1186488 - DNA, 22 bp, Artificial Sequence
  chemically synthesized
tactgtctaaatttcaggccaa

SEQ ID NO: 1186489 - DNA, 22 bp, Artificial Sequence
  chemically synthesized
ctgtctaaatttcaggccaagt

SEQ ID NO: 1186490 - DNA, 22 bp, Artificial Sequence
  chemically synthesized
tcccttggcagaaacttggcct

SEQ ID NO: 1186491 - DNA, 22 bp, Artificial Sequence
  chemically synthesized
tctaaatttcaggccaagtttc

SEQ ID NO: 1186492 - DNA, 22 bp, Artificial Sequence
  chemically synthesized
cctgtcccttggcagaaacttg

SEQ ID NO: 1186493 - DNA, 22 bp, Artificial Sequence
  chemically synthesized
aatttcaggccaagtttctgcc

SEQ ID NO: 1186494 - DNA, 22 bp, Artificial Sequence
  chemically synthesized
ctgcctgtcccttggcagaaac

SEQ ID NO: 1186495 - DNA, 22 bp, Artificial Sequence
  chemically synthesized
caggccaagtttctgccaaggg

SEQ ID NO: 1186496 - DNA, 22 bp, Artificial Sequence
  chemically synthesized
aggccaagtttctgccaaggga

SEQ ID NO: 1186497 - DNA, 22 bp, Artificial Sequence
  chemically synthesized
cattcctgcctgtcccttggca

SEQ ID NO: 1186498 - DNA, 22 bp, Artificial Sequence
  chemically synthesized
ccattcctgcctgtcccttggc

SEQ ID NO: 1186499 - DNA, 22 bp, Artificial Sequence
  chemically synthesized
tatttccattcctgcctgtccc

SEQ ID NO: 1186500 - DNA, 22 bp, Artificial Sequence
  chemically synthesized
tgtatttccattcctgcctgtc

SEQ ID NO: 1186501 - DNA, 22 bp, Artificial Sequence
  chemically synthesized
ctgccaagggacaggcaggaat

SEQ ID NO: 1186502 - DNA, 22 bp, Artificial Sequence
  chemically synthesized
tgccaagggacaggcaggaatg

SEQ ID NO: 1186503 - DNA, 22 bp, Artificial Sequence
  chemically synthesized
ccaagggacaggcaggaatgga

SEQ ID NO: 1186504 - DNA, 22 bp, Artificial Sequence
  chemically synthesized
taattctgtatttccattcctg

SEQ ID NO: 1186505 - DNA, 22 bp, Artificial Sequence
  chemically synthesized
tgcattataattctgtatttcc

SEQ ID NO: 1186506 - DNA, 22 bp, Artificial Sequence
  chemically synthesized
cacatgctatgcattataattc

SEQ ID NO: 1186507 - DNA, 22 bp, Artificial Sequence
  chemically synthesized
aattacacatgctatgcattat

SEQ ID NO: 1186508 - DNA, 22 bp, Artificial Sequence
  chemically synthesized
caattacacatgctatgcatta

SEQ ID NO: 1186509 - DNA, 22 bp, Artificial Sequence
  chemically synthesized
tcaattacacatgctatgcatt

SEQ ID NO: 1186510 - DNA, 22 bp, Artificial Sequence
  chemically synthesized
ttttcaattacacatgctatgc

SEQ ID NO: 1186511 - DNA, 22 bp, Artificial Sequence
  chemically synthesized
gttttcaattacacatgctatg

SEQ ID NO: 1186512 - DNA, 22 bp, Artificial Sequence
  chemically synthesized
cttgttttcaattacacatgct

SEQ ID NO: 1186513 - DNA, 22 bp, Artificial Sequence
  chemically synthesized
gcttgttttcaattacacatgc

SEQ ID NO: 1186514 - DNA, 22 bp, Artificial Sequence
  chemically synthesized
taatgcatagcatgtgtaattg

SEQ ID NO: 1186515 - DNA, 22 bp, Artificial Sequence
  chemically synthesized
aaatcttgcttgttttcaatta

SEQ ID NO: 1186516 - DNA, 22 bp, Artificial Sequence
  chemically synthesized
gaaatcttgcttgttttcaatt

SEQ ID NO: 1186517 - DNA, 22 bp, Artificial Sequence
  chemically synthesized
tgaaatcttgcttgttttcaat

SEQ ID NO: 1186518 - DNA, 22 bp, Artificial Sequence
  chemically synthesized
tctttgaaatcttgcttgtttt

SEQ ID NO: 1186519 - DNA, 22 bp, Artificial Sequence
  chemically synthesized
ctatctttgaaatcttgcttgt

SEQ ID NO: 1186520 - DNA, 22 bp, Artificial Sequence
  chemically synthesized
tacctgctatctttgaaatctt

SEQ ID NO: 1186521 - DNA, 22 bp, Artificial Sequence
  chemically synthesized
atacctgctatctttgaaatct

SEQ ID NO: 1186522 - DNA, 22 bp, Artificial Sequence
  chemically synthesized
aaaacaagcaagatttcaaaga

SEQ ID NO: 1186523 - DNA, 22 bp, Artificial Sequence
  chemically synthesized
tgagtgcacatttatacctgct

SEQ ID NO: 1186524 - DNA, 22 bp, Artificial Sequence
  chemically synthesized
gtgagtgcacatttatacctgc

SEQ ID NO: 1186525 - DNA, 22 bp, Artificial Sequence
  chemically synthesized
tgtgagtgcacatttatacctg

SEQ ID NO: 1186526 - DNA, 22 bp, Artificial Sequence
  chemically synthesized
caaagatagcaggtataaatgt

SEQ ID NO: 1186527 - DNA, 22 bp, Artificial Sequence
  chemically synthesized
aaagatagcaggtataaatgtg

SEQ ID NO: 1186528 - DNA, 22 bp, Artificial Sequence
  chemically synthesized
aagctttgtgagtgcacattta

SEQ ID NO: 1186529 - DNA, 22 bp, Artificial Sequence
  chemically synthesized
accaactaaagctttgtgagtg

SEQ ID NO: 1186530 - DNA, 22 bp, Artificial Sequence
  chemically synthesized
aaagactgaccaactaaagctt

SEQ ID NO: 1186531 - DNA, 22 bp, Artificial Sequence
  chemically synthesized
aaaagactgaccaactaaagct

SEQ ID NO: 1186532 - DNA, 22 bp, Artificial Sequence
  chemically synthesized
ttaaaagactgaccaactaaag

SEQ ID NO: 1186533 - DNA, 22 bp, Artificial Sequence
  chemically synthesized
acaaagctttagttggtcagtc

SEQ ID NO: 1186534 - DNA, 22 bp, Artificial Sequence
  chemically synthesized
ataaaactcttaaaagactgac

SEQ ID NO: 1186535 - DNA, 22 bp, Artificial Sequence
  chemically synthesized
aataaaactcttaaaagactga

SEQ ID NO: 1186536 - DNA, 22 bp, Artificial Sequence
  chemically synthesized
tttaataaaactcttaaaagac

SEQ ID NO: 1186537 - DNA, 22 bp, Artificial Sequence
  chemically synthesized
tagttggtcagtcttttaagag

SEQ ID NO: 1186538 - DNA, 22 bp, Artificial Sequence
  chemically synthesized
agttggtcagtcttttaagagt

SEQ ID NO: 1186539 - DNA, 22 bp, Artificial Sequence
  chemically synthesized
ttgtttaataaaactcttaaaa

SEQ ID NO: 1186540 - DNA, 22 bp, Artificial Sequence
  chemically synthesized
gttggtcagtcttttaagagtt

SEQ ID NO: 1186541 - DNA, 22 bp, Artificial Sequence
  chemically synthesized
gttgtttaataaaactcttaaa

SEQ ID NO: 1186542 - DNA, 22 bp, Artificial Sequence
  chemically synthesized
tgttgtttaataaaactcttaa

SEQ ID NO: 1186543 - DNA, 22 bp, Artificial Sequence
  chemically synthesized
ttgttgtttaataaaactctta

SEQ ID NO: 1186544 - DNA, 22 bp, Artificial Sequence
  chemically synthesized
gtcagtcttttaagagttttat

SEQ ID NO: 1186545 - DNA, 22 bp, Artificial Sequence
  chemically synthesized
acagtttttgttgtttaataaa

SEQ ID NO: 1186546 - DNA, 22 bp, Artificial Sequence
  chemically synthesized
tcacagtttttgttgtttaata

SEQ ID NO: 1186547 - DNA, 22 bp, Artificial Sequence
  chemically synthesized
ttaagagttttattaaacaaca

SEQ ID NO: 1186548 - DNA, 22 bp, Artificial Sequence
  chemically synthesized
taagagttttattaaacaacaa

SEQ ID NO: 1186549 - DNA, 22 bp, Artificial Sequence
  chemically synthesized
aagagttttattaaacaacaaa

SEQ ID NO: 1186550 - DNA, 22 bp, Artificial Sequence
  chemically synthesized
agagttttattaaacaacaaaa

SEQ ID NO: 1186551 - DNA, 22 bp, Artificial Sequence
  chemically synthesized
tattaaacaacaaaaactgtga

SEQ ID NO: 1186552 - DNA, 22 bp, Artificial Sequence
  chemically synthesized
aatgacatcctctcacagtttt

SEQ ID NO: 1186553 - DNA, 22 bp, Artificial Sequence
  chemically synthesized
attaaacaacaaaaactgtgag

SEQ ID NO: 1186554 - DNA, 22 bp, Artificial Sequence
  chemically synthesized
ttaaacaacaaaaactgtgaga

SEQ ID NO: 1186555 - DNA, 22 bp, Artificial Sequence
  chemically synthesized
taaatgacatcctctcacagtt

SEQ ID NO: 1186556 - DNA, 22 bp, Artificial Sequence
  chemically synthesized
ctaaatgacatcctctcacagt

SEQ ID NO: 1186557 - DNA, 22 bp, Artificial Sequence
  chemically synthesized
aacaacaaaaactgtgagagga

SEQ ID NO: 1186558 - DNA, 22 bp, Artificial Sequence
  chemically synthesized
atcatggtttctaaatgacatc

SEQ ID NO: 1186559 - DNA, 22 bp, Artificial Sequence
  chemically synthesized
tgagaggatgtcatttagaaac

SEQ ID NO: 1186560 - DNA, 22 bp, Artificial Sequence
  chemically synthesized
atgctcatcatggtttctaaat

SEQ ID NO: 1186561 - DNA, 22 bp, Artificial Sequence
  chemically synthesized
tggggaggttgatgctcatcat

SEQ ID NO: 1186562 - DNA, 22 bp, Artificial Sequence
  chemically synthesized
agaaaccatgatgagcatcaac

SEQ ID NO: 1186563 - DNA, 22 bp, Artificial Sequence
  chemically synthesized
gaaaccatgatgagcatcaacc

SEQ ID NO: 1186564 - DNA, 22 bp, Artificial Sequence
  chemically synthesized
atacaaaccctgtggggaggtt

SEQ ID NO: 1186565 - DNA, 22 bp, Artificial Sequence
  chemically synthesized
ctaatacaaaccctgtggggag

SEQ ID NO: 1186566 - DNA, 22 bp, Artificial Sequence
  chemically synthesized
cctaatacaaaccctgtgggga

SEQ ID NO: 1186567 - DNA, 22 bp, Artificial Sequence
  chemically synthesized
tttcctaatacaaaccctgtgg

SEQ ID NO: 1186568 - DNA, 22 bp, Artificial Sequence
  chemically synthesized
gtttcctaatacaaaccctgtg

SEQ ID NO: 1186569 - DNA, 22 bp, Artificial Sequence
  chemically synthesized
tgtttcctaatacaaaccctgt

SEQ ID NO: 1186570 - DNA, 22 bp, Artificial Sequence
  chemically synthesized
ttgtttcctaatacaaaccctg

SEQ ID NO: 1186571 - DNA, 22 bp, Artificial Sequence
  chemically synthesized
tttttgtttcctaatacaaacc

SEQ ID NO: 1186572 - DNA, 22 bp, Artificial Sequence
  chemically synthesized
atttttgtttcctaatacaaac

SEQ ID NO: 1186573 - DNA, 22 bp, Artificial Sequence
  chemically synthesized
tttatttttgtttcctaataca

SEQ ID NO: 1186574 - DNA, 22 bp, Artificial Sequence
  chemically synthesized
cccacagggtttgtattaggaa

SEQ ID NO: 1186575 - DNA, 22 bp, Artificial Sequence
  chemically synthesized
atttatttttgtttcctaatac

SEQ ID NO: 1186576 - DNA, 22 bp, Artificial Sequence
  chemically synthesized
agtgaatttatttatttttgtt

SEQ ID NO: 1186577 - DNA, 22 bp, Artificial Sequence
  chemically synthesized
tcagtgaatttatttatttttg

SEQ ID NO: 1186578 - DNA, 22 bp, Artificial Sequence
  chemically synthesized
gtattaggaaacaaaaataaat

SEQ ID NO: 1186579 - DNA, 22 bp, Artificial Sequence
  chemically synthesized
ctcagtgaatttatttattttt

SEQ ID NO: 1186580 - DNA, 22 bp, Artificial Sequence
  chemically synthesized
tattaggaaacaaaaataaata

SEQ ID NO: 1186581 - DNA, 22 bp, Artificial Sequence
  chemically synthesized
ttctcagtgaatttatttattt

SEQ ID NO: 1186582 - DNA, 22 bp, Artificial Sequence
  chemically synthesized
cttctcagtgaatttatttatt

SEQ ID NO: 1186583 - DNA, 22 bp, Artificial Sequence
  chemically synthesized
tcttctcagtgaatttatttat

SEQ ID NO: 1186584 - DNA, 22 bp, Artificial Sequence
  chemically synthesized
ttcttctcagtgaatttattta

SEQ ID NO: 1186585 - DNA, 22 bp, Artificial Sequence
  chemically synthesized
ggaaacaaaaataaataaattc

SEQ ID NO: 1186586 - DNA, 22 bp, Artificial Sequence
  chemically synthesized
cttttcttctcagtgaatttat

SEQ ID NO: 1186587 - DNA, 22 bp, Artificial Sequence
  chemically synthesized
ttccttttcttctcagtgaatt

SEQ ID NO: 1186588 - DNA, 22 bp, Artificial Sequence
  chemically synthesized
tattccttttcttctcagtgaa

SEQ ID NO: 1186589 - DNA, 22 bp, Artificial Sequence
  chemically synthesized
tctattccttttcttctcagtg

SEQ ID NO: 1186590 - DNA, 22 bp, Artificial Sequence
  chemically synthesized
ctctattccttttcttctcagt

SEQ ID NO: 1186591 - DNA, 22 bp, Artificial Sequence
  chemically synthesized
cagtttctctattccttttctt

SEQ ID NO: 1186592 - DNA, 22 bp, Artificial Sequence
  chemically synthesized
ccagtttctctattccttttct

SEQ ID NO: 1186593 - DNA, 22 bp, Artificial Sequence
  chemically synthesized
tccagtttctctattccttttc

SEQ ID NO: 1186594 - DNA, 22 bp, Artificial Sequence
  chemically synthesized
tttccagtttctctattccttt

SEQ ID NO: 1186595 - DNA, 22 bp, Artificial Sequence
  chemically synthesized
ctttccagtttctctattcctt

SEQ ID NO: 1186596 - DNA, 22 bp, Artificial Sequence
  chemically synthesized
actgagaagaaaaggaatagag

SEQ ID NO: 1186597 - DNA, 22 bp, Artificial Sequence
  chemically synthesized
agaagaaaaggaatagagaaac

SEQ ID NO: 1186598 - DNA, 22 bp, Artificial Sequence
  chemically synthesized
tgaccagaagtgccttctttcc

SEQ ID NO: 1186599 - DNA, 22 bp, Artificial Sequence
  chemically synthesized
atgaccagaagtgccttctttc

SEQ ID NO: 1186600 - DNA, 22 bp, Artificial Sequence
  chemically synthesized
gtttatgaccagaagtgccttc

SEQ ID NO: 1186601 - DNA, 22 bp, Artificial Sequence
  chemically synthesized
tggctagtttatgaccagaagt

SEQ ID NO: 1186602 - DNA, 22 bp, Artificial Sequence
  chemically synthesized
gaaagaaggcacttctggtcat

SEQ ID NO: 1186603 - DNA, 22 bp, Artificial Sequence
  chemically synthesized
gctatggctagtttatgaccag

SEQ ID NO: 1186604 - DNA, 22 bp, Artificial Sequence
  chemically synthesized
tggctatggctagtttatgacc

SEQ ID NO: 1186605 - DNA, 22 bp, Artificial Sequence
  chemically synthesized
agcattctggctatggctagtt

SEQ ID NO: 1186606 - DNA, 22 bp, Artificial Sequence
  chemically synthesized
gagcattctggctatggctagt

SEQ ID NO: 1186607 - DNA, 22 bp, Artificial Sequence
  chemically synthesized
tgagcattctggctatggctag

SEQ ID NO: 1186608 - DNA, 22 bp, Artificial Sequence
  chemically synthesized
ctggtcataaactagccatagc

SEQ ID NO: 1186609 - DNA, 22 bp, Artificial Sequence
  chemically synthesized
tggtcataaactagccatagcc

SEQ ID NO: 1186610 - DNA, 22 bp, Artificial Sequence
  chemically synthesized
gtcataaactagccatagccag

SEQ ID NO: 1186611 - DNA, 22 bp, Artificial Sequence
  chemically synthesized
atattttgagcattctggctat

SEQ ID NO: 1186612 - DNA, 22 bp, Artificial Sequence
  chemically synthesized
catattttgagcattctggcta

SEQ ID NO: 1186613 - DNA, 22 bp, Artificial Sequence
  chemically synthesized
tcatattttgagcattctggct

SEQ ID NO: 1186614 - DNA, 22 bp, Artificial Sequence
  chemically synthesized
ttttcatattttgagcattctg

SEQ ID NO: 1186615 - DNA, 22 bp, Artificial Sequence
  chemically synthesized
tgttttcatattttgagcattc

SEQ ID NO: 1186616 - DNA, 22 bp, Artificial Sequence
  chemically synthesized
ctgttttcatattttgagcatt

SEQ ID NO: 1186617 - DNA, 22 bp, Artificial Sequence
  chemically synthesized
gccatagccagaatgctcaaaa

SEQ ID NO: 1186618 - DNA, 22 bp, Artificial Sequence
  chemically synthesized
tctgttttcatattttgagcat

SEQ ID NO: 1186619 - DNA, 22 bp, Artificial Sequence
  chemically synthesized
aaaatatgaaaacagaaaggcc

SEQ ID NO: 1186620 - DNA, 22 bp, Artificial Sequence
  chemically synthesized
tgccaacatataggcctttctg

SEQ ID NO: 1186621 - DNA, 22 bp, Artificial Sequence
  chemically synthesized
gttgtgccaacatataggcctt

SEQ ID NO: 1186622 - DNA, 22 bp, Artificial Sequence
  chemically synthesized
ggttgtgccaacatataggcct

SEQ ID NO: 1186623 - DNA, 22 bp, Artificial Sequence
  chemically synthesized
tggttgtgccaacatataggcc

SEQ ID NO: 1186624 - DNA, 22 bp, Artificial Sequence
  chemically synthesized
caaccataggttttggttgtgc

SEQ ID NO: 1186625 - DNA, 22 bp, Artificial Sequence
  chemically synthesized
acaaccataggttttggttgtg

SEQ ID NO: 1186626 - DNA, 22 bp, Artificial Sequence
  chemically synthesized
tttacaaccataggttttggtt

SEQ ID NO: 1186627 - DNA, 22 bp, Artificial Sequence
  chemically synthesized
tatgttggcacaaccaaaacct

SEQ ID NO: 1186628 - DNA, 22 bp, Artificial Sequence
  chemically synthesized
ttgtttacaaccataggttttg

SEQ ID NO: 1186629 - DNA, 22 bp, Artificial Sequence
  chemically synthesized
gcacaaccaaaacctatggttg

SEQ ID NO: 1186630 - DNA, 22 bp, Artificial Sequence
  chemically synthesized
ggttattgtttacaaccatagg

SEQ ID NO: 1186631 - DNA, 22 bp, Artificial Sequence
  chemically synthesized
tggttgtaaacaataacctaat

SEQ ID NO: 1186632 - DNA, 22 bp, Artificial Sequence
  chemically synthesized
gaatatcacatcaatgaattag

SEQ ID NO: 1186633 - DNA, 22 bp, Artificial Sequence
  chemically synthesized
taaacaataacctaattcattg

SEQ ID NO: 1186634 - DNA, 22 bp, Artificial Sequence
  chemically synthesized
agaatatcacatcaatgaatta

SEQ ID NO: 1186635 - DNA, 22 bp, Artificial Sequence
  chemically synthesized
tagaatatcacatcaatgaatt

SEQ ID NO: 1186636 - DNA, 22 bp, Artificial Sequence
  chemically synthesized
ttagaatatcacatcaatgaat

SEQ ID NO: 1186637 - DNA, 22 bp, Artificial Sequence
  chemically synthesized
tccttttagaatatcacatcaa

SEQ ID NO: 1186638 - DNA, 22 bp, Artificial Sequence
  chemically synthesized
gtccttttagaatatcacatca

SEQ ID NO: 1186639 - DNA, 22 bp, Artificial Sequence
  chemically synthesized
tgtccttttagaatatcacatc

SEQ ID NO: 1186640 - DNA, 22 bp, Artificial Sequence
  chemically synthesized
attcattgatgtgatattctaa

SEQ ID NO: 1186641 - DNA, 22 bp, Artificial Sequence
  chemically synthesized
cagcactttgtccttttagaat

SEQ ID NO: 1186642 - DNA, 22 bp, Artificial Sequence
  chemically synthesized
attgatgtgatattctaaaagg

SEQ ID NO: 1186643 - DNA, 22 bp, Artificial Sequence
  chemically synthesized
ccagcactttgtccttttagaa

SEQ ID NO: 1186644 - DNA, 22 bp, Artificial Sequence
  chemically synthesized
cttccagcactttgtcctttta

SEQ ID NO: 1186645 - DNA, 22 bp, Artificial Sequence
  chemically synthesized
atgtgatattctaaaaggacaa

SEQ ID NO: 1186646 - DNA, 22 bp, Artificial Sequence
  chemically synthesized
acttccagcactttgtcctttt

SEQ ID NO: 1186647 - DNA, 22 bp, Artificial Sequence
  chemically synthesized
tacttccagcactttgtccttt

SEQ ID NO: 1186648 - DNA, 22 bp, Artificial Sequence
  chemically synthesized
taaaaggacaaagtgctggaag

SEQ ID NO: 1186649 - DNA, 22 bp, Artificial Sequence
  chemically synthesized
aaaggacaaagtgctggaagta

SEQ ID NO: 1186650 - DNA, 22 bp, Artificial Sequence
  chemically synthesized
aaaaaataatccactttacttc

SEQ ID NO: 1186651 - DNA, 22 bp, Artificial Sequence
  chemically synthesized
gaagtaaagtggattatttttt

SEQ ID NO: 1186652 - DNA, 22 bp, Artificial Sequence
  chemically synthesized
gtatgcaagcctcaaaaaataa

SEQ ID NO: 1186653 - DNA, 22 bp, Artificial Sequence
  chemically synthesized
cgtatgcaagcctcaaaaaata

SEQ ID NO: 1186654 - DNA, 22 bp, Artificial Sequence
  chemically synthesized
ttcgtatgcaagcctcaaaaaa

SEQ ID NO: 1186655 - DNA, 22 bp, Artificial Sequence
  chemically synthesized
ttttttgaggcttgcatacgaa

SEQ ID NO: 1186656 - DNA, 22 bp, Artificial Sequence
  chemically synthesized
taacataaatctcttcgtatgc

SEQ ID NO: 1186657 - DNA, 22 bp, Artificial Sequence
  chemically synthesized
tttgaggcttgcatacgaagag

SEQ ID NO: 1186658 - DNA, 22 bp, Artificial Sequence
  chemically synthesized
ttgaggcttgcatacgaagaga

SEQ ID NO: 1186659 - DNA, 22 bp, Artificial Sequence
  chemically synthesized
tgaggcttgcatacgaagagat

SEQ ID NO: 1186660 - DNA, 22 bp, Artificial Sequence
  chemically synthesized
gaggcttgcatacgaagagatt

SEQ ID NO: 1186661 - DNA, 22 bp, Artificial Sequence
  chemically synthesized
aggcttgcatacgaagagattt

SEQ ID NO: 1186662 - DNA, 22 bp, Artificial Sequence
  chemically synthesized
gcatacgaagagatttatgtta

SEQ ID NO: 1186663 - DNA, 22 bp, Artificial Sequence
  chemically synthesized
catacgaagagatttatgttat

SEQ ID NO: 1186664 - DNA, 22 bp, Artificial Sequence
  chemically synthesized
gatatcagatgatattataaca

SEQ ID NO: 1186665 - DNA, 22 bp, Artificial Sequence
  chemically synthesized
agatatcagatgatattataac

SEQ ID NO: 1186666 - DNA, 22 bp, Artificial Sequence
  chemically synthesized
cagcatttagatatcagatgat

SEQ ID NO: 1186667 - DNA, 22 bp, Artificial Sequence
  chemically synthesized
atgttataatatcatctgatat

SEQ ID NO: 1186668 - DNA, 22 bp, Artificial Sequence
  chemically synthesized
tgttataatatcatctgatatc

SEQ ID NO: 1186669 - DNA, 22 bp, Artificial Sequence
  chemically synthesized
gaaactccagcatttagatatc

SEQ ID NO: 1186670 - DNA, 22 bp, Artificial Sequence
  chemically synthesized
taatatcatctgatatctaaat

SEQ ID NO: 1186671 - DNA, 22 bp, Artificial Sequence
  chemically synthesized
agaaactccagcatttagatat

SEQ ID NO: 1186672 - DNA, 22 bp, Artificial Sequence
  chemically synthesized
caacttagaaactccagcattt

SEQ ID NO: 1186673 - DNA, 22 bp, Artificial Sequence
  chemically synthesized
atatctaaatgctggagtttct

SEQ ID NO: 1186674 - DNA, 22 bp, Artificial Sequence
  chemically synthesized
aatgctggagtttctaagttgt

SEQ ID NO: 1186675 - DNA, 22 bp, Artificial Sequence
  chemically synthesized
ccatgatatggtctacaactta

SEQ ID NO: 1186676 - DNA, 22 bp, Artificial Sequence
  chemically synthesized
gagtttctaagttgtagaccat

SEQ ID NO: 1186677 - DNA, 22 bp, Artificial Sequence
  chemically synthesized
gtccattgccatgatatggtct

SEQ ID NO: 1186678 - DNA, 22 bp, Artificial Sequence
  chemically synthesized
ctaagttgtagaccatatcatg

SEQ ID NO: 1186679 - DNA, 22 bp, Artificial Sequence
  chemically synthesized
taagttgtagaccatatcatgg

SEQ ID NO: 1186680 - DNA, 22 bp, Artificial Sequence
  chemically synthesized
agttgtagaccatatcatggca

SEQ ID NO: 1186681 - DNA, 22 bp, Artificial Sequence
  chemically synthesized
atgaattagtccattgccatga

SEQ ID NO: 1186682 - DNA, 22 bp, Artificial Sequence
  chemically synthesized
aatgaattagtccattgccatg

SEQ ID NO: 1186683 - DNA, 22 bp, Artificial Sequence
  chemically synthesized
taatgaattagtccattgccat

SEQ ID NO: 1186684 - DNA, 22 bp, Artificial Sequence
  chemically synthesized
tagaccatatcatggcaatgga

SEQ ID NO: 1186685 - DNA, 22 bp, Artificial Sequence
  chemically synthesized
aaaataacaatatcatgcttta

SEQ ID NO: 1186686 - DNA, 22 bp, Artificial Sequence
  chemically synthesized
attcattaaagcatgatattgt

SEQ ID NO: 1186687 - DNA, 22 bp, Artificial Sequence
  chemically synthesized
attaaagcatgatattgttatt

SEQ ID NO: 1186688 - DNA, 22 bp, Artificial Sequence
  chemically synthesized
aagcatgatattgttattttta

SEQ ID NO: 1186689 - DNA, 22 bp, Artificial Sequence
  chemically synthesized
aatgccaaatacaaaatattaa

SEQ ID NO: 1186690 - DNA, 22 bp, Artificial Sequence
  chemically synthesized
ttatttttaatattttgtattt

SEQ ID NO: 1186691 - DNA, 22 bp, Artificial Sequence
  chemically synthesized
tttttaatattttgtatttggc

SEQ ID NO: 1186692 - DNA, 22 bp, Artificial Sequence
  chemically synthesized
ttaatattttgtatttggcatt

SEQ ID NO: 1186693 - DNA, 22 bp, Artificial Sequence
  chemically synthesized
taatattttgtatttggcattc

SEQ ID NO: 1186694 - DNA, 22 bp, Artificial Sequence
  chemically synthesized
aatattttgtatttggcattca

SEQ ID NO: 1186695 - DNA, 22 bp, Artificial Sequence
  chemically synthesized
atattttgtatttggcattcag

SEQ ID NO: 1186696 - DNA, 22 bp, Artificial Sequence
  chemically synthesized
tgtatttggcattcagcactga

SEQ ID NO: 1186697 - DNA, 22 bp, Artificial Sequence
  chemically synthesized
gtatttggcattcagcactgac

SEQ ID NO: 1186698 - DNA, 22 bp, Artificial Sequence
  chemically synthesized
tatttggcattcagcactgact

SEQ ID NO: 1186699 - DNA, 22 bp, Artificial Sequence
  chemically synthesized
ggcattcagcactgactgcatt

SEQ ID NO: 1186700 - DNA, 22 bp, Artificial Sequence
  chemically synthesized
gcattcagcactgactgcattg

SEQ ID NO: 1186701 - DNA, 22 bp, Artificial Sequence
  chemically synthesized
agcactgactgcattgtacata

SEQ ID NO: 1186702 - DNA, 22 bp, Artificial Sequence
  chemically synthesized
taagtagagaatacatgtatgt

SEQ ID NO: 1186703 - DNA, 22 bp, Artificial Sequence
  chemically synthesized
gtaagtagagaatacatgtatg

SEQ ID NO: 1186704 - DNA, 22 bp, Artificial Sequence
  chemically synthesized
actgcattgtacatacatgtat

SEQ ID NO: 1186705 - DNA, 22 bp, Artificial Sequence
  chemically synthesized
cattgtacatacatgtattctc

SEQ ID NO: 1186706 - DNA, 22 bp, Artificial Sequence
  chemically synthesized
tacatacatgtattctctactt

SEQ ID NO: 1186707 - DNA, 22 bp, Artificial Sequence
  chemically synthesized
tatatagtgacttgtaagtaga

SEQ ID NO: 1186708 - DNA, 22 bp, Artificial Sequence
  chemically synthesized
ttgtatatagtgacttgtaagt

SEQ ID NO: 1186709 - DNA, 22 bp, Artificial Sequence
  chemically synthesized
tatatctattgtatatagtgac

SEQ ID NO: 1186710 - DNA, 22 bp, Artificial Sequence
  chemically synthesized
tctacttacaagtcactatata

SEQ ID NO: 1186711 - DNA, 22 bp, Artificial Sequence
  chemically synthesized
tacttacaagtcactatataca

SEQ ID NO: 1186712 - DNA, 22 bp, Artificial Sequence
  chemically synthesized
cttacaagtcactatatacaat

SEQ ID NO: 1186713 - DNA, 22 bp, Artificial Sequence
  chemically synthesized
acaagtcactatatacaataga

SEQ ID NO: 1186714 - DNA, 22 bp, Artificial Sequence
  chemically synthesized
aaatgttgtatatctattgtat

SEQ ID NO: 1186715 - DNA, 22 bp, Artificial Sequence
  chemically synthesized
caagtcactatatacaatagat

SEQ ID NO: 1186716 - DNA, 22 bp, Artificial Sequence
  chemically synthesized
attaaaatgttgtatatctatt

SEQ ID NO: 1186717 - DNA, 22 bp, Artificial Sequence
  chemically synthesized
aattaaaatgttgtatatctat

SEQ ID NO: 1186718 - DNA, 22 bp, Artificial Sequence
  chemically synthesized
taattaaaatgttgtatatcta

SEQ ID NO: 1186719 - DNA, 22 bp, Artificial Sequence
  chemically synthesized
tatacaatagatatacaacatt

SEQ ID NO: 1186720 - DNA, 22 bp, Artificial Sequence
  chemically synthesized
tgcaaattttaattaaaatgtt

SEQ ID NO: 1186721 - DNA, 22 bp, Artificial Sequence
  chemically synthesized
acatgggaggagttgtgcaaat

SEQ ID NO: 1186722 - DNA, 22 bp, Artificial Sequence
  chemically synthesized
aacatgggaggagttgtgcaaa

SEQ ID NO: 1186723 - DNA, 22 bp, Artificial Sequence
  chemically synthesized
taattaaaatttgcacaactcc

SEQ ID NO: 1186724 - DNA, 22 bp, Artificial Sequence
  chemically synthesized
aattaaaatttgcacaactcct

SEQ ID NO: 1186725 - DNA, 22 bp, Artificial Sequence
  chemically synthesized
attaaaatttgcacaactcctc

SEQ ID NO: 1186726 - DNA, 22 bp, Artificial Sequence
  chemically synthesized
aaaaatttaacatgggaggagt

SEQ ID NO: 1186727 - DNA, 22 bp, Artificial Sequence
  chemically synthesized
aaatttgcacaactcctcccat

SEQ ID NO: 1186728 - DNA, 22 bp, Artificial Sequence
  chemically synthesized
gcacaactcctcccatgttaaa

SEQ ID NO: 1186729 - DNA, 22 bp, Artificial Sequence
  chemically synthesized
cacaactcctcccatgttaaat

SEQ ID NO: 1186730 - DNA, 22 bp, Artificial Sequence
  chemically synthesized
cagaatgttaaaaaatttaaca

SEQ ID NO: 1186731 - DNA, 22 bp, Artificial Sequence
  chemically synthesized
gcagaatgttaaaaaatttaac

SEQ ID NO: 1186732 - DNA, 22 bp, Artificial Sequence
  chemically synthesized
ctcccatgttaaattttttaac

SEQ ID NO: 1186733 - DNA, 22 bp, Artificial Sequence
  chemically synthesized
ccatgttaaattttttaacatt

SEQ ID NO: 1186734 - DNA, 22 bp, Artificial Sequence
  chemically synthesized
aattttttaacattctgcaaga

SEQ ID NO: 1186735 - DNA, 22 bp, Artificial Sequence
  chemically synthesized
aggcagaacatatcttgcagaa

SEQ ID NO: 1186736 - DNA, 22 bp, Artificial Sequence
  chemically synthesized
gctaaggcagaacatatcttgc

SEQ ID NO: 1186737 - DNA, 22 bp, Artificial Sequence
  chemically synthesized
tttaacattctgcaagatatgt

SEQ ID NO: 1186738 - DNA, 22 bp, Artificial Sequence
  chemically synthesized
agctaaggcagaacatatcttg

SEQ ID NO: 1186739 - DNA, 22 bp, Artificial Sequence
  chemically synthesized
ttaacattctgcaagatatgtt

SEQ ID NO: 1186740 - DNA, 22 bp, Artificial Sequence
  chemically synthesized
taacattctgcaagatatgttc

SEQ ID NO: 1186741 - DNA, 22 bp, Artificial Sequence
  chemically synthesized
aacattctgcaagatatgttct

SEQ ID NO: 1186742 - DNA, 22 bp, Artificial Sequence
  chemically synthesized
acattctgcaagatatgttctg

SEQ ID NO: 1186743 - DNA, 22 bp, Artificial Sequence
  chemically synthesized
atttagctaaggcagaacatat

SEQ ID NO: 1186744 - DNA, 22 bp, Artificial Sequence
  chemically synthesized
aatttagctaaggcagaacata

SEQ ID NO: 1186745 - DNA, 22 bp, Artificial Sequence
  chemically synthesized
tgcaagatatgttctgccttag

SEQ ID NO: 1186746 - DNA, 22 bp, Artificial Sequence
  chemically synthesized
caagatatgttctgccttagct

SEQ ID NO: 1186747 - DNA, 22 bp, Artificial Sequence
  chemically synthesized
aggagtacttaatttagctaag

SEQ ID NO: 1186748 - DNA, 22 bp, Artificial Sequence
  chemically synthesized
attaaggagtacttaatttagc

SEQ ID NO: 1186749 - DNA, 22 bp, Artificial Sequence
  chemically synthesized
tgccttagctaaattaagtact

SEQ ID NO: 1186750 - DNA, 22 bp, Artificial Sequence
  chemically synthesized
ccttagctaaattaagtactcc

SEQ ID NO: 1186751 - DNA, 22 bp, Artificial Sequence
  chemically synthesized
agctaaattaagtactccttaa

SEQ ID NO: 1186752 - DNA, 22 bp, Artificial Sequence
  chemically synthesized
aaaatggattaattaaggagta

SEQ ID NO: 1186753 - DNA, 22 bp, Artificial Sequence
  chemically synthesized
gctaaattaagtactccttaat

SEQ ID NO: 1186754 - DNA, 22 bp, Artificial Sequence
  chemically synthesized
aattaagtactccttaattaat

SEQ ID NO: 1186755 - DNA, 22 bp, Artificial Sequence
  chemically synthesized
agtactccttaattaatccatt

SEQ ID NO: 1186756 - DNA, 22 bp, Artificial Sequence
  chemically synthesized
cttaattaatccatttttagca

SEQ ID NO: 1186757 - DNA, 22 bp, Artificial Sequence
  chemically synthesized
aattaatccatttttagcactt

SEQ ID NO: 1186758 - DNA, 22 bp, Artificial Sequence
  chemically synthesized
tatcagtgaatgaagtgctaaa

SEQ ID NO: 1186759 - DNA, 22 bp, Artificial Sequence
  chemically synthesized
attaatccatttttagcacttc

SEQ ID NO: 1186760 - DNA, 22 bp, Artificial Sequence
  chemically synthesized
gtatcagtgaatgaagtgctaa

SEQ ID NO: 1186761 - DNA, 22 bp, Artificial Sequence
  chemically synthesized
cttgtatcagtgaatgaagtgc

SEQ ID NO: 1186762 - DNA, 22 bp, Artificial Sequence
  chemically synthesized
atccatttttagcacttcattc

SEQ ID NO: 1186763 - DNA, 22 bp, Artificial Sequence
  chemically synthesized
ttagcacttcattcactgatac

SEQ ID NO: 1186764 - DNA, 22 bp, Artificial Sequence
  chemically synthesized
tagcacttcattcactgataca

SEQ ID NO: 1186765 - DNA, 22 bp, Artificial Sequence
  chemically synthesized
agcacttcattcactgatacaa

SEQ ID NO: 1186766 - DNA, 22 bp, Artificial Sequence
  chemically synthesized
gcacttcattcactgatacaag

SEQ ID NO: 1186767 - DNA, 22 bp, Artificial Sequence
  chemically synthesized
aatggtaaaagcaactgcttgt

SEQ ID NO: 1186768 - DNA, 22 bp, Artificial Sequence
  chemically synthesized
cattcactgatacaagcagttg

SEQ ID NO: 1186769 - DNA, 22 bp, Artificial Sequence
  chemically synthesized
attcactgatacaagcagttgc

SEQ ID NO: 1186770 - DNA, 22 bp, Artificial Sequence
  chemically synthesized
ctaaatggtaaaagcaactgct

SEQ ID NO: 1186771 - DNA, 22 bp, Artificial Sequence
  chemically synthesized
actgatacaagcagttgctttt

SEQ ID NO: 1186772 - DNA, 22 bp, Artificial Sequence
  chemically synthesized
ttactaaatggtaaaagcaact

SEQ ID NO: 1186773 - DNA, 22 bp, Artificial Sequence
  chemically synthesized
atacaagcagttgcttttacca

SEQ ID NO: 1186774 - DNA, 22 bp, Artificial Sequence
  chemically synthesized
atgagaagcattgttactaaat

SEQ ID NO: 1186775 - DNA, 22 bp, Artificial Sequence
  chemically synthesized
aatgagaagcattgttactaaa

SEQ ID NO: 1186776 - DNA, 22 bp, Artificial Sequence
  chemically synthesized
taatgagaagcattgttactaa

SEQ ID NO: 1186777 - DNA, 22 bp, Artificial Sequence
  chemically synthesized
cttttaccatttagtaacaatg

SEQ ID NO: 1186778 - DNA, 22 bp, Artificial Sequence
  chemically synthesized
ttaccatttagtaacaatgctt

SEQ ID NO: 1186779 - DNA, 22 bp, Artificial Sequence
  chemically synthesized
taccatttagtaacaatgcttc

SEQ ID NO: 1186780 - DNA, 22 bp, Artificial Sequence
  chemically synthesized
accatttagtaacaatgcttct

SEQ ID NO: 1186781 - DNA, 22 bp, Artificial Sequence
  chemically synthesized
ccatttagtaacaatgcttctc

SEQ ID NO: 1186782 - DNA, 22 bp, Artificial Sequence
  chemically synthesized
ccgtcctttaatgagaagcatt

SEQ ID NO: 1186783 - DNA, 22 bp, Artificial Sequence
  chemically synthesized
accgtcctttaatgagaagcat

SEQ ID NO: 1186784 - DNA, 22 bp, Artificial Sequence
  chemically synthesized
taccgtcctttaatgagaagca

SEQ ID NO: 1186785 - DNA, 22 bp, Artificial Sequence
  chemically synthesized
agtaacaatgcttctcattaaa

SEQ ID NO: 1186786 - DNA, 22 bp, Artificial Sequence
  chemically synthesized
gtaacaatgcttctcattaaag

SEQ ID NO: 1186787 - DNA, 22 bp, Artificial Sequence
  chemically synthesized
tgacattttaccgtcctttaat

SEQ ID NO: 1186788 - DNA, 22 bp, Artificial Sequence
  chemically synthesized
cattatgacattttaccgtcct

SEQ ID NO: 1186789 - DNA, 22 bp, Artificial Sequence
  chemically synthesized
ccattatgacattttaccgtcc

SEQ ID NO: 1186790 - DNA, 22 bp, Artificial Sequence
  chemically synthesized
ctcattaaaggacggtaaaatg

SEQ ID NO: 1186791 - DNA, 22 bp, Artificial Sequence
  chemically synthesized
tttccattatgacattttaccg

SEQ ID NO: 1186792 - DNA, 22 bp, Artificial Sequence
  chemically synthesized
tcattaaaggacggtaaaatgt

SEQ ID NO: 1186793 - DNA, 22 bp, Artificial Sequence
  chemically synthesized
attaaaggacggtaaaatgtca

SEQ ID NO: 1186794 - DNA, 22 bp, Artificial Sequence
  chemically synthesized
aaggacggtaaaatgtcataat

SEQ ID NO: 1186795 - DNA, 22 bp, Artificial Sequence
  chemically synthesized
atcaacgcaaattatttccatt

SEQ ID NO: 1186796 - DNA, 22 bp, Artificial Sequence
  chemically synthesized
catcaacgcaaattatttccat

SEQ ID NO: 1186797 - DNA, 22 bp, Artificial Sequence
  chemically synthesized
aatcatcttcatcaacgcaaat

SEQ ID NO: 1186798 - DNA, 22 bp, Artificial Sequence
  chemically synthesized
tgatgaaattcaatcatcttca

SEQ ID NO: 1186799 - DNA, 22 bp, Artificial Sequence
  chemically synthesized
atgatgaaattcaatcatcttc

SEQ ID NO: 1186800 - DNA, 22 bp, Artificial Sequence
  chemically synthesized
tatgatgaaattcaatcatctt

SEQ ID NO: 1186801 - DNA, 22 bp, Artificial Sequence
  chemically synthesized
gcgttgatgaagatgattgaat

SEQ ID NO: 1186802 - DNA, 22 bp, Artificial Sequence
  chemically synthesized
cgttgatgaagatgattgaatt

SEQ ID NO: 1186803 - DNA, 22 bp, Artificial Sequence
  chemically synthesized
attttatgatgaaattcaatca

SEQ ID NO: 1186804 - DNA, 22 bp, Artificial Sequence
  chemically synthesized
ttaattttatgatgaaattcaa

SEQ ID NO: 1186805 - DNA, 22 bp, Artificial Sequence
  chemically synthesized
atgaagatgattgaatttcatc

SEQ ID NO: 1186806 - DNA, 22 bp, Artificial Sequence
  chemically synthesized
tcgttattaattttatgatgaa

SEQ ID NO: 1186807 - DNA, 22 bp, Artificial Sequence
  chemically synthesized
atcgttattaattttatgatga

SEQ ID NO: 1186808 - DNA, 22 bp, Artificial Sequence
  chemically synthesized
tatcgttattaattttatgatg

SEQ ID NO: 1186809 - DNA, 22 bp, Artificial Sequence
  chemically synthesized
ttatcgttattaattttatgat

SEQ ID NO: 1186810 - DNA, 22 bp, Artificial Sequence
  chemically synthesized
tttatcgttattaattttatga

SEQ ID NO: 1186811 - DNA, 22 bp, Artificial Sequence
  chemically synthesized
ctttttatcgttattaatttta

SEQ ID NO: 1186812 - DNA, 22 bp, Artificial Sequence
  chemically synthesized
aatttcatcataaaattaataa

SEQ ID NO: 1186813 - DNA, 22 bp, Artificial Sequence
  chemically synthesized
catcataaaattaataacgata

SEQ ID NO: 1186814 - DNA, 22 bp, Artificial Sequence
  chemically synthesized
atcataaaattaataacgataa

SEQ ID NO: 1186815 - DNA, 22 bp, Artificial Sequence
  chemically synthesized
gataaatataggccattacttt

SEQ ID NO: 1186816 - DNA, 22 bp, Artificial Sequence
  chemically synthesized
ataacgataaaaagtaatggcc

SEQ ID NO: 1186817 - DNA, 22 bp, Artificial Sequence
  chemically synthesized
ctggataaatataggccattac

SEQ ID NO: 1186818 - DNA, 22 bp, Artificial Sequence
  chemically synthesized
tcctggataaatataggccatt

SEQ ID NO: 1186819 - DNA, 22 bp, Artificial Sequence
  chemically synthesized
ctcctggataaatataggccat

SEQ ID NO: 1186820 - DNA, 22 bp, Artificial Sequence
  chemically synthesized
tgtttctcctggataaatatag

SEQ ID NO: 1186821 - DNA, 22 bp, Artificial Sequence
  chemically synthesized
gtgtttctcctggataaatata

SEQ ID NO: 1186822 - DNA, 22 bp, Artificial Sequence
  chemically synthesized
tgtgtttctcctggataaatat

SEQ ID NO: 1186823 - DNA, 22 bp, Artificial Sequence
  chemically synthesized
ttttgtgtttctcctggataaa

SEQ ID NO: 1186824 - DNA, 22 bp, Artificial Sequence
  chemically synthesized
tatttatccaggagaaacacaa

SEQ ID NO: 1186825 - DNA, 22 bp, Artificial Sequence
  chemically synthesized
atccaggagaaacacaaaacaa

SEQ ID NO: 1186826 - DNA, 22 bp, Artificial Sequence
  chemically synthesized
tccaggagaaacacaaaacaat

SEQ ID NO: 1186827 - DNA, 22 bp, Artificial Sequence
  chemically synthesized
aaaagcgtaatggaaagtgcaa

SEQ ID NO: 1186828 - DNA, 22 bp, Artificial Sequence
  chemically synthesized
tatcttttgcactttccattac

SEQ ID NO: 1186829 - DNA, 22 bp, Artificial Sequence
  chemically synthesized
atcttttgcactttccattacg

SEQ ID NO: 1186830 - DNA, 22 bp, Artificial Sequence
  chemically synthesized
tcttttgcactttccattacgc

SEQ ID NO: 1186831 - DNA, 22 bp, Artificial Sequence
  chemically synthesized
ttgcactttccattacgctttt

SEQ ID NO: 1186832 - DNA, 22 bp, Artificial Sequence
  chemically synthesized
tgcactttccattacgcttttc

SEQ ID NO: 1186833 - DNA, 22 bp, Artificial Sequence
  chemically synthesized
gcactttccattacgcttttca

SEQ ID NO: 1186834 - DNA, 22 bp, Artificial Sequence
  chemically synthesized
cactttccattacgcttttcaa

SEQ ID NO: 1186835 - DNA, 22 bp, Artificial Sequence
  chemically synthesized
caccataagcatgttgaaaagc

SEQ ID NO: 1186836 - DNA, 22 bp, Artificial Sequence
  chemically synthesized
tccattacgcttttcaacatgc

SEQ ID NO: 1186837 - DNA, 22 bp, Artificial Sequence
  chemically synthesized
gttacaccataagcatgttgaa

SEQ ID NO: 1186838 - DNA, 22 bp, Artificial Sequence
  chemically synthesized
ccattacgcttttcaacatgct

SEQ ID NO: 1186839 - DNA, 22 bp, Artificial Sequence
  chemically synthesized
cattacgcttttcaacatgctt

SEQ ID NO: 1186840 - DNA, 22 bp, Artificial Sequence
  chemically synthesized
ctagttacaccataagcatgtt

SEQ ID NO: 1186841 - DNA, 22 bp, Artificial Sequence
  chemically synthesized
tgctagttacaccataagcatg

SEQ ID NO: 1186842 - DNA, 22 bp, Artificial Sequence
  chemically synthesized
ctgctagttacaccataagcat

SEQ ID NO: 1186843 - DNA, 22 bp, Artificial Sequence
  chemically synthesized
cgcttttcaacatgcttatggt

SEQ ID NO: 1186844 - DNA, 22 bp, Artificial Sequence
  chemically synthesized
tctgctagttacaccataagca

SEQ ID NO: 1186845 - DNA, 22 bp, Artificial Sequence
  chemically synthesized
ttcaacatgcttatggtgtaac

SEQ ID NO: 1186846 - DNA, 22 bp, Artificial Sequence
  chemically synthesized
tcaacatgcttatggtgtaact

SEQ ID NO: 1186847 - DNA, 22 bp, Artificial Sequence
  chemically synthesized
caacatgcttatggtgtaacta

SEQ ID NO: 1186848 - DNA, 22 bp, Artificial Sequence
  chemically synthesized
aacatgcttatggtgtaactag

SEQ ID NO: 1186849 - DNA, 22 bp, Artificial Sequence
  chemically synthesized
atggtgtaactagcagaaaact

SEQ ID NO: 1186850 - DNA, 22 bp, Artificial Sequence
  chemically synthesized
tggtgtaactagcagaaaacta

SEQ ID NO: 1186851 - DNA, 22 bp, Artificial Sequence
  chemically synthesized
taacaagatgatggtgatagtt

SEQ ID NO: 1186852 - DNA, 22 bp, Artificial Sequence
  chemically synthesized
gtaacaagatgatggtgatagt

SEQ ID NO: 1186853 - DNA, 22 bp, Artificial Sequence
  chemically synthesized
cttgtaacaagatgatggtgat

SEQ ID NO: 1186854 - DNA, 22 bp, Artificial Sequence
  chemically synthesized
gcagaaaactatcaccatcatc

SEQ ID NO: 1186855 - DNA, 22 bp, Artificial Sequence
  chemically synthesized
tacttgtaacaagatgatggtg

SEQ ID NO: 1186856 - DNA, 22 bp, Artificial Sequence
  chemically synthesized
ctacttgtaacaagatgatggt

SEQ ID NO: 1186857 - DNA, 22 bp, Artificial Sequence
  chemically synthesized
tctacttgtaacaagatgatgg

SEQ ID NO: 1186858 - DNA, 22 bp, Artificial Sequence
  chemically synthesized
ttttctacttgtaacaagatga

SEQ ID NO: 1186859 - DNA, 22 bp, Artificial Sequence
  chemically synthesized
tcaccatcatcttgttacaagt

SEQ ID NO: 1186860 - DNA, 22 bp, Artificial Sequence
  chemically synthesized
agccactgttttctacttgtaa

SEQ ID NO: 1186861 - DNA, 22 bp, Artificial Sequence
  chemically synthesized
gttacaagtagaaaacagtggc

SEQ ID NO: 1186862 - DNA, 22 bp, Artificial Sequence
  chemically synthesized
ttacaagtagaaaacagtggct

SEQ ID NO: 1186863 - DNA, 22 bp, Artificial Sequence
  chemically synthesized
aagcgcccagcctgagccactg

SEQ ID NO: 1186864 - DNA, 22 bp, Artificial Sequence
  chemically synthesized
caagtagaaaacagtggctcag

SEQ ID NO: 1186865 - DNA, 22 bp, Artificial Sequence
  chemically synthesized
caggcatgagctaaagcgccca

SEQ ID NO: 1186866 - DNA, 22 bp, Artificial Sequence
  chemically synthesized
ggattacaggcatgagctaaag

SEQ ID NO: 1186867 - DNA, 22 bp, Artificial Sequence
  chemically synthesized
aggctgggcgctttagctcatg

SEQ ID NO: 1186868 - DNA, 22 bp, Artificial Sequence
  chemically synthesized
ggcgctttagctcatgcctgta

SEQ ID NO: 1186869 - DNA, 22 bp, Artificial Sequence
  chemically synthesized
ccgaagtgctgggattacaggc

SEQ ID NO: 1186870 - DNA, 22 bp, Artificial Sequence
  chemically synthesized
tagctcatgcctgtaatcccag

SEQ ID NO: 1186871 - DNA, 22 bp, Artificial Sequence
  chemically synthesized
agctcatgcctgtaatcccagc

SEQ ID NO: 1186872 - DNA, 22 bp, Artificial Sequence
  chemically synthesized
gctcatgcctgtaatcccagca

SEQ ID NO: 1186873 - DNA, 22 bp, Artificial Sequence
  chemically synthesized
gtcctcccgaagtgctgggatt

SEQ ID NO: 1186874 - DNA, 22 bp, Artificial Sequence
  chemically synthesized
atgcctgtaatcccagcacttc

SEQ ID NO: 1186875 - DNA, 22 bp, Artificial Sequence
  chemically synthesized
cctcgtcctcccgaagtgctgg

SEQ ID NO: 1186876 - DNA, 22 bp, Artificial Sequence
  chemically synthesized
taatcccagcacttcgggagga

SEQ ID NO: 1186877 - DNA, 22 bp, Artificial Sequence
  chemically synthesized
aggcgatgcacctgcctcgtcc

SEQ ID NO: 1186878 - DNA, 22 bp, Artificial Sequence
  chemically synthesized
acctcaggcgatgcacctgcct

SEQ ID NO: 1186879 - DNA, 22 bp, Artificial Sequence
  chemically synthesized
cgggaggacgaggcaggtgcat

SEQ ID NO: 1186880 - DNA, 22 bp, Artificial Sequence
  chemically synthesized
gggaggacgaggcaggtgcatc

SEQ ID NO: 1186881 - DNA, 22 bp, Artificial Sequence
  chemically synthesized
ctaacctcaggcgatgcacctg

SEQ ID NO: 1186882 - DNA, 22 bp, Artificial Sequence
  chemically synthesized
gtgtcaaattcctaacctcagg

SEQ ID NO: 1186883 - DNA, 22 bp, Artificial Sequence
  chemically synthesized
gccaggctggtgtcaaattcct

SEQ ID NO: 1186884 - DNA, 22 bp, Artificial Sequence
  chemically synthesized
aggttaggaatttgacaccagc

SEQ ID NO: 1186885 - DNA, 22 bp, Artificial Sequence
  chemically synthesized
accgtgttggccaggctggtgt

SEQ ID NO: 1186886 - DNA, 22 bp, Artificial Sequence
  chemically synthesized
caccgtgttggccaggctggtg

SEQ ID NO: 1186887 - DNA, 22 bp, Artificial Sequence
  chemically synthesized
tcaccgtgttggccaggctggt

SEQ ID NO: 1186888 - DNA, 22 bp, Artificial Sequence
  chemically synthesized
ttcaccgtgttggccaggctgg

SEQ ID NO: 1186889 - DNA, 22 bp, Artificial Sequence
  chemically synthesized
ggaatttgacaccagcctggcc

SEQ ID NO: 1186890 - DNA, 22 bp, Artificial Sequence
  chemically synthesized
gacaccagcctggccaacacgg

SEQ ID NO: 1186891 - DNA, 22 bp, Artificial Sequence
  chemically synthesized
acaccagcctggccaacacggt

SEQ ID NO: 1186892 - DNA, 22 bp, Artificial Sequence
  chemically synthesized
agacggcttttcaccgtgttgg

SEQ ID NO: 1186893 - DNA, 22 bp, Artificial Sequence
  chemically synthesized
gttgagacggcttttcaccgtg

SEQ ID NO: 1186894 - DNA, 22 bp, Artificial Sequence
  chemically synthesized
agttgagacggcttttcaccgt

SEQ ID NO: 1186895 - DNA, 22 bp, Artificial Sequence
  chemically synthesized
tagttgagacggcttttcaccg

SEQ ID NO: 1186896 - DNA, 22 bp, Artificial Sequence
  chemically synthesized
ttagttgagacggcttttcacc

SEQ ID NO: 1186897 - DNA, 22 bp, Artificial Sequence
  chemically synthesized
gccaacacggtgaaaagccgtc

SEQ ID NO: 1186898 - DNA, 22 bp, Artificial Sequence
  chemically synthesized
tatttttagttgagacggcttt

SEQ ID NO: 1186899 - DNA, 22 bp, Artificial Sequence
  chemically synthesized
atatttttagttgagacggctt

SEQ ID NO: 1186900 - DNA, 22 bp, Artificial Sequence
  chemically synthesized
tatatttttagttgagacggct

SEQ ID NO: 1186901 - DNA, 22 bp, Artificial Sequence
  chemically synthesized
ttatatttttagttgagacggc

SEQ ID NO: 1186902 - DNA, 22 bp, Artificial Sequence
  chemically synthesized
aactaaaaatataaaaatttct

SEQ ID NO: 1186903 - DNA, 22 bp, Artificial Sequence
  chemically synthesized
aaaatataaaaatttctccaca

SEQ ID NO: 1186904 - DNA, 22 bp, Artificial Sequence
  chemically synthesized
ctccacatcctctccggcacct

SEQ ID NO: 1186905 - DNA, 22 bp, Artificial Sequence
  chemically synthesized
tccacatcctctccggcacctg

SEQ ID NO: 1186906 - DNA, 22 bp, Artificial Sequence
  chemically synthesized
cacatcctctccggcacctgtt

SEQ ID NO: 1186907 - DNA, 22 bp, Artificial Sequence
  chemically synthesized
aaaagtcaggaaacaacaggtg

SEQ ID NO: 1186908 - DNA, 22 bp, Artificial Sequence
  chemically synthesized
tccggcacctgttgtttcctga

SEQ ID NO: 1186909 - DNA, 22 bp, Artificial Sequence
  chemically synthesized
cggcacctgttgtttcctgact

SEQ ID NO: 1186910 - DNA, 22 bp, Artificial Sequence
  chemically synthesized
gaatggcgatcattaaaaagtc

SEQ ID NO: 1186911 - DNA, 22 bp, Artificial Sequence
  chemically synthesized
ttgtttcctgactttttaatga

SEQ ID NO: 1186912 - DNA, 22 bp, Artificial Sequence
  chemically synthesized
tttcctgactttttaatgatcg

SEQ ID NO: 1186913 - DNA, 22 bp, Artificial Sequence
  chemically synthesized
cctgactttttaatgatcgcca

SEQ ID NO: 1186914 - DNA, 22 bp, Artificial Sequence
  chemically synthesized
ctgactttttaatgatcgccat

SEQ ID NO: 1186915 - DNA, 22 bp, Artificial Sequence
  chemically synthesized
acaccagttagaatggcgatca

SEQ ID NO: 1186916 - DNA, 22 bp, Artificial Sequence
  chemically synthesized
actttttaatgatcgccattct

SEQ ID NO: 1186917 - DNA, 22 bp, Artificial Sequence
  chemically synthesized
tttaatgatcgccattctaact

SEQ ID NO: 1186918 - DNA, 22 bp, Artificial Sequence
  chemically synthesized
ttaatgatcgccattctaactg

SEQ ID NO: 1186919 - DNA, 22 bp, Artificial Sequence
  chemically synthesized
taatgatcgccattctaactgg

SEQ ID NO: 1186920 - DNA, 22 bp, Artificial Sequence
  chemically synthesized
aatgatcgccattctaactggt

SEQ ID NO: 1186921 - DNA, 22 bp, Artificial Sequence
  chemically synthesized
atgatcgccattctaactggtg

SEQ ID NO: 1186922 - DNA, 22 bp, Artificial Sequence
  chemically synthesized
taactggtgtgagatggtatct

SEQ ID NO: 1186923 - DNA, 22 bp, Artificial Sequence
  chemically synthesized
actggtgtgagatggtatctca

SEQ ID NO: 1186924 - DNA, 22 bp, Artificial Sequence
  chemically synthesized
gtgtgagatggtatctcattgt

SEQ ID NO: 1186925 - DNA, 22 bp, Artificial Sequence
  chemically synthesized
gccatcagagaaatgcaaatca

SEQ ID NO: 1186926 - DNA, 22 bp, Artificial Sequence
  chemically synthesized
attgtggttttgatttgcattt

SEQ ID NO: 1186927 - DNA, 22 bp, Artificial Sequence
  chemically synthesized
tggttttgatttgcatttctct

SEQ ID NO: 1186928 - DNA, 22 bp, Artificial Sequence
  chemically synthesized
atcatcactggccatcagagaa

SEQ ID NO: 1186929 - DNA, 22 bp, Artificial Sequence
  chemically synthesized
tgatttgcatttctctgatggc

SEQ ID NO: 1186930 - DNA, 22 bp, Artificial Sequence
  chemically synthesized
gatttgcatttctctgatggcc

SEQ ID NO: 1186931 - DNA, 22 bp, Artificial Sequence
  chemically synthesized
atttgcatttctctgatggcca

SEQ ID NO: 1186932 - DNA, 22 bp, Artificial Sequence
  chemically synthesized
gcatttctctgatggccagtga

SEQ ID NO: 1186933 - DNA, 22 bp, Artificial Sequence
  chemically synthesized
catttctctgatggccagtgat

SEQ ID NO: 1186934 - DNA, 22 bp, Artificial Sequence
  chemically synthesized
ctctgatggccagtgatgatga

SEQ ID NO: 1186935 - DNA, 22 bp, Artificial Sequence
  chemically synthesized
tctgatggccagtgatgatgag

SEQ ID NO: 1186936 - DNA, 22 bp, Artificial Sequence
  chemically synthesized
tgatggccagtgatgatgagca

SEQ ID NO: 1186937 - DNA, 22 bp, Artificial Sequence
  chemically synthesized
atggccagtgatgatgagcatt

SEQ ID NO: 1186938 - DNA, 22 bp, Artificial Sequence
  chemically synthesized
agccaaaaaacacatgaaaaaa

SEQ ID NO: 1186939 - DNA, 22 bp, Artificial Sequence
  chemically synthesized
ttcagccaaaaaacacatgaaa

SEQ ID NO: 1186940 - DNA, 22 bp, Artificial Sequence
  chemically synthesized
attcagccaaaaaacacatgaa

SEQ ID NO: 1186941 - DNA, 22 bp, Artificial Sequence
  chemically synthesized
agacatttattcagccaaaaaa

SEQ ID NO: 1186942 - DNA, 22 bp, Artificial Sequence
  chemically synthesized
tttcatgtgttttttggctgaa

SEQ ID NO: 1186943 - DNA, 22 bp, Artificial Sequence
  chemically synthesized
ttcatgtgttttttggctgaat

SEQ ID NO: 1186944 - DNA, 22 bp, Artificial Sequence
  chemically synthesized
tcatgtgttttttggctgaata

SEQ ID NO: 1186945 - DNA, 22 bp, Artificial Sequence
  chemically synthesized
catgtgttttttggctgaataa

SEQ ID NO: 1186946 - DNA, 22 bp, Artificial Sequence
  chemically synthesized
atgtgttttttggctgaataaa

SEQ ID NO: 1186947 - DNA, 22 bp, Artificial Sequence
  chemically synthesized
gatccctgagacatttattcag

SEQ ID NO: 1186948 - DNA, 22 bp, Artificial Sequence
  chemically synthesized
tagatccctgagacatttattc

SEQ ID NO: 1186949 - DNA, 22 bp, Artificial Sequence
  chemically synthesized
gttctagatccctgagacattt

SEQ ID NO: 1186950 - DNA, 22 bp, Artificial Sequence
  chemically synthesized
tttggctgaataaatgtctcag

SEQ ID NO: 1186951 - DNA, 22 bp, Artificial Sequence
  chemically synthesized
ttggctgaataaatgtctcagg

SEQ ID NO: 1186952 - DNA, 22 bp, Artificial Sequence
  chemically synthesized
tagttctagatccctgagacat

SEQ ID NO: 1186953 - DNA, 22 bp, Artificial Sequence
  chemically synthesized
tggctgaataaatgtctcaggg

SEQ ID NO: 1186954 - DNA, 22 bp, Artificial Sequence
  chemically synthesized
ctagttctagatccctgagaca

SEQ ID NO: 1186955 - DNA, 22 bp, Artificial Sequence
  chemically synthesized
ggctgaataaatgtctcaggga

SEQ ID NO: 1186956 - DNA, 22 bp, Artificial Sequence
  chemically synthesized
gctgaataaatgtctcagggat

SEQ ID NO: 1186957 - DNA, 22 bp, Artificial Sequence
  chemically synthesized
aataaatgtctcagggatctag

SEQ ID NO: 1186958 - DNA, 22 bp, Artificial Sequence
  chemically synthesized
aaatggtatttctagttctaga

SEQ ID NO: 1186959 - DNA, 22 bp, Artificial Sequence
  chemically synthesized
gctcaaatggtatttctagttc

SEQ ID NO: 1186960 - DNA, 22 bp, Artificial Sequence
  chemically synthesized
agggatctagaactagaaatac

SEQ ID NO: 1186961 - DNA, 22 bp, Artificial Sequence
  chemically synthesized
gaactagaaataccatttgagc

SEQ ID NO: 1186962 - DNA, 22 bp, Artificial Sequence
  chemically synthesized
gaaataccatttgagccagcca

SEQ ID NO: 1186963 - DNA, 22 bp, Artificial Sequence
  chemically synthesized
ggtatatacccagtaatgggat

SEQ ID NO: 1186964 - DNA, 22 bp, Artificial Sequence
  chemically synthesized
gggtatatacccagtaatggga

SEQ ID NO: 1186965 - DNA, 22 bp, Artificial Sequence
  chemically synthesized
tgggtatatacccagtaatggg

SEQ ID NO: 1186966 - DNA, 22 bp, Artificial Sequence
  chemically synthesized
gagccagccatcccattactgg

SEQ ID NO: 1186967 - DNA, 22 bp, Artificial Sequence
  chemically synthesized
agccagccatcccattactggg

SEQ ID NO: 1186968 - DNA, 22 bp, Artificial Sequence
  chemically synthesized
tagtcctttgggtatataccca

SEQ ID NO: 1186969 - DNA, 22 bp, Artificial Sequence
  chemically synthesized
atagtcctttgggtatataccc

SEQ ID NO: 1186970 - DNA, 22 bp, Artificial Sequence
  chemically synthesized
ctgggtatatacccaaaggact

SEQ ID NO: 1186971 - DNA, 22 bp, Artificial Sequence
  chemically synthesized
ggtatatacccaaaggactata

SEQ ID NO: 1186972 - DNA, 22 bp, Artificial Sequence
  chemically synthesized
tagcagcatgatttatagtcct

SEQ ID NO: 1186973 - DNA, 22 bp, Artificial Sequence
  chemically synthesized
atagcagcatgatttatagtcc

SEQ ID NO: 1186974 - DNA, 22 bp, Artificial Sequence
  chemically synthesized
tatagcagcatgatttatagtc

SEQ ID NO: 1186975 - DNA, 22 bp, Artificial Sequence
  chemically synthesized
taaatcatgctgctataaagac

SEQ ID NO: 1186976 - DNA, 22 bp, Artificial Sequence
  chemically synthesized
cagtaaacatacgtgtgcatgt

SEQ ID NO: 1186977 - DNA, 22 bp, Artificial Sequence
  chemically synthesized
ctataaagacacatgcacacgt

SEQ ID NO: 1186978 - DNA, 22 bp, Artificial Sequence
  chemically synthesized
taaagacacatgcacacgtatg

SEQ ID NO: 1186979 - DNA, 22 bp, Artificial Sequence
  chemically synthesized
tgaatagtgctgcagtaaacat

SEQ ID NO: 1186980 - DNA, 22 bp, Artificial Sequence
  chemically synthesized
ttgtgaatagtgctgcagtaaa

SEQ ID NO: 1186981 - DNA, 22 bp, Artificial Sequence
  chemically synthesized
ctattgtgaatagtgctgcagt

SEQ ID NO: 1186982 - DNA, 22 bp, Artificial Sequence
  chemically synthesized
gctattgtgaatagtgctgcag

SEQ ID NO: 1186983 - DNA, 22 bp, Artificial Sequence
  chemically synthesized
tgctattgtgaatagtgctgca

SEQ ID NO: 1186984 - DNA, 22 bp, Artificial Sequence
  chemically synthesized
caagtctttgctattgtgaata

SEQ ID NO: 1186985 - DNA, 22 bp, Artificial Sequence
  chemically synthesized
actgcagcactattcacaatag

SEQ ID NO: 1186986 - DNA, 22 bp, Artificial Sequence
  chemically synthesized
ctgcagcactattcacaatagc

SEQ ID NO: 1186987 - DNA, 22 bp, Artificial Sequence
  chemically synthesized
gttccaagtctttgctattgtg

SEQ ID NO: 1186988 - DNA, 22 bp, Artificial Sequence
  chemically synthesized
cagcactattcacaatagcaaa

SEQ ID NO: 1186989 - DNA, 22 bp, Artificial Sequence
  chemically synthesized
ggttggttccaagtctttgcta

SEQ ID NO: 1186990 - DNA, 22 bp, Artificial Sequence
  chemically synthesized
gggttggttccaagtctttgct

SEQ ID NO: 1186991 - DNA, 22 bp, Artificial Sequence
  chemically synthesized
ttcacaatagcaaagacttgga

SEQ ID NO: 1186992 - DNA, 22 bp, Artificial Sequence
  chemically synthesized
acaatagcaaagacttggaacc

SEQ ID NO: 1186993 - DNA, 22 bp, Artificial Sequence
  chemically synthesized
gacatttgggttggttccaagt

SEQ ID NO: 1186994 - DNA, 22 bp, Artificial Sequence
  chemically synthesized
ttggacatttgggttggttcca

SEQ ID NO: 1186995 - DNA, 22 bp, Artificial Sequence
  chemically synthesized
tcattgttggacatttgggttg

SEQ ID NO: 1186996 - DNA, 22 bp, Artificial Sequence
  chemically synthesized
ggaaccaacccaaatgtccaac

SEQ ID NO: 1186997 - DNA, 22 bp, Artificial Sequence
  chemically synthesized
gaaccaacccaaatgtccaaca

SEQ ID NO: 1186998 - DNA, 22 bp, Artificial Sequence
  chemically synthesized
atccagtctatcattgttggac

SEQ ID NO: 1186999 - DNA, 22 bp, Artificial Sequence
  chemically synthesized
aatccagtctatcattgttgga

SEQ ID NO: 1187000 - DNA, 22 bp, Artificial Sequence
  chemically synthesized
ttaatccagtctatcattgttg

SEQ ID NO: 1187001 - DNA, 22 bp, Artificial Sequence
  chemically synthesized
cttaatccagtctatcattgtt

SEQ ID NO: 1187002 - DNA, 22 bp, Artificial Sequence
  chemically synthesized
tcttaatccagtctatcattgt

SEQ ID NO: 1187003 - DNA, 22 bp, Artificial Sequence
  chemically synthesized
catggtgcatatatgccacatt

SEQ ID NO: 1187004 - DNA, 22 bp, Artificial Sequence
  chemically synthesized
gattaagaaaatgtggcatata

SEQ ID NO: 1187005 - DNA, 22 bp, Artificial Sequence
  chemically synthesized
agaaaatgtggcatatatgcac

SEQ ID NO: 1187006 - DNA, 22 bp, Artificial Sequence
  chemically synthesized
catagtattccatggtgcatat

SEQ ID NO: 1187007 - DNA, 22 bp, Artificial Sequence
  chemically synthesized
tgactgcatagtattccatggt

SEQ ID NO: 1187008 - DNA, 22 bp, Artificial Sequence
  chemically synthesized
atgactgcatagtattccatgg

SEQ ID NO: 1187009 - DNA, 22 bp, Artificial Sequence
  chemically synthesized
tatgactgcatagtattccatg

SEQ ID NO: 1187010 - DNA, 22 bp, Artificial Sequence
  chemically synthesized
ttatgactgcatagtattccat

SEQ ID NO: 1187011 - DNA, 22 bp, Artificial Sequence
  chemically synthesized
tttatgactgcatagtattcca

SEQ ID NO: 1187012 - DNA, 22 bp, Artificial Sequence
  chemically synthesized
ttttatgactgcatagtattcc

SEQ ID NO: 1187013 - DNA, 22 bp, Artificial Sequence
  chemically synthesized
atccttttttatgactgcatag

SEQ ID NO: 1187014 - DNA, 22 bp, Artificial Sequence
  chemically synthesized
tgcagtcataaaaaaggatgag

SEQ ID NO: 1187015 - DNA, 22 bp, Artificial Sequence
  chemically synthesized
caaaggacatgaactcatcctt

SEQ ID NO: 1187016 - DNA, 22 bp, Artificial Sequence
  chemically synthesized
atccatgtccctacaaaggaca

SEQ ID NO: 1187017 - DNA, 22 bp, Artificial Sequence
  chemically synthesized
catccatgtccctacaaaggac

SEQ ID NO: 1187018 - DNA, 22 bp, Artificial Sequence
  chemically synthesized
cagcttcatccatgtccctaca

SEQ ID NO: 1187019 - DNA, 22 bp, Artificial Sequence
  chemically synthesized
ccagcttcatccatgtccctac

SEQ ID NO: 1187020 - DNA, 22 bp, Artificial Sequence
  chemically synthesized
atgtcctttgtagggacatgga

SEQ ID NO: 1187021 - DNA, 22 bp, Artificial Sequence
  chemically synthesized
tgtagggacatggatgaagctg

SEQ ID NO: 1187022 - DNA, 22 bp, Artificial Sequence
  chemically synthesized
gtagggacatggatgaagctgg

SEQ ID NO: 1187023 - DNA, 22 bp, Artificial Sequence
  chemically synthesized
tagggacatggatgaagctgga

SEQ ID NO: 1187024 - DNA, 22 bp, Artificial Sequence
  chemically synthesized
agaatgatggtttccagcttca

SEQ ID NO: 1187025 - DNA, 22 bp, Artificial Sequence
  chemically synthesized
ctgagaatgatggtttccagct

SEQ ID NO: 1187026 - DNA, 22 bp, Artificial Sequence
  chemically synthesized
gctgagaatgatggtttccagc

SEQ ID NO: 1187027 - DNA, 22 bp, Artificial Sequence
  chemically synthesized
tgatagtttgctgagaatgatg

SEQ ID NO: 1187028 - DNA, 22 bp, Artificial Sequence
  chemically synthesized
gtgatagtttgctgagaatgat

SEQ ID NO: 1187029 - DNA, 22 bp, Artificial Sequence
  chemically synthesized
tccttgtgatagtttgctgaga

SEQ ID NO: 1187030 - DNA, 22 bp, Artificial Sequence
  chemically synthesized
gaaaccatcattctcagcaaac

SEQ ID NO: 1187031 - DNA, 22 bp, Artificial Sequence
  chemically synthesized
gtccttgtgatagtttgctgag

SEQ ID NO: 1187032 - DNA, 22 bp, Artificial Sequence
  chemically synthesized
tgtccttgtgatagtttgctga

SEQ ID NO: 1187033 - DNA, 22 bp, Artificial Sequence
  chemically synthesized
ttgtccttgtgatagtttgctg

SEQ ID NO: 1187034 - DNA, 22 bp, Artificial Sequence
  chemically synthesized
tttgtccttgtgatagtttgct

SEQ ID NO: 1187035 - DNA, 22 bp, Artificial Sequence
  chemically synthesized
gttttttgtccttgtgatagtt

SEQ ID NO: 1187036 - DNA, 22 bp, Artificial Sequence
  chemically synthesized
ggttttttgtccttgtgatagt

SEQ ID NO: 1187037 - DNA, 22 bp, Artificial Sequence
  chemically synthesized
tcagcaaactatcacaaggaca

SEQ ID NO: 1187038 - DNA, 22 bp, Artificial Sequence
  chemically synthesized
agcaaactatcacaaggacaaa

SEQ ID NO: 1187039 - DNA, 22 bp, Artificial Sequence
  chemically synthesized
tcacaaggacaaaaaaccaaac

SEQ ID NO: 1187040 - DNA, 22 bp, Artificial Sequence
  chemically synthesized
agtgagaacatgcagtgtttgg

SEQ ID NO: 1187041 - DNA, 22 bp, Artificial Sequence
  chemically synthesized
tgagtgagaacatgcagtgttt

SEQ ID NO: 1187042 - DNA, 22 bp, Artificial Sequence
  chemically synthesized
ccacctctgagtgagaacatgc

SEQ ID NO: 1187043 - DNA, 22 bp, Artificial Sequence
  chemically synthesized
agttcccacctctgagtgagaa

SEQ ID NO: 1187044 - DNA, 22 bp, Artificial Sequence
  chemically synthesized
cagttcccacctctgagtgaga

SEQ ID NO: 1187045 - DNA, 22 bp, Artificial Sequence
  chemically synthesized
tcagttcccacctctgagtgag

SEQ ID NO: 1187046 - DNA, 22 bp, Artificial Sequence
  chemically synthesized
ttcagttcccacctctgagtga

SEQ ID NO: 1187047 - DNA, 22 bp, Artificial Sequence
  chemically synthesized
tttcagttcccacctctgagtg

SEQ ID NO: 1187048 - DNA, 22 bp, Artificial Sequence
  chemically synthesized
ttttcagttcccacctctgagt

SEQ ID NO: 1187049 - DNA, 22 bp, Artificial Sequence
  chemically synthesized
ttttttcagttcccacctctga

SEQ ID NO: 1187050 - DNA, 22 bp, Artificial Sequence
  chemically synthesized
catgttctcactcagaggtggg

SEQ ID NO: 1187051 - DNA, 22 bp, Artificial Sequence
  chemically synthesized
tcttttttcagttcccacctct

SEQ ID NO: 1187052 - DNA, 22 bp, Artificial Sequence
  chemically synthesized
tcactcagaggtgggaactgaa

SEQ ID NO: 1187053 - DNA, 22 bp, Artificial Sequence
  chemically synthesized
actcagaggtgggaactgaaaa

SEQ ID NO: 1187054 - DNA, 22 bp, Artificial Sequence
  chemically synthesized
agaggtgggaactgaaaaaaga

SEQ ID NO: 1187055 - DNA, 22 bp, Artificial Sequence
  chemically synthesized
tgtccaagtgttctcttttttc

SEQ ID NO: 1187056 - DNA, 22 bp, Artificial Sequence
  chemically synthesized
ctgtgtccaagtgttctctttt

SEQ ID NO: 1187057 - DNA, 22 bp, Artificial Sequence
  chemically synthesized
cctgtgtccaagtgttctcttt

SEQ ID NO: 1187058 - DNA, 22 bp, Artificial Sequence
  chemically synthesized
cccttcctgtgtccaagtgttc

SEQ ID NO: 1187059 - DNA, 22 bp, Artificial Sequence
  chemically synthesized
aaaaaagagaacacttggacac

SEQ ID NO: 1187060 - DNA, 22 bp, Artificial Sequence
  chemically synthesized
ggacacaggaaggggaacatca

SEQ ID NO: 1187061 - DNA, 22 bp, Artificial Sequence
  chemically synthesized
gacacaggaaggggaacatcac

SEQ ID NO: 1187062 - DNA, 22 bp, Artificial Sequence
  chemically synthesized
cccccaccccacaacaggcccc

SEQ ID NO: 1187063 - DNA, 22 bp, Artificial Sequence
  chemically synthesized
cccactccccccaccccacaac

SEQ ID NO: 1187064 - DNA, 22 bp, Artificial Sequence
  chemically synthesized
ccccctccccactccccccacc

SEQ ID NO: 1187065 - DNA, 22 bp, Artificial Sequence
  chemically synthesized
ttgtggggtggggggagtgggg

SEQ ID NO: 1187066 - DNA, 22 bp, Artificial Sequence
  chemically synthesized
tccctcccccctccccactccc

SEQ ID NO: 1187067 - DNA, 22 bp, Artificial Sequence
  chemically synthesized
tggggtggggggagtggggagg

SEQ ID NO: 1187068 - DNA, 22 bp, Artificial Sequence
  chemically synthesized
atgctatccctcccccctcccc

SEQ ID NO: 1187069 - DNA, 22 bp, Artificial Sequence
  chemically synthesized
ctaatgctatccctcccccctc

SEQ ID NO: 1187070 - DNA, 22 bp, Artificial Sequence
  chemically synthesized
ggtatatctcctaatgctatcc

SEQ ID NO: 1187071 - DNA, 22 bp, Artificial Sequence
  chemically synthesized
gcattaggtatatctcctaatg

SEQ ID NO: 1187072 - DNA, 22 bp, Artificial Sequence
  chemically synthesized
cgcattaggtatatctcctaat

SEQ ID NO: 1187073 - DNA, 22 bp, Artificial Sequence
  chemically synthesized
gtcatttcgcattaggtatatc

SEQ ID NO: 1187074 - DNA, 22 bp, Artificial Sequence
  chemically synthesized
actcgtcatttcgcattaggta

SEQ ID NO: 1187075 - DNA, 22 bp, Artificial Sequence
  chemically synthesized
ggagatatacctaatgcgaaat

SEQ ID NO: 1187076 - DNA, 22 bp, Artificial Sequence
  chemically synthesized
cacccattaactcgtcatttcg

SEQ ID NO: 1187077 - DNA, 22 bp, Artificial Sequence
  chemically synthesized
gtgtgctgcacccattaactcg

SEQ ID NO: 1187078 - DNA, 22 bp, Artificial Sequence
  chemically synthesized
atgcgaaatgacgagttaatgg

SEQ ID NO: 1187079 - DNA, 22 bp, Artificial Sequence
  chemically synthesized
atgggtgcagcacaccaacatg

SEQ ID NO: 1187080 - DNA, 22 bp, Artificial Sequence
  chemically synthesized
catatgtatacatgtgccatgt

SEQ ID NO: 1187081 - DNA, 22 bp, Artificial Sequence
  chemically synthesized
ttacatatgtatacatgtgcca

SEQ ID NO: 1187082 - DNA, 22 bp, Artificial Sequence
  chemically synthesized
gttacatatgtatacatgtgcc

SEQ ID NO: 1187083 - DNA, 22 bp, Artificial Sequence
  chemically synthesized
gggtacatgtgcacaacgtgca

SEQ ID NO: 1187084 - DNA, 22 bp, Artificial Sequence
  chemically synthesized
agggtacatgtgcacaacgtgc

SEQ ID NO: 1187085 - DNA, 22 bp, Artificial Sequence
  chemically synthesized
tagggtacatgtgcacaacgtg

SEQ ID NO: 1187086 - DNA, 22 bp, Artificial Sequence
  chemically synthesized
agttttagggtacatgtgcaca

SEQ ID NO: 1187087 - DNA, 22 bp, Artificial Sequence
  chemically synthesized
aagttttagggtacatgtgcac

SEQ ID NO: 1187088 - DNA, 22 bp, Artificial Sequence
  chemically synthesized
taagttttagggtacatgtgca

SEQ ID NO: 1187089 - DNA, 22 bp, Artificial Sequence
  chemically synthesized
cacgttgtgcacatgtacccta

SEQ ID NO: 1187090 - DNA, 22 bp, Artificial Sequence
  chemically synthesized
tactttaagttttagggtacat

SEQ ID NO: 1187091 - DNA, 22 bp, Artificial Sequence
  chemically synthesized
ttatactttaagttttagggta

SEQ ID NO: 1187092 - DNA, 22 bp, Artificial Sequence
  chemically synthesized
ttattatactttaagttttagg

SEQ ID NO: 1187093 - DNA, 22 bp, Artificial Sequence
  chemically synthesized
tgcacatgtaccctaaaactta

SEQ ID NO: 1187094 - DNA, 22 bp, Artificial Sequence
  chemically synthesized
attattatactttaagttttag

SEQ ID NO: 1187095 - DNA, 22 bp, Artificial Sequence
  chemically synthesized
tattattatactttaagtttta

SEQ ID NO: 1187096 - DNA, 22 bp, Artificial Sequence
  chemically synthesized
ttattattatactttaagtttt

SEQ ID NO: 1187097 - DNA, 22 bp, Artificial Sequence
  chemically synthesized
tttattattatactttaagttt

SEQ ID NO: 1187098 - DNA, 22 bp, Artificial Sequence
  chemically synthesized
ttttattattatactttaagtt

SEQ ID NO: 1187099 - DNA, 22 bp, Artificial Sequence
  chemically synthesized
tttttattattatactttaagt

SEQ ID NO: 1187100 - DNA, 22 bp, Artificial Sequence
  chemically synthesized
ttttttattattatactttaag

SEQ ID NO: 1187101 - DNA, 22 bp, Artificial Sequence
  chemically synthesized
tttttttattattatactttaa

SEQ ID NO: 1187102 - DNA, 22 bp, Artificial Sequence
  chemically synthesized
cattttttttttattattatac

SEQ ID NO: 1187103 - DNA, 22 bp, Artificial Sequence
  chemically synthesized
acattttttttttattattata

SEQ ID NO: 1187104 - DNA, 22 bp, Artificial Sequence
  chemically synthesized
tacattttttttttattattat

SEQ ID NO: 1187105 - DNA, 22 bp, Artificial Sequence
  chemically synthesized
aaacttaaagtataataataaa

SEQ ID NO: 1187106 - DNA, 22 bp, Artificial Sequence
  chemically synthesized
ttacattttttttttattatta

SEQ ID NO: 1187107 - DNA, 22 bp, Artificial Sequence
  chemically synthesized
atttttacattttttttttatt

SEQ ID NO: 1187108 - DNA, 22 bp, Artificial Sequence
  chemically synthesized
aaagtataataataaaaaaaaa

SEQ ID NO: 1187109 - DNA, 22 bp, Artificial Sequence
  chemically synthesized
aagtataataataaaaaaaaaa

SEQ ID NO: 1187110 - DNA, 22 bp, Artificial Sequence
  chemically synthesized
gaggcgtgtatcaccatgccca

SEQ ID NO: 1187111 - DNA, 22 bp, Artificial Sequence
  chemically synthesized
ggattagaggcgtgtatcacca

SEQ ID NO: 1187112 - DNA, 22 bp, Artificial Sequence
  chemically synthesized
gctgggcatggtgatacacgcc

SEQ ID NO: 1187113 - DNA, 22 bp, Artificial Sequence
  chemically synthesized
ggcatggtgatacacgcctcta

SEQ ID NO: 1187114 - DNA, 22 bp, Artificial Sequence
  chemically synthesized
ggatcacctgggattagaggcg

SEQ ID NO: 1187115 - DNA, 22 bp, Artificial Sequence
  chemically synthesized
ccgaatagctgggatcacctgg

SEQ ID NO: 1187116 - DNA, 22 bp, Artificial Sequence
  chemically synthesized
agcctcccgaatagctgggatc

SEQ ID NO: 1187117 - DNA, 22 bp, Artificial Sequence
  chemically synthesized
taatcccaggtgatcccagcta

SEQ ID NO: 1187118 - DNA, 22 bp, Artificial Sequence
  chemically synthesized
atcccaggtgatcccagctatt

SEQ ID NO: 1187119 - DNA, 22 bp, Artificial Sequence
  chemically synthesized
acctcagcctcccgaatagctg

SEQ ID NO: 1187120 - DNA, 22 bp, Artificial Sequence
  chemically synthesized
taacctcagcctcccgaatagc

SEQ ID NO: 1187121 - DNA, 22 bp, Artificial Sequence
  chemically synthesized
tctaacctcagcctcccgaata

SEQ ID NO: 1187122 - DNA, 22 bp, Artificial Sequence
  chemically synthesized
aagcgattctctaacctcagcc

SEQ ID NO: 1187123 - DNA, 22 bp, Artificial Sequence
  chemically synthesized
gttcaagcgattctctaacctc

SEQ ID NO: 1187124 - DNA, 22 bp, Artificial Sequence
  chemically synthesized
ttcgggaggctgaggttagaga

SEQ ID NO: 1187125 - DNA, 22 bp, Artificial Sequence
  chemically synthesized
gggaggctgaggttagagaatc

SEQ ID NO: 1187126 - DNA, 22 bp, Artificial Sequence
  chemically synthesized
cctggttcaagcgattctctaa

SEQ ID NO: 1187127 - DNA, 22 bp, Artificial Sequence
  chemically synthesized
ctccctggttcaagcgattctc

SEQ ID NO: 1187128 - DNA, 22 bp, Artificial Sequence
  chemically synthesized
ctcctccctggttcaagcgatt

SEQ ID NO: 1187129 - DNA, 22 bp, Artificial Sequence
  chemically synthesized
aggttagagaatcgcttgaacc

SEQ ID NO: 1187130 - DNA, 22 bp, Artificial Sequence
  chemically synthesized
caacctcctcctccctggttca

SEQ ID NO: 1187131 - DNA, 22 bp, Artificial Sequence
  chemically synthesized
gagaatcgcttgaaccagggag

SEQ ID NO: 1187132 - DNA, 22 bp, Artificial Sequence
  chemically synthesized
ctgcaacctcctcctccctggt

SEQ ID NO: 1187133 - DNA, 22 bp, Artificial Sequence
  chemically synthesized
gctgcaacctcctcctccctgg

SEQ ID NO: 1187134 - DNA, 22 bp, Artificial Sequence
  chemically synthesized
agcttgctgcaacctcctcctc

SEQ ID NO: 1187135 - DNA, 22 bp, Artificial Sequence
  chemically synthesized
gaaccagggaggaggaggttgc

SEQ ID NO: 1187136 - DNA, 22 bp, Artificial Sequence
  chemically synthesized
aaccagggaggaggaggttgca

SEQ ID NO: 1187137 - DNA, 22 bp, Artificial Sequence
  chemically synthesized
cagcaagctgagatcgggccac

SEQ ID NO: 1187138 - DNA, 22 bp, Artificial Sequence
  chemically synthesized
acccagggtggagtgcagtggc

SEQ ID NO: 1187139 - DNA, 22 bp, Artificial Sequence
  chemically synthesized
tcacccagggtggagtgcagtg

SEQ ID NO: 1187140 - DNA, 22 bp, Artificial Sequence
  chemically synthesized
tctcacccagggtggagtgcag

SEQ ID NO: 1187141 - DNA, 22 bp, Artificial Sequence
  chemically synthesized
agatcgggccactgcactccac

SEQ ID NO: 1187142 - DNA, 22 bp, Artificial Sequence
  chemically synthesized
actctctcacccagggtggagt

SEQ ID NO: 1187143 - DNA, 22 bp, Artificial Sequence
  chemically synthesized
cactccaccctgggtgagagag

SEQ ID NO: 1187144 - DNA, 22 bp, Artificial Sequence
  chemically synthesized
agatggagtctcactctctcac

SEQ ID NO: 1187145 - DNA, 22 bp, Artificial Sequence
  chemically synthesized
gagatggagtctcactctctca

SEQ ID NO: 1187146 - DNA, 22 bp, Artificial Sequence
  chemically synthesized
tgagatggagtctcactctctc

SEQ ID NO: 1187147 - DNA, 22 bp, Artificial Sequence
  chemically synthesized
ttgagatggagtctcactctct

SEQ ID NO: 1187148 - DNA, 22 bp, Artificial Sequence
  chemically synthesized
caccctgggtgagagagtgaga

SEQ ID NO: 1187149 - DNA, 22 bp, Artificial Sequence
  chemically synthesized
tttgagatggagtctcactctc

SEQ ID NO: 1187150 - DNA, 22 bp, Artificial Sequence
  chemically synthesized
ttttttgagatggagtctcact

SEQ ID NO: 1187151 - DNA, 22 bp, Artificial Sequence
  chemically synthesized
gttttttgagatggagtctcac

SEQ ID NO: 1187152 - DNA, 22 bp, Artificial Sequence
  chemically synthesized
ggtgagagagtgagactccatc

SEQ ID NO: 1187153 - DNA, 22 bp, Artificial Sequence
  chemically synthesized
tttgttttttgagatggagtct

SEQ ID NO: 1187154 - DNA, 22 bp, Artificial Sequence
  chemically synthesized
gtttgttttttgagatggagtc

SEQ ID NO: 1187155 - DNA, 22 bp, Artificial Sequence
  chemically synthesized
tttgtttgttttttgagatgga

SEQ ID NO: 1187156 - DNA, 22 bp, Artificial Sequence
  chemically synthesized
gtttgtttgttttttgagatgg

SEQ ID NO: 1187157 - DNA, 22 bp, Artificial Sequence
  chemically synthesized
tgtttgtttgttttttgagatg

SEQ ID NO: 1187158 - DNA, 22 bp, Artificial Sequence
  chemically synthesized
ttgtttgtttgttttttgagat

SEQ ID NO: 1187159 - DNA, 22 bp, Artificial Sequence
  chemically synthesized
tttgtttgtttgttttttgaga

SEQ ID NO: 1187160 - DNA, 22 bp, Artificial Sequence
  chemically synthesized
attttttgtttgtttgtttttt

SEQ ID NO: 1187161 - DNA, 22 bp, Artificial Sequence
  chemically synthesized
aattttttgtttgtttgttttt

SEQ ID NO: 1187162 - DNA, 22 bp, Artificial Sequence
  chemically synthesized
taattttttgtttgtttgtttt

SEQ ID NO: 1187163 - DNA, 22 bp, Artificial Sequence
  chemically synthesized
ttaattttttgtttgtttgttt

SEQ ID NO: 1187164 - DNA, 22 bp, Artificial Sequence
  chemically synthesized
tttaattttttgtttgtttgtt

SEQ ID NO: 1187165 - DNA, 22 bp, Artificial Sequence
  chemically synthesized
ttttaattttttgtttgtttgt

SEQ ID NO: 1187166 - DNA, 22 bp, Artificial Sequence
  chemically synthesized
catctcaaaaaacaaacaaaca

SEQ ID NO: 1187167 - DNA, 22 bp, Artificial Sequence
  chemically synthesized
ttttttaattttttgtttgttt

SEQ ID NO: 1187168 - DNA, 22 bp, Artificial Sequence
  chemically synthesized
cttttttaattttttgtttgtt

SEQ ID NO: 1187169 - DNA, 22 bp, Artificial Sequence
  chemically synthesized
tcttttttaattttttgtttgt

SEQ ID NO: 1187170 - DNA, 22 bp, Artificial Sequence
  chemically synthesized
ttcttttttaattttttgtttg

SEQ ID NO: 1187171 - DNA, 22 bp, Artificial Sequence
  chemically synthesized
tttcttttttaattttttgttt

SEQ ID NO: 1187172 - DNA, 22 bp, Artificial Sequence
  chemically synthesized
aaaaaacaaacaaacaaaaaat

SEQ ID NO: 1187173 - DNA, 22 bp, Artificial Sequence
  chemically synthesized
ttttcttttttaattttttgtt

SEQ ID NO: 1187174 - DNA, 22 bp, Artificial Sequence
  chemically synthesized
tttttttcttttttaatttttt

SEQ ID NO: 1187175 - DNA, 22 bp, Artificial Sequence
  chemically synthesized
agccactgtttttttctttttt

SEQ ID NO: 1187176 - DNA, 22 bp, Artificial Sequence
  chemically synthesized
gagccactgtttttttcttttt

SEQ ID NO: 1187177 - DNA, 22 bp, Artificial Sequence
  chemically synthesized
tgagccactgtttttttctttt

SEQ ID NO: 1187178 - DNA, 22 bp, Artificial Sequence
  chemically synthesized
tgcattttgagccactgttttt

SEQ ID NO: 1187179 - DNA, 22 bp, Artificial Sequence
  chemically synthesized
aaaaagaaaaaaacagtggctc

SEQ ID NO: 1187180 - DNA, 22 bp, Artificial Sequence
  chemically synthesized
ggcaagcattatgcattttgag

SEQ ID NO: 1187181 - DNA, 22 bp, Artificial Sequence
  chemically synthesized
taggcaagcattatgcattttg

SEQ ID NO: 1187182 - DNA, 22 bp, Artificial Sequence
  chemically synthesized
tgctctaggcaagcattatgca

SEQ ID NO: 1187183 - DNA, 22 bp, Artificial Sequence
  chemically synthesized
ttatgctctaggcaagcattat

SEQ ID NO: 1187184 - DNA, 22 bp, Artificial Sequence
  chemically synthesized
cctgttatgctctaggcaagca

SEQ ID NO: 1187185 - DNA, 22 bp, Artificial Sequence
  chemically synthesized
aaaatgcataatgcttgcctag

SEQ ID NO: 1187186 - DNA, 22 bp, Artificial Sequence
  chemically synthesized
ccctgttatgctctaggcaagc

SEQ ID NO: 1187187 - DNA, 22 bp, Artificial Sequence
  chemically synthesized
tccctgttatgctctaggcaag

SEQ ID NO: 1187188 - DNA, 22 bp, Artificial Sequence
  chemically synthesized
ttccctgttatgctctaggcaa

SEQ ID NO: 1187189 - DNA, 22 bp, Artificial Sequence
  chemically synthesized
tttccctgttatgctctaggca

SEQ ID NO: 1187190 - DNA, 22 bp, Artificial Sequence
  chemically synthesized
ttttccctgttatgctctaggc

SEQ ID NO: 1187191 - DNA, 22 bp, Artificial Sequence
  chemically synthesized
cttttttccctgttatgctcta

SEQ ID NO: 1187192 - DNA, 22 bp, Artificial Sequence
  chemically synthesized
ccttttttccctgttatgctct

SEQ ID NO: 1187193 - DNA, 22 bp, Artificial Sequence
  chemically synthesized
tccttttttccctgttatgctc

SEQ ID NO: 1187194 - DNA, 22 bp, Artificial Sequence
  chemically synthesized
attttccttttttccctgttat

SEQ ID NO: 1187195 - DNA, 22 bp, Artificial Sequence
  chemically synthesized
gcctagagcataacagggaaaa

SEQ ID NO: 1187196 - DNA, 22 bp, Artificial Sequence
  chemically synthesized
cctagagcataacagggaaaaa

SEQ ID NO: 1187197 - DNA, 22 bp, Artificial Sequence
  chemically synthesized
gagcataacagggaaaaaagga

SEQ ID NO: 1187198 - DNA, 22 bp, Artificial Sequence
  chemically synthesized
aaagcatctgattttccttttt

SEQ ID NO: 1187199 - DNA, 22 bp, Artificial Sequence
  chemically synthesized
taaaagcatctgattttccttt

SEQ ID NO: 1187200 - DNA, 22 bp, Artificial Sequence
  chemically synthesized
ctaaaagcatctgattttcctt

SEQ ID NO: 1187201 - DNA, 22 bp, Artificial Sequence
  chemically synthesized
agtgtatcagtcttctaaaagc

SEQ ID NO: 1187202 - DNA, 22 bp, Artificial Sequence
  chemically synthesized
cagtgtatcagtcttctaaaag

SEQ ID NO: 1187203 - DNA, 22 bp, Artificial Sequence
  chemically synthesized
tcagtgtatcagtcttctaaaa

SEQ ID NO: 1187204 - DNA, 22 bp, Artificial Sequence
  chemically synthesized
aaatagttttcagtgtatcagt

SEQ ID NO: 1187205 - DNA, 22 bp, Artificial Sequence
  chemically synthesized
ttagaagactgatacactgaaa

SEQ ID NO: 1187206 - DNA, 22 bp, Artificial Sequence
  chemically synthesized
tagaagactgatacactgaaaa

SEQ ID NO: 1187207 - DNA, 22 bp, Artificial Sequence
  chemically synthesized
agaagactgatacactgaaaac

SEQ ID NO: 1187208 - DNA, 22 bp, Artificial Sequence
  chemically synthesized
gaagactgatacactgaaaact

SEQ ID NO: 1187209 - DNA, 22 bp, Artificial Sequence
  chemically synthesized
acagaacgctcaaatagttttc

SEQ ID NO: 1187210 - DNA, 22 bp, Artificial Sequence
  chemically synthesized
attaacagaacgctcaaatagt

SEQ ID NO: 1187211 - DNA, 22 bp, Artificial Sequence
  chemically synthesized
atacactgaaaactatttgagc

SEQ ID NO: 1187212 - DNA, 22 bp, Artificial Sequence
  chemically synthesized
ttgattaacagaacgctcaaat

SEQ ID NO: 1187213 - DNA, 22 bp, Artificial Sequence
  chemically synthesized
attgattaacagaacgctcaaa

SEQ ID NO: 1187214 - DNA, 22 bp, Artificial Sequence
  chemically synthesized
aaaactatttgagcgttctgtt

SEQ ID NO: 1187215 - DNA, 22 bp, Artificial Sequence
  chemically synthesized
ggatttattgattaacagaacg

SEQ ID NO: 1187216 - DNA, 22 bp, Artificial Sequence
  chemically synthesized
aggatttattgattaacagaac

SEQ ID NO: 1187217 - DNA, 22 bp, Artificial Sequence
  chemically synthesized
tttgagcgttctgttaatcaat

SEQ ID NO: 1187218 - DNA, 22 bp, Artificial Sequence
  chemically synthesized
gagcgttctgttaatcaataaa

SEQ ID NO: 1187219 - DNA, 22 bp, Artificial Sequence
  chemically synthesized
gtaggtttaggatttattgatt

SEQ ID NO: 1187220 - DNA, 22 bp, Artificial Sequence
  chemically synthesized
agcgttctgttaatcaataaat

SEQ ID NO: 1187221 - DNA, 22 bp, Artificial Sequence
  chemically synthesized
tattggtaggtttaggatttat

SEQ ID NO: 1187222 - DNA, 22 bp, Artificial Sequence
  chemically synthesized
gtattggtaggtttaggattta

SEQ ID NO: 1187223 - DNA, 22 bp, Artificial Sequence
  chemically synthesized
tgttaatcaataaatcctaaac

SEQ ID NO: 1187224 - DNA, 22 bp, Artificial Sequence
  chemically synthesized
ttaatcaataaatcctaaacct

SEQ ID NO: 1187225 - DNA, 22 bp, Artificial Sequence
  chemically synthesized
catttgtattggtaggtttagg

SEQ ID NO: 1187226 - DNA, 22 bp, Artificial Sequence
  chemically synthesized
atcaataaatcctaaacctacc

SEQ ID NO: 1187227 - DNA, 22 bp, Artificial Sequence
  chemically synthesized
catgataagttccatttgtatt

SEQ ID NO: 1187228 - DNA, 22 bp, Artificial Sequence
  chemically synthesized
aacctaccaatacaaatggaac

SEQ ID NO: 1187229 - DNA, 22 bp, Artificial Sequence
  chemically synthesized
gctgcatgataagttccatttg

SEQ ID NO: 1187230 - DNA, 22 bp, Artificial Sequence
  chemically synthesized
gattggctgcatgataagttcc

SEQ ID NO: 1187231 - DNA, 22 bp, Artificial Sequence
  chemically synthesized
ccaatacaaatggaacttatca

SEQ ID NO: 1187232 - DNA, 22 bp, Artificial Sequence
  chemically synthesized
ctggattggctgcatgataagt

SEQ ID NO: 1187233 - DNA, 22 bp, Artificial Sequence
  chemically synthesized
actggattggctgcatgataag

SEQ ID NO: 1187234 - DNA, 22 bp, Artificial Sequence
  chemically synthesized
tttactggattggctgcatgat

SEQ ID NO: 1187235 - DNA, 22 bp, Artificial Sequence
  chemically synthesized
ccattatttactggattggctg

SEQ ID NO: 1187236 - DNA, 22 bp, Artificial Sequence
  chemically synthesized
atcatgcagccaatccagtaaa

SEQ ID NO: 1187237 - DNA, 22 bp, Artificial Sequence
  chemically synthesized
cagctaccattatttactggat

SEQ ID NO: 1187238 - DNA, 22 bp, Artificial Sequence
  chemically synthesized
tcatgcagccaatccagtaaat

SEQ ID NO: 1187239 - DNA, 22 bp, Artificial Sequence
  chemically synthesized
ccagctaccattatttactgga

SEQ ID NO: 1187240 - DNA, 22 bp, Artificial Sequence
  chemically synthesized
cttccagctaccattatttact

SEQ ID NO: 1187241 - DNA, 22 bp, Artificial Sequence
  chemically synthesized
tcattacttccagctaccatta

SEQ ID NO: 1187242 - DNA, 22 bp, Artificial Sequence
  chemically synthesized
caatcactatcattacttccag

SEQ ID NO: 1187243 - DNA, 22 bp, Artificial Sequence
  chemically synthesized
acaatcactatcattacttcca

SEQ ID NO: 1187244 - DNA, 22 bp, Artificial Sequence
  chemically synthesized
tacaatcactatcattacttcc

SEQ ID NO: 1187245 - DNA, 22 bp, Artificial Sequence
  chemically synthesized
ttacaatcactatcattacttc

SEQ ID NO: 1187246 - DNA, 22 bp, Artificial Sequence
  chemically synthesized
gaagtaatgatagtgattgtaa

SEQ ID NO: 1187247 - DNA, 22 bp, Artificial Sequence
  chemically synthesized
taaaaactatggctgggcatgg

SEQ ID NO: 1187248 - DNA, 22 bp, Artificial Sequence
  chemically synthesized
caggcatgagccaccatgccca

SEQ ID NO: 1187249 - DNA, 22 bp, Artificial Sequence
  chemically synthesized
ggattacaggcatgagccacca

SEQ ID NO: 1187250 - DNA, 22 bp, Artificial Sequence
  chemically synthesized
tggctgggcatggtggctcatg

SEQ ID NO: 1187251 - DNA, 22 bp, Artificial Sequence
  chemically synthesized
ggcatggtggctcatgcctgta

SEQ ID NO: 1187252 - DNA, 22 bp, Artificial Sequence
  chemically synthesized
ccaaagtgctcggattacaggc

SEQ ID NO: 1187253 - DNA, 22 bp, Artificial Sequence
  chemically synthesized
agcctcccaaagtgctcggatt

SEQ ID NO: 1187254 - DNA, 22 bp, Artificial Sequence
  chemically synthesized
atgcctgtaatccgagcacttt

SEQ ID NO: 1187255 - DNA, 22 bp, Artificial Sequence
  chemically synthesized
taatccgagcactttgggaggc

SEQ ID NO: 1187256 - DNA, 22 bp, Artificial Sequence
  chemically synthesized
aggtgatccgcccacctcagcc

SEQ ID NO: 1187257 - DNA, 22 bp, Artificial Sequence
  chemically synthesized
acctcaggtgatccgcccacct

SEQ ID NO: 1187258 - DNA, 22 bp, Artificial Sequence
  chemically synthesized
tgggaggctgaggtgggcggat

SEQ ID NO: 1187259 - DNA, 22 bp, Artificial Sequence
  chemically synthesized
gggaggctgaggtgggcggatc

SEQ ID NO: 1187260 - DNA, 22 bp, Artificial Sequence
  chemically synthesized
ctgacctcaggtgatccgccca

SEQ ID NO: 1187261 - DNA, 22 bp, Artificial Sequence
  chemically synthesized
ggaggctgaggtgggcggatca

SEQ ID NO: 1187262 - DNA, 22 bp, Artificial Sequence
  chemically synthesized
aactcctgacctcaggtgatcc

SEQ ID NO: 1187263 - DNA, 22 bp, Artificial Sequence
  chemically synthesized
tgaactcctgacctcaggtgat

SEQ ID NO: 1187264 - DNA, 22 bp, Artificial Sequence
  chemically synthesized
aggtgggcggatcacctgaggt

SEQ ID NO: 1187265 - DNA, 22 bp, Artificial Sequence
  chemically synthesized
gtctctgaactcctgacctcag

SEQ ID NO: 1187266 - DNA, 22 bp, Artificial Sequence
  chemically synthesized
gccaggctggtctctgaactcc

SEQ ID NO: 1187267 - DNA, 22 bp, Artificial Sequence
  chemically synthesized
ggccaggctggtctctgaactc

SEQ ID NO: 1187268 - DNA, 22 bp, Artificial Sequence
  chemically synthesized
aggtcaggagttcagagaccag

SEQ ID NO: 1187269 - DNA, 22 bp, Artificial Sequence
  chemically synthesized
accatcttggccaggctggtct

SEQ ID NO: 1187270 - DNA, 22 bp, Artificial Sequence
  chemically synthesized
caccatcttggccaggctggtc

SEQ ID NO: 1187271 - DNA, 22 bp, Artificial Sequence
  chemically synthesized
agagaccagcctggccaagatg

SEQ ID NO: 1187272 - DNA, 22 bp, Artificial Sequence
  chemically synthesized
atagagacggggtttcaccatc

SEQ ID NO: 1187273 - DNA, 22 bp, Artificial Sequence
  chemically synthesized
aatagagacggggtttcaccat

SEQ ID NO: 1187274 - DNA, 22 bp, Artificial Sequence
  chemically synthesized
taatagagacggggtttcacca

SEQ ID NO: 1187275 - DNA, 22 bp, Artificial Sequence
  chemically synthesized
ttaatagagacggggtttcacc

SEQ ID NO: 1187276 - DNA, 22 bp, Artificial Sequence
  chemically synthesized
gccaagatggtgaaaccccgtc

SEQ ID NO: 1187277 - DNA, 22 bp, Artificial Sequence
  chemically synthesized
tatttttaatagagacggggtt

SEQ ID NO: 1187278 - DNA, 22 bp, Artificial Sequence
  chemically synthesized
gtatttttaatagagacggggt

SEQ ID NO: 1187279 - DNA, 22 bp, Artificial Sequence
  chemically synthesized
tgtatttttaatagagacgggg

SEQ ID NO: 1187280 - DNA, 22 bp, Artificial Sequence
  chemically synthesized
ttgtatttttaatagagacggg

SEQ ID NO: 1187281 - DNA, 22 bp, Artificial Sequence
  chemically synthesized
atttttgtatttttaatagaga

SEQ ID NO: 1187282 - DNA, 22 bp, Artificial Sequence
  chemically synthesized
tattaaaaatacaaaaatcagc

SEQ ID NO: 1187283 - DNA, 22 bp, Artificial Sequence
  chemically synthesized
ttaaaaatacaaaaatcagccg

SEQ ID NO: 1187284 - DNA, 22 bp, Artificial Sequence
  chemically synthesized
aaaatacaaaaatcagccgggt

SEQ ID NO: 1187285 - DNA, 22 bp, Artificial Sequence
  chemically synthesized
caggcatgcaccaccatacccg

SEQ ID NO: 1187286 - DNA, 22 bp, Artificial Sequence
  chemically synthesized
ccgagtaggtgggattacaggc

SEQ ID NO: 1187287 - DNA, 22 bp, Artificial Sequence
  chemically synthesized
agcctcccgagtaggtgggatt

SEQ ID NO: 1187288 - DNA, 22 bp, Artificial Sequence
  chemically synthesized
cctcagcctcccgagtaggtgg

SEQ ID NO: 1187289 - DNA, 22 bp, Artificial Sequence
  chemically synthesized
ctgcctcagcctcccgagtagg

SEQ ID NO: 1187290 - DNA, 22 bp, Artificial Sequence
  chemically synthesized
tcctgcctcagcctcccgagta

SEQ ID NO: 1187291 - DNA, 22 bp, Artificial Sequence
  chemically synthesized
taatcccacctactcgggaggc

SEQ ID NO: 1187292 - DNA, 22 bp, Artificial Sequence
  chemically synthesized
aagcaattctcctgcctcagcc

SEQ ID NO: 1187293 - DNA, 22 bp, Artificial Sequence
  chemically synthesized
ctcgggaggctgaggcaggaga

SEQ ID NO: 1187294 - DNA, 22 bp, Artificial Sequence
  chemically synthesized
gggaggctgaggcaggagaatt

SEQ ID NO: 1187295 - DNA, 22 bp, Artificial Sequence
  chemically synthesized
ccgggttcaagcaattctcctg

SEQ ID NO: 1187296 - DNA, 22 bp, Artificial Sequence
  chemically synthesized
cctcccgggttcaagcaattct

SEQ ID NO: 1187297 - DNA, 22 bp, Artificial Sequence
  chemically synthesized
tgcctcccgggttcaagcaatt

SEQ ID NO: 1187298 - DNA, 22 bp, Artificial Sequence
  chemically synthesized
aggcaggagaattgcttgaacc

SEQ ID NO: 1187299 - DNA, 22 bp, Artificial Sequence
  chemically synthesized
accgtcatctctgcctcccggg

SEQ ID NO: 1187300 - DNA, 22 bp, Artificial Sequence
  chemically synthesized
ggctcaccgtcatctctgcctc

SEQ ID NO: 1187301 - DNA, 22 bp, Artificial Sequence
  chemically synthesized
cttgaacccgggaggcagagat

SEQ ID NO: 1187302 - DNA, 22 bp, Artificial Sequence
  chemically synthesized
gaacccgggaggcagagatgac

SEQ ID NO: 1187303 - DNA, 22 bp, Artificial Sequence
  chemically synthesized
aacccgggaggcagagatgacg

SEQ ID NO: 1187304 - DNA, 22 bp, Artificial Sequence
  chemically synthesized
gagtacagtggcgtgatctcgg

SEQ ID NO: 1187305 - DNA, 22 bp, Artificial Sequence
  chemically synthesized
ccaggctggagtacagtggcgt

SEQ ID NO: 1187306 - DNA, 22 bp, Artificial Sequence
  chemically synthesized
cccaggctggagtacagtggcg

SEQ ID NO: 1187307 - DNA, 22 bp, Artificial Sequence
  chemically synthesized
tttcccaggctggagtacagtg

SEQ ID NO: 1187308 - DNA, 22 bp, Artificial Sequence
  chemically synthesized
tgtttcccaggctggagtacag

SEQ ID NO: 1187309 - DNA, 22 bp, Artificial Sequence
  chemically synthesized
ctctgtttcccaggctggagta

SEQ ID NO: 1187310 - DNA, 22 bp, Artificial Sequence
  chemically synthesized
gctctgtttcccaggctggagt

SEQ ID NO: 1187311 - DNA, 22 bp, Artificial Sequence
  chemically synthesized
tactccagcctgggaaacagag

SEQ ID NO: 1187312 - DNA, 22 bp, Artificial Sequence
  chemically synthesized
cgagacggagtcttgctctgtt

SEQ ID NO: 1187313 - DNA, 22 bp, Artificial Sequence
  chemically synthesized
cagcctgggaaacagagcaaga

SEQ ID NO: 1187314 - DNA, 22 bp, Artificial Sequence
  chemically synthesized
ccccctccgagacggagtcttg

SEQ ID NO: 1187315 - DNA, 22 bp, Artificial Sequence
  chemically synthesized
accccctccgagacggagtctt

SEQ ID NO: 1187316 - DNA, 22 bp, Artificial Sequence
  chemically synthesized
ggaaacagagcaagactccgtc

SEQ ID NO: 1187317 - DNA, 22 bp, Artificial Sequence
  chemically synthesized
taccccctccgagacggagtct

SEQ ID NO: 1187318 - DNA, 22 bp, Artificial Sequence
  chemically synthesized
ttaccccctccgagacggagtc

SEQ ID NO: 1187319 - DNA, 22 bp, Artificial Sequence
  chemically synthesized
tttaccccctccgagacggagt

SEQ ID NO: 1187320 - DNA, 22 bp, Artificial Sequence
  chemically synthesized
ttttaccccctccgagacggag

SEQ ID NO: 1187321 - DNA, 22 bp, Artificial Sequence
  chemically synthesized
tttttaccccctccgagacgga

SEQ ID NO: 1187322 - DNA, 22 bp, Artificial Sequence
  chemically synthesized
ttttttaccccctccgagacgg

SEQ ID NO: 1187323 - DNA, 22 bp, Artificial Sequence
  chemically synthesized
aatatagatttttttttacccc

SEQ ID NO: 1187324 - DNA, 22 bp, Artificial Sequence
  chemically synthesized
caatatagatttttttttaccc

SEQ ID NO: 1187325 - DNA, 22 bp, Artificial Sequence
  chemically synthesized
cgtctcggagggggtaaaaaaa

SEQ ID NO: 1187326 - DNA, 22 bp, Artificial Sequence
  chemically synthesized
tcaatatagatttttttttacc

SEQ ID NO: 1187327 - DNA, 22 bp, Artificial Sequence
  chemically synthesized
ggagggggtaaaaaaaaatcta

SEQ ID NO: 1187328 - DNA, 22 bp, Artificial Sequence
  chemically synthesized
atattttcaatatagatttttt

SEQ ID NO: 1187329 - DNA, 22 bp, Artificial Sequence
  chemically synthesized
tgtctcatattttcaatataga

SEQ ID NO: 1187330 - DNA, 22 bp, Artificial Sequence
  chemically synthesized
tgtgtctcatattttcaatata

SEQ ID NO: 1187331 - DNA, 22 bp, Artificial Sequence
  chemically synthesized
ctgtgtctcatattttcaatat

SEQ ID NO: 1187332 - DNA, 22 bp, Artificial Sequence
  chemically synthesized
tctgtgtctcatattttcaata

SEQ ID NO: 1187333 - DNA, 22 bp, Artificial Sequence
  chemically synthesized
ttctgtgtctcatattttcaat

SEQ ID NO: 1187334 - DNA, 22 bp, Artificial Sequence
  chemically synthesized
tattgaaaatatgagacacaga

SEQ ID NO: 1187335 - DNA, 22 bp, Artificial Sequence
  chemically synthesized
tggagtatatttttctgtgtct

SEQ ID NO: 1187336 - DNA, 22 bp, Artificial Sequence
  chemically synthesized
gtggagtatatttttctgtgtc

SEQ ID NO: 1187337 - DNA, 22 bp, Artificial Sequence
  chemically synthesized
aaaatatgagacacagaaaaat

SEQ ID NO: 1187338 - DNA, 22 bp, Artificial Sequence
  chemically synthesized
aataaacgtttgtggagtatat

SEQ ID NO: 1187339 - DNA, 22 bp, Artificial Sequence
  chemically synthesized
gcacaaagtaactcaataaacg

SEQ ID NO: 1187340 - DNA, 22 bp, Artificial Sequence
  chemically synthesized
cacaaacgtttattgagttact

SEQ ID NO: 1187341 - DNA, 22 bp, Artificial Sequence
  chemically synthesized
aaatatagcctggcacaaagta

SEQ ID NO: 1187342 - DNA, 22 bp, Artificial Sequence
  chemically synthesized
attgagttactttgtgccaggc

SEQ ID NO: 1187343 - DNA, 22 bp, Artificial Sequence
  chemically synthesized
ttgagttactttgtgccaggct

SEQ ID NO: 1187344 - DNA, 22 bp, Artificial Sequence
  chemically synthesized
aagtctaaaatatagcctggca

SEQ ID NO: 1187345 - DNA, 22 bp, Artificial Sequence
  chemically synthesized
agttactttgtgccaggctata

SEQ ID NO: 1187346 - DNA, 22 bp, Artificial Sequence
  chemically synthesized
ttaaagtctaaaatatagcctg

SEQ ID NO: 1187347 - DNA, 22 bp, Artificial Sequence
  chemically synthesized
ctttgtgccaggctatatttta

SEQ ID NO: 1187348 - DNA, 22 bp, Artificial Sequence
  chemically synthesized
tattattaaagtctaaaatata

SEQ ID NO: 1187349 - DNA, 22 bp, Artificial Sequence
  chemically synthesized
tgtgccaggctatattttagac

SEQ ID NO: 1187350 - DNA, 22 bp, Artificial Sequence
  chemically synthesized
gtgccaggctatattttagact

SEQ ID NO: 1187351 - DNA, 22 bp, Artificial Sequence
  chemically synthesized
tgccaggctatattttagactt

SEQ ID NO: 1187352 - DNA, 22 bp, Artificial Sequence
  chemically synthesized
ccattgtattattaaagtctaa

SEQ ID NO: 1187353 - DNA, 22 bp, Artificial Sequence
  chemically synthesized
accattgtattattaaagtcta

SEQ ID NO: 1187354 - DNA, 22 bp, Artificial Sequence
  chemically synthesized
tttaccattgtattattaaagt

SEQ ID NO: 1187355 - DNA, 22 bp, Artificial Sequence
  chemically synthesized
atttaccattgtattattaaag

SEQ ID NO: 1187356 - DNA, 22 bp, Artificial Sequence
  chemically synthesized
tattttagactttaataataca

SEQ ID NO: 1187357 - DNA, 22 bp, Artificial Sequence
  chemically synthesized
tagactttaataatacaatggt

SEQ ID NO: 1187358 - DNA, 22 bp, Artificial Sequence
  chemically synthesized
agactttaataatacaatggta

SEQ ID NO: 1187359 - DNA, 22 bp, Artificial Sequence
  chemically synthesized
ggatcatttatttaccattgta

SEQ ID NO: 1187360 - DNA, 22 bp, Artificial Sequence
  chemically synthesized
gactttaataatacaatggtaa

SEQ ID NO: 1187361 - DNA, 22 bp, Artificial Sequence
  chemically synthesized
tgggatcatttatttaccattg

SEQ ID NO: 1187362 - DNA, 22 bp, Artificial Sequence
  chemically synthesized
taataatacaatggtaaataaa

SEQ ID NO: 1187363 - DNA, 22 bp, Artificial Sequence
  chemically synthesized
aataatacaatggtaaataaat

SEQ ID NO: 1187364 - DNA, 22 bp, Artificial Sequence
  chemically synthesized
ataatacaatggtaaataaatg

SEQ ID NO: 1187365 - DNA, 22 bp, Artificial Sequence
  chemically synthesized
atgagaacatatctctgggatc

SEQ ID NO: 1187366 - DNA, 22 bp, Artificial Sequence
  chemically synthesized
catgagaacatatctctgggat

SEQ ID NO: 1187367 - DNA, 22 bp, Artificial Sequence
  chemically synthesized
tcatgagaacatatctctggga

SEQ ID NO: 1187368 - DNA, 22 bp, Artificial Sequence
  chemically synthesized
tttcatgagaacatatctctgg

SEQ ID NO: 1187369 - DNA, 22 bp, Artificial Sequence
  chemically synthesized
cagtcattctttcatgagaaca

SEQ ID NO: 1187370 - DNA, 22 bp, Artificial Sequence
  chemically synthesized
ccattacagtcattctttcatg

SEQ ID NO: 1187371 - DNA, 22 bp, Artificial Sequence
  chemically synthesized
cccattacagtcattctttcat

SEQ ID NO: 1187372 - DNA, 22 bp, Artificial Sequence
  chemically synthesized
tcccattacagtcattctttca

SEQ ID NO: 1187373 - DNA, 22 bp, Artificial Sequence
  chemically synthesized
ctttcccattacagtcattctt

SEQ ID NO: 1187374 - DNA, 22 bp, Artificial Sequence
  chemically synthesized
cctttcccattacagtcattct

SEQ ID NO: 1187375 - DNA, 22 bp, Artificial Sequence
  chemically synthesized
tcatgaaagaatgactgtaatg

SEQ ID NO: 1187376 - DNA, 22 bp, Artificial Sequence
  chemically synthesized
atgaaagaatgactgtaatggg

SEQ ID NO: 1187377 - DNA, 22 bp, Artificial Sequence
  chemically synthesized
gtaacttcctttcccattacag

SEQ ID NO: 1187378 - DNA, 22 bp, Artificial Sequence
  chemically synthesized
ttcgtaacttcctttcccatta

SEQ ID NO: 1187379 - DNA, 22 bp, Artificial Sequence
  chemically synthesized
attcgtaacttcctttcccatt

SEQ ID NO: 1187380 - DNA, 22 bp, Artificial Sequence
  chemically synthesized
tttattcgtaacttcctttccc

SEQ ID NO: 1187381 - DNA, 22 bp, Artificial Sequence
  chemically synthesized
aaattatttattcgtaacttcc

SEQ ID NO: 1187382 - DNA, 22 bp, Artificial Sequence
  chemically synthesized
gaaattatttattcgtaacttc

SEQ ID NO: 1187383 - DNA, 22 bp, Artificial Sequence
  chemically synthesized
taatgggaaaggaagttacgaa

SEQ ID NO: 1187384 - DNA, 22 bp, Artificial Sequence
  chemically synthesized
tgaaattatttattcgtaactt

SEQ ID NO: 1187385 - DNA, 22 bp, Artificial Sequence
  chemically synthesized
agaattttgaaattatttattc

SEQ ID NO: 1187386 - DNA, 22 bp, Artificial Sequence
  chemically synthesized
cgaataaataatttcaaaattc

SEQ ID NO: 1187387 - DNA, 22 bp, Artificial Sequence
  chemically synthesized
caaaattctcagtttaccactt

SEQ ID NO: 1187388 - DNA, 22 bp, Artificial Sequence
  chemically synthesized
aaaattctcagtttaccacttg

SEQ ID NO: 1187389 - DNA, 22 bp, Artificial Sequence
  chemically synthesized
tcagtttaccacttgccactgt

SEQ ID NO: 1187390 - DNA, 22 bp, Artificial Sequence
  chemically synthesized
agtttaccacttgccactgtat

SEQ ID NO: 1187391 - DNA, 22 bp, Artificial Sequence
  chemically synthesized
aatgaagcagggatacagtggc

SEQ ID NO: 1187392 - DNA, 22 bp, Artificial Sequence
  chemically synthesized
accacttgccactgtatccctg

SEQ ID NO: 1187393 - DNA, 22 bp, Artificial Sequence
  chemically synthesized
ccacttgccactgtatccctgc

SEQ ID NO: 1187394 - DNA, 22 bp, Artificial Sequence
  chemically synthesized
gccactgtatccctgcttcatt

SEQ ID NO: 1187395 - DNA, 22 bp, Artificial Sequence
  chemically synthesized
ccactgtatccctgcttcattg

SEQ ID NO: 1187396 - DNA, 22 bp, Artificial Sequence
  chemically synthesized
tggaaggcaattcaatgaagca

SEQ ID NO: 1187397 - DNA, 22 bp, Artificial Sequence
  chemically synthesized
atggaaggcaattcaatgaagc

SEQ ID NO: 1187398 - DNA, 22 bp, Artificial Sequence
  chemically synthesized
tatggaaggcaattcaatgaag

SEQ ID NO: 1187399 - DNA, 22 bp, Artificial Sequence
  chemically synthesized
ttatggaaggcaattcaatgaa

SEQ ID NO: 1187400 - DNA, 22 bp, Artificial Sequence
  chemically synthesized
tatccctgcttcattgaattgc

SEQ ID NO: 1187401 - DNA, 22 bp, Artificial Sequence
  chemically synthesized
cttcattgaattgccttccata

SEQ ID NO: 1187402 - DNA, 22 bp, Artificial Sequence
  chemically synthesized
cattgaattgccttccataaaa

SEQ ID NO: 1187403 - DNA, 22 bp, Artificial Sequence
  chemically synthesized
attgaattgccttccataaaag

SEQ ID NO: 1187404 - DNA, 22 bp, Artificial Sequence
  chemically synthesized
tcccagcgaagagggcttttat

SEQ ID NO: 1187405 - DNA, 22 bp, Artificial Sequence
  chemically synthesized
aattgccttccataaaagccct

SEQ ID NO: 1187406 - DNA, 22 bp, Artificial Sequence
  chemically synthesized
ccttccataaaagccctcttcg

SEQ ID NO: 1187407 - DNA, 22 bp, Artificial Sequence
  chemically synthesized
caaaaactatcccagcgaagag

SEQ ID NO: 1187408 - DNA, 22 bp, Artificial Sequence
  chemically synthesized
ccataaaagccctcttcgctgg

SEQ ID NO: 1187409 - DNA, 22 bp, Artificial Sequence
  chemically synthesized
ccaaaaactatcccagcgaaga

SEQ ID NO: 1187410 - DNA, 22 bp, Artificial Sequence
  chemically synthesized
cataaaagccctcttcgctggg

SEQ ID NO: 1187411 - DNA, 22 bp, Artificial Sequence
  chemically synthesized
atttccaaaaactatcccagcg

SEQ ID NO: 1187412 - DNA, 22 bp, Artificial Sequence
  chemically synthesized
aatttccaaaaactatcccagc

SEQ ID NO: 1187413 - DNA, 22 bp, Artificial Sequence
  chemically synthesized
atttaatttccaaaaactatcc

SEQ ID NO: 1187414 - DNA, 22 bp, Artificial Sequence
  chemically synthesized
tgatttaatttccaaaaactat

SEQ ID NO: 1187415 - DNA, 22 bp, Artificial Sequence
  chemically synthesized
ttcgctgggatagtttttggaa

SEQ ID NO: 1187416 - DNA, 22 bp, Artificial Sequence
  chemically synthesized
cgctgggatagtttttggaaat

SEQ ID NO: 1187417 - DNA, 22 bp, Artificial Sequence
  chemically synthesized
cattctgatttaatttccaaaa

SEQ ID NO: 1187418 - DNA, 22 bp, Artificial Sequence
  chemically synthesized
gctgggatagtttttggaaatt

SEQ ID NO: 1187419 - DNA, 22 bp, Artificial Sequence
  chemically synthesized
ccattctgatttaatttccaaa

SEQ ID NO: 1187420 - DNA, 22 bp, Artificial Sequence
  chemically synthesized
ggatagtttttggaaattaaat

SEQ ID NO: 1187421 - DNA, 22 bp, Artificial Sequence
  chemically synthesized
cagagcttccattctgatttaa

SEQ ID NO: 1187422 - DNA, 22 bp, Artificial Sequence
  chemically synthesized
ttggaaattaaatcagaatgga

SEQ ID NO: 1187423 - DNA, 22 bp, Artificial Sequence
  chemically synthesized
tggaaattaaatcagaatggaa

SEQ ID NO: 1187424 - DNA, 22 bp, Artificial Sequence
  chemically synthesized
acactgcagagcttccattctg

SEQ ID NO: 1187425 - DNA, 22 bp, Artificial Sequence
  chemically synthesized
ggaaattaaatcagaatggaag

SEQ ID NO: 1187426 - DNA, 22 bp, Artificial Sequence
  chemically synthesized
gaaattaaatcagaatggaagc

SEQ ID NO: 1187427 - DNA, 22 bp, Artificial Sequence
  chemically synthesized
gtattaacactgcagagcttcc

SEQ ID NO: 1187428 - DNA, 22 bp, Artificial Sequence
  chemically synthesized
ggtattaacactgcagagcttc

SEQ ID NO: 1187429 - DNA, 22 bp, Artificial Sequence
  chemically synthesized
aatcagaatggaagctctgcag

SEQ ID NO: 1187430 - DNA, 22 bp, Artificial Sequence
  chemically synthesized
aggatgtttggtattaacactg

SEQ ID NO: 1187431 - DNA, 22 bp, Artificial Sequence
  chemically synthesized
tcaggatgtttggtattaacac

SEQ ID NO: 1187432 - DNA, 22 bp, Artificial Sequence
  chemically synthesized
tgcagtgttaataccaaacatc

SEQ ID NO: 1187433 - DNA, 22 bp, Artificial Sequence
  chemically synthesized
aggcactctcaggatgtttggt

SEQ ID NO: 1187434 - DNA, 22 bp, Artificial Sequence
  chemically synthesized
cagtgttaataccaaacatcct

SEQ ID NO: 1187435 - DNA, 22 bp, Artificial Sequence
  chemically synthesized
tgaggcactctcaggatgtttg

SEQ ID NO: 1187436 - DNA, 22 bp, Artificial Sequence
  chemically synthesized
ctctgaggcactctcaggatgt

SEQ ID NO: 1187437 - DNA, 22 bp, Artificial Sequence
  chemically synthesized
gctctgaggcactctcaggatg

SEQ ID NO: 1187438 - DNA, 22 bp, Artificial Sequence
  chemically synthesized
ataccaaacatcctgagagtgc

SEQ ID NO: 1187439 - DNA, 22 bp, Artificial Sequence
  chemically synthesized
tgcatttgctctgaggcactct

SEQ ID NO: 1187440 - DNA, 22 bp, Artificial Sequence
  chemically synthesized
tgtgcatttgctctgaggcact

SEQ ID NO: 1187441 - DNA, 22 bp, Artificial Sequence
  chemically synthesized
ctgtgcatttgctctgaggcac

SEQ ID NO: 1187442 - DNA, 22 bp, Artificial Sequence
  chemically synthesized
agagtgcctcagagcaaatgca

SEQ ID NO: 1187443 - DNA, 22 bp, Artificial Sequence
  chemically synthesized
cccaccagcttctgtgcatttg

SEQ ID NO: 1187444 - DNA, 22 bp, Artificial Sequence
  chemically synthesized
ccccaccagcttctgtgcattt

SEQ ID NO: 1187445 - DNA, 22 bp, Artificial Sequence
  chemically synthesized
tccccaccagcttctgtgcatt

SEQ ID NO: 1187446 - DNA, 22 bp, Artificial Sequence
  chemically synthesized
ttccccaccagcttctgtgcat

SEQ ID NO: 1187447 - DNA, 22 bp, Artificial Sequence
  chemically synthesized
acttttccccaccagcttctgt

SEQ ID NO: 1187448 - DNA, 22 bp, Artificial Sequence
  chemically synthesized
agagcaaatgcacagaagctgg

SEQ ID NO: 1187449 - DNA, 22 bp, Artificial Sequence
  chemically synthesized
actgacttttccccaccagctt

SEQ ID NO: 1187450 - DNA, 22 bp, Artificial Sequence
  chemically synthesized
aactgacttttccccaccagct

SEQ ID NO: 1187451 - DNA, 22 bp, Artificial Sequence
  chemically synthesized
atttaactgacttttccccacc

SEQ ID NO: 1187452 - DNA, 22 bp, Artificial Sequence
  chemically synthesized
catttaactgacttttccccac

SEQ ID NO: 1187453 - DNA, 22 bp, Artificial Sequence
  chemically synthesized
tcatttaactgacttttcccca

SEQ ID NO: 1187454 - DNA, 22 bp, Artificial Sequence
  chemically synthesized
cgaattttcatttaactgactt

SEQ ID NO: 1187455 - DNA, 22 bp, Artificial Sequence
  chemically synthesized
gtggggaaaagtcagttaaatg

SEQ ID NO: 1187456 - DNA, 22 bp, Artificial Sequence
  chemically synthesized
gttgcgaattttcatttaactg

SEQ ID NO: 1187457 - DNA, 22 bp, Artificial Sequence
  chemically synthesized
aagtcacagttggttgcgaatt

SEQ ID NO: 1187458 - DNA, 22 bp, Artificial Sequence
  chemically synthesized
ctaaagtcacagttggttgcga

SEQ ID NO: 1187459 - DNA, 22 bp, Artificial Sequence
  chemically synthesized
aatgaaaattcgcaaccaactg

SEQ ID NO: 1187460 - DNA, 22 bp, Artificial Sequence
  chemically synthesized
aaactcctaaagtcacagttgg

SEQ ID NO: 1187461 - DNA, 22 bp, Artificial Sequence
  chemically synthesized
aaaactcctaaagtcacagttg

SEQ ID NO: 1187462 - DNA, 22 bp, Artificial Sequence
  chemically synthesized
tttaaaactcctaaagtcacag

SEQ ID NO: 1187463 - DNA, 22 bp, Artificial Sequence
  chemically synthesized
atttaaaactcctaaagtcaca

SEQ ID NO: 1187464 - DNA, 22 bp, Artificial Sequence
  chemically synthesized
gcaaccaactgtgactttagga

SEQ ID NO: 1187465 - DNA, 22 bp, Artificial Sequence
  chemically synthesized
aaacacgtcttatttaaaactc

SEQ ID NO: 1187466 - DNA, 22 bp, Artificial Sequence
  chemically synthesized
tgactttaggagttttaaataa

SEQ ID NO: 1187467 - DNA, 22 bp, Artificial Sequence
  chemically synthesized
aactgaaacacgtcttatttaa

SEQ ID NO: 1187468 - DNA, 22 bp, Artificial Sequence
  chemically synthesized
caactgaaacacgtcttattta

SEQ ID NO: 1187469 - DNA, 22 bp, Artificial Sequence
  chemically synthesized
tcaactgaaacacgtcttattt

SEQ ID NO: 1187470 - DNA, 22 bp, Artificial Sequence
  chemically synthesized
ttcaactgaaacacgtcttatt

SEQ ID NO: 1187471 - DNA, 22 bp, Artificial Sequence
  chemically synthesized
taggagttttaaataagacgtg

SEQ ID NO: 1187472 - DNA, 22 bp, Artificial Sequence
  chemically synthesized
aggagttttaaataagacgtgt

SEQ ID NO: 1187473 - DNA, 22 bp, Artificial Sequence
  chemically synthesized
ggagttttaaataagacgtgtt

SEQ ID NO: 1187474 - DNA, 22 bp, Artificial Sequence
  chemically synthesized
aaaaacttttcaactgaaacac

SEQ ID NO: 1187475 - DNA, 22 bp, Artificial Sequence
  chemically synthesized
gaaaaacttttcaactgaaaca

SEQ ID NO: 1187476 - DNA, 22 bp, Artificial Sequence
  chemically synthesized
taaataagacgtgtttcagttg

SEQ ID NO: 1187477 - DNA, 22 bp, Artificial Sequence
  chemically synthesized
tgaaaaacttttcaactgaaac

SEQ ID NO: 1187478 - DNA, 22 bp, Artificial Sequence
  chemically synthesized
aaataagacgtgtttcagttga

SEQ ID NO: 1187479 - DNA, 22 bp, Artificial Sequence
  chemically synthesized
ttgaaaaacttttcaactgaaa

SEQ ID NO: 1187480 - DNA, 22 bp, Artificial Sequence
  chemically synthesized
aataagacgtgtttcagttgaa

SEQ ID NO: 1187481 - DNA, 22 bp, Artificial Sequence
  chemically synthesized
atttttgaaaaacttttcaact

SEQ ID NO: 1187482 - DNA, 22 bp, Artificial Sequence
  chemically synthesized
gatttttgaaaaacttttcaac

SEQ ID NO: 1187483 - DNA, 22 bp, Artificial Sequence
  chemically synthesized
cagttgaaaagtttttcaaaaa

SEQ ID NO: 1187484 - DNA, 22 bp, Artificial Sequence
  chemically synthesized
agttgaaaagtttttcaaaaat

SEQ ID NO: 1187485 - DNA, 22 bp, Artificial Sequence
  chemically synthesized
aaaagtttttcaaaaatcaaat

SEQ ID NO: 1187486 - DNA, 22 bp, Artificial Sequence
  chemically synthesized
gggcacacggcagaaatttgat

SEQ ID NO: 1187487 - DNA, 22 bp, Artificial Sequence
  chemically synthesized
attagggcacacggcagaaatt

SEQ ID NO: 1187488 - DNA, 22 bp, Artificial Sequence
  chemically synthesized
ttcaaaaatcaaatttctgccg

SEQ ID NO: 1187489 - DNA, 22 bp, Artificial Sequence
  chemically synthesized
tcaaaaatcaaatttctgccgt

SEQ ID NO: 1187490 - DNA, 22 bp, Artificial Sequence
  chemically synthesized
caaaaatcaaatttctgccgtg

SEQ ID NO: 1187491 - DNA, 22 bp, Artificial Sequence
  chemically synthesized
ttgattagggcacacggcagaa

SEQ ID NO: 1187492 - DNA, 22 bp, Artificial Sequence
  chemically synthesized
aaaaatcaaatttctgccgtgt

SEQ ID NO: 1187493 - DNA, 22 bp, Artificial Sequence
  chemically synthesized
ctgttgattagggcacacggca

SEQ ID NO: 1187494 - DNA, 22 bp, Artificial Sequence
  chemically synthesized
cctgttgattagggcacacggc

SEQ ID NO: 1187495 - DNA, 22 bp, Artificial Sequence
  chemically synthesized
tcctgttgattagggcacacgg

SEQ ID NO: 1187496 - DNA, 22 bp, Artificial Sequence
  chemically synthesized
ttcctgttgattagggcacacg

SEQ ID NO: 1187497 - DNA, 22 bp, Artificial Sequence
  chemically synthesized
ctgccgtgtgccctaatcaaca

SEQ ID NO: 1187498 - DNA, 22 bp, Artificial Sequence
  chemically synthesized
tgccgtgtgccctaatcaacag

SEQ ID NO: 1187499 - DNA, 22 bp, Artificial Sequence
  chemically synthesized
ccgtgtgccctaatcaacagga

SEQ ID NO: 1187500 - DNA, 22 bp, Artificial Sequence
  chemically synthesized
aagatagaacttttcctgttga

SEQ ID NO: 1187501 - DNA, 22 bp, Artificial Sequence
  chemically synthesized
aaagatagaacttttcctgttg

SEQ ID NO: 1187502 - DNA, 22 bp, Artificial Sequence
  chemically synthesized
aaaatttaaagatagaactttt

SEQ ID NO: 1187503 - DNA, 22 bp, Artificial Sequence
  chemically synthesized
atcaacaggaaaagttctatct

SEQ ID NO: 1187504 - DNA, 22 bp, Artificial Sequence
  chemically synthesized
gaaattgaaaatttaaagatag

SEQ ID NO: 1187505 - DNA, 22 bp, Artificial Sequence
  chemically synthesized
ggaaattgaaaatttaaagata

SEQ ID NO: 1187506 - DNA, 22 bp, Artificial Sequence
  chemically synthesized
catttggaaattgaaaatttaa

SEQ ID NO: 1187507 - DNA, 22 bp, Artificial Sequence
  chemically synthesized
ctgcatttggaaattgaaaatt

SEQ ID NO: 1187508 - DNA, 22 bp, Artificial Sequence
  chemically synthesized
cctgcatttggaaattgaaaat

SEQ ID NO: 1187509 - DNA, 22 bp, Artificial Sequence
  chemically synthesized
tatctttaaattttcaatttcc

SEQ ID NO: 1187510 - DNA, 22 bp, Artificial Sequence
  chemically synthesized
tctttaaattttcaatttccaa

SEQ ID NO: 1187511 - DNA, 22 bp, Artificial Sequence
  chemically synthesized
aaaatttcctgcatttggaaat

SEQ ID NO: 1187512 - DNA, 22 bp, Artificial Sequence
  chemically synthesized
gaaaatttcctgcatttggaaa

SEQ ID NO: 1187513 - DNA, 22 bp, Artificial Sequence
  chemically synthesized
taaattttcaatttccaaatgc

SEQ ID NO: 1187514 - DNA, 22 bp, Artificial Sequence
  chemically synthesized
tgaaaatttcctgcatttggaa

SEQ ID NO: 1187515 - DNA, 22 bp, Artificial Sequence
  chemically synthesized
aaattttcaatttccaaatgca

SEQ ID NO: 1187516 - DNA, 22 bp, Artificial Sequence
  chemically synthesized
aattttcaatttccaaatgcag

SEQ ID NO: 1187517 - DNA, 22 bp, Artificial Sequence
  chemically synthesized
tcaatttccaaatgcaggaaat

SEQ ID NO: 1187518 - DNA, 22 bp, Artificial Sequence
  chemically synthesized
caatttccaaatgcaggaaatt

SEQ ID NO: 1187519 - DNA, 22 bp, Artificial Sequence
  chemically synthesized
aatttccaaatgcaggaaattt

SEQ ID NO: 1187520 - DNA, 22 bp, Artificial Sequence
  chemically synthesized
ccaaatgcaggaaattttcaaa

SEQ ID NO: 1187521 - DNA, 22 bp, Artificial Sequence
  chemically synthesized
caaatgcaggaaattttcaaaa

SEQ ID NO: 1187522 - DNA, 22 bp, Artificial Sequence
  chemically synthesized
tgacggaagagacaattttgaa

SEQ ID NO: 1187523 - DNA, 22 bp, Artificial Sequence
  chemically synthesized
ggacaattgtgacggaagagac

SEQ ID NO: 1187524 - DNA, 22 bp, Artificial Sequence
  chemically synthesized
aggacaattgtgacggaagaga

SEQ ID NO: 1187525 - DNA, 22 bp, Artificial Sequence
  chemically synthesized
tcaaaattgtctcttccgtcac

SEQ ID NO: 1187526 - DNA, 22 bp, Artificial Sequence
  chemically synthesized
caaaattgtctcttccgtcaca

SEQ ID NO: 1187527 - DNA, 22 bp, Artificial Sequence
  chemically synthesized
aaaattgtctcttccgtcacaa

SEQ ID NO: 1187528 - DNA, 22 bp, Artificial Sequence
  chemically synthesized
tctcttccgtcacaattgtcct

SEQ ID NO: 1187529 - DNA, 22 bp, Artificial Sequence
  chemically synthesized
acatatgtaaacttaggacaat

SEQ ID NO: 1187530 - DNA, 22 bp, Artificial Sequence
  chemically synthesized
aacatatgtaaacttaggacaa

SEQ ID NO: 1187531 - DNA, 22 bp, Artificial Sequence
  chemically synthesized
ttccgtcacaattgtcctaagt

SEQ ID NO: 1187532 - DNA, 22 bp, Artificial Sequence
  chemically synthesized
ccgtcacaattgtcctaagttt

SEQ ID NO: 1187533 - DNA, 22 bp, Artificial Sequence
  chemically synthesized
cgtcacaattgtcctaagttta

SEQ ID NO: 1187534 - DNA, 22 bp, Artificial Sequence
  chemically synthesized
tcctaagtttacatatgttaaa

SEQ ID NO: 1187535 - DNA, 22 bp, Artificial Sequence
  chemically synthesized
aaataaaatatatttaacatat

SEQ ID NO: 1187536 - DNA, 22 bp, Artificial Sequence
  chemically synthesized
caaataaaatatatttaacata

SEQ ID NO: 1187537 - DNA, 22 bp, Artificial Sequence
  chemically synthesized
tcaaataaaatatatttaacat

SEQ ID NO: 1187538 - DNA, 22 bp, Artificial Sequence
  chemically synthesized
ttcaaataaaatatatttaaca

SEQ ID NO: 1187539 - DNA, 22 bp, Artificial Sequence
  chemically synthesized
agtttacatatgttaaatatat

SEQ ID NO: 1187540 - DNA, 22 bp, Artificial Sequence
  chemically synthesized
acatatgttaaatatattttat

SEQ ID NO: 1187541 - DNA, 22 bp, Artificial Sequence
  chemically synthesized
catatgttaaatatattttatt

SEQ ID NO: 1187542 - DNA, 22 bp, Artificial Sequence
  chemically synthesized
aatatattttatttgaaaaata

SEQ ID NO: 1187543 - DNA, 22 bp, Artificial Sequence
  chemically synthesized
aatagtcaaggatgtatttttc

SEQ ID NO: 1187544 - DNA, 22 bp, Artificial Sequence
  chemically synthesized
aaatagtcaaggatgtattttt

SEQ ID NO: 1187545 - DNA, 22 bp, Artificial Sequence
  chemically synthesized
tatttgaaaaatacatccttga

SEQ ID NO: 1187546 - DNA, 22 bp, Artificial Sequence
  chemically synthesized
atttgaaaaatacatccttgac

SEQ ID NO: 1187547 - DNA, 22 bp, Artificial Sequence
  chemically synthesized
aggatttaaatagtcaaggatg

SEQ ID NO: 1187548 - DNA, 22 bp, Artificial Sequence
  chemically synthesized
tttgaaaaatacatccttgact

SEQ ID NO: 1187549 - DNA, 22 bp, Artificial Sequence
  chemically synthesized
taaggatttaaatagtcaagga

SEQ ID NO: 1187550 - DNA, 22 bp, Artificial Sequence
  chemically synthesized
gaaaaatacatccttgactatt

SEQ ID NO: 1187551 - DNA, 22 bp, Artificial Sequence
  chemically synthesized
aaaaatacatccttgactattt

SEQ ID NO: 1187552 - DNA, 22 bp, Artificial Sequence
  chemically synthesized
ttctaaggatttaaatagtcaa

SEQ ID NO: 1187553 - DNA, 22 bp, Artificial Sequence
  chemically synthesized
gttctaaggatttaaatagtca

SEQ ID NO: 1187554 - DNA, 22 bp, Artificial Sequence
  chemically synthesized
gactatttaaatccttagaaca

SEQ ID NO: 1187555 - DNA, 22 bp, Artificial Sequence
  chemically synthesized
actatttaaatccttagaacaa

SEQ ID NO: 1187556 - DNA, 22 bp, Artificial Sequence
  chemically synthesized
cataccaaatatttgttctaag

SEQ ID NO: 1187557 - DNA, 22 bp, Artificial Sequence
  chemically synthesized
tttaaatccttagaacaaatat

SEQ ID NO: 1187558 - DNA, 22 bp, Artificial Sequence
  chemically synthesized
aaatccttagaacaaatatttg

SEQ ID NO: 1187559 - DNA, 22 bp, Artificial Sequence
  chemically synthesized
gaagttacataccaaatatttg

SEQ ID NO: 1187560 - DNA, 22 bp, Artificial Sequence
  chemically synthesized
aatccttagaacaaatatttgg

SEQ ID NO: 1187561 - DNA, 22 bp, Artificial Sequence
  chemically synthesized
agaagttacataccaaatattt

SEQ ID NO: 1187562 - DNA, 22 bp, Artificial Sequence
  chemically synthesized
ggtttagaagttacataccaaa

SEQ ID NO: 1187563 - DNA, 22 bp, Artificial Sequence
  chemically synthesized
agaacaaatatttggtatgtaa

SEQ ID NO: 1187564 - DNA, 22 bp, Artificial Sequence
  chemically synthesized
gaacaaatatttggtatgtaac

SEQ ID NO: 1187565 - DNA, 22 bp, Artificial Sequence
  chemically synthesized
ctgggtttagaagttacatacc

SEQ ID NO: 1187566 - DNA, 22 bp, Artificial Sequence
  chemically synthesized
tcctgggtttagaagttacata

SEQ ID NO: 1187567 - DNA, 22 bp, Artificial Sequence
  chemically synthesized
ttctcctgggtttagaagttac

SEQ ID NO: 1187568 - DNA, 22 bp, Artificial Sequence
  chemically synthesized
ggtatgtaacttctaaacccag

SEQ ID NO: 1187569 - DNA, 22 bp, Artificial Sequence
  chemically synthesized
gtgtctgttctcctgggtttag

SEQ ID NO: 1187570 - DNA, 22 bp, Artificial Sequence
  chemically synthesized
gtatgtaacttctaaacccagg

SEQ ID NO: 1187571 - DNA, 22 bp, Artificial Sequence
  chemically synthesized
tgtcaagttagtgtctgttctc

SEQ ID NO: 1187572 - DNA, 22 bp, Artificial Sequence
  chemically synthesized
ctaaacccaggagaacagacac

SEQ ID NO: 1187573 - DNA, 22 bp, Artificial Sequence
  chemically synthesized
taaacccaggagaacagacact

SEQ ID NO: 1187574 - DNA, 22 bp, Artificial Sequence
  chemically synthesized
ttatgtcaagttagtgtctgtt

SEQ ID NO: 1187575 - DNA, 22 bp, Artificial Sequence
  chemically synthesized
gttatgtcaagttagtgtctgt

SEQ ID NO: 1187576 - DNA, 22 bp, Artificial Sequence
  chemically synthesized
aacccaggagaacagacactaa

SEQ ID NO: 1187577 - DNA, 22 bp, Artificial Sequence
  chemically synthesized
catttgttatgtcaagttagtg

SEQ ID NO: 1187578 - DNA, 22 bp, Artificial Sequence
  chemically synthesized
ccatttgttatgtcaagttagt

SEQ ID NO: 1187579 - DNA, 22 bp, Artificial Sequence
  chemically synthesized
agtagcttccatttgttatgtc

SEQ ID NO: 1187580 - DNA, 22 bp, Artificial Sequence
  chemically synthesized
actgagtagcttccatttgtta

SEQ ID NO: 1187581 - DNA, 22 bp, Artificial Sequence
  chemically synthesized
acttgacataacaaatggaagc

SEQ ID NO: 1187582 - DNA, 22 bp, Artificial Sequence
  chemically synthesized
gacataacaaatggaagctact

SEQ ID NO: 1187583 - DNA, 22 bp, Artificial Sequence
  chemically synthesized
ccatgctgactgagtagcttcc

SEQ ID NO: 1187584 - DNA, 22 bp, Artificial Sequence
  chemically synthesized
acataacaaatggaagctactc

SEQ ID NO: 1187585 - DNA, 22 bp, Artificial Sequence
  chemically synthesized
tagtctcccatgctgactgagt

SEQ ID NO: 1187586 - DNA, 22 bp, Artificial Sequence
  chemically synthesized
tctgtagtctcccatgctgact

SEQ ID NO: 1187587 - DNA, 22 bp, Artificial Sequence
  chemically synthesized
tatctgtagtctcccatgctga

SEQ ID NO: 1187588 - DNA, 22 bp, Artificial Sequence
  chemically synthesized
ctatctgtagtctcccatgctg

SEQ ID NO: 1187589 - DNA, 22 bp, Artificial Sequence
  chemically synthesized
tctatctgtagtctcccatgct

SEQ ID NO: 1187590 - DNA, 22 bp, Artificial Sequence
  chemically synthesized
ttctatctgtagtctcccatgc

SEQ ID NO: 1187591 - DNA, 22 bp, Artificial Sequence
  chemically synthesized
ctcagtcagcatgggagactac

SEQ ID NO: 1187592 - DNA, 22 bp, Artificial Sequence
  chemically synthesized
agtcagcatgggagactacaga

SEQ ID NO: 1187593 - DNA, 22 bp, Artificial Sequence
  chemically synthesized
taagaaagtacagatgtttttc

SEQ ID NO: 1187594 - DNA, 22 bp, Artificial Sequence
  chemically synthesized
cagatagaaaaacatctgtact

SEQ ID NO: 1187595 - DNA, 22 bp, Artificial Sequence
  chemically synthesized
tactttcttacaattctctcga

SEQ ID NO: 1187596 - DNA, 22 bp, Artificial Sequence
  chemically synthesized
ccacaacaggcatgtcgagaga

SEQ ID NO: 1187597 - DNA, 22 bp, Artificial Sequence
  chemically synthesized
cccacaacaggcatgtcgagag

SEQ ID NO: 1187598 - DNA, 22 bp, Artificial Sequence
  chemically synthesized
tcttacaattctctcgacatgc

SEQ ID NO: 1187599 - DNA, 22 bp, Artificial Sequence
  chemically synthesized
ttcccacaacaggcatgtcgag

SEQ ID NO: 1187600 - DNA, 22 bp, Artificial Sequence
  chemically synthesized
cttacaattctctcgacatgcc

SEQ ID NO: 1187601 - DNA, 22 bp, Artificial Sequence
  chemically synthesized
ttacaattctctcgacatgcct

SEQ ID NO: 1187602 - DNA, 22 bp, Artificial Sequence
  chemically synthesized
acaattctctcgacatgcctgt

SEQ ID NO: 1187603 - DNA, 22 bp, Artificial Sequence
  chemically synthesized
caattctctcgacatgcctgtt

SEQ ID NO: 1187604 - DNA, 22 bp, Artificial Sequence
  chemically synthesized
atagttcttcccacaacaggca

SEQ ID NO: 1187605 - DNA, 22 bp, Artificial Sequence
  chemically synthesized
tctcgacatgcctgttgtggga

SEQ ID NO: 1187606 - DNA, 22 bp, Artificial Sequence
  chemically synthesized
tcgacatgcctgttgtgggaag

SEQ ID NO: 1187607 - DNA, 22 bp, Artificial Sequence
  chemically synthesized
gacatgcctgttgtgggaagaa

SEQ ID NO: 1187608 - DNA, 22 bp, Artificial Sequence
  chemically synthesized
aaatgtaaaccctaatagttct

SEQ ID NO: 1187609 - DNA, 22 bp, Artificial Sequence
  chemically synthesized
ttgtgggaagaactattagggt

SEQ ID NO: 1187610 - DNA, 22 bp, Artificial Sequence
  chemically synthesized
atctcaaatgtaaaccctaata

SEQ ID NO: 1187611 - DNA, 22 bp, Artificial Sequence
  chemically synthesized
catctcaaatgtaaaccctaat

SEQ ID NO: 1187612 - DNA, 22 bp, Artificial Sequence
  chemically synthesized
tgggaagaactattagggttta

SEQ ID NO: 1187613 - DNA, 22 bp, Artificial Sequence
  chemically synthesized
tcatctcaaatgtaaaccctaa

SEQ ID NO: 1187614 - DNA, 22 bp, Artificial Sequence
  chemically synthesized
ttagggtttacatttgagatga

SEQ ID NO: 1187615 - DNA, 22 bp, Artificial Sequence
  chemically synthesized
agtcaaaatactttcatctcaa

SEQ ID NO: 1187616 - DNA, 22 bp, Artificial Sequence
  chemically synthesized
gggtttacatttgagatgaaag

SEQ ID NO: 1187617 - DNA, 22 bp, Artificial Sequence
  chemically synthesized
acatttgagatgaaagtatttt

SEQ ID NO: 1187618 - DNA, 22 bp, Artificial Sequence
  chemically synthesized
catttgagatgaaagtattttg

SEQ ID NO: 1187619 - DNA, 22 bp, Artificial Sequence
  chemically synthesized
aatgtcactgagtcaaaatact

SEQ ID NO: 1187620 - DNA, 22 bp, Artificial Sequence
  chemically synthesized
gagatgaaagtattttgactca

SEQ ID NO: 1187621 - DNA, 22 bp, Artificial Sequence
  chemically synthesized
agatgaaagtattttgactcag

SEQ ID NO: 1187622 - DNA, 22 bp, Artificial Sequence
  chemically synthesized
agcagagttaaatgtcactgag

SEQ ID NO: 1187623 - DNA, 22 bp, Artificial Sequence
  chemically synthesized
aagcagagttaaatgtcactga

SEQ ID NO: 1187624 - DNA, 22 bp, Artificial Sequence
  chemically synthesized
tgactcagtgacatttaactct

SEQ ID NO: 1187625 - DNA, 22 bp, Artificial Sequence
  chemically synthesized
gactcagtgacatttaactctg

SEQ ID NO: 1187626 - DNA, 22 bp, Artificial Sequence
  chemically synthesized
actcagtgacatttaactctgc

SEQ ID NO: 1187627 - DNA, 22 bp, Artificial Sequence
  chemically synthesized
agtgacatttaactctgcttaa

SEQ ID NO: 1187628 - DNA, 22 bp, Artificial Sequence
  chemically synthesized
aactctgcttaagtgattgtca

SEQ ID NO: 1187629 - DNA, 22 bp, Artificial Sequence
  chemically synthesized
actctgcttaagtgattgtcac

SEQ ID NO: 1187630 - DNA, 22 bp, Artificial Sequence
  chemically synthesized
tgcttaagtgattgtcacctgc

SEQ ID NO: 1187631 - DNA, 22 bp, Artificial Sequence
  chemically synthesized
cttaagtgattgtcacctgcgg

SEQ ID NO: 1187632 - DNA, 22 bp, Artificial Sequence
  chemically synthesized
aagtgattgtcacctgcggttt

SEQ ID NO: 1187633 - DNA, 22 bp, Artificial Sequence
  chemically synthesized
agtgattgtcacctgcggtttt

SEQ ID NO: 1187634 - DNA, 22 bp, Artificial Sequence
  chemically synthesized
ggtcaaaagcaaagcacgaaaa

SEQ ID NO: 1187635 - DNA, 22 bp, Artificial Sequence
  chemically synthesized
tcacctgcggttttcgtgcttt

SEQ ID NO: 1187636 - DNA, 22 bp, Artificial Sequence
  chemically synthesized
gttaggtcaaaagcaaagcacg

SEQ ID NO: 1187637 - DNA, 22 bp, Artificial Sequence
  chemically synthesized
ggttaggtcaaaagcaaagcac

SEQ ID NO: 1187638 - DNA, 22 bp, Artificial Sequence
  chemically synthesized
cggttttcgtgctttgcttttg

SEQ ID NO: 1187639 - DNA, 22 bp, Artificial Sequence
  chemically synthesized
tcgtgctttgcttttgacctaa

SEQ ID NO: 1187640 - DNA, 22 bp, Artificial Sequence
  chemically synthesized
cgtgctttgcttttgacctaac

SEQ ID NO: 1187641 - DNA, 22 bp, Artificial Sequence
  chemically synthesized
gtgctttgcttttgacctaacc

SEQ ID NO: 1187642 - DNA, 22 bp, Artificial Sequence
  chemically synthesized
tgcttttgacctaaccaaattg

SEQ ID NO: 1187643 - DNA, 22 bp, Artificial Sequence
  chemically synthesized
gcttttgacctaaccaaattga

SEQ ID NO: 1187644 - DNA, 22 bp, Artificial Sequence
  chemically synthesized
cttttgacctaaccaaattgac

SEQ ID NO: 1187645 - DNA, 22 bp, Artificial Sequence
  chemically synthesized
ttgacctaaccaaattgacttt

SEQ ID NO: 1187646 - DNA, 22 bp, Artificial Sequence
  chemically synthesized
tgacctaaccaaattgactttt

SEQ ID NO: 1187647 - DNA, 22 bp, Artificial Sequence
  chemically synthesized
gacctaaccaaattgacttttt

SEQ ID NO: 1187648 - DNA, 22 bp, Artificial Sequence
  chemically synthesized
acctaaccaaattgactttttc

SEQ ID NO: 1187649 - DNA, 22 bp, Artificial Sequence
  chemically synthesized
gcagcagaggaaagaaaaagtc

SEQ ID NO: 1187650 - DNA, 22 bp, Artificial Sequence
  chemically synthesized
tagcagcagaggaaagaaaaag

SEQ ID NO: 1187651 - DNA, 22 bp, Artificial Sequence
  chemically synthesized
ctagcagcagaggaaagaaaaa

SEQ ID NO: 1187652 - DNA, 22 bp, Artificial Sequence
  chemically synthesized
accaaattgactttttctttcc

SEQ ID NO: 1187653 - DNA, 22 bp, Artificial Sequence
  chemically synthesized
tctagcagcagaggaaagaaaa

SEQ ID NO: 1187654 - DNA, 22 bp, Artificial Sequence
  chemically synthesized
ttctagcagcagaggaaagaaa

SEQ ID NO: 1187655 - DNA, 22 bp, Artificial Sequence
  chemically synthesized
tttctagcagcagaggaaagaa

SEQ ID NO: 1187656 - DNA, 22 bp, Artificial Sequence
  chemically synthesized
tactttttctagcagcagagga

SEQ ID NO: 1187657 - DNA, 22 bp, Artificial Sequence
  chemically synthesized
actttttctttcctctgctgct

SEQ ID NO: 1187658 - DNA, 22 bp, Artificial Sequence
  chemically synthesized
actatactttttctagcagcag

SEQ ID NO: 1187659 - DNA, 22 bp, Artificial Sequence
  chemically synthesized
tttctttcctctgctgctagaa

SEQ ID NO: 1187660 - DNA, 22 bp, Artificial Sequence
  chemically synthesized
ttctttcctctgctgctagaaa

SEQ ID NO: 1187661 - DNA, 22 bp, Artificial Sequence
  chemically synthesized
tctttcctctgctgctagaaaa

SEQ ID NO: 1187662 - DNA, 22 bp, Artificial Sequence
  chemically synthesized
ctttcctctgctgctagaaaaa

SEQ ID NO: 1187663 - DNA, 22 bp, Artificial Sequence
  chemically synthesized
tttcctctgctgctagaaaaag

SEQ ID NO: 1187664 - DNA, 22 bp, Artificial Sequence
  chemically synthesized
aaactgactatactttttctag

SEQ ID NO: 1187665 - DNA, 22 bp, Artificial Sequence
  chemically synthesized
tcctctgctgctagaaaaagta

SEQ ID NO: 1187666 - DNA, 22 bp, Artificial Sequence
  chemically synthesized
tgaaactgactatactttttct

SEQ ID NO: 1187667 - DNA, 22 bp, Artificial Sequence
  chemically synthesized
cctctgctgctagaaaaagtat

SEQ ID NO: 1187668 - DNA, 22 bp, Artificial Sequence
  chemically synthesized
ctgaaactgactatactttttc

SEQ ID NO: 1187669 - DNA, 22 bp, Artificial Sequence
  chemically synthesized
ctctgctgctagaaaaagtata

SEQ ID NO: 1187670 - DNA, 22 bp, Artificial Sequence
  chemically synthesized
cttctgaaactgactatacttt

SEQ ID NO: 1187671 - DNA, 22 bp, Artificial Sequence
  chemically synthesized
tgctgctagaaaaagtatagtc

SEQ ID NO: 1187672 - DNA, 22 bp, Artificial Sequence
  chemically synthesized
ctgctagaaaaagtatagtcag

SEQ ID NO: 1187673 - DNA, 22 bp, Artificial Sequence
  chemically synthesized
ctagaaaaagtatagtcagttt

SEQ ID NO: 1187674 - DNA, 22 bp, Artificial Sequence
  chemically synthesized
gaaaaagtatagtcagtttcag

SEQ ID NO: 1187675 - DNA, 22 bp, Artificial Sequence
  chemically synthesized
gcgaggaagataaggggtggag

SEQ ID NO: 1187676 - DNA, 22 bp, Artificial Sequence
  chemically synthesized
cagaagtaactccaccccttat

SEQ ID NO: 1187677 - DNA, 22 bp, Artificial Sequence
  chemically synthesized
agaagtaactccaccccttatc

SEQ ID NO: 1187678 - DNA, 22 bp, Artificial Sequence
  chemically synthesized
tgttagcgaggaagataagggg

SEQ ID NO: 1187679 - DNA, 22 bp, Artificial Sequence
  chemically synthesized
atgttagcgaggaagataaggg

SEQ ID NO: 1187680 - DNA, 22 bp, Artificial Sequence
  chemically synthesized
tatgttagcgaggaagataagg

SEQ ID NO: 1187681 - DNA, 22 bp, Artificial Sequence
  chemically synthesized
ttttatgttagcgaggaagata

SEQ ID NO: 1187682 - DNA, 22 bp, Artificial Sequence
  chemically synthesized
caccccttatcttcctcgctaa

SEQ ID NO: 1187683 - DNA, 22 bp, Artificial Sequence
  chemically synthesized
acaaatagactattttatgtta

SEQ ID NO: 1187684 - DNA, 22 bp, Artificial Sequence
  chemically synthesized
atcttcctcgctaacataaaat

SEQ ID NO: 1187685 - DNA, 22 bp, Artificial Sequence
  chemically synthesized
tcttcctcgctaacataaaata

SEQ ID NO: 1187686 - DNA, 22 bp, Artificial Sequence
  chemically synthesized
cctcgctaacataaaatagtct

SEQ ID NO: 1187687 - DNA, 22 bp, Artificial Sequence
  chemically synthesized
aggttcacaaatagactatttt

SEQ ID NO: 1187688 - DNA, 22 bp, Artificial Sequence
  chemically synthesized
ctcgctaacataaaatagtcta

SEQ ID NO: 1187689 - DNA, 22 bp, Artificial Sequence
  chemically synthesized
gctaacataaaatagtctattt

SEQ ID NO: 1187690 - DNA, 22 bp, Artificial Sequence
  chemically synthesized
acataaaatagtctatttgtga

SEQ ID NO: 1187691 - DNA, 22 bp, Artificial Sequence
  chemically synthesized
taaacaattaaggttcacaaat

SEQ ID NO: 1187692 - DNA, 22 bp, Artificial Sequence
  chemically synthesized
acactgtaaacaattaaggttc

SEQ ID NO: 1187693 - DNA, 22 bp, Artificial Sequence
  chemically synthesized
taacactgtaaacaattaaggt

SEQ ID NO: 1187694 - DNA, 22 bp, Artificial Sequence
  chemically synthesized
ctaacactgtaaacaattaagg

SEQ ID NO: 1187695 - DNA, 22 bp, Artificial Sequence
  chemically synthesized
tttgtgaaccttaattgtttac

SEQ ID NO: 1187696 - DNA, 22 bp, Artificial Sequence
  chemically synthesized
gtgaaccttaattgtttacagt

SEQ ID NO: 1187697 - DNA, 22 bp, Artificial Sequence
  chemically synthesized
tgaaccttaattgtttacagtg

SEQ ID NO: 1187698 - DNA, 22 bp, Artificial Sequence
  chemically synthesized
aattgtttacagtgttagaagt

SEQ ID NO: 1187699 - DNA, 22 bp, Artificial Sequence
  chemically synthesized
attgtttacagtgttagaagtt

SEQ ID NO: 1187700 - DNA, 22 bp, Artificial Sequence
  chemically synthesized
tgtatcaagtataacttctaac

SEQ ID NO: 1187701 - DNA, 22 bp, Artificial Sequence
  chemically synthesized
tttacagtgttagaagttatac

SEQ ID NO: 1187702 - DNA, 22 bp, Artificial Sequence
  chemically synthesized
actgtgtatcaagtataacttc

SEQ ID NO: 1187703 - DNA, 22 bp, Artificial Sequence
  chemically synthesized
acagtgttagaagttatacttg

SEQ ID NO: 1187704 - DNA, 22 bp, Artificial Sequence
  chemically synthesized
cagtgttagaagttatacttga

SEQ ID NO: 1187705 - DNA, 22 bp, Artificial Sequence
  chemically synthesized
gcctcactgtgtatcaagtata

SEQ ID NO: 1187706 - DNA, 22 bp, Artificial Sequence
  chemically synthesized
tggcctcactgtgtatcaagta

SEQ ID NO: 1187707 - DNA, 22 bp, Artificial Sequence
  chemically synthesized
ttctggcctcactgtgtatcaa

SEQ ID NO: 1187708 - DNA, 22 bp, Artificial Sequence
  chemically synthesized
attctggcctcactgtgtatca

SEQ ID NO: 1187709 - DNA, 22 bp, Artificial Sequence
  chemically synthesized
gaagttatacttgatacacagt

SEQ ID NO: 1187710 - DNA, 22 bp, Artificial Sequence
  chemically synthesized
tattctggcctcactgtgtatc

SEQ ID NO: 1187711 - DNA, 22 bp, Artificial Sequence
  chemically synthesized
tacttgatacacagtgaggcca

SEQ ID NO: 1187712 - DNA, 22 bp, Artificial Sequence
  chemically synthesized
gatacacagtgaggccagaata

SEQ ID NO: 1187713 - DNA, 22 bp, Artificial Sequence
  chemically synthesized
atacacagtgaggccagaataa

SEQ ID NO: 1187714 - DNA, 22 bp, Artificial Sequence
  chemically synthesized
tgtcacatgaaataaacatctt

SEQ ID NO: 1187715 - DNA, 22 bp, Artificial Sequence
  chemically synthesized
atgtcacatgaaataaacatct

SEQ ID NO: 1187716 - DNA, 22 bp, Artificial Sequence
  chemically synthesized
aatttatgtcacatgaaataaa

SEQ ID NO: 1187717 - DNA, 22 bp, Artificial Sequence
  chemically synthesized
atttcatgtgacataaatttaa

SEQ ID NO: 1187718 - DNA, 22 bp, Artificial Sequence
  chemically synthesized
tttcatgtgacataaatttaat

SEQ ID NO: 1187719 - DNA, 22 bp, Artificial Sequence
  chemically synthesized
catgtgacataaatttaattgg

SEQ ID NO: 1187720 - DNA, 22 bp, Artificial Sequence
  chemically synthesized
atgtgacataaatttaattggt

SEQ ID NO: 1187721 - DNA, 22 bp, Artificial Sequence
  chemically synthesized
aattggttattattctttctgg

SEQ ID NO: 1187722 - DNA, 22 bp, Artificial Sequence
  chemically synthesized
attggttattattctttctggt

SEQ ID NO: 1187723 - DNA, 22 bp, Artificial Sequence
  chemically synthesized
aaatcccaaaatataccagaaa

SEQ ID NO: 1187724 - DNA, 22 bp, Artificial Sequence
  chemically synthesized
gaaatcccaaaatataccagaa

SEQ ID NO: 1187725 - DNA, 22 bp, Artificial Sequence
  chemically synthesized
gttattattctttctggtatat

SEQ ID NO: 1187726 - DNA, 22 bp, Artificial Sequence
  chemically synthesized
tgaaatcccaaaatataccaga

SEQ ID NO: 1187727 - DNA, 22 bp, Artificial Sequence
  chemically synthesized
ttattctttctggtatattttg

SEQ ID NO: 1187728 - DNA, 22 bp, Artificial Sequence
  chemically synthesized
ttctttctggtatattttggga

SEQ ID NO: 1187729 - DNA, 22 bp, Artificial Sequence
  chemically synthesized
tttctggtatattttgggattt

SEQ ID NO: 1187730 - DNA, 22 bp, Artificial Sequence
  chemically synthesized
tctggtatattttgggatttca

SEQ ID NO: 1187731 - DNA, 22 bp, Artificial Sequence
  chemically synthesized
ctggtatattttgggatttcaa

SEQ ID NO: 1187732 - DNA, 22 bp, Artificial Sequence
  chemically synthesized
tggtatattttgggatttcaaa

SEQ ID NO: 1187733 - DNA, 22 bp, Artificial Sequence
  chemically synthesized
gtatattttgggatttcaaaat

SEQ ID NO: 1187734 - DNA, 22 bp, Artificial Sequence
  chemically synthesized
taccatcaggcatattttgaaa

SEQ ID NO: 1187735 - DNA, 22 bp, Artificial Sequence
  chemically synthesized
ataccatcaggcatattttgaa

SEQ ID NO: 1187736 - DNA, 22 bp, Artificial Sequence
  chemically synthesized
cccttataccatcaggcatatt

SEQ ID NO: 1187737 - DNA, 22 bp, Artificial Sequence
  chemically synthesized
tgggatttcaaaatatgcctga

SEQ ID NO: 1187738 - DNA, 22 bp, Artificial Sequence
  chemically synthesized
gggatttcaaaatatgcctgat

SEQ ID NO: 1187739 - DNA, 22 bp, Artificial Sequence
  chemically synthesized
ggatttcaaaatatgcctgatg

SEQ ID NO: 1187740 - DNA, 22 bp, Artificial Sequence
  chemically synthesized
caaaatatgcctgatggtataa

SEQ ID NO: 1187741 - DNA, 22 bp, Artificial Sequence
  chemically synthesized
aaaatatgcctgatggtataag

SEQ ID NO: 1187742 - DNA, 22 bp, Artificial Sequence
  chemically synthesized
ccccaggactgcccttatacca

SEQ ID NO: 1187743 - DNA, 22 bp, Artificial Sequence
  chemically synthesized
gccccaggactgcccttatacc

SEQ ID NO: 1187744 - DNA, 22 bp, Artificial Sequence
  chemically synthesized
agtaatttgccccaggactgcc

SEQ ID NO: 1187745 - DNA, 22 bp, Artificial Sequence
  chemically synthesized
atggtataagggcagtcctggg

SEQ ID NO: 1187746 - DNA, 22 bp, Artificial Sequence
  chemically synthesized
gtcatcattgagtaatttgccc

SEQ ID NO: 1187747 - DNA, 22 bp, Artificial Sequence
  chemically synthesized
agctagtcatcattgagtaatt

SEQ ID NO: 1187748 - DNA, 22 bp, Artificial Sequence
  chemically synthesized
cgttaagctagtcatcattgag

SEQ ID NO: 1187749 - DNA, 22 bp, Artificial Sequence
  chemically synthesized
gggcaaattactcaatgatgac

SEQ ID NO: 1187750 - DNA, 22 bp, Artificial Sequence
  chemically synthesized
tacaatatctgcgttaagctag

SEQ ID NO: 1187751 - DNA, 22 bp, Artificial Sequence
  chemically synthesized
ctcaatgatgactagcttaacg

SEQ ID NO: 1187752 - DNA, 22 bp, Artificial Sequence
  chemically synthesized
gtacaatatctgcgttaagcta

SEQ ID NO: 1187753 - DNA, 22 bp, Artificial Sequence
  chemically synthesized
tgtacaatatctgcgttaagct

SEQ ID NO: 1187754 - DNA, 22 bp, Artificial Sequence
  chemically synthesized
aatgatgactagcttaacgcag

SEQ ID NO: 1187755 - DNA, 22 bp, Artificial Sequence
  chemically synthesized
atcattttgtacaatatctgcg

SEQ ID NO: 1187756 - DNA, 22 bp, Artificial Sequence
  chemically synthesized
gcttaacgcagatattgtacaa

SEQ ID NO: 1187757 - DNA, 22 bp, Artificial Sequence
  chemically synthesized
aacgcagatattgtacaaaatg

SEQ ID NO: 1187758 - DNA, 22 bp, Artificial Sequence
  chemically synthesized
acgcagatattgtacaaaatga

SEQ ID NO: 1187759 - DNA, 22 bp, Artificial Sequence
  chemically synthesized
aaaaaaaaaaaaacctgatcat

SEQ ID NO: 1187760 - DNA, 22 bp, Artificial Sequence
  chemically synthesized
caaaaaaaaaaaaacctgatca

SEQ ID NO: 1187761 - DNA, 22 bp, Artificial Sequence
  chemically synthesized
tcaaaaaaaaaaaaacctgatc

SEQ ID NO: 1187762 - DNA, 22 bp, Artificial Sequence
  chemically synthesized
ttcaaaaaaaaaaaaacctgat

SEQ ID NO: 1187763 - DNA, 22 bp, Artificial Sequence
  chemically synthesized
tttcaaaaaaaaaaaaacctga

SEQ ID NO: 1187764 - DNA, 22 bp, Artificial Sequence
  chemically synthesized
ttttcaaaaaaaaaaaaacctg

SEQ ID NO: 1187765 - DNA, 22 bp, Artificial Sequence
  chemically synthesized
tacaaaatgatcaggttttttt

SEQ ID NO: 1187766 - DNA, 22 bp, Artificial Sequence
  chemically synthesized
ccatatttttttcaaaaaaaaa

SEQ ID NO: 1187767 - DNA, 22 bp, Artificial Sequence
  chemically synthesized
accatatttttttcaaaaaaaa

SEQ ID NO: 1187768 - DNA, 22 bp, Artificial Sequence
  chemically synthesized
taccatatttttttcaaaaaaa

SEQ ID NO: 1187769 - DNA, 22 bp, Artificial Sequence
  chemically synthesized
ttaccatatttttttcaaaaaa

SEQ ID NO: 1187770 - DNA, 22 bp, Artificial Sequence
  chemically synthesized
ttttttttttgaaaaaaatatg

SEQ ID NO: 1187771 - DNA, 22 bp, Artificial Sequence
  chemically synthesized
tttttttttgaaaaaaatatgg

SEQ ID NO: 1187772 - DNA, 22 bp, Artificial Sequence
  chemically synthesized
ttttttttgaaaaaaatatggt

SEQ ID NO: 1187773 - DNA, 22 bp, Artificial Sequence
  chemically synthesized
tttttttgaaaaaaatatggta

SEQ ID NO: 1187774 - DNA, 22 bp, Artificial Sequence
  chemically synthesized
ttttttgaaaaaaatatggtaa

SEQ ID NO: 1187775 - DNA, 22 bp, Artificial Sequence
  chemically synthesized
tttttgaaaaaaatatggtaaa

SEQ ID NO: 1187776 - DNA, 22 bp, Artificial Sequence
  chemically synthesized
ttttgaaaaaaatatggtaaaa

SEQ ID NO: 1187777 - DNA, 22 bp, Artificial Sequence
  chemically synthesized
tttgaaaaaaatatggtaaaaa

SEQ ID NO: 1187778 - DNA, 22 bp, Artificial Sequence
  chemically synthesized
ttgaaaaaaatatggtaaaaat

SEQ ID NO: 1187779 - DNA, 22 bp, Artificial Sequence
  chemically synthesized
tgaaaaaaatatggtaaaaatg

SEQ ID NO: 1187780 - DNA, 22 bp, Artificial Sequence
  chemically synthesized
gaaaaaaatatggtaaaaatgg

SEQ ID NO: 1187781 - DNA, 22 bp, Artificial Sequence
  chemically synthesized
tatgtagtgggtccatttttac

SEQ ID NO: 1187782 - DNA, 22 bp, Artificial Sequence
  chemically synthesized
aaaaaaatatggtaaaaatgga

SEQ ID NO: 1187783 - DNA, 22 bp, Artificial Sequence
  chemically synthesized
atatgtagtgggtccattttta

SEQ ID NO: 1187784 - DNA, 22 bp, Artificial Sequence
  chemically synthesized
tatatgtagtgggtccattttt

SEQ ID NO: 1187785 - DNA, 22 bp, Artificial Sequence
  chemically synthesized
ttatatgtagtgggtccatttt

SEQ ID NO: 1187786 - DNA, 22 bp, Artificial Sequence
  chemically synthesized
ttttatatgtagtgggtccatt

SEQ ID NO: 1187787 - DNA, 22 bp, Artificial Sequence
  chemically synthesized
agctcttttatatgtagtgggt

SEQ ID NO: 1187788 - DNA, 22 bp, Artificial Sequence
  chemically synthesized
aacaggctaagctcttttatat

SEQ ID NO: 1187789 - DNA, 22 bp, Artificial Sequence
  chemically synthesized
cctcaacaggctaagctctttt

SEQ ID NO: 1187790 - DNA, 22 bp, Artificial Sequence
  chemically synthesized
gcctcaacaggctaagctcttt

SEQ ID NO: 1187791 - DNA, 22 bp, Artificial Sequence
  chemically synthesized
tgcctcaacaggctaagctctt

SEQ ID NO: 1187792 - DNA, 22 bp, Artificial Sequence
  chemically synthesized
ttgcctcaacaggctaagctct

SEQ ID NO: 1187793 - DNA, 22 bp, Artificial Sequence
  chemically synthesized
catataaaagagcttagcctgt

SEQ ID NO: 1187794 - DNA, 22 bp, Artificial Sequence
  chemically synthesized
atcaaggtatttttgcctcaac

SEQ ID NO: 1187795 - DNA, 22 bp, Artificial Sequence
  chemically synthesized
gatcaaggtatttttgcctcaa

SEQ ID NO: 1187796 - DNA, 22 bp, Artificial Sequence
  chemically synthesized
agcctgttgaggcaaaaatacc

SEQ ID NO: 1187797 - DNA, 22 bp, Artificial Sequence
  chemically synthesized
gcctgttgaggcaaaaatacct

SEQ ID NO: 1187798 - DNA, 22 bp, Artificial Sequence
  chemically synthesized
ttgaggcaaaaataccttgatc

SEQ ID NO: 1187799 - DNA, 22 bp, Artificial Sequence
  chemically synthesized
aggcaaaaataccttgatcaaa

SEQ ID NO: 1187800 - DNA, 22 bp, Artificial Sequence
  chemically synthesized
gtgatagggtcaggatttgatc

SEQ ID NO: 1187801 - DNA, 22 bp, Artificial Sequence
  chemically synthesized
ttagtgatagggtcaggatttg

SEQ ID NO: 1187802 - DNA, 22 bp, Artificial Sequence
  chemically synthesized
cctattagtgatagggtcagga

SEQ ID NO: 1187803 - DNA, 22 bp, Artificial Sequence
  chemically synthesized
acctattagtgatagggtcagg

SEQ ID NO: 1187804 - DNA, 22 bp, Artificial Sequence
  chemically synthesized
gatcaaatcctgaccctatcac

SEQ ID NO: 1187805 - DNA, 22 bp, Artificial Sequence
  chemically synthesized
atcaaatcctgaccctatcact

SEQ ID NO: 1187806 - DNA, 22 bp, Artificial Sequence
  chemically synthesized
ccacagtcccttacctattagt

SEQ ID NO: 1187807 - DNA, 22 bp, Artificial Sequence
  chemically synthesized
accacagtcccttacctattag

SEQ ID NO: 1187808 - DNA, 22 bp, Artificial Sequence
  chemically synthesized
taccacagtcccttacctatta

SEQ ID NO: 1187809 - DNA, 22 bp, Artificial Sequence
  chemically synthesized
accctatcactaataggtaagg

SEQ ID NO: 1187810 - DNA, 22 bp, Artificial Sequence
  chemically synthesized
tcactaataggtaagggactgt

SEQ ID NO: 1187811 - DNA, 22 bp, Artificial Sequence
  chemically synthesized
gtgaattttaccacagtccctt

SEQ ID NO: 1187812 - DNA, 22 bp, Artificial Sequence
  chemically synthesized
ataggtaagggactgtggtaaa

SEQ ID NO: 1187813 - DNA, 22 bp, Artificial Sequence
  chemically synthesized
ggacagggaaattagtgaattt

SEQ ID NO: 1187814 - DNA, 22 bp, Artificial Sequence
  chemically synthesized
tggtaaaattcactaatttccc

SEQ ID NO: 1187815 - DNA, 22 bp, Artificial Sequence
  chemically synthesized
tagataaaaactgggacaggga

SEQ ID NO: 1187816 - DNA, 22 bp, Artificial Sequence
  chemically synthesized
atagataaaaactgggacaggg

SEQ ID NO: 1187817 - DNA, 22 bp, Artificial Sequence
  chemically synthesized
tatagataaaaactgggacagg

SEQ ID NO: 1187818 - DNA, 22 bp, Artificial Sequence
  chemically synthesized
actaatttccctgtcccagttt

SEQ ID NO: 1187819 - DNA, 22 bp, Artificial Sequence
  chemically synthesized
attttatagataaaaactggga

SEQ ID NO: 1187820 - DNA, 22 bp, Artificial Sequence
  chemically synthesized
atttccctgtcccagtttttat

SEQ ID NO: 1187821 - DNA, 22 bp, Artificial Sequence
  chemically synthesized
ccctgtcccagtttttatctat

SEQ ID NO: 1187822 - DNA, 22 bp, Artificial Sequence
  chemically synthesized
cctgtcccagtttttatctata

SEQ ID NO: 1187823 - DNA, 22 bp, Artificial Sequence
  chemically synthesized
atatgactcattttatagataa

SEQ ID NO: 1187824 - DNA, 22 bp, Artificial Sequence
  chemically synthesized
tcccagtttttatctataaaat

SEQ ID NO: 1187825 - DNA, 22 bp, Artificial Sequence
  chemically synthesized
caagatactaatatgactcatt

SEQ ID NO: 1187826 - DNA, 22 bp, Artificial Sequence
  chemically synthesized
gcaagatactaatatgactcat

SEQ ID NO: 1187827 - DNA, 22 bp, Artificial Sequence
  chemically synthesized
ttatctataaaatgagtcatat

SEQ ID NO: 1187828 - DNA, 22 bp, Artificial Sequence
  chemically synthesized
tatctataaaatgagtcatatt

SEQ ID NO: 1187829 - DNA, 22 bp, Artificial Sequence
  chemically synthesized
atctataaaatgagtcatatta

SEQ ID NO: 1187830 - DNA, 22 bp, Artificial Sequence
  chemically synthesized
tttgcaagatactaatatgact

SEQ ID NO: 1187831 - DNA, 22 bp, Artificial Sequence
  chemically synthesized
tctataaaatgagtcatattag

SEQ ID NO: 1187832 - DNA, 22 bp, Artificial Sequence
  chemically synthesized
attatttgcaagatactaatat

SEQ ID NO: 1187833 - DNA, 22 bp, Artificial Sequence
  chemically synthesized
taaaatgagtcatattagtatc

SEQ ID NO: 1187834 - DNA, 22 bp, Artificial Sequence
  chemically synthesized
acatcatccctaattatttgca

SEQ ID NO: 1187835 - DNA, 22 bp, Artificial Sequence
  chemically synthesized
ttaacatcatccctaattattt

SEQ ID NO: 1187836 - DNA, 22 bp, Artificial Sequence
  chemically synthesized
tgttaacatcatccctaattat

SEQ ID NO: 1187837 - DNA, 22 bp, Artificial Sequence
  chemically synthesized
gtatcttgcaaataattaggga

SEQ ID NO: 1187838 - DNA, 22 bp, Artificial Sequence
  chemically synthesized
tctgttaacatcatccctaatt

SEQ ID NO: 1187839 - DNA, 22 bp, Artificial Sequence
  chemically synthesized
ctctgttaacatcatccctaat

SEQ ID NO: 1187840 - DNA, 22 bp, Artificial Sequence
  chemically synthesized
tctctgttaacatcatccctaa

SEQ ID NO: 1187841 - DNA, 22 bp, Artificial Sequence
  chemically synthesized
gcaaataattagggatgatgtt

SEQ ID NO: 1187842 - DNA, 22 bp, Artificial Sequence
  chemically synthesized
attttctctgttaacatcatcc

SEQ ID NO: 1187843 - DNA, 22 bp, Artificial Sequence
  chemically synthesized
caaataattagggatgatgtta

SEQ ID NO: 1187844 - DNA, 22 bp, Artificial Sequence
  chemically synthesized
cattcattttctctgttaacat

SEQ ID NO: 1187845 - DNA, 22 bp, Artificial Sequence
  chemically synthesized
gcattcattttctctgttaaca

SEQ ID NO: 1187846 - DNA, 22 bp, Artificial Sequence
  chemically synthesized
tgcattcattttctctgttaac

SEQ ID NO: 1187847 - DNA, 22 bp, Artificial Sequence
  chemically synthesized
ctttgcattcattttctctgtt

SEQ ID NO: 1187848 - DNA, 22 bp, Artificial Sequence
  chemically synthesized
gggatgatgttaacagagaaaa

SEQ ID NO: 1187849 - DNA, 22 bp, Artificial Sequence
  chemically synthesized
actttgcattcattttctctgt

SEQ ID NO: 1187850 - DNA, 22 bp, Artificial Sequence
  chemically synthesized
agcatttactttgcattcattt

SEQ ID NO: 1187851 - DNA, 22 bp, Artificial Sequence
  chemically synthesized
acagagaaaatgaatgcaaagt

SEQ ID NO: 1187852 - DNA, 22 bp, Artificial Sequence
  chemically synthesized
aatatatacgatctattatttt

SEQ ID NO: 1187853 - DNA, 22 bp, Artificial Sequence
  chemically synthesized
gaaggaaatcaggaaaaataat

SEQ ID NO: 1187854 - DNA, 22 bp, Artificial Sequence
  chemically synthesized
tgtgccaattggaaggaaatca

SEQ ID NO: 1187855 - DNA, 22 bp, Artificial Sequence
  chemically synthesized
ttatttttcctgatttccttcc

SEQ ID NO: 1187856 - DNA, 22 bp, Artificial Sequence
  chemically synthesized
tttttcctgatttccttccaat

SEQ ID NO: 1187857 - DNA, 22 bp, Artificial Sequence
  chemically synthesized
caattatgtgccaattggaagg

SEQ ID NO: 1187858 - DNA, 22 bp, Artificial Sequence
  chemically synthesized
ttcctgatttccttccaattgg

SEQ ID NO: 1187859 - DNA, 22 bp, Artificial Sequence
  chemically synthesized
tcctgatttccttccaattggc

SEQ ID NO: 1187860 - DNA, 22 bp, Artificial Sequence
  chemically synthesized
cctgatttccttccaattggca

SEQ ID NO: 1187861 - DNA, 22 bp, Artificial Sequence
  chemically synthesized
ctgatttccttccaattggcac

SEQ ID NO: 1187862 - DNA, 22 bp, Artificial Sequence
  chemically synthesized
tgaattacaattatgtgccaat

SEQ ID NO: 1187863 - DNA, 22 bp, Artificial Sequence
  chemically synthesized
atttccttccaattggcacata

SEQ ID NO: 1187864 - DNA, 22 bp, Artificial Sequence
  chemically synthesized
ccttccaattggcacataattg

SEQ ID NO: 1187865 - DNA, 22 bp, Artificial Sequence
  chemically synthesized
cttccaattggcacataattgt

SEQ ID NO: 1187866 - DNA, 22 bp, Artificial Sequence
  chemically synthesized
ccaattggcacataattgtaat

SEQ ID NO: 1187867 - DNA, 22 bp, Artificial Sequence
  chemically synthesized
caattggcacataattgtaatt

SEQ ID NO: 1187868 - DNA, 22 bp, Artificial Sequence
  chemically synthesized
gcacataattgtaattcatagg

SEQ ID NO: 1187869 - DNA, 22 bp, Artificial Sequence
  chemically synthesized
taattcataggtttgcttgcat

SEQ ID NO: 1187870 - DNA, 22 bp, Artificial Sequence
  chemically synthesized
atgaaggcatgaatgcaagcaa

SEQ ID NO: 1187871 - DNA, 22 bp, Artificial Sequence
  chemically synthesized
aatgaaggcatgaatgcaagca

SEQ ID NO: 1187872 - DNA, 22 bp, Artificial Sequence
  chemically synthesized
ataggtttgcttgcattcatgc

SEQ ID NO: 1187873 - DNA, 22 bp, Artificial Sequence
  chemically synthesized
cacaaatacttaatgaaggcat

SEQ ID NO: 1187874 - DNA, 22 bp, Artificial Sequence
  chemically synthesized
gcttgcattcatgccttcatta

SEQ ID NO: 1187875 - DNA, 22 bp, Artificial Sequence
  chemically synthesized
cttgcattcatgccttcattaa

SEQ ID NO: 1187876 - DNA, 22 bp, Artificial Sequence
  chemically synthesized
gcattcatgccttcattaagta

SEQ ID NO: 1187877 - DNA, 22 bp, Artificial Sequence
  chemically synthesized
cattcatgccttcattaagtat

SEQ ID NO: 1187878 - DNA, 22 bp, Artificial Sequence
  chemically synthesized
atgccttcattaagtatttgtg

SEQ ID NO: 1187879 - DNA, 22 bp, Artificial Sequence
  chemically synthesized
acacatggtaggcattccacaa

SEQ ID NO: 1187880 - DNA, 22 bp, Artificial Sequence
  chemically synthesized
cattaagtatttgtggaatgcc

SEQ ID NO: 1187881 - DNA, 22 bp, Artificial Sequence
  chemically synthesized
attaagtatttgtggaatgcct

SEQ ID NO: 1187882 - DNA, 22 bp, Artificial Sequence
  chemically synthesized
agtatttgtggaatgcctacca

SEQ ID NO: 1187883 - DNA, 22 bp, Artificial Sequence
  chemically synthesized
gtatcatgtctgacacatggta

SEQ ID NO: 1187884 - DNA, 22 bp, Artificial Sequence
  chemically synthesized
gtggaatgcctaccatgtgtca

SEQ ID NO: 1187885 - DNA, 22 bp, Artificial Sequence
  chemically synthesized
tggaatgcctaccatgtgtcag

SEQ ID NO: 1187886 - DNA, 22 bp, Artificial Sequence
  chemically synthesized
gtgaattggtatcatgtctgac

SEQ ID NO: 1187887 - DNA, 22 bp, Artificial Sequence
  chemically synthesized
ggtgaattggtatcatgtctga

SEQ ID NO: 1187888 - DNA, 22 bp, Artificial Sequence
  chemically synthesized
cttggtgaattggtatcatgtc

SEQ ID NO: 1187889 - DNA, 22 bp, Artificial Sequence
  chemically synthesized
ccatgtgtcagacatgatacca

SEQ ID NO: 1187890 - DNA, 22 bp, Artificial Sequence
  chemically synthesized
attgcttggtgaattggtatca

SEQ ID NO: 1187891 - DNA, 22 bp, Artificial Sequence
  chemically synthesized
taaaacgtgattaattgcttgg

SEQ ID NO: 1187892 - DNA, 22 bp, Artificial Sequence
  chemically synthesized
attataaaacgtgattaattgc

SEQ ID NO: 1187893 - DNA, 22 bp, Artificial Sequence
  chemically synthesized
taattataaaacgtgattaatt

SEQ ID NO: 1187894 - DNA, 22 bp, Artificial Sequence
  chemically synthesized
accaagcaattaatcacgtttt

SEQ ID NO: 1187895 - DNA, 22 bp, Artificial Sequence
  chemically synthesized
ggaaatggagccattctaatta

SEQ ID NO: 1187896 - DNA, 22 bp, Artificial Sequence
  chemically synthesized
atcacgttttataattagaatg

SEQ ID NO: 1187897 - DNA, 22 bp, Artificial Sequence
  chemically synthesized
ggaattaggaaatggagccatt

SEQ ID NO: 1187898 - DNA, 22 bp, Artificial Sequence
  chemically synthesized
aggaattaggaaatggagccat

SEQ ID NO: 1187899 - DNA, 22 bp, Artificial Sequence
  chemically synthesized
tataattagaatggctccattt

SEQ ID NO: 1187900 - DNA, 22 bp, Artificial Sequence
  chemically synthesized
ataattagaatggctccatttc

SEQ ID NO: 1187901 - DNA, 22 bp, Artificial Sequence
  chemically synthesized
cttaggaattaggaaatggagc

SEQ ID NO: 1187902 - DNA, 22 bp, Artificial Sequence
  chemically synthesized
taattagaatggctccatttcc

SEQ ID NO: 1187903 - DNA, 22 bp, Artificial Sequence
  chemically synthesized
ccttaggaattaggaaatggag

SEQ ID NO: 1187904 - DNA, 22 bp, Artificial Sequence
  chemically synthesized
ttccttaggaattaggaaatgg

SEQ ID NO: 1187905 - DNA, 22 bp, Artificial Sequence
  chemically synthesized
cttccttaggaattaggaaatg

SEQ ID NO: 1187906 - DNA, 22 bp, Artificial Sequence
  chemically synthesized
gaatggctccatttcctaattc

SEQ ID NO: 1187907 - DNA, 22 bp, Artificial Sequence
  chemically synthesized
gtttcttccttaggaattagga

SEQ ID NO: 1187908 - DNA, 22 bp, Artificial Sequence
  chemically synthesized
catttcctaattcctaaggaag

SEQ ID NO: 1187909 - DNA, 22 bp, Artificial Sequence
  chemically synthesized
cctaattcctaaggaagaaacg

SEQ ID NO: 1187910 - DNA, 22 bp, Artificial Sequence
  chemically synthesized
ctaattcctaaggaagaaacga

SEQ ID NO: 1187911 - DNA, 22 bp, Artificial Sequence
  chemically synthesized
tccaatggtccactcgtttctt

SEQ ID NO: 1187912 - DNA, 22 bp, Artificial Sequence
  chemically synthesized
gtccaatggtccactcgtttct

SEQ ID NO: 1187913 - DNA, 22 bp, Artificial Sequence
  chemically synthesized
attcctaaggaagaaacgagtg

SEQ ID NO: 1187914 - DNA, 22 bp, Artificial Sequence
  chemically synthesized
gtttgtccaatggtccactcgt

SEQ ID NO: 1187915 - DNA, 22 bp, Artificial Sequence
  chemically synthesized
ctaaggaagaaacgagtggacc

SEQ ID NO: 1187916 - DNA, 22 bp, Artificial Sequence
  chemically synthesized
aggaagaaacgagtggaccatt

SEQ ID NO: 1187917 - DNA, 22 bp, Artificial Sequence
  chemically synthesized
tatgccatctggtttgtccaat

SEQ ID NO: 1187918 - DNA, 22 bp, Artificial Sequence
  chemically synthesized
gacaaaccagatggcatacaac

SEQ ID NO: 1187919 - DNA, 22 bp, Artificial Sequence
  chemically synthesized
agagagtcacatcagtgttgta

SEQ ID NO: 1187920 - DNA, 22 bp, Artificial Sequence
  chemically synthesized
tgctgagagagtcacatcagtg

SEQ ID NO: 1187921 - DNA, 22 bp, Artificial Sequence
  chemically synthesized
gtgctgagagagtcacatcagt

SEQ ID NO: 1187922 - DNA, 22 bp, Artificial Sequence
  chemically synthesized
tgtgctgagagagtcacatcag

SEQ ID NO: 1187923 - DNA, 22 bp, Artificial Sequence
  chemically synthesized
atgtgactctctcagcacaaaa

SEQ ID NO: 1187924 - DNA, 22 bp, Artificial Sequence
  chemically synthesized
tctcagcacaaaacatttatgt

SEQ ID NO: 1187925 - DNA, 22 bp, Artificial Sequence
  chemically synthesized
tcagcacaaaacatttatgtgg

SEQ ID NO: 1187926 - DNA, 22 bp, Artificial Sequence
  chemically synthesized
agcacaaaacatttatgtggga

SEQ ID NO: 1187927 - DNA, 22 bp, Artificial Sequence
  chemically synthesized
atgtgggatggtgtcatggtgg

SEQ ID NO: 1187928 - DNA, 22 bp, Artificial Sequence
  chemically synthesized
tgtgggatggtgtcatggtggt

SEQ ID NO: 1187929 - DNA, 22 bp, Artificial Sequence
  chemically synthesized
cgtatgacatatgataccacca

SEQ ID NO: 1187930 - DNA, 22 bp, Artificial Sequence
  chemically synthesized
atgttgcgtatgacatatgata

SEQ ID NO: 1187931 - DNA, 22 bp, Artificial Sequence
  chemically synthesized
tgatgttgcgtatgacatatga

SEQ ID NO: 1187932 - DNA, 22 bp, Artificial Sequence
  chemically synthesized
ttctgatgttgcgtatgacata

SEQ ID NO: 1187933 - DNA, 22 bp, Artificial Sequence
  chemically synthesized
attctgatgttgcgtatgacat

SEQ ID NO: 1187934 - DNA, 22 bp, Artificial Sequence
  chemically synthesized
aaccccttattctgatgttgcg

SEQ ID NO: 1187935 - DNA, 22 bp, Artificial Sequence
  chemically synthesized
aacactgaaccccttattctga

SEQ ID NO: 1187936 - DNA, 22 bp, Artificial Sequence
  chemically synthesized
ctcaacactgaaccccttattc

SEQ ID NO: 1187937 - DNA, 22 bp, Artificial Sequence
  chemically synthesized
gctcaacactgaaccccttatt

SEQ ID NO: 1187938 - DNA, 22 bp, Artificial Sequence
  chemically synthesized
tgctcaacactgaaccccttat

SEQ ID NO: 1187939 - DNA, 22 bp, Artificial Sequence
  chemically synthesized
tgtgtgatggtgttttgctcaa

SEQ ID NO: 1187940 - DNA, 22 bp, Artificial Sequence
  chemically synthesized
gtgtgtgatggtgttttgctca

SEQ ID NO: 1187941 - DNA, 22 bp, Artificial Sequence
  chemically synthesized
aagtttgtgtgtgatggtgttt

SEQ ID NO: 1187942 - DNA, 22 bp, Artificial Sequence
  chemically synthesized
agtgttgagcaaaacaccatca

SEQ ID NO: 1187943 - DNA, 22 bp, Artificial Sequence
  chemically synthesized
ttgaagtttgtgtgtgatggtg

SEQ ID NO: 1187944 - DNA, 22 bp, Artificial Sequence
  chemically synthesized
agcaaaacaccatcacacacaa

SEQ ID NO: 1187945 - DNA, 22 bp, Artificial Sequence
  chemically synthesized
tcagttgttgaagtttgtgtgt

SEQ ID NO: 1187946 - DNA, 22 bp, Artificial Sequence
  chemically synthesized
gtcagttgttgaagtttgtgtg

SEQ ID NO: 1187947 - DNA, 22 bp, Artificial Sequence
  chemically synthesized
tgtcagttgttgaagtttgtgt

SEQ ID NO: 1187948 - DNA, 22 bp, Artificial Sequence
  chemically synthesized
ttttgtcagttgttgaagtttg

SEQ ID NO: 1187949 - DNA, 22 bp, Artificial Sequence
  chemically synthesized
gccatcagttattttgtcagtt

SEQ ID NO: 1187950 - DNA, 22 bp, Artificial Sequence
  chemically synthesized
attcgccatcagttattttgtc

SEQ ID NO: 1187951 - DNA, 22 bp, Artificial Sequence
  chemically synthesized
aattcgccatcagttattttgt

SEQ ID NO: 1187952 - DNA, 22 bp, Artificial Sequence
  chemically synthesized
caacaactgacaaaataactga

SEQ ID NO: 1187953 - DNA, 22 bp, Artificial Sequence
  chemically synthesized
aacaactgacaaaataactgat

SEQ ID NO: 1187954 - DNA, 22 bp, Artificial Sequence
  chemically synthesized
aggaaaacttaattcgccatca

SEQ ID NO: 1187955 - DNA, 22 bp, Artificial Sequence
  chemically synthesized
acaaaataactgatggcgaatt

SEQ ID NO: 1187956 - DNA, 22 bp, Artificial Sequence
  chemically synthesized
gttcaggaaaacttaattcgcc

SEQ ID NO: 1187957 - DNA, 22 bp, Artificial Sequence
  chemically synthesized
gattagttcaggaaaacttaat

SEQ ID NO: 1187958 - DNA, 22 bp, Artificial Sequence
  chemically synthesized
ggattagttcaggaaaacttaa

SEQ ID NO: 1187959 - DNA, 22 bp, Artificial Sequence
  chemically synthesized
tggattagttcaggaaaactta

SEQ ID NO: 1187960 - DNA, 22 bp, Artificial Sequence
  chemically synthesized
atggcgaattaagttttcctga

SEQ ID NO: 1187961 - DNA, 22 bp, Artificial Sequence
  chemically synthesized
aaaactttggattagttcagga

SEQ ID NO: 1187962 - DNA, 22 bp, Artificial Sequence
  chemically synthesized
ctgaaaactttggattagttca

SEQ ID NO: 1187963 - DNA, 22 bp, Artificial Sequence
  chemically synthesized
agttttcctgaactaatccaaa

SEQ ID NO: 1187964 - DNA, 22 bp, Artificial Sequence
  chemically synthesized
gagtactactgaaaactttgga

SEQ ID NO: 1187965 - DNA, 22 bp, Artificial Sequence
  chemically synthesized
tcctgaactaatccaaagtttt

SEQ ID NO: 1187966 - DNA, 22 bp, Artificial Sequence
  chemically synthesized
cctgaactaatccaaagttttc

SEQ ID NO: 1187967 - DNA, 22 bp, Artificial Sequence
  chemically synthesized
ctgaactaatccaaagttttca

SEQ ID NO: 1187968 - DNA, 22 bp, Artificial Sequence
  chemically synthesized
agttagagtactactgaaaact

SEQ ID NO: 1187969 - DNA, 22 bp, Artificial Sequence
  chemically synthesized
aactaatccaaagttttcagta

SEQ ID NO: 1187970 - DNA, 22 bp, Artificial Sequence
  chemically synthesized
cagttagagtactactgaaaac

SEQ ID NO: 1187971 - DNA, 22 bp, Artificial Sequence
  chemically synthesized
tcagttagagtactactgaaaa

SEQ ID NO: 1187972 - DNA, 22 bp, Artificial Sequence
  chemically synthesized
atccaaagttttcagtagtact

SEQ ID NO: 1187973 - DNA, 22 bp, Artificial Sequence
  chemically synthesized
agttttcagttagagtactact

SEQ ID NO: 1187974 - DNA, 22 bp, Artificial Sequence
  chemically synthesized
cagttttcagttagagtactac

SEQ ID NO: 1187975 - DNA, 22 bp, Artificial Sequence
  chemically synthesized
gtttcagttttcagttagagta

SEQ ID NO: 1187976 - DNA, 22 bp, Artificial Sequence
  chemically synthesized
tcagtagtactctaactgaaaa

SEQ ID NO: 1187977 - DNA, 22 bp, Artificial Sequence
  chemically synthesized
cagtagtactctaactgaaaac

SEQ ID NO: 1187978 - DNA, 22 bp, Artificial Sequence
  chemically synthesized
agtagtactctaactgaaaact

SEQ ID NO: 1187979 - DNA, 22 bp, Artificial Sequence
  chemically synthesized
gtccactggtttcagttttcag

SEQ ID NO: 1187980 - DNA, 22 bp, Artificial Sequence
  chemically synthesized
taactgaaaactgaaaccagtg

SEQ ID NO: 1187981 - DNA, 22 bp, Artificial Sequence
  chemically synthesized
actgaaaactgaaaccagtgga

SEQ ID NO: 1187982 - DNA, 22 bp, Artificial Sequence
  chemically synthesized
aaaactgaaaccagtggacgaa

SEQ ID NO: 1187983 - DNA, 22 bp, Artificial Sequence
  chemically synthesized
aaaccagtggacgaacatcacg

SEQ ID NO: 1187984 - DNA, 22 bp, Artificial Sequence
  chemically synthesized
gaaaatacacaaatgcgtgatg

SEQ ID NO: 1187985 - DNA, 22 bp, Artificial Sequence
  chemically synthesized
agaaaatacacaaatgcgtgat

SEQ ID NO: 1187986 - DNA, 22 bp, Artificial Sequence
  chemically synthesized
cagtagtgcttagaaaatacac

SEQ ID NO: 1187987 - DNA, 22 bp, Artificial Sequence
  chemically synthesized
gtgtattttctaagcactactg

SEQ ID NO: 1187988 - DNA, 22 bp, Artificial Sequence
  chemically synthesized
tgtattttctaagcactactgg

SEQ ID NO: 1187989 - DNA, 22 bp, Artificial Sequence
  chemically synthesized
atcagcatgcctccagtagtgc

SEQ ID NO: 1187990 - DNA, 22 bp, Artificial Sequence
  chemically synthesized
catcagcatgcctccagtagtg

SEQ ID NO: 1187991 - DNA, 22 bp, Artificial Sequence
  chemically synthesized
tctaagcactactggaggcatg

SEQ ID NO: 1187992 - DNA, 22 bp, Artificial Sequence
  chemically synthesized
ctaagcactactggaggcatgc

SEQ ID NO: 1187993 - DNA, 22 bp, Artificial Sequence
  chemically synthesized
taagcactactggaggcatgct

SEQ ID NO: 1187994 - DNA, 22 bp, Artificial Sequence
  chemically synthesized
ggtgtgtttcatcagcatgcct

SEQ ID NO: 1187995 - DNA, 22 bp, Artificial Sequence
  chemically synthesized
agcactactggaggcatgctga

SEQ ID NO: 1187996 - DNA, 22 bp, Artificial Sequence
  chemically synthesized
attgggtgtgtttcatcagcat

SEQ ID NO: 1187997 - DNA, 22 bp, Artificial Sequence
  chemically synthesized
gattgggtgtgtttcatcagca

SEQ ID NO: 1187998 - DNA, 22 bp, Artificial Sequence
  chemically synthesized
ttgattgggtgtgtttcatcag

SEQ ID NO: 1187999 - DNA, 22 bp, Artificial Sequence
  chemically synthesized
ctggaggcatgctgatgaaaca

SEQ ID NO: 1188000 - DNA, 22 bp, Artificial Sequence
  chemically synthesized
cttgattgggtgtgtttcatca

SEQ ID NO: 1188001 - DNA, 22 bp, Artificial Sequence
  chemically synthesized
gaggcatgctgatgaaacacac

SEQ ID NO: 1188002 - DNA, 22 bp, Artificial Sequence
  chemically synthesized
cttcttgattgggtgtgtttca

SEQ ID NO: 1188003 - DNA, 22 bp, Artificial Sequence
  chemically synthesized
ctacttcttgattgggtgtgtt

SEQ ID NO: 1188004 - DNA, 22 bp, Artificial Sequence
  chemically synthesized
gctacttcttgattgggtgtgt

SEQ ID NO: 1188005 - DNA, 22 bp, Artificial Sequence
  chemically synthesized
aagtttgctacttcttgattgg

SEQ ID NO: 1188006 - DNA, 22 bp, Artificial Sequence
  chemically synthesized
atgaaacacacccaatcaagaa

SEQ ID NO: 1188007 - DNA, 22 bp, Artificial Sequence
  chemically synthesized
aaaatgggttaaagtttgctac

SEQ ID NO: 1188008 - DNA, 22 bp, Artificial Sequence
  chemically synthesized
gaaaatgggttaaagtttgcta

SEQ ID NO: 1188009 - DNA, 22 bp, Artificial Sequence
  chemically synthesized
taatttgaaaatgggttaaagt

SEQ ID NO: 1188010 - DNA, 22 bp, Artificial Sequence
  chemically synthesized
gtaatttgaaaatgggttaaag

SEQ ID NO: 1188011 - DNA, 22 bp, Artificial Sequence
  chemically synthesized
tgtaatttgaaaatgggttaaa

SEQ ID NO: 1188012 - DNA, 22 bp, Artificial Sequence
  chemically synthesized
taacccattttcaaattacaaa

SEQ ID NO: 1188013 - DNA, 22 bp, Artificial Sequence
  chemically synthesized
aacccattttcaaattacaaag

SEQ ID NO: 1188014 - DNA, 22 bp, Artificial Sequence
  chemically synthesized
acccattttcaaattacaaaga

SEQ ID NO: 1188015 - DNA, 22 bp, Artificial Sequence
  chemically synthesized
tcaaaaggaaaatgtatctttg

SEQ ID NO: 1188016 - DNA, 22 bp, Artificial Sequence
  chemically synthesized
tcaaattacaaagatacatttt

SEQ ID NO: 1188017 - DNA, 22 bp, Artificial Sequence
  chemically synthesized
caaattacaaagatacattttc

SEQ ID NO: 1188018 - DNA, 22 bp, Artificial Sequence
  chemically synthesized
aaattacaaagatacattttcc

SEQ ID NO: 1188019 - DNA, 22 bp, Artificial Sequence
  chemically synthesized
ataagtactgtcaaaaggaaaa

SEQ ID NO: 1188020 - DNA, 22 bp, Artificial Sequence
  chemically synthesized
cataagtactgtcaaaaggaaa

SEQ ID NO: 1188021 - DNA, 22 bp, Artificial Sequence
  chemically synthesized
caaagatacattttccttttga

SEQ ID NO: 1188022 - DNA, 22 bp, Artificial Sequence
  chemically synthesized
aaatgaaatttcataagtactg

SEQ ID NO: 1188023 - DNA, 22 bp, Artificial Sequence
  chemically synthesized
tccttttgacagtacttatgaa

SEQ ID NO: 1188024 - DNA, 22 bp, Artificial Sequence
  chemically synthesized
ccttttgacagtacttatgaaa

SEQ ID NO: 1188025 - DNA, 22 bp, Artificial Sequence
  chemically synthesized
cttttgacagtacttatgaaat

SEQ ID NO: 1188026 - DNA, 22 bp, Artificial Sequence
  chemically synthesized
caaactcaaatgaaatttcata

SEQ ID NO: 1188027 - DNA, 22 bp, Artificial Sequence
  chemically synthesized
ttgacagtacttatgaaatttc

SEQ ID NO: 1188028 - DNA, 22 bp, Artificial Sequence
  chemically synthesized
tgacagtacttatgaaatttca

SEQ ID NO: 1188029 - DNA, 22 bp, Artificial Sequence
  chemically synthesized
gacagtacttatgaaatttcat

SEQ ID NO: 1188030 - DNA, 22 bp, Artificial Sequence
  chemically synthesized
acagtacttatgaaatttcatt

SEQ ID NO: 1188031 - DNA, 22 bp, Artificial Sequence
  chemically synthesized
atgaaatttcatttgagtttgg

SEQ ID NO: 1188032 - DNA, 22 bp, Artificial Sequence
  chemically synthesized
tgaaatttcatttgagtttgga

SEQ ID NO: 1188033 - DNA, 22 bp, Artificial Sequence
  chemically synthesized
catttgagtttggagtttctgg

SEQ ID NO: 1188034 - DNA, 22 bp, Artificial Sequence
  chemically synthesized
caatggtggaagccagaaactc

SEQ ID NO: 1188035 - DNA, 22 bp, Artificial Sequence
  chemically synthesized
atttgagtttggagtttctggc

SEQ ID NO: 1188036 - DNA, 22 bp, Artificial Sequence
  chemically synthesized
attacaatggtggaagccagaa

SEQ ID NO: 1188037 - DNA, 22 bp, Artificial Sequence
  chemically synthesized
gagtttggagtttctggcttcc

SEQ ID NO: 1188038 - DNA, 22 bp, Artificial Sequence
  chemically synthesized
agtttggagtttctggcttcca

SEQ ID NO: 1188039 - DNA, 22 bp, Artificial Sequence
  chemically synthesized
ggagtttctggcttccaccatt

SEQ ID NO: 1188040 - DNA, 22 bp, Artificial Sequence
  chemically synthesized
gagtttctggcttccaccattg

SEQ ID NO: 1188041 - DNA, 22 bp, Artificial Sequence
  chemically synthesized
ggaggtcctaattacaatggtg

SEQ ID NO: 1188042 - DNA, 22 bp, Artificial Sequence
  chemically synthesized
ctggcttccaccattgtaatta

SEQ ID NO: 1188043 - DNA, 22 bp, Artificial Sequence
  chemically synthesized
tggcttccaccattgtaattag

SEQ ID NO: 1188044 - DNA, 22 bp, Artificial Sequence
  chemically synthesized
tagttgggaggtcctaattaca

SEQ ID NO: 1188045 - DNA, 22 bp, Artificial Sequence
  chemically synthesized
gcttccaccattgtaattagga

SEQ ID NO: 1188046 - DNA, 22 bp, Artificial Sequence
  chemically synthesized
gtagttgggaggtcctaattac

SEQ ID NO: 1188047 - DNA, 22 bp, Artificial Sequence
  chemically synthesized
ccaccattgtaattaggacctc

SEQ ID NO: 1188048 - DNA, 22 bp, Artificial Sequence
  chemically synthesized
caccattgtaattaggacctcc

SEQ ID NO: 1188049 - DNA, 22 bp, Artificial Sequence
  chemically synthesized
tatttgtagttgggaggtccta

SEQ ID NO: 1188050 - DNA, 22 bp, Artificial Sequence
  chemically synthesized
ttgtatttgtagttgggaggtc

SEQ ID NO: 1188051 - DNA, 22 bp, Artificial Sequence
  chemically synthesized
taattaggacctcccaactaca

SEQ ID NO: 1188052 - DNA, 22 bp, Artificial Sequence
  chemically synthesized
ggacctcccaactacaaataca

SEQ ID NO: 1188053 - DNA, 22 bp, Artificial Sequence
  chemically synthesized
acatccatggatattattgtat

SEQ ID NO: 1188054 - DNA, 22 bp, Artificial Sequence
  chemically synthesized
gacatccatggatattattgta

SEQ ID NO: 1188055 - DNA, 22 bp, Artificial Sequence
  chemically synthesized
ccaactacaaatacaataatat

SEQ ID NO: 1188056 - DNA, 22 bp, Artificial Sequence
  chemically synthesized
cttgacatccatggatattatt

SEQ ID NO: 1188057 - DNA, 22 bp, Artificial Sequence
  chemically synthesized
caaatacaataatatccatgga

SEQ ID NO: 1188058 - DNA, 22 bp, Artificial Sequence
  chemically synthesized
gaaattacttgacatccatgga

SEQ ID NO: 1188059 - DNA, 22 bp, Artificial Sequence
  chemically synthesized
acattggaaattacttgacatc

SEQ ID NO: 1188060 - DNA, 22 bp, Artificial Sequence
  chemically synthesized
cacattggaaattacttgacat

SEQ ID NO: 1188061 - DNA, 22 bp, Artificial Sequence
  chemically synthesized
tcacattggaaattacttgaca

SEQ ID NO: 1188062 - DNA, 22 bp, Artificial Sequence
  chemically synthesized
ttcacattggaaattacttgac

SEQ ID NO: 1188063 - DNA, 22 bp, Artificial Sequence
  chemically synthesized
tttcacattggaaattacttga

SEQ ID NO: 1188064 - DNA, 22 bp, Artificial Sequence
  chemically synthesized
ttttcacattggaaattacttg

SEQ ID NO: 1188065 - DNA, 22 bp, Artificial Sequence
  chemically synthesized
catttttttcacattggaaatt

SEQ ID NO: 1188066 - DNA, 22 bp, Artificial Sequence
  chemically synthesized
aattgcatttttttcacattgg

SEQ ID NO: 1188067 - DNA, 22 bp, Artificial Sequence
  chemically synthesized
taaattgcatttttttcacatt

SEQ ID NO: 1188068 - DNA, 22 bp, Artificial Sequence
  chemically synthesized
ctaaattgcatttttttcacat

SEQ ID NO: 1188069 - DNA, 22 bp, Artificial Sequence
  chemically synthesized
taaatttctaaattgcattttt

SEQ ID NO: 1188070 - DNA, 22 bp, Artificial Sequence
  chemically synthesized
ccaatgtgaaaaaaatgcaatt

SEQ ID NO: 1188071 - DNA, 22 bp, Artificial Sequence
  chemically synthesized
tgtaaatttctaaattgcattt

SEQ ID NO: 1188072 - DNA, 22 bp, Artificial Sequence
  chemically synthesized
caatgtgaaaaaaatgcaattt

SEQ ID NO: 1188073 - DNA, 22 bp, Artificial Sequence
  chemically synthesized
ctgtaaatttctaaattgcatt

SEQ ID NO: 1188074 - DNA, 22 bp, Artificial Sequence
  chemically synthesized
acttctgtaaatttctaaattg

SEQ ID NO: 1188075 - DNA, 22 bp, Artificial Sequence
  chemically synthesized
cacttctgtaaatttctaaatt

SEQ ID NO: 1188076 - DNA, 22 bp, Artificial Sequence
  chemically synthesized
tcttcacttctgtaaatttcta

SEQ ID NO: 1188077 - DNA, 22 bp, Artificial Sequence
  chemically synthesized
attatcttcacttctgtaaatt

SEQ ID NO: 1188078 - DNA, 22 bp, Artificial Sequence
  chemically synthesized
gattatcttcacttctgtaaat

SEQ ID NO: 1188079 - DNA, 22 bp, Artificial Sequence
  chemically synthesized
acatttgattatcttcacttct

SEQ ID NO: 1188080 - DNA, 22 bp, Artificial Sequence
  chemically synthesized
cacatttgattatcttcacttc

SEQ ID NO: 1188081 - DNA, 22 bp, Artificial Sequence
  chemically synthesized
agaaatttacagaagtgaagat

SEQ ID NO: 1188082 - DNA, 22 bp, Artificial Sequence
  chemically synthesized
gaaatttacagaagtgaagata

SEQ ID NO: 1188083 - DNA, 22 bp, Artificial Sequence
  chemically synthesized
acagaagtgaagataatcaaat

SEQ ID NO: 1188084 - DNA, 22 bp, Artificial Sequence
  chemically synthesized
cagaagtgaagataatcaaatg

SEQ ID NO: 1188085 - DNA, 22 bp, Artificial Sequence
  chemically synthesized
catcaatgcttcacatttgatt

SEQ ID NO: 1188086 - DNA, 22 bp, Artificial Sequence
  chemically synthesized
tccatcaatgcttcacatttga

SEQ ID NO: 1188087 - DNA, 22 bp, Artificial Sequence
  chemically synthesized
ctccatcaatgcttcacatttg

SEQ ID NO: 1188088 - DNA, 22 bp, Artificial Sequence
  chemically synthesized
tctccatcaatgcttcacattt

SEQ ID NO: 1188089 - DNA, 22 bp, Artificial Sequence
  chemically synthesized
tacctttctccatcaatgcttc

SEQ ID NO: 1188090 - DNA, 22 bp, Artificial Sequence
  chemically synthesized
gtacctttctccatcaatgctt

SEQ ID NO: 1188091 - DNA, 22 bp, Artificial Sequence
  chemically synthesized
acttgtacctttctccatcaat

SEQ ID NO: 1188092 - DNA, 22 bp, Artificial Sequence
  chemically synthesized
cacttgtacctttctccatcaa

SEQ ID NO: 1188093 - DNA, 22 bp, Artificial Sequence
  chemically synthesized
tcacttgtacctttctccatca

SEQ ID NO: 1188094 - DNA, 22 bp, Artificial Sequence
  chemically synthesized
ttcacttgtacctttctccatc

SEQ ID NO: 1188095 - DNA, 22 bp, Artificial Sequence
  chemically synthesized
tttcacttgtacctttctccat

SEQ ID NO: 1188096 - DNA, 22 bp, Artificial Sequence
  chemically synthesized
tttttcacttgtacctttctcc

SEQ ID NO: 1188097 - DNA, 22 bp, Artificial Sequence
  chemically synthesized
tctttttcacttgtacctttct

SEQ ID NO: 1188098 - DNA, 22 bp, Artificial Sequence
  chemically synthesized
ctctctttttcacttgtacctt

SEQ ID NO: 1188099 - DNA, 22 bp, Artificial Sequence
  chemically synthesized
actctctttttcacttgtacct

SEQ ID NO: 1188100 - DNA, 22 bp, Artificial Sequence
  chemically synthesized
atggagaaaggtacaagtgaaa

SEQ ID NO: 1188101 - DNA, 22 bp, Artificial Sequence
  chemically synthesized
gatgcttactctctttttcact

SEQ ID NO: 1188102 - DNA, 22 bp, Artificial Sequence
  chemically synthesized
ggatgcttactctctttttcac

SEQ ID NO: 1188103 - DNA, 22 bp, Artificial Sequence
  chemically synthesized
tggatgcttactctctttttca

SEQ ID NO: 1188104 - DNA, 22 bp, Artificial Sequence
  chemically synthesized
catggttttggatgcttactct

SEQ ID NO: 1188105 - DNA, 22 bp, Artificial Sequence
  chemically synthesized
tgttacatggttttggatgctt

SEQ ID NO: 1188106 - DNA, 22 bp, Artificial Sequence
  chemically synthesized
gtgttacatggttttggatgct

SEQ ID NO: 1188107 - DNA, 22 bp, Artificial Sequence
  chemically synthesized
tcatcatcatatttgtgttaca

SEQ ID NO: 1188108 - DNA, 22 bp, Artificial Sequence
  chemically synthesized
atcatcatcatatttgtgttac

SEQ ID NO: 1188109 - DNA, 22 bp, Artificial Sequence
  chemically synthesized
tcccttatcatcatcatatttg

SEQ ID NO: 1188110 - DNA, 22 bp, Artificial Sequence
  chemically synthesized
taaagttatcccttatcatcat

SEQ ID NO: 1188111 - DNA, 22 bp, Artificial Sequence
  chemically synthesized
ataaagttatcccttatcatca

SEQ ID NO: 1188112 - DNA, 22 bp, Artificial Sequence
  chemically synthesized
tataaagttatcccttatcatc

SEQ ID NO: 1188113 - DNA, 22 bp, Artificial Sequence
  chemically synthesized
ttataaagttatcccttatcat

SEQ ID NO: 1188114 - DNA, 22 bp, Artificial Sequence
  chemically synthesized
ttttataaagttatcccttatc

SEQ ID NO: 1188115 - DNA, 22 bp, Artificial Sequence
  chemically synthesized
tcttttataaagttatccctta

SEQ ID NO: 1188116 - DNA, 22 bp, Artificial Sequence
  chemically synthesized
cattctcttttataaagttatc

SEQ ID NO: 1188117 - DNA, 22 bp, Artificial Sequence
  chemically synthesized
ttacattctcttttataaagtt

SEQ ID NO: 1188118 - DNA, 22 bp, Artificial Sequence
  chemically synthesized
attacattctcttttataaagt

SEQ ID NO: 1188119 - DNA, 22 bp, Artificial Sequence
  chemically synthesized
acatcatttattacattctctt

SEQ ID NO: 1188120 - DNA, 22 bp, Artificial Sequence
  chemically synthesized
aacatcatttattacattctct

SEQ ID NO: 1188121 - DNA, 22 bp, Artificial Sequence
  chemically synthesized
ttaacatcatttattacattct

SEQ ID NO: 1188122 - DNA, 22 bp, Artificial Sequence
  chemically synthesized
tataaaagagaatgtaataaat

SEQ ID NO: 1188123 - DNA, 22 bp, Artificial Sequence
  chemically synthesized
ataaaagagaatgtaataaatg

SEQ ID NO: 1188124 - DNA, 22 bp, Artificial Sequence
  chemically synthesized
taaaagagaatgtaataaatga

SEQ ID NO: 1188125 - DNA, 22 bp, Artificial Sequence
  chemically synthesized
cgcattcttaacatcatttatt

SEQ ID NO: 1188126 - DNA, 22 bp, Artificial Sequence
  chemically synthesized
acgcattcttaacatcatttat

SEQ ID NO: 1188127 - DNA, 22 bp, Artificial Sequence
  chemically synthesized
tacgcattcttaacatcattta

SEQ ID NO: 1188128 - DNA, 22 bp, Artificial Sequence
  chemically synthesized
tgttttacgcattcttaacatc

SEQ ID NO: 1188129 - DNA, 22 bp, Artificial Sequence
  chemically synthesized
agctatgttttacgcattctta

SEQ ID NO: 1188130 - DNA, 22 bp, Artificial Sequence
  chemically synthesized
agaatgcgtaaaacatagctga

SEQ ID NO: 1188131 - DNA, 22 bp, Artificial Sequence
  chemically synthesized
atgaaaatcaatctcagctatg

SEQ ID NO: 1188132 - DNA, 22 bp, Artificial Sequence
  chemically synthesized
aatgaaaatcaatctcagctat

SEQ ID NO: 1188133 - DNA, 22 bp, Artificial Sequence
  chemically synthesized
taatgaaaatcaatctcagcta

SEQ ID NO: 1188134 - DNA, 22 bp, Artificial Sequence
  chemically synthesized
gtatatacattttaatgaaaat

SEQ ID NO: 1188135 - DNA, 22 bp, Artificial Sequence
  chemically synthesized
agtatatacattttaatgaaaa

SEQ ID NO: 1188136 - DNA, 22 bp, Artificial Sequence
  chemically synthesized
tagtatatacattttaatgaaa

SEQ ID NO: 1188137 - DNA, 22 bp, Artificial Sequence
  chemically synthesized
agattgattttcattaaaatgt

SEQ ID NO: 1188138 - DNA, 22 bp, Artificial Sequence
  chemically synthesized
attttcattaaaatgtatatac

SEQ ID NO: 1188139 - DNA, 22 bp, Artificial Sequence
  chemically synthesized
aaaaaatatactttagtatata

SEQ ID NO: 1188140 - DNA, 22 bp, Artificial Sequence
  chemically synthesized
tcattaaaatgtatatactaaa

SEQ ID NO: 1188141 - DNA, 22 bp, Artificial Sequence
  chemically synthesized
cattaaaatgtatatactaaag

SEQ ID NO: 1188142 - DNA, 22 bp, Artificial Sequence
  chemically synthesized
attaaaatgtatatactaaagt

SEQ ID NO: 1188143 - DNA, 22 bp, Artificial Sequence
  chemically synthesized
ttcaaaaaatatactttagtat

SEQ ID NO: 1188144 - DNA, 22 bp, Artificial Sequence
  chemically synthesized
aaatgtatatactaaagtatat

SEQ ID NO: 1188145 - DNA, 22 bp, Artificial Sequence
  chemically synthesized
actattcaaaaaatatacttta

SEQ ID NO: 1188146 - DNA, 22 bp, Artificial Sequence
  chemically synthesized
ttcactattcaaaaaatatact

SEQ ID NO: 1188147 - DNA, 22 bp, Artificial Sequence
  chemically synthesized
tattcactattcaaaaaatata

SEQ ID NO: 1188148 - DNA, 22 bp, Artificial Sequence
  chemically synthesized
aagtatattttttgaatagtga

SEQ ID NO: 1188149 - DNA, 22 bp, Artificial Sequence
  chemically synthesized
acacatacatcaaattctattc

SEQ ID NO: 1188150 - DNA, 22 bp, Artificial Sequence
  chemically synthesized
aacacatacatcaaattctatt

SEQ ID NO: 1188151 - DNA, 22 bp, Artificial Sequence
  chemically synthesized
tttgaatagtgaatagaatttg

SEQ ID NO: 1188152 - DNA, 22 bp, Artificial Sequence
  chemically synthesized
taacacatacatcaaattctat

SEQ ID NO: 1188153 - DNA, 22 bp, Artificial Sequence
  chemically synthesized
ttgaatagtgaatagaatttga

SEQ ID NO: 1188154 - DNA, 22 bp, Artificial Sequence
  chemically synthesized
ttaacacatacatcaaattcta

SEQ ID NO: 1188155 - DNA, 22 bp, Artificial Sequence
  chemically synthesized
tgaatagtgaatagaatttgat

SEQ ID NO: 1188156 - DNA, 22 bp, Artificial Sequence
  chemically synthesized
gaatagtgaatagaatttgatg

SEQ ID NO: 1188157 - DNA, 22 bp, Artificial Sequence
  chemically synthesized
aatagtgaatagaatttgatgt

SEQ ID NO: 1188158 - DNA, 22 bp, Artificial Sequence
  chemically synthesized
gatgtatgtgttaaaagacact

SEQ ID NO: 1188159 - DNA, 22 bp, Artificial Sequence
  chemically synthesized
atgtatgtgttaaaagacactg

SEQ ID NO: 1188160 - DNA, 22 bp, Artificial Sequence
  chemically synthesized
caggcatggaaggcagtgtctt

SEQ ID NO: 1188161 - DNA, 22 bp, Artificial Sequence
  chemically synthesized
acaggcatggaaggcagtgtct

SEQ ID NO: 1188162 - DNA, 22 bp, Artificial Sequence
  chemically synthesized
tacaggcatggaaggcagtgtc

SEQ ID NO: 1188163 - DNA, 22 bp, Artificial Sequence
  chemically synthesized
tactttacaggcatggaaggca

SEQ ID NO: 1188164 - DNA, 22 bp, Artificial Sequence
  chemically synthesized
aaagacactgccttccatgcct

SEQ ID NO: 1188165 - DNA, 22 bp, Artificial Sequence
  chemically synthesized
ggtcatgctgtactttacaggc

SEQ ID NO: 1188166 - DNA, 22 bp, Artificial Sequence
  chemically synthesized
ccttccatgcctgtaaagtaca

SEQ ID NO: 1188167 - DNA, 22 bp, Artificial Sequence
  chemically synthesized
ccatgcctgtaaagtacagcat

SEQ ID NO: 1188168 - DNA, 22 bp, Artificial Sequence
  chemically synthesized
catgcctgtaaagtacagcatg

SEQ ID NO: 1188169 - DNA, 22 bp, Artificial Sequence
  chemically synthesized
agtgtgaaggattgggtcatgc

SEQ ID NO: 1188170 - DNA, 22 bp, Artificial Sequence
  chemically synthesized
taaagtacagcatgacccaatc

SEQ ID NO: 1188171 - DNA, 22 bp, Artificial Sequence
  chemically synthesized
gctaagtgtgaaggattgggtc

SEQ ID NO: 1188172 - DNA, 22 bp, Artificial Sequence
  chemically synthesized
agctaagtgtgaaggattgggt

SEQ ID NO: 1188173 - DNA, 22 bp, Artificial Sequence
  chemically synthesized
tagctaagtgtgaaggattggg

SEQ ID NO: 1188174 - DNA, 22 bp, Artificial Sequence
  chemically synthesized
ttagctaagtgtgaaggattgg

SEQ ID NO: 1188175 - DNA, 22 bp, Artificial Sequence
  chemically synthesized
gagtgcttttagctaagtgtga

SEQ ID NO: 1188176 - DNA, 22 bp, Artificial Sequence
  chemically synthesized
cacacttagctaaaagcactct

SEQ ID NO: 1188177 - DNA, 22 bp, Artificial Sequence
  chemically synthesized
acacttagctaaaagcactcta

SEQ ID NO: 1188178 - DNA, 22 bp, Artificial Sequence
  chemically synthesized
agctaaaagcactctaatgtca

SEQ ID NO: 1188179 - DNA, 22 bp, Artificial Sequence
  chemically synthesized
gctaaaagcactctaatgtcat

SEQ ID NO: 1188180 - DNA, 22 bp, Artificial Sequence
  chemically synthesized
aaagcactctaatgtcatccct

SEQ ID NO: 1188181 - DNA, 22 bp, Artificial Sequence
  chemically synthesized
taatgtcatccctctttctctt

SEQ ID NO: 1188182 - DNA, 22 bp, Artificial Sequence
  chemically synthesized
atgtcatccctctttctctttc

SEQ ID NO: 1188183 - DNA, 22 bp, Artificial Sequence
  chemically synthesized
tttctctttcacacattggtct

SEQ ID NO: 1188184 - DNA, 22 bp, Artificial Sequence
  chemically synthesized
tctctttcacacattggtcttg

SEQ ID NO: 1188185 - DNA, 22 bp, Artificial Sequence
  chemically synthesized
ctctttcacacattggtcttgt

SEQ ID NO: 1188186 - DNA, 22 bp, Artificial Sequence
  chemically synthesized
tctttcacacattggtcttgtt

SEQ ID NO: 1188187 - DNA, 22 bp, Artificial Sequence
  chemically synthesized
tttcacacattggtcttgtttt

SEQ ID NO: 1188188 - DNA, 22 bp, Artificial Sequence
  chemically synthesized
agatgcaaaaacaaaacaagac

SEQ ID NO: 1188189 - DNA, 22 bp, Artificial Sequence
  chemically synthesized
gagatgcaaaaacaaaacaaga

SEQ ID NO: 1188190 - DNA, 22 bp, Artificial Sequence
  chemically synthesized
tcacacattggtcttgttttgt

SEQ ID NO: 1188191 - DNA, 22 bp, Artificial Sequence
  chemically synthesized
cacacattggtcttgttttgtt

SEQ ID NO: 1188192 - DNA, 22 bp, Artificial Sequence
  chemically synthesized
acacattggtcttgttttgttt

SEQ ID NO: 1188193 - DNA, 22 bp, Artificial Sequence
  chemically synthesized
ggtatttgagatgcaaaaacaa

SEQ ID NO: 1188194 - DNA, 22 bp, Artificial Sequence
  chemically synthesized
cggtatttgagatgcaaaaaca

SEQ ID NO: 1188195 - DNA, 22 bp, Artificial Sequence
  chemically synthesized
gtcttgttttgtttttgcatct

SEQ ID NO: 1188196 - DNA, 22 bp, Artificial Sequence
  chemically synthesized
gttttgtttttgcatctcaaat

SEQ ID NO: 1188197 - DNA, 22 bp, Artificial Sequence
  chemically synthesized
ttttgtttttgcatctcaaata

SEQ ID NO: 1188198 - DNA, 22 bp, Artificial Sequence
  chemically synthesized
tgtttttgcatctcaaataccg

SEQ ID NO: 1188199 - DNA, 22 bp, Artificial Sequence
  chemically synthesized
gtttttgcatctcaaataccga

SEQ ID NO: 1188200 - DNA, 22 bp, Artificial Sequence
  chemically synthesized
tttttgcatctcaaataccgaa

SEQ ID NO: 1188201 - DNA, 22 bp, Artificial Sequence
  chemically synthesized
ttgcatctcaaataccgaaggc

SEQ ID NO: 1188202 - DNA, 22 bp, Artificial Sequence
  chemically synthesized
tgcatctcaaataccgaaggcc

SEQ ID NO: 1188203 - DNA, 22 bp, Artificial Sequence
  chemically synthesized
gcatctcaaataccgaaggcca

SEQ ID NO: 1188204 - DNA, 22 bp, Artificial Sequence
  chemically synthesized
catctcaaataccgaaggccat

SEQ ID NO: 1188205 - DNA, 22 bp, Artificial Sequence
  chemically synthesized
aaataccgaaggccattttaca

SEQ ID NO: 1188206 - DNA, 22 bp, Artificial Sequence
  chemically synthesized
tacacctcttgatcttcatatt

SEQ ID NO: 1188207 - DNA, 22 bp, Artificial Sequence
  chemically synthesized
acacctcttgatcttcatattt

SEQ ID NO: 1188208 - DNA, 22 bp, Artificial Sequence
  chemically synthesized
cacctcttgatcttcatatttg

SEQ ID NO: 1188209 - DNA, 22 bp, Artificial Sequence
  chemically synthesized
ggtaaaagagcaccaaatatga

SEQ ID NO: 1188210 - DNA, 22 bp, Artificial Sequence
  chemically synthesized
aggtaaaagagcaccaaatatg

SEQ ID NO: 1188211 - DNA, 22 bp, Artificial Sequence
  chemically synthesized
taggtaaaagagcaccaaatat

SEQ ID NO: 1188212 - DNA, 22 bp, Artificial Sequence
  chemically synthesized
ttgatcttcatatttggtgctc

SEQ ID NO: 1188213 - DNA, 22 bp, Artificial Sequence
  chemically synthesized
ttttaggtaaaagagcaccaaa

SEQ ID NO: 1188214 - DNA, 22 bp, Artificial Sequence
  chemically synthesized
gatcttcatatttggtgctctt

SEQ ID NO: 1188215 - DNA, 22 bp, Artificial Sequence
  chemically synthesized
atcttcatatttggtgctcttt

SEQ ID NO: 1188216 - DNA, 22 bp, Artificial Sequence
  chemically synthesized
catatttggtgctcttttacct

SEQ ID NO: 1188217 - DNA, 22 bp, Artificial Sequence
  chemically synthesized
atatttggtgctcttttaccta

SEQ ID NO: 1188218 - DNA, 22 bp, Artificial Sequence
  chemically synthesized
ggtgctcttttacctaaaataa

SEQ ID NO: 1188219 - DNA, 22 bp, Artificial Sequence
  chemically synthesized
gtgctcttttacctaaaataat

SEQ ID NO: 1188220 - DNA, 22 bp, Artificial Sequence
  chemically synthesized
ttttacctaaaataatttctct

SEQ ID NO: 1188221 - DNA, 22 bp, Artificial Sequence
  chemically synthesized
ttacctaaaataatttctcttt

SEQ ID NO: 1188222 - DNA, 22 bp, Artificial Sequence
  chemically synthesized
tacctaaaataatttctctttt

SEQ ID NO: 1188223 - DNA, 22 bp, Artificial Sequence
  chemically synthesized
acctaaaataatttctcttttt

SEQ ID NO: 1188224 - DNA, 22 bp, Artificial Sequence
  chemically synthesized
cctaaaataatttctctttttg

SEQ ID NO: 1188225 - DNA, 22 bp, Artificial Sequence
  chemically synthesized
aaataatttctctttttgcatt

SEQ ID NO: 1188226 - DNA, 22 bp, Artificial Sequence
  chemically synthesized
atgggtgagaatgaatcaaaaa

SEQ ID NO: 1188227 - DNA, 22 bp, Artificial Sequence
  chemically synthesized
ctctttttgcatttttgattca

SEQ ID NO: 1188228 - DNA, 22 bp, Artificial Sequence
  chemically synthesized
tctttttgcatttttgattcat

SEQ ID NO: 1188229 - DNA, 22 bp, Artificial Sequence
  chemically synthesized
tttttgcatttttgattcattc

SEQ ID NO: 1188230 - DNA, 22 bp, Artificial Sequence
  chemically synthesized
tttgcatttttgattcattctc

SEQ ID NO: 1188231 - DNA, 22 bp, Artificial Sequence
  chemically synthesized
ttgcatttttgattcattctca

SEQ ID NO: 1188232 - DNA, 22 bp, Artificial Sequence
  chemically synthesized
agacctaatgggtgagaatgaa

SEQ ID NO: 1188233 - DNA, 22 bp, Artificial Sequence
  chemically synthesized
tgcatttttgattcattctcac

SEQ ID NO: 1188234 - DNA, 22 bp, Artificial Sequence
  chemically synthesized
gcatttttgattcattctcacc

SEQ ID NO: 1188235 - DNA, 22 bp, Artificial Sequence
  chemically synthesized
catttttgattcattctcaccc

SEQ ID NO: 1188236 - DNA, 22 bp, Artificial Sequence
  chemically synthesized
ttgattcattctcacccattag

SEQ ID NO: 1188237 - DNA, 22 bp, Artificial Sequence
  chemically synthesized
tgattcattctcacccattagg

SEQ ID NO: 1188238 - DNA, 22 bp, Artificial Sequence
  chemically synthesized
gattcattctcacccattaggt

SEQ ID NO: 1188239 - DNA, 22 bp, Artificial Sequence
  chemically synthesized
attcattctcacccattaggtc

SEQ ID NO: 1188240 - DNA, 22 bp, Artificial Sequence
  chemically synthesized
attctcacccattaggtcttaa

SEQ ID NO: 1188241 - DNA, 22 bp, Artificial Sequence
  chemically synthesized
tcacccattaggtcttaactca

SEQ ID NO: 1188242 - DNA, 22 bp, Artificial Sequence
  chemically synthesized
aagaggtgccatatgagttaag

SEQ ID NO: 1188243 - DNA, 22 bp, Artificial Sequence
  chemically synthesized
acccattaggtcttaactcata

SEQ ID NO: 1188244 - DNA, 22 bp, Artificial Sequence
  chemically synthesized
tgaagaggtgccatatgagtta

SEQ ID NO: 1188245 - DNA, 22 bp, Artificial Sequence
  chemically synthesized
ggtcttaactcatatggcacct

SEQ ID NO: 1188246 - DNA, 22 bp, Artificial Sequence
  chemically synthesized
aactcatatggcacctcttcag

SEQ ID NO: 1188247 - DNA, 22 bp, Artificial Sequence
  chemically synthesized
actcatatggcacctcttcaga

SEQ ID NO: 1188248 - DNA, 22 bp, Artificial Sequence
  chemically synthesized
atatggcacctcttcagagatg

SEQ ID NO: 1188249 - DNA, 22 bp, Artificial Sequence
  chemically synthesized
aatgggataggaaatgcatctc

SEQ ID NO: 1188250 - DNA, 22 bp, Artificial Sequence
  chemically synthesized
aaatgggataggaaatgcatct

SEQ ID NO: 1188251 - DNA, 22 bp, Artificial Sequence
  chemically synthesized
taaatgggataggaaatgcatc

SEQ ID NO: 1188252 - DNA, 22 bp, Artificial Sequence
  chemically synthesized
tttaaatgggataggaaatgca

SEQ ID NO: 1188253 - DNA, 22 bp, Artificial Sequence
  chemically synthesized
ctttaaatgggataggaaatgc

SEQ ID NO: 1188254 - DNA, 22 bp, Artificial Sequence
  chemically synthesized
ttcagagatgcatttcctatcc

SEQ ID NO: 1188255 - DNA, 22 bp, Artificial Sequence
  chemically synthesized
cagagatgcatttcctatccca

SEQ ID NO: 1188256 - DNA, 22 bp, Artificial Sequence
  chemically synthesized
ggcttctttaaatgggatagga

SEQ ID NO: 1188257 - DNA, 22 bp, Artificial Sequence
  chemically synthesized
agagatgcatttcctatcccat

SEQ ID NO: 1188258 - DNA, 22 bp, Artificial Sequence
  chemically synthesized
cctatcccatttaaagaagccc

SEQ ID NO: 1188259 - DNA, 22 bp, Artificial Sequence
  chemically synthesized
ctatcccatttaaagaagccca

SEQ ID NO: 1188260 - DNA, 22 bp, Artificial Sequence
  chemically synthesized
tcccatttaaagaagcccaacc

SEQ ID NO: 1188261 - DNA, 22 bp, Artificial Sequence
  chemically synthesized
aaagaagcccaacccctttccc

SEQ ID NO: 1188262 - DNA, 22 bp, Artificial Sequence
  chemically synthesized
aagaagcccaacccctttccct

SEQ ID NO: 1188263 - DNA, 22 bp, Artificial Sequence
  chemically synthesized
tccctttattttacattgattt

SEQ ID NO: 1188264 - DNA, 22 bp, Artificial Sequence
  chemically synthesized
ccctttattttacattgatttc

SEQ ID NO: 1188265 - DNA, 22 bp, Artificial Sequence
  chemically synthesized
cctttattttacattgatttcc

SEQ ID NO: 1188266 - DNA, 22 bp, Artificial Sequence
  chemically synthesized
tattttacattgatttccttta

SEQ ID NO: 1188267 - DNA, 22 bp, Artificial Sequence
  chemically synthesized
tgacaagcaatgtaaaggaaat

SEQ ID NO: 1188268 - DNA, 22 bp, Artificial Sequence
  chemically synthesized
attttacattgatttcctttac

SEQ ID NO: 1188269 - DNA, 22 bp, Artificial Sequence
  chemically synthesized
gtgacaagcaatgtaaaggaaa

SEQ ID NO: 1188270 - DNA, 22 bp, Artificial Sequence
  chemically synthesized
ttttacattgatttcctttaca

SEQ ID NO: 1188271 - DNA, 22 bp, Artificial Sequence
  chemically synthesized
tacattgatttcctttacattg

SEQ ID NO: 1188272 - DNA, 22 bp, Artificial Sequence
  chemically synthesized
acattgatttcctttacattgc

SEQ ID NO: 1188273 - DNA, 22 bp, Artificial Sequence
  chemically synthesized
cattgatttcctttacattgct

SEQ ID NO: 1188274 - DNA, 22 bp, Artificial Sequence
  chemically synthesized
atttcctttacattgcttgtca

SEQ ID NO: 1188275 - DNA, 22 bp, Artificial Sequence
  chemically synthesized
cctttacattgcttgtcacaaa

SEQ ID NO: 1188276 - DNA, 22 bp, Artificial Sequence
  chemically synthesized
ctttacattgcttgtcacaaac

SEQ ID NO: 1188277 - DNA, 22 bp, Artificial Sequence
  chemically synthesized
tacattgcttgtcacaaactgt

SEQ ID NO: 1188278 - DNA, 22 bp, Artificial Sequence
  chemically synthesized
acattgcttgtcacaaactgtc

SEQ ID NO: 1188279 - DNA, 22 bp, Artificial Sequence
  chemically synthesized
cattgcttgtcacaaactgtca

SEQ ID NO: 1188280 - DNA, 22 bp, Artificial Sequence
  chemically synthesized
cttgtcacaaactgtcattatt

SEQ ID NO: 1188281 - DNA, 22 bp, Artificial Sequence
  chemically synthesized
gtcacaaactgtcattattatg

SEQ ID NO: 1188282 - DNA, 22 bp, Artificial Sequence
  chemically synthesized
tcacaaactgtcattattatgt

SEQ ID NO: 1188283 - DNA, 22 bp, Artificial Sequence
  chemically synthesized
tataaaaaataaacataataat

SEQ ID NO: 1188284 - DNA, 22 bp, Artificial Sequence
  chemically synthesized
atataaaaaataaacataataa

SEQ ID NO: 1188285 - DNA, 22 bp, Artificial Sequence
  chemically synthesized
ttatataaaaaataaacataat

SEQ ID NO: 1188286 - DNA, 22 bp, Artificial Sequence
  chemically synthesized
tattcttatataaaaaataaac

SEQ ID NO: 1188287 - DNA, 22 bp, Artificial Sequence
  chemically synthesized
atattcttatataaaaaataaa

SEQ ID NO: 1188288 - DNA, 22 bp, Artificial Sequence
  chemically synthesized
tcattattatgtttatttttta

SEQ ID NO: 1188289 - DNA, 22 bp, Artificial Sequence
  chemically synthesized
tatattcttatataaaaaataa

SEQ ID NO: 1188290 - DNA, 22 bp, Artificial Sequence
  chemically synthesized
ttatattcttatataaaaaata

SEQ ID NO: 1188291 - DNA, 22 bp, Artificial Sequence
  chemically synthesized
ttatgtttattttttatataag

SEQ ID NO: 1188292 - DNA, 22 bp, Artificial Sequence
  chemically synthesized
tggtttttatattcttatataa

SEQ ID NO: 1188293 - DNA, 22 bp, Artificial Sequence
  chemically synthesized
gtggtttttatattcttatata

SEQ ID NO: 1188294 - DNA, 22 bp, Artificial Sequence
  chemically synthesized
tgtttattttttatataagaat

SEQ ID NO: 1188295 - DNA, 22 bp, Artificial Sequence
  chemically synthesized
tgtggtttttatattcttatat

SEQ ID NO: 1188296 - DNA, 22 bp, Artificial Sequence
  chemically synthesized
cctttgtggtttttatattctt

SEQ ID NO: 1188297 - DNA, 22 bp, Artificial Sequence
  chemically synthesized
attttttatataagaatataaa

SEQ ID NO: 1188298 - DNA, 22 bp, Artificial Sequence
  chemically synthesized
ttttttatataagaatataaaa

SEQ ID NO: 1188299 - DNA, 22 bp, Artificial Sequence
  chemically synthesized
ctgcctttgtggtttttatatt

SEQ ID NO: 1188300 - DNA, 22 bp, Artificial Sequence
  chemically synthesized
tttatataagaatataaaaacc

SEQ ID NO: 1188301 - DNA, 22 bp, Artificial Sequence
  chemically synthesized
ttatataagaatataaaaacca

SEQ ID NO: 1188302 - DNA, 22 bp, Artificial Sequence
  chemically synthesized
tatataagaatataaaaaccac

SEQ ID NO: 1188303 - DNA, 22 bp, Artificial Sequence
  chemically synthesized
atataagaatataaaaaccaca

SEQ ID NO: 1188304 - DNA, 22 bp, Artificial Sequence
  chemically synthesized
tataagaatataaaaaccacaa

SEQ ID NO: 1188305 - DNA, 22 bp, Artificial Sequence
  chemically synthesized
aaggaagttcctgcctttgtgg

SEQ ID NO: 1188306 - DNA, 22 bp, Artificial Sequence
  chemically synthesized
gtaaaacaatctaaaggaagtt

SEQ ID NO: 1188307 - DNA, 22 bp, Artificial Sequence
  chemically synthesized
agtcattggtaaaacaatctaa

SEQ ID NO: 1188308 - DNA, 22 bp, Artificial Sequence
  chemically synthesized
tcagtcattggtaaaacaatct

SEQ ID NO: 1188309 - DNA, 22 bp, Artificial Sequence
  chemically synthesized
ctcagtcattggtaaaacaatc

SEQ ID NO: 1188310 - DNA, 22 bp, Artificial Sequence
  chemically synthesized
cttctcagtcattggtaaaaca

SEQ ID NO: 1188311 - DNA, 22 bp, Artificial Sequence
  chemically synthesized
cctttagattgttttaccaatg

SEQ ID NO: 1188312 - DNA, 22 bp, Artificial Sequence
  chemically synthesized
ctacttctcagtcattggtaaa

SEQ ID NO: 1188313 - DNA, 22 bp, Artificial Sequence
  chemically synthesized
ctttagattgttttaccaatga

SEQ ID NO: 1188314 - DNA, 22 bp, Artificial Sequence
  chemically synthesized
tagattgttttaccaatgactg

SEQ ID NO: 1188315 - DNA, 22 bp, Artificial Sequence
  chemically synthesized
agattgttttaccaatgactga

SEQ ID NO: 1188316 - DNA, 22 bp, Artificial Sequence
  chemically synthesized
gattgttttaccaatgactgag

SEQ ID NO: 1188317 - DNA, 22 bp, Artificial Sequence
  chemically synthesized
agtacctactacttctcagtca

SEQ ID NO: 1188318 - DNA, 22 bp, Artificial Sequence
  chemically synthesized
ttttaccaatgactgagaagta

SEQ ID NO: 1188319 - DNA, 22 bp, Artificial Sequence
  chemically synthesized
taccaatgactgagaagtagta

SEQ ID NO: 1188320 - DNA, 22 bp, Artificial Sequence
  chemically synthesized
accaatgactgagaagtagtag

SEQ ID NO: 1188321 - DNA, 22 bp, Artificial Sequence
  chemically synthesized
ccaatgactgagaagtagtagg

SEQ ID NO: 1188322 - DNA, 22 bp, Artificial Sequence
  chemically synthesized
acaaatactgagtacctactac

SEQ ID NO: 1188323 - DNA, 22 bp, Artificial Sequence
  chemically synthesized
aacaaatactgagtacctacta

SEQ ID NO: 1188324 - DNA, 22 bp, Artificial Sequence
  chemically synthesized
atttaacaaatactgagtacct

SEQ ID NO: 1188325 - DNA, 22 bp, Artificial Sequence
  chemically synthesized
agaagtagtaggtactcagtat

SEQ ID NO: 1188326 - DNA, 22 bp, Artificial Sequence
  chemically synthesized
ctgatttaacaaatactgagta

SEQ ID NO: 1188327 - DNA, 22 bp, Artificial Sequence
  chemically synthesized
actgatttaacaaatactgagt

SEQ ID NO: 1188328 - DNA, 22 bp, Artificial Sequence
  chemically synthesized
atttactgatttaacaaatact

SEQ ID NO: 1188329 - DNA, 22 bp, Artificial Sequence
  chemically synthesized
cattcatttactgatttaacaa

SEQ ID NO: 1188330 - DNA, 22 bp, Artificial Sequence
  chemically synthesized
tccattcatttactgatttaac

SEQ ID NO: 1188331 - DNA, 22 bp, Artificial Sequence
  chemically synthesized
tctccattcatttactgattta

SEQ ID NO: 1188332 - DNA, 22 bp, Artificial Sequence
  chemically synthesized
tctctccattcatttactgatt

SEQ ID NO: 1188333 - DNA, 22 bp, Artificial Sequence
  chemically synthesized
agtatttgttaaatcagtaaat

SEQ ID NO: 1188334 - DNA, 22 bp, Artificial Sequence
  chemically synthesized
gttaaatcagtaaatgaatgga

SEQ ID NO: 1188335 - DNA, 22 bp, Artificial Sequence
  chemically synthesized
ttaaatcagtaaatgaatggag

SEQ ID NO: 1188336 - DNA, 22 bp, Artificial Sequence
  chemically synthesized
ccaaaaggttctctctccattc

SEQ ID NO: 1188337 - DNA, 22 bp, Artificial Sequence
  chemically synthesized
aatcagtaaatgaatggagaga

SEQ ID NO: 1188338 - DNA, 22 bp, Artificial Sequence
  chemically synthesized
ttcccaaaaggttctctctcca

SEQ ID NO: 1188339 - DNA, 22 bp, Artificial Sequence
  chemically synthesized
attcccaaaaggttctctctcc

SEQ ID NO: 1188340 - DNA, 22 bp, Artificial Sequence
  chemically synthesized
tattcccaaaaggttctctctc

SEQ ID NO: 1188341 - DNA, 22 bp, Artificial Sequence
  chemically synthesized
ttgggaataaaggttcattttc

SEQ ID NO: 1188342 - DNA, 22 bp, Artificial Sequence
  chemically synthesized
tgggaataaaggttcattttca

SEQ ID NO: 1188343 - DNA, 22 bp, Artificial Sequence
  chemically synthesized
gggaataaaggttcattttcat

SEQ ID NO: 1188344 - DNA, 22 bp, Artificial Sequence
  chemically synthesized
ggaataaaggttcattttcatg

SEQ ID NO: 1188345 - DNA, 22 bp, Artificial Sequence
  chemically synthesized
agggggtgtagaccatgaaaat

SEQ ID NO: 1188346 - DNA, 22 bp, Artificial Sequence
  chemically synthesized
cattcagggggtgtagaccatg

SEQ ID NO: 1188347 - DNA, 22 bp, Artificial Sequence
  chemically synthesized
tacattcagggggtgtagacca

SEQ ID NO: 1188348 - DNA, 22 bp, Artificial Sequence
  chemically synthesized
ctctacattcagggggtgtaga

SEQ ID NO: 1188349 - DNA, 22 bp, Artificial Sequence
  chemically synthesized
actctacattcagggggtgtag

SEQ ID NO: 1188350 - DNA, 22 bp, Artificial Sequence
  chemically synthesized
attttcatggtctacaccccct

SEQ ID NO: 1188351 - DNA, 22 bp, Artificial Sequence
  chemically synthesized
tcatggtctacaccccctgaat

SEQ ID NO: 1188352 - DNA, 22 bp, Artificial Sequence
  chemically synthesized
catggtctacaccccctgaatg

SEQ ID NO: 1188353 - DNA, 22 bp, Artificial Sequence
  chemically synthesized
atggtctacaccccctgaatgt

SEQ ID NO: 1188354 - DNA, 22 bp, Artificial Sequence
  chemically synthesized
aacatgtgtcttactctacatt

SEQ ID NO: 1188355 - DNA, 22 bp, Artificial Sequence
  chemically synthesized
caacatgtgtcttactctacat

SEQ ID NO: 1188356 - DNA, 22 bp, Artificial Sequence
  chemically synthesized
tcaacatgtgtcttactctaca

SEQ ID NO: 1188357 - DNA, 22 bp, Artificial Sequence
  chemically synthesized
caccccctgaatgtagagtaag

SEQ ID NO: 1188358 - DNA, 22 bp, Artificial Sequence
  chemically synthesized
aattttcaacatgtgtcttact

SEQ ID NO: 1188359 - DNA, 22 bp, Artificial Sequence
  chemically synthesized
aatgtagagtaagacacatgtt

SEQ ID NO: 1188360 - DNA, 22 bp, Artificial Sequence
  chemically synthesized
aagcagtgctcaattttcaaca

SEQ ID NO: 1188361 - DNA, 22 bp, Artificial Sequence
  chemically synthesized
caagcagtgctcaattttcaac

SEQ ID NO: 1188362 - DNA, 22 bp, Artificial Sequence
  chemically synthesized
ccccttcaagcagtgctcaatt

SEQ ID NO: 1188363 - DNA, 22 bp, Artificial Sequence
  chemically synthesized
tgccccttcaagcagtgctcaa

SEQ ID NO: 1188364 - DNA, 22 bp, Artificial Sequence
  chemically synthesized
ctgccccttcaagcagtgctca

SEQ ID NO: 1188365 - DNA, 22 bp, Artificial Sequence
  chemically synthesized
tctgccccttcaagcagtgctc

SEQ ID NO: 1188366 - DNA, 22 bp, Artificial Sequence
  chemically synthesized
aaaattgagcactgcttgaagg

SEQ ID NO: 1188367 - DNA, 22 bp, Artificial Sequence
  chemically synthesized
tgtgctttctgccccttcaagc

SEQ ID NO: 1188368 - DNA, 22 bp, Artificial Sequence
  chemically synthesized
ctatgtgctttctgccccttca

SEQ ID NO: 1188369 - DNA, 22 bp, Artificial Sequence
  chemically synthesized
gctatgtgctttctgccccttc

SEQ ID NO: 1188370 - DNA, 22 bp, Artificial Sequence
  chemically synthesized
agcactgcttgaaggggcagaa

SEQ ID NO: 1188371 - DNA, 22 bp, Artificial Sequence
  chemically synthesized
cttgctatgtgctttctgcccc

SEQ ID NO: 1188372 - DNA, 22 bp, Artificial Sequence
  chemically synthesized
ttccttgctatgtgctttctgc

SEQ ID NO: 1188373 - DNA, 22 bp, Artificial Sequence
  chemically synthesized
cttgaaggggcagaaagcacat

SEQ ID NO: 1188374 - DNA, 22 bp, Artificial Sequence
  chemically synthesized
ctgttccttgctatgtgctttc

SEQ ID NO: 1188375 - DNA, 22 bp, Artificial Sequence
  chemically synthesized
gaaggggcagaaagcacatagc

SEQ ID NO: 1188376 - DNA, 22 bp, Artificial Sequence
  chemically synthesized
ctcctgttccttgctatgtgct

SEQ ID NO: 1188377 - DNA, 22 bp, Artificial Sequence
  chemically synthesized
aaggggcagaaagcacatagca

SEQ ID NO: 1188378 - DNA, 22 bp, Artificial Sequence
  chemically synthesized
tagggagaaaaatacaggctgc

SEQ ID NO: 1188379 - DNA, 22 bp, Artificial Sequence
  chemically synthesized
gtagggagaaaaatacaggctg

SEQ ID NO: 1188380 - DNA, 22 bp, Artificial Sequence
  chemically synthesized
tgtagggagaaaaatacaggct

SEQ ID NO: 1188381 - DNA, 22 bp, Artificial Sequence
  chemically synthesized
cagaattttgtagggagaaaaa

SEQ ID NO: 1188382 - DNA, 22 bp, Artificial Sequence
  chemically synthesized
gcagaattttgtagggagaaaa

SEQ ID NO: 1188383 - DNA, 22 bp, Artificial Sequence
  chemically synthesized
tgcagaattttgtagggagaaa

SEQ ID NO: 1188384 - DNA, 22 bp, Artificial Sequence
  chemically synthesized
ttgcagaattttgtagggagaa

SEQ ID NO: 1188385 - DNA, 22 bp, Artificial Sequence
  chemically synthesized
ttttgcagaattttgtagggag

SEQ ID NO: 1188386 - DNA, 22 bp, Artificial Sequence
  chemically synthesized
tatttttctccctacaaaattc

SEQ ID NO: 1188387 - DNA, 22 bp, Artificial Sequence
  chemically synthesized
aatctcttttgcagaattttgt

SEQ ID NO: 1188388 - DNA, 22 bp, Artificial Sequence
  chemically synthesized
ttctccctacaaaattctgcaa

SEQ ID NO: 1188389 - DNA, 22 bp, Artificial Sequence
  chemically synthesized
tctccctacaaaattctgcaaa

SEQ ID NO: 1188390 - DNA, 22 bp, Artificial Sequence
  chemically synthesized
ctccctacaaaattctgcaaaa

SEQ ID NO: 1188391 - DNA, 22 bp, Artificial Sequence
  chemically synthesized
tccctacaaaattctgcaaaag

SEQ ID NO: 1188392 - DNA, 22 bp, Artificial Sequence
  chemically synthesized
cctacaaaattctgcaaaagag

SEQ ID NO: 1188393 - DNA, 22 bp, Artificial Sequence
  chemically synthesized
taccaaactgaatctcttttgc

SEQ ID NO: 1188394 - DNA, 22 bp, Artificial Sequence
  chemically synthesized
tataccaaactgaatctctttt

SEQ ID NO: 1188395 - DNA, 22 bp, Artificial Sequence
  chemically synthesized
caaaattctgcaaaagagattc

SEQ ID NO: 1188396 - DNA, 22 bp, Artificial Sequence
  chemically synthesized
attctataccaaactgaatctc

SEQ ID NO: 1188397 - DNA, 22 bp, Artificial Sequence
  chemically synthesized
tgcaaaagagattcagtttggt

SEQ ID NO: 1188398 - DNA, 22 bp, Artificial Sequence
  chemically synthesized
caaaagagattcagtttggtat

SEQ ID NO: 1188399 - DNA, 22 bp, Artificial Sequence
  chemically synthesized
ataaaaactaattctataccaa

SEQ ID NO: 1188400 - DNA, 22 bp, Artificial Sequence
  chemically synthesized
gataaaaactaattctatacca

SEQ ID NO: 1188401 - DNA, 22 bp, Artificial Sequence
  chemically synthesized
atacttgataaaaactaattct

SEQ ID NO: 1188402 - DNA, 22 bp, Artificial Sequence
  chemically synthesized
agtttggtatagaattagtttt

SEQ ID NO: 1188403 - DNA, 22 bp, Artificial Sequence
  chemically synthesized
ggtatagaattagtttttatca

SEQ ID NO: 1188404 - DNA, 22 bp, Artificial Sequence
  chemically synthesized
gtatagaattagtttttatcaa

SEQ ID NO: 1188405 - DNA, 22 bp, Artificial Sequence
  chemically synthesized
tatataattgatacttgataaa

SEQ ID NO: 1188406 - DNA, 22 bp, Artificial Sequence
  chemically synthesized
gtatataattgatacttgataa

SEQ ID NO: 1188407 - DNA, 22 bp, Artificial Sequence
  chemically synthesized
ttgtatataattgatacttgat

SEQ ID NO: 1188408 - DNA, 22 bp, Artificial Sequence
  chemically synthesized
gtttttatcaagtatcaattat

SEQ ID NO: 1188409 - DNA, 22 bp, Artificial Sequence
  chemically synthesized
ttatcaagtatcaattatatac

SEQ ID NO: 1188410 - DNA, 22 bp, Artificial Sequence
  chemically synthesized
tatcaagtatcaattatataca

SEQ ID NO: 1188411 - DNA, 22 bp, Artificial Sequence
  chemically synthesized
atcaagtatcaattatatacaa

SEQ ID NO: 1188412 - DNA, 22 bp, Artificial Sequence
  chemically synthesized
tcaagtatcaattatatacaag

SEQ ID NO: 1188413 - DNA, 22 bp, Artificial Sequence
  chemically synthesized
tatacaagaacttttattatgt

SEQ ID NO: 1188414 - DNA, 22 bp, Artificial Sequence
  chemically synthesized
aatgaaaaaaaaacataataaa

SEQ ID NO: 1188415 - DNA, 22 bp, Artificial Sequence
  chemically synthesized
aaatgaaaaaaaaacataataa

SEQ ID NO: 1188416 - DNA, 22 bp, Artificial Sequence
  chemically synthesized
ttattatgtttttttttcattt

SEQ ID NO: 1188417 - DNA, 22 bp, Artificial Sequence
  chemically synthesized
tattatgtttttttttcattta

SEQ ID NO: 1188418 - DNA, 22 bp, Artificial Sequence
  chemically synthesized
attatgtttttttttcatttaa

SEQ ID NO: 1188419 - DNA, 22 bp, Artificial Sequence
  chemically synthesized
ttatgtttttttttcatttaaa

SEQ ID NO: 1188420 - DNA, 22 bp, Artificial Sequence
  chemically synthesized
tgtttttttttcatttaaattc

SEQ ID NO: 1188421 - DNA, 22 bp, Artificial Sequence
  chemically synthesized
acaagagagtggtgaatttaaa

SEQ ID NO: 1188422 - DNA, 22 bp, Artificial Sequence
  chemically synthesized
ttttttcatttaaattcaccac

SEQ ID NO: 1188423 - DNA, 22 bp, Artificial Sequence
  chemically synthesized
actcacaagagagtggtgaatt

SEQ ID NO: 1188424 - DNA, 22 bp, Artificial Sequence
  chemically synthesized
tttttcatttaaattcaccact

SEQ ID NO: 1188425 - DNA, 22 bp, Artificial Sequence
  chemically synthesized
aactcacaagagagtggtgaat

SEQ ID NO: 1188426 - DNA, 22 bp, Artificial Sequence
  chemically synthesized
ttttcatttaaattcaccactc

SEQ ID NO: 1188427 - DNA, 22 bp, Artificial Sequence
  chemically synthesized
tttcatttaaattcaccactct

SEQ ID NO: 1188428 - DNA, 22 bp, Artificial Sequence
  chemically synthesized
ttaactcacaagagagtggtga

SEQ ID NO: 1188429 - DNA, 22 bp, Artificial Sequence
  chemically synthesized
ttcatttaaattcaccactctc

SEQ ID NO: 1188430 - DNA, 22 bp, Artificial Sequence
  chemically synthesized
tcatttaaattcaccactctct

SEQ ID NO: 1188431 - DNA, 22 bp, Artificial Sequence
  chemically synthesized
catttaaattcaccactctctt

SEQ ID NO: 1188432 - DNA, 22 bp, Artificial Sequence
  chemically synthesized
atttaaattcaccactctcttg

SEQ ID NO: 1188433 - DNA, 22 bp, Artificial Sequence
  chemically synthesized
tattcttaactcacaagagagt

SEQ ID NO: 1188434 - DNA, 22 bp, Artificial Sequence
  chemically synthesized
aaattcaccactctcttgtgag

SEQ ID NO: 1188435 - DNA, 22 bp, Artificial Sequence
  chemically synthesized
aattcaccactctcttgtgagt

SEQ ID NO: 1188436 - DNA, 22 bp, Artificial Sequence
  chemically synthesized
ggctgtattcttaactcacaag

SEQ ID NO: 1188437 - DNA, 22 bp, Artificial Sequence
  chemically synthesized
gggctgtattcttaactcacaa

SEQ ID NO: 1188438 - DNA, 22 bp, Artificial Sequence
  chemically synthesized
accactctcttgtgagttaaga

SEQ ID NO: 1188439 - DNA, 22 bp, Artificial Sequence
  chemically synthesized
tatgaccttgggctgtattctt

SEQ ID NO: 1188440 - DNA, 22 bp, Artificial Sequence
  chemically synthesized
tcttgtgagttaagaatacagc

SEQ ID NO: 1188441 - DNA, 22 bp, Artificial Sequence
  chemically synthesized
ttgtgagttaagaatacagccc

SEQ ID NO: 1188442 - DNA, 22 bp, Artificial Sequence
  chemically synthesized
gttgtatgaccttgggctgtat

SEQ ID NO: 1188443 - DNA, 22 bp, Artificial Sequence
  chemically synthesized
gtgagttaagaatacagcccaa

SEQ ID NO: 1188444 - DNA, 22 bp, Artificial Sequence
  chemically synthesized
tgagttaagaatacagcccaag

SEQ ID NO: 1188445 - DNA, 22 bp, Artificial Sequence
  chemically synthesized
ttggttgtatgaccttgggctg

SEQ ID NO: 1188446 - DNA, 22 bp, Artificial Sequence
  chemically synthesized
attggttgtatgaccttgggct

SEQ ID NO: 1188447 - DNA, 22 bp, Artificial Sequence
  chemically synthesized
agaatacagcccaaggtcatac

SEQ ID NO: 1188448 - DNA, 22 bp, Artificial Sequence
  chemically synthesized
tcacttattggttgtatgacct

SEQ ID NO: 1188449 - DNA, 22 bp, Artificial Sequence
  chemically synthesized
atcagactgtcacttattggtt

SEQ ID NO: 1188450 - DNA, 22 bp, Artificial Sequence
  chemically synthesized
aatcagactgtcacttattggt

SEQ ID NO: 1188451 - DNA, 22 bp, Artificial Sequence
  chemically synthesized
taatcagactgtcacttattgg

SEQ ID NO: 1188452 - DNA, 22 bp, Artificial Sequence
  chemically synthesized
cactttaatcagactgtcactt

SEQ ID NO: 1188453 - DNA, 22 bp, Artificial Sequence
  chemically synthesized
ccactttaatcagactgtcact

SEQ ID NO: 1188454 - DNA, 22 bp, Artificial Sequence
  chemically synthesized
tccactttaatcagactgtcac

SEQ ID NO: 1188455 - DNA, 22 bp, Artificial Sequence
  chemically synthesized
ttccactttaatcagactgtca

SEQ ID NO: 1188456 - DNA, 22 bp, Artificial Sequence
  chemically synthesized
tttccactttaatcagactgtc

SEQ ID NO: 1188457 - DNA, 22 bp, Artificial Sequence
  chemically synthesized
ttttccactttaatcagactgt

SEQ ID NO: 1188458 - DNA, 22 bp, Artificial Sequence
  chemically synthesized
tttttccactttaatcagactg

SEQ ID NO: 1188459 - DNA, 22 bp, Artificial Sequence
  chemically synthesized
ttttttccactttaatcagact

SEQ ID NO: 1188460 - DNA, 22 bp, Artificial Sequence
  chemically synthesized
tttttttccactttaatcagac

SEQ ID NO: 1188461 - DNA, 22 bp, Artificial Sequence
  chemically synthesized
ttttttttccactttaatcaga

SEQ ID NO: 1188462 - DNA, 22 bp, Artificial Sequence
  chemically synthesized
cttttttttttccactttaatc

SEQ ID NO: 1188463 - DNA, 22 bp, Artificial Sequence
  chemically synthesized
tacttttttttttccactttaa

SEQ ID NO: 1188464 - DNA, 22 bp, Artificial Sequence
  chemically synthesized
attaaagtggaaaaaaaaaagt

SEQ ID NO: 1188465 - DNA, 22 bp, Artificial Sequence
  chemically synthesized
aagtggaaaaaaaaaagtagag

SEQ ID NO: 1188466 - DNA, 22 bp, Artificial Sequence
  chemically synthesized
ggagccaaaccaaggactctac

SEQ ID NO: 1188467 - DNA, 22 bp, Artificial Sequence
  chemically synthesized
ggtttggctcccagttctttca

SEQ ID NO: 1188468 - DNA, 22 bp, Artificial Sequence
  chemically synthesized
gtttggctcccagttctttcat

SEQ ID NO: 1188469 - DNA, 22 bp, Artificial Sequence
  chemically synthesized
tccaaggtcacaaaatgaaaga

SEQ ID NO: 1188470 - DNA, 22 bp, Artificial Sequence
  chemically synthesized
atccaaggtcacaaaatgaaag

SEQ ID NO: 1188471 - DNA, 22 bp, Artificial Sequence
  chemically synthesized
ggctcccagttctttcattttg

SEQ ID NO: 1188472 - DNA, 22 bp, Artificial Sequence
  chemically synthesized
tatccaaggtcacaaaatgaaa

SEQ ID NO: 1188473 - DNA, 22 bp, Artificial Sequence
  chemically synthesized
gctcccagttctttcattttgt

SEQ ID NO: 1188474 - DNA, 22 bp, Artificial Sequence
  chemically synthesized
actttatccaaggtcacaaaat

SEQ ID NO: 1188475 - DNA, 22 bp, Artificial Sequence
  chemically synthesized
ccagttctttcattttgtgacc

SEQ ID NO: 1188476 - DNA, 22 bp, Artificial Sequence
  chemically synthesized
aactttatccaaggtcacaaaa

SEQ ID NO: 1188477 - DNA, 22 bp, Artificial Sequence
  chemically synthesized
tgcttaactttatccaaggtca

SEQ ID NO: 1188478 - DNA, 22 bp, Artificial Sequence
  chemically synthesized
tttcattttgtgaccttggata

SEQ ID NO: 1188479 - DNA, 22 bp, Artificial Sequence
  chemically synthesized
tcattttgtgaccttggataaa

SEQ ID NO: 1188480 - DNA, 22 bp, Artificial Sequence
  chemically synthesized
cattttgtgaccttggataaag

SEQ ID NO: 1188481 - DNA, 22 bp, Artificial Sequence
  chemically synthesized
attttgtgaccttggataaagt

SEQ ID NO: 1188482 - DNA, 22 bp, Artificial Sequence
  chemically synthesized
tgtgaccttggataaagttaag

SEQ ID NO: 1188483 - DNA, 22 bp, Artificial Sequence
  chemically synthesized
aggtgcattatgcttaacttta

SEQ ID NO: 1188484 - DNA, 22 bp, Artificial Sequence
  chemically synthesized
gtgaccttggataaagttaagc

SEQ ID NO: 1188485 - DNA, 22 bp, Artificial Sequence
  chemically synthesized
tgaccttggataaagttaagca

SEQ ID NO: 1188486 - DNA, 22 bp, Artificial Sequence
  chemically synthesized
ggataaagttaagcataatgca

SEQ ID NO: 1188487 - DNA, 22 bp, Artificial Sequence
  chemically synthesized
gataaagttaagcataatgcac

SEQ ID NO: 1188488 - DNA, 22 bp, Artificial Sequence
  chemically synthesized
caatacaataggaagctgaggt

SEQ ID NO: 1188489 - DNA, 22 bp, Artificial Sequence
  chemically synthesized
gcaatacaataggaagctgagg

SEQ ID NO: 1188490 - DNA, 22 bp, Artificial Sequence
  chemically synthesized
agcataatgcacctcagcttcc

SEQ ID NO: 1188491 - DNA, 22 bp, Artificial Sequence
  chemically synthesized
ttgcaatacaataggaagctga

SEQ ID NO: 1188492 - DNA, 22 bp, Artificial Sequence
  chemically synthesized
cttgcaatacaataggaagctg

SEQ ID NO: 1188493 - DNA, 22 bp, Artificial Sequence
  chemically synthesized
agcttcctattgtattgcaaga

SEQ ID NO: 1188494 - DNA, 22 bp, Artificial Sequence
  chemically synthesized
cctattgtattgcaagaagttt

SEQ ID NO: 1188495 - DNA, 22 bp, Artificial Sequence
  chemically synthesized
ctattgtattgcaagaagtttt

SEQ ID NO: 1188496 - DNA, 22 bp, Artificial Sequence
  chemically synthesized
ttgtattgcaagaagtttttct

SEQ ID NO: 1188497 - DNA, 22 bp, Artificial Sequence
  chemically synthesized
tattgcaagaagtttttcttat

SEQ ID NO: 1188498 - DNA, 22 bp, Artificial Sequence
  chemically synthesized
gaaatgtgatcaataagaaaaa

SEQ ID NO: 1188499 - DNA, 22 bp, Artificial Sequence
  chemically synthesized
ggaaatgtgatcaataagaaaa

SEQ ID NO: 1188500 - DNA, 22 bp, Artificial Sequence
  chemically synthesized
tggaaatgtgatcaataagaaa

SEQ ID NO: 1188501 - DNA, 22 bp, Artificial Sequence
  chemically synthesized
ttggaaatgtgatcaataagaa

SEQ ID NO: 1188502 - DNA, 22 bp, Artificial Sequence
  chemically synthesized
caagaagtttttcttattgatc

SEQ ID NO: 1188503 - DNA, 22 bp, Artificial Sequence
  chemically synthesized
tttttggaaatgtgatcaataa

SEQ ID NO: 1188504 - DNA, 22 bp, Artificial Sequence
  chemically synthesized
atttttggaaatgtgatcaata

SEQ ID NO: 1188505 - DNA, 22 bp, Artificial Sequence
  chemically synthesized
ttcttattgatcacatttccaa

SEQ ID NO: 1188506 - DNA, 22 bp, Artificial Sequence
  chemically synthesized
tcttattgatcacatttccaaa

SEQ ID NO: 1188507 - DNA, 22 bp, Artificial Sequence
  chemically synthesized
cttattgatcacatttccaaaa

SEQ ID NO: 1188508 - DNA, 22 bp, Artificial Sequence
  chemically synthesized
ttattgatcacatttccaaaaa

SEQ ID NO: 1188509 - DNA, 22 bp, Artificial Sequence
  chemically synthesized
aaatcaagtcttatttttggaa

SEQ ID NO: 1188510 - DNA, 22 bp, Artificial Sequence
  chemically synthesized
attgatcacatttccaaaaata

SEQ ID NO: 1188511 - DNA, 22 bp, Artificial Sequence
  chemically synthesized
caaatcaagtcttatttttgga

SEQ ID NO: 1188512 - DNA, 22 bp, Artificial Sequence
  chemically synthesized
ttgatcacatttccaaaaataa

SEQ ID NO: 1188513 - DNA, 22 bp, Artificial Sequence
  chemically synthesized
ttcaaatcaagtcttatttttg

SEQ ID NO: 1188514 - DNA, 22 bp, Artificial Sequence
  chemically synthesized
atcacatttccaaaaataagac

SEQ ID NO: 1188515 - DNA, 22 bp, Artificial Sequence
  chemically synthesized
ccaaaaataagacttgatttga

SEQ ID NO: 1188516 - DNA, 22 bp, Artificial Sequence
  chemically synthesized
caaaaataagacttgatttgaa

SEQ ID NO: 1188517 - DNA, 22 bp, Artificial Sequence
  chemically synthesized
gagcatgagatgttcttcaaat

SEQ ID NO: 1188518 - DNA, 22 bp, Artificial Sequence
  chemically synthesized
tagagcatgagatgttcttcaa

SEQ ID NO: 1188519 - DNA, 22 bp, Artificial Sequence
  chemically synthesized
ctagagcatgagatgttcttca

SEQ ID NO: 1188520 - DNA, 22 bp, Artificial Sequence
  chemically synthesized
gatttgaagaacatctcatgct

SEQ ID NO: 1188521 - DNA, 22 bp, Artificial Sequence
  chemically synthesized
atttgaagaacatctcatgctc

SEQ ID NO: 1188522 - DNA, 22 bp, Artificial Sequence
  chemically synthesized
atacagtttctagagcatgaga

SEQ ID NO: 1188523 - DNA, 22 bp, Artificial Sequence
  chemically synthesized
gaagaacatctcatgctctaga

SEQ ID NO: 1188524 - DNA, 22 bp, Artificial Sequence
  chemically synthesized
aagaacatctcatgctctagaa

SEQ ID NO: 1188525 - DNA, 22 bp, Artificial Sequence
  chemically synthesized
aaaataatctgatacagtttct

SEQ ID NO: 1188526 - DNA, 22 bp, Artificial Sequence
  chemically synthesized
aaaaataatctgatacagtttc

SEQ ID NO: 1188527 - DNA, 22 bp, Artificial Sequence
  chemically synthesized
atgctctagaaactgtatcaga

SEQ ID NO: 1188528 - DNA, 22 bp, Artificial Sequence
  chemically synthesized
tcacttaaaaataatctgatac

SEQ ID NO: 1188529 - DNA, 22 bp, Artificial Sequence
  chemically synthesized
tagaaactgtatcagattattt

SEQ ID NO: 1188530 - DNA, 22 bp, Artificial Sequence
  chemically synthesized
cctatcacttaaaaataatctg

SEQ ID NO: 1188531 - DNA, 22 bp, Artificial Sequence
  chemically synthesized
ccctatcacttaaaaataatct

SEQ ID NO: 1188532 - DNA, 22 bp, Artificial Sequence
  chemically synthesized
gaaactgtatcagattattttt

SEQ ID NO: 1188533 - DNA, 22 bp, Artificial Sequence
  chemically synthesized
tccctatcacttaaaaataatc

SEQ ID NO: 1188534 - DNA, 22 bp, Artificial Sequence
  chemically synthesized
tttccctatcacttaaaaataa

SEQ ID NO: 1188535 - DNA, 22 bp, Artificial Sequence
  chemically synthesized
ctttccctatcacttaaaaata

SEQ ID NO: 1188536 - DNA, 22 bp, Artificial Sequence
  chemically synthesized
tatcagattatttttaagtgat

SEQ ID NO: 1188537 - DNA, 22 bp, Artificial Sequence
  chemically synthesized
atgcttctttccctatcactta

SEQ ID NO: 1188538 - DNA, 22 bp, Artificial Sequence
  chemically synthesized
gaaattaatgcttctttcccta

SEQ ID NO: 1188539 - DNA, 22 bp, Artificial Sequence
  chemically synthesized
tttttaagtgatagggaaagaa

SEQ ID NO: 1188540 - DNA, 22 bp, Artificial Sequence
  chemically synthesized
ggaaattaatgcttctttccct

SEQ ID NO: 1188541 - DNA, 22 bp, Artificial Sequence
  chemically synthesized
ttaagtgatagggaaagaagca

SEQ ID NO: 1188542 - DNA, 22 bp, Artificial Sequence
  chemically synthesized
taagtgatagggaaagaagcat

SEQ ID NO: 1188543 - DNA, 22 bp, Artificial Sequence
  chemically synthesized
atttggaaattaatgcttcttt

SEQ ID NO: 1188544 - DNA, 22 bp, Artificial Sequence
  chemically synthesized
aagtgatagggaaagaagcatt

SEQ ID NO: 1188545 - DNA, 22 bp, Artificial Sequence
  chemically synthesized
agtgatagggaaagaagcatta

SEQ ID NO: 1188546 - DNA, 22 bp, Artificial Sequence
  chemically synthesized
taatttggaaattaatgcttct

SEQ ID NO: 1188547 - DNA, 22 bp, Artificial Sequence
  chemically synthesized
tctaatttggaaattaatgctt

SEQ ID NO: 1188548 - DNA, 22 bp, Artificial Sequence
  chemically synthesized
atgctctctaatttggaaatta

SEQ ID NO: 1188549 - DNA, 22 bp, Artificial Sequence
  chemically synthesized
ctaatgctctctaatttggaaa

SEQ ID NO: 1188550 - DNA, 22 bp, Artificial Sequence
  chemically synthesized
acctgctaatgctctctaattt

SEQ ID NO: 1188551 - DNA, 22 bp, Artificial Sequence
  chemically synthesized
attaacctgctaatgctctcta

SEQ ID NO: 1188552 - DNA, 22 bp, Artificial Sequence
  chemically synthesized
gattaacctgctaatgctctct

SEQ ID NO: 1188553 - DNA, 22 bp, Artificial Sequence
  chemically synthesized
atttccaaattagagagcatta

SEQ ID NO: 1188554 - DNA, 22 bp, Artificial Sequence
  chemically synthesized
ttgattaacctgctaatgctct

SEQ ID NO: 1188555 - DNA, 22 bp, Artificial Sequence
  chemically synthesized
cttgattaacctgctaatgctc

SEQ ID NO: 1188556 - DNA, 22 bp, Artificial Sequence
  chemically synthesized
ccaaattagagagcattagcag

SEQ ID NO: 1188557 - DNA, 22 bp, Artificial Sequence
  chemically synthesized
caaattagagagcattagcagg

SEQ ID NO: 1188558 - DNA, 22 bp, Artificial Sequence
  chemically synthesized
ataggcttcttgattaacctgc

SEQ ID NO: 1188559 - DNA, 22 bp, Artificial Sequence
  chemically synthesized
gagagcattagcaggttaatca

SEQ ID NO: 1188560 - DNA, 22 bp, Artificial Sequence
  chemically synthesized
gcaggttaatcaagaagcctat

SEQ ID NO: 1188561 - DNA, 22 bp, Artificial Sequence
  chemically synthesized
tcatcatcactcataggcttct

SEQ ID NO: 1188562 - DNA, 22 bp, Artificial Sequence
  chemically synthesized
gtcatcatcactcataggcttc

SEQ ID NO: 1188563 - DNA, 22 bp, Artificial Sequence
  chemically synthesized
tgtcatcatcactcataggctt

SEQ ID NO: 1188564 - DNA, 22 bp, Artificial Sequence
  chemically synthesized
actttgtcatcatcactcatag

SEQ ID NO: 1188565 - DNA, 22 bp, Artificial Sequence
  chemically synthesized
atcaagaagcctatgagtgatg

SEQ ID NO: 1188566 - DNA, 22 bp, Artificial Sequence
  chemically synthesized
aaatgtactaactttgtcatca

SEQ ID NO: 1188567 - DNA, 22 bp, Artificial Sequence
  chemically synthesized
aaaatgtactaactttgtcatc

SEQ ID NO: 1188568 - DNA, 22 bp, Artificial Sequence
  chemically synthesized
tgagtgatgatgacaaagttag

SEQ ID NO: 1188569 - DNA, 22 bp, Artificial Sequence
  chemically synthesized
aatttaaaatgtactaactttg

SEQ ID NO: 1188570 - DNA, 22 bp, Artificial Sequence
  chemically synthesized
aatctgaatttaaaatgtacta

SEQ ID NO: 1188571 - DNA, 22 bp, Artificial Sequence
  chemically synthesized
caatctgaatttaaaatgtact

SEQ ID NO: 1188572 - DNA, 22 bp, Artificial Sequence
  chemically synthesized
tcaatctgaatttaaaatgtac

SEQ ID NO: 1188573 - DNA, 22 bp, Artificial Sequence
  chemically synthesized
agtattttcaatctgaatttaa

SEQ ID NO: 1188574 - DNA, 22 bp, Artificial Sequence
  chemically synthesized
gagtattttcaatctgaattta

SEQ ID NO: 1188575 - DNA, 22 bp, Artificial Sequence
  chemically synthesized
gtacattttaaattcagattga

SEQ ID NO: 1188576 - DNA, 22 bp, Artificial Sequence
  chemically synthesized
tgtcttgagtattttcaatctg

SEQ ID NO: 1188577 - DNA, 22 bp, Artificial Sequence
  chemically synthesized
ctgtgtcttgagtattttcaat

SEQ ID NO: 1188578 - DNA, 22 bp, Artificial Sequence
  chemically synthesized
cctgtgtcttgagtattttcaa

SEQ ID NO: 1188579 - DNA, 22 bp, Artificial Sequence
  chemically synthesized
tcctgtgtcttgagtattttca

SEQ ID NO: 1188580 - DNA, 22 bp, Artificial Sequence
  chemically synthesized
taaattcagattgaaaatactc

SEQ ID NO: 1188581 - DNA, 22 bp, Artificial Sequence
  chemically synthesized
aaattcagattgaaaatactca

SEQ ID NO: 1188582 - DNA, 22 bp, Artificial Sequence
  chemically synthesized
aattcagattgaaaatactcaa

SEQ ID NO: 1188583 - DNA, 22 bp, Artificial Sequence
  chemically synthesized
gttttcctgtgtcttgagtatt

SEQ ID NO: 1188584 - DNA, 22 bp, Artificial Sequence
  chemically synthesized
agattgaaaatactcaagacac

SEQ ID NO: 1188585 - DNA, 22 bp, Artificial Sequence
  chemically synthesized
aaaatactcaagacacaggaaa

SEQ ID NO: 1188586 - DNA, 22 bp, Artificial Sequence
  chemically synthesized
aagacacaggaaaactaatgtt

SEQ ID NO: 1188587 - DNA, 22 bp, Artificial Sequence
  chemically synthesized
gaacaatgaataaaacattagt

SEQ ID NO: 1188588 - DNA, 22 bp, Artificial Sequence
  chemically synthesized
agaacaatgaataaaacattag

SEQ ID NO: 1188589 - DNA, 22 bp, Artificial Sequence
  chemically synthesized
atgttttattcattgttctaaa

SEQ ID NO: 1188590 - DNA, 22 bp, Artificial Sequence
  chemically synthesized
tagtgtgtatgccaaagtttag

SEQ ID NO: 1188591 - DNA, 22 bp, Artificial Sequence
  chemically synthesized
tattcattgttctaaactttgg

SEQ ID NO: 1188592 - DNA, 22 bp, Artificial Sequence
  chemically synthesized
gtagtgtgtatgccaaagttta

SEQ ID NO: 1188593 - DNA, 22 bp, Artificial Sequence
  chemically synthesized
attcattgttctaaactttggc

SEQ ID NO: 1188594 - DNA, 22 bp, Artificial Sequence
  chemically synthesized
tgtagtgtgtatgccaaagttt

SEQ ID NO: 1188595 - DNA, 22 bp, Artificial Sequence
  chemically synthesized
ttcattgttctaaactttggca

SEQ ID NO: 1188596 - DNA, 22 bp, Artificial Sequence
  chemically synthesized
ttttgtagtgtgtatgccaaag

SEQ ID NO: 1188597 - DNA, 22 bp, Artificial Sequence
  chemically synthesized
attgttctaaactttggcatac

SEQ ID NO: 1188598 - DNA, 22 bp, Artificial Sequence
  chemically synthesized
ttctaaactttggcatacacac

SEQ ID NO: 1188599 - DNA, 22 bp, Artificial Sequence
  chemically synthesized
taaactttggcatacacactac

SEQ ID NO: 1188600 - DNA, 22 bp, Artificial Sequence
  chemically synthesized
aactttggcatacacactacaa

SEQ ID NO: 1188601 - DNA, 22 bp, Artificial Sequence
  chemically synthesized
tggcatacacactacaaaatag

SEQ ID NO: 1188602 - DNA, 22 bp, Artificial Sequence
  chemically synthesized
taaagcacggtgctattttgta

SEQ ID NO: 1188603 - DNA, 22 bp, Artificial Sequence
  chemically synthesized
ggcatacacactacaaaatagc

SEQ ID NO: 1188604 - DNA, 22 bp, Artificial Sequence
  chemically synthesized
gtaaagcacggtgctattttgt

SEQ ID NO: 1188605 - DNA, 22 bp, Artificial Sequence
  chemically synthesized
gcatacacactacaaaatagca

SEQ ID NO: 1188606 - DNA, 22 bp, Artificial Sequence
  chemically synthesized
tgtaaagcacggtgctattttg

SEQ ID NO: 1188607 - DNA, 22 bp, Artificial Sequence
  chemically synthesized
ttgtaaagcacggtgctatttt

SEQ ID NO: 1188608 - DNA, 22 bp, Artificial Sequence
  chemically synthesized
caaaatagcaccgtgctttaca

SEQ ID NO: 1188609 - DNA, 22 bp, Artificial Sequence
  chemically synthesized
aaaatacgtttttgtaaagcac

SEQ ID NO: 1188610 - DNA, 22 bp, Artificial Sequence
  chemically synthesized
gaaaatacgtttttgtaaagca

SEQ ID NO: 1188611 - DNA, 22 bp, Artificial Sequence
  chemically synthesized
tgaaaatacgtttttgtaaagc

SEQ ID NO: 1188612 - DNA, 22 bp, Artificial Sequence
  chemically synthesized
ttgaaaatacgtttttgtaaag

SEQ ID NO: 1188613 - DNA, 22 bp, Artificial Sequence
  chemically synthesized
tttttgaaaatacgtttttgta

SEQ ID NO: 1188614 - DNA, 22 bp, Artificial Sequence
  chemically synthesized
tacaaaaacgtattttcaaaaa

SEQ ID NO: 1188615 - DNA, 22 bp, Artificial Sequence
  chemically synthesized
acaaaaacgtattttcaaaaat

SEQ ID NO: 1188616 - DNA, 22 bp, Artificial Sequence
  chemically synthesized
caaaaacgtattttcaaaaata

SEQ ID NO: 1188617 - DNA, 22 bp, Artificial Sequence
  chemically synthesized
tagatatcagtcaatattattt

SEQ ID NO: 1188618 - DNA, 22 bp, Artificial Sequence
  chemically synthesized
tgtagatatcagtcaatattat

SEQ ID NO: 1188619 - DNA, 22 bp, Artificial Sequence
  chemically synthesized
ctgtagatatcagtcaatatta

SEQ ID NO: 1188620 - DNA, 22 bp, Artificial Sequence
  chemically synthesized
tctgtagatatcagtcaatatt

SEQ ID NO: 1188621 - DNA, 22 bp, Artificial Sequence
  chemically synthesized
ttctgtagatatcagtcaatat

SEQ ID NO: 1188622 - DNA, 22 bp, Artificial Sequence
  chemically synthesized
tttctgtagatatcagtcaata

SEQ ID NO: 1188623 - DNA, 22 bp, Artificial Sequence
  chemically synthesized
ttttctgtagatatcagtcaat

SEQ ID NO: 1188624 - DNA, 22 bp, Artificial Sequence
  chemically synthesized
tcaaaaataatattgactgata

SEQ ID NO: 1188625 - DNA, 22 bp, Artificial Sequence
  chemically synthesized
tttttctgtagatatcagtcaa

SEQ ID NO: 1188626 - DNA, 22 bp, Artificial Sequence
  chemically synthesized
caaaaataatattgactgatat

SEQ ID NO: 1188627 - DNA, 22 bp, Artificial Sequence
  chemically synthesized
ttttttctgtagatatcagtca

SEQ ID NO: 1188628 - DNA, 22 bp, Artificial Sequence
  chemically synthesized
aaaaataatattgactgatatc

SEQ ID NO: 1188629 - DNA, 22 bp, Artificial Sequence
  chemically synthesized
agtacatttttttttctgtaga

SEQ ID NO: 1188630 - DNA, 22 bp, Artificial Sequence
  chemically synthesized
gagtacatttttttttctgtag

SEQ ID NO: 1188631 - DNA, 22 bp, Artificial Sequence
  chemically synthesized
actgatatctacagaaaaaaaa

SEQ ID NO: 1188632 - DNA, 22 bp, Artificial Sequence
  chemically synthesized
atatctacagaaaaaaaaatgt

SEQ ID NO: 1188633 - DNA, 22 bp, Artificial Sequence
  chemically synthesized
agagcacttgagtacatttttt

SEQ ID NO: 1188634 - DNA, 22 bp, Artificial Sequence
  chemically synthesized
cagaaaaaaaaatgtactcaag

SEQ ID NO: 1188635 - DNA, 22 bp, Artificial Sequence
  chemically synthesized
agtctgagagcacttgagtaca

SEQ ID NO: 1188636 - DNA, 22 bp, Artificial Sequence
  chemically synthesized
tcctcagtctgagagcacttga

SEQ ID NO: 1188637 - DNA, 22 bp, Artificial Sequence
  chemically synthesized
ctatcctcagtctgagagcact

SEQ ID NO: 1188638 - DNA, 22 bp, Artificial Sequence
  chemically synthesized
cctatcctcagtctgagagcac

SEQ ID NO: 1188639 - DNA, 22 bp, Artificial Sequence
  chemically synthesized
tcctatcctcagtctgagagca

SEQ ID NO: 1188640 - DNA, 22 bp, Artificial Sequence
  chemically synthesized
ttcctatcctcagtctgagagc

SEQ ID NO: 1188641 - DNA, 22 bp, Artificial Sequence
  chemically synthesized
cttttcctatcctcagtctgag

SEQ ID NO: 1188642 - DNA, 22 bp, Artificial Sequence
  chemically synthesized
aagtgctctcagactgaggata

SEQ ID NO: 1188643 - DNA, 22 bp, Artificial Sequence
  chemically synthesized
aggagtctgcttttcctatcct

SEQ ID NO: 1188644 - DNA, 22 bp, Artificial Sequence
  chemically synthesized
taaggagtctgcttttcctatc

SEQ ID NO: 1188645 - DNA, 22 bp, Artificial Sequence
  chemically synthesized
tcagactgaggataggaaaagc

SEQ ID NO: 1188646 - DNA, 22 bp, Artificial Sequence
  chemically synthesized
agactgaggataggaaaagcag

SEQ ID NO: 1188647 - DNA, 22 bp, Artificial Sequence
  chemically synthesized
caaagttctaaggagtctgctt

SEQ ID NO: 1188648 - DNA, 22 bp, Artificial Sequence
  chemically synthesized
ccaaagttctaaggagtctgct

SEQ ID NO: 1188649 - DNA, 22 bp, Artificial Sequence
  chemically synthesized
aggataggaaaagcagactcct

SEQ ID NO: 1188650 - DNA, 22 bp, Artificial Sequence
  chemically synthesized
tgcttccaaagttctaaggagt

SEQ ID NO: 1188651 - DNA, 22 bp, Artificial Sequence
  chemically synthesized
gaagctatgcttccaaagttct

SEQ ID NO: 1188652 - DNA, 22 bp, Artificial Sequence
  chemically synthesized
ggaagctatgcttccaaagttc

SEQ ID NO: 1188653 - DNA, 22 bp, Artificial Sequence
  chemically synthesized
tggaagctatgcttccaaagtt

SEQ ID NO: 1188654 - DNA, 22 bp, Artificial Sequence
  chemically synthesized
ttggaagctatgcttccaaagt

SEQ ID NO: 1188655 - DNA, 22 bp, Artificial Sequence
  chemically synthesized
cttagaactttggaagcatagc

SEQ ID NO: 1188656 - DNA, 22 bp, Artificial Sequence
  chemically synthesized
agaactttggaagcatagcttc

SEQ ID NO: 1188657 - DNA, 22 bp, Artificial Sequence
  chemically synthesized
gaactttggaagcatagcttcc

SEQ ID NO: 1188658 - DNA, 22 bp, Artificial Sequence
  chemically synthesized
gcacaaaatttttggaagctat

SEQ ID NO: 1188659 - DNA, 22 bp, Artificial Sequence
  chemically synthesized
agcacaaaatttttggaagcta

SEQ ID NO: 1188660 - DNA, 22 bp, Artificial Sequence
  chemically synthesized
tggaagcatagcttccaaaaat

SEQ ID NO: 1188661 - DNA, 22 bp, Artificial Sequence
  chemically synthesized
ggaagcatagcttccaaaaatt

SEQ ID NO: 1188662 - DNA, 22 bp, Artificial Sequence
  chemically synthesized
gaagcatagcttccaaaaattt

SEQ ID NO: 1188663 - DNA, 22 bp, Artificial Sequence
  chemically synthesized
ccaaaaattttgtgctaagcgt

SEQ ID NO: 1188664 - DNA, 22 bp, Artificial Sequence
  chemically synthesized
caaaaattttgtgctaagcgtc

SEQ ID NO: 1188665 - DNA, 22 bp, Artificial Sequence
  chemically synthesized
aaacccccaggtatgcagacgc

SEQ ID NO: 1188666 - DNA, 22 bp, Artificial Sequence
  chemically synthesized
caaacccccaggtatgcagacg

SEQ ID NO: 1188667 - DNA, 22 bp, Artificial Sequence
  chemically synthesized
tcaaacccccaggtatgcagac

SEQ ID NO: 1188668 - DNA, 22 bp, Artificial Sequence
  chemically synthesized
tgtgctaagcgtctgcatacct

SEQ ID NO: 1188669 - DNA, 22 bp, Artificial Sequence
  chemically synthesized
gtgctaagcgtctgcatacctg

SEQ ID NO: 1188670 - DNA, 22 bp, Artificial Sequence
  chemically synthesized
tgctaagcgtctgcatacctgg

SEQ ID NO: 1188671 - DNA, 22 bp, Artificial Sequence
  chemically synthesized
aatctttcaaacccccaggtat

SEQ ID NO: 1188672 - DNA, 22 bp, Artificial Sequence
  chemically synthesized
gaatctttcaaacccccaggta

SEQ ID NO: 1188673 - DNA, 22 bp, Artificial Sequence
  chemically synthesized
agcgtctgcatacctgggggtt

SEQ ID NO: 1188674 - DNA, 22 bp, Artificial Sequence
  chemically synthesized
acacacttgaatctttcaaacc

SEQ ID NO: 1188675 - DNA, 22 bp, Artificial Sequence
  chemically synthesized
catacctgggggtttgaaagat

SEQ ID NO: 1188676 - DNA, 22 bp, Artificial Sequence
  chemically synthesized
ggggtttgaaagattcaagtgt

SEQ ID NO: 1188677 - DNA, 22 bp, Artificial Sequence
  chemically synthesized
gaaagattcaagtgtgtgaatt

SEQ ID NO: 1188678 - DNA, 22 bp, Artificial Sequence
  chemically synthesized
aaagattcaagtgtgtgaattc

SEQ ID NO: 1188679 - DNA, 22 bp, Artificial Sequence
  chemically synthesized
gtgagatgacaaggaattcaca

SEQ ID NO: 1188680 - DNA, 22 bp, Artificial Sequence
  chemically synthesized
agtgagatgacaaggaattcac

SEQ ID NO: 1188681 - DNA, 22 bp, Artificial Sequence
  chemically synthesized
tagtgagatgacaaggaattca

SEQ ID NO: 1188682 - DNA, 22 bp, Artificial Sequence
  chemically synthesized
aagtgtgtgaattccttgtcat

SEQ ID NO: 1188683 - DNA, 22 bp, Artificial Sequence
  chemically synthesized
atagttttagtgagatgacaag

SEQ ID NO: 1188684 - DNA, 22 bp, Artificial Sequence
  chemically synthesized
actcatagttttagtgagatga

SEQ ID NO: 1188685 - DNA, 22 bp, Artificial Sequence
  chemically synthesized
cttgtcatctcactaaaactat

SEQ ID NO: 1188686 - DNA, 22 bp, Artificial Sequence
  chemically synthesized
cccaccgctgactcatagtttt

SEQ ID NO: 1188687 - DNA, 22 bp, Artificial Sequence
  chemically synthesized
gtcatctcactaaaactatgag

SEQ ID NO: 1188688 - DNA, 22 bp, Artificial Sequence
  chemically synthesized
tcatctcactaaaactatgagt

SEQ ID NO: 1188689 - DNA, 22 bp, Artificial Sequence
  chemically synthesized
actaaaactatgagtcagcggt

SEQ ID NO: 1188690 - DNA, 22 bp, Artificial Sequence
  chemically synthesized
gtagaatcctacccaccgctga

SEQ ID NO: 1188691 - DNA, 22 bp, Artificial Sequence
  chemically synthesized
ggtagaatcctacccaccgctg

SEQ ID NO: 1188692 - DNA, 22 bp, Artificial Sequence
  chemically synthesized
aaactatgagtcagcggtgggt

SEQ ID NO: 1188693 - DNA, 22 bp, Artificial Sequence
  chemically synthesized
tttggtagaatcctacccaccg

SEQ ID NO: 1188694 - DNA, 22 bp, Artificial Sequence
  chemically synthesized
tgagtcagcggtgggtaggatt

SEQ ID NO: 1188695 - DNA, 22 bp, Artificial Sequence
  chemically synthesized
tcattatttggtagaatcctac

SEQ ID NO: 1188696 - DNA, 22 bp, Artificial Sequence
  chemically synthesized
caattatcattatttggtagaa

SEQ ID NO: 1188697 - DNA, 22 bp, Artificial Sequence
  chemically synthesized
acaattatcattatttggtaga

SEQ ID NO: 1188698 - DNA, 22 bp, Artificial Sequence
  chemically synthesized
tacaattatcattatttggtag

SEQ ID NO: 1188699 - DNA, 22 bp, Artificial Sequence
  chemically synthesized
ttacaattatcattatttggta

SEQ ID NO: 1188700 - DNA, 22 bp, Artificial Sequence
  chemically synthesized
tttacaattatcattatttggt

SEQ ID NO: 1188701 - DNA, 22 bp, Artificial Sequence
  chemically synthesized
aaaagcattttttacaattatc

SEQ ID NO: 1188702 - DNA, 22 bp, Artificial Sequence
  chemically synthesized
taccaaataatgataattgtaa

SEQ ID NO: 1188703 - DNA, 22 bp, Artificial Sequence
  chemically synthesized
aaaaagcattttttacaattat

SEQ ID NO: 1188704 - DNA, 22 bp, Artificial Sequence
  chemically synthesized
ccaaataatgataattgtaaaa

SEQ ID NO: 1188705 - DNA, 22 bp, Artificial Sequence
  chemically synthesized
agcttaaaaagcattttttaca

SEQ ID NO: 1188706 - DNA, 22 bp, Artificial Sequence
  chemically synthesized
atatatctgagcttaaaaagca

SEQ ID NO: 1188707 - DNA, 22 bp, Artificial Sequence
  chemically synthesized
tcatatatctgagcttaaaaag

SEQ ID NO: 1188708 - DNA, 22 bp, Artificial Sequence
  chemically synthesized
ctcatatatctgagcttaaaaa

SEQ ID NO: 1188709 - DNA, 22 bp, Artificial Sequence
  chemically synthesized
tctcatatatctgagcttaaaa

SEQ ID NO: 1188710 - DNA, 22 bp, Artificial Sequence
  chemically synthesized
taaaaaatgctttttaagctca

SEQ ID NO: 1188711 - DNA, 22 bp, Artificial Sequence
  chemically synthesized
aatccctttctcatatatctga

SEQ ID NO: 1188712 - DNA, 22 bp, Artificial Sequence
  chemically synthesized
ttgaatccctttctcatatatc

SEQ ID NO: 1188713 - DNA, 22 bp, Artificial Sequence
  chemically synthesized
attgaatccctttctcatatat

SEQ ID NO: 1188714 - DNA, 22 bp, Artificial Sequence
  chemically synthesized
tttaagctcagatatatgagaa

SEQ ID NO: 1188715 - DNA, 22 bp, Artificial Sequence
  chemically synthesized
tattgaatccctttctcatata

SEQ ID NO: 1188716 - DNA, 22 bp, Artificial Sequence
  chemically synthesized
ttaagctcagatatatgagaaa

SEQ ID NO: 1188717 - DNA, 22 bp, Artificial Sequence
  chemically synthesized
taagctcagatatatgagaaag

SEQ ID NO: 1188718 - DNA, 22 bp, Artificial Sequence
  chemically synthesized
tttattgaatccctttctcata

SEQ ID NO: 1188719 - DNA, 22 bp, Artificial Sequence
  chemically synthesized
aagctcagatatatgagaaagg

SEQ ID NO: 1188720 - DNA, 22 bp, Artificial Sequence
  chemically synthesized
ctttattgaatccctttctcat

SEQ ID NO: 1188721 - DNA, 22 bp, Artificial Sequence
  chemically synthesized
agctcagatatatgagaaaggg

SEQ ID NO: 1188722 - DNA, 22 bp, Artificial Sequence
  chemically synthesized
tttctttattgaatccctttct

SEQ ID NO: 1188723 - DNA, 22 bp, Artificial Sequence
  chemically synthesized
gtttctttattgaatccctttc

SEQ ID NO: 1188724 - DNA, 22 bp, Artificial Sequence
  chemically synthesized
tgtttctttattgaatcccttt

SEQ ID NO: 1188725 - DNA, 22 bp, Artificial Sequence
  chemically synthesized
agatatatgagaaagggattca

SEQ ID NO: 1188726 - DNA, 22 bp, Artificial Sequence
  chemically synthesized
ttgtttctttattgaatccctt

SEQ ID NO: 1188727 - DNA, 22 bp, Artificial Sequence
  chemically synthesized
ggtttttgtttctttattgaat

SEQ ID NO: 1188728 - DNA, 22 bp, Artificial Sequence
  chemically synthesized
aataaagaaacaaaaacctagg

SEQ ID NO: 1188729 - DNA, 22 bp, Artificial Sequence
  chemically synthesized
taaatgtgtgtataccatccta

SEQ ID NO: 1188730 - DNA, 22 bp, Artificial Sequence
  chemically synthesized
ataaatgtgtgtataccatcct

SEQ ID NO: 1188731 - DNA, 22 bp, Artificial Sequence
  chemically synthesized
tttataaatgtgtgtataccat

SEQ ID NO: 1188732 - DNA, 22 bp, Artificial Sequence
  chemically synthesized
ggatggtatacacacatttata

SEQ ID NO: 1188733 - DNA, 22 bp, Artificial Sequence
  chemically synthesized
gtgatcatattgtttataaatg

SEQ ID NO: 1188734 - DNA, 22 bp, Artificial Sequence
  chemically synthesized
tatattagtgatcatattgttt

SEQ ID NO: 1188735 - DNA, 22 bp, Artificial Sequence
  chemically synthesized
tagttatatattagtgatcata

SEQ ID NO: 1188736 - DNA, 22 bp, Artificial Sequence
  chemically synthesized
ataaacaatatgatcactaata

SEQ ID NO: 1188737 - DNA, 22 bp, Artificial Sequence
  chemically synthesized
taaacaatatgatcactaatat

SEQ ID NO: 1188738 - DNA, 22 bp, Artificial Sequence
  chemically synthesized
catgcatattatagttatatat

SEQ ID NO: 1188739 - DNA, 22 bp, Artificial Sequence
  chemically synthesized
gcatgcatattatagttatata

SEQ ID NO: 1188740 - DNA, 22 bp, Artificial Sequence
  chemically synthesized
atatataactataatatgcatg

SEQ ID NO: 1188741 - DNA, 22 bp, Artificial Sequence
  chemically synthesized
caaatatgtaatgtttgcatgc

SEQ ID NO: 1188742 - DNA, 22 bp, Artificial Sequence
  chemically synthesized
ccaaatatgtaatgtttgcatg

SEQ ID NO: 1188743 - DNA, 22 bp, Artificial Sequence
  chemically synthesized
tccaaatatgtaatgtttgcat

SEQ ID NO: 1188744 - DNA, 22 bp, Artificial Sequence
  chemically synthesized
ctttccaaatatgtaatgtttg

SEQ ID NO: 1188745 - DNA, 22 bp, Artificial Sequence
  chemically synthesized
taatatgcatgcaaacattaca

SEQ ID NO: 1188746 - DNA, 22 bp, Artificial Sequence
  chemically synthesized
gtcaaagggagttgctttccaa

SEQ ID NO: 1188747 - DNA, 22 bp, Artificial Sequence
  chemically synthesized
catatttggaaagcaactccct

SEQ ID NO: 1188748 - DNA, 22 bp, Artificial Sequence
  chemically synthesized
atatctagtcaaagggagttgc

SEQ ID NO: 1188749 - DNA, 22 bp, Artificial Sequence
  chemically synthesized
ctaatatctagtcaaagggagt

SEQ ID NO: 1188750 - DNA, 22 bp, Artificial Sequence
  chemically synthesized
ggaaagcaactccctttgacta

SEQ ID NO: 1188751 - DNA, 22 bp, Artificial Sequence
  chemically synthesized
gaaagcaactccctttgactag

SEQ ID NO: 1188752 - DNA, 22 bp, Artificial Sequence
  chemically synthesized
aagttgctaatatctagtcaaa

SEQ ID NO: 1188753 - DNA, 22 bp, Artificial Sequence
  chemically synthesized
gaagttgctaatatctagtcaa

SEQ ID NO: 1188754 - DNA, 22 bp, Artificial Sequence
  chemically synthesized
tgaagttgctaatatctagtca

SEQ ID NO: 1188755 - DNA, 22 bp, Artificial Sequence
  chemically synthesized
gtctttgaagttgctaatatct

SEQ ID NO: 1188756 - DNA, 22 bp, Artificial Sequence
  chemically synthesized
agtctttgaagttgctaatatc

SEQ ID NO: 1188757 - DNA, 22 bp, Artificial Sequence
  chemically synthesized
cctttgactagatattagcaac

SEQ ID NO: 1188758 - DNA, 22 bp, Artificial Sequence
  chemically synthesized
tttagtctttgaagttgctaat

SEQ ID NO: 1188759 - DNA, 22 bp, Artificial Sequence
  chemically synthesized
tatttagtctttgaagttgcta

SEQ ID NO: 1188760 - DNA, 22 bp, Artificial Sequence
  chemically synthesized
tgactagatattagcaacttca

SEQ ID NO: 1188761 - DNA, 22 bp, Artificial Sequence
  chemically synthesized
gactagatattagcaacttcaa

SEQ ID NO: 1188762 - DNA, 22 bp, Artificial Sequence
  chemically synthesized
tctatttagtctttgaagttgc

SEQ ID NO: 1188763 - DNA, 22 bp, Artificial Sequence
  chemically synthesized
actagatattagcaacttcaaa

SEQ ID NO: 1188764 - DNA, 22 bp, Artificial Sequence
  chemically synthesized
ctctatttagtctttgaagttg

SEQ ID NO: 1188765 - DNA, 22 bp, Artificial Sequence
  chemically synthesized
tctctatttagtctttgaagtt

SEQ ID NO: 1188766 - DNA, 22 bp, Artificial Sequence
  chemically synthesized
ttctctatttagtctttgaagt

SEQ ID NO: 1188767 - DNA, 22 bp, Artificial Sequence
  chemically synthesized
gatattagcaacttcaaagact

SEQ ID NO: 1188768 - DNA, 22 bp, Artificial Sequence
  chemically synthesized
cttttctctatttagtctttga

SEQ ID NO: 1188769 - DNA, 22 bp, Artificial Sequence
  chemically synthesized
ccttttctctatttagtctttg

SEQ ID NO: 1188770 - DNA, 22 bp, Artificial Sequence
  chemically synthesized
tccttttctctatttagtcttt

SEQ ID NO: 1188771 - DNA, 22 bp, Artificial Sequence
  chemically synthesized
gcaacttcaaagactaaataga

SEQ ID NO: 1188772 - DNA, 22 bp, Artificial Sequence
  chemically synthesized
caaagactaaatagagaaaagg

SEQ ID NO: 1188773 - DNA, 22 bp, Artificial Sequence
  chemically synthesized
cgcaaagcctttccttttctct

SEQ ID NO: 1188774 - DNA, 22 bp, Artificial Sequence
  chemically synthesized
aaagactaaatagagaaaagga

SEQ ID NO: 1188775 - DNA, 22 bp, Artificial Sequence
  chemically synthesized
tacgcaaagcctttccttttct

SEQ ID NO: 1188776 - DNA, 22 bp, Artificial Sequence
  chemically synthesized
aatagagaaaaggaaaggcttt

SEQ ID NO: 1188777 - DNA, 22 bp, Artificial Sequence
  chemically synthesized
aaatagcagtaagattctacgc

SEQ ID NO: 1188778 - DNA, 22 bp, Artificial Sequence
  chemically synthesized
agtaattaaaatagcagtaaga

SEQ ID NO: 1188779 - DNA, 22 bp, Artificial Sequence
  chemically synthesized
tgcgtagaatcttactgctatt

SEQ ID NO: 1188780 - DNA, 22 bp, Artificial Sequence
  chemically synthesized
gcgtagaatcttactgctattt

SEQ ID NO: 1188781 - DNA, 22 bp, Artificial Sequence
  chemically synthesized
cgtagaatcttactgctatttt

SEQ ID NO: 1188782 - DNA, 22 bp, Artificial Sequence
  chemically synthesized
actgctattttaattactgaat

SEQ ID NO: 1188783 - DNA, 22 bp, Artificial Sequence
  chemically synthesized
ctgctattttaattactgaatg

SEQ ID NO: 1188784 - DNA, 22 bp, Artificial Sequence
  chemically synthesized
ctattttaattactgaatgttc

SEQ ID NO: 1188785 - DNA, 22 bp, Artificial Sequence
  chemically synthesized
caaatggacaaaaggaacattc

SEQ ID NO: 1188786 - DNA, 22 bp, Artificial Sequence
  chemically synthesized
ttttaattactgaatgttcctt

SEQ ID NO: 1188787 - DNA, 22 bp, Artificial Sequence
  chemically synthesized
taattactgaatgttccttttg

SEQ ID NO: 1188788 - DNA, 22 bp, Artificial Sequence
  chemically synthesized
aattactgaatgttccttttgt

SEQ ID NO: 1188789 - DNA, 22 bp, Artificial Sequence
  chemically synthesized
attactgaatgttccttttgtc

SEQ ID NO: 1188790 - DNA, 22 bp, Artificial Sequence
  chemically synthesized
aaattgcaaatggacaaaagga

SEQ ID NO: 1188791 - DNA, 22 bp, Artificial Sequence
  chemically synthesized
aaaattgcaaatggacaaaagg

SEQ ID NO: 1188792 - DNA, 22 bp, Artificial Sequence
  chemically synthesized
taaaattgcaaatggacaaaag

SEQ ID NO: 1188793 - DNA, 22 bp, Artificial Sequence
  chemically synthesized
ctgaatgttccttttgtccatt

SEQ ID NO: 1188794 - DNA, 22 bp, Artificial Sequence
  chemically synthesized
aatgttccttttgtccatttgc

SEQ ID NO: 1188795 - DNA, 22 bp, Artificial Sequence
  chemically synthesized
cttttgtccatttgcaatttta

SEQ ID NO: 1188796 - DNA, 22 bp, Artificial Sequence
  chemically synthesized
ttgtccatttgcaattttaaaa

SEQ ID NO: 1188797 - DNA, 22 bp, Artificial Sequence
  chemically synthesized
tgtccatttgcaattttaaaat

SEQ ID NO: 1188798 - DNA, 22 bp, Artificial Sequence
  chemically synthesized
gtccatttgcaattttaaaatt

SEQ ID NO: 1188799 - DNA, 22 bp, Artificial Sequence
  chemically synthesized
tccatttgcaattttaaaattt

SEQ ID NO: 1188800 - DNA, 22 bp, Artificial Sequence
  chemically synthesized
agaaaaggaaagaagaaatttt

SEQ ID NO: 1188801 - DNA, 22 bp, Artificial Sequence
  chemically synthesized
gcaattttaaaatttcttcttt

SEQ ID NO: 1188802 - DNA, 22 bp, Artificial Sequence
  chemically synthesized
caattttaaaatttcttctttc

SEQ ID NO: 1188803 - DNA, 22 bp, Artificial Sequence
  chemically synthesized
taaaatttcttctttccttttc

SEQ ID NO: 1188804 - DNA, 22 bp, Artificial Sequence
  chemically synthesized
aaaatttcttctttccttttct

SEQ ID NO: 1188805 - DNA, 22 bp, Artificial Sequence
  chemically synthesized
atccagccactgagaaaaggaa

SEQ ID NO: 1188806 - DNA, 22 bp, Artificial Sequence
  chemically synthesized
aaatttcttctttccttttctc

SEQ ID NO: 1188807 - DNA, 22 bp, Artificial Sequence
  chemically synthesized
accctcatccagccactgagaa

SEQ ID NO: 1188808 - DNA, 22 bp, Artificial Sequence
  chemically synthesized
cttctttccttttctcagtggc

SEQ ID NO: 1188809 - DNA, 22 bp, Artificial Sequence
  chemically synthesized
aaccctcatccagccactgaga

SEQ ID NO: 1188810 - DNA, 22 bp, Artificial Sequence
  chemically synthesized
ttctttccttttctcagtggct

SEQ ID NO: 1188811 - DNA, 22 bp, Artificial Sequence
  chemically synthesized
taaccctcatccagccactgag

SEQ ID NO: 1188812 - DNA, 22 bp, Artificial Sequence
  chemically synthesized
ctttccttttctcagtggctgg

SEQ ID NO: 1188813 - DNA, 22 bp, Artificial Sequence
  chemically synthesized
tttccttttctcagtggctgga

SEQ ID NO: 1188814 - DNA, 22 bp, Artificial Sequence
  chemically synthesized
tccttttctcagtggctggatg

SEQ ID NO: 1188815 - DNA, 22 bp, Artificial Sequence
  chemically synthesized
ccttttctcagtggctggatga

SEQ ID NO: 1188816 - DNA, 22 bp, Artificial Sequence
  chemically synthesized
cttttctcagtggctggatgag

SEQ ID NO: 1188817 - DNA, 22 bp, Artificial Sequence
  chemically synthesized
ttctcagtggctggatgagggt

SEQ ID NO: 1188818 - DNA, 22 bp, Artificial Sequence
  chemically synthesized
tctcagtggctggatgagggtt

SEQ ID NO: 1188819 - DNA, 22 bp, Artificial Sequence
  chemically synthesized
ctcagtggctggatgagggtta

SEQ ID NO: 1188820 - DNA, 22 bp, Artificial Sequence
  chemically synthesized
gcatatcagttttaaccctcat

SEQ ID NO: 1188821 - DNA, 22 bp, Artificial Sequence
  chemically synthesized
tcagtggctggatgagggttaa

SEQ ID NO: 1188822 - DNA, 22 bp, Artificial Sequence
  chemically synthesized
agcatatcagttttaaccctca

SEQ ID NO: 1188823 - DNA, 22 bp, Artificial Sequence
  chemically synthesized
agtggctggatgagggttaaaa

SEQ ID NO: 1188824 - DNA, 22 bp, Artificial Sequence
  chemically synthesized
gatgagggttaaaactgatatg

SEQ ID NO: 1188825 - DNA, 22 bp, Artificial Sequence
  chemically synthesized
tgtggtatttagcatatcagtt

SEQ ID NO: 1188826 - DNA, 22 bp, Artificial Sequence
  chemically synthesized
aaactgatatgctaaataccac

SEQ ID NO: 1188827 - DNA, 22 bp, Artificial Sequence
  chemically synthesized
atatgctaaataccacataacc

SEQ ID NO: 1188828 - DNA, 22 bp, Artificial Sequence
  chemically synthesized
taccaagaaaatgggttatgtg

SEQ ID NO: 1188829 - DNA, 22 bp, Artificial Sequence
  chemically synthesized
aataccacataacccattttct

SEQ ID NO: 1188830 - DNA, 22 bp, Artificial Sequence
  chemically synthesized
gaagctataccaagaaaatggg

SEQ ID NO: 1188831 - DNA, 22 bp, Artificial Sequence
  chemically synthesized
agagtcaagaagaactggaagc

SEQ ID NO: 1188832 - DNA, 22 bp, Artificial Sequence
  chemically synthesized
cagagtcaagaagaactggaag

SEQ ID NO: 1188833 - DNA, 22 bp, Artificial Sequence
  chemically synthesized
tcttggtatagcttccagttct

SEQ ID NO: 1188834 - DNA, 22 bp, Artificial Sequence
  chemically synthesized
cttggtatagcttccagttctt

SEQ ID NO: 1188835 - DNA, 22 bp, Artificial Sequence
  chemically synthesized
ttggtatagcttccagttcttc

SEQ ID NO: 1188836 - DNA, 22 bp, Artificial Sequence
  chemically synthesized
ggtatagcttccagttcttctt

SEQ ID NO: 1188837 - DNA, 22 bp, Artificial Sequence
  chemically synthesized
gtatagcttccagttcttcttg

SEQ ID NO: 1188838 - DNA, 22 bp, Artificial Sequence
  chemically synthesized
ccagttcttcttgactctgaaa

SEQ ID NO: 1188839 - DNA, 22 bp, Artificial Sequence
  chemically synthesized
cagttcttcttgactctgaaat

SEQ ID NO: 1188840 - DNA, 22 bp, Artificial Sequence
  chemically synthesized
agagaggccgacatttcagagt

SEQ ID NO: 1188841 - DNA, 22 bp, Artificial Sequence
  chemically synthesized
gagagaggccgacatttcagag

SEQ ID NO: 1188842 - DNA, 22 bp, Artificial Sequence
  chemically synthesized
ttcttgactctgaaatgtcggc

SEQ ID NO: 1188843 - DNA, 22 bp, Artificial Sequence
  chemically synthesized
cttgactctgaaatgtcggcct

SEQ ID NO: 1188844 - DNA, 22 bp, Artificial Sequence
  chemically synthesized
ttgactctgaaatgtcggcctc

SEQ ID NO: 1188845 - DNA, 22 bp, Artificial Sequence
  chemically synthesized
gactctgaaatgtcggcctctc

SEQ ID NO: 1188846 - DNA, 22 bp, Artificial Sequence
  chemically synthesized
actctgaaatgtcggcctctct

SEQ ID NO: 1188847 - DNA, 22 bp, Artificial Sequence
  chemically synthesized
agggagaggtatttgagagagg

SEQ ID NO: 1188848 - DNA, 22 bp, Artificial Sequence
  chemically synthesized
tgaaatgtcggcctctctcaaa

SEQ ID NO: 1188849 - DNA, 22 bp, Artificial Sequence
  chemically synthesized
aaatgtcggcctctctcaaata

SEQ ID NO: 1188850 - DNA, 22 bp, Artificial Sequence
  chemically synthesized
cctgagggagaggtatttgaga

SEQ ID NO: 1188851 - DNA, 22 bp, Artificial Sequence
  chemically synthesized
tacctgagggagaggtatttga

SEQ ID NO: 1188852 - DNA, 22 bp, Artificial Sequence
  chemically synthesized
gtagagctctacctgagggaga

SEQ ID NO: 1188853 - DNA, 22 bp, Artificial Sequence
  chemically synthesized
tctcaaatacctctccctcagg

SEQ ID NO: 1188854 - DNA, 22 bp, Artificial Sequence
  chemically synthesized
tcaaatacctctccctcaggta

SEQ ID NO: 1188855 - DNA, 22 bp, Artificial Sequence
  chemically synthesized
ctagtagagctctacctgaggg

SEQ ID NO: 1188856 - DNA, 22 bp, Artificial Sequence
  chemically synthesized
aaatacctctccctcaggtaga

SEQ ID NO: 1188857 - DNA, 22 bp, Artificial Sequence
  chemically synthesized
tccctcaggtagagctctacta

SEQ ID NO: 1188858 - DNA, 22 bp, Artificial Sequence
  chemically synthesized
cctcaggtagagctctactagc

SEQ ID NO: 1188859 - DNA, 22 bp, Artificial Sequence
  chemically synthesized
aggtagagctctactagcaggg

SEQ ID NO: 1188860 - DNA, 22 bp, Artificial Sequence
  chemically synthesized
gtcatcaggaaagacaggcccc

SEQ ID NO: 1188861 - DNA, 22 bp, Artificial Sequence
  chemically synthesized
tggtcatcaggaaagacaggcc

SEQ ID NO: 1188862 - DNA, 22 bp, Artificial Sequence
  chemically synthesized
ctggtcatcaggaaagacaggc

SEQ ID NO: 1188863 - DNA, 22 bp, Artificial Sequence
  chemically synthesized
tactagcaggggcctgtctttc

SEQ ID NO: 1188864 - DNA, 22 bp, Artificial Sequence
  chemically synthesized
ctagcaggggcctgtctttcct

SEQ ID NO: 1188865 - DNA, 22 bp, Artificial Sequence
  chemically synthesized
ggtttctggtcatcaggaaaga

SEQ ID NO: 1188866 - DNA, 22 bp, Artificial Sequence
  chemically synthesized
gcaggggcctgtctttcctgat

SEQ ID NO: 1188867 - DNA, 22 bp, Artificial Sequence
  chemically synthesized
tctttcctgatgaccagaaacc

SEQ ID NO: 1188868 - DNA, 22 bp, Artificial Sequence
  chemically synthesized
taccaagcccctgggtttctgg

SEQ ID NO: 1188869 - DNA, 22 bp, Artificial Sequence
  chemically synthesized
tcctgatgaccagaaacccagg

SEQ ID NO: 1188870 - DNA, 22 bp, Artificial Sequence
  chemically synthesized
cctgatgaccagaaacccaggg

SEQ ID NO: 1188871 - DNA, 22 bp, Artificial Sequence
  chemically synthesized
ctgatgaccagaaacccagggg

SEQ ID NO: 1188872 - DNA, 22 bp, Artificial Sequence
  chemically synthesized
atgaccagaaacccaggggctt

SEQ ID NO: 1188873 - DNA, 22 bp, Artificial Sequence
  chemically synthesized
agatagttataccaagcccctg

SEQ ID NO: 1188874 - DNA, 22 bp, Artificial Sequence
  chemically synthesized
cataggatatagtaattgagat

SEQ ID NO: 1188875 - DNA, 22 bp, Artificial Sequence
  chemically synthesized
ggtataactatctcaattacta

SEQ ID NO: 1188876 - DNA, 22 bp, Artificial Sequence
  chemically synthesized
gtataactatctcaattactat

SEQ ID NO: 1188877 - DNA, 22 bp, Artificial Sequence
  chemically synthesized
tctcaattactatatcctatgg

SEQ ID NO: 1188878 - DNA, 22 bp, Artificial Sequence
  chemically synthesized
aattactatatcctatggagcc

SEQ ID NO: 1188879 - DNA, 22 bp, Artificial Sequence
  chemically synthesized
tgataaggagtcaggctccata

SEQ ID NO: 1188880 - DNA, 22 bp, Artificial Sequence
  chemically synthesized
ctatatcctatggagcctgact

SEQ ID NO: 1188881 - DNA, 22 bp, Artificial Sequence
  chemically synthesized
gagctatgataaggagtcaggc

SEQ ID NO: 1188882 - DNA, 22 bp, Artificial Sequence
  chemically synthesized
tatcctatggagcctgactcct

SEQ ID NO: 1188883 - DNA, 22 bp, Artificial Sequence
  chemically synthesized
tggagcctgactccttatcata

SEQ ID NO: 1188884 - DNA, 22 bp, Artificial Sequence
  chemically synthesized
actccttatcatagctccagtc

SEQ ID NO: 1188885 - DNA, 22 bp, Artificial Sequence
  chemically synthesized
cttatcatagctccagtcccca

SEQ ID NO: 1188886 - DNA, 22 bp, Artificial Sequence
  chemically synthesized
atcatagctccagtccccatat

SEQ ID NO: 1188887 - DNA, 22 bp, Artificial Sequence
  chemically synthesized
tcatagctccagtccccatatg

SEQ ID NO: 1188888 - DNA, 22 bp, Artificial Sequence
  chemically synthesized
gtcaatccaagatcagagccca

SEQ ID NO: 1188889 - DNA, 22 bp, Artificial Sequence
  chemically synthesized
cagtccccatatgggctctgat

SEQ ID NO: 1188890 - DNA, 22 bp, Artificial Sequence
  chemically synthesized
tgatcttggattgaccagatgg

SEQ ID NO: 1188891 - DNA, 22 bp, Artificial Sequence
  chemically synthesized
atcttggattgaccagatgggt

SEQ ID NO: 1188892 - DNA, 22 bp, Artificial Sequence
  chemically synthesized
ggattgaccagatgggtcattt

SEQ ID NO: 1188893 - DNA, 22 bp, Artificial Sequence
  chemically synthesized
agataagagtggaaatgaccca

SEQ ID NO: 1188894 - DNA, 22 bp, Artificial Sequence
  chemically synthesized
gattgaccagatgggtcatttc

SEQ ID NO: 1188895 - DNA, 22 bp, Artificial Sequence
  chemically synthesized
accagatgggtcatttccactc

SEQ ID NO: 1188896 - DNA, 22 bp, Artificial Sequence
  chemically synthesized
ccattgagataagagtggaaat

SEQ ID NO: 1188897 - DNA, 22 bp, Artificial Sequence
  chemically synthesized
ccactcttatctcaatgggaac

SEQ ID NO: 1188898 - DNA, 22 bp, Artificial Sequence
  chemically synthesized
atcaaggggcacgttcccattg

SEQ ID NO: 1188899 - DNA, 22 bp, Artificial Sequence
  chemically synthesized
cactcttatctcaatgggaacg

SEQ ID NO: 1188900 - DNA, 22 bp, Artificial Sequence
  chemically synthesized
ctaatcaaggggcacgttccca

SEQ ID NO: 1188901 - DNA, 22 bp, Artificial Sequence
  chemically synthesized
cctaatcaaggggcacgttccc

SEQ ID NO: 1188902 - DNA, 22 bp, Artificial Sequence
  chemically synthesized
tcctaatcaaggggcacgttcc

SEQ ID NO: 1188903 - DNA, 22 bp, Artificial Sequence
  chemically synthesized
ttatctcaatgggaacgtgccc

SEQ ID NO: 1188904 - DNA, 22 bp, Artificial Sequence
  chemically synthesized
atctcaatgggaacgtgcccct

SEQ ID NO: 1188905 - DNA, 22 bp, Artificial Sequence
  chemically synthesized
tctcaatgggaacgtgcccctt

SEQ ID NO: 1188906 - DNA, 22 bp, Artificial Sequence
  chemically synthesized
aatgggaacgtgccccttgatt

SEQ ID NO: 1188907 - DNA, 22 bp, Artificial Sequence
  chemically synthesized
agggaaagctttcctaatcaag

SEQ ID NO: 1188908 - DNA, 22 bp, Artificial Sequence
  chemically synthesized
tgagggaaagctttcctaatca

SEQ ID NO: 1188909 - DNA, 22 bp, Artificial Sequence
  chemically synthesized
tctgagggaaagctttcctaat

SEQ ID NO: 1188910 - DNA, 22 bp, Artificial Sequence
  chemically synthesized
ctctgagggaaagctttcctaa

SEQ ID NO: 1188911 - DNA, 22 bp, Artificial Sequence
  chemically synthesized
tctctgagggaaagctttccta

SEQ ID NO: 1188912 - DNA, 22 bp, Artificial Sequence
  chemically synthesized
gattaggaaagctttccctcag

SEQ ID NO: 1188913 - DNA, 22 bp, Artificial Sequence
  chemically synthesized
attaggaaagctttccctcaga

SEQ ID NO: 1188914 - DNA, 22 bp, Artificial Sequence
  chemically synthesized
ggaaagctttccctcagagaaa

SEQ ID NO: 1188915 - DNA, 22 bp, Artificial Sequence
  chemically synthesized
tccctcagagaaaacacatccc

SEQ ID NO: 1188916 - DNA, 22 bp, Artificial Sequence
  chemically synthesized
ccctcagagaaaacacatccca

SEQ ID NO: 1188917 - DNA, 22 bp, Artificial Sequence
  chemically synthesized
cctcagagaaaacacatcccat

SEQ ID NO: 1188918 - DNA, 22 bp, Artificial Sequence
  chemically synthesized
gggccaaaaccgtcaatgggat

SEQ ID NO: 1188919 - DNA, 22 bp, Artificial Sequence
  chemically synthesized
agagaaaacacatcccattgac

SEQ ID NO: 1188920 - DNA, 22 bp, Artificial Sequence
  chemically synthesized
ggggccaaaaccgtcaatggga

SEQ ID NO: 1188921 - DNA, 22 bp, Artificial Sequence
  chemically synthesized
ttggggccaaaaccgtcaatgg

SEQ ID NO: 1188922 - DNA, 22 bp, Artificial Sequence
  chemically synthesized
aactcttggggccaaaaccgtc

SEQ ID NO: 1188923 - DNA, 22 bp, Artificial Sequence
  chemically synthesized
acggttgaactcttggggccaa

SEQ ID NO: 1188924 - DNA, 22 bp, Artificial Sequence
  chemically synthesized
acggttttggccccaagagttc

SEQ ID NO: 1188925 - DNA, 22 bp, Artificial Sequence
  chemically synthesized
tggccccaagagttcaaccgtt

SEQ ID NO: 1188926 - DNA, 22 bp, Artificial Sequence
  chemically synthesized
ggccccaagagttcaaccgtta

SEQ ID NO: 1188927 - DNA, 22 bp, Artificial Sequence
  chemically synthesized
gccccaagagttcaaccgttag

SEQ ID NO: 1188928 - DNA, 22 bp, Artificial Sequence
  chemically synthesized
aaatatcaaagacaactaacgg

SEQ ID NO: 1188929 - DNA, 22 bp, Artificial Sequence
  chemically synthesized
tgaaattaaaatatcaaagaca

SEQ ID NO: 1188930 - DNA, 22 bp, Artificial Sequence
  chemically synthesized
atgaaattaaaatatcaaagac

SEQ ID NO: 1188931 - DNA, 22 bp, Artificial Sequence
  chemically synthesized
aaccgttagttgtctttgatat

SEQ ID NO: 1188932 - DNA, 22 bp, Artificial Sequence
  chemically synthesized
gttgtctttgatattttaattt

SEQ ID NO: 1188933 - DNA, 22 bp, Artificial Sequence
  chemically synthesized
aatccagacttatgaaattaaa

SEQ ID NO: 1188934 - DNA, 22 bp, Artificial Sequence
  chemically synthesized
tctttgatattttaatttcata

SEQ ID NO: 1188935 - DNA, 22 bp, Artificial Sequence
  chemically synthesized
tgatattttaatttcataagtc

SEQ ID NO: 1188936 - DNA, 22 bp, Artificial Sequence
  chemically synthesized
gatattttaatttcataagtct

SEQ ID NO: 1188937 - DNA, 22 bp, Artificial Sequence
  chemically synthesized
atattttaatttcataagtctg

SEQ ID NO: 1188938 - DNA, 22 bp, Artificial Sequence
  chemically synthesized
taatttcataagtctggattta

SEQ ID NO: 1188939 - DNA, 22 bp, Artificial Sequence
  chemically synthesized
aaagtgagagattaaatccaga

SEQ ID NO: 1188940 - DNA, 22 bp, Artificial Sequence
  chemically synthesized
aatttcataagtctggatttaa

SEQ ID NO: 1188941 - DNA, 22 bp, Artificial Sequence
  chemically synthesized
aaaagtgagagattaaatccag

SEQ ID NO: 1188942 - DNA, 22 bp, Artificial Sequence
  chemically synthesized
atttcataagtctggatttaat

SEQ ID NO: 1188943 - DNA, 22 bp, Artificial Sequence
  chemically synthesized
cataagtctggatttaatctct

SEQ ID NO: 1188944 - DNA, 22 bp, Artificial Sequence
  chemically synthesized
ataagtctggatttaatctctc

SEQ ID NO: 1188945 - DNA, 22 bp, Artificial Sequence
  chemically synthesized
taataaaatgtttaaaagtgag

SEQ ID NO: 1188946 - DNA, 22 bp, Artificial Sequence
  chemically synthesized
gtaataaaatgtttaaaagtga

SEQ ID NO: 1188947 - DNA, 22 bp, Artificial Sequence
  chemically synthesized
gatttaatctctcacttttaaa

SEQ ID NO: 1188948 - DNA, 22 bp, Artificial Sequence
  chemically synthesized
tgtaataaaatgtttaaaagtg

SEQ ID NO: 1188949 - DNA, 22 bp, Artificial Sequence
  chemically synthesized
ttgtaataaaatgtttaaaagt

SEQ ID NO: 1188950 - DNA, 22 bp, Artificial Sequence
  chemically synthesized
aatctctcacttttaaacattt

SEQ ID NO: 1188951 - DNA, 22 bp, Artificial Sequence
  chemically synthesized
atctctcacttttaaacatttt

SEQ ID NO: 1188952 - DNA, 22 bp, Artificial Sequence
  chemically synthesized
tcacttttaaacattttattac

SEQ ID NO: 1188953 - DNA, 22 bp, Artificial Sequence
  chemically synthesized
acttttaaacattttattacaa

SEQ ID NO: 1188954 - DNA, 22 bp, Artificial Sequence
  chemically synthesized
ttaaacattttattacaaaagc

SEQ ID NO: 1188955 - DNA, 22 bp, Artificial Sequence
  chemically synthesized
taaacattttattacaaaagcc

SEQ ID NO: 1188956 - DNA, 22 bp, Artificial Sequence
  chemically synthesized
aaacattttattacaaaagcca

SEQ ID NO: 1188957 - DNA, 22 bp, Artificial Sequence
  chemically synthesized
aacattttattacaaaagccat

SEQ ID NO: 1188958 - DNA, 22 bp, Artificial Sequence
  chemically synthesized
caataagcatgtatggcttttg

SEQ ID NO: 1188959 - DNA, 22 bp, Artificial Sequence
  chemically synthesized
cactacaataagcatgtatggc

SEQ ID NO: 1188960 - DNA, 22 bp, Artificial Sequence
  chemically synthesized
ccactacaataagcatgtatgg

SEQ ID NO: 1188961 - DNA, 22 bp, Artificial Sequence
  chemically synthesized
tattacaaaagccatacatgct

SEQ ID NO: 1188962 - DNA, 22 bp, Artificial Sequence
  chemically synthesized
tccactacaataagcatgtatg

SEQ ID NO: 1188963 - DNA, 22 bp, Artificial Sequence
  chemically synthesized
attacaaaagccatacatgctt

SEQ ID NO: 1188964 - DNA, 22 bp, Artificial Sequence
  chemically synthesized
ttacaaaagccatacatgctta

SEQ ID NO: 1188965 - DNA, 22 bp, Artificial Sequence
  chemically synthesized
gttttccactacaataagcatg

SEQ ID NO: 1188966 - DNA, 22 bp, Artificial Sequence
  chemically synthesized
caaaagccatacatgcttattg

SEQ ID NO: 1188967 - DNA, 22 bp, Artificial Sequence
  chemically synthesized
agttttccactacaataagcat

SEQ ID NO: 1188968 - DNA, 22 bp, Artificial Sequence
  chemically synthesized
tagttttccactacaataagca

SEQ ID NO: 1188969 - DNA, 22 bp, Artificial Sequence
  chemically synthesized
ttttagttttccactacaataa

SEQ ID NO: 1188970 - DNA, 22 bp, Artificial Sequence
  chemically synthesized
tactgttttagttttccactac

SEQ ID NO: 1188971 - DNA, 22 bp, Artificial Sequence
  chemically synthesized
attgtagtggaaaactaaaaca

SEQ ID NO: 1188972 - DNA, 22 bp, Artificial Sequence
  chemically synthesized
ttgtagtggaaaactaaaacag

SEQ ID NO: 1188973 - DNA, 22 bp, Artificial Sequence
  chemically synthesized
aatgcgtctgtactgttttagt

SEQ ID NO: 1188974 - DNA, 22 bp, Artificial Sequence
  chemically synthesized
aaatgcgtctgtactgttttag

SEQ ID NO: 1188975 - DNA, 22 bp, Artificial Sequence
  chemically synthesized
taaatgcgtctgtactgtttta

SEQ ID NO: 1188976 - DNA, 22 bp, Artificial Sequence
  chemically synthesized
tagtggaaaactaaaacagtac

SEQ ID NO: 1188977 - DNA, 22 bp, Artificial Sequence
  chemically synthesized
actttaaatgcgtctgtactgt

SEQ ID NO: 1188978 - DNA, 22 bp, Artificial Sequence
  chemically synthesized
ttaactttaaatgcgtctgtac

SEQ ID NO: 1188979 - DNA, 22 bp, Artificial Sequence
  chemically synthesized
actattaactttaaatgcgtct

SEQ ID NO: 1188980 - DNA, 22 bp, Artificial Sequence
  chemically synthesized
cactattaactttaaatgcgtc

SEQ ID NO: 1188981 - DNA, 22 bp, Artificial Sequence
  chemically synthesized
tcactattaactttaaatgcgt

SEQ ID NO: 1188982 - DNA, 22 bp, Artificial Sequence
  chemically synthesized
aaacagtacagacgcatttaaa

SEQ ID NO: 1188983 - DNA, 22 bp, Artificial Sequence
  chemically synthesized
tagagatatggggtactttcac

SEQ ID NO: 1188984 - DNA, 22 bp, Artificial Sequence
  chemically synthesized
aaagttaatagtgaaagtaccc

SEQ ID NO: 1188985 - DNA, 22 bp, Artificial Sequence
  chemically synthesized
aagttaatagtgaaagtacccc

SEQ ID NO: 1188986 - DNA, 22 bp, Artificial Sequence
  chemically synthesized
tggtgctgtagagatatggggt

SEQ ID NO: 1188987 - DNA, 22 bp, Artificial Sequence
  chemically synthesized
atagtgaaagtaccccatatct

SEQ ID NO: 1188988 - DNA, 22 bp, Artificial Sequence
  chemically synthesized
atgggactgtggtgctgtagag

SEQ ID NO: 1188989 - DNA, 22 bp, Artificial Sequence
  chemically synthesized
gctaatgggactgtggtgctgt

SEQ ID NO: 1188990 - DNA, 22 bp, Artificial Sequence
  chemically synthesized
tagctaatgggactgtggtgct

SEQ ID NO: 1188991 - DNA, 22 bp, Artificial Sequence
  chemically synthesized
ctagctaatgggactgtggtgc

SEQ ID NO: 1188992 - DNA, 22 bp, Artificial Sequence
  chemically synthesized
cttctagctaatgggactgtgg

SEQ ID NO: 1188993 - DNA, 22 bp, Artificial Sequence
  chemically synthesized
tacagcaccacagtcccattag

SEQ ID NO: 1188994 - DNA, 22 bp, Artificial Sequence
  chemically synthesized
cagcaccacagtcccattagct

SEQ ID NO: 1188995 - DNA, 22 bp, Artificial Sequence
  chemically synthesized
gtgacaagtattacttctagct

SEQ ID NO: 1188996 - DNA, 22 bp, Artificial Sequence
  chemically synthesized
gctagaagtaatacttgtcacc

SEQ ID NO: 1188997 - DNA, 22 bp, Artificial Sequence
  chemically synthesized
gaagtaatacttgtcaccagat

SEQ ID NO: 1188998 - DNA, 22 bp, Artificial Sequence
  chemically synthesized
gtcaccagatgctatgtcatcc

SEQ ID NO: 1188999 - DNA, 22 bp, Artificial Sequence
  chemically synthesized
tcaccagatgctatgtcatcca

SEQ ID NO: 1189000 - DNA, 22 bp, Artificial Sequence
  chemically synthesized
aatggatagatgcatggatgta

SEQ ID NO: 1189001 - DNA, 22 bp, Artificial Sequence
  chemically synthesized
tgtcatccatacatccatgcat

SEQ ID NO: 1189002 - DNA, 22 bp, Artificial Sequence
  chemically synthesized
aaagaatggctgaatggataga

SEQ ID NO: 1189003 - DNA, 22 bp, Artificial Sequence
  chemically synthesized
tccattcagccattcttttagc

SEQ ID NO: 1189004 - DNA, 22 bp, Artificial Sequence
  chemically synthesized
agccattcttttagctatccat

SEQ ID NO: 1189005 - DNA, 22 bp, Artificial Sequence
  chemically synthesized
ttttagctatccatttatcata

SEQ ID NO: 1189006 - DNA, 22 bp, Artificial Sequence
  chemically synthesized
ttagctatccatttatcatact

SEQ ID NO: 1189007 - DNA, 22 bp, Artificial Sequence
  chemically synthesized
gacaggcagatgagtatgataa

SEQ ID NO: 1189008 - DNA, 22 bp, Artificial Sequence
  chemically synthesized
tagctatccatttatcatactc

SEQ ID NO: 1189009 - DNA, 22 bp, Artificial Sequence
  chemically synthesized
agctatccatttatcatactca

SEQ ID NO: 1189010 - DNA, 22 bp, Artificial Sequence
  chemically synthesized
gctatccatttatcatactcat

SEQ ID NO: 1189011 - DNA, 22 bp, Artificial Sequence
  chemically synthesized
attagacaggcagatgagtatg

SEQ ID NO: 1189012 - DNA, 22 bp, Artificial Sequence
  chemically synthesized
tccatttatcatactcatctgc

SEQ ID NO: 1189013 - DNA, 22 bp, Artificial Sequence
  chemically synthesized
atctcattagacaggcagatga

SEQ ID NO: 1189014 - DNA, 22 bp, Artificial Sequence
  chemically synthesized
aatctcattagacaggcagatg

SEQ ID NO: 1189015 - DNA, 22 bp, Artificial Sequence
  chemically synthesized
atcatactcatctgcctgtcta

SEQ ID NO: 1189016 - DNA, 22 bp, Artificial Sequence
  chemically synthesized
tcatactcatctgcctgtctaa

SEQ ID NO: 1189017 - DNA, 22 bp, Artificial Sequence
  chemically synthesized
atctgcctgtctaatgagatta

SEQ ID NO: 1189018 - DNA, 22 bp, Artificial Sequence
  chemically synthesized
cctgtctaatgagattaaacat

SEQ ID NO: 1189019 - DNA, 22 bp, Artificial Sequence
  chemically synthesized
tctaatgagattaaacatatac

SEQ ID NO: 1189020 - DNA, 22 bp, Artificial Sequence
  chemically synthesized
atgagattaaacatatacactg

SEQ ID NO: 1189021 - DNA, 22 bp, Artificial Sequence
  chemically synthesized
agaaagtacatgcatagacagt

SEQ ID NO: 1189022 - DNA, 22 bp, Artificial Sequence
  chemically synthesized
aagaaagtacatgcatagacag

SEQ ID NO: 1189023 - DNA, 22 bp, Artificial Sequence
  chemically synthesized
aacatatacactgtctatgcat

SEQ ID NO: 1189024 - DNA, 22 bp, Artificial Sequence
  chemically synthesized
agcacatcttaagaaagtacat

SEQ ID NO: 1189025 - DNA, 22 bp, Artificial Sequence
  chemically synthesized
attgagcacatcttaagaaagt

SEQ ID NO: 1189026 - DNA, 22 bp, Artificial Sequence
  chemically synthesized
tctatgcatgtactttcttaag

SEQ ID NO: 1189027 - DNA, 22 bp, Artificial Sequence
  chemically synthesized
ctaattgagcacatcttaagaa

SEQ ID NO: 1189028 - DNA, 22 bp, Artificial Sequence
  chemically synthesized
actaattgagcacatcttaaga

SEQ ID NO: 1189029 - DNA, 22 bp, Artificial Sequence
  chemically synthesized
tgcatgtactttcttaagatgt

SEQ ID NO: 1189030 - DNA, 22 bp, Artificial Sequence
  chemically synthesized
tactaattgagcacatcttaag

SEQ ID NO: 1189031 - DNA, 22 bp, Artificial Sequence
  chemically synthesized
aatctttactaattgagcacat

SEQ ID NO: 1189032 - DNA, 22 bp, Artificial Sequence
  chemically synthesized
gaatctttactaattgagcaca

SEQ ID NO: 1189033 - DNA, 22 bp, Artificial Sequence
  chemically synthesized
tgaatctttactaattgagcac

SEQ ID NO: 1189034 - DNA, 22 bp, Artificial Sequence
  chemically synthesized
tcttaagatgtgctcaattagt

SEQ ID NO: 1189035 - DNA, 22 bp, Artificial Sequence
  chemically synthesized
cttaagatgtgctcaattagta

SEQ ID NO: 1189036 - DNA, 22 bp, Artificial Sequence
  chemically synthesized
ttaagatgtgctcaattagtaa

SEQ ID NO: 1189037 - DNA, 22 bp, Artificial Sequence
  chemically synthesized
aattttgaatctttactaattg

SEQ ID NO: 1189038 - DNA, 22 bp, Artificial Sequence
  chemically synthesized
aagatgtgctcaattagtaaag

SEQ ID NO: 1189039 - DNA, 22 bp, Artificial Sequence
  chemically synthesized
agatgtgctcaattagtaaaga

SEQ ID NO: 1189040 - DNA, 22 bp, Artificial Sequence
  chemically synthesized
aattagtaaagattcaaaattt

SEQ ID NO: 1189041 - DNA, 22 bp, Artificial Sequence
  chemically synthesized
gtaaagattcaaaatttagctt

SEQ ID NO: 1189042 - DNA, 22 bp, Artificial Sequence
  chemically synthesized
ataataccagtgagtggtaaag

SEQ ID NO: 1189043 - DNA, 22 bp, Artificial Sequence
  chemically synthesized
aaaatttagctttaccactcac

SEQ ID NO: 1189044 - DNA, 22 bp, Artificial Sequence
  chemically synthesized
tccaaattcataataccagtga

SEQ ID NO: 1189045 - DNA, 22 bp, Artificial Sequence
  chemically synthesized
agctttaccactcactggtatt

SEQ ID NO: 1189046 - DNA, 22 bp, Artificial Sequence
  chemically synthesized
atccaaattcataataccagtg

SEQ ID NO: 1189047 - DNA, 22 bp, Artificial Sequence
  chemically synthesized
gctttaccactcactggtatta

SEQ ID NO: 1189048 - DNA, 22 bp, Artificial Sequence
  chemically synthesized
ttatccaaattcataataccag

SEQ ID NO: 1189049 - DNA, 22 bp, Artificial Sequence
  chemically synthesized
cttatccaaattcataatacca

SEQ ID NO: 1189050 - DNA, 22 bp, Artificial Sequence
  chemically synthesized
taccactcactggtattatgaa

SEQ ID NO: 1189051 - DNA, 22 bp, Artificial Sequence
  chemically synthesized
accactcactggtattatgaat

SEQ ID NO: 1189052 - DNA, 22 bp, Artificial Sequence
  chemically synthesized
ccactcactggtattatgaatt

SEQ ID NO: 1189053 - DNA, 22 bp, Artificial Sequence
  chemically synthesized
agtttcttatccaaattcataa

SEQ ID NO: 1189054 - DNA, 22 bp, Artificial Sequence
  chemically synthesized
actggtattatgaatttggata

SEQ ID NO: 1189055 - DNA, 22 bp, Artificial Sequence
  chemically synthesized
gtattatgaatttggataagaa

SEQ ID NO: 1189056 - DNA, 22 bp, Artificial Sequence
  chemically synthesized
tgaatttggataagaaacttaa

SEQ ID NO: 1189057 - DNA, 22 bp, Artificial Sequence
  chemically synthesized
ggataagaaacttaatttcttc

SEQ ID NO: 1189058 - DNA, 22 bp, Artificial Sequence
  chemically synthesized
gataagaaacttaatttcttca

SEQ ID NO: 1189059 - DNA, 22 bp, Artificial Sequence
  chemically synthesized
ccaatgagggtatgaagaaatg

SEQ ID NO: 1189060 - DNA, 22 bp, Artificial Sequence
  chemically synthesized
accaatgagggtatgaagaaat

SEQ ID NO: 1189061 - DNA, 22 bp, Artificial Sequence
  chemically synthesized
taccaatgagggtatgaagaaa

SEQ ID NO: 1189062 - DNA, 22 bp, Artificial Sequence
  chemically synthesized
aatttcttcatttcttcatacc

SEQ ID NO: 1189063 - DNA, 22 bp, Artificial Sequence
  chemically synthesized
atttcttcatttcttcataccc

SEQ ID NO: 1189064 - DNA, 22 bp, Artificial Sequence
  chemically synthesized
attttaccaatgagggtatgaa

SEQ ID NO: 1189065 - DNA, 22 bp, Artificial Sequence
  chemically synthesized
cttcatttcttcataccctcat

SEQ ID NO: 1189066 - DNA, 22 bp, Artificial Sequence
  chemically synthesized
ttcatttcttcataccctcatt

SEQ ID NO: 1189067 - DNA, 22 bp, Artificial Sequence
  chemically synthesized
cctcattttaccaatgagggta

SEQ ID NO: 1189068 - DNA, 22 bp, Artificial Sequence
  chemically synthesized
gcctcattttaccaatgagggt

SEQ ID NO: 1189069 - DNA, 22 bp, Artificial Sequence
  chemically synthesized
catttcttcataccctcattgg

SEQ ID NO: 1189070 - DNA, 22 bp, Artificial Sequence
  chemically synthesized
tgcctcattttaccaatgaggg

SEQ ID NO: 1189071 - DNA, 22 bp, Artificial Sequence
  chemically synthesized
atttcttcataccctcattggt

SEQ ID NO: 1189072 - DNA, 22 bp, Artificial Sequence
  chemically synthesized
cttcataccctcattggtaaaa

SEQ ID NO: 1189073 - DNA, 22 bp, Artificial Sequence
  chemically synthesized
ttcataccctcattggtaaaat

SEQ ID NO: 1189074 - DNA, 22 bp, Artificial Sequence
  chemically synthesized
cataccctcattggtaaaatga

SEQ ID NO: 1189075 - DNA, 22 bp, Artificial Sequence
  chemically synthesized
ataccctcattggtaaaatgag

SEQ ID NO: 1189076 - DNA, 22 bp, Artificial Sequence
  chemically synthesized
gaaaagtctttgcctcatttta

SEQ ID NO: 1189077 - DNA, 22 bp, Artificial Sequence
  chemically synthesized
ggaaaagtctttgcctcatttt

SEQ ID NO: 1189078 - DNA, 22 bp, Artificial Sequence
  chemically synthesized
ttggaaaagtctttgcctcatt

SEQ ID NO: 1189079 - DNA, 22 bp, Artificial Sequence
  chemically synthesized
cttggaaaagtctttgcctcat

SEQ ID NO: 1189080 - DNA, 22 bp, Artificial Sequence
  chemically synthesized
attggtaaaatgaggcaaagac

SEQ ID NO: 1189081 - DNA, 22 bp, Artificial Sequence
  chemically synthesized
ccttcttggaaaagtctttgcc

SEQ ID NO: 1189082 - DNA, 22 bp, Artificial Sequence
  chemically synthesized
accttcttggaaaagtctttgc

SEQ ID NO: 1189083 - DNA, 22 bp, Artificial Sequence
  chemically synthesized
gtaaaatgaggcaaagactttt

SEQ ID NO: 1189084 - DNA, 22 bp, Artificial Sequence
  chemically synthesized
cacttaccttcttggaaaagtc

SEQ ID NO: 1189085 - DNA, 22 bp, Artificial Sequence
  chemically synthesized
gcacttaccttcttggaaaagt

SEQ ID NO: 1189086 - DNA, 22 bp, Artificial Sequence
  chemically synthesized
cttgcacttaccttcttggaaa

SEQ ID NO: 1189087 - DNA, 22 bp, Artificial Sequence
  chemically synthesized
acttgcacttaccttcttggaa

SEQ ID NO: 1189088 - DNA, 22 bp, Artificial Sequence
  chemically synthesized
aatgccttacttgcacttacct

SEQ ID NO: 1189089 - DNA, 22 bp, Artificial Sequence
  chemically synthesized
taaatgccttacttgcacttac

SEQ ID NO: 1189090 - DNA, 22 bp, Artificial Sequence
  chemically synthesized
ttccaagaaggtaagtgcaagt

SEQ ID NO: 1189091 - DNA, 22 bp, Artificial Sequence
  chemically synthesized
tccaagaaggtaagtgcaagta

SEQ ID NO: 1189092 - DNA, 22 bp, Artificial Sequence
  chemically synthesized
ctctaaatgccttacttgcact

SEQ ID NO: 1189093 - DNA, 22 bp, Artificial Sequence
  chemically synthesized
ccaagaaggtaagtgcaagtaa

SEQ ID NO: 1189094 - DNA, 22 bp, Artificial Sequence
  chemically synthesized
caagaaggtaagtgcaagtaag

SEQ ID NO: 1189095 - DNA, 22 bp, Artificial Sequence
  chemically synthesized
tgccaggcattgctctaaatgc

SEQ ID NO: 1189096 - DNA, 22 bp, Artificial Sequence
  chemically synthesized
atgccaggcattgctctaaatg

SEQ ID NO: 1189097 - DNA, 22 bp, Artificial Sequence
  chemically synthesized
tatgccaggcattgctctaaat

SEQ ID NO: 1189098 - DNA, 22 bp, Artificial Sequence
  chemically synthesized
aaaacatactttatgccaggca

SEQ ID NO: 1189099 - DNA, 22 bp, Artificial Sequence
  chemically synthesized
ctgaaaacatactttatgccag

SEQ ID NO: 1189100 - DNA, 22 bp, Artificial Sequence
  chemically synthesized
gctgaaaacatactttatgcca

SEQ ID NO: 1189101 - DNA, 22 bp, Artificial Sequence
  chemically synthesized
agagcaatgcctggcataaagt

SEQ ID NO: 1189102 - DNA, 22 bp, Artificial Sequence
  chemically synthesized
gagcaatgcctggcataaagta

SEQ ID NO: 1189103 - DNA, 22 bp, Artificial Sequence
  chemically synthesized
aaatttgctgaaaacatacttt

SEQ ID NO: 1189104 - DNA, 22 bp, Artificial Sequence
  chemically synthesized
gaaatttgctgaaaacatactt

SEQ ID NO: 1189105 - DNA, 22 bp, Artificial Sequence
  chemically synthesized
aacttgaaatttgctgaaaaca

SEQ ID NO: 1189106 - DNA, 22 bp, Artificial Sequence
  chemically synthesized
aaacttgaaatttgctgaaaac

SEQ ID NO: 1189107 - DNA, 22 bp, Artificial Sequence
  chemically synthesized
gcataaagtatgttttcagcaa

SEQ ID NO: 1189108 - DNA, 22 bp, Artificial Sequence
  chemically synthesized
taaacttgaaatttgctgaaaa

SEQ ID NO: 1189109 - DNA, 22 bp, Artificial Sequence
  chemically synthesized
tcagcaaatttcaagtttaaaa

SEQ ID NO: 1189110 - DNA, 22 bp, Artificial Sequence
  chemically synthesized
cagcaaatttcaagtttaaaat

SEQ ID NO: 1189111 - DNA, 22 bp, Artificial Sequence
  chemically synthesized
agcaaatttcaagtttaaaatg

SEQ ID NO: 1189112 - DNA, 22 bp, Artificial Sequence
  chemically synthesized
tatatatacatgtgtatataca

SEQ ID NO: 1189113 - DNA, 22 bp, Artificial Sequence
  chemically synthesized
caagtttaaaatgtatatacac

SEQ ID NO: 1189114 - DNA, 22 bp, Artificial Sequence
  chemically synthesized
aagtttaaaatgtatatacaca

SEQ ID NO: 1189115 - DNA, 22 bp, Artificial Sequence
  chemically synthesized
acattgtatatatacatgtgta

SEQ ID NO: 1189116 - DNA, 22 bp, Artificial Sequence
  chemically synthesized
aaaatgtatatacacatgtata

SEQ ID NO: 1189117 - DNA, 22 bp, Artificial Sequence
  chemically synthesized
aaatgtatatacacatgtatat

SEQ ID NO: 1189118 - DNA, 22 bp, Artificial Sequence
  chemically synthesized
aagttcacattgtatatataca

SEQ ID NO: 1189119 - DNA, 22 bp, Artificial Sequence
  chemically synthesized
gaagttcacattgtatatatac

SEQ ID NO: 1189120 - DNA, 22 bp, Artificial Sequence
  chemically synthesized
tgaagttcacattgtatatata

SEQ ID NO: 1189121 - DNA, 22 bp, Artificial Sequence
  chemically synthesized
attttgaagttcacattgtata

SEQ ID NO: 1189122 - DNA, 22 bp, Artificial Sequence
  chemically synthesized
aaattaattttgaagttcacat

SEQ ID NO: 1189123 - DNA, 22 bp, Artificial Sequence
  chemically synthesized
ctgaaattaattttgaagttca

SEQ ID NO: 1189124 - DNA, 22 bp, Artificial Sequence
  chemically synthesized
caaaattaatttcagtaatgca

SEQ ID NO: 1189125 - DNA, 22 bp, Artificial Sequence
  chemically synthesized
aaaattaatttcagtaatgcat

SEQ ID NO: 1189126 - DNA, 22 bp, Artificial Sequence
  chemically synthesized
atttcagtaatgcatgtattca

SEQ ID NO: 1189127 - DNA, 22 bp, Artificial Sequence
  chemically synthesized
cagtaatgcatgtattcattta

SEQ ID NO: 1189128 - DNA, 22 bp, Artificial Sequence
  chemically synthesized
agtaatgcatgtattcatttat

SEQ ID NO: 1189129 - DNA, 22 bp, Artificial Sequence
  chemically synthesized
cagaataaataaatggataaat

SEQ ID NO: 1189130 - DNA, 22 bp, Artificial Sequence
  chemically synthesized
atttatccatttatttattctg

SEQ ID NO: 1189131 - DNA, 22 bp, Artificial Sequence
  chemically synthesized
atccatttatttattctgtaac

SEQ ID NO: 1189132 - DNA, 22 bp, Artificial Sequence
  chemically synthesized
tccatttatttattctgtaact

SEQ ID NO: 1189133 - DNA, 22 bp, Artificial Sequence
  chemically synthesized
atttattctgtaactatttatt

SEQ ID NO: 1189134 - DNA, 22 bp, Artificial Sequence
  chemically synthesized
tggcaagtgtccaataaatagt

SEQ ID NO: 1189135 - DNA, 22 bp, Artificial Sequence
  chemically synthesized
tttattctgtaactatttattg

SEQ ID NO: 1189136 - DNA, 22 bp, Artificial Sequence
  chemically synthesized
atggcaagtgtccaataaatag

SEQ ID NO: 1189137 - DNA, 22 bp, Artificial Sequence
  chemically synthesized
attctgtaactatttattggac

SEQ ID NO: 1189138 - DNA, 22 bp, Artificial Sequence
  chemically synthesized
ttctgtaactatttattggaca

SEQ ID NO: 1189139 - DNA, 22 bp, Artificial Sequence
  chemically synthesized
gacttatggcaagtgtccaata

SEQ ID NO: 1189140 - DNA, 22 bp, Artificial Sequence
  chemically synthesized
tgtaactatttattggacactt

SEQ ID NO: 1189141 - DNA, 22 bp, Artificial Sequence
  chemically synthesized
taactatttattggacacttgc

SEQ ID NO: 1189142 - DNA, 22 bp, Artificial Sequence
  chemically synthesized
tttattggacacttgccataag

SEQ ID NO: 1189143 - DNA, 22 bp, Artificial Sequence
  chemically synthesized
attggacacttgccataagtcg

SEQ ID NO: 1189144 - DNA, 22 bp, Artificial Sequence
  chemically synthesized
ttggacacttgccataagtcga

SEQ ID NO: 1189145 - DNA, 22 bp, Artificial Sequence
  chemically synthesized
gacacttgccataagtcgagga

SEQ ID NO: 1189146 - DNA, 22 bp, Artificial Sequence
  chemically synthesized
cagtgtccagcataatcctcga

SEQ ID NO: 1189147 - DNA, 22 bp, Artificial Sequence
  chemically synthesized
gccataagtcgaggattatgct

SEQ ID NO: 1189148 - DNA, 22 bp, Artificial Sequence
  chemically synthesized
ccataagtcgaggattatgctg

SEQ ID NO: 1189149 - DNA, 22 bp, Artificial Sequence
  chemically synthesized
agctgcagtgtccagcataatc

SEQ ID NO: 1189150 - DNA, 22 bp, Artificial Sequence
  chemically synthesized
cagctgcagtgtccagcataat

SEQ ID NO: 1189151 - DNA, 22 bp, Artificial Sequence
  chemically synthesized
tttcagctgcagtgtccagcat

SEQ ID NO: 1189152 - DNA, 22 bp, Artificial Sequence
  chemically synthesized
actatttcagctgcagtgtcca

SEQ ID NO: 1189153 - DNA, 22 bp, Artificial Sequence
  chemically synthesized
ctcactatttcagctgcagtgt

SEQ ID NO: 1189154 - DNA, 22 bp, Artificial Sequence
  chemically synthesized
gctcactatttcagctgcagtg

SEQ ID NO: 1189155 - DNA, 22 bp, Artificial Sequence
  chemically synthesized
tgctcactatttcagctgcagt

SEQ ID NO: 1189156 - DNA, 22 bp, Artificial Sequence
  chemically synthesized
ttgctcactatttcagctgcag

SEQ ID NO: 1189157 - DNA, 22 bp, Artificial Sequence
  chemically synthesized
tgctggacactgcagctgaaat

SEQ ID NO: 1189158 - DNA, 22 bp, Artificial Sequence
  chemically synthesized
tttttgctcactatttcagctg

SEQ ID NO: 1189159 - DNA, 22 bp, Artificial Sequence
  chemically synthesized
atttttgctcactatttcagct

SEQ ID NO: 1189160 - DNA, 22 bp, Artificial Sequence
  chemically synthesized
tatttttgctcactatttcagc

SEQ ID NO: 1189161 - DNA, 22 bp, Artificial Sequence
  chemically synthesized
ttatttttgctcactatttcag

SEQ ID NO: 1189162 - DNA, 22 bp, Artificial Sequence
  chemically synthesized
gacactgcagctgaaatagtga

SEQ ID NO: 1189163 - DNA, 22 bp, Artificial Sequence
  chemically synthesized
tttttatttttgctcactattt

SEQ ID NO: 1189164 - DNA, 22 bp, Artificial Sequence
  chemically synthesized
gtttttatttttgctcactatt

SEQ ID NO: 1189165 - DNA, 22 bp, Artificial Sequence
  chemically synthesized
cagctgaaatagtgagcaaaaa

SEQ ID NO: 1189166 - DNA, 22 bp, Artificial Sequence
  chemically synthesized
tgtttgtttttatttttgctca

SEQ ID NO: 1189167 - DNA, 22 bp, Artificial Sequence
  chemically synthesized
gtgtttgtttttatttttgctc

SEQ ID NO: 1189168 - DNA, 22 bp, Artificial Sequence
  chemically synthesized
tttgtgtttgtttttatttttg

SEQ ID NO: 1189169 - DNA, 22 bp, Artificial Sequence
  chemically synthesized
gtttgtgtttgtttttattttt

SEQ ID NO: 1189170 - DNA, 22 bp, Artificial Sequence
  chemically synthesized
aaatagtgagcaaaaataaaaa

SEQ ID NO: 1189171 - DNA, 22 bp, Artificial Sequence
  chemically synthesized
ggtttgtttgtgtttgttttta

SEQ ID NO: 1189172 - DNA, 22 bp, Artificial Sequence
  chemically synthesized
taggcaccataaaatcagggtc

SEQ ID NO: 1189173 - DNA, 22 bp, Artificial Sequence
  chemically synthesized
gactataggcaccataaaatca

SEQ ID NO: 1189174 - DNA, 22 bp, Artificial Sequence
  chemically synthesized
ccattggactataggcaccata

SEQ ID NO: 1189175 - DNA, 22 bp, Artificial Sequence
  chemically synthesized
gaccctgattttatggtgccta

SEQ ID NO: 1189176 - DNA, 22 bp, Artificial Sequence
  chemically synthesized
taccattggactataggcacca

SEQ ID NO: 1189177 - DNA, 22 bp, Artificial Sequence
  chemically synthesized
attttatggtgcctatagtcca

SEQ ID NO: 1189178 - DNA, 22 bp, Artificial Sequence
  chemically synthesized
tatggtgcctatagtccaatgg

SEQ ID NO: 1189179 - DNA, 22 bp, Artificial Sequence
  chemically synthesized
atggtgcctatagtccaatggt

SEQ ID NO: 1189180 - DNA, 22 bp, Artificial Sequence
  chemically synthesized
tggtgcctatagtccaatggta

SEQ ID NO: 1189181 - DNA, 22 bp, Artificial Sequence
  chemically synthesized
ggcagatatatctctaccattg

SEQ ID NO: 1189182 - DNA, 22 bp, Artificial Sequence
  chemically synthesized
ttaggcagatatatctctacca

SEQ ID NO: 1189183 - DNA, 22 bp, Artificial Sequence
  chemically synthesized
tagtccaatggtagagatatat

SEQ ID NO: 1189184 - DNA, 22 bp, Artificial Sequence
  chemically synthesized
tggactgttaggcagatatatc

SEQ ID NO: 1189185 - DNA, 22 bp, Artificial Sequence
  chemically synthesized
atgctatggactgttaggcaga

SEQ ID NO: 1189186 - DNA, 22 bp, Artificial Sequence
  chemically synthesized
catgctatggactgttaggcag

SEQ ID NO: 1189187 - DNA, 22 bp, Artificial Sequence
  chemically synthesized
tcatgctatggactgttaggca

SEQ ID NO: 1189188 - DNA, 22 bp, Artificial Sequence
  chemically synthesized
ttcatgctatggactgttaggc

SEQ ID NO: 1189189 - DNA, 22 bp, Artificial Sequence
  chemically synthesized
cagtatttttcatgctatggac

SEQ ID NO: 1189190 - DNA, 22 bp, Artificial Sequence
  chemically synthesized
cctaacagtccatagcatgaaa

SEQ ID NO: 1189191 - DNA, 22 bp, Artificial Sequence
  chemically synthesized
acagtccatagcatgaaaaata

SEQ ID NO: 1189192 - DNA, 22 bp, Artificial Sequence
  chemically synthesized
tacacagtagctccagtatttt

SEQ ID NO: 1189193 - DNA, 22 bp, Artificial Sequence
  chemically synthesized
cagcgttgtacacagtagctcc

SEQ ID NO: 1189194 - DNA, 22 bp, Artificial Sequence
  chemically synthesized
attgcagcgttgtacacagtag

SEQ ID NO: 1189195 - DNA, 22 bp, Artificial Sequence
  chemically synthesized
gagctactgtgtacaacgctgc

SEQ ID NO: 1189196 - DNA, 22 bp, Artificial Sequence
  chemically synthesized
ctgtgtacaacgctgcaatgaa

SEQ ID NO: 1189197 - DNA, 22 bp, Artificial Sequence
  chemically synthesized
tgtacaacgctgcaatgaacat

SEQ ID NO: 1189198 - DNA, 22 bp, Artificial Sequence
  chemically synthesized
cgacaaatgtgtaaggatgttc

SEQ ID NO: 1189199 - DNA, 22 bp, Artificial Sequence
  chemically synthesized
caatgaacatccttacacattt

SEQ ID NO: 1189200 - DNA, 22 bp, Artificial Sequence
  chemically synthesized
atacatatctacgacaaatgtg

SEQ ID NO: 1189201 - DNA, 22 bp, Artificial Sequence
  chemically synthesized
acacatttgtcgtagatatgta

SEQ ID NO: 1189202 - DNA, 22 bp, Artificial Sequence
  chemically synthesized
cacatttgtcgtagatatgtat

SEQ ID NO: 1189203 - DNA, 22 bp, Artificial Sequence
  chemically synthesized
gatatatagtaatactcataca

SEQ ID NO: 1189204 - DNA, 22 bp, Artificial Sequence
  chemically synthesized
gtcgtagatatgtatgagtatt

SEQ ID NO: 1189205 - DNA, 22 bp, Artificial Sequence
  chemically synthesized
tcgtagatatgtatgagtatta

SEQ ID NO: 1189206 - DNA, 22 bp, Artificial Sequence
  chemically synthesized
agaattagatatatagtaatac

SEQ ID NO: 1189207 - DNA, 22 bp, Artificial Sequence
  chemically synthesized
aagaattagatatatagtaata

SEQ ID NO: 1189208 - DNA, 22 bp, Artificial Sequence
  chemically synthesized
acatttaagaattagatatata

SEQ ID NO: 1189209 - DNA, 22 bp, Artificial Sequence
  chemically synthesized
cacatttaagaattagatatat

SEQ ID NO: 1189210 - DNA, 22 bp, Artificial Sequence
  chemically synthesized
aggtttcacatttaagaattag

SEQ ID NO: 1189211 - DNA, 22 bp, Artificial Sequence
  chemically synthesized
ctatatatctaattcttaaatg

SEQ ID NO: 1189212 - DNA, 22 bp, Artificial Sequence
  chemically synthesized
atcctgaggtttcacatttaag

SEQ ID NO: 1189213 - DNA, 22 bp, Artificial Sequence
  chemically synthesized
tatatctaattcttaaatgtga

SEQ ID NO: 1189214 - DNA, 22 bp, Artificial Sequence
  chemically synthesized
gatcctgaggtttcacatttaa

SEQ ID NO: 1189215 - DNA, 22 bp, Artificial Sequence
  chemically synthesized
attcttaaatgtgaaacctcag

SEQ ID NO: 1189216 - DNA, 22 bp, Artificial Sequence
  chemically synthesized
catatatttgatcctgaggttt

SEQ ID NO: 1189217 - DNA, 22 bp, Artificial Sequence
  chemically synthesized
acatatatttgatcctgaggtt

SEQ ID NO: 1189218 - DNA, 22 bp, Artificial Sequence
  chemically synthesized
tacatatatttgatcctgaggt

SEQ ID NO: 1189219 - DNA, 22 bp, Artificial Sequence
  chemically synthesized
ttaaatgtgaaacctcaggatc

SEQ ID NO: 1189220 - DNA, 22 bp, Artificial Sequence
  chemically synthesized
aaatgtgaaacctcaggatcaa

SEQ ID NO: 1189221 - DNA, 22 bp, Artificial Sequence
  chemically synthesized
aatgtgaaacctcaggatcaaa

SEQ ID NO: 1189222 - DNA, 22 bp, Artificial Sequence
  chemically synthesized
aaaatatgtaattttacatata

SEQ ID NO: 1189223 - DNA, 22 bp, Artificial Sequence
  chemically synthesized
caaaatatgtaattttacatat

SEQ ID NO: 1189224 - DNA, 22 bp, Artificial Sequence
  chemically synthesized
tcaaaatatgtaattttacata

SEQ ID NO: 1189225 - DNA, 22 bp, Artificial Sequence
  chemically synthesized
aggatcaaatatatgtaaaatt

SEQ ID NO: 1189226 - DNA, 22 bp, Artificial Sequence
  chemically synthesized
tctttcaaaatatgtaatttta

SEQ ID NO: 1189227 - DNA, 22 bp, Artificial Sequence
  chemically synthesized
gtattatctttcaaaatatgta

SEQ ID NO: 1189228 - DNA, 22 bp, Artificial Sequence
  chemically synthesized
agtattatctttcaaaatatgt

SEQ ID NO: 1189229 - DNA, 22 bp, Artificial Sequence
  chemically synthesized
atcagacaatttagtattatct

SEQ ID NO: 1189230 - DNA, 22 bp, Artificial Sequence
  chemically synthesized
catattttgaaagataatacta

SEQ ID NO: 1189231 - DNA, 22 bp, Artificial Sequence
  chemically synthesized
aatcagacaatttagtattatc

SEQ ID NO: 1189232 - DNA, 22 bp, Artificial Sequence
  chemically synthesized
taatcagacaatttagtattat

SEQ ID NO: 1189233 - DNA, 22 bp, Artificial Sequence
  chemically synthesized
tgaaagataatactaaattgtc

SEQ ID NO: 1189234 - DNA, 22 bp, Artificial Sequence
  chemically synthesized
gaaagataatactaaattgtct

SEQ ID NO: 1189235 - DNA, 22 bp, Artificial Sequence
  chemically synthesized
aaagataatactaaattgtctg

SEQ ID NO: 1189236 - DNA, 22 bp, Artificial Sequence
  chemically synthesized
taatattttaatcagacaattt

SEQ ID NO: 1189237 - DNA, 22 bp, Artificial Sequence
  chemically synthesized
gtaatattttaatcagacaatt

SEQ ID NO: 1189238 - DNA, 22 bp, Artificial Sequence
  chemically synthesized
aattgtctgattaaaatattac

SEQ ID NO: 1189239 - DNA, 22 bp, Artificial Sequence
  chemically synthesized
gaggaaacacaacttgtaatat

SEQ ID NO: 1189240 - DNA, 22 bp, Artificial Sequence
  chemically synthesized
ggaggaaacacaacttgtaata

SEQ ID NO: 1189241 - DNA, 22 bp, Artificial Sequence
  chemically synthesized
tctgattaaaatattacaagtt

SEQ ID NO: 1189242 - DNA, 22 bp, Artificial Sequence
  chemically synthesized
tggaggaaacacaacttgtaat

SEQ ID NO: 1189243 - DNA, 22 bp, Artificial Sequence
  chemically synthesized
ttggaggaaacacaacttgtaa

SEQ ID NO: 1189244 - DNA, 22 bp, Artificial Sequence
  chemically synthesized
ttttggaggaaacacaacttgt

SEQ ID NO: 1189245 - DNA, 22 bp, Artificial Sequence
  chemically synthesized
attaaaatattacaagttgtgt

SEQ ID NO: 1189246 - DNA, 22 bp, Artificial Sequence
  chemically synthesized
cttttggaggaaacacaacttg

SEQ ID NO: 1189247 - DNA, 22 bp, Artificial Sequence
  chemically synthesized
aaatattacaagttgtgtttcc

SEQ ID NO: 1189248 - DNA, 22 bp, Artificial Sequence
  chemically synthesized
tgtttcttttggaggaaacaca

SEQ ID NO: 1189249 - DNA, 22 bp, Artificial Sequence
  chemically synthesized
caagttgtgtttcctccaaaag

SEQ ID NO: 1189250 - DNA, 22 bp, Artificial Sequence
  chemically synthesized
tgtttcctccaaaagaaacaca

SEQ ID NO: 1189251 - DNA, 22 bp, Artificial Sequence
  chemically synthesized
atgtaaataggccctgtgtttc

SEQ ID NO: 1189252 - DNA, 22 bp, Artificial Sequence
  chemically synthesized
cctccaaaagaaacacagggcc

SEQ ID NO: 1189253 - DNA, 22 bp, Artificial Sequence
  chemically synthesized
ctccaaaagaaacacagggcct

SEQ ID NO: 1189254 - DNA, 22 bp, Artificial Sequence
  chemically synthesized
caaaagaaacacagggcctatt

SEQ ID NO: 1189255 - DNA, 22 bp, Artificial Sequence
  chemically synthesized
tgagggttcatgtaaataggcc

SEQ ID NO: 1189256 - DNA, 22 bp, Artificial Sequence
  chemically synthesized
ttatgagggttcatgtaaatag

SEQ ID NO: 1189257 - DNA, 22 bp, Artificial Sequence
  chemically synthesized
attatgagggttcatgtaaata

SEQ ID NO: 1189258 - DNA, 22 bp, Artificial Sequence
  chemically synthesized
ttattatgagggttcatgtaaa

SEQ ID NO: 1189259 - DNA, 22 bp, Artificial Sequence
  chemically synthesized
cttattatgagggttcatgtaa

SEQ ID NO: 1189260 - DNA, 22 bp, Artificial Sequence
  chemically synthesized
tttacatgaaccctcataataa

SEQ ID NO: 1189261 - DNA, 22 bp, Artificial Sequence
  chemically synthesized
acatgaaccctcataataagaa

SEQ ID NO: 1189262 - DNA, 22 bp, Artificial Sequence
  chemically synthesized
catgaaccctcataataagaag

SEQ ID NO: 1189263 - DNA, 22 bp, Artificial Sequence
  chemically synthesized
ataataagaagatatttgtact

SEQ ID NO: 1189264 - DNA, 22 bp, Artificial Sequence
  chemically synthesized
ataaataaatgcatagtacaaa

SEQ ID NO: 1189265 - DNA, 22 bp, Artificial Sequence
  chemically synthesized
actaataaataaatgcatagta

SEQ ID NO: 1189266 - DNA, 22 bp, Artificial Sequence
  chemically synthesized
aactaataaataaatgcatagt

SEQ ID NO: 1189267 - DNA, 22 bp, Artificial Sequence
  chemically synthesized
agcttaactaataaataaatgc

SEQ ID NO: 1189268 - DNA, 22 bp, Artificial Sequence
  chemically synthesized
gtactatgcatttatttattag

SEQ ID NO: 1189269 - DNA, 22 bp, Artificial Sequence
  chemically synthesized
tactatgcatttatttattagt

SEQ ID NO: 1189270 - DNA, 22 bp, Artificial Sequence
  chemically synthesized
tgcatttatttattagttaagc

SEQ ID NO: 1189271 - DNA, 22 bp, Artificial Sequence
  chemically synthesized
atttattagttaagcttaattt

SEQ ID NO: 1189272 - DNA, 22 bp, Artificial Sequence
  chemically synthesized
tttattagttaagcttaatttt

SEQ ID NO: 1189273 - DNA, 22 bp, Artificial Sequence
  chemically synthesized
attagttaagcttaattttatt

SEQ ID NO: 1189274 - DNA, 22 bp, Artificial Sequence
  chemically synthesized
ttagttaagcttaattttattt

SEQ ID NO: 1189275 - DNA, 22 bp, Artificial Sequence
  chemically synthesized
gaaatagcccatcaaaataaaa

SEQ ID NO: 1189276 - DNA, 22 bp, Artificial Sequence
  chemically synthesized
gttaagcttaattttattttga

SEQ ID NO: 1189277 - DNA, 22 bp, Artificial Sequence
  chemically synthesized
agcttaattttattttgatggg

SEQ ID NO: 1189278 - DNA, 22 bp, Artificial Sequence
  chemically synthesized
ggaaaattagaaatagcccatc

SEQ ID NO: 1189279 - DNA, 22 bp, Artificial Sequence
  chemically synthesized
aattttattttgatgggctatt

SEQ ID NO: 1189280 - DNA, 22 bp, Artificial Sequence
  chemically synthesized
gggaaaattagaaatagcccat

SEQ ID NO: 1189281 - DNA, 22 bp, Artificial Sequence
  chemically synthesized
attttattttgatgggctattt

SEQ ID NO: 1189282 - DNA, 22 bp, Artificial Sequence
  chemically synthesized
acttgggaaaattagaaatagc

SEQ ID NO: 1189283 - DNA, 22 bp, Artificial Sequence
  chemically synthesized
tattttgatgggctatttctaa

SEQ ID NO: 1189284 - DNA, 22 bp, Artificial Sequence
  chemically synthesized
attttgatgggctatttctaat

SEQ ID NO: 1189285 - DNA, 22 bp, Artificial Sequence
  chemically synthesized
ttttgatgggctatttctaatt

SEQ ID NO: 1189286 - DNA, 22 bp, Artificial Sequence
  chemically synthesized
tgatgggctatttctaattttc

SEQ ID NO: 1189287 - DNA, 22 bp, Artificial Sequence
  chemically synthesized
gatgggctatttctaattttcc

SEQ ID NO: 1189288 - DNA, 22 bp, Artificial Sequence
  chemically synthesized
atgggctatttctaattttccc

SEQ ID NO: 1189289 - DNA, 22 bp, Artificial Sequence
  chemically synthesized
tggtcaggacattcacttggga

SEQ ID NO: 1189290 - DNA, 22 bp, Artificial Sequence
  chemically synthesized
tttctaattttcccaagtgaat

SEQ ID NO: 1189291 - DNA, 22 bp, Artificial Sequence
  chemically synthesized
ctaattttcccaagtgaatgtc

SEQ ID NO: 1189292 - DNA, 22 bp, Artificial Sequence
  chemically synthesized
taattttcccaagtgaatgtcc

SEQ ID NO: 1189293 - DNA, 22 bp, Artificial Sequence
  chemically synthesized
catattatggtcaggacattca

SEQ ID NO: 1189294 - DNA, 22 bp, Artificial Sequence
  chemically synthesized
attttcccaagtgaatgtcctg

SEQ ID NO: 1189295 - DNA, 22 bp, Artificial Sequence
  chemically synthesized
tcccaagtgaatgtcctgacca

SEQ ID NO: 1189296 - DNA, 22 bp, Artificial Sequence
  chemically synthesized
cccaagtgaatgtcctgaccat

SEQ ID NO: 1189297 - DNA, 22 bp, Artificial Sequence
  chemically synthesized
ccaagtgaatgtcctgaccata

SEQ ID NO: 1189298 - DNA, 22 bp, Artificial Sequence
  chemically synthesized
aaagtggctacatattatggtc

SEQ ID NO: 1189299 - DNA, 22 bp, Artificial Sequence
  chemically synthesized
aaaagtggctacatattatggt

SEQ ID NO: 1189300 - DNA, 22 bp, Artificial Sequence
  chemically synthesized
taaaagtggctacatattatgg

SEQ ID NO: 1189301 - DNA, 22 bp, Artificial Sequence
  chemically synthesized
accataatatgtagccactttt

SEQ ID NO: 1189302 - DNA, 22 bp, Artificial Sequence
  chemically synthesized
caatgaatatacaaagtataat

SEQ ID NO: 1189303 - DNA, 22 bp, Artificial Sequence
  chemically synthesized
ctacaatgaatatacaaagtat

SEQ ID NO: 1189304 - DNA, 22 bp, Artificial Sequence
  chemically synthesized
ttaaaatattatactttgtata

SEQ ID NO: 1189305 - DNA, 22 bp, Artificial Sequence
  chemically synthesized
taaaatattatactttgtatat

SEQ ID NO: 1189306 - DNA, 22 bp, Artificial Sequence
  chemically synthesized
aaaatattatactttgtatatt

SEQ ID NO: 1189307 - DNA, 22 bp, Artificial Sequence
  chemically synthesized
aaatattatactttgtatattc

SEQ ID NO: 1189308 - DNA, 22 bp, Artificial Sequence
  chemically synthesized
tactttgtatattcattgtagg

SEQ ID NO: 1189309 - DNA, 22 bp, Artificial Sequence
  chemically synthesized
agtatgataacactcctacaat

SEQ ID NO: 1189310 - DNA, 22 bp, Artificial Sequence
  chemically synthesized
tgtatattcattgtaggagtgt

SEQ ID NO: 1189311 - DNA, 22 bp, Artificial Sequence
  chemically synthesized
gtatattcattgtaggagtgtt

SEQ ID NO: 1189312 - DNA, 22 bp, Artificial Sequence
  chemically synthesized
tatattcattgtaggagtgtta

SEQ ID NO: 1189313 - DNA, 22 bp, Artificial Sequence
  chemically synthesized
attgtaggagtgttatcatact

SEQ ID NO: 1189314 - DNA, 22 bp, Artificial Sequence
  chemically synthesized
taggagtgttatcatactgagg

SEQ ID NO: 1189315 - DNA, 22 bp, Artificial Sequence
  chemically synthesized
gtaataaaaaatcaataacctc

SEQ ID NO: 1189316 - DNA, 22 bp, Artificial Sequence
  chemically synthesized
tcatactgaggttattgatttt

SEQ ID NO: 1189317 - DNA, 22 bp, Artificial Sequence
  chemically synthesized
aggttattgattttttattact

SEQ ID NO: 1189318 - DNA, 22 bp, Artificial Sequence
  chemically synthesized
cagaatgacactagtaataaaa

SEQ ID NO: 1189319 - DNA, 22 bp, Artificial Sequence
  chemically synthesized
ttgattttttattactagtgtc

SEQ ID NO: 1189320 - DNA, 22 bp, Artificial Sequence
  chemically synthesized
attttttattactagtgtcatt

SEQ ID NO: 1189321 - DNA, 22 bp, Artificial Sequence
  chemically synthesized
tgatggactgcagaatgacact

SEQ ID NO: 1189322 - DNA, 22 bp, Artificial Sequence
  chemically synthesized
tttattactagtgtcattctgc

SEQ ID NO: 1189323 - DNA, 22 bp, Artificial Sequence
  chemically synthesized
ttattactagtgtcattctgca

SEQ ID NO: 1189324 - DNA, 22 bp, Artificial Sequence
  chemically synthesized
tattactagtgtcattctgcag

SEQ ID NO: 1189325 - DNA, 22 bp, Artificial Sequence
  chemically synthesized
attactagtgtcattctgcagt

SEQ ID NO: 1189326 - DNA, 22 bp, Artificial Sequence
  chemically synthesized
ttactagtgtcattctgcagtc

SEQ ID NO: 1189327 - DNA, 22 bp, Artificial Sequence
  chemically synthesized
ctagtgtcattctgcagtccat

SEQ ID NO: 1189328 - DNA, 22 bp, Artificial Sequence
  chemically synthesized
gtgtcattctgcagtccatcat

SEQ ID NO: 1189329 - DNA, 22 bp, Artificial Sequence
  chemically synthesized
aacagtaataaaacctatgatg

SEQ ID NO: 1189330 - DNA, 22 bp, Artificial Sequence
  chemically synthesized
tgcagtccatcataggttttat

SEQ ID NO: 1189331 - DNA, 22 bp, Artificial Sequence
  chemically synthesized
cagtccatcataggttttatta

SEQ ID NO: 1189332 - DNA, 22 bp, Artificial Sequence
  chemically synthesized
tgaaagaccattaaacagtaat

SEQ ID NO: 1189333 - DNA, 22 bp, Artificial Sequence
  chemically synthesized
cattgtgaaagaccattaaaca

SEQ ID NO: 1189334 - DNA, 22 bp, Artificial Sequence
  chemically synthesized
ccattgtgaaagaccattaaac

SEQ ID NO: 1189335 - DNA, 22 bp, Artificial Sequence
  chemically synthesized
tccattgtgaaagaccattaaa

SEQ ID NO: 1189336 - DNA, 22 bp, Artificial Sequence
  chemically synthesized
tattactgtttaatggtctttc

SEQ ID NO: 1189337 - DNA, 22 bp, Artificial Sequence
  chemically synthesized
attactgtttaatggtctttca

SEQ ID NO: 1189338 - DNA, 22 bp, Artificial Sequence
  chemically synthesized
ttactgtttaatggtctttcac

SEQ ID NO: 1189339 - DNA, 22 bp, Artificial Sequence
  chemically synthesized
aaatattttccattgtgaaaga

SEQ ID NO: 1189340 - DNA, 22 bp, Artificial Sequence
  chemically synthesized
ctgtttaatggtctttcacaat

SEQ ID NO: 1189341 - DNA, 22 bp, Artificial Sequence
  chemically synthesized
tttaatggtctttcacaatgga

SEQ ID NO: 1189342 - DNA, 22 bp, Artificial Sequence
  chemically synthesized
aatggtctttcacaatggaaaa

SEQ ID NO: 1189343 - DNA, 22 bp, Artificial Sequence
  chemically synthesized
atggtctttcacaatggaaaat

SEQ ID NO: 1189344 - DNA, 22 bp, Artificial Sequence
  chemically synthesized
ccaacacaaaattaaaatattt

SEQ ID NO: 1189345 - DNA, 22 bp, Artificial Sequence
  chemically synthesized
accaacacaaaattaaaatatt

SEQ ID NO: 1189346 - DNA, 22 bp, Artificial Sequence
  chemically synthesized
tcacaatggaaaatattttaat

SEQ ID NO: 1189347 - DNA, 22 bp, Artificial Sequence
  chemically synthesized
cacaatggaaaatattttaatt

SEQ ID NO: 1189348 - DNA, 22 bp, Artificial Sequence
  chemically synthesized
acaatggaaaatattttaattt

SEQ ID NO: 1189349 - DNA, 22 bp, Artificial Sequence
  chemically synthesized
taaaataccgacaaatttacca

SEQ ID NO: 1189350 - DNA, 22 bp, Artificial Sequence
  chemically synthesized
taattttgtgttggtaaatttg

SEQ ID NO: 1189351 - DNA, 22 bp, Artificial Sequence
  chemically synthesized
aattttgtgttggtaaatttgt

SEQ ID NO: 1189352 - DNA, 22 bp, Artificial Sequence
  chemically synthesized
attttgtgttggtaaatttgtc

SEQ ID NO: 1189353 - DNA, 22 bp, Artificial Sequence
  chemically synthesized
tgtgttggtaaatttgtcggta

SEQ ID NO: 1189354 - DNA, 22 bp, Artificial Sequence
  chemically synthesized
gaggctgtaaaataccgacaaa

SEQ ID NO: 1189355 - DNA, 22 bp, Artificial Sequence
  chemically synthesized
gtgttggtaaatttgtcggtat

SEQ ID NO: 1189356 - DNA, 22 bp, Artificial Sequence
  chemically synthesized
tgttggtaaatttgtcggtatt

SEQ ID NO: 1189357 - DNA, 22 bp, Artificial Sequence
  chemically synthesized
gtaaatttgtcggtattttaca

SEQ ID NO: 1189358 - DNA, 22 bp, Artificial Sequence
  chemically synthesized
gtcggtattttacagcctctag

SEQ ID NO: 1189359 - DNA, 22 bp, Artificial Sequence
  chemically synthesized
tcggtattttacagcctctagg

SEQ ID NO: 1189360 - DNA, 22 bp, Artificial Sequence
  chemically synthesized
aggtgatataaaacctagaggc

SEQ ID NO: 1189361 - DNA, 22 bp, Artificial Sequence
  chemically synthesized
tacagcctctaggttttatatc

SEQ ID NO: 1189362 - DNA, 22 bp, Artificial Sequence
  chemically synthesized
acagcctctaggttttatatca

SEQ ID NO: 1189363 - DNA, 22 bp, Artificial Sequence
  chemically synthesized
cagcctctaggttttatatcac

SEQ ID NO: 1189364 - DNA, 22 bp, Artificial Sequence
  chemically synthesized
caataatattaaggtgatataa

SEQ ID NO: 1189365 - DNA, 22 bp, Artificial Sequence
  chemically synthesized
taggttttatatcaccttaata

SEQ ID NO: 1189366 - DNA, 22 bp, Artificial Sequence
  chemically synthesized
ggttttatatcaccttaatatt

SEQ ID NO: 1189367 - DNA, 22 bp, Artificial Sequence
  chemically synthesized
tatatcaccttaatattattgt

SEQ ID NO: 1189368 - DNA, 22 bp, Artificial Sequence
  chemically synthesized
atatcaccttaatattattgta

SEQ ID NO: 1189369 - DNA, 22 bp, Artificial Sequence
  chemically synthesized
tatcaccttaatattattgtaa

SEQ ID NO: 1189370 - DNA, 22 bp, Artificial Sequence
  chemically synthesized
caatgtagaagaatattacaat

SEQ ID NO: 1189371 - DNA, 22 bp, Artificial Sequence
  chemically synthesized
ttacaatgtagaagaatattac

SEQ ID NO: 1189372 - DNA, 22 bp, Artificial Sequence
  chemically synthesized
attacaatgtagaagaatatta

SEQ ID NO: 1189373 - DNA, 22 bp, Artificial Sequence
  chemically synthesized
tattacaatgtagaagaatatt

SEQ ID NO: 1189374 - DNA, 22 bp, Artificial Sequence
  chemically synthesized
aatattattgtaatattcttct

SEQ ID NO: 1189375 - DNA, 22 bp, Artificial Sequence
  chemically synthesized
atattattgtaatattcttcta

SEQ ID NO: 1189376 - DNA, 22 bp, Artificial Sequence
  chemically synthesized
aatactttattacaatgtagaa

SEQ ID NO: 1189377 - DNA, 22 bp, Artificial Sequence
  chemically synthesized
ttgtaatattcttctacattgt

SEQ ID NO: 1189378 - DNA, 22 bp, Artificial Sequence
  chemically synthesized
aaatactttattacaatgtaga

SEQ ID NO: 1189379 - DNA, 22 bp, Artificial Sequence
  chemically synthesized
taatattcttctacattgtaat

SEQ ID NO: 1189380 - DNA, 22 bp, Artificial Sequence
  chemically synthesized
ttctacattgtaataaagtatt

SEQ ID NO: 1189381 - DNA, 22 bp, Artificial Sequence
  chemically synthesized
ctacattgtaataaagtattta

SEQ ID NO: 1189382 - DNA, 22 bp, Artificial Sequence
  chemically synthesized
tacattgtaataaagtatttaa

SEQ ID NO: 1189383 - DNA, 22 bp, Artificial Sequence
  chemically synthesized
cattgtaataaagtatttaaat

SEQ ID NO: 1189384 - DNA, 22 bp, Artificial Sequence
  chemically synthesized
aatgtgaataaacatttaaata

SEQ ID NO: 1189385 - DNA, 22 bp, Artificial Sequence
  chemically synthesized
taataaagtatttaaatgttta

SEQ ID NO: 1189386 - DNA, 22 bp, Artificial Sequence
  chemically synthesized
agataatgattgaatgtgaata

SEQ ID NO: 1189387 - DNA, 22 bp, Artificial Sequence
  chemically synthesized
cagataatgattgaatgtgaat

SEQ ID NO: 1189388 - DNA, 22 bp, Artificial Sequence
  chemically synthesized
tcagataatgattgaatgtgaa

SEQ ID NO: 1189389 - DNA, 22 bp, Artificial Sequence
  chemically synthesized
aaatgtttattcacattcaatc

SEQ ID NO: 1189390 - DNA, 22 bp, Artificial Sequence
  chemically synthesized
aatgtttattcacattcaatca

SEQ ID NO: 1189391 - DNA, 22 bp, Artificial Sequence
  chemically synthesized
agataactttcagataatgatt

SEQ ID NO: 1189392 - DNA, 22 bp, Artificial Sequence
  chemically synthesized
attcacattcaatcattatctg

SEQ ID NO: 1189393 - DNA, 22 bp, Artificial Sequence
  chemically synthesized
ttcacattcaatcattatctga

SEQ ID NO: 1189394 - DNA, 22 bp, Artificial Sequence
  chemically synthesized
acattcaatcattatctgaaag

SEQ ID NO: 1189395 - DNA, 22 bp, Artificial Sequence
  chemically synthesized
aatcattatctgaaagttatct

SEQ ID NO: 1189396 - DNA, 22 bp, Artificial Sequence
  chemically synthesized
tctgaaagttatcttagtattt

SEQ ID NO: 1189397 - DNA, 22 bp, Artificial Sequence
  chemically synthesized
aaagttatcttagtatttgttg

SEQ ID NO: 1189398 - DNA, 22 bp, Artificial Sequence
  chemically synthesized
tggaaacccaaggcacaacaaa

SEQ ID NO: 1189399 - DNA, 22 bp, Artificial Sequence
  chemically synthesized
tcttagtatttgttgtgccttg

SEQ ID NO: 1189400 - DNA, 22 bp, Artificial Sequence
  chemically synthesized
aactgtggaaacccaaggcaca

SEQ ID NO: 1189401 - DNA, 22 bp, Artificial Sequence
  chemically synthesized
caactgtggaaacccaaggcac

SEQ ID NO: 1189402 - DNA, 22 bp, Artificial Sequence
  chemically synthesized
agtatttgttgtgccttgggtt

SEQ ID NO: 1189403 - DNA, 22 bp, Artificial Sequence
  chemically synthesized
gtatttgttgtgccttgggttt

SEQ ID NO: 1189404 - DNA, 22 bp, Artificial Sequence
  chemically synthesized
gttgtgccttgggtttccacag

SEQ ID NO: 1189405 - DNA, 22 bp, Artificial Sequence
  chemically synthesized
ttgtgccttgggtttccacagt

SEQ ID NO: 1189406 - DNA, 22 bp, Artificial Sequence
  chemically synthesized
ataaagccttcaactgtggaaa

SEQ ID NO: 1189407 - DNA, 22 bp, Artificial Sequence
  chemically synthesized
tgccttgggtttccacagttga

SEQ ID NO: 1189408 - DNA, 22 bp, Artificial Sequence
  chemically synthesized
gctaataaagccttcaactgtg

SEQ ID NO: 1189409 - DNA, 22 bp, Artificial Sequence
  chemically synthesized
gggtttccacagttgaaggctt

SEQ ID NO: 1189410 - DNA, 22 bp, Artificial Sequence
  chemically synthesized
ggtttccacagttgaaggcttt

SEQ ID NO: 1189411 - DNA, 22 bp, Artificial Sequence
  chemically synthesized
ccacagttgaaggctttattag

SEQ ID NO: 1189412 - DNA, 22 bp, Artificial Sequence
  chemically synthesized
cacagttgaaggctttattagc

SEQ ID NO: 1189413 - DNA, 22 bp, Artificial Sequence
  chemically synthesized
gagatagaataggttagctaat

SEQ ID NO: 1189414 - DNA, 22 bp, Artificial Sequence
  chemically synthesized
tagagatagaataggttagcta

SEQ ID NO: 1189415 - DNA, 22 bp, Artificial Sequence
  chemically synthesized
aaggctttattagctaacctat

SEQ ID NO: 1189416 - DNA, 22 bp, Artificial Sequence
  chemically synthesized
atgtctctagagatagaatagg

SEQ ID NO: 1189417 - DNA, 22 bp, Artificial Sequence
  chemically synthesized
catgtctctagagatagaatag

SEQ ID NO: 1189418 - DNA, 22 bp, Artificial Sequence
  chemically synthesized
tattagctaacctattctatct

SEQ ID NO: 1189419 - DNA, 22 bp, Artificial Sequence
  chemically synthesized
attagctaacctattctatctc

SEQ ID NO: 1189420 - DNA, 22 bp, Artificial Sequence
  chemically synthesized
ttagctaacctattctatctct

SEQ ID NO: 1189421 - DNA, 22 bp, Artificial Sequence
  chemically synthesized
gctaacctattctatctctaga

SEQ ID NO: 1189422 - DNA, 22 bp, Artificial Sequence
  chemically synthesized
acctattctatctctagagaca

SEQ ID NO: 1189423 - DNA, 22 bp, Artificial Sequence
  chemically synthesized
gggtgacatttcatgtctctag

SEQ ID NO: 1189424 - DNA, 22 bp, Artificial Sequence
  chemically synthesized
ttctatctctagagacatgaaa

SEQ ID NO: 1189425 - DNA, 22 bp, Artificial Sequence
  chemically synthesized
tatctctagagacatgaaatgt

SEQ ID NO: 1189426 - DNA, 22 bp, Artificial Sequence
  chemically synthesized
tctctagagacatgaaatgtca

SEQ ID NO: 1189427 - DNA, 22 bp, Artificial Sequence
  chemically synthesized
gtacacaattagggtgacattt

SEQ ID NO: 1189428 - DNA, 22 bp, Artificial Sequence
  chemically synthesized
agtacacaattagggtgacatt

SEQ ID NO: 1189429 - DNA, 22 bp, Artificial Sequence
  chemically synthesized
tagagacatgaaatgtcaccct

SEQ ID NO: 1189430 - DNA, 22 bp, Artificial Sequence
  chemically synthesized
gagacatgaaatgtcaccctaa

SEQ ID NO: 1189431 - DNA, 22 bp, Artificial Sequence
  chemically synthesized
ggtaaatttagtacacaattag

SEQ ID NO: 1189432 - DNA, 22 bp, Artificial Sequence
  chemically synthesized
aggtaaatttagtacacaatta

SEQ ID NO: 1189433 - DNA, 22 bp, Artificial Sequence
  chemically synthesized
tttaggtaaatttagtacacaa

SEQ ID NO: 1189434 - DNA, 22 bp, Artificial Sequence
  chemically synthesized
atttaggtaaatttagtacaca

SEQ ID NO: 1189435 - DNA, 22 bp, Artificial Sequence
  chemically synthesized
tatttaggtaaatttagtacac

SEQ ID NO: 1189436 - DNA, 22 bp, Artificial Sequence
  chemically synthesized
ttatttaggtaaatttagtaca

SEQ ID NO: 1189437 - DNA, 22 bp, Artificial Sequence
  chemically synthesized
ccttttatttaggtaaatttag

SEQ ID NO: 1189438 - DNA, 22 bp, Artificial Sequence
  chemically synthesized
attgtgtactaaatttacctaa

SEQ ID NO: 1189439 - DNA, 22 bp, Artificial Sequence
  chemically synthesized
tgtactaaatttacctaaataa

SEQ ID NO: 1189440 - DNA, 22 bp, Artificial Sequence
  chemically synthesized
acaacattcccttttatttagg

SEQ ID NO: 1189441 - DNA, 22 bp, Artificial Sequence
  chemically synthesized
gacaacattcccttttatttag

SEQ ID NO: 1189442 - DNA, 22 bp, Artificial Sequence
  chemically synthesized
tgacaacattcccttttattta

SEQ ID NO: 1189443 - DNA, 22 bp, Artificial Sequence
  chemically synthesized
aatttacctaaataaaagggaa

SEQ ID NO: 1189444 - DNA, 22 bp, Artificial Sequence
  chemically synthesized
acctaaataaaagggaatgttg

SEQ ID NO: 1189445 - DNA, 22 bp, Artificial Sequence
  chemically synthesized
cctaaataaaagggaatgttgt

SEQ ID NO: 1189446 - DNA, 22 bp, Artificial Sequence
  chemically synthesized
aataaaagggaatgttgtcaaa

SEQ ID NO: 1189447 - DNA, 22 bp, Artificial Sequence
  chemically synthesized
atggtgtggaatagatattttg

SEQ ID NO: 1189448 - DNA, 22 bp, Artificial Sequence
  chemically synthesized
aatggtgtggaatagatatttt

SEQ ID NO: 1189449 - DNA, 22 bp, Artificial Sequence
  chemically synthesized
tcaaaatatctattccacacca

SEQ ID NO: 1189450 - DNA, 22 bp, Artificial Sequence
  chemically synthesized
ttccacaccattaaattatttc

SEQ ID NO: 1189451 - DNA, 22 bp, Artificial Sequence
  chemically synthesized
cacaccattaaattatttctct

SEQ ID NO: 1189452 - DNA, 22 bp, Artificial Sequence
  chemically synthesized
acatagtatgacatgatagaga

SEQ ID NO: 1189453 - DNA, 22 bp, Artificial Sequence
  chemically synthesized
aacatagtatgacatgatagag

SEQ ID NO: 1189454 - DNA, 22 bp, Artificial Sequence
  chemically synthesized
aattatttctctatcatgtcat

SEQ ID NO: 1189455 - DNA, 22 bp, Artificial Sequence
  chemically synthesized
tttctctatcatgtcatactat

SEQ ID NO: 1189456 - DNA, 22 bp, Artificial Sequence
  chemically synthesized
taacatacttaacatagtatga

SEQ ID NO: 1189457 - DNA, 22 bp, Artificial Sequence
  chemically synthesized
ataacatacttaacatagtatg

SEQ ID NO: 1189458 - DNA, 22 bp, Artificial Sequence
  chemically synthesized
ctctatcatgtcatactatgtt

SEQ ID NO: 1189459 - DNA, 22 bp, Artificial Sequence
  chemically synthesized
tataacatacttaacatagtat

SEQ ID NO: 1189460 - DNA, 22 bp, Artificial Sequence
  chemically synthesized
tctatcatgtcatactatgtta

SEQ ID NO: 1189461 - DNA, 22 bp, Artificial Sequence
  chemically synthesized
tatcatgtcatactatgttaag

SEQ ID NO: 1189462 - DNA, 22 bp, Artificial Sequence
  chemically synthesized
tcatgtcatactatgttaagta

SEQ ID NO: 1189463 - DNA, 22 bp, Artificial Sequence
  chemically synthesized
gtagattttataacatacttaa

SEQ ID NO: 1189464 - DNA, 22 bp, Artificial Sequence
  chemically synthesized
agtagattttataacatactta

SEQ ID NO: 1189465 - DNA, 22 bp, Artificial Sequence
  chemically synthesized
tagtagattttataacatactt

SEQ ID NO: 1189466 - DNA, 22 bp, Artificial Sequence
  chemically synthesized
ctttagtagattttataacata

SEQ ID NO: 1189467 - DNA, 22 bp, Artificial Sequence
  chemically synthesized
gctttagtagattttataacat

SEQ ID NO: 1189468 - DNA, 22 bp, Artificial Sequence
  chemically synthesized
tgttaagtatgttataaaatct

SEQ ID NO: 1189469 - DNA, 22 bp, Artificial Sequence
  chemically synthesized
agtatgttataaaatctactaa

SEQ ID NO: 1189470 - DNA, 22 bp, Artificial Sequence
  chemically synthesized
aaacaggtgatttgctttagta

SEQ ID NO: 1189471 - DNA, 22 bp, Artificial Sequence
  chemically synthesized
caaacaggtgatttgctttagt

SEQ ID NO: 1189472 - DNA, 22 bp, Artificial Sequence
  chemically synthesized
tcaaacaggtgatttgctttag

SEQ ID NO: 1189473 - DNA, 22 bp, Artificial Sequence
  chemically synthesized
taaaatctactaaagcaaatca

SEQ ID NO: 1189474 - DNA, 22 bp, Artificial Sequence
  chemically synthesized
ttttcaaacaggtgatttgctt

SEQ ID NO: 1189475 - DNA, 22 bp, Artificial Sequence
  chemically synthesized
agaaattattttcaaacaggtg

SEQ ID NO: 1189476 - DNA, 22 bp, Artificial Sequence
  chemically synthesized
ctaaagcaaatcacctgtttga

SEQ ID NO: 1189477 - DNA, 22 bp, Artificial Sequence
  chemically synthesized
aagcaaatcacctgtttgaaaa

SEQ ID NO: 1189478 - DNA, 22 bp, Artificial Sequence
  chemically synthesized
tttgaaaataatttcttaactg

SEQ ID NO: 1189479 - DNA, 22 bp, Artificial Sequence
  chemically synthesized
gaaaataatttcttaactgtac

SEQ ID NO: 1189480 - DNA, 22 bp, Artificial Sequence
  chemically synthesized
aaaataatttcttaactgtact

SEQ ID NO: 1189481 - DNA, 22 bp, Artificial Sequence
  chemically synthesized
aatgtaaatgcgtgagtacagt

SEQ ID NO: 1189482 - DNA, 22 bp, Artificial Sequence
  chemically synthesized
aaatgtaaatgcgtgagtacag

SEQ ID NO: 1189483 - DNA, 22 bp, Artificial Sequence
  chemically synthesized
tttaaatgtaaatgcgtgagta

SEQ ID NO: 1189484 - DNA, 22 bp, Artificial Sequence
  chemically synthesized
gtttaaatgtaaatgcgtgagt

SEQ ID NO: 1189485 - DNA, 22 bp, Artificial Sequence
  chemically synthesized
cttaactgtactcacgcattta

SEQ ID NO: 1189486 - DNA, 22 bp, Artificial Sequence
  chemically synthesized
ttaactgtactcacgcatttac

SEQ ID NO: 1189487 - DNA, 22 bp, Artificial Sequence
  chemically synthesized
aactgtactcacgcatttacat

SEQ ID NO: 1189488 - DNA, 22 bp, Artificial Sequence
  chemically synthesized
aaatttgtttaaatgtaaatgc

SEQ ID NO: 1189489 - DNA, 22 bp, Artificial Sequence
  chemically synthesized
actgtactcacgcatttacatt

SEQ ID NO: 1189490 - DNA, 22 bp, Artificial Sequence
  chemically synthesized
taaaatttgtttaaatgtaaat

SEQ ID NO: 1189491 - DNA, 22 bp, Artificial Sequence
  chemically synthesized
tactcacgcatttacatttaaa

SEQ ID NO: 1189492 - DNA, 22 bp, Artificial Sequence
  chemically synthesized
acgcatttacatttaaacaaat

SEQ ID NO: 1189493 - DNA, 22 bp, Artificial Sequence
  chemically synthesized
gataattctaaaatttgtttaa

SEQ ID NO: 1189494 - DNA, 22 bp, Artificial Sequence
  chemically synthesized
tagataattctaaaatttgttt

SEQ ID NO: 1189495 - DNA, 22 bp, Artificial Sequence
  chemically synthesized
ctagataattctaaaatttgtt

SEQ ID NO: 1189496 - DNA, 22 bp, Artificial Sequence
  chemically synthesized
tctagataattctaaaatttgt

SEQ ID NO: 1189497 - DNA, 22 bp, Artificial Sequence
  chemically synthesized
acatttaaacaaattttagaat

SEQ ID NO: 1189498 - DNA, 22 bp, Artificial Sequence
  chemically synthesized
catttaaacaaattttagaatt

SEQ ID NO: 1189499 - DNA, 22 bp, Artificial Sequence
  chemically synthesized
agttttctagataattctaaaa

SEQ ID NO: 1189500 - DNA, 22 bp, Artificial Sequence
  chemically synthesized
aaacaaattttagaattatcta

SEQ ID NO: 1189501 - DNA, 22 bp, Artificial Sequence
  chemically synthesized
aacaaattttagaattatctag

SEQ ID NO: 1189502 - DNA, 22 bp, Artificial Sequence
  chemically synthesized
tagaattatctagaaaactgaa

SEQ ID NO: 1189503 - DNA, 22 bp, Artificial Sequence
  chemically synthesized
agaattatctagaaaactgaat

SEQ ID NO: 1189504 - DNA, 22 bp, Artificial Sequence
  chemically synthesized
gaattatctagaaaactgaatc

SEQ ID NO: 1189505 - DNA, 22 bp, Artificial Sequence
  chemically synthesized
tctagaaaactgaatccctctt

SEQ ID NO: 1189506 - DNA, 22 bp, Artificial Sequence
  chemically synthesized
gaaaactgaatccctcttacca

SEQ ID NO: 1189507 - DNA, 22 bp, Artificial Sequence
  chemically synthesized
aacataaatcacatgaatggta

SEQ ID NO: 1189508 - DNA, 22 bp, Artificial Sequence
  chemically synthesized
aatccctcttaccattcatgtg

SEQ ID NO: 1189509 - DNA, 22 bp, Artificial Sequence
  chemically synthesized
ttaccattcatgtgatttatgt

SEQ ID NO: 1189510 - DNA, 22 bp, Artificial Sequence
  chemically synthesized
accattcatgtgatttatgttc

SEQ ID NO: 1189511 - DNA, 22 bp, Artificial Sequence
  chemically synthesized
ccattcatgtgatttatgttca

SEQ ID NO: 1189512 - DNA, 22 bp, Artificial Sequence
  chemically synthesized
agggtgagcacactgaacataa

SEQ ID NO: 1189513 - DNA, 22 bp, Artificial Sequence
  chemically synthesized
atgtgatttatgttcagtgtgc

SEQ ID NO: 1189514 - DNA, 22 bp, Artificial Sequence
  chemically synthesized
tgttcagggtgagcacactgaa

SEQ ID NO: 1189515 - DNA, 22 bp, Artificial Sequence
  chemically synthesized
atgttcagggtgagcacactga

SEQ ID NO: 1189516 - DNA, 22 bp, Artificial Sequence
  chemically synthesized
atgttcagtgtgctcaccctga

SEQ ID NO: 1189517 - DNA, 22 bp, Artificial Sequence
  chemically synthesized
tgttcagtgtgctcaccctgaa

SEQ ID NO: 1189518 - DNA, 22 bp, Artificial Sequence
  chemically synthesized
agtgtgctcaccctgaacataa

SEQ ID NO: 1189519 - DNA, 22 bp, Artificial Sequence
  chemically synthesized
accctgaacataaacacccttt

SEQ ID NO: 1189520 - DNA, 22 bp, Artificial Sequence
  chemically synthesized
gagaataagcagagaagaaagg

SEQ ID NO: 1189521 - DNA, 22 bp, Artificial Sequence
  chemically synthesized
aacataaacaccctttcttctc

SEQ ID NO: 1189522 - DNA, 22 bp, Artificial Sequence
  chemically synthesized
agagaataagcagagaagaaag

SEQ ID NO: 1189523 - DNA, 22 bp, Artificial Sequence
  chemically synthesized
tcttctctgcttattctctaag

SEQ ID NO: 1189524 - DNA, 22 bp, Artificial Sequence
  chemically synthesized
cttctctgcttattctctaagt

SEQ ID NO: 1189525 - DNA, 22 bp, Artificial Sequence
  chemically synthesized
ttctctgcttattctctaagtg

SEQ ID NO: 1189526 - DNA, 22 bp, Artificial Sequence
  chemically synthesized
ctctgcttattctctaagtggc

SEQ ID NO: 1189527 - DNA, 22 bp, Artificial Sequence
  chemically synthesized
tctgcttattctctaagtggct

SEQ ID NO: 1189528 - DNA, 22 bp, Artificial Sequence
  chemically synthesized
tgcttattctctaagtggctga

SEQ ID NO: 1189529 - DNA, 22 bp, Artificial Sequence
  chemically synthesized
cttattctctaagtggctgacc

SEQ ID NO: 1189530 - DNA, 22 bp, Artificial Sequence
  chemically synthesized
attctctaagtggctgaccctt

SEQ ID NO: 1189531 - DNA, 22 bp, Artificial Sequence
  chemically synthesized
ttctctaagtggctgacccttt

SEQ ID NO: 1189532 - DNA, 22 bp, Artificial Sequence
  chemically synthesized
tctaagtggctgaccctttcac

SEQ ID NO: 1189533 - DNA, 22 bp, Artificial Sequence
  chemically synthesized
taagtggctgaccctttcacac

SEQ ID NO: 1189534 - DNA, 22 bp, Artificial Sequence
  chemically synthesized
agtggctgaccctttcacactg

SEQ ID NO: 1189535 - DNA, 22 bp, Artificial Sequence
  chemically synthesized
atgatcacaggagatacagtgt

SEQ ID NO: 1189536 - DNA, 22 bp, Artificial Sequence
  chemically synthesized
accctttcacactgtatctcct

SEQ ID NO: 1189537 - DNA, 22 bp, Artificial Sequence
  chemically synthesized
gccagctaatgatcacaggaga

SEQ ID NO: 1189538 - DNA, 22 bp, Artificial Sequence
  chemically synthesized
tcacactgtatctcctgtgatc

SEQ ID NO: 1189539 - DNA, 22 bp, Artificial Sequence
  chemically synthesized
cacactgtatctcctgtgatca

SEQ ID NO: 1189540 - DNA, 22 bp, Artificial Sequence
  chemically synthesized
acactgtatctcctgtgatcat

SEQ ID NO: 1189541 - DNA, 22 bp, Artificial Sequence
  chemically synthesized
gaatctagccagctaatgatca

SEQ ID NO: 1189542 - DNA, 22 bp, Artificial Sequence
  chemically synthesized
tatctcctgtgatcattagctg

SEQ ID NO: 1189543 - DNA, 22 bp, Artificial Sequence
  chemically synthesized
ctgtgatcattagctggctaga

SEQ ID NO: 1189544 - DNA, 22 bp, Artificial Sequence
  chemically synthesized
atgcaactggaatctagccagc

SEQ ID NO: 1189545 - DNA, 22 bp, Artificial Sequence
  chemically synthesized
aatgcaactggaatctagccag

SEQ ID NO: 1189546 - DNA, 22 bp, Artificial Sequence
  chemically synthesized
tgatcattagctggctagattc

SEQ ID NO: 1189547 - DNA, 22 bp, Artificial Sequence
  chemically synthesized
ccaccagcttaatgcaactgga

SEQ ID NO: 1189548 - DNA, 22 bp, Artificial Sequence
  chemically synthesized
gctggctagattccagttgcat

SEQ ID NO: 1189549 - DNA, 22 bp, Artificial Sequence
  chemically synthesized
cccaccagcttaatgcaactgg

SEQ ID NO: 1189550 - DNA, 22 bp, Artificial Sequence
  chemically synthesized
gctagattccagttgcattaag

SEQ ID NO: 1189551 - DNA, 22 bp, Artificial Sequence
  chemically synthesized
gtacttcccaccagcttaatgc

SEQ ID NO: 1189552 - DNA, 22 bp, Artificial Sequence
  chemically synthesized
gattccagttgcattaagctgg

SEQ ID NO: 1189553 - DNA, 22 bp, Artificial Sequence
  chemically synthesized
cagctggtacttcccaccagct

SEQ ID NO: 1189554 - DNA, 22 bp, Artificial Sequence
  chemically synthesized
cagttgcattaagctggtggga

SEQ ID NO: 1189555 - DNA, 22 bp, Artificial Sequence
  chemically synthesized
aatctccagctggtacttccca

SEQ ID NO: 1189556 - DNA, 22 bp, Artificial Sequence
  chemically synthesized
cattaagctggtgggaagtacc

SEQ ID NO: 1189557 - DNA, 22 bp, Artificial Sequence
  chemically synthesized
caatctccagctggtacttccc

SEQ ID NO: 1189558 - DNA, 22 bp, Artificial Sequence
  chemically synthesized
tcaatctccagctggtacttcc

SEQ ID NO: 1189559 - DNA, 22 bp, Artificial Sequence
  chemically synthesized
tttcaatctccagctggtactt

SEQ ID NO: 1189560 - DNA, 22 bp, Artificial Sequence
  chemically synthesized
ctttcaatctccagctggtact

SEQ ID NO: 1189561 - DNA, 22 bp, Artificial Sequence
  chemically synthesized
agctggtgggaagtaccagctg

SEQ ID NO: 1189562 - DNA, 22 bp, Artificial Sequence
  chemically synthesized
ttctttcaatctccagctggta

SEQ ID NO: 1189563 - DNA, 22 bp, Artificial Sequence
  chemically synthesized
gtgggaagtaccagctggagat

SEQ ID NO: 1189564 - DNA, 22 bp, Artificial Sequence
  chemically synthesized
cctcttctttcaatctccagct

SEQ ID NO: 1189565 - DNA, 22 bp, Artificial Sequence
  chemically synthesized
ccctcttctttcaatctccagc

SEQ ID NO: 1189566 - DNA, 22 bp, Artificial Sequence
  chemically synthesized
tccctcttctttcaatctccag

SEQ ID NO: 1189567 - DNA, 22 bp, Artificial Sequence
  chemically synthesized
tttccctcttctttcaatctcc

SEQ ID NO: 1189568 - DNA, 22 bp, Artificial Sequence
  chemically synthesized
tctttccctcttctttcaatct

SEQ ID NO: 1189569 - DNA, 22 bp, Artificial Sequence
  chemically synthesized
ctctttccctcttctttcaatc

SEQ ID NO: 1189570 - DNA, 22 bp, Artificial Sequence
  chemically synthesized
tctctttccctcttctttcaat

SEQ ID NO: 1189571 - DNA, 22 bp, Artificial Sequence
  chemically synthesized
cccagctttctctttccctctt

SEQ ID NO: 1189572 - DNA, 22 bp, Artificial Sequence
  chemically synthesized
gagattgaaagaagagggaaag

SEQ ID NO: 1189573 - DNA, 22 bp, Artificial Sequence
  chemically synthesized
ccccagctttctctttccctct

SEQ ID NO: 1189574 - DNA, 22 bp, Artificial Sequence
  chemically synthesized
aaagaagagggaaagagaaagc

SEQ ID NO: 1189575 - DNA, 22 bp, Artificial Sequence
  chemically synthesized
gagcagggaaataatagagaaa

SEQ ID NO: 1189576 - DNA, 22 bp, Artificial Sequence
  chemically synthesized
tggagcagggaaataatagaga

SEQ ID NO: 1189577 - DNA, 22 bp, Artificial Sequence
  chemically synthesized
gggaaatttctctattatttcc

SEQ ID NO: 1189578 - DNA, 22 bp, Artificial Sequence
  chemically synthesized
tgcagctctggagcagggaaat

SEQ ID NO: 1189579 - DNA, 22 bp, Artificial Sequence
  chemically synthesized
ctctattatttccctgctccag

SEQ ID NO: 1189580 - DNA, 22 bp, Artificial Sequence
  chemically synthesized
cattatgcagctctggagcagg

SEQ ID NO: 1189581 - DNA, 22 bp, Artificial Sequence
  chemically synthesized
tctattatttccctgctccaga

SEQ ID NO: 1189582 - DNA, 22 bp, Artificial Sequence
  chemically synthesized
tattatttccctgctccagagc

SEQ ID NO: 1189583 - DNA, 22 bp, Artificial Sequence
  chemically synthesized
ttatttccctgctccagagctg

SEQ ID NO: 1189584 - DNA, 22 bp, Artificial Sequence
  chemically synthesized
tttccctgctccagagctgcat

SEQ ID NO: 1189585 - DNA, 22 bp, Artificial Sequence
  chemically synthesized
agatactacattatgcagctct

SEQ ID NO: 1189586 - DNA, 22 bp, Artificial Sequence
  chemically synthesized
ccctgctccagagctgcataat

SEQ ID NO: 1189587 - DNA, 22 bp, Artificial Sequence
  chemically synthesized
cctgctccagagctgcataatg

SEQ ID NO: 1189588 - DNA, 22 bp, Artificial Sequence
  chemically synthesized
ctccagagctgcataatgtagt

SEQ ID NO: 1189589 - DNA, 22 bp, Artificial Sequence
  chemically synthesized
gtagaactcagatactacatta

SEQ ID NO: 1189590 - DNA, 22 bp, Artificial Sequence
  chemically synthesized
cagagctgcataatgtagtatc

SEQ ID NO: 1189591 - DNA, 22 bp, Artificial Sequence
  chemically synthesized
ttggtagaactcagatactaca

SEQ ID NO: 1189592 - DNA, 22 bp, Artificial Sequence
  chemically synthesized
cataatgtagtatctgagttct

SEQ ID NO: 1189593 - DNA, 22 bp, Artificial Sequence
  chemically synthesized
agttctaccaacaactacattc

SEQ ID NO: 1189594 - DNA, 22 bp, Artificial Sequence
  chemically synthesized
caccaatggagggaatgtagtt

SEQ ID NO: 1189595 - DNA, 22 bp, Artificial Sequence
  chemically synthesized
taccaacaactacattccctcc

SEQ ID NO: 1189596 - DNA, 22 bp, Artificial Sequence
  chemically synthesized
ccaacaactacattccctccat

SEQ ID NO: 1189597 - DNA, 22 bp, Artificial Sequence
  chemically synthesized
agtgaaagctgcaccaatggag

SEQ ID NO: 1189598 - DNA, 22 bp, Artificial Sequence
  chemically synthesized
cattccctccattggtgcagct

SEQ ID NO: 1189599 - DNA, 22 bp, Artificial Sequence
  chemically synthesized
cctccattggtgcagctttcac

SEQ ID NO: 1189600 - DNA, 22 bp, Artificial Sequence
  chemically synthesized
cattggtgcagctttcactgaa

SEQ ID NO: 1189601 - DNA, 22 bp, Artificial Sequence
  chemically synthesized
gtgcagctttcactgaactccg

SEQ ID NO: 1189602 - DNA, 22 bp, Artificial Sequence
  chemically synthesized
aaaggaaagggggaacggagtt

SEQ ID NO: 1189603 - DNA, 22 bp, Artificial Sequence
  chemically synthesized
tcactgaactccgttccccctt

SEQ ID NO: 1189604 - DNA, 22 bp, Artificial Sequence
  chemically synthesized
cactgaactccgttcccccttt

SEQ ID NO: 1189605 - DNA, 22 bp, Artificial Sequence
  chemically synthesized
actgaactccgttccccctttc

SEQ ID NO: 1189606 - DNA, 22 bp, Artificial Sequence
  chemically synthesized
tatagtagctgaaaggaaaggg

SEQ ID NO: 1189607 - DNA, 22 bp, Artificial Sequence
  chemically synthesized
aactccgttccccctttccttt

SEQ ID NO: 1189608 - DNA, 22 bp, Artificial Sequence
  chemically synthesized
ctatatagtagctgaaaggaaa

SEQ ID NO: 1189609 - DNA, 22 bp, Artificial Sequence
  chemically synthesized
cgttccccctttcctttcagct

SEQ ID NO: 1189610 - DNA, 22 bp, Artificial Sequence
  chemically synthesized
ctactatatagtagctgaaagg

SEQ ID NO: 1189611 - DNA, 22 bp, Artificial Sequence
  chemically synthesized
ttcctactatatagtagctgaa

SEQ ID NO: 1189612 - DNA, 22 bp, Artificial Sequence
  chemically synthesized
cccctttcctttcagctactat

SEQ ID NO: 1189613 - DNA, 22 bp, Artificial Sequence
  chemically synthesized
ctattcctactatatagtagct

SEQ ID NO: 1189614 - DNA, 22 bp, Artificial Sequence
  chemically synthesized
tactattcctactatatagtag

SEQ ID NO: 1189615 - DNA, 22 bp, Artificial Sequence
  chemically synthesized
ctactattcctactatatagta

SEQ ID NO: 1189616 - DNA, 22 bp, Artificial Sequence
  chemically synthesized
tcctttcagctactatatagta

SEQ ID NO: 1189617 - DNA, 22 bp, Artificial Sequence
  chemically synthesized
cctttcagctactatatagtag

SEQ ID NO: 1189618 - DNA, 22 bp, Artificial Sequence
  chemically synthesized
tttctactattcctactatata

SEQ ID NO: 1189619 - DNA, 22 bp, Artificial Sequence
  chemically synthesized
ctttcagctactatatagtagg

SEQ ID NO: 1189620 - DNA, 22 bp, Artificial Sequence
  chemically synthesized
ctatttctactattcctactat

SEQ ID NO: 1189621 - DNA, 22 bp, Artificial Sequence
  chemically synthesized
tcagctactatatagtaggaat

SEQ ID NO: 1189622 - DNA, 22 bp, Artificial Sequence
  chemically synthesized
cagctactatatagtaggaata

SEQ ID NO: 1189623 - DNA, 22 bp, Artificial Sequence
  chemically synthesized
agctactatatagtaggaatag

SEQ ID NO: 1189624 - DNA, 22 bp, Artificial Sequence
  chemically synthesized
ctatatagtaggaatagtagaa

SEQ ID NO: 1189625 - DNA, 22 bp, Artificial Sequence
  chemically synthesized
tatagtaggaatagtagaaata

SEQ ID NO: 1189626 - DNA, 22 bp, Artificial Sequence
  chemically synthesized
gagaggagcaatagtaggaagt

SEQ ID NO: 1189627 - DNA, 22 bp, Artificial Sequence
  chemically synthesized
cttcctactattgctcctctct

SEQ ID NO: 1189628 - DNA, 22 bp, Artificial Sequence
  chemically synthesized
cctactattgctcctctctaga

SEQ ID NO: 1189629 - DNA, 22 bp, Artificial Sequence
  chemically synthesized
ctactattgctcctctctagat

SEQ ID NO: 1189630 - DNA, 22 bp, Artificial Sequence
  chemically synthesized
ctattgctcctctctagattat

SEQ ID NO: 1189631 - DNA, 22 bp, Artificial Sequence
  chemically synthesized
ttgctcctctctagattatttc

SEQ ID NO: 1189632 - DNA, 22 bp, Artificial Sequence
  chemically synthesized
ctcctctctagattatttcttg

SEQ ID NO: 1189633 - DNA, 22 bp, Artificial Sequence
  chemically synthesized
acaaataggtgacaagaaataa

SEQ ID NO: 1189634 - DNA, 22 bp, Artificial Sequence
  chemically synthesized
ctctctagattatttcttgtca

SEQ ID NO: 1189635 - DNA, 22 bp, Artificial Sequence
  chemically synthesized
tctagattatttcttgtcacct

SEQ ID NO: 1189636 - DNA, 22 bp, Artificial Sequence
  chemically synthesized
tagattatttcttgtcacctat

SEQ ID NO: 1189637 - DNA, 22 bp, Artificial Sequence
  chemically synthesized
gattatttcttgtcacctattt

SEQ ID NO: 1189638 - DNA, 22 bp, Artificial Sequence
  chemically synthesized
tttcttgtcacctatttgttaa

SEQ ID NO: 1189639 - DNA, 22 bp, Artificial Sequence
  chemically synthesized
cagaagtatatattaacaaata

SEQ ID NO: 1189640 - DNA, 22 bp, Artificial Sequence
  chemically synthesized
cttgtcacctatttgttaatat

SEQ ID NO: 1189641 - DNA, 22 bp, Artificial Sequence
  chemically synthesized
ttgtcacctatttgttaatata

SEQ ID NO: 1189642 - DNA, 22 bp, Artificial Sequence
  chemically synthesized
gtcacctatttgttaatatata

SEQ ID NO: 1189643 - DNA, 22 bp, Artificial Sequence
  chemically synthesized
tcacctatttgttaatatatac

SEQ ID NO: 1189644 - DNA, 22 bp, Artificial Sequence
  chemically synthesized
aaagttacagaagtatatatta

SEQ ID NO: 1189645 - DNA, 22 bp, Artificial Sequence
  chemically synthesized
aaaagttacagaagtatatatt

SEQ ID NO: 1189646 - DNA, 22 bp, Artificial Sequence
  chemically synthesized
taaaagttacagaagtatatat

SEQ ID NO: 1189647 - DNA, 22 bp, Artificial Sequence
  chemically synthesized
tttgttaatatatacttctgta

SEQ ID NO: 1189648 - DNA, 22 bp, Artificial Sequence
  chemically synthesized
tattttaaaagttacagaagta

SEQ ID NO: 1189649 - DNA, 22 bp, Artificial Sequence
  chemically synthesized
gttaatatatacttctgtaact

SEQ ID NO: 1189650 - DNA, 22 bp, Artificial Sequence
  chemically synthesized
ttaatatatacttctgtaactt

SEQ ID NO: 1189651 - DNA, 22 bp, Artificial Sequence
  chemically synthesized
atatatacttctgtaactttta

SEQ ID NO: 1189652 - DNA, 22 bp, Artificial Sequence
  chemically synthesized
ctgtaacttttaaaatacaatt

SEQ ID NO: 1189653 - DNA, 22 bp, Artificial Sequence
  chemically synthesized
tgtaacttttaaaatacaatta

SEQ ID NO: 1189654 - DNA, 22 bp, Artificial Sequence
  chemically synthesized
taacttttaaaatacaattatc

SEQ ID NO: 1189655 - DNA, 22 bp, Artificial Sequence
  chemically synthesized
agatggtaaaatgaagataatt

SEQ ID NO: 1189656 - DNA, 22 bp, Artificial Sequence
  chemically synthesized
ttaaaatacaattatcttcatt

SEQ ID NO: 1189657 - DNA, 22 bp, Artificial Sequence
  chemically synthesized
taaaatacaattatcttcattt

SEQ ID NO: 1189658 - DNA, 22 bp, Artificial Sequence
  chemically synthesized
tctcagatggtaaaatgaagat

SEQ ID NO: 1189659 - DNA, 22 bp, Artificial Sequence
  chemically synthesized
aaaatacaattatcttcatttt

SEQ ID NO: 1189660 - DNA, 22 bp, Artificial Sequence
  chemically synthesized
atctcagatggtaaaatgaaga

SEQ ID NO: 1189661 - DNA, 22 bp, Artificial Sequence
  chemically synthesized
aaatacaattatcttcatttta

SEQ ID NO: 1189662 - DNA, 22 bp, Artificial Sequence
  chemically synthesized
tcttcattttaccatctgagat

SEQ ID NO: 1189663 - DNA, 22 bp, Artificial Sequence
  chemically synthesized
cattttaccatctgagataaat

SEQ ID NO: 1189664 - DNA, 22 bp, Artificial Sequence
  chemically synthesized
gcaataaatagaatttatctca

SEQ ID NO: 1189665 - DNA, 22 bp, Artificial Sequence
  chemically synthesized
attttaccatctgagataaatt

SEQ ID NO: 1189666 - DNA, 22 bp, Artificial Sequence
  chemically synthesized
taccatctgagataaattctat

SEQ ID NO: 1189667 - DNA, 22 bp, Artificial Sequence
  chemically synthesized
accatctgagataaattctatt

SEQ ID NO: 1189668 - DNA, 22 bp, Artificial Sequence
  chemically synthesized
ccatctgagataaattctattt

SEQ ID NO: 1189669 - DNA, 22 bp, Artificial Sequence
  chemically synthesized
agataaattctatttattgcta

SEQ ID NO: 1189670 - DNA, 22 bp, Artificial Sequence
  chemically synthesized
gaggatataacagaaccctagc

SEQ ID NO: 1189671 - DNA, 22 bp, Artificial Sequence
  chemically synthesized
agaggatataacagaaccctag

SEQ ID NO: 1189672 - DNA, 22 bp, Artificial Sequence
  chemically synthesized
tagaggatataacagaacccta

SEQ ID NO: 1189673 - DNA, 22 bp, Artificial Sequence
  chemically synthesized
tatttattgctagggttctgtt

SEQ ID NO: 1189674 - DNA, 22 bp, Artificial Sequence
  chemically synthesized
ttttagaggatataacagaacc

SEQ ID NO: 1189675 - DNA, 22 bp, Artificial Sequence
  chemically synthesized
tttattgctagggttctgttat

SEQ ID NO: 1189676 - DNA, 22 bp, Artificial Sequence
  chemically synthesized
attgctagggttctgttatatc

SEQ ID NO: 1189677 - DNA, 22 bp, Artificial Sequence
  chemically synthesized
ttgctagggttctgttatatcc

SEQ ID NO: 1189678 - DNA, 22 bp, Artificial Sequence
  chemically synthesized
tattattttagaggatataaca

SEQ ID NO: 1189679 - DNA, 22 bp, Artificial Sequence
  chemically synthesized
gtattattttagaggatataac

SEQ ID NO: 1189680 - DNA, 22 bp, Artificial Sequence
  chemically synthesized
ctagggttctgttatatcctct

SEQ ID NO: 1189681 - DNA, 22 bp, Artificial Sequence
  chemically synthesized
gggttctgttatatcctctaaa

SEQ ID NO: 1189682 - DNA, 22 bp, Artificial Sequence
  chemically synthesized
tatttgtattattttagaggat

SEQ ID NO: 1189683 - DNA, 22 bp, Artificial Sequence
  chemically synthesized
tgttatatcctctaaaataata

SEQ ID NO: 1189684 - DNA, 22 bp, Artificial Sequence
  chemically synthesized
ttatatcctctaaaataataca

SEQ ID NO: 1189685 - DNA, 22 bp, Artificial Sequence
  chemically synthesized
tgtatctatatttgtattattt

SEQ ID NO: 1189686 - DNA, 22 bp, Artificial Sequence
  chemically synthesized
tgtgtatctatatttgtattat

SEQ ID NO: 1189687 - DNA, 22 bp, Artificial Sequence
  chemically synthesized
tatcctctaaaataatacaaat

SEQ ID NO: 1189688 - DNA, 22 bp, Artificial Sequence
  chemically synthesized
tctgtgtatctatatttgtatt

SEQ ID NO: 1189689 - DNA, 22 bp, Artificial Sequence
  chemically synthesized
taaaataatacaaatatagata

SEQ ID NO: 1189690 - DNA, 22 bp, Artificial Sequence
  chemically synthesized
aaataatacaaatatagataca

SEQ ID NO: 1189691 - DNA, 22 bp, Artificial Sequence
  chemically synthesized
acatgcccacaaacatgtatgt

SEQ ID NO: 1189692 - DNA, 22 bp, Artificial Sequence
  chemically synthesized
cacactcacatgcccacaaaca

SEQ ID NO: 1189693 - DNA, 22 bp, Artificial Sequence
  chemically synthesized
tataattacacactcacatgcc

SEQ ID NO: 1189694 - DNA, 22 bp, Artificial Sequence
  chemically synthesized
gtgggcatgtgagtgtgtaatt

SEQ ID NO: 1189695 - DNA, 22 bp, Artificial Sequence
  chemically synthesized
tgggcatgtgagtgtgtaatta

SEQ ID NO: 1189696 - DNA, 22 bp, Artificial Sequence
  chemically synthesized
tcataagtcgaggagcatctgt

SEQ ID NO: 1189697 - DNA, 22 bp, Artificial Sequence
  chemically synthesized
tacagatgctcctcgacttatg

SEQ ID NO: 1189698 - DNA, 22 bp, Artificial Sequence
  chemically synthesized
gaatgtaaccctgtcataagtc

SEQ ID NO: 1189699 - DNA, 22 bp, Artificial Sequence
  chemically synthesized
ttggaatgtaaccctgtcataa

SEQ ID NO: 1189700 - DNA, 22 bp, Artificial Sequence
  chemically synthesized
attggaatgtaaccctgtcata

SEQ ID NO: 1189701 - DNA, 22 bp, Artificial Sequence
  chemically synthesized
ctcgacttatgacagggttaca

SEQ ID NO: 1189702 - DNA, 22 bp, Artificial Sequence
  chemically synthesized
gacttatgacagggttacattc

SEQ ID NO: 1189703 - DNA, 22 bp, Artificial Sequence
  chemically synthesized
atgacagggttacattccaata

SEQ ID NO: 1189704 - DNA, 22 bp, Artificial Sequence
  chemically synthesized
tgacagggttacattccaataa

SEQ ID NO: 1189705 - DNA, 22 bp, Artificial Sequence
  chemically synthesized
tggacaatgggtttattggaat

SEQ ID NO: 1189706 - DNA, 22 bp, Artificial Sequence
  chemically synthesized
tatggacaatgggtttattgga

SEQ ID NO: 1189707 - DNA, 22 bp, Artificial Sequence
  chemically synthesized
ctatggacaatgggtttattgg

SEQ ID NO: 1189708 - DNA, 22 bp, Artificial Sequence
  chemically synthesized
tctatggacaatgggtttattg

SEQ ID NO: 1189709 - DNA, 22 bp, Artificial Sequence
  chemically synthesized
tattttctatggacaatgggtt

SEQ ID NO: 1189710 - DNA, 22 bp, Artificial Sequence
  chemically synthesized
cattccaataaacccattgtcc

SEQ ID NO: 1189711 - DNA, 22 bp, Artificial Sequence
  chemically synthesized
actatattttctatggacaatg

SEQ ID NO: 1189712 - DNA, 22 bp, Artificial Sequence
  chemically synthesized
caataaacccattgtccataga

SEQ ID NO: 1189713 - DNA, 22 bp, Artificial Sequence
  chemically synthesized
actcactatattttctatggac

SEQ ID NO: 1189714 - DNA, 22 bp, Artificial Sequence
  chemically synthesized
gactcactatattttctatgga

SEQ ID NO: 1189715 - DNA, 22 bp, Artificial Sequence
  chemically synthesized
tgactcactatattttctatgg

SEQ ID NO: 1189716 - DNA, 22 bp, Artificial Sequence
  chemically synthesized
aatgcaattttgactcactata

SEQ ID NO: 1189717 - DNA, 22 bp, Artificial Sequence
  chemically synthesized
tccatagaaaatatagtgagtc

SEQ ID NO: 1189718 - DNA, 22 bp, Artificial Sequence
  chemically synthesized
agtgtattaaatgcaattttga

SEQ ID NO: 1189719 - DNA, 22 bp, Artificial Sequence
  chemically synthesized
acaggttcagtgtattaaatgc

SEQ ID NO: 1189720 - DNA, 22 bp, Artificial Sequence
  chemically synthesized
gacaggttcagtgtattaaatg

SEQ ID NO: 1189721 - DNA, 22 bp, Artificial Sequence
  chemically synthesized
taatatttgacaggttcagtgt

SEQ ID NO: 1189722 - DNA, 22 bp, Artificial Sequence
  chemically synthesized
catttaatacactgaacctgtc

SEQ ID NO: 1189723 - DNA, 22 bp, Artificial Sequence
  chemically synthesized
agctataatatttgacaggttc

SEQ ID NO: 1189724 - DNA, 22 bp, Artificial Sequence
  chemically synthesized
aatacactgaacctgtcaaata

SEQ ID NO: 1189725 - DNA, 22 bp, Artificial Sequence
  chemically synthesized
atacactgaacctgtcaaatat

SEQ ID NO: 1189726 - DNA, 22 bp, Artificial Sequence
  chemically synthesized
ggctaagctataatatttgaca

SEQ ID NO: 1189727 - DNA, 22 bp, Artificial Sequence
  chemically synthesized
aacctgtcaaatattatagctt

SEQ ID NO: 1189728 - DNA, 22 bp, Artificial Sequence
  chemically synthesized
aggaaggctaggctaagctata

SEQ ID NO: 1189729 - DNA, 22 bp, Artificial Sequence
  chemically synthesized
aaggaaggctaggctaagctat

SEQ ID NO: 1189730 - DNA, 22 bp, Artificial Sequence
  chemically synthesized
tcaaatattatagcttagccta

SEQ ID NO: 1189731 - DNA, 22 bp, Artificial Sequence
  chemically synthesized
catgtttaaggaaggctaggct

SEQ ID NO: 1189732 - DNA, 22 bp, Artificial Sequence
  chemically synthesized
gcatgtttaaggaaggctaggc

SEQ ID NO: 1189733 - DNA, 22 bp, Artificial Sequence
  chemically synthesized
ttgcatgtttaaggaaggctag

SEQ ID NO: 1189734 - DNA, 22 bp, Artificial Sequence
  chemically synthesized
tagcttagcctagccttcctta

SEQ ID NO: 1189735 - DNA, 22 bp, Artificial Sequence
  chemically synthesized
agcctagccttccttaaacatg

SEQ ID NO: 1189736 - DNA, 22 bp, Artificial Sequence
  chemically synthesized
gcctagccttccttaaacatgc

SEQ ID NO: 1189737 - DNA, 22 bp, Artificial Sequence
  chemically synthesized
atgtaagtgttcttgcatgttt

SEQ ID NO: 1189738 - DNA, 22 bp, Artificial Sequence
  chemically synthesized
gccttccttaaacatgcaagaa

SEQ ID NO: 1189739 - DNA, 22 bp, Artificial Sequence
  chemically synthesized
ccttaaacatgcaagaacactt

SEQ ID NO: 1189740 - DNA, 22 bp, Artificial Sequence
  chemically synthesized
cttaaacatgcaagaacactta

SEQ ID NO: 1189741 - DNA, 22 bp, Artificial Sequence
  chemically synthesized
aaacatgcaagaacacttacat

SEQ ID NO: 1189742 - DNA, 22 bp, Artificial Sequence
  chemically synthesized
aacatgcaagaacacttacatt

SEQ ID NO: 1189743 - DNA, 22 bp, Artificial Sequence
  chemically synthesized
ccaaagtataggctaatgtaag

SEQ ID NO: 1189744 - DNA, 22 bp, Artificial Sequence
  chemically synthesized
gccaaagtataggctaatgtaa

SEQ ID NO: 1189745 - DNA, 22 bp, Artificial Sequence
  chemically synthesized
tgccaaagtataggctaatgta

SEQ ID NO: 1189746 - DNA, 22 bp, Artificial Sequence
  chemically synthesized
gatggttttgccaaagtatagg

SEQ ID NO: 1189747 - DNA, 22 bp, Artificial Sequence
  chemically synthesized
acattagcctatactttggcaa

SEQ ID NO: 1189748 - DNA, 22 bp, Artificial Sequence
  chemically synthesized
tgttagatggttttgccaaagt

SEQ ID NO: 1189749 - DNA, 22 bp, Artificial Sequence
  chemically synthesized
cattagcctatactttggcaaa

SEQ ID NO: 1189750 - DNA, 22 bp, Artificial Sequence
  chemically synthesized
gtgttagatggttttgccaaag

SEQ ID NO: 1189751 - DNA, 22 bp, Artificial Sequence
  chemically synthesized
tgtgttagatggttttgccaaa

SEQ ID NO: 1189752 - DNA, 22 bp, Artificial Sequence
  chemically synthesized
gcctatactttggcaaaaccat

SEQ ID NO: 1189753 - DNA, 22 bp, Artificial Sequence
  chemically synthesized
tactttggcaaaaccatctaac

SEQ ID NO: 1189754 - DNA, 22 bp, Artificial Sequence
  chemically synthesized
tagaacaggctttgtgttagat

SEQ ID NO: 1189755 - DNA, 22 bp, Artificial Sequence
  chemically synthesized
atagaacaggctttgtgttaga

SEQ ID NO: 1189756 - DNA, 22 bp, Artificial Sequence
  chemically synthesized
tggcaaaaccatctaacacaaa

SEQ ID NO: 1189757 - DNA, 22 bp, Artificial Sequence
  chemically synthesized
tatagaacaggctttgtgttag

SEQ ID NO: 1189758 - DNA, 22 bp, Artificial Sequence
  chemically synthesized
ggcaaaaccatctaacacaaag

SEQ ID NO: 1189759 - DNA, 22 bp, Artificial Sequence
  chemically synthesized
ttatagaacaggctttgtgtta

SEQ ID NO: 1189760 - DNA, 22 bp, Artificial Sequence
  chemically synthesized
gcaaaaccatctaacacaaagc

SEQ ID NO: 1189761 - DNA, 22 bp, Artificial Sequence
  chemically synthesized
gtttttatagaacaggctttgt

SEQ ID NO: 1189762 - DNA, 22 bp, Artificial Sequence
  chemically synthesized
agtttttatagaacaggctttg

SEQ ID NO: 1189763 - DNA, 22 bp, Artificial Sequence
  chemically synthesized
tagtttttatagaacaggcttt

SEQ ID NO: 1189764 - DNA, 22 bp, Artificial Sequence
  chemically synthesized
agtactttagtttttatagaac

SEQ ID NO: 1189765 - DNA, 22 bp, Artificial Sequence
  chemically synthesized
acacaaagcctgttctataaaa

SEQ ID NO: 1189766 - DNA, 22 bp, Artificial Sequence
  chemically synthesized
cacgatatattcagtactttag

SEQ ID NO: 1189767 - DNA, 22 bp, Artificial Sequence
  chemically synthesized
ttctataaaaactaaagtactg

SEQ ID NO: 1189768 - DNA, 22 bp, Artificial Sequence
  chemically synthesized
tataaaaactaaagtactgaat

SEQ ID NO: 1189769 - DNA, 22 bp, Artificial Sequence
  chemically synthesized
taaaaactaaagtactgaatat

SEQ ID NO: 1189770 - DNA, 22 bp, Artificial Sequence
  chemically synthesized
aatgcattacacgatatattca

SEQ ID NO: 1189771 - DNA, 22 bp, Artificial Sequence
  chemically synthesized
tgctcaatgcattacacgatat

SEQ ID NO: 1189772 - DNA, 22 bp, Artificial Sequence
  chemically synthesized
aagtactgaatatatcgtgtaa

SEQ ID NO: 1189773 - DNA, 22 bp, Artificial Sequence
  chemically synthesized
ctgtgctcaatgcattacacga

SEQ ID NO: 1189774 - DNA, 22 bp, Artificial Sequence
  chemically synthesized
aatatatcgtgtaatgcattga

SEQ ID NO: 1189775 - DNA, 22 bp, Artificial Sequence
  chemically synthesized
tcactactgtgctcaatgcatt

SEQ ID NO: 1189776 - DNA, 22 bp, Artificial Sequence
  chemically synthesized
actgtcactactgtgctcaatg

SEQ ID NO: 1189777 - DNA, 22 bp, Artificial Sequence
  chemically synthesized
cactgtcactactgtgctcaat

SEQ ID NO: 1189778 - DNA, 22 bp, Artificial Sequence
  chemically synthesized
tcactgtcactactgtgctcaa

SEQ ID NO: 1189779 - DNA, 22 bp, Artificial Sequence
  chemically synthesized
ttcactgtcactactgtgctca

SEQ ID NO: 1189780 - DNA, 22 bp, Artificial Sequence
  chemically synthesized
atcatgccatttttcactgtca

SEQ ID NO: 1189781 - DNA, 22 bp, Artificial Sequence
  chemically synthesized
aatcatgccatttttcactgtc

SEQ ID NO: 1189782 - DNA, 22 bp, Artificial Sequence
  chemically synthesized
agcacagtagtgacagtgaaaa

SEQ ID NO: 1189783 - DNA, 22 bp, Artificial Sequence
  chemically synthesized
agtacccatttaatcatgccat

SEQ ID NO: 1189784 - DNA, 22 bp, Artificial Sequence
  chemically synthesized
gagtacccatttaatcatgcca

SEQ ID NO: 1189785 - DNA, 22 bp, Artificial Sequence
  chemically synthesized
tgagtacccatttaatcatgcc

SEQ ID NO: 1189786 - DNA, 22 bp, Artificial Sequence
  chemically synthesized
agtagaaaccgtactttgagta

SEQ ID NO: 1189787 - DNA, 22 bp, Artificial Sequence
  chemically synthesized
aatgggtactcaaagtacggtt

SEQ ID NO: 1189788 - DNA, 22 bp, Artificial Sequence
  chemically synthesized
aaagtacggtttctactgaacg

SEQ ID NO: 1189789 - DNA, 22 bp, Artificial Sequence
  chemically synthesized
tgatggtgtgaaagcagtgtgc

SEQ ID NO: 1189790 - DNA, 22 bp, Artificial Sequence
  chemically synthesized
atgatggtgtgaaagcagtgtg

SEQ ID NO: 1189791 - DNA, 22 bp, Artificial Sequence
  chemically synthesized
tatgatggtgtgaaagcagtgt

SEQ ID NO: 1189792 - DNA, 22 bp, Artificial Sequence
  chemically synthesized
ctactgaacgcacactgctttc

SEQ ID NO: 1189793 - DNA, 22 bp, Artificial Sequence
  chemically synthesized
tactgaacgcacactgctttca

SEQ ID NO: 1189794 - DNA, 22 bp, Artificial Sequence
  chemically synthesized
ctgaacgcacactgctttcaca

SEQ ID NO: 1189795 - DNA, 22 bp, Artificial Sequence
  chemically synthesized
aactttatgatggtgtgaaagc

SEQ ID NO: 1189796 - DNA, 22 bp, Artificial Sequence
  chemically synthesized
caactttatgatggtgtgaaag

SEQ ID NO: 1189797 - DNA, 22 bp, Artificial Sequence
  chemically synthesized
aacgcacactgctttcacacca

SEQ ID NO: 1189798 - DNA, 22 bp, Artificial Sequence
  chemically synthesized
tcaactttatgatggtgtgaaa

SEQ ID NO: 1189799 - DNA, 22 bp, Artificial Sequence
  chemically synthesized
ttcaactttatgatggtgtgaa

SEQ ID NO: 1189800 - DNA, 22 bp, Artificial Sequence
  chemically synthesized
atgatttttcaactttatgatg

SEQ ID NO: 1189801 - DNA, 22 bp, Artificial Sequence
  chemically synthesized
ctttcacaccatcataaagttg

SEQ ID NO: 1189802 - DNA, 22 bp, Artificial Sequence
  chemically synthesized
actaatgatttttcaactttat

SEQ ID NO: 1189803 - DNA, 22 bp, Artificial Sequence
  chemically synthesized
gactaatgatttttcaacttta

SEQ ID NO: 1189804 - DNA, 22 bp, Artificial Sequence
  chemically synthesized
tcacaccatcataaagttgaaa

SEQ ID NO: 1189805 - DNA, 22 bp, Artificial Sequence
  chemically synthesized
cacaccatcataaagttgaaaa

SEQ ID NO: 1189806 - DNA, 22 bp, Artificial Sequence
  chemically synthesized
acaccatcataaagttgaaaaa

SEQ ID NO: 1189807 - DNA, 22 bp, Artificial Sequence
  chemically synthesized
agatggtttgactaatgatttt

SEQ ID NO: 1189808 - DNA, 22 bp, Artificial Sequence
  chemically synthesized
aagatggtttgactaatgattt

SEQ ID NO: 1189809 - DNA, 22 bp, Artificial Sequence
  chemically synthesized
acttaagatggtttgactaatg

SEQ ID NO: 1189810 - DNA, 22 bp, Artificial Sequence
  chemically synthesized
aaaaatcattagtcaaaccatc

SEQ ID NO: 1189811 - DNA, 22 bp, Artificial Sequence
  chemically synthesized
gatggtccctgacttaagatgg

SEQ ID NO: 1189812 - DNA, 22 bp, Artificial Sequence
  chemically synthesized
gtcaaaccatcttaagtcaggg

SEQ ID NO: 1189813 - DNA, 22 bp, Artificial Sequence
  chemically synthesized
aatcaagatctagatggtccct

SEQ ID NO: 1189814 - DNA, 22 bp, Artificial Sequence
  chemically synthesized
caatcaagatctagatggtccc

SEQ ID NO: 1189815 - DNA, 22 bp, Artificial Sequence
  chemically synthesized
cttcaatcaagatctagatggt

SEQ ID NO: 1189816 - DNA, 22 bp, Artificial Sequence
  chemically synthesized
aagtcagggaccatctagatct

SEQ ID NO: 1189817 - DNA, 22 bp, Artificial Sequence
  chemically synthesized
agtcagggaccatctagatctt

SEQ ID NO: 1189818 - DNA, 22 bp, Artificial Sequence
  chemically synthesized
aagttacttcaatcaagatcta

SEQ ID NO: 1189819 - DNA, 22 bp, Artificial Sequence
  chemically synthesized
ctgaagttacttcaatcaagat

SEQ ID NO: 1189820 - DNA, 22 bp, Artificial Sequence
  chemically synthesized
aagttcctgaagttacttcaat

SEQ ID NO: 1189821 - DNA, 22 bp, Artificial Sequence
  chemically synthesized
gatcttgattgaagtaacttca

SEQ ID NO: 1189822 - DNA, 22 bp, Artificial Sequence
  chemically synthesized
aatctaaagttcctgaagttac

SEQ ID NO: 1189823 - DNA, 22 bp, Artificial Sequence
  chemically synthesized
aaatctaaagttcctgaagtta

SEQ ID NO: 1189824 - DNA, 22 bp, Artificial Sequence
  chemically synthesized
gattgaagtaacttcaggaact

SEQ ID NO: 1189825 - DNA, 22 bp, Artificial Sequence
  chemically synthesized
attgaagtaacttcaggaactt

SEQ ID NO: 1189826 - DNA, 22 bp, Artificial Sequence
  chemically synthesized
taccccttaaatctaaagttcc

SEQ ID NO: 1189827 - DNA, 22 bp, Artificial Sequence
  chemically synthesized
aagtaacttcaggaactttaga

SEQ ID NO: 1189828 - DNA, 22 bp, Artificial Sequence
  chemically synthesized
gtaccccttaaatctaaagttc

SEQ ID NO: 1189829 - DNA, 22 bp, Artificial Sequence
  chemically synthesized
cacttgtaccccttaaatctaa

SEQ ID NO: 1189830 - DNA, 22 bp, Artificial Sequence
  chemically synthesized
caggaactttagatttaagggg

SEQ ID NO: 1189831 - DNA, 22 bp, Artificial Sequence
  chemically synthesized
aggaactttagatttaaggggt

SEQ ID NO: 1189832 - DNA, 22 bp, Artificial Sequence
  chemically synthesized
tagatttaaggggtacaagtgc

SEQ ID NO: 1189833 - DNA, 22 bp, Artificial Sequence
  chemically synthesized
agatttaaggggtacaagtgca

SEQ ID NO: 1189834 - DNA, 22 bp, Artificial Sequence
  chemically synthesized
gatttaaggggtacaagtgcaa

SEQ ID NO: 1189835 - DNA, 22 bp, Artificial Sequence
  chemically synthesized
aaggggtacaagtgcaattttg

SEQ ID NO: 1189836 - DNA, 22 bp, Artificial Sequence
  chemically synthesized
aggggtacaagtgcaattttgt

SEQ ID NO: 1189837 - DNA, 22 bp, Artificial Sequence
  chemically synthesized
cacaacatatccatgtaacaaa

SEQ ID NO: 1189838 - DNA, 22 bp, Artificial Sequence
  chemically synthesized
atcactacacaacatatccatg

SEQ ID NO: 1189839 - DNA, 22 bp, Artificial Sequence
  chemically synthesized
gatcactacacaacatatccat

SEQ ID NO: 1189840 - DNA, 22 bp, Artificial Sequence
  chemically synthesized
tgttacatggatatgttgtgta

SEQ ID NO: 1189841 - DNA, 22 bp, Artificial Sequence
  chemically synthesized
gttacatggatatgttgtgtag

SEQ ID NO: 1189842 - DNA, 22 bp, Artificial Sequence
  chemically synthesized
ttacatggatatgttgtgtagt

SEQ ID NO: 1189843 - DNA, 22 bp, Artificial Sequence
  chemically synthesized
catggatatgttgtgtagtgat

SEQ ID NO: 1189844 - DNA, 22 bp, Artificial Sequence
  chemically synthesized
aaagccgagacttgatcactac

SEQ ID NO: 1189845 - DNA, 22 bp, Artificial Sequence
  chemically synthesized
tgtagtgatcaagtctcggctt

SEQ ID NO: 1189846 - DNA, 22 bp, Artificial Sequence
  chemically synthesized
tgtgatgggtacactaaaagcc

SEQ ID NO: 1189847 - DNA, 22 bp, Artificial Sequence
  chemically synthesized
gtgtgatgggtacactaaaagc

SEQ ID NO: 1189848 - DNA, 22 bp, Artificial Sequence
  chemically synthesized
tttgtgtgatgggtacactaaa

SEQ ID NO: 1189849 - DNA, 22 bp, Artificial Sequence
  chemically synthesized
tagactatttgtgtgatgggta

SEQ ID NO: 1189850 - DNA, 22 bp, Artificial Sequence
  chemically synthesized
ggcttttagtgtacccatcaca

SEQ ID NO: 1189851 - DNA, 22 bp, Artificial Sequence
  chemically synthesized
ttagtgtacccatcacacaaat

SEQ ID NO: 1189852 - DNA, 22 bp, Artificial Sequence
  chemically synthesized
tagtgtacccatcacacaaata

SEQ ID NO: 1189853 - DNA, 22 bp, Artificial Sequence
  chemically synthesized
agtgtacccatcacacaaatag

SEQ ID NO: 1189854 - DNA, 22 bp, Artificial Sequence
  chemically synthesized
gtgtacccatcacacaaatagt

SEQ ID NO: 1189855 - DNA, 22 bp, Artificial Sequence
  chemically synthesized
ggtacattgtagactatttgtg

SEQ ID NO: 1189856 - DNA, 22 bp, Artificial Sequence
  chemically synthesized
ttaggtacattgtagactattt

SEQ ID NO: 1189857 - DNA, 22 bp, Artificial Sequence
  chemically synthesized
cctattaggtacattgtagact

SEQ ID NO: 1189858 - DNA, 22 bp, Artificial Sequence
  chemically synthesized
caatgtacctaataggtaattt

SEQ ID NO: 1189859 - DNA, 22 bp, Artificial Sequence
  chemically synthesized
ataggtaatttttcatctctca

SEQ ID NO: 1189860 - DNA, 22 bp, Artificial Sequence
  chemically synthesized
ttcatctctcacccccttccca

SEQ ID NO: 1189861 - DNA, 22 bp, Artificial Sequence
  chemically synthesized
tcatctctcacccccttcccac

SEQ ID NO: 1189862 - DNA, 22 bp, Artificial Sequence
  chemically synthesized
catctctcacccccttcccact

SEQ ID NO: 1189863 - DNA, 22 bp, Artificial Sequence
  chemically synthesized
atctctcacccccttcccactc

SEQ ID NO: 1189864 - DNA, 22 bp, Artificial Sequence
  chemically synthesized
caaaagatgggagagtgggaag

SEQ ID NO: 1189865 - DNA, 22 bp, Artificial Sequence
  chemically synthesized
tcacccccttcccactctccca

SEQ ID NO: 1189866 - DNA, 22 bp, Artificial Sequence
  chemically synthesized
acccccttcccactctcccatc

SEQ ID NO: 1189867 - DNA, 22 bp, Artificial Sequence
  chemically synthesized
gagactccaaaagatgggagag

SEQ ID NO: 1189868 - DNA, 22 bp, Artificial Sequence
  chemically synthesized
aacattggagactccaaaagat

SEQ ID NO: 1189869 - DNA, 22 bp, Artificial Sequence
  chemically synthesized
cccactctcccatcttttggag

SEQ ID NO: 1189870 - DNA, 22 bp, Artificial Sequence
  chemically synthesized
ccactctcccatcttttggagt

SEQ ID NO: 1189871 - DNA, 22 bp, Artificial Sequence
  chemically synthesized
aatactcaacattggagactcc

SEQ ID NO: 1189872 - DNA, 22 bp, Artificial Sequence
  chemically synthesized
tcccatcttttggagtctccaa

SEQ ID NO: 1189873 - DNA, 22 bp, Artificial Sequence
  chemically synthesized
ccatcttttggagtctccaatg

SEQ ID NO: 1189874 - DNA, 22 bp, Artificial Sequence
  chemically synthesized
ttggagtctccaatgttgagta

SEQ ID NO: 1189875 - DNA, 22 bp, Artificial Sequence
  chemically synthesized
tggagtctccaatgttgagtat

SEQ ID NO: 1189876 - DNA, 22 bp, Artificial Sequence
  chemically synthesized
ggagtctccaatgttgagtatt

SEQ ID NO: 1189877 - DNA, 22 bp, Artificial Sequence
  chemically synthesized
gagtctccaatgttgagtattc

SEQ ID NO: 1189878 - DNA, 22 bp, Artificial Sequence
  chemically synthesized
caatgttgagtattcaattctg

SEQ ID NO: 1189879 - DNA, 22 bp, Artificial Sequence
  chemically synthesized
agtattcaattctgtatgtcca

SEQ ID NO: 1189880 - DNA, 22 bp, Artificial Sequence
  chemically synthesized
atcaatgggtacacatggacat

SEQ ID NO: 1189881 - DNA, 22 bp, Artificial Sequence
  chemically synthesized
aattctgtatgtccatgtgtac

SEQ ID NO: 1189882 - DNA, 22 bp, Artificial Sequence
  chemically synthesized
tgtatgtccatgtgtacccatt

SEQ ID NO: 1189883 - DNA, 22 bp, Artificial Sequence
  chemically synthesized
tatgtccatgtgtacccattga

SEQ ID NO: 1189884 - DNA, 22 bp, Artificial Sequence
  chemically synthesized
taagtggtaactaatcaatggg

SEQ ID NO: 1189885 - DNA, 22 bp, Artificial Sequence
  chemically synthesized
ctataagtggtaactaatcaat

SEQ ID NO: 1189886 - DNA, 22 bp, Artificial Sequence
  chemically synthesized
cctataagtggtaactaatcaa

SEQ ID NO: 1189887 - DNA, 22 bp, Artificial Sequence
  chemically synthesized
tcctataagtggtaactaatca

SEQ ID NO: 1189888 - DNA, 22 bp, Artificial Sequence
  chemically synthesized
tattttcctataagtggtaact

SEQ ID NO: 1189889 - DNA, 22 bp, Artificial Sequence
  chemically synthesized
attagttaccacttataggaaa

SEQ ID NO: 1189890 - DNA, 22 bp, Artificial Sequence
  chemically synthesized
gttaccacttataggaaaatac

SEQ ID NO: 1189891 - DNA, 22 bp, Artificial Sequence
  chemically synthesized
ccacttataggaaaatacagta

SEQ ID NO: 1189892 - DNA, 22 bp, Artificial Sequence
  chemically synthesized
ataggaaaatacagtatttgat

SEQ ID NO: 1189893 - DNA, 22 bp, Artificial Sequence
  chemically synthesized
taggaaaatacagtatttgatt

SEQ ID NO: 1189894 - DNA, 22 bp, Artificial Sequence
  chemically synthesized
agtgaaataagtcagaaacaga

SEQ ID NO: 1189895 - DNA, 22 bp, Artificial Sequence
  chemically synthesized
gattttctgtttctgacttatt

SEQ ID NO: 1189896 - DNA, 22 bp, Artificial Sequence
  chemically synthesized
attttctgtttctgacttattt

SEQ ID NO: 1189897 - DNA, 22 bp, Artificial Sequence
  chemically synthesized
tcatcctaagtgaaataagtca

SEQ ID NO: 1189898 - DNA, 22 bp, Artificial Sequence
  chemically synthesized
tctgtttctgacttatttcact

SEQ ID NO: 1189899 - DNA, 22 bp, Artificial Sequence
  chemically synthesized
ctgtttctgacttatttcactt

SEQ ID NO: 1189900 - DNA, 22 bp, Artificial Sequence
  chemically synthesized
tgtttctgacttatttcactta

SEQ ID NO: 1189901 - DNA, 22 bp, Artificial Sequence
  chemically synthesized
gaggctatcatcctaagtgaaa

SEQ ID NO: 1189902 - DNA, 22 bp, Artificial Sequence
  chemically synthesized
tttctgacttatttcacttagg

SEQ ID NO: 1189903 - DNA, 22 bp, Artificial Sequence
  chemically synthesized
ctgacttatttcacttaggatg

SEQ ID NO: 1189904 - DNA, 22 bp, Artificial Sequence
  chemically synthesized
tgacttatttcacttaggatga

SEQ ID NO: 1189905 - DNA, 22 bp, Artificial Sequence
  chemically synthesized
acttatttcacttaggatgata

SEQ ID NO: 1189906 - DNA, 22 bp, Artificial Sequence
  chemically synthesized
atttcacttaggatgatagcct

SEQ ID NO: 1189907 - DNA, 22 bp, Artificial Sequence
  chemically synthesized
tttcacttaggatgatagcctc

SEQ ID NO: 1189908 - DNA, 22 bp, Artificial Sequence
  chemically synthesized
cacttaggatgatagcctccag

SEQ ID NO: 1189909 - DNA, 22 bp, Artificial Sequence
  chemically synthesized
acttaggatgatagcctccagt

SEQ ID NO: 1189910 - DNA, 22 bp, Artificial Sequence
  chemically synthesized
aggatgatagcctccagtttca

SEQ ID NO: 1189911 - DNA, 22 bp, Artificial Sequence
  chemically synthesized
cagcaacatggatgaaactgga

SEQ ID NO: 1189912 - DNA, 22 bp, Artificial Sequence
  chemically synthesized
ggatgatagcctccagtttcat

SEQ ID NO: 1189913 - DNA, 22 bp, Artificial Sequence
  chemically synthesized
gcagcaacatggatgaaactgg

SEQ ID NO: 1189914 - DNA, 22 bp, Artificial Sequence
  chemically synthesized
tgcagcaacatggatgaaactg

SEQ ID NO: 1189915 - DNA, 22 bp, Artificial Sequence
  chemically synthesized
ttgcagcaacatggatgaaact

SEQ ID NO: 1189916 - DNA, 22 bp, Artificial Sequence
  chemically synthesized
tgtcttttgcagcaacatggat

SEQ ID NO: 1189917 - DNA, 22 bp, Artificial Sequence
  chemically synthesized
cagtttcatccatgttgctgca

SEQ ID NO: 1189918 - DNA, 22 bp, Artificial Sequence
  chemically synthesized
catccatgttgctgcaaaagac

SEQ ID NO: 1189919 - DNA, 22 bp, Artificial Sequence
  chemically synthesized
atccatgttgctgcaaaagaca

SEQ ID NO: 1189920 - DNA, 22 bp, Artificial Sequence
  chemically synthesized
ctgcaaaagacataattttatt

SEQ ID NO: 1189921 - DNA, 22 bp, Artificial Sequence
  chemically synthesized
acgagccacaaaggaataaaat

SEQ ID NO: 1189922 - DNA, 22 bp, Artificial Sequence
  chemically synthesized
caaaagacataattttattcct

SEQ ID NO: 1189923 - DNA, 22 bp, Artificial Sequence
  chemically synthesized
tattcctttgtggctcgttagt

SEQ ID NO: 1189924 - DNA, 22 bp, Artificial Sequence
  chemically synthesized
attcctttgtggctcgttagta

SEQ ID NO: 1189925 - DNA, 22 bp, Artificial Sequence
  chemically synthesized
ttcctttgtggctcgttagtat

SEQ ID NO: 1189926 - DNA, 22 bp, Artificial Sequence
  chemically synthesized
ctttgtggctcgttagtattcc

SEQ ID NO: 1189927 - DNA, 22 bp, Artificial Sequence
  chemically synthesized
tgtggctcgttagtattccatt

SEQ ID NO: 1189928 - DNA, 22 bp, Artificial Sequence
  chemically synthesized
gtggctcgttagtattccatta

SEQ ID NO: 1189929 - DNA, 22 bp, Artificial Sequence
  chemically synthesized
tggctcgttagtattccattat

SEQ ID NO: 1189930 - DNA, 22 bp, Artificial Sequence
  chemically synthesized
gttagtattccattatatatac

SEQ ID NO: 1189931 - DNA, 22 bp, Artificial Sequence
  chemically synthesized
gtattccattatatatacacac

SEQ ID NO: 1189932 - DNA, 22 bp, Artificial Sequence
  chemically synthesized
cattatatatacacaccacatt

SEQ ID NO: 1189933 - DNA, 22 bp, Artificial Sequence
  chemically synthesized
tatatacacaccacattatctt

SEQ ID NO: 1189934 - DNA, 22 bp, Artificial Sequence
  chemically synthesized
tgtccatgagtagataaagata

SEQ ID NO: 1189935 - DNA, 22 bp, Artificial Sequence
  chemically synthesized
tctttatctactcatggacaca

SEQ ID NO: 1189936 - DNA, 22 bp, Artificial Sequence
  chemically synthesized
tatctactcatggacacaactt

SEQ ID NO: 1189937 - DNA, 22 bp, Artificial Sequence
  chemically synthesized
atctactcatggacacaacttg

SEQ ID NO: 1189938 - DNA, 22 bp, Artificial Sequence
  chemically synthesized
tctactcatggacacaacttga

SEQ ID NO: 1189939 - DNA, 22 bp, Artificial Sequence
  chemically synthesized
ctcatggacacaacttgattcc

SEQ ID NO: 1189940 - DNA, 22 bp, Artificial Sequence
  chemically synthesized
atggacacaacttgattccacg

SEQ ID NO: 1189941 - DNA, 22 bp, Artificial Sequence
  chemically synthesized
tgcgtaatagcaaaatcgtgga

SEQ ID NO: 1189942 - DNA, 22 bp, Artificial Sequence
  chemically synthesized
gagcactatgcgtaatagcaaa

SEQ ID NO: 1189943 - DNA, 22 bp, Artificial Sequence
  chemically synthesized
gattccacgattttgctattac

SEQ ID NO: 1189944 - DNA, 22 bp, Artificial Sequence
  chemically synthesized
attccacgattttgctattacg

SEQ ID NO: 1189945 - DNA, 22 bp, Artificial Sequence
  chemically synthesized
actggagcactatgcgtaatag

SEQ ID NO: 1189946 - DNA, 22 bp, Artificial Sequence
  chemically synthesized
cacgattttgctattacgcata

SEQ ID NO: 1189947 - DNA, 22 bp, Artificial Sequence
  chemically synthesized
gcatgttcactggagcactatg

SEQ ID NO: 1189948 - DNA, 22 bp, Artificial Sequence
  chemically synthesized
tgctattacgcatagtgctcca

SEQ ID NO: 1189949 - DNA, 22 bp, Artificial Sequence
  chemically synthesized
gctattacgcatagtgctccag

SEQ ID NO: 1189950 - DNA, 22 bp, Artificial Sequence
  chemically synthesized
ctattacgcatagtgctccagt

SEQ ID NO: 1189951 - DNA, 22 bp, Artificial Sequence
  chemically synthesized
ttacgcatagtgctccagtgaa

SEQ ID NO: 1189952 - DNA, 22 bp, Artificial Sequence
  chemically synthesized
cgcatagtgctccagtgaacat

SEQ ID NO: 1189953 - DNA, 22 bp, Artificial Sequence
  chemically synthesized
agtcacactcgcatgttcactg

SEQ ID NO: 1189954 - DNA, 22 bp, Artificial Sequence
  chemically synthesized
cagtcacactcgcatgttcact

SEQ ID NO: 1189955 - DNA, 22 bp, Artificial Sequence
  chemically synthesized
aaagtaacttcagtcacactcg

SEQ ID NO: 1189956 - DNA, 22 bp, Artificial Sequence
  chemically synthesized
cagtgaacatgcgagtgtgact

SEQ ID NO: 1189957 - DNA, 22 bp, Artificial Sequence
  chemically synthesized
tacattgaaagtaacttcagtc

SEQ ID NO: 1189958 - DNA, 22 bp, Artificial Sequence
  chemically synthesized
gtacattgaaagtaacttcagt

SEQ ID NO: 1189959 - DNA, 22 bp, Artificial Sequence
  chemically synthesized
gtttgtacattgaaagtaactt

SEQ ID NO: 1189960 - DNA, 22 bp, Artificial Sequence
  chemically synthesized
agttagtttgtacattgaaagt

SEQ ID NO: 1189961 - DNA, 22 bp, Artificial Sequence
  chemically synthesized
cctaagttagtttgtacattga

SEQ ID NO: 1189962 - DNA, 22 bp, Artificial Sequence
  chemically synthesized
tccctaagttagtttgtacatt

SEQ ID NO: 1189963 - DNA, 22 bp, Artificial Sequence
  chemically synthesized
aagttactttcaatgtacaaac

SEQ ID NO: 1189964 - DNA, 22 bp, Artificial Sequence
  chemically synthesized
gttctccctaagttagtttgta

SEQ ID NO: 1189965 - DNA, 22 bp, Artificial Sequence
  chemically synthesized
ctttcaatgtacaaactaactt

SEQ ID NO: 1189966 - DNA, 22 bp, Artificial Sequence
  chemically synthesized
tcaatgtacaaactaacttagg

SEQ ID NO: 1189967 - DNA, 22 bp, Artificial Sequence
  chemically synthesized
caatgtacaaactaacttaggg

SEQ ID NO: 1189968 - DNA, 22 bp, Artificial Sequence
  chemically synthesized
aatgtacaaactaacttaggga

SEQ ID NO: 1189969 - DNA, 22 bp, Artificial Sequence
  chemically synthesized
acttagggagaactagcatttt

SEQ ID NO: 1189970 - DNA, 22 bp, Artificial Sequence
  chemically synthesized
agggagaactagcattttcatc

SEQ ID NO: 1189971 - DNA, 22 bp, Artificial Sequence
  chemically synthesized
gggagaactagcattttcatca

SEQ ID NO: 1189972 - DNA, 22 bp, Artificial Sequence
  chemically synthesized
gcattttcatcatatgtgactt

SEQ ID NO: 1189973 - DNA, 22 bp, Artificial Sequence
  chemically synthesized
tcatcatatgtgacttcctttc

SEQ ID NO: 1189974 - DNA, 22 bp, Artificial Sequence
  chemically synthesized
catcatatgtgacttcctttcc

SEQ ID NO: 1189975 - DNA, 22 bp, Artificial Sequence
  chemically synthesized
atcatatgtgacttcctttcct

SEQ ID NO: 1189976 - DNA, 22 bp, Artificial Sequence
  chemically synthesized
cctttcctcatgtctttattta

SEQ ID NO: 1189977 - DNA, 22 bp, Artificial Sequence
  chemically synthesized
tatataagtacataaataaaga

SEQ ID NO: 1189978 - DNA, 22 bp, Artificial Sequence
  chemically synthesized
ctttcctcatgtctttatttat

SEQ ID NO: 1189979 - DNA, 22 bp, Artificial Sequence
  chemically synthesized
tcctcatgtctttatttatgta

SEQ ID NO: 1189980 - DNA, 22 bp, Artificial Sequence
  chemically synthesized
cctcatgtctttatttatgtac

SEQ ID NO: 1189981 - DNA, 22 bp, Artificial Sequence
  chemically synthesized
ctcatgtctttatttatgtact

SEQ ID NO: 1189982 - DNA, 22 bp, Artificial Sequence
  chemically synthesized
aagttgtatataagtacataaa

SEQ ID NO: 1189983 - DNA, 22 bp, Artificial Sequence
  chemically synthesized
aaagttgtatataagtacataa

SEQ ID NO: 1189984 - DNA, 22 bp, Artificial Sequence
  chemically synthesized
atgtctttatttatgtacttat

SEQ ID NO: 1189985 - DNA, 22 bp, Artificial Sequence
  chemically synthesized
tatttatgtacttatatacaac

SEQ ID NO: 1189986 - DNA, 22 bp, Artificial Sequence
  chemically synthesized
atttatgtacttatatacaact

SEQ ID NO: 1189987 - DNA, 22 bp, Artificial Sequence
  chemically synthesized
taggaagtttaaagttgtatat

SEQ ID NO: 1189988 - DNA, 22 bp, Artificial Sequence
  chemically synthesized
tttatgtacttatatacaactt

SEQ ID NO: 1189989 - DNA, 22 bp, Artificial Sequence
  chemically synthesized
ataggaagtttaaagttgtata

SEQ ID NO: 1189990 - DNA, 22 bp, Artificial Sequence
  chemically synthesized
tataggaagtttaaagttgtat

SEQ ID NO: 1189991 - DNA, 22 bp, Artificial Sequence
  chemically synthesized
ttataggaagtttaaagttgta

SEQ ID NO: 1189992 - DNA, 22 bp, Artificial Sequence
  chemically synthesized
atgtacttatatacaactttaa

SEQ ID NO: 1189993 - DNA, 22 bp, Artificial Sequence
  chemically synthesized
tttataggaagtttaaagttgt

SEQ ID NO: 1189994 - DNA, 22 bp, Artificial Sequence
  chemically synthesized
tgtacttatatacaactttaaa

SEQ ID NO: 1189995 - DNA, 22 bp, Artificial Sequence
  chemically synthesized
ttttataggaagtttaaagttg

SEQ ID NO: 1189996 - DNA, 22 bp, Artificial Sequence
  chemically synthesized
tttttataggaagtttaaagtt

SEQ ID NO: 1189997 - DNA, 22 bp, Artificial Sequence
  chemically synthesized
ttttttataggaagtttaaagt

SEQ ID NO: 1189998 - DNA, 22 bp, Artificial Sequence
  chemically synthesized
atatacaactttaaacttccta

SEQ ID NO: 1189999 - DNA, 22 bp, Artificial Sequence
  chemically synthesized
tatacaactttaaacttcctat

SEQ ID NO: 1190000 - DNA, 22 bp, Artificial Sequence
  chemically synthesized
taaacttcctataaaaaaaagc

SEQ ID NO: 1190001 - DNA, 22 bp, Artificial Sequence
  chemically synthesized
aaacttcctataaaaaaaagct

SEQ ID NO: 1190002 - DNA, 22 bp, Artificial Sequence
  chemically synthesized
aacttcctataaaaaaaagctt

SEQ ID NO: 1190003 - DNA, 22 bp, Artificial Sequence
  chemically synthesized
cctataaaaaaaagcttatact

SEQ ID NO: 1190004 - DNA, 22 bp, Artificial Sequence
  chemically synthesized
ctataaaaaaaagcttatactt

SEQ ID NO: 1190005 - DNA, 22 bp, Artificial Sequence
  chemically synthesized
taaaaaaaagcttatactttct

SEQ ID NO: 1190006 - DNA, 22 bp, Artificial Sequence
  chemically synthesized
gaagtaaaccgcacaagaaagt

SEQ ID NO: 1190007 - DNA, 22 bp, Artificial Sequence
  chemically synthesized
agaagtaaaccgcacaagaaag

SEQ ID NO: 1190008 - DNA, 22 bp, Artificial Sequence
  chemically synthesized
ttagaagtaaaccgcacaagaa

SEQ ID NO: 1190009 - DNA, 22 bp, Artificial Sequence
  chemically synthesized
cttagaagtaaaccgcacaaga

SEQ ID NO: 1190010 - DNA, 22 bp, Artificial Sequence
  chemically synthesized
tcttagaagtaaaccgcacaag

SEQ ID NO: 1190011 - DNA, 22 bp, Artificial Sequence
  chemically synthesized
atactttcttgtgcggtttact

SEQ ID NO: 1190012 - DNA, 22 bp, Artificial Sequence
  chemically synthesized
tactttcttgtgcggtttactt

SEQ ID NO: 1190013 - DNA, 22 bp, Artificial Sequence
  chemically synthesized
tgtagttttcttagaagtaaac

SEQ ID NO: 1190014 - DNA, 22 bp, Artificial Sequence
  chemically synthesized
tcttgtgcggtttacttctaag

SEQ ID NO: 1190015 - DNA, 22 bp, Artificial Sequence
  chemically synthesized
cttgtgcggtttacttctaaga

SEQ ID NO: 1190016 - DNA, 22 bp, Artificial Sequence
  chemically synthesized
ttgtgcggtttacttctaagaa

SEQ ID NO: 1190017 - DNA, 22 bp, Artificial Sequence
  chemically synthesized
gtgcggtttacttctaagaaaa

SEQ ID NO: 1190018 - DNA, 22 bp, Artificial Sequence
  chemically synthesized
tgcggtttacttctaagaaaac

SEQ ID NO: 1190019 - DNA, 22 bp, Artificial Sequence
  chemically synthesized
caaaatctatgtagttttctta

SEQ ID NO: 1190020 - DNA, 22 bp, Artificial Sequence
  chemically synthesized
acttctaagaaaactacataga

SEQ ID NO: 1190021 - DNA, 22 bp, Artificial Sequence
  chemically synthesized
cttctaagaaaactacatagat

SEQ ID NO: 1190022 - DNA, 22 bp, Artificial Sequence
  chemically synthesized
ctaagaaaactacatagatttt

SEQ ID NO: 1190023 - DNA, 22 bp, Artificial Sequence
  chemically synthesized
taagaaaactacatagattttg

SEQ ID NO: 1190024 - DNA, 22 bp, Artificial Sequence
  chemically synthesized
agaaaactacatagattttgga

SEQ ID NO: 1190025 - DNA, 22 bp, Artificial Sequence
  chemically synthesized
aaaaagagaagttccaaaatct

SEQ ID NO: 1190026 - DNA, 22 bp, Artificial Sequence
  chemically synthesized
aaaaaagagaagttccaaaatc

SEQ ID NO: 1190027 - DNA, 22 bp, Artificial Sequence
  chemically synthesized
taaaaaagagaagttccaaaat

SEQ ID NO: 1190028 - DNA, 22 bp, Artificial Sequence
  chemically synthesized
ttaaaaaagagaagttccaaaa

SEQ ID NO: 1190029 - DNA, 22 bp, Artificial Sequence
  chemically synthesized
tttttaaaaaagagaagttcca

SEQ ID NO: 1190030 - DNA, 22 bp, Artificial Sequence
  chemically synthesized
catagattttggaacttctctt

SEQ ID NO: 1190031 - DNA, 22 bp, Artificial Sequence
  chemically synthesized
tggaacttctcttttttaaaaa

SEQ ID NO: 1190032 - DNA, 22 bp, Artificial Sequence
  chemically synthesized
ggaacttctcttttttaaaaat

SEQ ID NO: 1190033 - DNA, 22 bp, Artificial Sequence
  chemically synthesized
gaacttctcttttttaaaaata

SEQ ID NO: 1190034 - DNA, 22 bp, Artificial Sequence
  chemically synthesized
aaacacacaataaaattatttt

SEQ ID NO: 1190035 - DNA, 22 bp, Artificial Sequence
  chemically synthesized
aaaacacacaataaaattattt

SEQ ID NO: 1190036 - DNA, 22 bp, Artificial Sequence
  chemically synthesized
ctcttttttaaaaataatttta

SEQ ID NO: 1190037 - DNA, 22 bp, Artificial Sequence
  chemically synthesized
tcttttttaaaaataattttat

SEQ ID NO: 1190038 - DNA, 22 bp, Artificial Sequence
  chemically synthesized
ttttttaaaaataattttattg

SEQ ID NO: 1190039 - DNA, 22 bp, Artificial Sequence
  chemically synthesized
ttttaaaaataattttattgtg

SEQ ID NO: 1190040 - DNA, 22 bp, Artificial Sequence
  chemically synthesized
tttaaaaataattttattgtgt

SEQ ID NO: 1190041 - DNA, 22 bp, Artificial Sequence
  chemically synthesized
ttaaaaataattttattgtgtg

SEQ ID NO: 1190042 - DNA, 22 bp, Artificial Sequence
  chemically synthesized
taaaaataattttattgtgtgt

SEQ ID NO: 1190043 - DNA, 22 bp, Artificial Sequence
  chemically synthesized
aaaaataattttattgtgtgtt

SEQ ID NO: 1190044 - DNA, 22 bp, Artificial Sequence
  chemically synthesized
aaaataattttattgtgtgttt

SEQ ID NO: 1190045 - DNA, 22 bp, Artificial Sequence
  chemically synthesized
tagcatcatgtgtataccttaa

SEQ ID NO: 1190046 - DNA, 22 bp, Artificial Sequence
  chemically synthesized
tattgtgtgttttaaggtatac

SEQ ID NO: 1190047 - DNA, 22 bp, Artificial Sequence
  chemically synthesized
atagcatcatgtgtatacctta

SEQ ID NO: 1190048 - DNA, 22 bp, Artificial Sequence
  chemically synthesized
attgtgtgttttaaggtataca

SEQ ID NO: 1190049 - DNA, 22 bp, Artificial Sequence
  chemically synthesized
ttgtgtgttttaaggtatacac

SEQ ID NO: 1190050 - DNA, 22 bp, Artificial Sequence
  chemically synthesized
tgtgttttaaggtatacacatg

SEQ ID NO: 1190051 - DNA, 22 bp, Artificial Sequence
  chemically synthesized
taaggtatacacatgatgctat

SEQ ID NO: 1190052 - DNA, 22 bp, Artificial Sequence
  chemically synthesized
catgtgtatcttatagcatcat

SEQ ID NO: 1190053 - DNA, 22 bp, Artificial Sequence
  chemically synthesized
aaggtatacacatgatgctata

SEQ ID NO: 1190054 - DNA, 22 bp, Artificial Sequence
  chemically synthesized
acatgtgtatcttatagcatca

SEQ ID NO: 1190055 - DNA, 22 bp, Artificial Sequence
  chemically synthesized
aggtatacacatgatgctataa

SEQ ID NO: 1190056 - DNA, 22 bp, Artificial Sequence
  chemically synthesized
tggtaaccatttacatgtgtat

SEQ ID NO: 1190057 - DNA, 22 bp, Artificial Sequence
  chemically synthesized
attatggtaaccatttacatgt

SEQ ID NO: 1190058 - DNA, 22 bp, Artificial Sequence
  chemically synthesized
cattatggtaaccatttacatg

SEQ ID NO: 1190059 - DNA, 22 bp, Artificial Sequence
  chemically synthesized
taagatacacatgtaaatggtt

SEQ ID NO: 1190060 - DNA, 22 bp, Artificial Sequence
  chemically synthesized
tggtttcattatggtaaccatt

SEQ ID NO: 1190061 - DNA, 22 bp, Artificial Sequence
  chemically synthesized
attatggtttcattatggtaac

SEQ ID NO: 1190062 - DNA, 22 bp, Artificial Sequence
  chemically synthesized
cattatggtttcattatggtaa

SEQ ID NO: 1190063 - DNA, 22 bp, Artificial Sequence
  chemically synthesized
tcattatggtttcattatggta

SEQ ID NO: 1190064 - DNA, 22 bp, Artificial Sequence
  chemically synthesized
tttcattatggtttcattatgg

SEQ ID NO: 1190065 - DNA, 22 bp, Artificial Sequence
  chemically synthesized
ctttcattatggtttcattatg

SEQ ID NO: 1190066 - DNA, 22 bp, Artificial Sequence
  chemically synthesized
atttctttcattatggtttcat

SEQ ID NO: 1190067 - DNA, 22 bp, Artificial Sequence
  chemically synthesized
ccataatgaaaccataatgaaa

SEQ ID NO: 1190068 - DNA, 22 bp, Artificial Sequence
  chemically synthesized
tgtgagatgatggatatgttaa

SEQ ID NO: 1190069 - DNA, 22 bp, Artificial Sequence
  chemically synthesized
acatatccatcatctcacataa

SEQ ID NO: 1190070 - DNA, 22 bp, Artificial Sequence
  chemically synthesized
gtggtcagagggtgggggaacg

SEQ ID NO: 1190071 - DNA, 22 bp, Artificial Sequence
  chemically synthesized
tcgtggtcagagggtgggggaa

SEQ ID NO: 1190072 - DNA, 22 bp, Artificial Sequence
  chemically synthesized
ctcgtggtcagagggtggggga

SEQ ID NO: 1190073 - DNA, 22 bp, Artificial Sequence
  chemically synthesized
acataatcgttcccccaccctc

SEQ ID NO: 1190074 - DNA, 22 bp, Artificial Sequence
  chemically synthesized
tagcttctcgtggtcagagggt

SEQ ID NO: 1190075 - DNA, 22 bp, Artificial Sequence
  chemically synthesized
ccccaccctctgaccacgagaa

SEQ ID NO: 1190076 - DNA, 22 bp, Artificial Sequence
  chemically synthesized
aatgagtagattatagcttctc

SEQ ID NO: 1190077 - DNA, 22 bp, Artificial Sequence
  chemically synthesized
ctaaatgagtagattatagctt

SEQ ID NO: 1190078 - DNA, 22 bp, Artificial Sequence
  chemically synthesized
actaaatgagtagattatagct

SEQ ID NO: 1190079 - DNA, 22 bp, Artificial Sequence
  chemically synthesized
tgaccacgagaagctataatct

SEQ ID NO: 1190080 - DNA, 22 bp, Artificial Sequence
  chemically synthesized
tactaaatgagtagattatagc

SEQ ID NO: 1190081 - DNA, 22 bp, Artificial Sequence
  chemically synthesized
ttactaaatgagtagattatag

SEQ ID NO: 1190082 - DNA, 22 bp, Artificial Sequence
  chemically synthesized
accacgagaagctataatctac

SEQ ID NO: 1190083 - DNA, 22 bp, Artificial Sequence
  chemically synthesized
agaatttttactaaatgagtag

SEQ ID NO: 1190084 - DNA, 22 bp, Artificial Sequence
  chemically synthesized
tattcagaatttttactaaatg

SEQ ID NO: 1190085 - DNA, 22 bp, Artificial Sequence
  chemically synthesized
taatctactcatttagtaaaaa

SEQ ID NO: 1190086 - DNA, 22 bp, Artificial Sequence
  chemically synthesized
ctcatttagtaaaaattctgaa

SEQ ID NO: 1190087 - DNA, 22 bp, Artificial Sequence
  chemically synthesized
atagtgtgttgtattcagaatt

SEQ ID NO: 1190088 - DNA, 22 bp, Artificial Sequence
  chemically synthesized
atttagtaaaaattctgaatac

SEQ ID NO: 1190089 - DNA, 22 bp, Artificial Sequence
  chemically synthesized
agtaaaaattctgaatacaaca

SEQ ID NO: 1190090 - DNA, 22 bp, Artificial Sequence
  chemically synthesized
tagttaatagtgtgttgtattc

SEQ ID NO: 1190091 - DNA, 22 bp, Artificial Sequence
  chemically synthesized
gtaaaaattctgaatacaacac

SEQ ID NO: 1190092 - DNA, 22 bp, Artificial Sequence
  chemically synthesized
tgaatacaacacactattaact

SEQ ID NO: 1190093 - DNA, 22 bp, Artificial Sequence
  chemically synthesized
aatacaacacactattaactat

SEQ ID NO: 1190094 - DNA, 22 bp, Artificial Sequence
  chemically synthesized
atataaaacatgaggattatag

SEQ ID NO: 1190095 - DNA, 22 bp, Artificial Sequence
  chemically synthesized
ttaactataatcctcatgtttt

SEQ ID NO: 1190096 - DNA, 22 bp, Artificial Sequence
  chemically synthesized
aaagatctaatataaaacatga

SEQ ID NO: 1190097 - DNA, 22 bp, Artificial Sequence
  chemically synthesized
actataatcctcatgttttata

SEQ ID NO: 1190098 - DNA, 22 bp, Artificial Sequence
  chemically synthesized
taatcctcatgttttatattag

SEQ ID NO: 1190099 - DNA, 22 bp, Artificial Sequence
  chemically synthesized
atgttttatattagatctttca

SEQ ID NO: 1190100 - DNA, 22 bp, Artificial Sequence
  chemically synthesized
tatattagatctttcaacttgt

SEQ ID NO: 1190101 - DNA, 22 bp, Artificial Sequence
  chemically synthesized
atattagatctttcaacttgtt

SEQ ID NO: 1190102 - DNA, 22 bp, Artificial Sequence
  chemically synthesized
tattagatctttcaacttgttt

SEQ ID NO: 1190103 - DNA, 22 bp, Artificial Sequence
  chemically synthesized
gatctttcaacttgtttatccc

SEQ ID NO: 1190104 - DNA, 22 bp, Artificial Sequence
  chemically synthesized
taaagtagcaaatatgtgggat

SEQ ID NO: 1190105 - DNA, 22 bp, Artificial Sequence
  chemically synthesized
tcaacttgtttatcccacatat

SEQ ID NO: 1190106 - DNA, 22 bp, Artificial Sequence
  chemically synthesized
caacttgtttatcccacatatt

SEQ ID NO: 1190107 - DNA, 22 bp, Artificial Sequence
  chemically synthesized
aacttgtttatcccacatattt

SEQ ID NO: 1190108 - DNA, 22 bp, Artificial Sequence
  chemically synthesized
gtttatcccacatatttgctac

SEQ ID NO: 1190109 - DNA, 22 bp, Artificial Sequence
  chemically synthesized
tttatcccacatatttgctact

SEQ ID NO: 1190110 - DNA, 22 bp, Artificial Sequence
  chemically synthesized
atcccacatatttgctacttta

SEQ ID NO: 1190111 - DNA, 22 bp, Artificial Sequence
  chemically synthesized
tcccacatatttgctactttat

SEQ ID NO: 1190112 - DNA, 22 bp, Artificial Sequence
  chemically synthesized
gctactttatagactttgacct

SEQ ID NO: 1190113 - DNA, 22 bp, Artificial Sequence
  chemically synthesized
ctactttatagactttgaccta

SEQ ID NO: 1190114 - DNA, 22 bp, Artificial Sequence
  chemically synthesized
ctttatagactttgacctacat

SEQ ID NO: 1190115 - DNA, 22 bp, Artificial Sequence
  chemically synthesized
tatagactttgacctacatctc

SEQ ID NO: 1190116 - DNA, 22 bp, Artificial Sequence
  chemically synthesized
atagactttgacctacatctcc

SEQ ID NO: 1190117 - DNA, 22 bp, Artificial Sequence
  chemically synthesized
tagactttgacctacatctccc

SEQ ID NO: 1190118 - DNA, 22 bp, Artificial Sequence
  chemically synthesized
tgacctacatctccccatttcc

SEQ ID NO: 1190119 - DNA, 22 bp, Artificial Sequence
  chemically synthesized
ggggtggaaggaggaaatgggg

SEQ ID NO: 1190120 - DNA, 22 bp, Artificial Sequence
  chemically synthesized
gacctacatctccccatttcct

SEQ ID NO: 1190121 - DNA, 22 bp, Artificial Sequence
  chemically synthesized
acctacatctccccatttcctc

SEQ ID NO: 1190122 - DNA, 22 bp, Artificial Sequence
  chemically synthesized
catctccccatttcctccttcc

SEQ ID NO: 1190123 - DNA, 22 bp, Artificial Sequence
  chemically synthesized
ccaggttgggggtggaaggagg

SEQ ID NO: 1190124 - DNA, 22 bp, Artificial Sequence
  chemically synthesized
cccatttcctccttccaccccc

SEQ ID NO: 1190125 - DNA, 22 bp, Artificial Sequence
  chemically synthesized
cctccttccacccccaacctgg

SEQ ID NO: 1190126 - DNA, 22 bp, Artificial Sequence
  chemically synthesized
ctccttccacccccaacctggt

SEQ ID NO: 1190127 - DNA, 22 bp, Artificial Sequence
  chemically synthesized
cttccacccccaacctggtaac

SEQ ID NO: 1190128 - DNA, 22 bp, Artificial Sequence
  chemically synthesized
ccacccccaacctggtaaccac

SEQ ID NO: 1190129 - DNA, 22 bp, Artificial Sequence
  chemically synthesized
cacccccaacctggtaaccact

SEQ ID NO: 1190130 - DNA, 22 bp, Artificial Sequence
  chemically synthesized
tatagagagaataaaacagtgg

SEQ ID NO: 1190131 - DNA, 22 bp, Artificial Sequence
  chemically synthesized
gtaaccactgttttattctctc

SEQ ID NO: 1190132 - DNA, 22 bp, Artificial Sequence
  chemically synthesized
tgtataactatatagagagaat

SEQ ID NO: 1190133 - DNA, 22 bp, Artificial Sequence
  chemically synthesized
cattgtgtataactatatagag

SEQ ID NO: 1190134 - DNA, 22 bp, Artificial Sequence
  chemically synthesized
ttttattctctctatatagtta

SEQ ID NO: 1190135 - DNA, 22 bp, Artificial Sequence
  chemically synthesized
tattctctctatatagttatac

SEQ ID NO: 1190136 - DNA, 22 bp, Artificial Sequence
  chemically synthesized
attctctctatatagttataca

SEQ ID NO: 1190137 - DNA, 22 bp, Artificial Sequence
  chemically synthesized
ttctctctatatagttatacac

SEQ ID NO: 1190138 - DNA, 22 bp, Artificial Sequence
  chemically synthesized
tctctatatagttatacacaat

SEQ ID NO: 1190139 - DNA, 22 bp, Artificial Sequence
  chemically synthesized
tctatatagttatacacaatgg

SEQ ID NO: 1190140 - DNA, 22 bp, Artificial Sequence
  chemically synthesized
tatatagttatacacaatggaa

SEQ ID NO: 1190141 - DNA, 22 bp, Artificial Sequence
  chemically synthesized
tatagttatacacaatggaata

SEQ ID NO: 1190142 - DNA, 22 bp, Artificial Sequence
  chemically synthesized
aaggccaagtaatattccattg

SEQ ID NO: 1190143 - DNA, 22 bp, Artificial Sequence
  chemically synthesized
aaaggccaagtaatattccatt

SEQ ID NO: 1190144 - DNA, 22 bp, Artificial Sequence
  chemically synthesized
taaaggccaagtaatattccat

SEQ ID NO: 1190145 - DNA, 22 bp, Artificial Sequence
  chemically synthesized
ttaaaggccaagtaatattcca

SEQ ID NO: 1190146 - DNA, 22 bp, Artificial Sequence
  chemically synthesized
tttaaaggccaagtaatattcc

SEQ ID NO: 1190147 - DNA, 22 bp, Artificial Sequence
  chemically synthesized
ctttttaaaggccaagtaatat

SEQ ID NO: 1190148 - DNA, 22 bp, Artificial Sequence
  chemically synthesized
tacacaatggaatattacttgg

SEQ ID NO: 1190149 - DNA, 22 bp, Artificial Sequence
  chemically synthesized
gcccaagatctcctttttaaag

SEQ ID NO: 1190150 - DNA, 22 bp, Artificial Sequence
  chemically synthesized
cttggcctttaaaaaggagatc

SEQ ID NO: 1190151 - DNA, 22 bp, Artificial Sequence
  chemically synthesized
ggcctttaaaaaggagatcttg

SEQ ID NO: 1190152 - DNA, 22 bp, Artificial Sequence
  chemically synthesized
gcctttaaaaaggagatcttgg

SEQ ID NO: 1190153 - DNA, 22 bp, Artificial Sequence
  chemically synthesized
taaaaaggagatcttgggccag

SEQ ID NO: 1190154 - DNA, 22 bp, Artificial Sequence
  chemically synthesized
aaaaaggagatcttgggccagg

SEQ ID NO: 1190155 - DNA, 22 bp, Artificial Sequence
  chemically synthesized
aaaaggagatcttgggccaggc

SEQ ID NO: 1190156 - DNA, 22 bp, Artificial Sequence
  chemically synthesized
caggcatgagccaccacgcctg

SEQ ID NO: 1190157 - DNA, 22 bp, Artificial Sequence
  chemically synthesized
ggattacaggcatgagccacca

SEQ ID NO: 1190158 - DNA, 22 bp, Artificial Sequence
  chemically synthesized
gggccaggcgtggtggctcatg

SEQ ID NO: 1190159 - DNA, 22 bp, Artificial Sequence
  chemically synthesized
ggccaggcgtggtggctcatgc

SEQ ID NO: 1190160 - DNA, 22 bp, Artificial Sequence
  chemically synthesized
ccaaagtgctgggattacaggc

SEQ ID NO: 1190161 - DNA, 22 bp, Artificial Sequence
  chemically synthesized
gcctcccaaagtgctgggatta

SEQ ID NO: 1190162 - DNA, 22 bp, Artificial Sequence
  chemically synthesized
ggcctcccaaagtgctgggatt

SEQ ID NO: 1190163 - DNA, 22 bp, Artificial Sequence
  chemically synthesized
atgcctgtaatcccagcacttt

SEQ ID NO: 1190164 - DNA, 22 bp, Artificial Sequence
  chemically synthesized
ccttggcctcccaaagtgctgg

SEQ ID NO: 1190165 - DNA, 22 bp, Artificial Sequence
  chemically synthesized
ctgccttggcctcccaaagtgc

SEQ ID NO: 1190166 - DNA, 22 bp, Artificial Sequence
  chemically synthesized
taatcccagcactttgggaggc

SEQ ID NO: 1190167 - DNA, 22 bp, Artificial Sequence
  chemically synthesized
tgatcctcctgccttggcctcc

SEQ ID NO: 1190168 - DNA, 22 bp, Artificial Sequence
  chemically synthesized
gtgatcctcctgccttggcctc

SEQ ID NO: 1190169 - DNA, 22 bp, Artificial Sequence
  chemically synthesized
accttgtgatcctcctgccttg

SEQ ID NO: 1190170 - DNA, 22 bp, Artificial Sequence
  chemically synthesized
gaccttgtgatcctcctgcctt

SEQ ID NO: 1190171 - DNA, 22 bp, Artificial Sequence
  chemically synthesized
ttgaccttgtgatcctcctgcc

SEQ ID NO: 1190172 - DNA, 22 bp, Artificial Sequence
  chemically synthesized
tgggaggccaaggcaggaggat

SEQ ID NO: 1190173 - DNA, 22 bp, Artificial Sequence
  chemically synthesized
gggaggccaaggcaggaggatc

SEQ ID NO: 1190174 - DNA, 22 bp, Artificial Sequence
  chemically synthesized
ggaggccaaggcaggaggatca

SEQ ID NO: 1190175 - DNA, 22 bp, Artificial Sequence
  chemically synthesized
aatctcttgaccttgtgatcct

SEQ ID NO: 1190176 - DNA, 22 bp, Artificial Sequence
  chemically synthesized
gccaggatggtctcaatctctt

SEQ ID NO: 1190177 - DNA, 22 bp, Artificial Sequence
  chemically synthesized
ccatgttggccaggatggtctc

SEQ ID NO: 1190178 - DNA, 22 bp, Artificial Sequence
  chemically synthesized
accatgttggccaggatggtct

SEQ ID NO: 1190179 - DNA, 22 bp, Artificial Sequence
  chemically synthesized
taccatgttggccaggatggtc

SEQ ID NO: 1190180 - DNA, 22 bp, Artificial Sequence
  chemically synthesized
ttaccatgttggccaggatggt

SEQ ID NO: 1190181 - DNA, 22 bp, Artificial Sequence
  chemically synthesized
gcttttaccatgttggccagga

SEQ ID NO: 1190182 - DNA, 22 bp, Artificial Sequence
  chemically synthesized
agaccatcctggccaacatggt

SEQ ID NO: 1190183 - DNA, 22 bp, Artificial Sequence
  chemically synthesized
gtagtgattggcttttaccatg

SEQ ID NO: 1190184 - DNA, 22 bp, Artificial Sequence
  chemically synthesized
agtagtgattggcttttaccat

SEQ ID NO: 1190185 - DNA, 22 bp, Artificial Sequence
  chemically synthesized
tagtagtgattggcttttacca

SEQ ID NO: 1190186 - DNA, 22 bp, Artificial Sequence
  chemically synthesized
ttagtagtgattggcttttacc

SEQ ID NO: 1190187 - DNA, 22 bp, Artificial Sequence
  chemically synthesized
gccaacatggtaaaagccaatc

SEQ ID NO: 1190188 - DNA, 22 bp, Artificial Sequence
  chemically synthesized
aatttttagtagtgattggctt

SEQ ID NO: 1190189 - DNA, 22 bp, Artificial Sequence
  chemically synthesized
gaatttttagtagtgattggct

SEQ ID NO: 1190190 - DNA, 22 bp, Artificial Sequence
  chemically synthesized
tgaatttttagtagtgattggc

SEQ ID NO: 1190191 - DNA, 22 bp, Artificial Sequence
  chemically synthesized
ttgaatttttagtagtgattgg

SEQ ID NO: 1190192 - DNA, 22 bp, Artificial Sequence
  chemically synthesized
atttttgaatttttagtagtga

SEQ ID NO: 1190193 - DNA, 22 bp, Artificial Sequence
  chemically synthesized
ctaaaaattcaaaaattagttt

SEQ ID NO: 1190194 - DNA, 22 bp, Artificial Sequence
  chemically synthesized
aaaattcaaaaattagtttggc

SEQ ID NO: 1190195 - DNA, 22 bp, Artificial Sequence
  chemically synthesized
caggcgcacaccaccaagccaa

SEQ ID NO: 1190196 - DNA, 22 bp, Artificial Sequence
  chemically synthesized
aaaaattagtttggcttggtgg

SEQ ID NO: 1190197 - DNA, 22 bp, Artificial Sequence
  chemically synthesized
ggattacaggcgcacaccacca

SEQ ID NO: 1190198 - DNA, 22 bp, Artificial Sequence
  chemically synthesized
gtttggcttggtggtgtgcgcc

SEQ ID NO: 1190199 - DNA, 22 bp, Artificial Sequence
  chemically synthesized
ggcttggtggtgtgcgcctgta

SEQ ID NO: 1190200 - DNA, 22 bp, Artificial Sequence
  chemically synthesized
aatagctgggattacaggcgca

SEQ ID NO: 1190201 - DNA, 22 bp, Artificial Sequence
  chemically synthesized
gcttggtggtgtgcgcctgtaa

SEQ ID NO: 1190202 - DNA, 22 bp, Artificial Sequence
  chemically synthesized
ctgaatagctgggattacaggc

SEQ ID NO: 1190203 - DNA, 22 bp, Artificial Sequence
  chemically synthesized
ggtggtgtgcgcctgtaatccc

SEQ ID NO: 1190204 - DNA, 22 bp, Artificial Sequence
  chemically synthesized
gtggtgtgcgcctgtaatccca

SEQ ID NO: 1190205 - DNA, 22 bp, Artificial Sequence
  chemically synthesized
agcctcctgaatagctgggatt

SEQ ID NO: 1190206 - DNA, 22 bp, Artificial Sequence
  chemically synthesized
cctcagcctcctgaatagctgg

SEQ ID NO: 1190207 - DNA, 22 bp, Artificial Sequence
  chemically synthesized
ctgcctcagcctcctgaatagc

SEQ ID NO: 1190208 - DNA, 22 bp, Artificial Sequence
  chemically synthesized
tcctgcctcagcctcctgaata

SEQ ID NO: 1190209 - DNA, 22 bp, Artificial Sequence
  chemically synthesized
taatcccagctattcaggaggc

SEQ ID NO: 1190210 - DNA, 22 bp, Artificial Sequence
  chemically synthesized
agagattctcctgcctcagcct

SEQ ID NO: 1190211 - DNA, 22 bp, Artificial Sequence
  chemically synthesized
aagagattctcctgcctcagcc

SEQ ID NO: 1190212 - DNA, 22 bp, Artificial Sequence
  chemically synthesized
taagagattctcctgcctcagc

SEQ ID NO: 1190213 - DNA, 22 bp, Artificial Sequence
  chemically synthesized
ttcaggaggctgaggcaggaga

SEQ ID NO: 1190214 - DNA, 22 bp, Artificial Sequence
  chemically synthesized
gctttaagagattctcctgcct

SEQ ID NO: 1190215 - DNA, 22 bp, Artificial Sequence
  chemically synthesized
aggaggctgaggcaggagaatc

SEQ ID NO: 1190216 - DNA, 22 bp, Artificial Sequence
  chemically synthesized
ctggctttaagagattctcctg

SEQ ID NO: 1190217 - DNA, 22 bp, Artificial Sequence
  chemically synthesized
cctggctttaagagattctcct

SEQ ID NO: 1190218 - DNA, 22 bp, Artificial Sequence
  chemically synthesized
cacttcctggctttaagagatt

SEQ ID NO: 1190219 - DNA, 22 bp, Artificial Sequence
  chemically synthesized
aggcaggagaatctcttaaagc

SEQ ID NO: 1190220 - DNA, 22 bp, Artificial Sequence
  chemically synthesized
caacctccacttcctggcttta

SEQ ID NO: 1190221 - DNA, 22 bp, Artificial Sequence
  chemically synthesized
actgcaacctccacttcctggc

SEQ ID NO: 1190222 - DNA, 22 bp, Artificial Sequence
  chemically synthesized
ggctcactgcaacctccacttc

SEQ ID NO: 1190223 - DNA, 22 bp, Artificial Sequence
  chemically synthesized
ttaaagccaggaagtggaggtt

SEQ ID NO: 1190224 - DNA, 22 bp, Artificial Sequence
  chemically synthesized
aaagccaggaagtggaggttgc

SEQ ID NO: 1190225 - DNA, 22 bp, Artificial Sequence
  chemically synthesized
aagccaggaagtggaggttgca

SEQ ID NO: 1190226 - DNA, 22 bp, Artificial Sequence
  chemically synthesized
atgtgcagtggcacaatctcgg

SEQ ID NO: 1190227 - DNA, 22 bp, Artificial Sequence
  chemically synthesized
cagtgagccgagattgtgccac

SEQ ID NO: 1190228 - DNA, 22 bp, Artificial Sequence
  chemically synthesized
tcaccaggctgatgtgcagtgg

SEQ ID NO: 1190229 - DNA, 22 bp, Artificial Sequence
  chemically synthesized
tgtcaccaggctgatgtgcagt

SEQ ID NO: 1190230 - DNA, 22 bp, Artificial Sequence
  chemically synthesized
tgccactgcacatcagcctggt

SEQ ID NO: 1190231 - DNA, 22 bp, Artificial Sequence
  chemically synthesized
atggaatctctgtcaccaggct

SEQ ID NO: 1190232 - DNA, 22 bp, Artificial Sequence
  chemically synthesized
gatggaatctctgtcaccaggc

SEQ ID NO: 1190233 - DNA, 22 bp, Artificial Sequence
  chemically synthesized
tgatggaatctctgtcaccagg

SEQ ID NO: 1190234 - DNA, 22 bp, Artificial Sequence
  chemically synthesized
ttgatggaatctctgtcaccag

SEQ ID NO: 1190235 - DNA, 22 bp, Artificial Sequence
  chemically synthesized
tttgatggaatctctgtcacca

SEQ ID NO: 1190236 - DNA, 22 bp, Artificial Sequence
  chemically synthesized
ttttgatggaatctctgtcacc

SEQ ID NO: 1190237 - DNA, 22 bp, Artificial Sequence
  chemically synthesized
cacatcagcctggtgacagaga

SEQ ID NO: 1190238 - DNA, 22 bp, Artificial Sequence
  chemically synthesized
tttttgatggaatctctgtcac

SEQ ID NO: 1190239 - DNA, 22 bp, Artificial Sequence
  chemically synthesized
ttttttgatggaatctctgtca

SEQ ID NO: 1190240 - DNA, 22 bp, Artificial Sequence
  chemically synthesized
tttttttgatggaatctctgtc

SEQ ID NO: 1190241 - DNA, 22 bp, Artificial Sequence
  chemically synthesized
ttttttttgatggaatctctgt

SEQ ID NO: 1190242 - DNA, 22 bp, Artificial Sequence
  chemically synthesized
tttttttttgatggaatctctg

SEQ ID NO: 1190243 - DNA, 22 bp, Artificial Sequence
  chemically synthesized
ttttttttttgatggaatctct

SEQ ID NO: 1190244 - DNA, 22 bp, Artificial Sequence
  chemically synthesized
tttttttttttgatggaatctc

SEQ ID NO: 1190245 - DNA, 22 bp, Artificial Sequence
  chemically synthesized
ttttttttttttgatggaatct

SEQ ID NO: 1190246 - DNA, 22 bp, Artificial Sequence
  chemically synthesized
tttttttttttttgatggaatc

SEQ ID NO: 1190247 - DNA, 22 bp, Artificial Sequence
  chemically synthesized
ttttttttttttttgatggaat

SEQ ID NO: 1190248 - DNA, 22 bp, Artificial Sequence
  chemically synthesized
tttttttttttttttgatggaa

SEQ ID NO: 1190249 - DNA, 22 bp, Artificial Sequence
  chemically synthesized
ttttttttttttttttgatgga

SEQ ID NO: 1190250 - DNA, 22 bp, Artificial Sequence
  chemically synthesized
gtgacagagattccatcaaaaa

SEQ ID NO: 1190251 - DNA, 22 bp, Artificial Sequence
  chemically synthesized
tttttttttttttttttgatgg

SEQ ID NO: 1190252 - DNA, 22 bp, Artificial Sequence
  chemically synthesized
ttttttttttttttttttgatg

SEQ ID NO: 1190253 - DNA, 22 bp, Artificial Sequence
  chemically synthesized
tttttttttttttttttttgat

SEQ ID NO: 1190254 - DNA, 22 bp, Artificial Sequence
  chemically synthesized
ttttttttttttttttttttga

SEQ ID NO: 1190255 - DNA, 22 bp, Artificial Sequence
  chemically synthesized
tttttttttttttttttttttg

SEQ ID NO: 1190256 - DNA, 22 bp, Artificial Sequence
  chemically synthesized
tttttttttttttttttttttt

SEQ ID NO: 1190257 - DNA, 22 bp, Artificial Sequence
  chemically synthesized
tttttttttttttttttttttt

SEQ ID NO: 1190258 - DNA, 22 bp, Artificial Sequence
  chemically synthesized
tttttttttttttttttttttt

SEQ ID NO: 1190259 - DNA, 22 bp, Artificial Sequence
  chemically synthesized
cttttttttttttttttttttt

SEQ ID NO: 1190260 - DNA, 22 bp, Artificial Sequence
  chemically synthesized
catcaaaaaaaaaaaaaaaaaa

SEQ ID NO: 1190261 - DNA, 22 bp, Artificial Sequence
  chemically synthesized
gtcaagatctcctttttttttt

SEQ ID NO: 1190262 - DNA, 22 bp, Artificial Sequence
  chemically synthesized
taggcataagccaccacacctg

SEQ ID NO: 1190263 - DNA, 22 bp, Artificial Sequence
  chemically synthesized
ggattataggcataagccacca

SEQ ID NO: 1190264 - DNA, 22 bp, Artificial Sequence
  chemically synthesized
gaccaggtgtggtggcttatgc

SEQ ID NO: 1190265 - DNA, 22 bp, Artificial Sequence
  chemically synthesized
accaggtgtggtggcttatgcc

SEQ ID NO: 1190266 - DNA, 22 bp, Artificial Sequence
  chemically synthesized
agtgctaggattataggcataa

SEQ ID NO: 1190267 - DNA, 22 bp, Artificial Sequence
  chemically synthesized
agtccctaagtgctaggattat

SEQ ID NO: 1190268 - DNA, 22 bp, Artificial Sequence
  chemically synthesized
cctaagtccctaagtgctagga

SEQ ID NO: 1190269 - DNA, 22 bp, Artificial Sequence
  chemically synthesized
atgcctataatcctagcactta

SEQ ID NO: 1190270 - DNA, 22 bp, Artificial Sequence
  chemically synthesized
tgcctataatcctagcacttag

SEQ ID NO: 1190271 - DNA, 22 bp, Artificial Sequence
  chemically synthesized
taatcctagcacttagggactt

SEQ ID NO: 1190272 - DNA, 22 bp, Artificial Sequence
  chemically synthesized
ccatggcctccctaagtcccta

SEQ ID NO: 1190273 - DNA, 22 bp, Artificial Sequence
  chemically synthesized
cctgccatggcctccctaagtc

SEQ ID NO: 1190274 - DNA, 22 bp, Artificial Sequence
  chemically synthesized
gcacttagggacttagggaggc

SEQ ID NO: 1190275 - DNA, 22 bp, Artificial Sequence
  chemically synthesized
cgtatctgcctgccatggcctc

SEQ ID NO: 1190276 - DNA, 22 bp, Artificial Sequence
  chemically synthesized
agggacttagggaggccatggc

SEQ ID NO: 1190277 - DNA, 22 bp, Artificial Sequence
  chemically synthesized
gggacttagggaggccatggca

SEQ ID NO: 1190278 - DNA, 22 bp, Artificial Sequence
  chemically synthesized
agggaggccatggcaggcagat

SEQ ID NO: 1190279 - DNA, 22 bp, Artificial Sequence
  chemically synthesized
gggaggccatggcaggcagata

SEQ ID NO: 1190280 - DNA, 22 bp, Artificial Sequence
  chemically synthesized
aggtgatctgcgtatctgcctg

SEQ ID NO: 1190281 - DNA, 22 bp, Artificial Sequence
  chemically synthesized
acctcaggtgatctgcgtatct

SEQ ID NO: 1190282 - DNA, 22 bp, Artificial Sequence
  chemically synthesized
ctgacctcaggtgatctgcgta

SEQ ID NO: 1190283 - DNA, 22 bp, Artificial Sequence
  chemically synthesized
aaactcctgacctcaggtgatc

SEQ ID NO: 1190284 - DNA, 22 bp, Artificial Sequence
  chemically synthesized
gccagggtctcaaactcctgac

SEQ ID NO: 1190285 - DNA, 22 bp, Artificial Sequence
  chemically synthesized
accatgttggccagggtctcaa

SEQ ID NO: 1190286 - DNA, 22 bp, Artificial Sequence
  chemically synthesized
aggtcaggagtttgagaccctg

SEQ ID NO: 1190287 - DNA, 22 bp, Artificial Sequence
  chemically synthesized
caccatgttggccagggtctca

SEQ ID NO: 1190288 - DNA, 22 bp, Artificial Sequence
  chemically synthesized
gagaccctggccaacatggtga

SEQ ID NO: 1190289 - DNA, 22 bp, Artificial Sequence
  chemically synthesized
agaccctggccaacatggtgaa

SEQ ID NO: 1190290 - DNA, 22 bp, Artificial Sequence
  chemically synthesized
gtagagatggggtttcaccatg

SEQ ID NO: 1190291 - DNA, 22 bp, Artificial Sequence
  chemically synthesized
agtagagatggggtttcaccat

SEQ ID NO: 1190292 - DNA, 22 bp, Artificial Sequence
  chemically synthesized
tagtagagatggggtttcacca

SEQ ID NO: 1190293 - DNA, 22 bp, Artificial Sequence
  chemically synthesized
ttagtagagatggggtttcacc

SEQ ID NO: 1190294 - DNA, 22 bp, Artificial Sequence
  chemically synthesized
gccaacatggtgaaaccccatc

SEQ ID NO: 1190295 - DNA, 22 bp, Artificial Sequence
  chemically synthesized
catttttagtagagatggggtt

SEQ ID NO: 1190296 - DNA, 22 bp, Artificial Sequence
  chemically synthesized
gcatttttagtagagatggggt

SEQ ID NO: 1190297 - DNA, 22 bp, Artificial Sequence
  chemically synthesized
tgcatttttagtagagatgggg

SEQ ID NO: 1190298 - DNA, 22 bp, Artificial Sequence
  chemically synthesized
ttgcatttttagtagagatggg

SEQ ID NO: 1190299 - DNA, 22 bp, Artificial Sequence
  chemically synthesized
atttttgcatttttagtagaga

SEQ ID NO: 1190300 - DNA, 22 bp, Artificial Sequence
  chemically synthesized
tactaaaaatgcaaaaattagc

SEQ ID NO: 1190301 - DNA, 22 bp, Artificial Sequence
  chemically synthesized
ctaaaaatgcaaaaattagctg

SEQ ID NO: 1190302 - DNA, 22 bp, Artificial Sequence
  chemically synthesized
aaaatgcaaaaattagctgggt

SEQ ID NO: 1190303 - DNA, 22 bp, Artificial Sequence
  chemically synthesized
caggcgcccaccaccacaccca

SEQ ID NO: 1190304 - DNA, 22 bp, Artificial Sequence
  chemically synthesized
acaggcgcccaccaccacaccc

SEQ ID NO: 1190305 - DNA, 22 bp, Artificial Sequence
  chemically synthesized
ggatttacaggcgcccaccacc

SEQ ID NO: 1190306 - DNA, 22 bp, Artificial Sequence
  chemically synthesized
gctgggtgtggtggtgggcgcc

SEQ ID NO: 1190307 - DNA, 22 bp, Artificial Sequence
  chemically synthesized
ggtgtggtggtgggcgcctgta

SEQ ID NO: 1190308 - DNA, 22 bp, Artificial Sequence
  chemically synthesized
ccaagtagctgggatttacagg

SEQ ID NO: 1190309 - DNA, 22 bp, Artificial Sequence
  chemically synthesized
agcctcccaagtagctgggatt

SEQ ID NO: 1190310 - DNA, 22 bp, Artificial Sequence
  chemically synthesized
cctcagcctcccaagtagctgg

SEQ ID NO: 1190311 - DNA, 22 bp, Artificial Sequence
  chemically synthesized
tcctacctcagcctcccaagta

SEQ ID NO: 1190312 - DNA, 22 bp, Artificial Sequence
  chemically synthesized
taaatcccagctacttgggagg

SEQ ID NO: 1190313 - DNA, 22 bp, Artificial Sequence
  chemically synthesized
aagtgattatcctacctcagcc

SEQ ID NO: 1190314 - DNA, 22 bp, Artificial Sequence
  chemically synthesized
cttgggaggctgaggtaggata

SEQ ID NO: 1190315 - DNA, 22 bp, Artificial Sequence
  chemically synthesized
gggaggctgaggtaggataatc

SEQ ID NO: 1190316 - DNA, 22 bp, Artificial Sequence
  chemically synthesized
cccggttcaagtgattatccta

SEQ ID NO: 1190317 - DNA, 22 bp, Artificial Sequence
  chemically synthesized
ggaggctgaggtaggataatca

SEQ ID NO: 1190318 - DNA, 22 bp, Artificial Sequence
  chemically synthesized
cacctccccggttcaagtgatt

SEQ ID NO: 1190319 - DNA, 22 bp, Artificial Sequence
  chemically synthesized
aggtaggataatcacttgaacc

SEQ ID NO: 1190320 - DNA, 22 bp, Artificial Sequence
  chemically synthesized
caacctccacctccccggttca

SEQ ID NO: 1190321 - DNA, 22 bp, Artificial Sequence
  chemically synthesized
actgcaacctccacctccccgg

SEQ ID NO: 1190322 - DNA, 22 bp, Artificial Sequence
  chemically synthesized
gaaccggggaggtggaggttgc

SEQ ID NO: 1190323 - DNA, 22 bp, Artificial Sequence
  chemically synthesized
aaccggggaggtggaggttgca

SEQ ID NO: 1190324 - DNA, 22 bp, Artificial Sequence
  chemically synthesized
gagtgcagtggctcactgcaac

SEQ ID NO: 1190325 - DNA, 22 bp, Artificial Sequence
  chemically synthesized
aagctggagtgcagtggctcac

SEQ ID NO: 1190326 - DNA, 22 bp, Artificial Sequence
  chemically synthesized
ccactcaagctggagtgcagtg

SEQ ID NO: 1190327 - DNA, 22 bp, Artificial Sequence
  chemically synthesized
tgccactcaagctggagtgcag

SEQ ID NO: 1190328 - DNA, 22 bp, Artificial Sequence
  chemically synthesized
cagtgagccactgcactccagc

SEQ ID NO: 1190329 - DNA, 22 bp, Artificial Sequence
  chemically synthesized
actctgccactcaagctggagt

SEQ ID NO: 1190330 - DNA, 22 bp, Artificial Sequence
  chemically synthesized
cactccagcttgagtggcagag

SEQ ID NO: 1190331 - DNA, 22 bp, Artificial Sequence
  chemically synthesized
agatgaagtctcactctgccac

SEQ ID NO: 1190332 - DNA, 22 bp, Artificial Sequence
  chemically synthesized
gagatgaagtctcactctgcca

SEQ ID NO: 1190333 - DNA, 22 bp, Artificial Sequence
  chemically synthesized
tgagatgaagtctcactctgcc

SEQ ID NO: 1190334 - DNA, 22 bp, Artificial Sequence
  chemically synthesized
cagcttgagtggcagagtgaga

SEQ ID NO: 1190335 - DNA, 22 bp, Artificial Sequence
  chemically synthesized
ttttgagatgaagtctcactct

SEQ ID NO: 1190336 - DNA, 22 bp, Artificial Sequence
  chemically synthesized
tgttttgagatgaagtctcact

SEQ ID NO: 1190337 - DNA, 22 bp, Artificial Sequence
  chemically synthesized
ctgttttgagatgaagtctcac

SEQ ID NO: 1190338 - DNA, 22 bp, Artificial Sequence
  chemically synthesized
gagtggcagagtgagacttcat

SEQ ID NO: 1190339 - DNA, 22 bp, Artificial Sequence
  chemically synthesized
agtggcagagtgagacttcatc

SEQ ID NO: 1190340 - DNA, 22 bp, Artificial Sequence
  chemically synthesized
tgtttctgttttgagatgaagt

SEQ ID NO: 1190341 - DNA, 22 bp, Artificial Sequence
  chemically synthesized
gtgtttctgttttgagatgaag

SEQ ID NO: 1190342 - DNA, 22 bp, Artificial Sequence
  chemically synthesized
tgtgtttctgttttgagatgaa

SEQ ID NO: 1190343 - DNA, 22 bp, Artificial Sequence
  chemically synthesized
ttgtgtttctgttttgagatga

SEQ ID NO: 1190344 - DNA, 22 bp, Artificial Sequence
  chemically synthesized
tttgtgtttctgttttgagatg

SEQ ID NO: 1190345 - DNA, 22 bp, Artificial Sequence
  chemically synthesized
ttttgtgtttctgttttgagat

SEQ ID NO: 1190346 - DNA, 22 bp, Artificial Sequence
  chemically synthesized
tttttgtgtttctgttttgaga

SEQ ID NO: 1190347 - DNA, 22 bp, Artificial Sequence
  chemically synthesized
ctttttttgtgtttctgttttg

SEQ ID NO: 1190348 - DNA, 22 bp, Artificial Sequence
  chemically synthesized
catctcaaaacagaaacacaaa

SEQ ID NO: 1190349 - DNA, 22 bp, Artificial Sequence
  chemically synthesized
atctcaaaacagaaacacaaaa

SEQ ID NO: 1190350 - DNA, 22 bp, Artificial Sequence
  chemically synthesized
aaaacagaaacacaaaaaaagg

SEQ ID NO: 1190351 - DNA, 22 bp, Artificial Sequence
  chemically synthesized
tggcaaataagaagatctcctt

SEQ ID NO: 1190352 - DNA, 22 bp, Artificial Sequence
  chemically synthesized
tcctgtggcaaataagaagatc

SEQ ID NO: 1190353 - DNA, 22 bp, Artificial Sequence
  chemically synthesized
catctgtcctgtggcaaataag

SEQ ID NO: 1190354 - DNA, 22 bp, Artificial Sequence
  chemically synthesized
ggctccatctgtcctgtggcaa

SEQ ID NO: 1190355 - DNA, 22 bp, Artificial Sequence
  chemically synthesized
cggctccatctgtcctgtggca

SEQ ID NO: 1190356 - DNA, 22 bp, Artificial Sequence
  chemically synthesized
ttcggctccatctgtcctgtgg

SEQ ID NO: 1190357 - DNA, 22 bp, Artificial Sequence
  chemically synthesized
cttatttgccacaggacagatg

SEQ ID NO: 1190358 - DNA, 22 bp, Artificial Sequence
  chemically synthesized
ttatttgccacaggacagatgg

SEQ ID NO: 1190359 - DNA, 22 bp, Artificial Sequence
  chemically synthesized
atgttcttcggctccatctgtc

SEQ ID NO: 1190360 - DNA, 22 bp, Artificial Sequence
  chemically synthesized
atttgccacaggacagatggag

SEQ ID NO: 1190361 - DNA, 22 bp, Artificial Sequence
  chemically synthesized
tttgccacaggacagatggagc

SEQ ID NO: 1190362 - DNA, 22 bp, Artificial Sequence
  chemically synthesized
gccacaggacagatggagccga

SEQ ID NO: 1190363 - DNA, 22 bp, Artificial Sequence
  chemically synthesized
gcctaatgttcttcggctccat

SEQ ID NO: 1190364 - DNA, 22 bp, Artificial Sequence
  chemically synthesized
ccacaggacagatggagccgaa

SEQ ID NO: 1190365 - DNA, 22 bp, Artificial Sequence
  chemically synthesized
agcctaatgttcttcggctcca

SEQ ID NO: 1190366 - DNA, 22 bp, Artificial Sequence
  chemically synthesized
acttagcctaatgttcttcggc

SEQ ID NO: 1190367 - DNA, 22 bp, Artificial Sequence
  chemically synthesized
cacttagcctaatgttcttcgg

SEQ ID NO: 1190368 - DNA, 22 bp, Artificial Sequence
  chemically synthesized
tttcacttagcctaatgttctt

SEQ ID NO: 1190369 - DNA, 22 bp, Artificial Sequence
  chemically synthesized
atttcacttagcctaatgttct

SEQ ID NO: 1190370 - DNA, 22 bp, Artificial Sequence
  chemically synthesized
cttatttcacttagcctaatgt

SEQ ID NO: 1190371 - DNA, 22 bp, Artificial Sequence
  chemically synthesized
gcttatttcacttagcctaatg

SEQ ID NO: 1190372 - DNA, 22 bp, Artificial Sequence
  chemically synthesized
tgtcttgcttatttcacttagc

SEQ ID NO: 1190373 - DNA, 22 bp, Artificial Sequence
  chemically synthesized
tgtgtcttgcttatttcactta

SEQ ID NO: 1190374 - DNA, 22 bp, Artificial Sequence
  chemically synthesized
ctgtgtcttgcttatttcactt

SEQ ID NO: 1190375 - DNA, 22 bp, Artificial Sequence
  chemically synthesized
tctgtgtcttgcttatttcact

SEQ ID NO: 1190376 - DNA, 22 bp, Artificial Sequence
  chemically synthesized
tttctgtgtcttgcttatttca

SEQ ID NO: 1190377 - DNA, 22 bp, Artificial Sequence
  chemically synthesized
ctttctgtgtcttgcttatttc

SEQ ID NO: 1190378 - DNA, 22 bp, Artificial Sequence
  chemically synthesized
tctttctgtgtcttgcttattt

SEQ ID NO: 1190379 - DNA, 22 bp, Artificial Sequence
  chemically synthesized
ttctttctgtgtcttgcttatt

SEQ ID NO: 1190380 - DNA, 22 bp, Artificial Sequence
  chemically synthesized
ggctaagtgaaataagcaagac

SEQ ID NO: 1190381 - DNA, 22 bp, Artificial Sequence
  chemically synthesized
agtgaaataagcaagacacaga

SEQ ID NO: 1190382 - DNA, 22 bp, Artificial Sequence
  chemically synthesized
cacaaacaagtgagatcatgca

SEQ ID NO: 1190383 - DNA, 22 bp, Artificial Sequence
  chemically synthesized
ccacaaacaagtgagatcatgc

SEQ ID NO: 1190384 - DNA, 22 bp, Artificial Sequence
  chemically synthesized
agtttccacaaacaagtgagat

SEQ ID NO: 1190385 - DNA, 22 bp, Artificial Sequence
  chemically synthesized
cagtttccacaaacaagtgaga

SEQ ID NO: 1190386 - DNA, 22 bp, Artificial Sequence
  chemically synthesized
tcagtttccacaaacaagtgag

SEQ ID NO: 1190387 - DNA, 22 bp, Artificial Sequence
  chemically synthesized
ttcagtttccacaaacaagtga

SEQ ID NO: 1190388 - DNA, 22 bp, Artificial Sequence
  chemically synthesized
tttttcagtttccacaaacaag

SEQ ID NO: 1190389 - DNA, 22 bp, Artificial Sequence
  chemically synthesized
gtttttcagtttccacaaacaa

SEQ ID NO: 1190390 - DNA, 22 bp, Artificial Sequence
  chemically synthesized
catgatctcacttgtttgtgga

SEQ ID NO: 1190391 - DNA, 22 bp, Artificial Sequence
  chemically synthesized
tgtttttcagtttccacaaaca

SEQ ID NO: 1190392 - DNA, 22 bp, Artificial Sequence
  chemically synthesized
ttgtttttcagtttccacaaac

SEQ ID NO: 1190393 - DNA, 22 bp, Artificial Sequence
  chemically synthesized
tttgtttttcagtttccacaaa

SEQ ID NO: 1190394 - DNA, 22 bp, Artificial Sequence
  chemically synthesized
ctttttgtttttcagtttccac

SEQ ID NO: 1190395 - DNA, 22 bp, Artificial Sequence
  chemically synthesized
acttgtttgtggaaactgaaaa

SEQ ID NO: 1190396 - DNA, 22 bp, Artificial Sequence
  chemically synthesized
gtttgtggaaactgaaaaacaa

SEQ ID NO: 1190397 - DNA, 22 bp, Artificial Sequence
  chemically synthesized
tttgtggaaactgaaaaacaaa

SEQ ID NO: 1190398 - DNA, 22 bp, Artificial Sequence
  chemically synthesized
agcatagttactttttgttttt

SEQ ID NO: 1190399 - DNA, 22 bp, Artificial Sequence
  chemically synthesized
gtggaaactgaaaaacaaaaag

SEQ ID NO: 1190400 - DNA, 22 bp, Artificial Sequence
  chemically synthesized
tggaaactgaaaaacaaaaagt

SEQ ID NO: 1190401 - DNA, 22 bp, Artificial Sequence
  chemically synthesized
aaaaacaaaaagtaactatgct

SEQ ID NO: 1190402 - DNA, 22 bp, Artificial Sequence
  chemically synthesized
tgctgagtatcattttattacc

SEQ ID NO: 1190403 - DNA, 22 bp, Artificial Sequence
  chemically synthesized
ggaaatgtacagtggtaataaa

SEQ ID NO: 1190404 - DNA, 22 bp, Artificial Sequence
  chemically synthesized
agtatcattttattaccactgt

SEQ ID NO: 1190405 - DNA, 22 bp, Artificial Sequence
  chemically synthesized
aaaattaggaaatgtacagtgg

SEQ ID NO: 1190406 - DNA, 22 bp, Artificial Sequence
  chemically synthesized
tattaccactgtacatttccta

SEQ ID NO: 1190407 - DNA, 22 bp, Artificial Sequence
  chemically synthesized
attaccactgtacatttcctaa

SEQ ID NO: 1190408 - DNA, 22 bp, Artificial Sequence
  chemically synthesized
ttaccactgtacatttcctaat

SEQ ID NO: 1190409 - DNA, 22 bp, Artificial Sequence
  chemically synthesized
ccactgtacatttcctaatttt

SEQ ID NO: 1190410 - DNA, 22 bp, Artificial Sequence
  chemically synthesized
tgtaaaatgatctcaaaattag

SEQ ID NO: 1190411 - DNA, 22 bp, Artificial Sequence
  chemically synthesized
tacatttcctaattttgagatc

SEQ ID NO: 1190412 - DNA, 22 bp, Artificial Sequence
  chemically synthesized
attatgtaaaatgatctcaaaa

SEQ ID NO: 1190413 - DNA, 22 bp, Artificial Sequence
  chemically synthesized
tcattatgtaaaatgatctcaa

SEQ ID NO: 1190414 - DNA, 22 bp, Artificial Sequence
  chemically synthesized
ctcattatgtaaaatgatctca

SEQ ID NO: 1190415 - DNA, 22 bp, Artificial Sequence
  chemically synthesized
tctcattatgtaaaatgatctc

SEQ ID NO: 1190416 - DNA, 22 bp, Artificial Sequence
  chemically synthesized
cctaattttgagatcattttac

SEQ ID NO: 1190417 - DNA, 22 bp, Artificial Sequence
  chemically synthesized
ctaattttgagatcattttaca

SEQ ID NO: 1190418 - DNA, 22 bp, Artificial Sequence
  chemically synthesized
attttgagatcattttacataa

SEQ ID NO: 1190419 - DNA, 22 bp, Artificial Sequence
  chemically synthesized
tgagatcattttacataatgag

SEQ ID NO: 1190420 - DNA, 22 bp, Artificial Sequence
  chemically synthesized
gagatcattttacataatgaga

SEQ ID NO: 1190421 - DNA, 22 bp, Artificial Sequence
  chemically synthesized
agatcattttacataatgagaa

SEQ ID NO: 1190422 - DNA, 22 bp, Artificial Sequence
  chemically synthesized
aaaataatatgattttctcatt

SEQ ID NO: 1190423 - DNA, 22 bp, Artificial Sequence
  chemically synthesized
gaaaataatatgattttctcat

SEQ ID NO: 1190424 - DNA, 22 bp, Artificial Sequence
  chemically synthesized
tttgaaaataatatgattttct

SEQ ID NO: 1190425 - DNA, 22 bp, Artificial Sequence
  chemically synthesized
tacataatgagaaaatcatatt

SEQ ID NO: 1190426 - DNA, 22 bp, Artificial Sequence
  chemically synthesized
acataatgagaaaatcatatta

SEQ ID NO: 1190427 - DNA, 22 bp, Artificial Sequence
  chemically synthesized
cataatgagaaaatcatattat

SEQ ID NO: 1190428 - DNA, 22 bp, Artificial Sequence
  chemically synthesized
gaaagcacaagataaattattt

SEQ ID NO: 1190429 - DNA, 22 bp, Artificial Sequence
  chemically synthesized
ttttcaaataatttatcttgtg

SEQ ID NO: 1190430 - DNA, 22 bp, Artificial Sequence
  chemically synthesized
tcaaataatttatcttgtgctt

SEQ ID NO: 1190431 - DNA, 22 bp, Artificial Sequence
  chemically synthesized
caaataatttatcttgtgcttt

SEQ ID NO: 1190432 - DNA, 22 bp, Artificial Sequence
  chemically synthesized
aaataatttatcttgtgctttc

SEQ ID NO: 1190433 - DNA, 22 bp, Artificial Sequence
  chemically synthesized
catgaaatatatattggaaagc

SEQ ID NO: 1190434 - DNA, 22 bp, Artificial Sequence
  chemically synthesized
atcttgtgctttccaatatata

SEQ ID NO: 1190435 - DNA, 22 bp, Artificial Sequence
  chemically synthesized
tcttgtgctttccaatatatat

SEQ ID NO: 1190436 - DNA, 22 bp, Artificial Sequence
  chemically synthesized
gtgctttccaatatatatttca

SEQ ID NO: 1190437 - DNA, 22 bp, Artificial Sequence
  chemically synthesized
tgctttccaatatatatttcat

SEQ ID NO: 1190438 - DNA, 22 bp, Artificial Sequence
  chemically synthesized
tccaatatatatttcatgtaac

SEQ ID NO: 1190439 - DNA, 22 bp, Artificial Sequence
  chemically synthesized
ccaatatatatttcatgtaact

SEQ ID NO: 1190440 - DNA, 22 bp, Artificial Sequence
  chemically synthesized
caatatatatttcatgtaactt

SEQ ID NO: 1190441 - DNA, 22 bp, Artificial Sequence
  chemically synthesized
tatgacgagagaaagttacatg

SEQ ID NO: 1190442 - DNA, 22 bp, Artificial Sequence
  chemically synthesized
gccaatattatatgacgagaga

SEQ ID NO: 1190443 - DNA, 22 bp, Artificial Sequence
  chemically synthesized
catgtaactttctctcgtcata

SEQ ID NO: 1190444 - DNA, 22 bp, Artificial Sequence
  chemically synthesized
atgtaactttctctcgtcatat

SEQ ID NO: 1190445 - DNA, 22 bp, Artificial Sequence
  chemically synthesized
gagaacctagccaatattatat

SEQ ID NO: 1190446 - DNA, 22 bp, Artificial Sequence
  chemically synthesized
tggagaacctagccaatattat

SEQ ID NO: 1190447 - DNA, 22 bp, Artificial Sequence
  chemically synthesized
tctctcgtcatataatattggc

SEQ ID NO: 1190448 - DNA, 22 bp, Artificial Sequence
  chemically synthesized
ctggagaacctagccaatatta

SEQ ID NO: 1190449 - DNA, 22 bp, Artificial Sequence
  chemically synthesized
ctctcgtcatataatattggct

SEQ ID NO: 1190450 - DNA, 22 bp, Artificial Sequence
  chemically synthesized
tctggagaacctagccaatatt

SEQ ID NO: 1190451 - DNA, 22 bp, Artificial Sequence
  chemically synthesized
tctcgtcatataatattggcta

SEQ ID NO: 1190452 - DNA, 22 bp, Artificial Sequence
  chemically synthesized
ttctggagaacctagccaatat

SEQ ID NO: 1190453 - DNA, 22 bp, Artificial Sequence
  chemically synthesized
tcgtcatataatattggctagg

SEQ ID NO: 1190454 - DNA, 22 bp, Artificial Sequence
  chemically synthesized
gtcatataatattggctaggtt

SEQ ID NO: 1190455 - DNA, 22 bp, Artificial Sequence
  chemically synthesized
agtatttttctggagaacctag

SEQ ID NO: 1190456 - DNA, 22 bp, Artificial Sequence
  chemically synthesized
ttcagtatttttctggagaacc

SEQ ID NO: 1190457 - DNA, 22 bp, Artificial Sequence
  chemically synthesized
acgctgttcagtatttttctgg

SEQ ID NO: 1190458 - DNA, 22 bp, Artificial Sequence
  chemically synthesized
gctaggttctccagaaaaatac

SEQ ID NO: 1190459 - DNA, 22 bp, Artificial Sequence
  chemically synthesized
tattgacgctgttcagtatttt

SEQ ID NO: 1190460 - DNA, 22 bp, Artificial Sequence
  chemically synthesized
ggttctccagaaaaatactgaa

SEQ ID NO: 1190461 - DNA, 22 bp, Artificial Sequence
  chemically synthesized
tgtattgacgctgttcagtatt

SEQ ID NO: 1190462 - DNA, 22 bp, Artificial Sequence
  chemically synthesized
ctctgtattgacgctgttcagt

SEQ ID NO: 1190463 - DNA, 22 bp, Artificial Sequence
  chemically synthesized
tccagaaaaatactgaacagcg

SEQ ID NO: 1190464 - DNA, 22 bp, Artificial Sequence
  chemically synthesized
cagaaaaatactgaacagcgtc

SEQ ID NO: 1190465 - DNA, 22 bp, Artificial Sequence
  chemically synthesized
ctcctctgtattgacgctgttc

SEQ ID NO: 1190466 - DNA, 22 bp, Artificial Sequence
  chemically synthesized
aacagcgtcaatacagaggagg

SEQ ID NO: 1190467 - DNA, 22 bp, Artificial Sequence
  chemically synthesized
aaacaataaatacgacaagaat

SEQ ID NO: 1190468 - DNA, 22 bp, Artificial Sequence
  chemically synthesized
gaatgactcaaacaataaatac

SEQ ID NO: 1190469 - DNA, 22 bp, Artificial Sequence
  chemically synthesized
ttgtcgtatttattgtttgagt

SEQ ID NO: 1190470 - DNA, 22 bp, Artificial Sequence
  chemically synthesized
gtcgtatttattgtttgagtca

SEQ ID NO: 1190471 - DNA, 22 bp, Artificial Sequence
  chemically synthesized
tcgtatttattgtttgagtcat

SEQ ID NO: 1190472 - DNA, 22 bp, Artificial Sequence
  chemically synthesized
attgtttgagtcattctagcat

SEQ ID NO: 1190473 - DNA, 22 bp, Artificial Sequence
  chemically synthesized
ttgtttgagtcattctagcata

SEQ ID NO: 1190474 - DNA, 22 bp, Artificial Sequence
  chemically synthesized
tttgagtcattctagcatattg

SEQ ID NO: 1190475 - DNA, 22 bp, Artificial Sequence
  chemically synthesized
gagtcattctagcatattgata

SEQ ID NO: 1190476 - DNA, 22 bp, Artificial Sequence
  chemically synthesized
agtcattctagcatattgatat

SEQ ID NO: 1190477 - DNA, 22 bp, Artificial Sequence
  chemically synthesized
tagcatattgatatgatttgga

SEQ ID NO: 1190478 - DNA, 22 bp, Artificial Sequence
  chemically synthesized
gcatattgatatgatttggatt

SEQ ID NO: 1190479 - DNA, 22 bp, Artificial Sequence
  chemically synthesized
ggcaaggaaacaaatccaaatc

SEQ ID NO: 1190480 - DNA, 22 bp, Artificial Sequence
  chemically synthesized
gggcaaggaaacaaatccaaat

SEQ ID NO: 1190481 - DNA, 22 bp, Artificial Sequence
  chemically synthesized
atatgatttggatttgtttcct

SEQ ID NO: 1190482 - DNA, 22 bp, Artificial Sequence
  chemically synthesized
aacatgagatttgggcaaggaa

SEQ ID NO: 1190483 - DNA, 22 bp, Artificial Sequence
  chemically synthesized
ggatttgtttccttgcccaaat

SEQ ID NO: 1190484 - DNA, 22 bp, Artificial Sequence
  chemically synthesized
gatttgtttccttgcccaaatc

SEQ ID NO: 1190485 - DNA, 22 bp, Artificial Sequence
  chemically synthesized
gtttccttgcccaaatctcatg

SEQ ID NO: 1190486 - DNA, 22 bp, Artificial Sequence
  chemically synthesized
tttccttgcccaaatctcatgt

SEQ ID NO: 1190487 - DNA, 22 bp, Artificial Sequence
  chemically synthesized
gggaacacaactcaacatgaga

SEQ ID NO: 1190488 - DNA, 22 bp, Artificial Sequence
  chemically synthesized
ccttgcccaaatctcatgttga

SEQ ID NO: 1190489 - DNA, 22 bp, Artificial Sequence
  chemically synthesized
cttgcccaaatctcatgttgag

SEQ ID NO: 1190490 - DNA, 22 bp, Artificial Sequence
  chemically synthesized
gcccaaatctcatgttgagttg

SEQ ID NO: 1190491 - DNA, 22 bp, Artificial Sequence
  chemically synthesized
cccaaatctcatgttgagttgt

SEQ ID NO: 1190492 - DNA, 22 bp, Artificial Sequence
  chemically synthesized
caacactggggaacacaactca

SEQ ID NO: 1190493 - DNA, 22 bp, Artificial Sequence
  chemically synthesized
ctccaacactggggaacacaac

SEQ ID NO: 1190494 - DNA, 22 bp, Artificial Sequence
  chemically synthesized
atgttgagttgtgttccccagt

SEQ ID NO: 1190495 - DNA, 22 bp, Artificial Sequence
  chemically synthesized
agttgtgttccccagtgttgga

SEQ ID NO: 1190496 - DNA, 22 bp, Artificial Sequence
  chemically synthesized
ccaccaggcccctcctccaaca

SEQ ID NO: 1190497 - DNA, 22 bp, Artificial Sequence
  chemically synthesized
tgttccccagtgttggaggagg

SEQ ID NO: 1190498 - DNA, 22 bp, Artificial Sequence
  chemically synthesized
cccagtgttggaggaggggcct

SEQ ID NO: 1190499 - DNA, 22 bp, Artificial Sequence
  chemically synthesized
tcatctcccaccaggcccctcc

SEQ ID NO: 1190500 - DNA, 22 bp, Artificial Sequence
  chemically synthesized
atgatcctatcatctcccacca

SEQ ID NO: 1190501 - DNA, 22 bp, Artificial Sequence
  chemically synthesized
gaggaggggcctggtgggagat

SEQ ID NO: 1190502 - DNA, 22 bp, Artificial Sequence
  chemically synthesized
accctcatgatcctatcatctc

SEQ ID NO: 1190503 - DNA, 22 bp, Artificial Sequence
  chemically synthesized
gtgggagatgataggatcatga

SEQ ID NO: 1190504 - DNA, 22 bp, Artificial Sequence
  chemically synthesized
ggaaattcaccctcatgatcct

SEQ ID NO: 1190505 - DNA, 22 bp, Artificial Sequence
  chemically synthesized
tcatgagaacagcaactgggaa

SEQ ID NO: 1190506 - DNA, 22 bp, Artificial Sequence
  chemically synthesized
attatcatgagaacagcaactg

SEQ ID NO: 1190507 - DNA, 22 bp, Artificial Sequence
  chemically synthesized
cccagttgctgttctcatgata

SEQ ID NO: 1190508 - DNA, 22 bp, Artificial Sequence
  chemically synthesized
atgagaactcattatcatgaga

SEQ ID NO: 1190509 - DNA, 22 bp, Artificial Sequence
  chemically synthesized
ccagttgctgttctcatgataa

SEQ ID NO: 1190510 - DNA, 22 bp, Artificial Sequence
  chemically synthesized
ctgttctcatgataatgagttc

SEQ ID NO: 1190511 - DNA, 22 bp, Artificial Sequence
  chemically synthesized
ttctcatgataatgagttctca

SEQ ID NO: 1190512 - DNA, 22 bp, Artificial Sequence
  chemically synthesized
tcatgataatgagttctcatga

SEQ ID NO: 1190513 - DNA, 22 bp, Artificial Sequence
  chemically synthesized
aacaaccagatctcatgagaac

SEQ ID NO: 1190514 - DNA, 22 bp, Artificial Sequence
  chemically synthesized
aaacaaccagatctcatgagaa

SEQ ID NO: 1190515 - DNA, 22 bp, Artificial Sequence
  chemically synthesized
atgataatgagttctcatgaga

SEQ ID NO: 1190516 - DNA, 22 bp, Artificial Sequence
  chemically synthesized
taaacaaccagatctcatgaga

SEQ ID NO: 1190517 - DNA, 22 bp, Artificial Sequence
  chemically synthesized
ttaaacaaccagatctcatgag

SEQ ID NO: 1190518 - DNA, 22 bp, Artificial Sequence
  chemically synthesized
cacacttttaaacaaccagatc

SEQ ID NO: 1190519 - DNA, 22 bp, Artificial Sequence
  chemically synthesized
tcatgagatctggttgtttaaa

SEQ ID NO: 1190520 - DNA, 22 bp, Artificial Sequence
  chemically synthesized
atgagatctggttgtttaaaag

SEQ ID NO: 1190521 - DNA, 22 bp, Artificial Sequence
  chemically synthesized
gttgtttaaaagtgtgtagtac

SEQ ID NO: 1190522 - DNA, 22 bp, Artificial Sequence
  chemically synthesized
tttaaaagtgtgtagtactgcc

SEQ ID NO: 1190523 - DNA, 22 bp, Artificial Sequence
  chemically synthesized
aaaagtgtgtagtactgccccc

SEQ ID NO: 1190524 - DNA, 22 bp, Artificial Sequence
  chemically synthesized
aaagtgtgtagtactgccccct

SEQ ID NO: 1190525 - DNA, 22 bp, Artificial Sequence
  chemically synthesized
catggccagagaaggaggagaa

SEQ ID NO: 1190526 - DNA, 22 bp, Artificial Sequence
  chemically synthesized
acatggccagagaaggaggaga

SEQ ID NO: 1190527 - DNA, 22 bp, Artificial Sequence
  chemically synthesized
ccccctgctttctcctccttct

SEQ ID NO: 1190528 - DNA, 22 bp, Artificial Sequence
  chemically synthesized
taccttacatggccagagaagg

SEQ ID NO: 1190529 - DNA, 22 bp, Artificial Sequence
  chemically synthesized
ataccttacatggccagagaag

SEQ ID NO: 1190530 - DNA, 22 bp, Artificial Sequence
  chemically synthesized
ctttctcctccttctctggcca

SEQ ID NO: 1190531 - DNA, 22 bp, Artificial Sequence
  chemically synthesized
tctcctccttctctggccatgt

SEQ ID NO: 1190532 - DNA, 22 bp, Artificial Sequence
  chemically synthesized
ctcctccttctctggccatgta

SEQ ID NO: 1190533 - DNA, 22 bp, Artificial Sequence
  chemically synthesized
tcctccttctctggccatgtaa

SEQ ID NO: 1190534 - DNA, 22 bp, Artificial Sequence
  chemically synthesized
ctccttctctggccatgtaagg

SEQ ID NO: 1190535 - DNA, 22 bp, Artificial Sequence
  chemically synthesized
cttctctggccatgtaaggtat

SEQ ID NO: 1190536 - DNA, 22 bp, Artificial Sequence
  chemically synthesized
ctctggccatgtaaggtataag

SEQ ID NO: 1190537 - DNA, 22 bp, Artificial Sequence
  chemically synthesized
tctggccatgtaaggtataaga

SEQ ID NO: 1190538 - DNA, 22 bp, Artificial Sequence
  chemically synthesized
tggccatgtaaggtataagatg

SEQ ID NO: 1190539 - DNA, 22 bp, Artificial Sequence
  chemically synthesized
gccatgtaaggtataagatgtg

SEQ ID NO: 1190540 - DNA, 22 bp, Artificial Sequence
  chemically synthesized
tggaaggcgaaggggaagcagg

SEQ ID NO: 1190541 - DNA, 22 bp, Artificial Sequence
  chemically synthesized
gtggaaggcgaaggggaagcag

SEQ ID NO: 1190542 - DNA, 22 bp, Artificial Sequence
  chemically synthesized
ttgtggaaggcgaaggggaagc

SEQ ID NO: 1190543 - DNA, 22 bp, Artificial Sequence
  chemically synthesized
cttgtggaaggcgaaggggaag

SEQ ID NO: 1190544 - DNA, 22 bp, Artificial Sequence
  chemically synthesized
caccttcttgtggaaggcgaag

SEQ ID NO: 1190545 - DNA, 22 bp, Artificial Sequence
  chemically synthesized
ccaccttcttgtggaaggcgaa

SEQ ID NO: 1190546 - DNA, 22 bp, Artificial Sequence
  chemically synthesized
cttccccttcgccttccacaag

SEQ ID NO: 1190547 - DNA, 22 bp, Artificial Sequence
  chemically synthesized
ccccttcgccttccacaagaag

SEQ ID NO: 1190548 - DNA, 22 bp, Artificial Sequence
  chemically synthesized
cccttcgccttccacaagaagg

SEQ ID NO: 1190549 - DNA, 22 bp, Artificial Sequence
  chemically synthesized
aggaaatttccaccttcttgtg

SEQ ID NO: 1190550 - DNA, 22 bp, Artificial Sequence
  chemically synthesized
cgccttccacaagaaggtggaa

SEQ ID NO: 1190551 - DNA, 22 bp, Artificial Sequence
  chemically synthesized
gccttccacaagaaggtggaaa

SEQ ID NO: 1190552 - DNA, 22 bp, Artificial Sequence
  chemically synthesized
gggatacctcaggaaatttcca

SEQ ID NO: 1190553 - DNA, 22 bp, Artificial Sequence
  chemically synthesized
ccacaagaaggtggaaatttcc

SEQ ID NO: 1190554 - DNA, 22 bp, Artificial Sequence
  chemically synthesized
cacaagaaggtggaaatttcct

SEQ ID NO: 1190555 - DNA, 22 bp, Artificial Sequence
  chemically synthesized
tacaggaagtatggctggggat

SEQ ID NO: 1190556 - DNA, 22 bp, Artificial Sequence
  chemically synthesized
cctgaggtatccccagccatac

SEQ ID NO: 1190557 - DNA, 22 bp, Artificial Sequence
  chemically synthesized
ctgaggtatccccagccatact

SEQ ID NO: 1190558 - DNA, 22 bp, Artificial Sequence
  chemically synthesized
aggctgtacaggaagtatggct

SEQ ID NO: 1190559 - DNA, 22 bp, Artificial Sequence
  chemically synthesized
caggctgtacaggaagtatggc

SEQ ID NO: 1190560 - DNA, 22 bp, Artificial Sequence
  chemically synthesized
aggtatccccagccatacttcc

SEQ ID NO: 1190561 - DNA, 22 bp, Artificial Sequence
  chemically synthesized
ttcaggctgtacaggaagtatg

SEQ ID NO: 1190562 - DNA, 22 bp, Artificial Sequence
  chemically synthesized
aaagttcttcaggctgtacagg

SEQ ID NO: 1190563 - DNA, 22 bp, Artificial Sequence
  chemically synthesized
actcaaagttcttcaggctgta

SEQ ID NO: 1190564 - DNA, 22 bp, Artificial Sequence
  chemically synthesized
aactcaaagttcttcaggctgt

SEQ ID NO: 1190565 - DNA, 22 bp, Artificial Sequence
  chemically synthesized
cttaactcaaagttcttcaggc

SEQ ID NO: 1190566 - DNA, 22 bp, Artificial Sequence
  chemically synthesized
acttaactcaaagttcttcagg

SEQ ID NO: 1190567 - DNA, 22 bp, Artificial Sequence
  chemically synthesized
cctgtacagcctgaagaacttt

SEQ ID NO: 1190568 - DNA, 22 bp, Artificial Sequence
  chemically synthesized
ctgtacagcctgaagaactttg

SEQ ID NO: 1190569 - DNA, 22 bp, Artificial Sequence
  chemically synthesized
tacagcctgaagaactttgagt

SEQ ID NO: 1190570 - DNA, 22 bp, Artificial Sequence
  chemically synthesized
aagaactttgagttaagtaaac

SEQ ID NO: 1190571 - DNA, 22 bp, Artificial Sequence
  chemically synthesized
taaagataagaggtttacttaa

SEQ ID NO: 1190572 - DNA, 22 bp, Artificial Sequence
  chemically synthesized
gtaaagataagaggtttactta

SEQ ID NO: 1190573 - DNA, 22 bp, Artificial Sequence
  chemically synthesized
tgagttaagtaaacctcttatc

SEQ ID NO: 1190574 - DNA, 22 bp, Artificial Sequence
  chemically synthesized
gagttaagtaaacctcttatct

SEQ ID NO: 1190575 - DNA, 22 bp, Artificial Sequence
  chemically synthesized
agtaatttgtaaagataagagg

SEQ ID NO: 1190576 - DNA, 22 bp, Artificial Sequence
  chemically synthesized
agttaagtaaacctcttatctt

SEQ ID NO: 1190577 - DNA, 22 bp, Artificial Sequence
  chemically synthesized
agtaaacctcttatctttacaa

SEQ ID NO: 1190578 - DNA, 22 bp, Artificial Sequence
  chemically synthesized
agattgagtaatttgtaaagat

SEQ ID NO: 1190579 - DNA, 22 bp, Artificial Sequence
  chemically synthesized
cctgagattgagtaatttgtaa

SEQ ID NO: 1190580 - DNA, 22 bp, Artificial Sequence
  chemically synthesized
ttatctttacaaattactcaat

SEQ ID NO: 1190581 - DNA, 22 bp, Artificial Sequence
  chemically synthesized
taaactacctgagattgagtaa

SEQ ID NO: 1190582 - DNA, 22 bp, Artificial Sequence
  chemically synthesized
atctttacaaattactcaatct

SEQ ID NO: 1190583 - DNA, 22 bp, Artificial Sequence
  chemically synthesized
tctttacaaattactcaatctc

SEQ ID NO: 1190584 - DNA, 22 bp, Artificial Sequence
  chemically synthesized
ctataaactacctgagattgag

SEQ ID NO: 1190585 - DNA, 22 bp, Artificial Sequence
  chemically synthesized
tacaaattactcaatctcaggt

SEQ ID NO: 1190586 - DNA, 22 bp, Artificial Sequence
  chemically synthesized
acaaattactcaatctcaggta

SEQ ID NO: 1190587 - DNA, 22 bp, Artificial Sequence
  chemically synthesized
caaattactcaatctcaggtag

SEQ ID NO: 1190588 - DNA, 22 bp, Artificial Sequence
  chemically synthesized
gcattgctataaactacctgag

SEQ ID NO: 1190589 - DNA, 22 bp, Artificial Sequence
  chemically synthesized
tcgcattgctataaactacctg

SEQ ID NO: 1190590 - DNA, 22 bp, Artificial Sequence
  chemically synthesized
ctcgcattgctataaactacct

SEQ ID NO: 1190591 - DNA, 22 bp, Artificial Sequence
  chemically synthesized
tctcgcattgctataaactacc

SEQ ID NO: 1190592 - DNA, 22 bp, Artificial Sequence
  chemically synthesized
ctcaatctcaggtagtttatag

SEQ ID NO: 1190593 - DNA, 22 bp, Artificial Sequence
  chemically synthesized
aatctcaggtagtttatagcaa

SEQ ID NO: 1190594 - DNA, 22 bp, Artificial Sequence
  chemically synthesized
gtcctttctcgcattgctataa

SEQ ID NO: 1190595 - DNA, 22 bp, Artificial Sequence
  chemically synthesized
aggtagtttatagcaatgcgag

SEQ ID NO: 1190596 - DNA, 22 bp, Artificial Sequence
  chemically synthesized
tattagtcctttctcgcattgc

SEQ ID NO: 1190597 - DNA, 22 bp, Artificial Sequence
  chemically synthesized
tgtattagtcctttctcgcatt

SEQ ID NO: 1190598 - DNA, 22 bp, Artificial Sequence
  chemically synthesized
ctgtattagtcctttctcgcat

SEQ ID NO: 1190599 - DNA, 22 bp, Artificial Sequence
  chemically synthesized
tctgtattagtcctttctcgca

SEQ ID NO: 1190600 - DNA, 22 bp, Artificial Sequence
  chemically synthesized
atagcaatgcgagaaaggacta

SEQ ID NO: 1190601 - DNA, 22 bp, Artificial Sequence
  chemically synthesized
tagcaatgcgagaaaggactaa

SEQ ID NO: 1190602 - DNA, 22 bp, Artificial Sequence
  chemically synthesized
ggtaccaattttctgtattagt

SEQ ID NO: 1190603 - DNA, 22 bp, Artificial Sequence
  chemically synthesized
tcggtaccaattttctgtatta

SEQ ID NO: 1190604 - DNA, 22 bp, Artificial Sequence
  chemically synthesized
cctctcggtaccaattttctgt

SEQ ID NO: 1190605 - DNA, 22 bp, Artificial Sequence
  chemically synthesized
atacagaaaattggtaccgaga

SEQ ID NO: 1190606 - DNA, 22 bp, Artificial Sequence
  chemically synthesized
gtagcagtgccctacctctcgg

SEQ ID NO: 1190607 - DNA, 22 bp, Artificial Sequence
  chemically synthesized
cgtagcagtgccctacctctcg

SEQ ID NO: 1190608 - DNA, 22 bp, Artificial Sequence
  chemically synthesized
gtaccgagaggtagggcactgc

SEQ ID NO: 1190609 - DNA, 22 bp, Artificial Sequence
  chemically synthesized
atgtatcttcgtagcagtgccc

SEQ ID NO: 1190610 - DNA, 22 bp, Artificial Sequence
  chemically synthesized
tcatgtatcttcgtagcagtgc

SEQ ID NO: 1190611 - DNA, 22 bp, Artificial Sequence
  chemically synthesized
cacgttctcatgtatcttcgta

SEQ ID NO: 1190612 - DNA, 22 bp, Artificial Sequence
  chemically synthesized
gttccacgttctcatgtatctt

SEQ ID NO: 1190613 - DNA, 22 bp, Artificial Sequence
  chemically synthesized
ctacgaagatacatgagaacgt

SEQ ID NO: 1190614 - DNA, 22 bp, Artificial Sequence
  chemically synthesized
caaagttagttccacgttctca

SEQ ID NO: 1190615 - DNA, 22 bp, Artificial Sequence
  chemically synthesized
cgaagatacatgagaacgtgga

SEQ ID NO: 1190616 - DNA, 22 bp, Artificial Sequence
  chemically synthesized
ttccaaagttagttccacgttc

SEQ ID NO: 1190617 - DNA, 22 bp, Artificial Sequence
  chemically synthesized
tgttccaaagttagttccacgt

SEQ ID NO: 1190618 - DNA, 22 bp, Artificial Sequence
  chemically synthesized
ctctgttccaaagttagttcca

SEQ ID NO: 1190619 - DNA, 22 bp, Artificial Sequence
  chemically synthesized
actctgttccaaagttagttcc

SEQ ID NO: 1190620 - DNA, 22 bp, Artificial Sequence
  chemically synthesized
ttactctgttccaaagttagtt

SEQ ID NO: 1190621 - DNA, 22 bp, Artificial Sequence
  chemically synthesized
cttactctgttccaaagttagt

SEQ ID NO: 1190622 - DNA, 22 bp, Artificial Sequence
  chemically synthesized
caacgtgtgcttcttactctgt

SEQ ID NO: 1190623 - DNA, 22 bp, Artificial Sequence
  chemically synthesized
ttccaacgtgtgcttcttactc

SEQ ID NO: 1190624 - DNA, 22 bp, Artificial Sequence
  chemically synthesized
actttggaacagagtaagaagc

SEQ ID NO: 1190625 - DNA, 22 bp, Artificial Sequence
  chemically synthesized
tggaacagagtaagaagcacac

SEQ ID NO: 1190626 - DNA, 22 bp, Artificial Sequence
  chemically synthesized
ggaacagagtaagaagcacacg

SEQ ID NO: 1190627 - DNA, 22 bp, Artificial Sequence
  chemically synthesized
gaacagagtaagaagcacacgt

SEQ ID NO: 1190628 - DNA, 22 bp, Artificial Sequence
  chemically synthesized
cacactgttccaacgtgtgctt

SEQ ID NO: 1190629 - DNA, 22 bp, Artificial Sequence
  chemically synthesized
agcgctccacactgttccaacg

SEQ ID NO: 1190630 - DNA, 22 bp, Artificial Sequence
  chemically synthesized
tgagcgctccacactgttccaa

SEQ ID NO: 1190631 - DNA, 22 bp, Artificial Sequence
  chemically synthesized
ctgagcgctccacactgttcca

SEQ ID NO: 1190632 - DNA, 22 bp, Artificial Sequence
  chemically synthesized
tcttctgagcgctccacactgt

SEQ ID NO: 1190633 - DNA, 22 bp, Artificial Sequence
  chemically synthesized
ctgtcttctgagcgctccacac

SEQ ID NO: 1190634 - DNA, 22 bp, Artificial Sequence
  chemically synthesized
cctgtcttctgagcgctccaca

SEQ ID NO: 1190635 - DNA, 22 bp, Artificial Sequence
  chemically synthesized
atcttcctgtcttctgagcgct

SEQ ID NO: 1190636 - DNA, 22 bp, Artificial Sequence
  chemically synthesized
gaacagtgtggagcgctcagaa

SEQ ID NO: 1190637 - DNA, 22 bp, Artificial Sequence
  chemically synthesized
cctcatcttcctgtcttctgag

SEQ ID NO: 1190638 - DNA, 22 bp, Artificial Sequence
  chemically synthesized
ccctcatcttcctgtcttctga

SEQ ID NO: 1190639 - DNA, 22 bp, Artificial Sequence
  chemically synthesized
tccctcatcttcctgtcttctg

SEQ ID NO: 1190640 - DNA, 22 bp, Artificial Sequence
  chemically synthesized
caaactttccctcatcttcctg

SEQ ID NO: 1190641 - DNA, 22 bp, Artificial Sequence
  chemically synthesized
agaagacaggaagatgagggaa

SEQ ID NO: 1190642 - DNA, 22 bp, Artificial Sequence
  chemically synthesized
ggaagttacaaactttccctca

SEQ ID NO: 1190643 - DNA, 22 bp, Artificial Sequence
  chemically synthesized
taggaagttacaaactttccct

SEQ ID NO: 1190644 - DNA, 22 bp, Artificial Sequence
  chemically synthesized
aagtctctaggaagttacaaac

SEQ ID NO: 1190645 - DNA, 22 bp, Artificial Sequence
  chemically synthesized
gtccaagcagttcaagtctcta

SEQ ID NO: 1190646 - DNA, 22 bp, Artificial Sequence
  chemically synthesized
ggtccaagcagttcaagtctct

SEQ ID NO: 1190647 - DNA, 22 bp, Artificial Sequence
  chemically synthesized
tggtccaagcagttcaagtctc

SEQ ID NO: 1190648 - DNA, 22 bp, Artificial Sequence
  chemically synthesized
gtaacttcctagagacttgaac

SEQ ID NO: 1190649 - DNA, 22 bp, Artificial Sequence
  chemically synthesized
taacttcctagagacttgaact

SEQ ID NO: 1190650 - DNA, 22 bp, Artificial Sequence
  chemically synthesized
cctagagacttgaactgcttgg

SEQ ID NO: 1190651 - DNA, 22 bp, Artificial Sequence
  chemically synthesized
ctagagacttgaactgcttgga

SEQ ID NO: 1190652 - DNA, 22 bp, Artificial Sequence
  chemically synthesized
gagacttgaactgcttggacca

SEQ ID NO: 1190653 - DNA, 22 bp, Artificial Sequence
  chemically synthesized
gaactgcttggaccaaaatgct

SEQ ID NO: 1190654 - DNA, 22 bp, Artificial Sequence
  chemically synthesized
aactgcttggaccaaaatgctg

SEQ ID NO: 1190655 - DNA, 22 bp, Artificial Sequence
  chemically synthesized
tccatatcaatatcagcatttt

SEQ ID NO: 1190656 - DNA, 22 bp, Artificial Sequence
  chemically synthesized
cttggaccaaaatgctgatatt

SEQ ID NO: 1190657 - DNA, 22 bp, Artificial Sequence
  chemically synthesized
attgtccatatcaatatcagca

SEQ ID NO: 1190658 - DNA, 22 bp, Artificial Sequence
  chemically synthesized
ggaccaaaatgctgatattgat

SEQ ID NO: 1190659 - DNA, 22 bp, Artificial Sequence
  chemically synthesized
gaccaaaatgctgatattgata

SEQ ID NO: 1190660 - DNA, 22 bp, Artificial Sequence
  chemically synthesized
gatctcattgtccatatcaata

SEQ ID NO: 1190661 - DNA, 22 bp, Artificial Sequence
  chemically synthesized
agcctggatctcattgtccata

SEQ ID NO: 1190662 - DNA, 22 bp, Artificial Sequence
  chemically synthesized
atattgatatggacaatgagat

SEQ ID NO: 1190663 - DNA, 22 bp, Artificial Sequence
  chemically synthesized
agaccacctcagcctggatctc

SEQ ID NO: 1190664 - DNA, 22 bp, Artificial Sequence
  chemically synthesized
atatggacaatgagatccaggc

SEQ ID NO: 1190665 - DNA, 22 bp, Artificial Sequence
  chemically synthesized
atctgagaccacctcagcctgg

SEQ ID NO: 1190666 - DNA, 22 bp, Artificial Sequence
  chemically synthesized
catctgagaccacctcagcctg

SEQ ID NO: 1190667 - DNA, 22 bp, Artificial Sequence
  chemically synthesized
atcttcatctgagaccacctca

SEQ ID NO: 1190668 - DNA, 22 bp, Artificial Sequence
  chemically synthesized
ctcatcttcatctgagaccacc

SEQ ID NO: 1190669 - DNA, 22 bp, Artificial Sequence
  chemically synthesized
aggtggtctcagatgaagatga

SEQ ID NO: 1190670 - DNA, 22 bp, Artificial Sequence
  chemically synthesized
ccaataagttcctcatcttcat

SEQ ID NO: 1190671 - DNA, 22 bp, Artificial Sequence
  chemically synthesized
cagttcccaataagttcctcat

SEQ ID NO: 1190672 - DNA, 22 bp, Artificial Sequence
  chemically synthesized
ttgcagttcccaataagttcct

SEQ ID NO: 1190673 - DNA, 22 bp, Artificial Sequence
  chemically synthesized
agatgaagatgaggaacttatt

SEQ ID NO: 1190674 - DNA, 22 bp, Artificial Sequence
  chemically synthesized
attgcagttcccaataagttcc

SEQ ID NO: 1190675 - DNA, 22 bp, Artificial Sequence
  chemically synthesized
tattgcagttcccaataagttc

SEQ ID NO: 1190676 - DNA, 22 bp, Artificial Sequence
  chemically synthesized
cgagagtgacctttattgcagt

SEQ ID NO: 1190677 - DNA, 22 bp, Artificial Sequence
  chemically synthesized
attgggaactgcaataaaggtc

SEQ ID NO: 1190678 - DNA, 22 bp, Artificial Sequence
  chemically synthesized
ttgggaactgcaataaaggtca

SEQ ID NO: 1190679 - DNA, 22 bp, Artificial Sequence
  chemically synthesized
aagcattgcgagagtgaccttt

SEQ ID NO: 1190680 - DNA, 22 bp, Artificial Sequence
  chemically synthesized
ggaactgcaataaaggtcactc

SEQ ID NO: 1190681 - DNA, 22 bp, Artificial Sequence
  chemically synthesized
ttaaagcattgcgagagtgacc

SEQ ID NO: 1190682 - DNA, 22 bp, Artificial Sequence
  chemically synthesized
gttaaagcattgcgagagtgac

SEQ ID NO: 1190683 - DNA, 22 bp, Artificial Sequence
  chemically synthesized
tgttaaagcattgcgagagtga

SEQ ID NO: 1190684 - DNA, 22 bp, Artificial Sequence
  chemically synthesized
ttgttaaagcattgcgagagtg

SEQ ID NO: 1190685 - DNA, 22 bp, Artificial Sequence
  chemically synthesized
tttgttaaagcattgcgagagt

SEQ ID NO: 1190686 - DNA, 22 bp, Artificial Sequence
  chemically synthesized
caataaaggtcactctcgcaat

SEQ ID NO: 1190687 - DNA, 22 bp, Artificial Sequence
  chemically synthesized
tttttgttaaagcattgcgaga

SEQ ID NO: 1190688 - DNA, 22 bp, Artificial Sequence
  chemically synthesized
ccaatctctttttgttaaagca

SEQ ID NO: 1190689 - DNA, 22 bp, Artificial Sequence
  chemically synthesized
tcgcaatgctttaacaaaaaga

SEQ ID NO: 1190690 - DNA, 22 bp, Artificial Sequence
  chemically synthesized
gcaatgctttaacaaaaagaga

SEQ ID NO: 1190691 - DNA, 22 bp, Artificial Sequence
  chemically synthesized
taacaaaaagagattggcagca

SEQ ID NO: 1190692 - DNA, 22 bp, Artificial Sequence
  chemically synthesized
aacaaaaagagattggcagcat

SEQ ID NO: 1190693 - DNA, 22 bp, Artificial Sequence
  chemically synthesized
acaaaaagagattggcagcatt

SEQ ID NO: 1190694 - DNA, 22 bp, Artificial Sequence
  chemically synthesized
gagcaggggcacaatgctgcca

SEQ ID NO: 1190695 - DNA, 22 bp, Artificial Sequence
  chemically synthesized
cacacatacctagagcaggggc

SEQ ID NO: 1190696 - DNA, 22 bp, Artificial Sequence
  chemically synthesized
gcagcattgtgcccctgctcta

SEQ ID NO: 1190697 - DNA, 22 bp, Artificial Sequence
  chemically synthesized
aaagttccacacatacctagag

SEQ ID NO: 1190698 - DNA, 22 bp, Artificial Sequence
  chemically synthesized
tgcccctgctctaggtatgtgt

SEQ ID NO: 1190699 - DNA, 22 bp, Artificial Sequence
  chemically synthesized
aagttaaaagttccacacatac

SEQ ID NO: 1190700 - DNA, 22 bp, Artificial Sequence
  chemically synthesized
ctctaggtatgtgtggaacttt

SEQ ID NO: 1190701 - DNA, 22 bp, Artificial Sequence
  chemically synthesized
taggtatgtgtggaacttttaa

SEQ ID NO: 1190702 - DNA, 22 bp, Artificial Sequence
  chemically synthesized
ggtatgtgtggaacttttaact

SEQ ID NO: 1190703 - DNA, 22 bp, Artificial Sequence
  chemically synthesized
aatcatcagtctcaagttaaaa

SEQ ID NO: 1190704 - DNA, 22 bp, Artificial Sequence
  chemically synthesized
ccatataccctaaatcatcagt

SEQ ID NO: 1190705 - DNA, 22 bp, Artificial Sequence
  chemically synthesized
ttaacttgagactgatgattta

SEQ ID NO: 1190706 - DNA, 22 bp, Artificial Sequence
  chemically synthesized
taccatataccctaaatcatca

SEQ ID NO: 1190707 - DNA, 22 bp, Artificial Sequence
  chemically synthesized
taacttgagactgatgatttag

SEQ ID NO: 1190708 - DNA, 22 bp, Artificial Sequence
  chemically synthesized
ctaccatataccctaaatcatc

SEQ ID NO: 1190709 - DNA, 22 bp, Artificial Sequence
  chemically synthesized
aacttgagactgatgatttagg

SEQ ID NO: 1190710 - DNA, 22 bp, Artificial Sequence
  chemically synthesized
acttgagactgatgatttaggg

SEQ ID NO: 1190711 - DNA, 22 bp, Artificial Sequence
  chemically synthesized
ttctaccatataccctaaatca

SEQ ID NO: 1190712 - DNA, 22 bp, Artificial Sequence
  chemically synthesized
cttctaccatataccctaaatc

SEQ ID NO: 1190713 - DNA, 22 bp, Artificial Sequence
  chemically synthesized
gagactgatgatttagggtata

SEQ ID NO: 1190714 - DNA, 22 bp, Artificial Sequence
  chemically synthesized
agactgatgatttagggtatat

SEQ ID NO: 1190715 - DNA, 22 bp, Artificial Sequence
  chemically synthesized
gaaatttcttctaccatatacc

SEQ ID NO: 1190716 - DNA, 22 bp, Artificial Sequence
  chemically synthesized
atgatttagggtatatggtaga

SEQ ID NO: 1190717 - DNA, 22 bp, Artificial Sequence
  chemically synthesized
gttagaaatttcttctaccata

SEQ ID NO: 1190718 - DNA, 22 bp, Artificial Sequence
  chemically synthesized
ctggttagaaatttcttctacc

SEQ ID NO: 1190719 - DNA, 22 bp, Artificial Sequence
  chemically synthesized
gctggttagaaatttcttctac

SEQ ID NO: 1190720 - DNA, 22 bp, Artificial Sequence
  chemically synthesized
tgctggttagaaatttcttcta

SEQ ID NO: 1190721 - DNA, 22 bp, Artificial Sequence
  chemically synthesized
agggtatatggtagaagaaatt

SEQ ID NO: 1190722 - DNA, 22 bp, Artificial Sequence
  chemically synthesized
gggtatatggtagaagaaattt

SEQ ID NO: 1190723 - DNA, 22 bp, Artificial Sequence
  chemically synthesized
aatgttttgctggttagaaatt

SEQ ID NO: 1190724 - DNA, 22 bp, Artificial Sequence
  chemically synthesized
aaatgttttgctggttagaaat

SEQ ID NO: 1190725 - DNA, 22 bp, Artificial Sequence
  chemically synthesized
ctaaccagcaaaacatttaaga

SEQ ID NO: 1190726 - DNA, 22 bp, Artificial Sequence
  chemically synthesized
taaccagcaaaacatttaagat

SEQ ID NO: 1190727 - DNA, 22 bp, Artificial Sequence
  chemically synthesized
accagcaaaacatttaagatgt

SEQ ID NO: 1190728 - DNA, 22 bp, Artificial Sequence
  chemically synthesized
gaagaagccaggtcacatctta

SEQ ID NO: 1190729 - DNA, 22 bp, Artificial Sequence
  chemically synthesized
ttagaagaagccaggtcacatc

SEQ ID NO: 1190730 - DNA, 22 bp, Artificial Sequence
  chemically synthesized
aagatgtgacctggcttcttct

SEQ ID NO: 1190731 - DNA, 22 bp, Artificial Sequence
  chemically synthesized
agatgtgacctggcttcttcta

SEQ ID NO: 1190732 - DNA, 22 bp, Artificial Sequence
  chemically synthesized
atacatatgaccgtatactgtt

SEQ ID NO: 1190733 - DNA, 22 bp, Artificial Sequence
  chemically synthesized
gcttcttctaacagtatacggt

SEQ ID NO: 1190734 - DNA, 22 bp, Artificial Sequence
  chemically synthesized
ctcatacatatgaccgtatact

SEQ ID NO: 1190735 - DNA, 22 bp, Artificial Sequence
  chemically synthesized
gctcatacatatgaccgtatac

SEQ ID NO: 1190736 - DNA, 22 bp, Artificial Sequence
  chemically synthesized
tgctcatacatatgaccgtata

SEQ ID NO: 1190737 - DNA, 22 bp, Artificial Sequence
  chemically synthesized
cttctaacagtatacggtcata

SEQ ID NO: 1190738 - DNA, 22 bp, Artificial Sequence
  chemically synthesized
tttgctcatacatatgaccgta

SEQ ID NO: 1190739 - DNA, 22 bp, Artificial Sequence
  chemically synthesized
ttctaacagtatacggtcatat

SEQ ID NO: 1190740 - DNA, 22 bp, Artificial Sequence
  chemically synthesized
ctaacagtatacggtcatatgt

SEQ ID NO: 1190741 - DNA, 22 bp, Artificial Sequence
  chemically synthesized
taacagtatacggtcatatgta

SEQ ID NO: 1190742 - DNA, 22 bp, Artificial Sequence
  chemically synthesized
acagtatacggtcatatgtatg

SEQ ID NO: 1190743 - DNA, 22 bp, Artificial Sequence
  chemically synthesized
agataatctctttgctcataca

SEQ ID NO: 1190744 - DNA, 22 bp, Artificial Sequence
  chemically synthesized
cagataatctctttgctcatac

SEQ ID NO: 1190745 - DNA, 22 bp, Artificial Sequence
  chemically synthesized
cagtttcagataatctctttgc

SEQ ID NO: 1190746 - DNA, 22 bp, Artificial Sequence
  chemically synthesized
aatataagttccagtttcagat

SEQ ID NO: 1190747 - DNA, 22 bp, Artificial Sequence
  chemically synthesized
aaatataagttccagtttcaga

SEQ ID NO: 1190748 - DNA, 22 bp, Artificial Sequence
  chemically synthesized
taaatataagttccagtttcag

SEQ ID NO: 1190749 - DNA, 22 bp, Artificial Sequence
  chemically synthesized
ttaaatataagttccagtttca

SEQ ID NO: 1190750 - DNA, 22 bp, Artificial Sequence
  chemically synthesized
ccttttaaatataagttccagt

SEQ ID NO: 1190751 - DNA, 22 bp, Artificial Sequence
  chemically synthesized
cccttttaaatataagttccag

SEQ ID NO: 1190752 - DNA, 22 bp, Artificial Sequence
  chemically synthesized
cttcccttttaaatataagttc

SEQ ID NO: 1190753 - DNA, 22 bp, Artificial Sequence
  chemically synthesized
tctgaaactggaacttatattt

SEQ ID NO: 1190754 - DNA, 22 bp, Artificial Sequence
  chemically synthesized
tgcttcccttttaaatataagt

SEQ ID NO: 1190755 - DNA, 22 bp, Artificial Sequence
  chemically synthesized
aaactggaacttatatttaaaa

SEQ ID NO: 1190756 - DNA, 22 bp, Artificial Sequence
  chemically synthesized
tgctctgcttcccttttaaata

SEQ ID NO: 1190757 - DNA, 22 bp, Artificial Sequence
  chemically synthesized
atgctctgcttcccttttaaat

SEQ ID NO: 1190758 - DNA, 22 bp, Artificial Sequence
  chemically synthesized
tatgctctgcttcccttttaaa

SEQ ID NO: 1190759 - DNA, 22 bp, Artificial Sequence
  chemically synthesized
ttatgctctgcttcccttttaa

SEQ ID NO: 1190760 - DNA, 22 bp, Artificial Sequence
  chemically synthesized
gaacttatatttaaaagggaag

SEQ ID NO: 1190761 - DNA, 22 bp, Artificial Sequence
  chemically synthesized
aacttttatgctctgcttccct

SEQ ID NO: 1190762 - DNA, 22 bp, Artificial Sequence
  chemically synthesized
taaacttttatgctctgcttcc

SEQ ID NO: 1190763 - DNA, 22 bp, Artificial Sequence
  chemically synthesized
atatttaaaagggaagcagagc

SEQ ID NO: 1190764 - DNA, 22 bp, Artificial Sequence
  chemically synthesized
ctaaacttttatgctctgcttc

SEQ ID NO: 1190765 - DNA, 22 bp, Artificial Sequence
  chemically synthesized
tatttaaaagggaagcagagca

SEQ ID NO: 1190766 - DNA, 22 bp, Artificial Sequence
  chemically synthesized
tctaaacttttatgctctgctt

SEQ ID NO: 1190767 - DNA, 22 bp, Artificial Sequence
  chemically synthesized
aaaagggaagcagagcataaaa

SEQ ID NO: 1190768 - DNA, 22 bp, Artificial Sequence
  chemically synthesized
aaagggaagcagagcataaaag

SEQ ID NO: 1190769 - DNA, 22 bp, Artificial Sequence
  chemically synthesized
caaattttctaaacttttatgc

SEQ ID NO: 1190770 - DNA, 22 bp, Artificial Sequence
  chemically synthesized
ccacatggtcaggctgcaaatt

SEQ ID NO: 1190771 - DNA, 22 bp, Artificial Sequence
  chemically synthesized
taccacatggtcaggctgcaaa

SEQ ID NO: 1190772 - DNA, 22 bp, Artificial Sequence
  chemically synthesized
ctaccacatggtcaggctgcaa

SEQ ID NO: 1190773 - DNA, 22 bp, Artificial Sequence
  chemically synthesized
tctaccacatggtcaggctgca

SEQ ID NO: 1190774 - DNA, 22 bp, Artificial Sequence
  chemically synthesized
ttttctaccacatggtcaggct

SEQ ID NO: 1190775 - DNA, 22 bp, Artificial Sequence
  chemically synthesized
agaaaatttgcagcctgaccat

SEQ ID NO: 1190776 - DNA, 22 bp, Artificial Sequence
  chemically synthesized
gttttctaccacatggtcaggc

SEQ ID NO: 1190777 - DNA, 22 bp, Artificial Sequence
  chemically synthesized
gaaaatttgcagcctgaccatg

SEQ ID NO: 1190778 - DNA, 22 bp, Artificial Sequence
  chemically synthesized
tgttttctaccacatggtcagg

SEQ ID NO: 1190779 - DNA, 22 bp, Artificial Sequence
  chemically synthesized
ttgttttctaccacatggtcag

SEQ ID NO: 1190780 - DNA, 22 bp, Artificial Sequence
  chemically synthesized
gcagcctgaccatgtggtagaa

SEQ ID NO: 1190781 - DNA, 22 bp, Artificial Sequence
  chemically synthesized
cagcctgaccatgtggtagaaa

SEQ ID NO: 1190782 - DNA, 22 bp, Artificial Sequence
  chemically synthesized
accatgtggtagaaaacaaaag

SEQ ID NO: 1190783 - DNA, 22 bp, Artificial Sequence
  chemically synthesized
ccccaccaccccgagaaaatag

SEQ ID NO: 1190784 - DNA, 22 bp, Artificial Sequence
  chemically synthesized
cccccaccaccccgagaaaata

SEQ ID NO: 1190785 - DNA, 22 bp, Artificial Sequence
  chemically synthesized
aatttcccccaccaccccgaga

SEQ ID NO: 1190786 - DNA, 22 bp, Artificial Sequence
  chemically synthesized
gaatttcccccaccaccccgag

SEQ ID NO: 1190787 - DNA, 22 bp, Artificial Sequence
  chemically synthesized
ttttctcggggtggtgggggaa

SEQ ID NO: 1190788 - DNA, 22 bp, Artificial Sequence
  chemically synthesized
tctcggggtggtgggggaaatt

SEQ ID NO: 1190789 - DNA, 22 bp, Artificial Sequence
  chemically synthesized
ctcggggtggtgggggaaattc

SEQ ID NO: 1190790 - DNA, 22 bp, Artificial Sequence
  chemically synthesized
cgcagacagcttgaatttcccc

SEQ ID NO: 1190791 - DNA, 22 bp, Artificial Sequence
  chemically synthesized
tcggggtggtgggggaaattca

SEQ ID NO: 1190792 - DNA, 22 bp, Artificial Sequence
  chemically synthesized
ccgcagacagcttgaatttccc

SEQ ID NO: 1190793 - DNA, 22 bp, Artificial Sequence
  chemically synthesized
ggggtggtgggggaaattcaag

SEQ ID NO: 1190794 - DNA, 22 bp, Artificial Sequence
  chemically synthesized
tgcaaatttccgcagacagctt

SEQ ID NO: 1190795 - DNA, 22 bp, Artificial Sequence
  chemically synthesized
atgcaaatttccgcagacagct

SEQ ID NO: 1190796 - DNA, 22 bp, Artificial Sequence
  chemically synthesized
cttatgcaaatttccgcagaca

SEQ ID NO: 1190797 - DNA, 22 bp, Artificial Sequence
  chemically synthesized
acttatgcaaatttccgcagac

SEQ ID NO: 1190798 - DNA, 22 bp, Artificial Sequence
  chemically synthesized
tacttatgcaaatttccgcaga

SEQ ID NO: 1190799 - DNA, 22 bp, Artificial Sequence
  chemically synthesized
ttacttatgcaaatttccgcag

SEQ ID NO: 1190800 - DNA, 22 bp, Artificial Sequence
  chemically synthesized
tttacttatgcaaatttccgca

SEQ ID NO: 1190801 - DNA, 22 bp, Artificial Sequence
  chemically synthesized
ctttttacttatgcaaatttcc

SEQ ID NO: 1190802 - DNA, 22 bp, Artificial Sequence
  chemically synthesized
aagctgtctgcggaaatttgca

SEQ ID NO: 1190803 - DNA, 22 bp, Artificial Sequence
  chemically synthesized
agttcctttttacttatgcaaa

SEQ ID NO: 1190804 - DNA, 22 bp, Artificial Sequence
  chemically synthesized
tctgcggaaatttgcataagta

SEQ ID NO: 1190805 - DNA, 22 bp, Artificial Sequence
  chemically synthesized
cggaaatttgcataagtaaaaa

SEQ ID NO: 1190806 - DNA, 22 bp, Artificial Sequence
  chemically synthesized
acattcagttcctttttactta

SEQ ID NO: 1190807 - DNA, 22 bp, Artificial Sequence
  chemically synthesized
ttaacattcagttcctttttac

SEQ ID NO: 1190808 - DNA, 22 bp, Artificial Sequence
  chemically synthesized
gttattaacattcagttccttt

SEQ ID NO: 1190809 - DNA, 22 bp, Artificial Sequence
  chemically synthesized
ggttattaacattcagttcctt

SEQ ID NO: 1190810 - DNA, 22 bp, Artificial Sequence
  chemically synthesized
gcataagtaaaaaggaactgaa

SEQ ID NO: 1190811 - DNA, 22 bp, Artificial Sequence
  chemically synthesized
cataagtaaaaaggaactgaat

SEQ ID NO: 1190812 - DNA, 22 bp, Artificial Sequence
  chemically synthesized
tcttggttattaacattcagtt

SEQ ID NO: 1190813 - DNA, 22 bp, Artificial Sequence
  chemically synthesized
gtcttggttattaacattcagt

SEQ ID NO: 1190814 - DNA, 22 bp, Artificial Sequence
  chemically synthesized
tgtcttggttattaacattcag

SEQ ID NO: 1190815 - DNA, 22 bp, Artificial Sequence
  chemically synthesized
ccctttgtcttggttattaaca

SEQ ID NO: 1190816 - DNA, 22 bp, Artificial Sequence
  chemically synthesized
cccctttgtcttggttattaac

SEQ ID NO: 1190817 - DNA, 22 bp, Artificial Sequence
  chemically synthesized
tcccctttgtcttggttattaa

SEQ ID NO: 1190818 - DNA, 22 bp, Artificial Sequence
  chemically synthesized
ggcattttcccctttgtcttgg

SEQ ID NO: 1190819 - DNA, 22 bp, Artificial Sequence
  chemically synthesized
aatgttaataaccaagacaaag

SEQ ID NO: 1190820 - DNA, 22 bp, Artificial Sequence
  chemically synthesized
gggcattttcccctttgtcttg

SEQ ID NO: 1190821 - DNA, 22 bp, Artificial Sequence
  chemically synthesized
tgggcattttcccctttgtctt

SEQ ID NO: 1190822 - DNA, 22 bp, Artificial Sequence
  chemically synthesized
ataaccaagacaaaggggaaaa

SEQ ID NO: 1190823 - DNA, 22 bp, Artificial Sequence
  chemically synthesized
aaatgcctttgggcattttccc

SEQ ID NO: 1190824 - DNA, 22 bp, Artificial Sequence
  chemically synthesized
tgaaatgcctttgggcattttc

SEQ ID NO: 1190825 - DNA, 22 bp, Artificial Sequence
  chemically synthesized
caaagggttctgaaatgccttt

SEQ ID NO: 1190826 - DNA, 22 bp, Artificial Sequence
  chemically synthesized
ctgcaaagggttctgaaatgcc

SEQ ID NO: 1190827 - DNA, 22 bp, Artificial Sequence
  chemically synthesized
tgataggaggggctgctgcaaa

SEQ ID NO: 1190828 - DNA, 22 bp, Artificial Sequence
  chemically synthesized
cagaaccctttgcagcagcccc

SEQ ID NO: 1190829 - DNA, 22 bp, Artificial Sequence
  chemically synthesized
agaaccctttgcagcagcccct

SEQ ID NO: 1190830 - DNA, 22 bp, Artificial Sequence
  chemically synthesized
cagacctgtgataggaggggct

SEQ ID NO: 1190831 - DNA, 22 bp, Artificial Sequence
  chemically synthesized
tgcagcagcccctcctatcaca

SEQ ID NO: 1190832 - DNA, 22 bp, Artificial Sequence
  chemically synthesized
gacctccagacctgtgatagga

SEQ ID NO: 1190833 - DNA, 22 bp, Artificial Sequence
  chemically synthesized
gcagcagcccctcctatcacag

SEQ ID NO: 1190834 - DNA, 22 bp, Artificial Sequence
  chemically synthesized
cagcagcccctcctatcacagg

SEQ ID NO: 1190835 - DNA, 22 bp, Artificial Sequence
  chemically synthesized
ctagacctccagacctgtgata

SEQ ID NO: 1190836 - DNA, 22 bp, Artificial Sequence
  chemically synthesized
cctagacctccagacctgtgat

SEQ ID NO: 1190837 - DNA, 22 bp, Artificial Sequence
  chemically synthesized
cttcctagacctccagacctgt

SEQ ID NO: 1190838 - DNA, 22 bp, Artificial Sequence
  chemically synthesized
ccttcctagacctccagacctg

SEQ ID NO: 1190839 - DNA, 22 bp, Artificial Sequence
  chemically synthesized
tccttcctagacctccagacct

SEQ ID NO: 1190840 - DNA, 22 bp, Artificial Sequence
  chemically synthesized
ttccttcctagacctccagacc

SEQ ID NO: 1190841 - DNA, 22 bp, Artificial Sequence
  chemically synthesized
ctatcacaggtctggaggtcta

SEQ ID NO: 1190842 - DNA, 22 bp, Artificial Sequence
  chemically synthesized
tcacaggtctggaggtctagga

SEQ ID NO: 1190843 - DNA, 22 bp, Artificial Sequence
  chemically synthesized
cgaaatcatttttccttcctag

SEQ ID NO: 1190844 - DNA, 22 bp, Artificial Sequence
  chemically synthesized
gcctccgaaatcatttttcctt

SEQ ID NO: 1190845 - DNA, 22 bp, Artificial Sequence
  chemically synthesized
gaggtctaggaaggaaaaatga

SEQ ID NO: 1190846 - DNA, 22 bp, Artificial Sequence
  chemically synthesized
ggcctggcctccgaaatcattt

SEQ ID NO: 1190847 - DNA, 22 bp, Artificial Sequence
  chemically synthesized
ggaaggaaaaatgatttcggag

SEQ ID NO: 1190848 - DNA, 22 bp, Artificial Sequence
  chemically synthesized
tgcagagcagtgaggccctagg

SEQ ID NO: 1190849 - DNA, 22 bp, Artificial Sequence
  chemically synthesized
cggaggccaggcctagggcctc

SEQ ID NO: 1190850 - DNA, 22 bp, Artificial Sequence
  chemically synthesized
ggaggccaggcctagggcctca

SEQ ID NO: 1190851 - DNA, 22 bp, Artificial Sequence
  chemically synthesized
aggttgtgcagagcagtgaggc

SEQ ID NO: 1190852 - DNA, 22 bp, Artificial Sequence
  chemically synthesized
gaggttgtgcagagcagtgagg

SEQ ID NO: 1190853 - DNA, 22 bp, Artificial Sequence
  chemically synthesized
gggcctcactgctctgcacaac

SEQ ID NO: 1190854 - DNA, 22 bp, Artificial Sequence
  chemically synthesized
actgctctgcacaacctcaaga

SEQ ID NO: 1190855 - DNA, 22 bp, Artificial Sequence
  chemically synthesized
ctctgcacaacctcaagacact

SEQ ID NO: 1190856 - DNA, 22 bp, Artificial Sequence
  chemically synthesized
ggacatagggagcagtgtcttg

SEQ ID NO: 1190857 - DNA, 22 bp, Artificial Sequence
  chemically synthesized
tgcacaacctcaagacactgct

SEQ ID NO: 1190858 - DNA, 22 bp, Artificial Sequence
  chemically synthesized
cacaacctcaagacactgctcc

SEQ ID NO: 1190859 - DNA, 22 bp, Artificial Sequence
  chemically synthesized
gagtgtctgggacatagggagc

SEQ ID NO: 1190860 - DNA, 22 bp, Artificial Sequence
  chemically synthesized
aagacactgctccctatgtccc

SEQ ID NO: 1190861 - DNA, 22 bp, Artificial Sequence
  chemically synthesized
gagctggagtgtctgggacata

SEQ ID NO: 1190862 - DNA, 22 bp, Artificial Sequence
  chemically synthesized
ctccctatgtcccagacactcc

SEQ ID NO: 1190863 - DNA, 22 bp, Artificial Sequence
  chemically synthesized
cctatgtcccagacactccagc

SEQ ID NO: 1190864 - DNA, 22 bp, Artificial Sequence
  chemically synthesized
gtaacagctggagctggagtgt

SEQ ID NO: 1190865 - DNA, 22 bp, Artificial Sequence
  chemically synthesized
agtaacagctggagctggagtg

SEQ ID NO: 1190866 - DNA, 22 bp, Artificial Sequence
  chemically synthesized
tagtaacagctggagctggagt

SEQ ID NO: 1190867 - DNA, 22 bp, Artificial Sequence
  chemically synthesized
ttagtaacagctggagctggag

SEQ ID NO: 1190868 - DNA, 22 bp, Artificial Sequence
  chemically synthesized
tgtcccagacactccagctcca

SEQ ID NO: 1190869 - DNA, 22 bp, Artificial Sequence
  chemically synthesized
tttagtaacagctggagctgga

SEQ ID NO: 1190870 - DNA, 22 bp, Artificial Sequence
  chemically synthesized
gggcctttttagtaacagctgg

SEQ ID NO: 1190871 - DNA, 22 bp, Artificial Sequence
  chemically synthesized
cagctccagctgttactaaaaa

SEQ ID NO: 1190872 - DNA, 22 bp, Artificial Sequence
  chemically synthesized
cagctgttactaaaaaggcccc

SEQ ID NO: 1190873 - DNA, 22 bp, Artificial Sequence
  chemically synthesized
ttactaaaaaggccccagatgt

SEQ ID NO: 1190874 - DNA, 22 bp, Artificial Sequence
  chemically synthesized
ctaaaaaggccccagatgtgtc

SEQ ID NO: 1190875 - DNA, 22 bp, Artificial Sequence
  chemically synthesized
aagcaacaccccaagacacatc

SEQ ID NO: 1190876 - DNA, 22 bp, Artificial Sequence
  chemically synthesized
aaaaggccccagatgtgtcttg

SEQ ID NO: 1190877 - DNA, 22 bp, Artificial Sequence
  chemically synthesized
tgaagcaacaccccaagacaca

SEQ ID NO: 1190878 - DNA, 22 bp, Artificial Sequence
  chemically synthesized
caccctctgaagcaacacccca

SEQ ID NO: 1190879 - DNA, 22 bp, Artificial Sequence
  chemically synthesized
gcaccctctgaagcaacacccc

SEQ ID NO: 1190880 - DNA, 22 bp, Artificial Sequence
  chemically synthesized
tggcttgcaccctctgaagcaa

SEQ ID NO: 1190881 - DNA, 22 bp, Artificial Sequence
  chemically synthesized
atggcttgcaccctctgaagca

SEQ ID NO: 1190882 - DNA, 22 bp, Artificial Sequence
  chemically synthesized
ggggtgttgcttcagagggtgc

SEQ ID NO: 1190883 - DNA, 22 bp, Artificial Sequence
  chemically synthesized
gggtgttgcttcagagggtgca

SEQ ID NO: 1190884 - DNA, 22 bp, Artificial Sequence
  chemically synthesized
cttcagagggtgcaagccataa

SEQ ID NO: 1190885 - DNA, 22 bp, Artificial Sequence
  chemically synthesized
cagagggtgcaagccataagca

SEQ ID NO: 1190886 - DNA, 22 bp, Artificial Sequence
  chemically synthesized
agagggtgcaagccataagcat

SEQ ID NO: 1190887 - DNA, 22 bp, Artificial Sequence
  chemically synthesized
acaccacatggaagccaccaat

SEQ ID NO: 1190888 - DNA, 22 bp, Artificial Sequence
  chemically synthesized
caggattaacaccacatggaag

SEQ ID NO: 1190889 - DNA, 22 bp, Artificial Sequence
  chemically synthesized
gcaggattaacaccacatggaa

SEQ ID NO: 1190890 - DNA, 22 bp, Artificial Sequence
  chemically synthesized
gtggcttccatgtggtgttaat

SEQ ID NO: 1190891 - DNA, 22 bp, Artificial Sequence
  chemically synthesized
cacacttgcaggattaacacca

SEQ ID NO: 1190892 - DNA, 22 bp, Artificial Sequence
  chemically synthesized
tgcacacttgcaggattaacac

SEQ ID NO: 1190893 - DNA, 22 bp, Artificial Sequence
  chemically synthesized
ccatgtggtgttaatcctgcaa

SEQ ID NO: 1190894 - DNA, 22 bp, Artificial Sequence
  chemically synthesized
catgtggtgttaatcctgcaag

SEQ ID NO: 1190895 - DNA, 22 bp, Artificial Sequence
  chemically synthesized
acactctgcacacttgcaggat

SEQ ID NO: 1190896 - DNA, 22 bp, Artificial Sequence
  chemically synthesized
tcacactctgcacacttgcagg

SEQ ID NO: 1190897 - DNA, 22 bp, Artificial Sequence
  chemically synthesized
aactctcacactctgcacactt

SEQ ID NO: 1190898 - DNA, 22 bp, Artificial Sequence
  chemically synthesized
atcctgcaagtgtgcagagtgt

SEQ ID NO: 1190899 - DNA, 22 bp, Artificial Sequence
  chemically synthesized
aagcctcaactctcacactctg

SEQ ID NO: 1190900 - DNA, 22 bp, Artificial Sequence
  chemically synthesized
tcaagcctcaactctcacactc

SEQ ID NO: 1190901 - DNA, 22 bp, Artificial Sequence
  chemically synthesized
caagtgtgcagagtgtgagagt

SEQ ID NO: 1190902 - DNA, 22 bp, Artificial Sequence
  chemically synthesized
ggtggatgctctcaagcctcaa

SEQ ID NO: 1190903 - DNA, 22 bp, Artificial Sequence
  chemically synthesized
aaatctaggtggatgctctcaa

SEQ ID NO: 1190904 - DNA, 22 bp, Artificial Sequence
  chemically synthesized
tgaaatctaggtggatgctctc

SEQ ID NO: 1190905 - DNA, 22 bp, Artificial Sequence
  chemically synthesized
tctgaaatctaggtggatgctc

SEQ ID NO: 1190906 - DNA, 22 bp, Artificial Sequence
  chemically synthesized
aggcttgagagcatccacctag

SEQ ID NO: 1190907 - DNA, 22 bp, Artificial Sequence
  chemically synthesized
cacacattctctgaaatctagg

SEQ ID NO: 1190908 - DNA, 22 bp, Artificial Sequence
  chemically synthesized
gagagcatccacctagatttca

SEQ ID NO: 1190909 - DNA, 22 bp, Artificial Sequence
  chemically synthesized
ccacacattctctgaaatctag

SEQ ID NO: 1190910 - DNA, 22 bp, Artificial Sequence
  chemically synthesized
agagcatccacctagatttcag

SEQ ID NO: 1190911 - DNA, 22 bp, Artificial Sequence
  chemically synthesized
gatttcagagaatgtgtggaaa

SEQ ID NO: 1190912 - DNA, 22 bp, Artificial Sequence
  chemically synthesized
gacatgcaggtgtttccacaca

SEQ ID NO: 1190913 - DNA, 22 bp, Artificial Sequence
  chemically synthesized
cctggacatgcaggtgtttcca

SEQ ID NO: 1190914 - DNA, 22 bp, Artificial Sequence
  chemically synthesized
cagagaatgtgtggaaacacct

SEQ ID NO: 1190915 - DNA, 22 bp, Artificial Sequence
  chemically synthesized
agagaatgtgtggaaacacctg

SEQ ID NO: 1190916 - DNA, 22 bp, Artificial Sequence
  chemically synthesized
tacctggacatgcaggtgtttc

SEQ ID NO: 1190917 - DNA, 22 bp, Artificial Sequence
  chemically synthesized
ctacctggacatgcaggtgttt

SEQ ID NO: 1190918 - DNA, 22 bp, Artificial Sequence
  chemically synthesized
cagcagacttctacctggacat

SEQ ID NO: 1190919 - DNA, 22 bp, Artificial Sequence
  chemically synthesized
ccccgctgcagcagacttctac

SEQ ID NO: 1190920 - DNA, 22 bp, Artificial Sequence
  chemically synthesized
catgtccaggtagaagtctgct

SEQ ID NO: 1190921 - DNA, 22 bp, Artificial Sequence
  chemically synthesized
tgcaggctcccccgctgcagca

SEQ ID NO: 1190922 - DNA, 22 bp, Artificial Sequence
  chemically synthesized
tatgcaggctcccccgctgcag

SEQ ID NO: 1190923 - DNA, 22 bp, Artificial Sequence
  chemically synthesized
tctatgcaggctcccccgctgc

SEQ ID NO: 1190924 - DNA, 22 bp, Artificial Sequence
  chemically synthesized
ctgcagcgggggagcctgcata

SEQ ID NO: 1190925 - DNA, 22 bp, Artificial Sequence
  chemically synthesized
gtagaggttctctatgcaggct

SEQ ID NO: 1190926 - DNA, 22 bp, Artificial Sequence
  chemically synthesized
cagcgggggagcctgcatagag

SEQ ID NO: 1190927 - DNA, 22 bp, Artificial Sequence
  chemically synthesized
ccctagtagaggttctctatgc

SEQ ID NO: 1190928 - DNA, 22 bp, Artificial Sequence
  chemically synthesized
cactgccctagtagaggttctc

SEQ ID NO: 1190929 - DNA, 22 bp, Artificial Sequence
  chemically synthesized
tgcactgccctagtagaggttc

SEQ ID NO: 1190930 - DNA, 22 bp, Artificial Sequence
  chemically synthesized
ctgcactgccctagtagaggtt

SEQ ID NO: 1190931 - DNA, 22 bp, Artificial Sequence
  chemically synthesized
catagagaacctctactagggc

SEQ ID NO: 1190932 - DNA, 22 bp, Artificial Sequence
  chemically synthesized
cccttctgcactgccctagtag

SEQ ID NO: 1190933 - DNA, 22 bp, Artificial Sequence
  chemically synthesized
accccacattacccttctgcac

SEQ ID NO: 1190934 - DNA, 22 bp, Artificial Sequence
  chemically synthesized
tactagggcagtgcagaagggt

SEQ ID NO: 1190935 - DNA, 22 bp, Artificial Sequence
  chemically synthesized
taaccccacattacccttctgc

SEQ ID NO: 1190936 - DNA, 22 bp, Artificial Sequence
  chemically synthesized
ctagggcagtgcagaagggtaa

SEQ ID NO: 1190937 - DNA, 22 bp, Artificial Sequence
  chemically synthesized
gggcagtgcagaagggtaatgt

SEQ ID NO: 1190938 - DNA, 22 bp, Artificial Sequence
  chemically synthesized
tgtgagagctctaaccccacat

SEQ ID NO: 1190939 - DNA, 22 bp, Artificial Sequence
  chemically synthesized
tgtgtgagagctctaaccccac

SEQ ID NO: 1190940 - DNA, 22 bp, Artificial Sequence
  chemically synthesized
gagctctcacacagagtcccca

SEQ ID NO: 1190941 - DNA, 22 bp, Artificial Sequence
  chemically synthesized
tcacacagagtccccactgggg

SEQ ID NO: 1190942 - DNA, 22 bp, Artificial Sequence
  chemically synthesized
aagtaggcagtgccccagtggg

SEQ ID NO: 1190943 - DNA, 22 bp, Artificial Sequence
  chemically synthesized
acacagagtccccactggggca

SEQ ID NO: 1190944 - DNA, 22 bp, Artificial Sequence
  chemically synthesized
aaagctcaagtaggcagtgccc

SEQ ID NO: 1190945 - DNA, 22 bp, Artificial Sequence
  chemically synthesized
tcaaagctcaagtaggcagtgc

SEQ ID NO: 1190946 - DNA, 22 bp, Artificial Sequence
  chemically synthesized
ctcaaagctcaagtaggcagtg

SEQ ID NO: 1190947 - DNA, 22 bp, Artificial Sequence
  chemically synthesized
ttctcaaagctcaagtaggcag

SEQ ID NO: 1190948 - DNA, 22 bp, Artificial Sequence
  chemically synthesized
gggcactgcctacttgagcttt

SEQ ID NO: 1190949 - DNA, 22 bp, Artificial Sequence
  chemically synthesized
cctacttgagctttgagaagag

SEQ ID NO: 1190950 - DNA, 22 bp, Artificial Sequence
  chemically synthesized
gaggacagtggccctcttctca

SEQ ID NO: 1190951 - DNA, 22 bp, Artificial Sequence
  chemically synthesized
tggaggacagtggccctcttct

SEQ ID NO: 1190952 - DNA, 22 bp, Artificial Sequence
  chemically synthesized
cttgagctttgagaagagggcc

SEQ ID NO: 1190953 - DNA, 22 bp, Artificial Sequence
  chemically synthesized
gagctttgagaagagggccact

SEQ ID NO: 1190954 - DNA, 22 bp, Artificial Sequence
  chemically synthesized
agctttgagaagagggccactg

SEQ ID NO: 1190955 - DNA, 22 bp, Artificial Sequence
  chemically synthesized
ggctctggaggacagtggccct

SEQ ID NO: 1190956 - DNA, 22 bp, Artificial Sequence
  chemically synthesized
taggctctggaggacagtggcc

SEQ ID NO: 1190957 - DNA, 22 bp, Artificial Sequence
  chemically synthesized
tgagaagagggccactgtcctc

SEQ ID NO: 1190958 - DNA, 22 bp, Artificial Sequence
  chemically synthesized
gagaagagggccactgtcctcc

SEQ ID NO: 1190959 - DNA, 22 bp, Artificial Sequence
  chemically synthesized
agaagagggccactgtcctcca

SEQ ID NO: 1190960 - DNA, 22 bp, Artificial Sequence
  chemically synthesized
gagagaccattctaggctctgg

SEQ ID NO: 1190961 - DNA, 22 bp, Artificial Sequence
  chemically synthesized
tcactggagagaccattctagg

SEQ ID NO: 1190962 - DNA, 22 bp, Artificial Sequence
  chemically synthesized
tcctccagagcctagaatggtc

SEQ ID NO: 1190963 - DNA, 22 bp, Artificial Sequence
  chemically synthesized
cagagcctagaatggtctctcc

SEQ ID NO: 1190964 - DNA, 22 bp, Artificial Sequence
  chemically synthesized
gaatggtctctccagtgacagt

SEQ ID NO: 1190965 - DNA, 22 bp, Artificial Sequence
  chemically synthesized
caggtgtatggtgcaaactgtc

SEQ ID NO: 1190966 - DNA, 22 bp, Artificial Sequence
  chemically synthesized
ccaggtgtatggtgcaaactgt

SEQ ID NO: 1190967 - DNA, 22 bp, Artificial Sequence
  chemically synthesized
tccaggtgtatggtgcaaactg

SEQ ID NO: 1190968 - DNA, 22 bp, Artificial Sequence
  chemically synthesized
ttccaggtgtatggtgcaaact

SEQ ID NO: 1190969 - DNA, 22 bp, Artificial Sequence
  chemically synthesized
tccagtgacagtttgcaccata

SEQ ID NO: 1190970 - DNA, 22 bp, Artificial Sequence
  chemically synthesized
cagtgacagtttgcaccataca

SEQ ID NO: 1190971 - DNA, 22 bp, Artificial Sequence
  chemically synthesized
gggcttttccaggtgtatggtg

SEQ ID NO: 1190972 - DNA, 22 bp, Artificial Sequence
  chemically synthesized
agtgactggggcttttccaggt

SEQ ID NO: 1190973 - DNA, 22 bp, Artificial Sequence
  chemically synthesized
gcaccatacacctggaaaagcc

SEQ ID NO: 1190974 - DNA, 22 bp, Artificial Sequence
  chemically synthesized
caccatacacctggaaaagccc

SEQ ID NO: 1190975 - DNA, 22 bp, Artificial Sequence
  chemically synthesized
gcattgagtgactggggctttt

SEQ ID NO: 1190976 - DNA, 22 bp, Artificial Sequence
  chemically synthesized
atgggctggcattgagtgactg

SEQ ID NO: 1190977 - DNA, 22 bp, Artificial Sequence
  chemically synthesized
catgggctggcattgagtgact

SEQ ID NO: 1190978 - DNA, 22 bp, Artificial Sequence
  chemically synthesized
tcatgggctggcattgagtgac

SEQ ID NO: 1190979 - DNA, 22 bp, Artificial Sequence
  chemically synthesized
gaaaagccccagtcactcaatg

SEQ ID NO: 1190980 - DNA, 22 bp, Artificial Sequence
  chemically synthesized
ttttcatgggctggcattgagt

SEQ ID NO: 1190981 - DNA, 22 bp, Artificial Sequence
  chemically synthesized
gttgttttcatgggctggcatt

SEQ ID NO: 1190982 - DNA, 22 bp, Artificial Sequence
  chemically synthesized
agttgttttcatgggctggcat

SEQ ID NO: 1190983 - DNA, 22 bp, Artificial Sequence
  chemically synthesized
aatgccagcccatgaaaacaac

SEQ ID NO: 1190984 - DNA, 22 bp, Artificial Sequence
  chemically synthesized
agcagggtgtacagcaccctta

SEQ ID NO: 1190985 - DNA, 22 bp, Artificial Sequence
  chemically synthesized
tggctcagcagggtgtacagca

SEQ ID NO: 1190986 - DNA, 22 bp, Artificial Sequence
  chemically synthesized
agggtgctgtacaccctgctga

SEQ ID NO: 1190987 - DNA, 22 bp, Artificial Sequence
  chemically synthesized
catccctgtggctcagcagggt

SEQ ID NO: 1190988 - DNA, 22 bp, Artificial Sequence
  chemically synthesized
ggcatctccatccctgtggctc

SEQ ID NO: 1190989 - DNA, 22 bp, Artificial Sequence
  chemically synthesized
tacaccctgctgagccacaggg

SEQ ID NO: 1190990 - DNA, 22 bp, Artificial Sequence
  chemically synthesized
gggcatctccatccctgtggct

SEQ ID NO: 1190991 - DNA, 22 bp, Artificial Sequence
  chemically synthesized
ctgagccacagggatggagatg

SEQ ID NO: 1190992 - DNA, 22 bp, Artificial Sequence
  chemically synthesized
ccaaggccttgggcatctccat

SEQ ID NO: 1190993 - DNA, 22 bp, Artificial Sequence
  chemically synthesized
agccacagggatggagatgccc

SEQ ID NO: 1190994 - DNA, 22 bp, Artificial Sequence
  chemically synthesized
gggagcctgtcccttgcatcac

SEQ ID NO: 1190995 - DNA, 22 bp, Artificial Sequence
  chemically synthesized
atccaagccacagtgatgcaag

SEQ ID NO: 1190996 - DNA, 22 bp, Artificial Sequence
  chemically synthesized
ggagcctgtcccttgcatcact

SEQ ID NO: 1190997 - DNA, 22 bp, Artificial Sequence
  chemically synthesized
cacatctcatccaagccacagt

SEQ ID NO: 1190998 - DNA, 22 bp, Artificial Sequence
  chemically synthesized
tcccttgcatcactgtggcttg

SEQ ID NO: 1190999 - DNA, 22 bp, Artificial Sequence
  chemically synthesized
actccacatctcatccaagcca

SEQ ID NO: 1191000 - DNA, 22 bp, Artificial Sequence
  chemically synthesized
gactccacatctcatccaagcc

SEQ ID NO: 1191001 - DNA, 22 bp, Artificial Sequence
  chemically synthesized
tgactccacatctcatccaagc

SEQ ID NO: 1191002 - DNA, 22 bp, Artificial Sequence
  chemically synthesized
gcatcactgtggcttggatgag

SEQ ID NO: 1191003 - DNA, 22 bp, Artificial Sequence
  chemically synthesized
catcactgtggcttggatgaga

SEQ ID NO: 1191004 - DNA, 22 bp, Artificial Sequence
  chemically synthesized
ctttgactccacatctcatcca

SEQ ID NO: 1191005 - DNA, 22 bp, Artificial Sequence
  chemically synthesized
cctttgactccacatctcatcc

SEQ ID NO: 1191006 - DNA, 22 bp, Artificial Sequence
  chemically synthesized
tggcttggatgagatgtggagt

SEQ ID NO: 1191007 - DNA, 22 bp, Artificial Sequence
  chemically synthesized
caaaataatttcctttgactcc

SEQ ID NO: 1191008 - DNA, 22 bp, Artificial Sequence
  chemically synthesized
ggatgagatgtggagtcaaagg

SEQ ID NO: 1191009 - DNA, 22 bp, Artificial Sequence
  chemically synthesized
gatgagatgtggagtcaaagga

SEQ ID NO: 1191010 - DNA, 22 bp, Artificial Sequence
  chemically synthesized
aagctccaaaataatttccttt

SEQ ID NO: 1191011 - DNA, 22 bp, Artificial Sequence
  chemically synthesized
aaagctccaaaataatttcctt

SEQ ID NO: 1191012 - DNA, 22 bp, Artificial Sequence
  chemically synthesized
aatcttaaagctccaaaataat

SEQ ID NO: 1191013 - DNA, 22 bp, Artificial Sequence
  chemically synthesized
ttttggagctttaagatttaat

SEQ ID NO: 1191014 - DNA, 22 bp, Artificial Sequence
  chemically synthesized
tggagctttaagatttaatgac

SEQ ID NO: 1191015 - DNA, 22 bp, Artificial Sequence
  chemically synthesized
ggagctttaagatttaatgact

SEQ ID NO: 1191016 - DNA, 22 bp, Artificial Sequence
  chemically synthesized
gagctttaagatttaatgacta

SEQ ID NO: 1191017 - DNA, 22 bp, Artificial Sequence
  chemically synthesized
taagatttaatgactaccctgc

SEQ ID NO: 1191018 - DNA, 22 bp, Artificial Sequence
  chemically synthesized
aagatttaatgactaccctgct

SEQ ID NO: 1191019 - DNA, 22 bp, Artificial Sequence
  chemically synthesized
agatttaatgactaccctgctg

SEQ ID NO: 1191020 - DNA, 22 bp, Artificial Sequence
  chemically synthesized
tgcaagtccaaaacccagcagg

SEQ ID NO: 1191021 - DNA, 22 bp, Artificial Sequence
  chemically synthesized
aatgactaccctgctgggtttt

SEQ ID NO: 1191022 - DNA, 22 bp, Artificial Sequence
  chemically synthesized
atgactaccctgctgggttttg

SEQ ID NO: 1191023 - DNA, 22 bp, Artificial Sequence
  chemically synthesized
caggccctgtgcaagtccaaaa

SEQ ID NO: 1191024 - DNA, 22 bp, Artificial Sequence
  chemically synthesized
ccctgctgggttttggacttgc

SEQ ID NO: 1191025 - DNA, 22 bp, Artificial Sequence
  chemically synthesized
ctgggttttggacttgcacagg

SEQ ID NO: 1191026 - DNA, 22 bp, Artificial Sequence
  chemically synthesized
ggttttggacttgcacagggcc

SEQ ID NO: 1191027 - DNA, 22 bp, Artificial Sequence
  chemically synthesized
tggacttgcacagggcctgtaa

SEQ ID NO: 1191028 - DNA, 22 bp, Artificial Sequence
  chemically synthesized
ggacttgcacagggcctgtaac

SEQ ID NO: 1191029 - DNA, 22 bp, Artificial Sequence
  chemically synthesized
gacttgcacagggcctgtaacc

SEQ ID NO: 1191030 - DNA, 22 bp, Artificial Sequence
  chemically synthesized
gcacagggcctgtaaccccttt

SEQ ID NO: 1191031 - DNA, 22 bp, Artificial Sequence
  chemically synthesized
cacagggcctgtaacccctttc

SEQ ID NO: 1191032 - DNA, 22 bp, Artificial Sequence
  chemically synthesized
aatcgatcagaagaaaggggtt

SEQ ID NO: 1191033 - DNA, 22 bp, Artificial Sequence
  chemically synthesized
aaaagagttaaatcgatcagaa

SEQ ID NO: 1191034 - DNA, 22 bp, Artificial Sequence
  chemically synthesized
taacccctttcttctgatcgat

SEQ ID NO: 1191035 - DNA, 22 bp, Artificial Sequence
  chemically synthesized
gctcaaaagagttaaatcgatc

SEQ ID NO: 1191036 - DNA, 22 bp, Artificial Sequence
  chemically synthesized
tcttctgatcgatttaactctt

SEQ ID NO: 1191037 - DNA, 22 bp, Artificial Sequence
  chemically synthesized
cttctgatcgatttaactcttt

SEQ ID NO: 1191038 - DNA, 22 bp, Artificial Sequence
  chemically synthesized
ttctgatcgatttaactctttt

SEQ ID NO: 1191039 - DNA, 22 bp, Artificial Sequence
  chemically synthesized
ctgatcgatttaactcttttga

SEQ ID NO: 1191040 - DNA, 22 bp, Artificial Sequence
  chemically synthesized
tgatcgatttaactcttttgag

SEQ ID NO: 1191041 - DNA, 22 bp, Artificial Sequence
  chemically synthesized
atcgatttaactcttttgagct

SEQ ID NO: 1191042 - DNA, 22 bp, Artificial Sequence
  chemically synthesized
aactcttttgagctaatgcctg

SEQ ID NO: 1191043 - DNA, 22 bp, Artificial Sequence
  chemically synthesized
actcttttgagctaatgcctgt

SEQ ID NO: 1191044 - DNA, 22 bp, Artificial Sequence
  chemically synthesized
ttttgagctaatgcctgtaccc

SEQ ID NO: 1191045 - DNA, 22 bp, Artificial Sequence
  chemically synthesized
caagatacaatgagggtacagg

SEQ ID NO: 1191046 - DNA, 22 bp, Artificial Sequence
  chemically synthesized
ttgagctaatgcctgtaccctc

SEQ ID NO: 1191047 - DNA, 22 bp, Artificial Sequence
  chemically synthesized
ccaagatacaatgagggtacag

SEQ ID NO: 1191048 - DNA, 22 bp, Artificial Sequence
  chemically synthesized
tgagctaatgcctgtaccctca

SEQ ID NO: 1191049 - DNA, 22 bp, Artificial Sequence
  chemically synthesized
gagctaatgcctgtaccctcat

SEQ ID NO: 1191050 - DNA, 22 bp, Artificial Sequence
  chemically synthesized
agctaatgcctgtaccctcatt

SEQ ID NO: 1191051 - DNA, 22 bp, Artificial Sequence
  chemically synthesized
cttccaagatacaatgagggta

SEQ ID NO: 1191052 - DNA, 22 bp, Artificial Sequence
  chemically synthesized
atgcctgtaccctcattgtatc

SEQ ID NO: 1191053 - DNA, 22 bp, Artificial Sequence
  chemically synthesized
taccctcattgtatcttggaag

SEQ ID NO: 1191054 - DNA, 22 bp, Artificial Sequence
  chemically synthesized
taaaatcaaaatgagttacttc

SEQ ID NO: 1191055 - DNA, 22 bp, Artificial Sequence
  chemically synthesized
attgtatcttggaagtaactca

SEQ ID NO: 1191056 - DNA, 22 bp, Artificial Sequence
  chemically synthesized
tatcttggaagtaactcatttt

SEQ ID NO: 1191057 - DNA, 22 bp, Artificial Sequence
  chemically synthesized
tgatcctgtaaaatcaaaatga

SEQ ID NO: 1191058 - DNA, 22 bp, Artificial Sequence
  chemically synthesized
ggaagtaactcattttgatttt

SEQ ID NO: 1191059 - DNA, 22 bp, Artificial Sequence
  chemically synthesized
gaagtaactcattttgatttta

SEQ ID NO: 1191060 - DNA, 22 bp, Artificial Sequence
  chemically synthesized
aacctatgatcctgtaaaatca

SEQ ID NO: 1191061 - DNA, 22 bp, Artificial Sequence
  chemically synthesized
caacctatgatcctgtaaaatc

SEQ ID NO: 1191062 - DNA, 22 bp, Artificial Sequence
  chemically synthesized
attttgattttacaggatcata

SEQ ID NO: 1191063 - DNA, 22 bp, Artificial Sequence
  chemically synthesized
tgattttacaggatcataggtt

SEQ ID NO: 1191064 - DNA, 22 bp, Artificial Sequence
  chemically synthesized
gattttacaggatcataggttg

SEQ ID NO: 1191065 - DNA, 22 bp, Artificial Sequence
  chemically synthesized
attttacaggatcataggttga

SEQ ID NO: 1191066 - DNA, 22 bp, Artificial Sequence
  chemically synthesized
aggcaagtcccttcaacctatg

SEQ ID NO: 1191067 - DNA, 22 bp, Artificial Sequence
  chemically synthesized
tacaggatcataggttgaaggg

SEQ ID NO: 1191068 - DNA, 22 bp, Artificial Sequence
  chemically synthesized
acaggatcataggttgaaggga

SEQ ID NO: 1191069 - DNA, 22 bp, Artificial Sequence
  chemically synthesized
caggatcataggttgaagggac

SEQ ID NO: 1191070 - DNA, 22 bp, Artificial Sequence
  chemically synthesized
agactaaggcaagtcccttcaa

SEQ ID NO: 1191071 - DNA, 22 bp, Artificial Sequence
  chemically synthesized
atctgagactaaggcaagtccc

SEQ ID NO: 1191072 - DNA, 22 bp, Artificial Sequence
  chemically synthesized
aagggacttgccttagtctcag

SEQ ID NO: 1191073 - DNA, 22 bp, Artificial Sequence
  chemically synthesized
gccttagtctcagatgagactt

SEQ ID NO: 1191074 - DNA, 22 bp, Artificial Sequence
  chemically synthesized
ccttagtctcagatgagacttt

SEQ ID NO: 1191075 - DNA, 22 bp, Artificial Sequence
  chemically synthesized
aaaagtccacagtccaaagtct

SEQ ID NO: 1191076 - DNA, 22 bp, Artificial Sequence
  chemically synthesized
agtctcagatgagactttggac

SEQ ID NO: 1191077 - DNA, 22 bp, Artificial Sequence
  chemically synthesized
gtctcagatgagactttggact

SEQ ID NO: 1191078 - DNA, 22 bp, Artificial Sequence
  chemically synthesized
gttcaaaagtccacagtccaaa

SEQ ID NO: 1191079 - DNA, 22 bp, Artificial Sequence
  chemically synthesized
agatgagactttggactgtgga

SEQ ID NO: 1191080 - DNA, 22 bp, Artificial Sequence
  chemically synthesized
cagtattagttcaaaagtccac

SEQ ID NO: 1191081 - DNA, 22 bp, Artificial Sequence
  chemically synthesized
attccagtattagttcaaaagt

SEQ ID NO: 1191082 - DNA, 22 bp, Artificial Sequence
  chemically synthesized
tggactgtggacttttgaacta

SEQ ID NO: 1191083 - DNA, 22 bp, Artificial Sequence
  chemically synthesized
ggactgtggacttttgaactaa

SEQ ID NO: 1191084 - DNA, 22 bp, Artificial Sequence
  chemically synthesized
gactgtggacttttgaactaat

SEQ ID NO: 1191085 - DNA, 22 bp, Artificial Sequence
  chemically synthesized
actcattccagtattagttcaa

SEQ ID NO: 1191086 - DNA, 22 bp, Artificial Sequence
  chemically synthesized
aactcattccagtattagttca

SEQ ID NO: 1191087 - DNA, 22 bp, Artificial Sequence
  chemically synthesized
tggacttttgaactaatactgg

SEQ ID NO: 1191088 - DNA, 22 bp, Artificial Sequence
  chemically synthesized
ttgaactaatactggaatgagt

SEQ ID NO: 1191089 - DNA, 22 bp, Artificial Sequence
  chemically synthesized
cccaaagtcttaactcattcca

SEQ ID NO: 1191090 - DNA, 22 bp, Artificial Sequence
  chemically synthesized
tgaactaatactggaatgagtt

SEQ ID NO: 1191091 - DNA, 22 bp, Artificial Sequence
  chemically synthesized
gaactaatactggaatgagtta

SEQ ID NO: 1191092 - DNA, 22 bp, Artificial Sequence
  chemically synthesized
aactaatactggaatgagttaa

SEQ ID NO: 1191093 - DNA, 22 bp, Artificial Sequence
  chemically synthesized
atactggaatgagttaagactt

SEQ ID NO: 1191094 - DNA, 22 bp, Artificial Sequence
  chemically synthesized
ccaacagttccccaaagtctta

SEQ ID NO: 1191095 - DNA, 22 bp, Artificial Sequence
  chemically synthesized
cccaacagttccccaaagtctt

SEQ ID NO: 1191096 - DNA, 22 bp, Artificial Sequence
  chemically synthesized
tcccaacagttccccaaagtct

SEQ ID NO: 1191097 - DNA, 22 bp, Artificial Sequence
  chemically synthesized
gaatgagttaagactttgggga

SEQ ID NO: 1191098 - DNA, 22 bp, Artificial Sequence
  chemically synthesized
agactttggggaactgttggga

SEQ ID NO: 1191099 - DNA, 22 bp, Artificial Sequence
  chemically synthesized
aaaatacaatcatgctttccca

SEQ ID NO: 1191100 - DNA, 22 bp, Artificial Sequence
  chemically synthesized
tggggaactgttgggaaagcat

SEQ ID NO: 1191101 - DNA, 22 bp, Artificial Sequence
  chemically synthesized
caaaatacaatcatgctttccc

SEQ ID NO: 1191102 - DNA, 22 bp, Artificial Sequence
  chemically synthesized
ggggaactgttgggaaagcatg

SEQ ID NO: 1191103 - DNA, 22 bp, Artificial Sequence
  chemically synthesized
gggaactgttgggaaagcatga

SEQ ID NO: 1191104 - DNA, 22 bp, Artificial Sequence
  chemically synthesized
acatttcaaaatacaatcatgc

SEQ ID NO: 1191105 - DNA, 22 bp, Artificial Sequence
  chemically synthesized
tcacatttcaaaatacaatcat

SEQ ID NO: 1191106 - DNA, 22 bp, Artificial Sequence
  chemically synthesized
ttgggaaagcatgattgtattt

SEQ ID NO: 1191107 - DNA, 22 bp, Artificial Sequence
  chemically synthesized
ttctcacatttcaaaatacaat

SEQ ID NO: 1191108 - DNA, 22 bp, Artificial Sequence
  chemically synthesized
ggaaagcatgattgtattttga

SEQ ID NO: 1191109 - DNA, 22 bp, Artificial Sequence
  chemically synthesized
atattgttctcacatttcaaaa

SEQ ID NO: 1191110 - DNA, 22 bp, Artificial Sequence
  chemically synthesized
ccaaatctcatattgttctcac

SEQ ID NO: 1191111 - DNA, 22 bp, Artificial Sequence
  chemically synthesized
tattttgaaatgtgagaacaat
